United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 62

SEQ ID NO: 2611227 - DNA, 20 bp, Homo sapiens
ctgggctctgccaccctacc

SEQ ID NO: 2611228 - DNA, 23 bp, Homo sapiens
ctgggctctgccccagctctggc

SEQ ID NO: 2611229 - DNA, 15 bp, Homo sapiens
ctgggctctgggagc

SEQ ID NO: 2611230 - DNA, 17 bp, Homo sapiens
ctgggctgagcccctac

SEQ ID NO: 2611231 - DNA, 13 bp, Homo sapiens
ctgggctgaggga

SEQ ID NO: 2611232 - DNA, 23 bp, Homo sapiens
ctgggctgagggagcctggcccc

SEQ ID NO: 2611233 - DNA, 17 bp, Homo sapiens
ctgggctgccatgtgaa

SEQ ID NO: 2611234 - DNA, 20 bp, Homo sapiens
ctgggctgccatgtgaagag

SEQ ID NO: 2611235 - DNA, 16 bp, Homo sapiens
ctgggctggctccctc

SEQ ID NO: 2611236 - DNA, 17 bp, Homo sapiens
ctgggcttcagtggcag

SEQ ID NO: 2611237 - DNA, 21 bp, Homo sapiens
ctgggcttcagtggcagctgc

SEQ ID NO: 2611238 - DNA, 23 bp, Homo sapiens
ctgggcttcagtggcagctgctt

SEQ ID NO: 2611239 - DNA, 24 bp, Homo sapiens
ctgggcttcagtggcagctgcttt

SEQ ID NO: 2611240 - DNA, 15 bp, Homo sapiens
ctgggcttcatctgg

SEQ ID NO: 2611241 - DNA, 16 bp, Homo sapiens
ctggggacagcaaggg

SEQ ID NO: 2611242 - DNA, 20 bp, Homo sapiens
ctggggacctggtaccctcc

SEQ ID NO: 2611243 - DNA, 17 bp, Homo sapiens
ctggggacggggggccc

SEQ ID NO: 2611244 - DNA, 15 bp, Homo sapiens
ctggggagcccgtct

SEQ ID NO: 2611245 - DNA, 16 bp, Homo sapiens
ctggggatgtgggagg

SEQ ID NO: 2611246 - DNA, 17 bp, Homo sapiens
ctggggatgtgggaggg

SEQ ID NO: 2611247 - DNA, 21 bp, Homo sapiens
ctggggcacttggcagcgcgg

SEQ ID NO: 2611248 - DNA, 12 bp, Homo sapiens
ctggggcccctt

SEQ ID NO: 2611249 - DNA, 16 bp, Homo sapiens
ctggggccgaaagaac

SEQ ID NO: 2611250 - DNA, 19 bp, Homo sapiens
ctggggcctcggagcctca

SEQ ID NO: 2611251 - DNA, 14 bp, Homo sapiens
ctggggcctggacc

SEQ ID NO: 2611252 - DNA, 16 bp, Homo sapiens
ctggggcctggacctg

SEQ ID NO: 2611253 - DNA, 18 bp, Homo sapiens
ctggggcctggacctgcc

SEQ ID NO: 2611254 - DNA, 19 bp, Homo sapiens
ctggggcctggacctgcct

SEQ ID NO: 2611255 - DNA, 15 bp, Homo sapiens
ctggggcgggcccct

SEQ ID NO: 2611256 - DNA, 15 bp, Homo sapiens
ctggggcgtggggag

SEQ ID NO: 2611257 - DNA, 16 bp, Homo sapiens
ctggggcgtggggagg

SEQ ID NO: 2611258 - DNA, 22 bp, Homo sapiens
ctggggctcccttcatctccag

SEQ ID NO: 2611259 - DNA, 20 bp, Homo sapiens
ctggggctcctttctccagc

SEQ ID NO: 2611260 - DNA, 14 bp, Homo sapiens
ctggggctctggga

SEQ ID NO: 2611261 - DNA, 14 bp, Homo sapiens
ctggggctctgtgc

SEQ ID NO: 2611262 - DNA, 17 bp, Homo sapiens
ctggggctctgtgcagg

SEQ ID NO: 2611263 - DNA, 19 bp, Homo sapiens
ctggggctctgtgcaggga

SEQ ID NO: 2611264 - DNA, 13 bp, Homo sapiens
ctggggctgaagg

SEQ ID NO: 2611265 - DNA, 22 bp, Homo sapiens
ctgggggccatgagctccagac

SEQ ID NO: 2611266 - DNA, 18 bp, Homo sapiens
ctgggggcctcagtgcca

SEQ ID NO: 2611267 - DNA, 19 bp, Homo sapiens
ctgggggtgccaggaccag

SEQ ID NO: 2611268 - DNA, 20 bp, Homo sapiens
ctgggggttctttcttcctc

SEQ ID NO: 2611269 - DNA, 15 bp, Homo sapiens
ctggggtccagggag

SEQ ID NO: 2611270 - DNA, 15 bp, Homo sapiens
ctggggtgccgcctg

SEQ ID NO: 2611271 - DNA, 20 bp, Homo sapiens
ctggggtggggatagggagc

SEQ ID NO: 2611272 - DNA, 16 bp, Homo sapiens
ctggggtgtgggaggc

SEQ ID NO: 2611273 - DNA, 19 bp, Homo sapiens
ctggggtgtgggaggcccg

SEQ ID NO: 2611274 - DNA, 22 bp, Homo sapiens
ctgggtaactagggaagataat

SEQ ID NO: 2611275 - DNA, 16 bp, Homo sapiens
ctgggtacttgtggac

SEQ ID NO: 2611276 - DNA, 20 bp, Homo sapiens
ctgggtacttgtggacacag

SEQ ID NO: 2611277 - DNA, 21 bp, Homo sapiens
ctgggtacttgtggacacagc

SEQ ID NO: 2611278 - DNA, 14 bp, Homo sapiens
ctgggtagctgtaa

SEQ ID NO: 2611279 - DNA, 15 bp, Homo sapiens
ctgggtccaaataaa

SEQ ID NO: 2611280 - DNA, 21 bp, Homo sapiens
ctgggtccaggggatgggagg

SEQ ID NO: 2611281 - DNA, 22 bp, Homo sapiens
ctgggtgacagagcaagactct

SEQ ID NO: 2611282 - DNA, 20 bp, Homo sapiens
ctgggtgcccaagctcagaa

SEQ ID NO: 2611283 - DNA, 14 bp, Homo sapiens
ctgggtgctcccta

SEQ ID NO: 2611284 - DNA, 23 bp, Homo sapiens
ctgggtggacatggcccctgtga

SEQ ID NO: 2611285 - DNA, 18 bp, Homo sapiens
ctgggtggcaccagcagc

SEQ ID NO: 2611286 - DNA, 21 bp, Homo sapiens
ctgggtggcaccagcagcctg

SEQ ID NO: 2611287 - DNA, 23 bp, Homo sapiens
ctgggtggcaccagcagcctgga

SEQ ID NO: 2611288 - DNA, 20 bp, Homo sapiens
ctgggtggcactgccatgca

SEQ ID NO: 2611289 - DNA, 19 bp, Homo sapiens
ctgggtggcctcgggacac

SEQ ID NO: 2611290 - DNA, 16 bp, Homo sapiens
ctgggtggggtgagga

SEQ ID NO: 2611291 - DNA, 22 bp, Homo sapiens
ctgggtgggtggtggggagggg

SEQ ID NO: 2611292 - DNA, 16 bp, Homo sapiens
ctgggtgtggcgcagc

SEQ ID NO: 2611293 - DNA, 16 bp, Homo sapiens
ctgggttccctttcct

SEQ ID NO: 2611294 - DNA, 21 bp, Homo sapiens
ctgggttccctttccttccat

SEQ ID NO: 2611295 - DNA, 17 bp, Homo sapiens
ctgggttctacccaggt

SEQ ID NO: 2611296 - DNA, 13 bp, Homo sapiens
ctgggttggaggg

SEQ ID NO: 2611297 - DNA, 22 bp, Homo sapiens
ctgggtttaaggggagaggaaa

SEQ ID NO: 2611298 - DNA, 23 bp, Homo sapiens
ctgggtttattacatggcagtgt

SEQ ID NO: 2611299 - DNA, 16 bp, Homo sapiens
ctgggtttggacccca

SEQ ID NO: 2611300 - DNA, 19 bp, Homo sapiens
ctgggtttggaccccagct

SEQ ID NO: 2611301 - DNA, 20 bp, Homo sapiens
ctgggtttggaccccagctg

SEQ ID NO: 2611302 - DNA, 19 bp, Homo sapiens
ctggtaaactatttgtctt

SEQ ID NO: 2611303 - DNA, 19 bp, Homo sapiens
ctggtacccagccatctgc

SEQ ID NO: 2611304 - DNA, 22 bp, Homo sapiens
ctggtacccagccatctgccca

SEQ ID NO: 2611305 - DNA, 14 bp, Homo sapiens
ctggtaccctcctg

SEQ ID NO: 2611306 - DNA, 15 bp, Homo sapiens
ctggtaccctcctgg

SEQ ID NO: 2611307 - DNA, 13 bp, Homo sapiens
ctggtactctcct

SEQ ID NO: 2611308 - DNA, 14 bp, Homo sapiens
ctggtagctcaggt

SEQ ID NO: 2611309 - DNA, 17 bp, Homo sapiens
ctggtcaaacaaactct

SEQ ID NO: 2611310 - DNA, 18 bp, Homo sapiens
ctggtcaaacaaactctc

SEQ ID NO: 2611311 - DNA, 15 bp, Homo sapiens
ctggtcaacctcctg

SEQ ID NO: 2611312 - DNA, 16 bp, Homo sapiens
ctggtcaacctcctgg

SEQ ID NO: 2611313 - DNA, 17 bp, Homo sapiens
ctggtcacagcctcctc

SEQ ID NO: 2611314 - DNA, 21 bp, Homo sapiens
ctggtcacaggactctgcctc

SEQ ID NO: 2611315 - DNA, 15 bp, Homo sapiens
ctggtccaaaagatt

SEQ ID NO: 2611316 - DNA, 17 bp, Homo sapiens
ctggtccagggaagctg

SEQ ID NO: 2611317 - DNA, 15 bp, Homo sapiens
ctggtcccactcagt

SEQ ID NO: 2611318 - DNA, 21 bp, Homo sapiens
ctggtcccttgcagctagttt

SEQ ID NO: 2611319 - DNA, 16 bp, Homo sapiens
ctggtccggacactcc

SEQ ID NO: 2611320 - DNA, 21 bp, Homo sapiens
ctggtccggacactcctagag

SEQ ID NO: 2611321 - DNA, 21 bp, Homo sapiens
ctggtcctgagggtccccacc

SEQ ID NO: 2611322 - DNA, 22 bp, Homo sapiens
ctggtctcagcagcgaccaccc

SEQ ID NO: 2611323 - DNA, 16 bp, Homo sapiens
ctggtctctaggctgg

SEQ ID NO: 2611324 - DNA, 16 bp, Homo sapiens
ctggtcttctttgggt

SEQ ID NO: 2611325 - DNA, 15 bp, Homo sapiens
ctggtcttgagatgt

SEQ ID NO: 2611326 - DNA, 14 bp, Homo sapiens
ctggtgacaccagc

SEQ ID NO: 2611327 - DNA, 15 bp, Homo sapiens
ctggtgacaccagcc

SEQ ID NO: 2611328 - DNA, 21 bp, Homo sapiens
ctggtgactttcctctttggt

SEQ ID NO: 2611329 - DNA, 13 bp, Homo sapiens
ctggtgaggcctt

SEQ ID NO: 2611330 - DNA, 19 bp, Homo sapiens
ctggtgagtcttggcggca

SEQ ID NO: 2611331 - DNA, 17 bp, Homo sapiens
ctggtgccagccttcct

SEQ ID NO: 2611332 - DNA, 14 bp, Homo sapiens
ctggtgcccggaga

SEQ ID NO: 2611333 - DNA, 21 bp, Homo sapiens
ctggtgctataggctggagaa

SEQ ID NO: 2611334 - DNA, 23 bp, Homo sapiens
ctggtgctataggctggagaagc

SEQ ID NO: 2611335 - DNA, 14 bp, Homo sapiens
ctggtgctgcctct

SEQ ID NO: 2611336 - DNA, 20 bp, Homo sapiens
ctggtgctggatattttcaa

SEQ ID NO: 2611337 - DNA, 17 bp, Homo sapiens
ctggtgctgtggccagg

SEQ ID NO: 2611338 - DNA, 19 bp, Homo sapiens
ctggtgctgtggccagggt

SEQ ID NO: 2611339 - DNA, 20 bp, Homo sapiens
ctggtgctgtggccagggtg

SEQ ID NO: 2611340 - DNA, 12 bp, Homo sapiens
ctggtggacagt

SEQ ID NO: 2611341 - DNA, 18 bp, Homo sapiens
ctggtggacagtcctggg

SEQ ID NO: 2611342 - DNA, 18 bp, Homo sapiens
ctggtggagaaagcactg

SEQ ID NO: 2611343 - DNA, 22 bp, Homo sapiens
ctggtggagaaagcactgacct

SEQ ID NO: 2611344 - DNA, 14 bp, Homo sapiens
ctggtggcagctca

SEQ ID NO: 2611345 - DNA, 17 bp, Homo sapiens
ctggtggcagctcacct

SEQ ID NO: 2611346 - DNA, 13 bp, Homo sapiens
ctggtggcagctg

SEQ ID NO: 2611347 - DNA, 14 bp, Homo sapiens
ctggtggcagctgc

SEQ ID NO: 2611348 - DNA, 23 bp, Homo sapiens
ctggtggctcccggagggccctg

SEQ ID NO: 2611349 - DNA, 12 bp, Homo sapiens
ctggtgggcctc

SEQ ID NO: 2611350 - DNA, 16 bp, Homo sapiens
ctggtgggtccagggg

SEQ ID NO: 2611351 - DNA, 15 bp, Homo sapiens
ctggtgtcctgacca

SEQ ID NO: 2611352 - DNA, 21 bp, Homo sapiens
ctggtgtcctgaccaccctcc

SEQ ID NO: 2611353 - DNA, 17 bp, Homo sapiens
ctggtgtctgctttctc

SEQ ID NO: 2611354 - DNA, 16 bp, Homo sapiens
ctggtgtgacctgagg

SEQ ID NO: 2611355 - DNA, 18 bp, Homo sapiens
ctggtgtgacctgagggc

SEQ ID NO: 2611356 - DNA, 23 bp, Homo sapiens
ctggtgtttctagcactggcctg

SEQ ID NO: 2611357 - DNA, 22 bp, Homo sapiens
ctggttagaggttccctttgac

SEQ ID NO: 2611358 - DNA, 16 bp, Homo sapiens
ctggttccatggcctc

SEQ ID NO: 2611359 - DNA, 18 bp, Homo sapiens
ctggttgctgtgtggttt

SEQ ID NO: 2611360 - DNA, 17 bp, Homo sapiens
ctggttggagagctaga

SEQ ID NO: 2611361 - DNA, 23 bp, Homo sapiens
ctggttggagagctagaacctgg

SEQ ID NO: 2611362 - DNA, 20 bp, Homo sapiens
ctggttggtgttgcagaagg

SEQ ID NO: 2611363 - DNA, 13 bp, Homo sapiens
ctggttgtcattt

SEQ ID NO: 2611364 - DNA, 15 bp, Homo sapiens
ctggttgtcattttt

SEQ ID NO: 2611365 - DNA, 21 bp, Homo sapiens
ctggtttgactccgctggagg

SEQ ID NO: 2611366 - DNA, 19 bp, Homo sapiens
ctgttcacagccagactgg

SEQ ID NO: 2611367 - DNA, 17 bp, Homo sapiens
ctgttcacttttcctcc

SEQ ID NO: 2611368 - DNA, 19 bp, Homo sapiens
ctgttcagctggttgaggt

SEQ ID NO: 2611369 - DNA, 23 bp, Homo sapiens
ctgttccagcctgccctcttcat

SEQ ID NO: 2611370 - DNA, 18 bp, Homo sapiens
ctgttcccattcttgcat

SEQ ID NO: 2611371 - DNA, 16 bp, Homo sapiens
ctgttccccctgtgca

SEQ ID NO: 2611372 - DNA, 22 bp, Homo sapiens
ctgttcccctagtaagtgcctt

SEQ ID NO: 2611373 - DNA, 15 bp, Homo sapiens
ctgttcccctcactg

SEQ ID NO: 2611374 - DNA, 17 bp, Homo sapiens
ctgttcccctcactgga

SEQ ID NO: 2611375 - DNA, 17 bp, Homo sapiens
ctgttccctctgctcct

SEQ ID NO: 2611376 - DNA, 19 bp, Homo sapiens
ctgttccctctgctcctgg

SEQ ID NO: 2611377 - DNA, 15 bp, Homo sapiens
ctgttccttcacatc

SEQ ID NO: 2611378 - DNA, 18 bp, Homo sapiens
ctgttccttcacatcctg

SEQ ID NO: 2611379 - DNA, 18 bp, Homo sapiens
ctgttctctgccctccaa

SEQ ID NO: 2611380 - DNA, 11 bp, Homo sapiens
ctgttctgtgg

SEQ ID NO: 2611381 - DNA, 14 bp, Homo sapiens
ctgttctgtggaaa

SEQ ID NO: 2611382 - DNA, 22 bp, Homo sapiens
ctgttctgtggaaagtgtaaag

SEQ ID NO: 2611383 - DNA, 23 bp, Homo sapiens
ctgttctgtggaaagtgtaaagc

SEQ ID NO: 2611384 - DNA, 14 bp, Homo sapiens
ctgttctgtgtctt

SEQ ID NO: 2611385 - DNA, 18 bp, Homo sapiens
ctgttcttaagacgtgat

SEQ ID NO: 2611386 - DNA, 13 bp, Homo sapiens
ctgttctttaatt

SEQ ID NO: 2611387 - DNA, 15 bp, Homo sapiens
ctgttctttccaaag

SEQ ID NO: 2611388 - DNA, 16 bp, Homo sapiens
ctgttctttccaaagt

SEQ ID NO: 2611389 - DNA, 21 bp, Homo sapiens
ctgttctttctggctatgcat

SEQ ID NO: 2611390 - DNA, 17 bp, Homo sapiens
ctgttgatgaggcctct

SEQ ID NO: 2611391 - DNA, 20 bp, Homo sapiens
ctgttgatgaggcctcttgg

SEQ ID NO: 2611392 - DNA, 21 bp, Homo sapiens
ctgttgatgaggcctcttgga

SEQ ID NO: 2611393 - DNA, 15 bp, Homo sapiens
ctgttgattgctaaa

SEQ ID NO: 2611394 - DNA, 17 bp, Homo sapiens
ctgttgatttctttcca

SEQ ID NO: 2611395 - DNA, 20 bp, Homo sapiens
ctgttgatttctttccagag

SEQ ID NO: 2611396 - DNA, 19 bp, Homo sapiens
ctgttgcacccagccctgg

SEQ ID NO: 2611397 - DNA, 23 bp, Homo sapiens
ctgttgcacccagccctggtctc

SEQ ID NO: 2611398 - DNA, 12 bp, Homo sapiens
ctgttgcagtga

SEQ ID NO: 2611399 - DNA, 12 bp, Homo sapiens
ctgttgcatggg

SEQ ID NO: 2611400 - DNA, 15 bp, Homo sapiens
ctgttgcccacgttt

SEQ ID NO: 2611401 - DNA, 13 bp, Homo sapiens
ctgttgcccaggc

SEQ ID NO: 2611402 - DNA, 15 bp, Homo sapiens
ctgttgcttacaatt

SEQ ID NO: 2611403 - DNA, 18 bp, Homo sapiens
ctgttggacccgctctgg

SEQ ID NO: 2611404 - DNA, 23 bp, Homo sapiens
ctgttggcactcacagacctgga

SEQ ID NO: 2611405 - DNA, 12 bp, Homo sapiens
ctgttgtacatt

SEQ ID NO: 2611406 - DNA, 17 bp, Homo sapiens
ctgttgtccctctgcta

SEQ ID NO: 2611407 - DNA, 22 bp, Homo sapiens
ctgttgttgttaatgaaaatgt

SEQ ID NO: 2611408 - DNA, 17 bp, Homo sapiens
ctgttgtttctaaacaa

SEQ ID NO: 2611409 - DNA, 19 bp, Homo sapiens
ctgtttaaatatttcaaga

SEQ ID NO: 2611410 - DNA, 18 bp, Homo sapiens
ctgtttaatatttaaaca

SEQ ID NO: 2611411 - DNA, 20 bp, Homo sapiens
ctgtttaatatttaaacagc

SEQ ID NO: 2611412 - DNA, 15 bp, Homo sapiens
ctgtttacaagaaaa

SEQ ID NO: 2611413 - DNA, 12 bp, Homo sapiens
ctgtttagataa

SEQ ID NO: 2611414 - DNA, 21 bp, Homo sapiens
ctgtttatggcctcagctgcc

SEQ ID NO: 2611415 - DNA, 22 bp, Homo sapiens
ctgtttatggcctcagctgcct

SEQ ID NO: 2611416 - DNA, 17 bp, Homo sapiens
ctgtttcaaactttact

SEQ ID NO: 2611417 - DNA, 13 bp, Homo sapiens
ctgtttcctttta

SEQ ID NO: 2611418 - DNA, 15 bp, Homo sapiens
ctgtttccttttatg

SEQ ID NO: 2611419 - DNA, 23 bp, Homo sapiens
ctgtttgaggatatattttcact

SEQ ID NO: 2611420 - DNA, 11 bp, Homo sapiens
ctgtttgtcat

SEQ ID NO: 2611421 - DNA, 21 bp, Homo sapiens
ctgtttgtttctgaaagggac

SEQ ID NO: 2611422 - DNA, 23 bp, Homo sapiens
ctgtttgtttctgaaagggacgc

SEQ ID NO: 2611423 - DNA, 22 bp, Homo sapiens
ctgttttacaaaaaagaaaaga

SEQ ID NO: 2611424 - DNA, 18 bp, Homo sapiens
ctgttttaggttaaaaaa

SEQ ID NO: 2611425 - DNA, 14 bp, Homo sapiens
ctgttttatactgt

SEQ ID NO: 2611426 - DNA, 15 bp, Homo sapiens
ctgttttatgacttc

SEQ ID NO: 2611427 - DNA, 16 bp, Homo sapiens
ctgttttatgacttca

SEQ ID NO: 2611428 - DNA, 13 bp, Homo sapiens
ctgttttccctga

SEQ ID NO: 2611429 - DNA, 14 bp, Homo sapiens
ctgttttcctttct

SEQ ID NO: 2611430 - DNA, 16 bp, Homo sapiens
ctgttttcctttctca

SEQ ID NO: 2611431 - DNA, 13 bp, Homo sapiens
ctgttttctcttg

SEQ ID NO: 2611432 - DNA, 20 bp, Homo sapiens
ctgttttctgagcccgggct

SEQ ID NO: 2611433 - DNA, 17 bp, Homo sapiens
ctgtttttaaaaatcat

SEQ ID NO: 2611434 - DNA, 18 bp, Homo sapiens
ctgtttttaagctgtttc

SEQ ID NO: 2611435 - DNA, 15 bp, Homo sapiens
ctgtttttacccata

SEQ ID NO: 2611436 - DNA, 12 bp, Homo sapiens
cttaaaaaactt

SEQ ID NO: 2611437 - DNA, 17 bp, Homo sapiens
cttaaaaaataaaaact

SEQ ID NO: 2611438 - DNA, 14 bp, Homo sapiens
cttaaaaaatgtcc

SEQ ID NO: 2611439 - DNA, 12 bp, Homo sapiens
cttaaaaatggt

SEQ ID NO: 2611440 - DNA, 20 bp, Homo sapiens
cttaaaaatggtttaaatgg

SEQ ID NO: 2611441 - DNA, 14 bp, Homo sapiens
cttaaaacaacact

SEQ ID NO: 2611442 - DNA, 19 bp, Homo sapiens
cttaaaataacttatatca

SEQ ID NO: 2611443 - DNA, 13 bp, Homo sapiens
cttaaaatagaaa

SEQ ID NO: 2611444 - DNA, 22 bp, Homo sapiens
cttaaaatagcaacactctata

SEQ ID NO: 2611445 - DNA, 19 bp, Homo sapiens
cttaaacaaaaattaaaat

SEQ ID NO: 2611446 - DNA, 14 bp, Homo sapiens
cttaaacagggcat

SEQ ID NO: 2611447 - DNA, 22 bp, Homo sapiens
cttaaacagggcatctccagga

SEQ ID NO: 2611448 - DNA, 18 bp, Homo sapiens
cttaaagaaaacccaccc

SEQ ID NO: 2611449 - DNA, 20 bp, Homo sapiens
cttaaagatttatcaaatca

SEQ ID NO: 2611450 - DNA, 20 bp, Homo sapiens
cttaaaggcaccatctaata

SEQ ID NO: 2611451 - DNA, 21 bp, Homo sapiens
cttaaaggctgtggtagtact

SEQ ID NO: 2611452 - DNA, 13 bp, Homo sapiens
cttaaataataaa

SEQ ID NO: 2611453 - DNA, 15 bp, Homo sapiens
cttaaattcatttta

SEQ ID NO: 2611454 - DNA, 14 bp, Homo sapiens
cttaacggctccag

SEQ ID NO: 2611455 - DNA, 15 bp, Homo sapiens
cttaacggctccagg

SEQ ID NO: 2611456 - DNA, 14 bp, Homo sapiens
cttaacttcacata

SEQ ID NO: 2611457 - DNA, 19 bp, Homo sapiens
cttaagccatcttggtaaa

SEQ ID NO: 2611458 - DNA, 20 bp, Homo sapiens
cttaagccatcttggtaaat

SEQ ID NO: 2611459 - DNA, 16 bp, Homo sapiens
cttaaggcactctgtt

SEQ ID NO: 2611460 - DNA, 14 bp, Homo sapiens
cttaaggggcagct

SEQ ID NO: 2611461 - DNA, 22 bp, Homo sapiens
cttaagtaagcaacagcataac

SEQ ID NO: 2611462 - DNA, 16 bp, Homo sapiens
cttaagtttctcagct

SEQ ID NO: 2611463 - DNA, 20 bp, Homo sapiens
cttaagtttctcagctccca

SEQ ID NO: 2611464 - DNA, 18 bp, Homo sapiens
cttaataaattcagatat

SEQ ID NO: 2611465 - DNA, 17 bp, Homo sapiens
cttaatagtatttatga

SEQ ID NO: 2611466 - DNA, 20 bp, Homo sapiens
cttaatcaggtcctcagaga

SEQ ID NO: 2611467 - DNA, 14 bp, Homo sapiens
cttaatctaaatgg

SEQ ID NO: 2611468 - DNA, 21 bp, Homo sapiens
cttaatcttttcacaaataaa

SEQ ID NO: 2611469 - DNA, 16 bp, Homo sapiens
cttaatgtttattcct

SEQ ID NO: 2611470 - DNA, 15 bp, Homo sapiens
cttaattattatttg

SEQ ID NO: 2611471 - DNA, 17 bp, Homo sapiens
cttaattcctttctcat

SEQ ID NO: 2611472 - DNA, 18 bp, Homo sapiens
cttaattttcagtataat

SEQ ID NO: 2611473 - DNA, 19 bp, Homo sapiens
cttaattttggttgtattc

SEQ ID NO: 2611474 - DNA, 19 bp, Homo sapiens
cttacaattccctgctgtc

SEQ ID NO: 2611475 - DNA, 22 bp, Homo sapiens
cttacaatttttttaattttgt

SEQ ID NO: 2611476 - DNA, 11 bp, Homo sapiens
cttacacccac

SEQ ID NO: 2611477 - DNA, 20 bp, Homo sapiens
cttacacccacagtggaaag

SEQ ID NO: 2611478 - DNA, 23 bp, Homo sapiens
cttacagctgggtggcactgcca

SEQ ID NO: 2611479 - DNA, 16 bp, Homo sapiens
cttacagtaggagccc

SEQ ID NO: 2611480 - DNA, 23 bp, Homo sapiens
cttacagtaggagcccagctctg

SEQ ID NO: 2611481 - DNA, 16 bp, Homo sapiens
cttacataatttttta

SEQ ID NO: 2611482 - DNA, 22 bp, Homo sapiens
cttacataattttttattcaag

SEQ ID NO: 2611483 - DNA, 14 bp, Homo sapiens
cttacatgttttct

SEQ ID NO: 2611484 - DNA, 17 bp, Homo sapiens
cttacatttttacaata

SEQ ID NO: 2611485 - DNA, 16 bp, Homo sapiens
cttaccaactttctgt

SEQ ID NO: 2611486 - DNA, 17 bp, Homo sapiens
cttaccaactttctgta

SEQ ID NO: 2611487 - DNA, 13 bp, Homo sapiens
cttaccagaagct

SEQ ID NO: 2611488 - DNA, 21 bp, Homo sapiens
cttacctaaacagatataaat

SEQ ID NO: 2611489 - DNA, 18 bp, Homo sapiens
cttacctaccacatgcca

SEQ ID NO: 2611490 - DNA, 17 bp, Homo sapiens
cttaccttcaataaagt

SEQ ID NO: 2611491 - DNA, 18 bp, Homo sapiens
cttaccttcaataaagta

SEQ ID NO: 2611492 - DNA, 22 bp, Homo sapiens
cttaccttcaataaagtatcta

SEQ ID NO: 2611493 - DNA, 23 bp, Homo sapiens
cttacgaatacttttgccctttg

SEQ ID NO: 2611494 - DNA, 18 bp, Homo sapiens
cttacgatggcacccagt

SEQ ID NO: 2611495 - DNA, 23 bp, Homo sapiens
cttactaagctttgccagctgct

SEQ ID NO: 2611496 - DNA, 14 bp, Homo sapiens
cttactccaggaga

SEQ ID NO: 2611497 - DNA, 21 bp, Homo sapiens
cttactgatttttaagttatt

SEQ ID NO: 2611498 - DNA, 13 bp, Homo sapiens
cttactgtacatg

SEQ ID NO: 2611499 - DNA, 16 bp, Homo sapiens
cttactgtacatgaaa

SEQ ID NO: 2611500 - DNA, 15 bp, Homo sapiens
cttactgtacctgtt

SEQ ID NO: 2611501 - DNA, 16 bp, Homo sapiens
cttactgtttctgtca

SEQ ID NO: 2611502 - DNA, 20 bp, Homo sapiens
cttagaaaaaccaccaccat

SEQ ID NO: 2611503 - DNA, 20 bp, Homo sapiens
cttagaagtcacacagtatt

SEQ ID NO: 2611504 - DNA, 11 bp, Homo sapiens
cttagacagtc

SEQ ID NO: 2611505 - DNA, 15 bp, Homo sapiens
cttagacagtccctg

SEQ ID NO: 2611506 - DNA, 16 bp, Homo sapiens
cttagacataacaaaa

SEQ ID NO: 2611507 - DNA, 16 bp, Homo sapiens
cttagacctcagcctg

SEQ ID NO: 2611508 - DNA, 17 bp, Homo sapiens
cttagacctcagcctgt

SEQ ID NO: 2611509 - DNA, 11 bp, Homo sapiens
cttagagcagt

SEQ ID NO: 2611510 - DNA, 17 bp, Homo sapiens
cttagagcctccctcaa

SEQ ID NO: 2611511 - DNA, 14 bp, Homo sapiens
cttgcctctctgtt

SEQ ID NO: 2611512 - DNA, 18 bp, Homo sapiens
cttgccttattagagtgt

SEQ ID NO: 2611513 - DNA, 20 bp, Homo sapiens
cttgccttcttcacccagct

SEQ ID NO: 2611514 - DNA, 17 bp, Homo sapiens
cttgctaatcagtgtct

SEQ ID NO: 2611515 - DNA, 19 bp, Homo sapiens
cttgctaatcagtgtctca

SEQ ID NO: 2611516 - DNA, 14 bp, Homo sapiens
cttgctctccctct

SEQ ID NO: 2611517 - DNA, 15 bp, Homo sapiens
cttgctctccctctt

SEQ ID NO: 2611518 - DNA, 20 bp, Homo sapiens
cttgctctttctactctgaa

SEQ ID NO: 2611519 - DNA, 22 bp, Homo sapiens
cttgctctttctactctgaact

SEQ ID NO: 2611520 - DNA, 21 bp, Homo sapiens
cttgctgcagtatgaaaataa

SEQ ID NO: 2611521 - DNA, 14 bp, Homo sapiens
cttgctgtcctagg

SEQ ID NO: 2611522 - DNA, 15 bp, Homo sapiens
cttgctgtcctaggc

SEQ ID NO: 2611523 - DNA, 16 bp, Homo sapiens
cttgctgtcctaggcc

SEQ ID NO: 2611524 - DNA, 17 bp, Homo sapiens
cttgctgtcctaggcca

SEQ ID NO: 2611525 - DNA, 20 bp, Homo sapiens
cttgctgtcctaggccacac

SEQ ID NO: 2611526 - DNA, 13 bp, Homo sapiens
cttgcttgctttt

SEQ ID NO: 2611527 - DNA, 20 bp, Homo sapiens
cttggaaaaatccagaaaga

SEQ ID NO: 2611528 - DNA, 14 bp, Homo sapiens
cttggaaacctgcc

SEQ ID NO: 2611529 - DNA, 16 bp, Homo sapiens
cttggaaacctgccct

SEQ ID NO: 2611530 - DNA, 20 bp, Homo sapiens
cttggaaacctgccctgcct

SEQ ID NO: 2611531 - DNA, 21 bp, Homo sapiens
cttggaaagaaacaaccgttg

SEQ ID NO: 2611532 - DNA, 12 bp, Homo sapiens
cttggacctctg

SEQ ID NO: 2611533 - DNA, 13 bp, Homo sapiens
cttggacctctgc

SEQ ID NO: 2611534 - DNA, 17 bp, Homo sapiens
cttggacctctgctctg

SEQ ID NO: 2611535 - DNA, 14 bp, Homo sapiens
cttggactattata

SEQ ID NO: 2611536 - DNA, 22 bp, Homo sapiens
cttggactattataatttaatg

SEQ ID NO: 2611537 - DNA, 16 bp, Homo sapiens
cttggactcattttaa

SEQ ID NO: 2611538 - DNA, 15 bp, Homo sapiens
cttggagctgagcct

SEQ ID NO: 2611539 - DNA, 18 bp, Homo sapiens
cttggagctgagcctctc

SEQ ID NO: 2611540 - DNA, 22 bp, Homo sapiens
cttggaggaaggaaacccagct

SEQ ID NO: 2611541 - DNA, 15 bp, Homo sapiens
cttggagggtcccaa

SEQ ID NO: 2611542 - DNA, 22 bp, Homo sapiens
cttggagtattggggtctgacc

SEQ ID NO: 2611543 - DNA, 21 bp, Homo sapiens
cttggattattttaaatcatt

SEQ ID NO: 2611544 - DNA, 15 bp, Homo sapiens
cttggattgtccccg

SEQ ID NO: 2611545 - DNA, 23 bp, Homo sapiens
cttggcacatttaagagacagtc

SEQ ID NO: 2611546 - DNA, 19 bp, Homo sapiens
cttggcatcacagggcaga

SEQ ID NO: 2611547 - DNA, 20 bp, Homo sapiens
cttggcatcacagggcagag

SEQ ID NO: 2611548 - DNA, 22 bp, Homo sapiens
cttggcatcacagggcagagcc

SEQ ID NO: 2611549 - DNA, 16 bp, Homo sapiens
cttggcatcagctggc

SEQ ID NO: 2611550 - DNA, 20 bp, Homo sapiens
cttggcatgccttccagcac

SEQ ID NO: 2611551 - DNA, 18 bp, Homo sapiens
cttggccagttatccctt

SEQ ID NO: 2611552 - DNA, 11 bp, Homo sapiens
cttggcctcag

SEQ ID NO: 2611553 - DNA, 12 bp, Homo sapiens
cttggcctcaga

SEQ ID NO: 2611554 - DNA, 17 bp, Homo sapiens
cttggctgcttggcctt

SEQ ID NO: 2611555 - DNA, 13 bp, Homo sapiens
cttggctgtgagg

SEQ ID NO: 2611556 - DNA, 23 bp, Homo sapiens
cttggcttctcatacgtccacca

SEQ ID NO: 2611557 - DNA, 10 bp, Homo sapiens
cttgggaatg

SEQ ID NO: 2611558 - DNA, 23 bp, Homo sapiens
cttgggaccgccagatggggcct

SEQ ID NO: 2611559 - DNA, 17 bp, Homo sapiens
cttgggactgggtttgg

SEQ ID NO: 2611560 - DNA, 14 bp, Homo sapiens
cttgggaggcccca

SEQ ID NO: 2611561 - DNA, 20 bp, Homo sapiens
cttgggatgatgcctcatga

SEQ ID NO: 2611562 - DNA, 22 bp, Homo sapiens
cttgggcactttttaattcacc

SEQ ID NO: 2611563 - DNA, 14 bp, Homo sapiens
cttgggccactgtg

SEQ ID NO: 2611564 - DNA, 20 bp, Homo sapiens
cttgggccactgtgaagaga

SEQ ID NO: 2611565 - DNA, 20 bp, Homo sapiens
cttgggcccagctgggctct

SEQ ID NO: 2611566 - DNA, 22 bp, Homo sapiens
cttgggcccagctgggctctgc

SEQ ID NO: 2611567 - DNA, 12 bp, Homo sapiens
cttgggccctcc

SEQ ID NO: 2611568 - DNA, 13 bp, Homo sapiens
cttgggccctcct

SEQ ID NO: 2611569 - DNA, 14 bp, Homo sapiens
cttgggccctttga

SEQ ID NO: 2611570 - DNA, 19 bp, Homo sapiens
cttgggccctttgagtgca

SEQ ID NO: 2611571 - DNA, 18 bp, Homo sapiens
cttgggcggctgagagcc

SEQ ID NO: 2611572 - DNA, 13 bp, Homo sapiens
cttgggctccctg

SEQ ID NO: 2611573 - DNA, 21 bp, Homo sapiens
cttgggctccctgtaacctct

SEQ ID NO: 2611574 - DNA, 14 bp, Homo sapiens
cttgggctgctcct

SEQ ID NO: 2611575 - DNA, 18 bp, Homo sapiens
cttggggaacaagggtgg

SEQ ID NO: 2611576 - DNA, 18 bp, Homo sapiens
cttggggaatttcctcta

SEQ ID NO: 2611577 - DNA, 15 bp, Homo sapiens
cttggggacatctct

SEQ ID NO: 2611578 - DNA, 14 bp, Homo sapiens
cttggggcttccta

SEQ ID NO: 2611579 - DNA, 22 bp, Homo sapiens
cttgggggacagggctggccca

SEQ ID NO: 2611580 - DNA, 23 bp, Homo sapiens
cttgggggacagggctggcccag

SEQ ID NO: 2611581 - DNA, 23 bp, Homo sapiens
cttgggtcccccacgtgacagtg

SEQ ID NO: 2611582 - DNA, 15 bp, Homo sapiens
cttgggtggagaagc

SEQ ID NO: 2611583 - DNA, 19 bp, Homo sapiens
cttgggtggagaagccatt

SEQ ID NO: 2611584 - DNA, 21 bp, Homo sapiens
cttgggtgtaacaggtctcct

SEQ ID NO: 2611585 - DNA, 15 bp, Homo sapiens
cttggtaagaagccg

SEQ ID NO: 2611586 - DNA, 14 bp, Homo sapiens
cttggtcctgctgc

SEQ ID NO: 2611587 - DNA, 16 bp, Homo sapiens
cttggtcctgctgcag

SEQ ID NO: 2611588 - DNA, 18 bp, Homo sapiens
cttggtcctgctgcagtt

SEQ ID NO: 2611589 - DNA, 20 bp, Homo sapiens
cttggtcctgctgcagttgc

SEQ ID NO: 2611590 - DNA, 19 bp, Homo sapiens
cttggtgtgaccctctgaa

SEQ ID NO: 2611591 - DNA, 21 bp, Homo sapiens
cttggttatttgtttaccact

SEQ ID NO: 2611592 - DNA, 16 bp, Homo sapiens
cttggttcataaatga

SEQ ID NO: 2611593 - DNA, 17 bp, Homo sapiens
cttggttcataaatgaa

SEQ ID NO: 2611594 - DNA, 15 bp, Homo sapiens
cttggttgaggaaac

SEQ ID NO: 2611595 - DNA, 14 bp, Homo sapiens
cttggttggctggc

SEQ ID NO: 2611596 - DNA, 17 bp, Homo sapiens
cttggttgggtcctcac

SEQ ID NO: 2611597 - DNA, 14 bp, Homo sapiens
cttggttgtctcca

SEQ ID NO: 2611598 - DNA, 22 bp, Homo sapiens
cttggtttcttcaacaggagaa

SEQ ID NO: 2611599 - DNA, 12 bp, Homo sapiens
cttgtaaataca

SEQ ID NO: 2611600 - DNA, 15 bp, Homo sapiens
cttgtaaatacacca

SEQ ID NO: 2611601 - DNA, 17 bp, Homo sapiens
cttgtaaatagctcagg

SEQ ID NO: 2611602 - DNA, 22 bp, Homo sapiens
cttgtaatgatatagccagaaa

SEQ ID NO: 2611603 - DNA, 16 bp, Homo sapiens
cttgtaattctaaatg

SEQ ID NO: 2611604 - DNA, 12 bp, Homo sapiens
cttgtacataat

SEQ ID NO: 2611605 - DNA, 15 bp, Homo sapiens
cttgtacataatgcg

SEQ ID NO: 2611606 - DNA, 22 bp, Homo sapiens
cttgtacataatgcgtgcatac

SEQ ID NO: 2611607 - DNA, 22 bp, Homo sapiens
cttgtacatgtgtagcctgtgc

SEQ ID NO: 2611608 - DNA, 21 bp, Homo sapiens
cttgtagtttacctctttaaa

SEQ ID NO: 2611609 - DNA, 11 bp, Homo sapiens
cttgtatattt

SEQ ID NO: 2611610 - DNA, 17 bp, Homo sapiens
cttgtatatttgtacaa

SEQ ID NO: 2611611 - DNA, 18 bp, Homo sapiens
cttgtatatttgtacaaa

SEQ ID NO: 2611612 - DNA, 20 bp, Homo sapiens
cttgtatcaacactgttact

SEQ ID NO: 2611613 - DNA, 17 bp, Homo sapiens
cttgtattaagttgtta

SEQ ID NO: 2611614 - DNA, 22 bp, Homo sapiens
cttgtattaagttgttaataaa

SEQ ID NO: 2611615 - DNA, 15 bp, Homo sapiens
cttgtcaatatttaa

SEQ ID NO: 2611616 - DNA, 22 bp, Homo sapiens
cttgtcactggtagaccaaaat

SEQ ID NO: 2611617 - DNA, 13 bp, Homo sapiens
cttgtcagagctg

SEQ ID NO: 2611618 - DNA, 15 bp, Homo sapiens
cttgtcagagctggg

SEQ ID NO: 2611619 - DNA, 15 bp, Homo sapiens
cttgtccacccacct

SEQ ID NO: 2611620 - DNA, 18 bp, Homo sapiens
cttgtcccactatctggg

SEQ ID NO: 2611621 - DNA, 19 bp, Homo sapiens
cttgtcccagaggctgccc

SEQ ID NO: 2611622 - DNA, 13 bp, Homo sapiens
cttgtccccacac

SEQ ID NO: 2611623 - DNA, 14 bp, Homo sapiens
cttgtccccacact

SEQ ID NO: 2611624 - DNA, 16 bp, Homo sapiens
cttgtccccacactcc

SEQ ID NO: 2611625 - DNA, 20 bp, Homo sapiens
cttgtcccctcctcactccc

SEQ ID NO: 2611626 - DNA, 21 bp, Homo sapiens
cttgtcccctgcctgtgcctg

SEQ ID NO: 2611627 - DNA, 15 bp, Homo sapiens
cttgtcctttccctt

SEQ ID NO: 2611628 - DNA, 23 bp, Homo sapiens
cttgtccttttgtaccatggtgt

SEQ ID NO: 2611629 - DNA, 18 bp, Homo sapiens
cttgtctttggaccctga

SEQ ID NO: 2611630 - DNA, 18 bp, Homo sapiens
cttgtgccaacactcaag

SEQ ID NO: 2611631 - DNA, 17 bp, Homo sapiens
cttgtgccacaccctcc

SEQ ID NO: 2611632 - DNA, 16 bp, Homo sapiens
cttgtgcctggctcag

SEQ ID NO: 2611633 - DNA, 18 bp, Homo sapiens
cttgtggaattgggagct

SEQ ID NO: 2611634 - DNA, 14 bp, Homo sapiens
cttgtggacacagc

SEQ ID NO: 2611635 - DNA, 18 bp, Homo sapiens
cttgtggacacagctctt

SEQ ID NO: 2611636 - DNA, 12 bp, Homo sapiens
cttgtggagccc

SEQ ID NO: 2611637 - DNA, 15 bp, Homo sapiens
cttgtggatgtttta

SEQ ID NO: 2611638 - DNA, 22 bp, Homo sapiens
cttgtggatgttttaattccat

SEQ ID NO: 2611639 - DNA, 16 bp, Homo sapiens
cttgtggtcccacccc

SEQ ID NO: 2611640 - DNA, 16 bp, Homo sapiens
cttgtgtatccattat

SEQ ID NO: 2611641 - DNA, 16 bp, Homo sapiens
cttgtgtcaaacagta

SEQ ID NO: 2611642 - DNA, 18 bp, Homo sapiens
cttgtgtctctgtgcttt

SEQ ID NO: 2611643 - DNA, 13 bp, Homo sapiens
cttgtgtctgcgt

SEQ ID NO: 2611644 - DNA, 12 bp, Homo sapiens
cttgtgtctgta

SEQ ID NO: 2611645 - DNA, 14 bp, Homo sapiens
cttgtgtctgtaca

SEQ ID NO: 2611646 - DNA, 15 bp, Homo sapiens
cttgtgtctgtacac

SEQ ID NO: 2611647 - DNA, 13 bp, Homo sapiens
cttgtgtgtttca

SEQ ID NO: 2611648 - DNA, 21 bp, Homo sapiens
cttgtgtttctttagtttttg

SEQ ID NO: 2611649 - DNA, 16 bp, Homo sapiens
cttgttaagatagtta

SEQ ID NO: 2611650 - DNA, 21 bp, Homo sapiens
cttgttctctaagttccactg

SEQ ID NO: 2611651 - DNA, 19 bp, Homo sapiens
cttgttgcatgatgtattt

SEQ ID NO: 2611652 - DNA, 15 bp, Homo sapiens
cttgttggagcctgc

SEQ ID NO: 2611653 - DNA, 18 bp, Homo sapiens
cttgttggagcctgcagg

SEQ ID NO: 2611654 - DNA, 13 bp, Homo sapiens
cttgttgttgtta

SEQ ID NO: 2611655 - DNA, 15 bp, Homo sapiens
cttgtttccaatgtt

SEQ ID NO: 2611656 - DNA, 19 bp, Homo sapiens
gaaatatttatttttttaa

SEQ ID NO: 2611657 - DNA, 19 bp, Homo sapiens
gaaatcaaatatgcaaagc

SEQ ID NO: 2611658 - DNA, 20 bp, Homo sapiens
gaaatcagtaatatttatat

SEQ ID NO: 2611659 - DNA, 23 bp, Homo sapiens
gaaatccctgtttaatatttaaa

SEQ ID NO: 2611660 - DNA, 12 bp, Homo sapiens
gaaatctcaccc

SEQ ID NO: 2611661 - DNA, 22 bp, Homo sapiens
gaaatctgtatctgtagtgaga

SEQ ID NO: 2611662 - DNA, 14 bp, Homo sapiens
gaaatgaccaatat

SEQ ID NO: 2611663 - DNA, 16 bp, Homo sapiens
gaaatgagatcaggct

SEQ ID NO: 2611664 - DNA, 13 bp, Homo sapiens
gaaatgctgcctg

SEQ ID NO: 2611665 - DNA, 15 bp, Homo sapiens
gaaatgctgcctgcc

SEQ ID NO: 2611666 - DNA, 17 bp, Homo sapiens
gaaatgctgcctgcctg

SEQ ID NO: 2611667 - DNA, 17 bp, Homo sapiens
gaaatgggcagagcaga

SEQ ID NO: 2611668 - DNA, 21 bp, Homo sapiens
gaaatggtatgagctgagggg

SEQ ID NO: 2611669 - DNA, 15 bp, Homo sapiens
gaaattaagaagaaa

SEQ ID NO: 2611670 - DNA, 15 bp, Homo sapiens
gaaattatttaataa

SEQ ID NO: 2611671 - DNA, 17 bp, Homo sapiens
gaaattcccttcatctg

SEQ ID NO: 2611672 - DNA, 12 bp, Homo sapiens
gaaattcctgta

SEQ ID NO: 2611673 - DNA, 15 bp, Homo sapiens
gaaattcctgtagca

SEQ ID NO: 2611674 - DNA, 15 bp, Homo sapiens
gaaattggctggatg

SEQ ID NO: 2611675 - DNA, 18 bp, Homo sapiens
gaaattgtacatatttgt

SEQ ID NO: 2611676 - DNA, 19 bp, Homo sapiens
gaaatttaaaagacactgt

SEQ ID NO: 2611677 - DNA, 22 bp, Homo sapiens
gaaatttaatatagctattttt

SEQ ID NO: 2611678 - DNA, 16 bp, Homo sapiens
gaaatttaattcatgt

SEQ ID NO: 2611679 - DNA, 11 bp, Homo sapiens
gaaatttcaga

SEQ ID NO: 2611680 - DNA, 21 bp, Homo sapiens
gaaatttcagattcccagagc

SEQ ID NO: 2611681 - DNA, 13 bp, Homo sapiens
gaaatttccagag

SEQ ID NO: 2611682 - DNA, 14 bp, Homo sapiens
gaaatttgatttct

SEQ ID NO: 2611683 - DNA, 22 bp, Homo sapiens
gaaattttatatgcttactgat

SEQ ID NO: 2611684 - DNA, 19 bp, Homo sapiens
gaaatttttattaaattat

SEQ ID NO: 2611685 - DNA, 17 bp, Homo sapiens
gaaatttttatttttct

SEQ ID NO: 2611686 - DNA, 22 bp, Homo sapiens
gaaatttttcagatgcttctgg

SEQ ID NO: 2611687 - DNA, 19 bp, Homo sapiens
gaacaagttgtttcattga

SEQ ID NO: 2611688 - DNA, 17 bp, Homo sapiens
gaacacaggcaaaatcc

SEQ ID NO: 2611689 - DNA, 18 bp, Homo sapiens
gaacactccaattaagga

SEQ ID NO: 2611690 - DNA, 20 bp, Homo sapiens
gaacactccaattaaggatt

SEQ ID NO: 2611691 - DNA, 16 bp, Homo sapiens
gaacactccttcacag

SEQ ID NO: 2611692 - DNA, 17 bp, Homo sapiens
gaacactccttcacaga

SEQ ID NO: 2611693 - DNA, 14 bp, Homo sapiens
gaacagaaggatga

SEQ ID NO: 2611694 - DNA, 19 bp, Homo sapiens
gaacagaaggatgaatgag

SEQ ID NO: 2611695 - DNA, 14 bp, Homo sapiens
gaacagaatgtttt

SEQ ID NO: 2611696 - DNA, 15 bp, Homo sapiens
gaacagaatgtttta

SEQ ID NO: 2611697 - DNA, 21 bp, Homo sapiens
gaacagattcacactgtctgg

SEQ ID NO: 2611698 - DNA, 23 bp, Homo sapiens
gaacagccaaatgcatggtgcag

SEQ ID NO: 2611699 - DNA, 15 bp, Homo sapiens
gaacagcttcaggtt

SEQ ID NO: 2611700 - DNA, 17 bp, Homo sapiens
gaacagcttcaggttat

SEQ ID NO: 2611701 - DNA, 12 bp, Homo sapiens
gaacagtaaaca

SEQ ID NO: 2611702 - DNA, 18 bp, Homo sapiens
gaacagtgcttgccacag

SEQ ID NO: 2611703 - DNA, 21 bp, Homo sapiens
gaacatcatcaaggcactgcc

SEQ ID NO: 2611704 - DNA, 12 bp, Homo sapiens
gaacatccaagg

SEQ ID NO: 2611705 - DNA, 23 bp, Homo sapiens
gaacatccaaggagaaacagaga

SEQ ID NO: 2611706 - DNA, 19 bp, Homo sapiens
gaacatggacttgtatatt

SEQ ID NO: 2611707 - DNA, 21 bp, Homo sapiens
gaacattgcatataacttata

SEQ ID NO: 2611708 - DNA, 21 bp, Homo sapiens
gaaccaaagagactggagcat

SEQ ID NO: 2611709 - DNA, 19 bp, Homo sapiens
gaaccaacaagtaaatatt

SEQ ID NO: 2611710 - DNA, 24 bp, Homo sapiens
gaaccaagtggaccttgagaccac

SEQ ID NO: 2611711 - DNA, 12 bp, Homo sapiens
gaaccagagcca

SEQ ID NO: 2611712 - DNA, 19 bp, Homo sapiens
gaaccagagccatggactc

SEQ ID NO: 2611713 - DNA, 20 bp, Homo sapiens
gaaccatcattataaacgtg

SEQ ID NO: 2611714 - DNA, 17 bp, Homo sapiens
gaacccaagtccaagca

SEQ ID NO: 2611715 - DNA, 15 bp, Homo sapiens
gaacccaggacgctt

SEQ ID NO: 2611716 - DNA, 19 bp, Homo sapiens
gaacccaggacgcttctga

SEQ ID NO: 2611717 - DNA, 21 bp, Homo sapiens
gaacccccctcccacccaccg

SEQ ID NO: 2611718 - DNA, 19 bp, Homo sapiens
gaaccccgtcgaggggctc

SEQ ID NO: 2611719 - DNA, 17 bp, Homo sapiens
gaacccgggaggcagag

SEQ ID NO: 2611720 - DNA, 19 bp, Homo sapiens
gaacccgggaggcagaggt

SEQ ID NO: 2611721 - DNA, 19 bp, Homo sapiens
gaaccctgcgtggggacag

SEQ ID NO: 2611722 - DNA, 17 bp, Homo sapiens
gaaccctgtgctggtgt

SEQ ID NO: 2611723 - DNA, 21 bp, Homo sapiens
gaaccgagcaaagatcaaaat

SEQ ID NO: 2611724 - DNA, 13 bp, Homo sapiens
gaaccgcaggaag

SEQ ID NO: 2611725 - DNA, 14 bp, Homo sapiens
gaaccgcaggaagc

SEQ ID NO: 2611726 - DNA, 15 bp, Homo sapiens
gaacctaccttcatt

SEQ ID NO: 2611727 - DNA, 16 bp, Homo sapiens
gaacctcacgcacctc

SEQ ID NO: 2611728 - DNA, 20 bp, Homo sapiens
gaacctcacgcacctcccat

SEQ ID NO: 2611729 - DNA, 13 bp, Homo sapiens
gaacctcctctgt

SEQ ID NO: 2611730 - DNA, 13 bp, Homo sapiens
gaacctcctttct

SEQ ID NO: 2611731 - DNA, 13 bp, Homo sapiens
gaacctcttcccc

SEQ ID NO: 2611732 - DNA, 21 bp, Homo sapiens
gaacctggagggctggaatct

SEQ ID NO: 2611733 - DNA, 15 bp, Homo sapiens
gaacctgtagagcta

SEQ ID NO: 2611734 - DNA, 12 bp, Homo sapiens
gaacctgtcctt

SEQ ID NO: 2611735 - DNA, 18 bp, Homo sapiens
gaaccttgtgcctggctc

SEQ ID NO: 2611736 - DNA, 18 bp, Homo sapiens
gaacgatttagaaagaag

SEQ ID NO: 2611737 - DNA, 21 bp, Homo sapiens
gaacgcagccctagagcctgc

SEQ ID NO: 2611738 - DNA, 22 bp, Homo sapiens
gaacgcagccctagagcctgcc

SEQ ID NO: 2611739 - DNA, 20 bp, Homo sapiens
gaacgcgtgtgtacacggga

SEQ ID NO: 2611740 - DNA, 22 bp, Homo sapiens
gaacggagccccaggcctctgt

SEQ ID NO: 2611741 - DNA, 15 bp, Homo sapiens
gaacgtttttcctgt

SEQ ID NO: 2611742 - DNA, 12 bp, Homo sapiens
gaactaaacttt

SEQ ID NO: 2611743 - DNA, 22 bp, Homo sapiens
gaactagccaccaactcttgca

SEQ ID NO: 2611744 - DNA, 16 bp, Homo sapiens
gaactcaactttgaca

SEQ ID NO: 2611745 - DNA, 18 bp, Homo sapiens
gaactcagatctgtctga

SEQ ID NO: 2611746 - DNA, 15 bp, Homo sapiens
gaactcagccaagca

SEQ ID NO: 2611747 - DNA, 17 bp, Homo sapiens
gaactcagccaagcaca

SEQ ID NO: 2611748 - DNA, 19 bp, Homo sapiens
gaactcagccaagcacagt

SEQ ID NO: 2611749 - DNA, 22 bp, Homo sapiens
gaactcatccctaatgctgcag

SEQ ID NO: 2611750 - DNA, 16 bp, Homo sapiens
gaactcattcctgcct

SEQ ID NO: 2611751 - DNA, 19 bp, Homo sapiens
gaactcccagcaacacaag

SEQ ID NO: 2611752 - DNA, 16 bp, Homo sapiens
gaactcctaaatcaag

SEQ ID NO: 2611753 - DNA, 17 bp, Homo sapiens
gaactctctccacccta

SEQ ID NO: 2611754 - DNA, 12 bp, Homo sapiens
gaactctgaaat

SEQ ID NO: 2611755 - DNA, 20 bp, Homo sapiens
gaactgaaccggctttacca

SEQ ID NO: 2611756 - DNA, 17 bp, Homo sapiens
gaactgagctcctctgg

SEQ ID NO: 2611757 - DNA, 17 bp, Homo sapiens
gaactgcagacctgtcc

SEQ ID NO: 2611758 - DNA, 16 bp, Homo sapiens
gaactgctttctttcg

SEQ ID NO: 2611759 - DNA, 15 bp, Homo sapiens
gaactggactcagga

SEQ ID NO: 2611760 - DNA, 22 bp, Homo sapiens
gaactgggtacttgtggacaca

SEQ ID NO: 2611761 - DNA, 13 bp, Homo sapiens
gaactgttgtata

SEQ ID NO: 2611762 - DNA, 15 bp, Homo sapiens
gaactgttgtataaa

SEQ ID NO: 2611763 - DNA, 20 bp, Homo sapiens
gaactgttgtataaatttat

SEQ ID NO: 2611764 - DNA, 23 bp, Homo sapiens
gaacttcgcatcaaaagacaatt

SEQ ID NO: 2611765 - DNA, 13 bp, Homo sapiens
gaacttctaatat

SEQ ID NO: 2611766 - DNA, 21 bp, Homo sapiens
gaacttgcagctgatgttgga

SEQ ID NO: 2611767 - DNA, 16 bp, Homo sapiens
gaactttgacctctgc

SEQ ID NO: 2611768 - DNA, 23 bp, Homo sapiens
gaactttgacctctgcagcaata

SEQ ID NO: 2611769 - DNA, 17 bp, Homo sapiens
gaagaaagagaaggagc

SEQ ID NO: 2611770 - DNA, 18 bp, Homo sapiens
gaagaaattcctgtagca

SEQ ID NO: 2611771 - DNA, 15 bp, Homo sapiens
gaagaagagggagag

SEQ ID NO: 2611772 - DNA, 22 bp, Homo sapiens
gaagaagagggagaggtggagc

SEQ ID NO: 2611773 - DNA, 14 bp, Homo sapiens
gaagaagctctctc

SEQ ID NO: 2611774 - DNA, 19 bp, Homo sapiens
gaagaatattcaggactta

SEQ ID NO: 2611775 - DNA, 20 bp, Homo sapiens
gaagaatctgtttcccagca

SEQ ID NO: 2611776 - DNA, 16 bp, Homo sapiens
gaagacaatgacttac

SEQ ID NO: 2611777 - DNA, 23 bp, Homo sapiens
gaagacaatgtgaaaagaaaaat

SEQ ID NO: 2611778 - DNA, 14 bp, Homo sapiens
gaagacaccagagc

SEQ ID NO: 2611779 - DNA, 16 bp, Homo sapiens
gaagacaccagagcag

SEQ ID NO: 2611780 - DNA, 22 bp, Homo sapiens
gaagacaccagagcagatgcag

SEQ ID NO: 2611781 - DNA, 15 bp, Homo sapiens
gaagacaggacagtg

SEQ ID NO: 2611782 - DNA, 18 bp, Homo sapiens
gaagacatgttttagaca

SEQ ID NO: 2611783 - DNA, 23 bp, Homo sapiens
gaagaccaatctcttgaatccca

SEQ ID NO: 2611784 - DNA, 14 bp, Homo sapiens
gaagaccacatcca

SEQ ID NO: 2611785 - DNA, 22 bp, Homo sapiens
gaagacctgctgagggaccagc

SEQ ID NO: 2611786 - DNA, 22 bp, Homo sapiens
gaagacgaggccctcgggccca

SEQ ID NO: 2611787 - DNA, 15 bp, Homo sapiens
gaagacgcctgagct

SEQ ID NO: 2611788 - DNA, 17 bp, Homo sapiens
gaagactcattcttctg

SEQ ID NO: 2611789 - DNA, 18 bp, Homo sapiens
gaagactcattcttctgt

SEQ ID NO: 2611790 - DNA, 19 bp, Homo sapiens
gaagactcattcttctgta

SEQ ID NO: 2611791 - DNA, 13 bp, Homo sapiens
gaagactctacca

SEQ ID NO: 2611792 - DNA, 12 bp, Homo sapiens
gaagactgtggc

SEQ ID NO: 2611793 - DNA, 16 bp, Homo sapiens
gaagagactgggaaga

SEQ ID NO: 2611794 - DNA, 12 bp, Homo sapiens
gaagagaggagt

SEQ ID NO: 2611795 - DNA, 13 bp, Homo sapiens
gaagagaggagtt

SEQ ID NO: 2611796 - DNA, 16 bp, Homo sapiens
gaagagaggagttcaa

SEQ ID NO: 2611797 - DNA, 19 bp, Homo sapiens
gaagagaggagttcaatga

SEQ ID NO: 2611798 - DNA, 18 bp, Homo sapiens
gaagagatgggcttgttt

SEQ ID NO: 2611799 - DNA, 15 bp, Homo sapiens
gaagagatttttcat

SEQ ID NO: 2611800 - DNA, 18 bp, Homo sapiens
gaagagatttttcatgat

SEQ ID NO: 2611801 - DNA, 23 bp, Homo sapiens
gacataggccatgaaaaaaatga

SEQ ID NO: 2611802 - DNA, 13 bp, Homo sapiens
gacatattcattt

SEQ ID NO: 2611803 - DNA, 15 bp, Homo sapiens
gacatcacttgtaca

SEQ ID NO: 2611804 - DNA, 13 bp, Homo sapiens
gacatcagtggca

SEQ ID NO: 2611805 - DNA, 17 bp, Homo sapiens
gacatccataaagaagc

SEQ ID NO: 2611806 - DNA, 18 bp, Homo sapiens
gacatccataaagaagca

SEQ ID NO: 2611807 - DNA, 19 bp, Homo sapiens
gacatccataaagaagcaa

SEQ ID NO: 2611808 - DNA, 20 bp, Homo sapiens
gacatccataaagaagcaat

SEQ ID NO: 2611809 - DNA, 23 bp, Homo sapiens
gacatccatgtttgtaaaactac

SEQ ID NO: 2611810 - DNA, 13 bp, Homo sapiens
gacatcctcttct

SEQ ID NO: 2611811 - DNA, 15 bp, Homo sapiens
gacatctcaggggcc

SEQ ID NO: 2611812 - DNA, 18 bp, Homo sapiens
gacatctcaggggccaga

SEQ ID NO: 2611813 - DNA, 20 bp, Homo sapiens
gacatctcaggggccagagg

SEQ ID NO: 2611814 - DNA, 13 bp, Homo sapiens
gacatctctgcac

SEQ ID NO: 2611815 - DNA, 16 bp, Homo sapiens
gacatcttagtatttg

SEQ ID NO: 2611816 - DNA, 19 bp, Homo sapiens
gacatcttagtatttgcat

SEQ ID NO: 2611817 - DNA, 12 bp, Homo sapiens
gacatgaatatg

SEQ ID NO: 2611818 - DNA, 14 bp, Homo sapiens
gacatgaatatgat

SEQ ID NO: 2611819 - DNA, 21 bp, Homo sapiens
gacatgatggagcgcacctgc

SEQ ID NO: 2611820 - DNA, 14 bp, Homo sapiens
gacatgctgacttt

SEQ ID NO: 2611821 - DNA, 21 bp, Homo sapiens
gacatgtcttttcttgcatga

SEQ ID NO: 2611822 - DNA, 12 bp, Homo sapiens
gacatgtgaaac

SEQ ID NO: 2611823 - DNA, 23 bp, Homo sapiens
gacatgtggaaagtgaatttgaa

SEQ ID NO: 2611824 - DNA, 16 bp, Homo sapiens
gacatgttttgataaa

SEQ ID NO: 2611825 - DNA, 23 bp, Homo sapiens
gacatgttttgataaagtagtaa

SEQ ID NO: 2611826 - DNA, 23 bp, Homo sapiens
gacattaaatctatgaagtatat

SEQ ID NO: 2611827 - DNA, 17 bp, Homo sapiens
gacattaacagttttcc

SEQ ID NO: 2611828 - DNA, 22 bp, Homo sapiens
gacattaacagttttccatgaa

SEQ ID NO: 2611829 - DNA, 20 bp, Homo sapiens
gacattcctaaactatcttt

SEQ ID NO: 2611830 - DNA, 16 bp, Homo sapiens
gacattcctgggcaca

SEQ ID NO: 2611831 - DNA, 17 bp, Homo sapiens
gacattcctgggcacag

SEQ ID NO: 2611832 - DNA, 23 bp, Homo sapiens
gacattgcggacagccacggcca

SEQ ID NO: 2611833 - DNA, 12 bp, Homo sapiens
gacattgctaag

SEQ ID NO: 2611834 - DNA, 19 bp, Homo sapiens
gacattgtagagcttctgg

SEQ ID NO: 2611835 - DNA, 13 bp, Homo sapiens
gacattgtcaata

SEQ ID NO: 2611836 - DNA, 14 bp, Homo sapiens
gacattgtcaataa

SEQ ID NO: 2611837 - DNA, 13 bp, Homo sapiens
gacatttctctaa

SEQ ID NO: 2611838 - DNA, 15 bp, Homo sapiens
gacatttgccttgct

SEQ ID NO: 2611839 - DNA, 15 bp, Homo sapiens
gacattttttcagtc

SEQ ID NO: 2611840 - DNA, 13 bp, Homo sapiens
gaccaaacctagc

SEQ ID NO: 2611841 - DNA, 16 bp, Homo sapiens
gaccaaccctgtttcc

SEQ ID NO: 2611842 - DNA, 19 bp, Homo sapiens
gaccaactagacattctgt

SEQ ID NO: 2611843 - DNA, 16 bp, Homo sapiens
gaccaagagagaaaga

SEQ ID NO: 2611844 - DNA, 19 bp, Homo sapiens
gaccaagcaggaagctcag

SEQ ID NO: 2611845 - DNA, 20 bp, Homo sapiens
gaccaagcaggaagctcaga

SEQ ID NO: 2611846 - DNA, 17 bp, Homo sapiens
gaccaaggcaaggcagg

SEQ ID NO: 2611847 - DNA, 23 bp, Homo sapiens
gaccaaggcaaggcaggtgcctc

SEQ ID NO: 2611848 - DNA, 17 bp, Homo sapiens
gaccaatattgtacagt

SEQ ID NO: 2611849 - DNA, 21 bp, Homo sapiens
gaccacacatttgtgtaaaca

SEQ ID NO: 2611850 - DNA, 12 bp, Homo sapiens
gaccacacctcc

SEQ ID NO: 2611851 - DNA, 17 bp, Homo sapiens
gaccacacctccctgaa

SEQ ID NO: 2611852 - DNA, 18 bp, Homo sapiens
gaccacacttcctgtcca

SEQ ID NO: 2611853 - DNA, 20 bp, Homo sapiens
gaccacacttcctgtccaga

SEQ ID NO: 2611854 - DNA, 22 bp, Homo sapiens
gaccacacttcctgtccagaga

SEQ ID NO: 2611855 - DNA, 18 bp, Homo sapiens
gaccacattttatattta

SEQ ID NO: 2611856 - DNA, 20 bp, Homo sapiens
gaccaccccgcctgccctca

SEQ ID NO: 2611857 - DNA, 17 bp, Homo sapiens
gaccacccctgcctcca

SEQ ID NO: 2611858 - DNA, 18 bp, Homo sapiens
gaccaccctcccctctct

SEQ ID NO: 2611859 - DNA, 21 bp, Homo sapiens
gaccacgctttctagctgttg

SEQ ID NO: 2611860 - DNA, 12 bp, Homo sapiens
gaccactgcatg

SEQ ID NO: 2611861 - DNA, 14 bp, Homo sapiens
gaccactgttatca

SEQ ID NO: 2611862 - DNA, 16 bp, Homo sapiens
gaccagaagccaaaga

SEQ ID NO: 2611863 - DNA, 23 bp, Homo sapiens
gaccagacaccttgacagggcac

SEQ ID NO: 2611864 - DNA, 11 bp, Homo sapiens
gaccagactaa

SEQ ID NO: 2611865 - DNA, 20 bp, Homo sapiens
gaccagcaacttgtcttttt

SEQ ID NO: 2611866 - DNA, 16 bp, Homo sapiens
gaccagcagatcccag

SEQ ID NO: 2611867 - DNA, 22 bp, Homo sapiens
gaccagcctccctgtcggcctg

SEQ ID NO: 2611868 - DNA, 12 bp, Homo sapiens
gaccagcctggc

SEQ ID NO: 2611869 - DNA, 12 bp, Homo sapiens
gaccagctgggg

SEQ ID NO: 2611870 - DNA, 22 bp, Homo sapiens
gaccaggactatagcccaggtc

SEQ ID NO: 2611871 - DNA, 16 bp, Homo sapiens
gaccaggactccctcc

SEQ ID NO: 2611872 - DNA, 19 bp, Homo sapiens
gaccaggactccctcctca

SEQ ID NO: 2611873 - DNA, 23 bp, Homo sapiens
gaccaggagggcactggagctgt

SEQ ID NO: 2611874 - DNA, 20 bp, Homo sapiens
gaccagggatttccatgatg

SEQ ID NO: 2611875 - DNA, 15 bp, Homo sapiens
gaccagggcagggcc

SEQ ID NO: 2611876 - DNA, 23 bp, Homo sapiens
gaccaggtcttggagctgagcct

SEQ ID NO: 2611877 - DNA, 17 bp, Homo sapiens
gaccagtcaacctgggc

SEQ ID NO: 2611878 - DNA, 21 bp, Homo sapiens
gaccatccactctaccctccc

SEQ ID NO: 2611879 - DNA, 17 bp, Homo sapiens
gaccatccctgaaggcc

SEQ ID NO: 2611880 - DNA, 13 bp, Homo sapiens
gaccatcctattt

SEQ ID NO: 2611881 - DNA, 16 bp, Homo sapiens
gaccattctccacctg

SEQ ID NO: 2611882 - DNA, 17 bp, Homo sapiens
gaccattctccacctgc

SEQ ID NO: 2611883 - DNA, 21 bp, Homo sapiens
gaccattctccacctgccagg

SEQ ID NO: 2611884 - DNA, 15 bp, Homo sapiens
gaccatttcaggggt

SEQ ID NO: 2611885 - DNA, 12 bp, Homo sapiens
gacccacccctg

SEQ ID NO: 2611886 - DNA, 12 bp, Homo sapiens
gacccactgctt

SEQ ID NO: 2611887 - DNA, 16 bp, Homo sapiens
gacccagatcctcaca

SEQ ID NO: 2611888 - DNA, 11 bp, Homo sapiens
gacccaggcac

SEQ ID NO: 2611889 - DNA, 11 bp, Homo sapiens
gacccaggccg

SEQ ID NO: 2611890 - DNA, 15 bp, Homo sapiens
gacccaggccgcagc

SEQ ID NO: 2611891 - DNA, 17 bp, Homo sapiens
gacccaggccgcagctc

SEQ ID NO: 2611892 - DNA, 12 bp, Homo sapiens
gacccagtgaga

SEQ ID NO: 2611893 - DNA, 22 bp, Homo sapiens
gacccagtgagattacagagga

SEQ ID NO: 2611894 - DNA, 14 bp, Homo sapiens
gacccagtggggag

SEQ ID NO: 2611895 - DNA, 23 bp, Homo sapiens
gaccccaaagagcctggagaagc

SEQ ID NO: 2611896 - DNA, 12 bp, Homo sapiens
gaccccagagga

SEQ ID NO: 2611897 - DNA, 16 bp, Homo sapiens
gaccccagctgggagg

SEQ ID NO: 2611898 - DNA, 12 bp, Homo sapiens
gacccccaacca

SEQ ID NO: 2611899 - DNA, 14 bp, Homo sapiens
gacccccacccctt

SEQ ID NO: 2611900 - DNA, 21 bp, Homo sapiens
gacccccaccccttccccact

SEQ ID NO: 2611901 - DNA, 20 bp, Homo sapiens
gacccccagcaaccctccta

SEQ ID NO: 2611902 - DNA, 16 bp, Homo sapiens
gacccccgccccctgc

SEQ ID NO: 2611903 - DNA, 14 bp, Homo sapiens
gacccctcctccct

SEQ ID NO: 2611904 - DNA, 15 bp, Homo sapiens
gacccctctggccag

SEQ ID NO: 2611905 - DNA, 18 bp, Homo sapiens
gacccctctggccaggat

SEQ ID NO: 2611906 - DNA, 15 bp, Homo sapiens
gacccctggcctccg

SEQ ID NO: 2611907 - DNA, 11 bp, Homo sapiens
gacccggaggc

SEQ ID NO: 2611908 - DNA, 14 bp, Homo sapiens
gacccggaggccac

SEQ ID NO: 2611909 - DNA, 12 bp, Homo sapiens
gacccggctgcg

SEQ ID NO: 2611910 - DNA, 13 bp, Homo sapiens
gacccggctgcgt

SEQ ID NO: 2611911 - DNA, 21 bp, Homo sapiens
gaccctcctgttgcacccagc

SEQ ID NO: 2611912 - DNA, 15 bp, Homo sapiens
gaccctcgtggcctt

SEQ ID NO: 2611913 - DNA, 16 bp, Homo sapiens
gaccctgaggcccaga

SEQ ID NO: 2611914 - DNA, 16 bp, Homo sapiens
gaccctgccctgtggg

SEQ ID NO: 2611915 - DNA, 22 bp, Homo sapiens
gaccctgcgaaggggccctggt

SEQ ID NO: 2611916 - DNA, 15 bp, Homo sapiens
gacccttgtggtccc

SEQ ID NO: 2611917 - DNA, 16 bp, Homo sapiens
gaccgccagatggggc

SEQ ID NO: 2611918 - DNA, 20 bp, Homo sapiens
gaccgtgggcggggccttgc

SEQ ID NO: 2611919 - DNA, 12 bp, Homo sapiens
gacctacctcag

SEQ ID NO: 2611920 - DNA, 14 bp, Homo sapiens
gacctacctcaggt

SEQ ID NO: 2611921 - DNA, 15 bp, Homo sapiens
gacctacctcaggtt

SEQ ID NO: 2611922 - DNA, 16 bp, Homo sapiens
gacctacctcaggttg

SEQ ID NO: 2611923 - DNA, 18 bp, Homo sapiens
gacctaggatatcttctc

SEQ ID NO: 2611924 - DNA, 20 bp, Homo sapiens
gacctaggatatcttctcca

SEQ ID NO: 2611925 - DNA, 22 bp, Homo sapiens
gacctagggatgttctggccct

SEQ ID NO: 2611926 - DNA, 21 bp, Homo sapiens
gacctatgtcctaaggacaca

SEQ ID NO: 2611927 - DNA, 21 bp, Homo sapiens
gacctcagagtccaggcccca

SEQ ID NO: 2611928 - DNA, 19 bp, Homo sapiens
gacctcagcctgtgctgcc

SEQ ID NO: 2611929 - DNA, 19 bp, Homo sapiens
gacctcaggtgagaagcag

SEQ ID NO: 2611930 - DNA, 13 bp, Homo sapiens
gacctcatcagga

SEQ ID NO: 2611931 - DNA, 23 bp, Homo sapiens
gacctcatcaggatgaacccagg

SEQ ID NO: 2611932 - DNA, 21 bp, Homo sapiens
gacctcatgcatctccacctg

SEQ ID NO: 2611933 - DNA, 22 bp, Homo sapiens
gacctcatgcatctccacctgc

SEQ ID NO: 2611934 - DNA, 21 bp, Homo sapiens
gacctcccagccctatggatg

SEQ ID NO: 2611935 - DNA, 14 bp, Homo sapiens
gacctctcccaggg

SEQ ID NO: 2611936 - DNA, 18 bp, Homo sapiens
gacctctgcagcaataaa

SEQ ID NO: 2611937 - DNA, 12 bp, Homo sapiens
gacctctgttgt

SEQ ID NO: 2611938 - DNA, 13 bp, Homo sapiens
gacctgaagttca

SEQ ID NO: 2611939 - DNA, 22 bp, Homo sapiens
gacctgaagttcaccattaaaa

SEQ ID NO: 2611940 - DNA, 14 bp, Homo sapiens
gacctgaggaagcg

SEQ ID NO: 2611941 - DNA, 18 bp, Homo sapiens
gacctgaggctcctgtgc

SEQ ID NO: 2611942 - DNA, 20 bp, Homo sapiens
gacctgaggctcctgtgcta

SEQ ID NO: 2611943 - DNA, 22 bp, Homo sapiens
gacctgcctcctgcctgcccct

SEQ ID NO: 2611944 - DNA, 23 bp, Homo sapiens
gacctgcctcctgcctgcccctc

SEQ ID NO: 2611945 - DNA, 20 bp, Homo sapiens
gacctgcggctgctgtgtgc

SEQ ID NO: 2611946 - DNA, 14 bp, Homo sapiens
gagcccgggagctg

SEQ ID NO: 2611947 - DNA, 14 bp, Homo sapiens
gagcccgggctgcc

SEQ ID NO: 2611948 - DNA, 15 bp, Homo sapiens
gagcccgggctgcct

SEQ ID NO: 2611949 - DNA, 17 bp, Homo sapiens
gagcccgggctgcctgg

SEQ ID NO: 2611950 - DNA, 19 bp, Homo sapiens
gagcccgggctgcctgggc

SEQ ID NO: 2611951 - DNA, 21 bp, Homo sapiens
gagccctcaaagtgaggggaa

SEQ ID NO: 2611952 - DNA, 13 bp, Homo sapiens
gagccctggtggc

SEQ ID NO: 2611953 - DNA, 19 bp, Homo sapiens
gagccgctgtgagcccctg

SEQ ID NO: 2611954 - DNA, 13 bp, Homo sapiens
gagccgggcctgg

SEQ ID NO: 2611955 - DNA, 20 bp, Homo sapiens
gagccgggtctgcctcttct

SEQ ID NO: 2611956 - DNA, 22 bp, Homo sapiens
gagccgggtctgcctcttctgg

SEQ ID NO: 2611957 - DNA, 20 bp, Homo sapiens
gagccgggtggatcgcctga

SEQ ID NO: 2611958 - DNA, 14 bp, Homo sapiens
gagccgtgatgcct

SEQ ID NO: 2611959 - DNA, 17 bp, Homo sapiens
gagccgtggtcctttgg

SEQ ID NO: 2611960 - DNA, 13 bp, Homo sapiens
gagcctcagcatc

SEQ ID NO: 2611961 - DNA, 17 bp, Homo sapiens
gagcctcagcatcctgg

SEQ ID NO: 2611962 - DNA, 21 bp, Homo sapiens
gagcctcagcatcctggcacc

SEQ ID NO: 2611963 - DNA, 18 bp, Homo sapiens
gagcctcatccgaggcag

SEQ ID NO: 2611964 - DNA, 21 bp, Homo sapiens
gagcctccctcaattccccct

SEQ ID NO: 2611965 - DNA, 15 bp, Homo sapiens
gagcctgagggatct

SEQ ID NO: 2611966 - DNA, 21 bp, Homo sapiens
gagcctgcaaactcactgctc

SEQ ID NO: 2611967 - DNA, 15 bp, Homo sapiens
gagcctgcagggtgg

SEQ ID NO: 2611968 - DNA, 18 bp, Homo sapiens
gagcctgcaggtgctgct

SEQ ID NO: 2611969 - DNA, 15 bp, Homo sapiens
gagcctgcagttatt

SEQ ID NO: 2611970 - DNA, 14 bp, Homo sapiens
gagcctgcctggag

SEQ ID NO: 2611971 - DNA, 16 bp, Homo sapiens
gagcctgcctggagcg

SEQ ID NO: 2611972 - DNA, 12 bp, Homo sapiens
gagcctgctggt

SEQ ID NO: 2611973 - DNA, 12 bp, Homo sapiens
gagcctggagaa

SEQ ID NO: 2611974 - DNA, 13 bp, Homo sapiens
gagcctggagaag

SEQ ID NO: 2611975 - DNA, 15 bp, Homo sapiens
gagcctggagaagct

SEQ ID NO: 2611976 - DNA, 15 bp, Homo sapiens
gagcctggcaagaat

SEQ ID NO: 2611977 - DNA, 13 bp, Homo sapiens
gagcctgggaggt

SEQ ID NO: 2611978 - DNA, 17 bp, Homo sapiens
gagccttccaggggtgg

SEQ ID NO: 2611979 - DNA, 17 bp, Homo sapiens
gagcctttggatgacca

SEQ ID NO: 2611980 - DNA, 20 bp, Homo sapiens
gagcgcacctgccccctggt

SEQ ID NO: 2611981 - DNA, 16 bp, Homo sapiens
gagcgcctgcccctcc

SEQ ID NO: 2611982 - DNA, 22 bp, Homo sapiens
gagcgcctgcccctcccagaac

SEQ ID NO: 2611983 - DNA, 13 bp, Homo sapiens
gagcggaaagcag

SEQ ID NO: 2611984 - DNA, 16 bp, Homo sapiens
gagcggaaagcagctc

SEQ ID NO: 2611985 - DNA, 17 bp, Homo sapiens
gagcggaaagcagctca

SEQ ID NO: 2611986 - DNA, 16 bp, Homo sapiens
gagcgggacctgtggc

SEQ ID NO: 2611987 - DNA, 20 bp, Homo sapiens
gagcgtgctccagcctggct

SEQ ID NO: 2611988 - DNA, 21 bp, Homo sapiens
gagcgtgctccagcctggctc

SEQ ID NO: 2611989 - DNA, 23 bp, Homo sapiens
gagctacgcctgcctcccctgtg

SEQ ID NO: 2611990 - DNA, 14 bp, Homo sapiens
gagctagaacctgg

SEQ ID NO: 2611991 - DNA, 13 bp, Homo sapiens
gagctatttccat

SEQ ID NO: 2611992 - DNA, 19 bp, Homo sapiens
gagctccagacccccagca

SEQ ID NO: 2611993 - DNA, 15 bp, Homo sapiens
gagctcctctcctgg

SEQ ID NO: 2611994 - DNA, 16 bp, Homo sapiens
gagctcctctcctgga

SEQ ID NO: 2611995 - DNA, 18 bp, Homo sapiens
gagctcctctcctggagg

SEQ ID NO: 2611996 - DNA, 19 bp, Homo sapiens
gagctcctctcctggagga

SEQ ID NO: 2611997 - DNA, 14 bp, Homo sapiens
gagctcctctgggc

SEQ ID NO: 2611998 - DNA, 16 bp, Homo sapiens
gagctcctctgggcag

SEQ ID NO: 2611999 - DNA, 18 bp, Homo sapiens
gagctcctctgggcagga

SEQ ID NO: 2612000 - DNA, 15 bp, Homo sapiens
gagctcggtggaccc

SEQ ID NO: 2612001 - DNA, 19 bp, Homo sapiens
gagctcttcaggcctccct

SEQ ID NO: 2612002 - DNA, 10 bp, Homo sapiens
gagctgagat

SEQ ID NO: 2612003 - DNA, 16 bp, Homo sapiens
gagctgagcagggaga

SEQ ID NO: 2612004 - DNA, 15 bp, Homo sapiens
gagctgagtggggga

SEQ ID NO: 2612005 - DNA, 15 bp, Homo sapiens
gagctgatccagagc

SEQ ID NO: 2612006 - DNA, 11 bp, Homo sapiens
gagctgccctc

SEQ ID NO: 2612007 - DNA, 15 bp, Homo sapiens
gagctgccctccttg

SEQ ID NO: 2612008 - DNA, 23 bp, Homo sapiens
gagctgccctccttgtccaccca

SEQ ID NO: 2612009 - DNA, 19 bp, Homo sapiens
gagctgcctgttcagctcc

SEQ ID NO: 2612010 - DNA, 14 bp, Homo sapiens
gagctgctctgaat

SEQ ID NO: 2612011 - DNA, 21 bp, Homo sapiens
gagctgctggcttgcagtgcg

SEQ ID NO: 2612012 - DNA, 14 bp, Homo sapiens
gagctggccccgcc

SEQ ID NO: 2612013 - DNA, 16 bp, Homo sapiens
gagctggccccgccgc

SEQ ID NO: 2612014 - DNA, 15 bp, Homo sapiens
gagctggggacctgg

SEQ ID NO: 2612015 - DNA, 18 bp, Homo sapiens
gagctgggggccatgagc

SEQ ID NO: 2612016 - DNA, 11 bp, Homo sapiens
gagctggtgca

SEQ ID NO: 2612017 - DNA, 21 bp, Homo sapiens
gagctggtgcccggagattgg

SEQ ID NO: 2612018 - DNA, 18 bp, Homo sapiens
gagctgtattaagccact

SEQ ID NO: 2612019 - DNA, 16 bp, Homo sapiens
gagctgtttatggcct

SEQ ID NO: 2612020 - DNA, 17 bp, Homo sapiens
gagctgtttatggcctc

SEQ ID NO: 2612021 - DNA, 17 bp, Homo sapiens
gagcttagccaatgtgg

SEQ ID NO: 2612022 - DNA, 13 bp, Homo sapiens
gagcttccctgac

SEQ ID NO: 2612023 - DNA, 17 bp, Homo sapiens
gagcttccctgactcat

SEQ ID NO: 2612024 - DNA, 10 bp, Homo sapiens
gagcttctct

SEQ ID NO: 2612025 - DNA, 16 bp, Homo sapiens
gagcttctctgtgaac

SEQ ID NO: 2612026 - DNA, 13 bp, Homo sapiens
gagcttgggaatg

SEQ ID NO: 2612027 - DNA, 15 bp, Homo sapiens
gagctttcaaagaag

SEQ ID NO: 2612028 - DNA, 18 bp, Homo sapiens
gagctttcaaagaaggaa

SEQ ID NO: 2612029 - DNA, 21 bp, Homo sapiens
gagctttctgtccttttggca

SEQ ID NO: 2612030 - DNA, 20 bp, Homo sapiens
gagctttgaaaattcagtgg

SEQ ID NO: 2612031 - DNA, 19 bp, Homo sapiens
gagctttgcatgttccact

SEQ ID NO: 2612032 - DNA, 20 bp, Homo sapiens
gaggaaactcacctgctggc

SEQ ID NO: 2612033 - DNA, 14 bp, Homo sapiens
gaggaaactcagag

SEQ ID NO: 2612034 - DNA, 15 bp, Homo sapiens
gaggaaccagagcca

SEQ ID NO: 2612035 - DNA, 18 bp, Homo sapiens
gaggaaccagagccatgg

SEQ ID NO: 2612036 - DNA, 22 bp, Homo sapiens
gaggaaccagagccatggactc

SEQ ID NO: 2612037 - DNA, 20 bp, Homo sapiens
gaggaactagccaccaactc

SEQ ID NO: 2612038 - DNA, 15 bp, Homo sapiens
gaggaactgtccaga

SEQ ID NO: 2612039 - DNA, 16 bp, Homo sapiens
gaggaactgtccagag

SEQ ID NO: 2612040 - DNA, 17 bp, Homo sapiens
gaggaactgtccagaga

SEQ ID NO: 2612041 - DNA, 17 bp, Homo sapiens
gaggaagagcaggcaca

SEQ ID NO: 2612042 - DNA, 14 bp, Homo sapiens
gaggaagccgctgg

SEQ ID NO: 2612043 - DNA, 17 bp, Homo sapiens
gaggaagccgctggggc

SEQ ID NO: 2612044 - DNA, 21 bp, Homo sapiens
gaggaaggaaacccagctctg

SEQ ID NO: 2612045 - DNA, 15 bp, Homo sapiens
gaggaaggattgtaa

SEQ ID NO: 2612046 - DNA, 16 bp, Homo sapiens
gaggaaggattgtaaa

SEQ ID NO: 2612047 - DNA, 18 bp, Homo sapiens
gaggaataattatttatt

SEQ ID NO: 2612048 - DNA, 22 bp, Homo sapiens
gaggaatcactcttgtggatgt

SEQ ID NO: 2612049 - DNA, 15 bp, Homo sapiens
gaggaatccagaccc

SEQ ID NO: 2612050 - DNA, 20 bp, Homo sapiens
gaggaatcgaggaaccagag

SEQ ID NO: 2612051 - DNA, 13 bp, Homo sapiens
gaggaatgctccc

SEQ ID NO: 2612052 - DNA, 15 bp, Homo sapiens
gaggaatgctccccc

SEQ ID NO: 2612053 - DNA, 21 bp, Homo sapiens
gaggaatgctcccccatcctc

SEQ ID NO: 2612054 - DNA, 20 bp, Homo sapiens
gaggacaattcatgaacttc

SEQ ID NO: 2612055 - DNA, 14 bp, Homo sapiens
gaggacagctgtcc

SEQ ID NO: 2612056 - DNA, 22 bp, Homo sapiens
gaggacagggaggtgaccccag

SEQ ID NO: 2612057 - DNA, 16 bp, Homo sapiens
gaggacccagacccag

SEQ ID NO: 2612058 - DNA, 16 bp, Homo sapiens
gaggacttgtgtctct

SEQ ID NO: 2612059 - DNA, 18 bp, Homo sapiens
gaggacttgtgtctctgt

SEQ ID NO: 2612060 - DNA, 16 bp, Homo sapiens
gaggacttttctttgt

SEQ ID NO: 2612061 - DNA, 23 bp, Homo sapiens
gaggacttttctttgtggcttcc

SEQ ID NO: 2612062 - DNA, 9 bp, Homo sapiens
gaggagaaa

SEQ ID NO: 2612063 - DNA, 13 bp, Homo sapiens
gaggagaaacaca

SEQ ID NO: 2612064 - DNA, 15 bp, Homo sapiens
gaggagacattggct

SEQ ID NO: 2612065 - DNA, 13 bp, Homo sapiens
gaggagagaagaa

SEQ ID NO: 2612066 - DNA, 14 bp, Homo sapiens
gaggagagaagaat

SEQ ID NO: 2612067 - DNA, 17 bp, Homo sapiens
gaggagagccagagaag

SEQ ID NO: 2612068 - DNA, 22 bp, Homo sapiens
gaggagagccagagaagtgaca

SEQ ID NO: 2612069 - DNA, 23 bp, Homo sapiens
gaggagagccagagaagtgacag

SEQ ID NO: 2612070 - DNA, 14 bp, Homo sapiens
gaggagagtcccag

SEQ ID NO: 2612071 - DNA, 15 bp, Homo sapiens
gaggagagtcccaga

SEQ ID NO: 2612072 - DNA, 16 bp, Homo sapiens
gaggagcaaaggctga

SEQ ID NO: 2612073 - DNA, 15 bp, Homo sapiens
gaggagccccagcta

SEQ ID NO: 2612074 - DNA, 15 bp, Homo sapiens
gaggagctgctggct

SEQ ID NO: 2612075 - DNA, 15 bp, Homo sapiens
gaggaggccacctct

SEQ ID NO: 2612076 - DNA, 19 bp, Homo sapiens
gaggaggccacctctccaa

SEQ ID NO: 2612077 - DNA, 20 bp, Homo sapiens
gaggaggccacctctccaag

SEQ ID NO: 2612078 - DNA, 19 bp, Homo sapiens
gaggagggatgctgcctga

SEQ ID NO: 2612079 - DNA, 18 bp, Homo sapiens
gaggaggtggcagccctg

SEQ ID NO: 2612080 - DNA, 20 bp, Homo sapiens
gaggaggtggcagccctgta

SEQ ID NO: 2612081 - DNA, 14 bp, Homo sapiens
gaggagttcaatga

SEQ ID NO: 2612082 - DNA, 17 bp, Homo sapiens
gaggagttcaatgatct

SEQ ID NO: 2612083 - DNA, 20 bp, Homo sapiens
gaggagtttcgaggtagagt

SEQ ID NO: 2612084 - DNA, 16 bp, Homo sapiens
gaggatctcttgagcc

SEQ ID NO: 2612085 - DNA, 21 bp, Homo sapiens
gaggatgaatgtatgtgcact

SEQ ID NO: 2612086 - DNA, 16 bp, Homo sapiens
gaggatgagagcccag

SEQ ID NO: 2612087 - DNA, 13 bp, Homo sapiens
gaggatggagaga

SEQ ID NO: 2612088 - DNA, 15 bp, Homo sapiens
gaggatggagagagg

SEQ ID NO: 2612089 - DNA, 16 bp, Homo sapiens
gaggatggccagtgtc

SEQ ID NO: 2612090 - DNA, 20 bp, Homo sapiens
gaggatggccagtgtctgtc

SEQ ID NO: 2612091 - DNA, 20 bp, Homo sapiens
gaggatgtcactcagatgga

SEQ ID NO: 2612092 - DNA, 18 bp, Homo sapiens
gatgcaaggaccaggact

SEQ ID NO: 2612093 - DNA, 21 bp, Homo sapiens
gatgcacagagttgttacatt

SEQ ID NO: 2612094 - DNA, 22 bp, Homo sapiens
gatgcacagagttgttacattt

SEQ ID NO: 2612095 - DNA, 14 bp, Homo sapiens
gatgcaccagccct

SEQ ID NO: 2612096 - DNA, 16 bp, Homo sapiens
gatgcagcattatgat

SEQ ID NO: 2612097 - DNA, 14 bp, Homo sapiens
gatgcagtgcttcc

SEQ ID NO: 2612098 - DNA, 20 bp, Homo sapiens
gatgcatgttttccagctcc

SEQ ID NO: 2612099 - DNA, 20 bp, Homo sapiens
gatgccaagttgtttgagaa

SEQ ID NO: 2612100 - DNA, 22 bp, Homo sapiens
gatgccaggttctatttggaat

SEQ ID NO: 2612101 - DNA, 17 bp, Homo sapiens
gatgcccactgaggaat

SEQ ID NO: 2612102 - DNA, 19 bp, Homo sapiens
gatgcccagagggcccagg

SEQ ID NO: 2612103 - DNA, 20 bp, Homo sapiens
gatgcccagagggcccaggc

SEQ ID NO: 2612104 - DNA, 12 bp, Homo sapiens
gatgccccagag

SEQ ID NO: 2612105 - DNA, 19 bp, Homo sapiens
gatgcctggtggcagctgc

SEQ ID NO: 2612106 - DNA, 14 bp, Homo sapiens
gatgctcacagggc

SEQ ID NO: 2612107 - DNA, 17 bp, Homo sapiens
gatgctccagccaaccc

SEQ ID NO: 2612108 - DNA, 23 bp, Homo sapiens
gatgctccagccaacccctgtgg

SEQ ID NO: 2612109 - DNA, 11 bp, Homo sapiens
gatgctgcttt

SEQ ID NO: 2612110 - DNA, 16 bp, Homo sapiens
gatgctggagaggtta

SEQ ID NO: 2612111 - DNA, 16 bp, Homo sapiens
gatgctggatgctcct

SEQ ID NO: 2612112 - DNA, 17 bp, Homo sapiens
gatgctggatgtctgcc

SEQ ID NO: 2612113 - DNA, 20 bp, Homo sapiens
gatgctgggttggtgcacag

SEQ ID NO: 2612114 - DNA, 23 bp, Homo sapiens
gatgcttctcactgccatgccag

SEQ ID NO: 2612115 - DNA, 24 bp, Homo sapiens
gatgcttgcctagggcctggtcca

SEQ ID NO: 2612116 - DNA, 14 bp, Homo sapiens
gatgcttgtacata

SEQ ID NO: 2612117 - DNA, 21 bp, Homo sapiens
gatgctttaagtgcacaacat

SEQ ID NO: 2612118 - DNA, 20 bp, Homo sapiens
gatgcttttctgtctctgcc

SEQ ID NO: 2612119 - DNA, 15 bp, Homo sapiens
gatggaagcttccag

SEQ ID NO: 2612120 - DNA, 16 bp, Homo sapiens
gatggagagaggggaa

SEQ ID NO: 2612121 - DNA, 18 bp, Homo sapiens
gatggagtccagggaaga

SEQ ID NO: 2612122 - DNA, 18 bp, Homo sapiens
gatggataacctatatga

SEQ ID NO: 2612123 - DNA, 22 bp, Homo sapiens
gatggattccaaccccaactcc

SEQ ID NO: 2612124 - DNA, 22 bp, Homo sapiens
gatggatttccagccaaagcct

SEQ ID NO: 2612125 - DNA, 14 bp, Homo sapiens
gatggatttgcctg

SEQ ID NO: 2612126 - DNA, 19 bp, Homo sapiens
gatggatttgcctgtgcca

SEQ ID NO: 2612127 - DNA, 15 bp, Homo sapiens
gatggcaggatggcc

SEQ ID NO: 2612128 - DNA, 17 bp, Homo sapiens
gatggcaggatggcctg

SEQ ID NO: 2612129 - DNA, 22 bp, Homo sapiens
gatggcccttcccactggaggt

SEQ ID NO: 2612130 - DNA, 22 bp, Homo sapiens
gatggccgggcgcggtggctca

SEQ ID NO: 2612131 - DNA, 15 bp, Homo sapiens
gatggcgggtggggg

SEQ ID NO: 2612132 - DNA, 21 bp, Homo sapiens
gatggctaaaaccatcatagt

SEQ ID NO: 2612133 - DNA, 13 bp, Homo sapiens
gatggctgtgcct

SEQ ID NO: 2612134 - DNA, 16 bp, Homo sapiens
gatgggaaagcattgt

SEQ ID NO: 2612135 - DNA, 16 bp, Homo sapiens
gatgggaatgaagctt

SEQ ID NO: 2612136 - DNA, 19 bp, Homo sapiens
gatgggatggtggagggcc

SEQ ID NO: 2612137 - DNA, 22 bp, Homo sapiens
gatgggcaacccccagcctgct

SEQ ID NO: 2612138 - DNA, 17 bp, Homo sapiens
gatgggcatggggtggg

SEQ ID NO: 2612139 - DNA, 20 bp, Homo sapiens
gatgggcatggggtgggcct

SEQ ID NO: 2612140 - DNA, 22 bp, Homo sapiens
gatgggcatggggtgggcctct

SEQ ID NO: 2612141 - DNA, 20 bp, Homo sapiens
gatgggcctgcttcctgtct

SEQ ID NO: 2612142 - DNA, 24 bp, Homo sapiens
gatggggccctgcctcctttgtga

SEQ ID NO: 2612143 - DNA, 19 bp, Homo sapiens
gatggggctcccgcccgtg

SEQ ID NO: 2612144 - DNA, 17 bp, Homo sapiens
gatgggggaaagcacag

SEQ ID NO: 2612145 - DNA, 21 bp, Homo sapiens
gatgggggaaagcacaggtgg

SEQ ID NO: 2612146 - DNA, 21 bp, Homo sapiens
gatgggggagtctgaagcaga

SEQ ID NO: 2612147 - DNA, 23 bp, Homo sapiens
gatggggtctcacagtgttgccc

SEQ ID NO: 2612148 - DNA, 15 bp, Homo sapiens
gatgggtcagttgta

SEQ ID NO: 2612149 - DNA, 21 bp, Homo sapiens
gatgggtcagttgtatcagca

SEQ ID NO: 2612150 - DNA, 23 bp, Homo sapiens
gatgggtctggtttgcagagctt

SEQ ID NO: 2612151 - DNA, 18 bp, Homo sapiens
gatgggtttgacaaggtt

SEQ ID NO: 2612152 - DNA, 15 bp, Homo sapiens
gatggtcctggggct

SEQ ID NO: 2612153 - DNA, 21 bp, Homo sapiens
gatggtcctggggctctgtgc

SEQ ID NO: 2612154 - DNA, 24 bp, Homo sapiens
gatggtcctggggctctgtgcagg

SEQ ID NO: 2612155 - DNA, 15 bp, Homo sapiens
gatggtggagggcca

SEQ ID NO: 2612156 - DNA, 17 bp, Homo sapiens
gatggtgttttggggat

SEQ ID NO: 2612157 - DNA, 23 bp, Homo sapiens
gatggttattttcttttctttca

SEQ ID NO: 2612158 - DNA, 18 bp, Homo sapiens
gatgtaaaagactttttt

SEQ ID NO: 2612159 - DNA, 18 bp, Homo sapiens
gatgtagaggagaaactg

SEQ ID NO: 2612160 - DNA, 15 bp, Homo sapiens
gatgtcacagggcca

SEQ ID NO: 2612161 - DNA, 22 bp, Homo sapiens
gatgtcagccgagccgggcctg

SEQ ID NO: 2612162 - DNA, 17 bp, Homo sapiens
gatgtccacagatgcct

SEQ ID NO: 2612163 - DNA, 20 bp, Homo sapiens
gatgtccctttcttggccag

SEQ ID NO: 2612164 - DNA, 14 bp, Homo sapiens
gatgtctgccaatt

SEQ ID NO: 2612165 - DNA, 18 bp, Homo sapiens
gatgtgatttaatagtgt

SEQ ID NO: 2612166 - DNA, 23 bp, Homo sapiens
gatgtgatttaatagtgttaatc

SEQ ID NO: 2612167 - DNA, 21 bp, Homo sapiens
gatgtgctttgcattcctaca

SEQ ID NO: 2612168 - DNA, 12 bp, Homo sapiens
gatgtgtacatc

SEQ ID NO: 2612169 - DNA, 13 bp, Homo sapiens
gatgtgtgcatgt

SEQ ID NO: 2612170 - DNA, 12 bp, Homo sapiens
gatgtgttgtga

SEQ ID NO: 2612171 - DNA, 14 bp, Homo sapiens
gatgttaaccagaa

SEQ ID NO: 2612172 - DNA, 20 bp, Homo sapiens
gatgttacatcacagtgttt

SEQ ID NO: 2612173 - DNA, 23 bp, Homo sapiens
gatgttacatcacagtgtttgca

SEQ ID NO: 2612174 - DNA, 16 bp, Homo sapiens
gatgttctgggacaca

SEQ ID NO: 2612175 - DNA, 23 bp, Homo sapiens
gatgttgaatgcccacaggcaaa

SEQ ID NO: 2612176 - DNA, 15 bp, Homo sapiens
gatgtttgtggcctc

SEQ ID NO: 2612177 - DNA, 17 bp, Homo sapiens
gatgtttgtggcctcag

SEQ ID NO: 2612178 - DNA, 22 bp, Homo sapiens
gatgtttttaaaagtttcaatg

SEQ ID NO: 2612179 - DNA, 19 bp, Homo sapiens
gattaaattcttgcaaagt

SEQ ID NO: 2612180 - DNA, 15 bp, Homo sapiens
gattaattaaatgca

SEQ ID NO: 2612181 - DNA, 21 bp, Homo sapiens
gattacaagcgtgagccactg

SEQ ID NO: 2612182 - DNA, 22 bp, Homo sapiens
gattacaagcgtgagccactgc

SEQ ID NO: 2612183 - DNA, 13 bp, Homo sapiens
gattacagaggaa

SEQ ID NO: 2612184 - DNA, 18 bp, Homo sapiens
gattacagggatgagcca

SEQ ID NO: 2612185 - DNA, 20 bp, Homo sapiens
gattacagggatgagccacc

SEQ ID NO: 2612186 - DNA, 14 bp, Homo sapiens
gattacatgcatgt

SEQ ID NO: 2612187 - DNA, 14 bp, Homo sapiens
gattacctcctgag

SEQ ID NO: 2612188 - DNA, 13 bp, Homo sapiens
gattagagggagg

SEQ ID NO: 2612189 - DNA, 19 bp, Homo sapiens
gattagcaagttacagtga

SEQ ID NO: 2612190 - DNA, 17 bp, Homo sapiens
gattagggagagaagat

SEQ ID NO: 2612191 - DNA, 23 bp, Homo sapiens
gattagggcatttgagaaatgca

SEQ ID NO: 2612192 - DNA, 20 bp, Homo sapiens
gattattagccaggtaatgt

SEQ ID NO: 2612193 - DNA, 13 bp, Homo sapiens
gattattcagtgt

SEQ ID NO: 2612194 - DNA, 21 bp, Homo sapiens
gattattcatttaaaatgatt

SEQ ID NO: 2612195 - DNA, 19 bp, Homo sapiens
gattattctgattccactt

SEQ ID NO: 2612196 - DNA, 22 bp, Homo sapiens
gattatttaataacattacctt

SEQ ID NO: 2612197 - DNA, 14 bp, Homo sapiens
gattatttcacttt

SEQ ID NO: 2612198 - DNA, 15 bp, Homo sapiens
gattattttttcaga

SEQ ID NO: 2612199 - DNA, 16 bp, Homo sapiens
gattattttttcagac

SEQ ID NO: 2612200 - DNA, 17 bp, Homo sapiens
gattattttttcagacc

SEQ ID NO: 2612201 - DNA, 23 bp, Homo sapiens
gattcaactaaaaaaaaaaaagt

SEQ ID NO: 2612202 - DNA, 16 bp, Homo sapiens
gattcaatctgtaaac

SEQ ID NO: 2612203 - DNA, 18 bp, Homo sapiens
gattcacaatgaaatgct

SEQ ID NO: 2612204 - DNA, 22 bp, Homo sapiens
gattcacaatgaaatgctctcc

SEQ ID NO: 2612205 - DNA, 21 bp, Homo sapiens
gattcacacctgactctgaaa

SEQ ID NO: 2612206 - DNA, 21 bp, Homo sapiens
gattcaccctgtccaaactgc

SEQ ID NO: 2612207 - DNA, 12 bp, Homo sapiens
gattcaggctgc

SEQ ID NO: 2612208 - DNA, 16 bp, Homo sapiens
gattcaggctgcttgg

SEQ ID NO: 2612209 - DNA, 10 bp, Homo sapiens
gattcatttt

SEQ ID NO: 2612210 - DNA, 22 bp, Homo sapiens
gattccaaccccaactccagta

SEQ ID NO: 2612211 - DNA, 17 bp, Homo sapiens
gattcccaagctctgct

SEQ ID NO: 2612212 - DNA, 18 bp, Homo sapiens
gattcccaagctctgctc

SEQ ID NO: 2612213 - DNA, 19 bp, Homo sapiens
gattcccaagctctgctcc

SEQ ID NO: 2612214 - DNA, 22 bp, Homo sapiens
gattcccaagctctgctcctct

SEQ ID NO: 2612215 - DNA, 13 bp, Homo sapiens
gattcccagagca

SEQ ID NO: 2612216 - DNA, 21 bp, Homo sapiens
gattcccctaacctcattccc

SEQ ID NO: 2612217 - DNA, 18 bp, Homo sapiens
gattcctgacccaggccg

SEQ ID NO: 2612218 - DNA, 12 bp, Homo sapiens
gattctcagggt

SEQ ID NO: 2612219 - DNA, 21 bp, Homo sapiens
gattctcagggtctctgctgc

SEQ ID NO: 2612220 - DNA, 18 bp, Homo sapiens
gattctcctgcctcagcc

SEQ ID NO: 2612221 - DNA, 14 bp, Homo sapiens
gattctcctgtgct

SEQ ID NO: 2612222 - DNA, 15 bp, Homo sapiens
gattctgtggaacaa

SEQ ID NO: 2612223 - DNA, 22 bp, Homo sapiens
gattctgtgtgttttcataata

SEQ ID NO: 2612224 - DNA, 23 bp, Homo sapiens
gattcttatgtagcaggaaataa

SEQ ID NO: 2612225 - DNA, 16 bp, Homo sapiens
gattcttcaaaagcat

SEQ ID NO: 2612226 - DNA, 12 bp, Homo sapiens
gattcttctgct

SEQ ID NO: 2612227 - DNA, 19 bp, Homo sapiens
gattctttccattatgatt

SEQ ID NO: 2612228 - DNA, 16 bp, Homo sapiens
gattctttcctgaggc

SEQ ID NO: 2612229 - DNA, 19 bp, Homo sapiens
gattctttcctgaggctgg

SEQ ID NO: 2612230 - DNA, 20 bp, Homo sapiens
gattctttcctgaggctggg

SEQ ID NO: 2612231 - DNA, 19 bp, Homo sapiens
gattgaaaacttttctcag

SEQ ID NO: 2612232 - DNA, 20 bp, Homo sapiens
gattgaaaacttttctcaga

SEQ ID NO: 2612233 - DNA, 23 bp, Homo sapiens
gattgaagtattttgctggaata

SEQ ID NO: 2612234 - DNA, 19 bp, Homo sapiens
gcatgtattggcctggagg

SEQ ID NO: 2612235 - DNA, 20 bp, Homo sapiens
gcatgtgactctgaagctga

SEQ ID NO: 2612236 - DNA, 12 bp, Homo sapiens
gcatgtggcctg

SEQ ID NO: 2612237 - DNA, 21 bp, Homo sapiens
gcatgtgtatttccagtgcaa

SEQ ID NO: 2612238 - DNA, 19 bp, Homo sapiens
gcatgtgtgcgagtgtgtg

SEQ ID NO: 2612239 - DNA, 22 bp, Homo sapiens
gcatgtgtttggttctggggcc

SEQ ID NO: 2612240 - DNA, 18 bp, Homo sapiens
gcatgttacctcctataa

SEQ ID NO: 2612241 - DNA, 22 bp, Homo sapiens
gcatgttctctgaggacactaa

SEQ ID NO: 2612242 - DNA, 20 bp, Homo sapiens
gcatgtttcatgttttgtga

SEQ ID NO: 2612243 - DNA, 13 bp, Homo sapiens
gcattaaaagaaa

SEQ ID NO: 2612244 - DNA, 19 bp, Homo sapiens
gcattaaatataatatgca

SEQ ID NO: 2612245 - DNA, 14 bp, Homo sapiens
gcattaacttctct

SEQ ID NO: 2612246 - DNA, 16 bp, Homo sapiens
gcattaacttctctgg

SEQ ID NO: 2612247 - DNA, 16 bp, Homo sapiens
gcattagaaatagaca

SEQ ID NO: 2612248 - DNA, 15 bp, Homo sapiens
gcattatataccatt

SEQ ID NO: 2612249 - DNA, 15 bp, Homo sapiens
gcattattgcattat

SEQ ID NO: 2612250 - DNA, 16 bp, Homo sapiens
gcattccccaggaggc

SEQ ID NO: 2612251 - DNA, 19 bp, Homo sapiens
gcattcctacaaagatgtt

SEQ ID NO: 2612252 - DNA, 21 bp, Homo sapiens
gcattcctgatatgatttaaa

SEQ ID NO: 2612253 - DNA, 22 bp, Homo sapiens
gcattcctgatatgatttaaaa

SEQ ID NO: 2612254 - DNA, 13 bp, Homo sapiens
gcattccttcttt

SEQ ID NO: 2612255 - DNA, 19 bp, Homo sapiens
gcattccttctttgataat

SEQ ID NO: 2612256 - DNA, 13 bp, Homo sapiens
gcattctagtact

SEQ ID NO: 2612257 - DNA, 16 bp, Homo sapiens
gcattgaatatattat

SEQ ID NO: 2612258 - DNA, 12 bp, Homo sapiens
gcattgagaact

SEQ ID NO: 2612259 - DNA, 16 bp, Homo sapiens
gcattgatggggaagg

SEQ ID NO: 2612260 - DNA, 18 bp, Homo sapiens
gcattgatggggaaggag

SEQ ID NO: 2612261 - DNA, 14 bp, Homo sapiens
gcattgccaagggc

SEQ ID NO: 2612262 - DNA, 20 bp, Homo sapiens
gcattgctttctgaaattag

SEQ ID NO: 2612263 - DNA, 16 bp, Homo sapiens
gcattggaagacccca

SEQ ID NO: 2612264 - DNA, 18 bp, Homo sapiens
gcattgtgaactgacagg

SEQ ID NO: 2612265 - DNA, 16 bp, Homo sapiens
gcattgtggctgtcag

SEQ ID NO: 2612266 - DNA, 21 bp, Homo sapiens
gcattgtttgcttattgttcc

SEQ ID NO: 2612267 - DNA, 12 bp, Homo sapiens
gcatttaaaaga

SEQ ID NO: 2612268 - DNA, 22 bp, Homo sapiens
gcatttaaaagatacagttact

SEQ ID NO: 2612269 - DNA, 16 bp, Homo sapiens
gcatttaatgtagcca

SEQ ID NO: 2612270 - DNA, 19 bp, Homo sapiens
gcatttaatgtagccatgg

SEQ ID NO: 2612271 - DNA, 17 bp, Homo sapiens
gcatttactttgaattt

SEQ ID NO: 2612272 - DNA, 13 bp, Homo sapiens
gcatttcattctt

SEQ ID NO: 2612273 - DNA, 23 bp, Homo sapiens
gcatttccaacaccacagacaca

SEQ ID NO: 2612274 - DNA, 12 bp, Homo sapiens
gcatttctgaag

SEQ ID NO: 2612275 - DNA, 13 bp, Homo sapiens
gcatttctgaagt

SEQ ID NO: 2612276 - DNA, 14 bp, Homo sapiens
gcatttgagaaatg

SEQ ID NO: 2612277 - DNA, 23 bp, Homo sapiens
gcatttggtggtttcagaaatgt

SEQ ID NO: 2612278 - DNA, 13 bp, Homo sapiens
gcatttgtgaggc

SEQ ID NO: 2612279 - DNA, 17 bp, Homo sapiens
gcattttaaaaatgaaa

SEQ ID NO: 2612280 - DNA, 13 bp, Homo sapiens
gcattttataaat

SEQ ID NO: 2612281 - DNA, 23 bp, Homo sapiens
gcattttgtatttgtctaactgg

SEQ ID NO: 2612282 - DNA, 20 bp, Homo sapiens
gcatttttgatttatgcatg

SEQ ID NO: 2612283 - DNA, 18 bp, Homo sapiens
gcatttttgtgaaatgaa

SEQ ID NO: 2612284 - DNA, 14 bp, Homo sapiens
gccaaaagctgctc

SEQ ID NO: 2612285 - DNA, 22 bp, Homo sapiens
gccaaacccatgaggcaatgtc

SEQ ID NO: 2612286 - DNA, 13 bp, Homo sapiens
gccaaacctctgt

SEQ ID NO: 2612287 - DNA, 19 bp, Homo sapiens
gccaaacctctgttcagtg

SEQ ID NO: 2612288 - DNA, 22 bp, Homo sapiens
gccaaacctctgttcagtgtaa

SEQ ID NO: 2612289 - DNA, 16 bp, Homo sapiens
gccaaagcctcctcca

SEQ ID NO: 2612290 - DNA, 23 bp, Homo sapiens
gccaacaggtggcaggaccagga

SEQ ID NO: 2612291 - DNA, 14 bp, Homo sapiens
gccaacgacaaagc

SEQ ID NO: 2612292 - DNA, 19 bp, Homo sapiens
gccaactgctgctttttga

SEQ ID NO: 2612293 - DNA, 20 bp, Homo sapiens
gccaacttgagggcccagag

SEQ ID NO: 2612294 - DNA, 22 bp, Homo sapiens
gccaacttgagggcccagagca

SEQ ID NO: 2612295 - DNA, 14 bp, Homo sapiens
gccaacttggcttt

SEQ ID NO: 2612296 - DNA, 15 bp, Homo sapiens
gccaacttgtaaata

SEQ ID NO: 2612297 - DNA, 18 bp, Homo sapiens
gccaagaagtttaaggaa

SEQ ID NO: 2612298 - DNA, 12 bp, Homo sapiens
gccaagacttgg

SEQ ID NO: 2612299 - DNA, 20 bp, Homo sapiens
gccaagcaacctgggtccaa

SEQ ID NO: 2612300 - DNA, 12 bp, Homo sapiens
gccaagcacagt

SEQ ID NO: 2612301 - DNA, 16 bp, Homo sapiens
gccaagcacagtggtg

SEQ ID NO: 2612302 - DNA, 21 bp, Homo sapiens
gccaagcacagtggtggcagg

SEQ ID NO: 2612303 - DNA, 15 bp, Homo sapiens
gccaagcactgtgct

SEQ ID NO: 2612304 - DNA, 14 bp, Homo sapiens
gccaagcagccaag

SEQ ID NO: 2612305 - DNA, 16 bp, Homo sapiens
gccaagctccttggga

SEQ ID NO: 2612306 - DNA, 19 bp, Homo sapiens
gccaagctccttgggaggc

SEQ ID NO: 2612307 - DNA, 20 bp, Homo sapiens
gccaaggagggtgagtgcaa

SEQ ID NO: 2612308 - DNA, 21 bp, Homo sapiens
gccaaggccagagtggcctgg

SEQ ID NO: 2612309 - DNA, 19 bp, Homo sapiens
gccaaggccgaagctctgg

SEQ ID NO: 2612310 - DNA, 15 bp, Homo sapiens
gccaaggccttctcc

SEQ ID NO: 2612311 - DNA, 16 bp, Homo sapiens
gccaaggtgggctgag

SEQ ID NO: 2612312 - DNA, 18 bp, Homo sapiens
gccaaggtgggctgagcc

SEQ ID NO: 2612313 - DNA, 22 bp, Homo sapiens
gccaagtcagctttgccttcca

SEQ ID NO: 2612314 - DNA, 16 bp, Homo sapiens
gccaagtgcaggctgg

SEQ ID NO: 2612315 - DNA, 17 bp, Homo sapiens
gccaagtttatatacaa

SEQ ID NO: 2612316 - DNA, 21 bp, Homo sapiens
gccaatcccctccttgggcac

SEQ ID NO: 2612317 - DNA, 19 bp, Homo sapiens
gccaatgaggtctgaaatg

SEQ ID NO: 2612318 - DNA, 13 bp, Homo sapiens
gccaatggaacct

SEQ ID NO: 2612319 - DNA, 17 bp, Homo sapiens
gccaatggaacctcctt

SEQ ID NO: 2612320 - DNA, 21 bp, Homo sapiens
gccacaaccctgttttatact

SEQ ID NO: 2612321 - DNA, 14 bp, Homo sapiens
gccacaagaaattt

SEQ ID NO: 2612322 - DNA, 16 bp, Homo sapiens
gccacaagaaatttga

SEQ ID NO: 2612323 - DNA, 23 bp, Homo sapiens
gccacaagaaatttgatttctat

SEQ ID NO: 2612324 - DNA, 17 bp, Homo sapiens
gccacacacacagaaaa

SEQ ID NO: 2612325 - DNA, 23 bp, Homo sapiens
gccacacacacagaaaatatact

SEQ ID NO: 2612326 - DNA, 13 bp, Homo sapiens
gccacaccctccc

SEQ ID NO: 2612327 - DNA, 22 bp, Homo sapiens
gccacactctgggctccagagt

SEQ ID NO: 2612328 - DNA, 18 bp, Homo sapiens
gccacagaagccaggagc

SEQ ID NO: 2612329 - DNA, 16 bp, Homo sapiens
gccacagcctcccctg

SEQ ID NO: 2612330 - DNA, 12 bp, Homo sapiens
gccacagttgtt

SEQ ID NO: 2612331 - DNA, 14 bp, Homo sapiens
gccacatgagtccc

SEQ ID NO: 2612332 - DNA, 15 bp, Homo sapiens
gccacatgggaggct

SEQ ID NO: 2612333 - DNA, 17 bp, Homo sapiens
gccacatggggctgggc

SEQ ID NO: 2612334 - DNA, 20 bp, Homo sapiens
gccacatggggctgggcagc

SEQ ID NO: 2612335 - DNA, 16 bp, Homo sapiens
gccacattcctgatgc

SEQ ID NO: 2612336 - DNA, 20 bp, Homo sapiens
gccacattcctgatgcttct

SEQ ID NO: 2612337 - DNA, 22 bp, Homo sapiens
gccaccaacatactcccatctg

SEQ ID NO: 2612338 - DNA, 14 bp, Homo sapiens
gccaccaagaggga

SEQ ID NO: 2612339 - DNA, 13 bp, Homo sapiens
gccaccacccccc

SEQ ID NO: 2612340 - DNA, 16 bp, Homo sapiens
gccaccaccccccact

SEQ ID NO: 2612341 - DNA, 22 bp, Homo sapiens
gccaccaccccccactctgtgc

SEQ ID NO: 2612342 - DNA, 15 bp, Homo sapiens
gccaccacgtccagc

SEQ ID NO: 2612343 - DNA, 13 bp, Homo sapiens
gccaccaggctgg

SEQ ID NO: 2612344 - DNA, 16 bp, Homo sapiens
gccaccagtcactgtc

SEQ ID NO: 2612345 - DNA, 22 bp, Homo sapiens
gccaccatattcagtgctgtgg

SEQ ID NO: 2612346 - DNA, 14 bp, Homo sapiens
gccaccatggccag

SEQ ID NO: 2612347 - DNA, 18 bp, Homo sapiens
gccaccatggccagccaa

SEQ ID NO: 2612348 - DNA, 15 bp, Homo sapiens
gccacccctccttcc

SEQ ID NO: 2612349 - DNA, 21 bp, Homo sapiens
gccacccgttctgctggcctg

SEQ ID NO: 2612350 - DNA, 18 bp, Homo sapiens
gccaccctacctgttcag

SEQ ID NO: 2612351 - DNA, 19 bp, Homo sapiens
gccaccctacctgttcagt

SEQ ID NO: 2612352 - DNA, 15 bp, Homo sapiens
gccaccctcatgctg

SEQ ID NO: 2612353 - DNA, 17 bp, Homo sapiens
gccaccgcgcccagcct

SEQ ID NO: 2612354 - DNA, 20 bp, Homo sapiens
gccacctatctcgtgggaga

SEQ ID NO: 2612355 - DNA, 15 bp, Homo sapiens
gccacctccagaaac

SEQ ID NO: 2612356 - DNA, 20 bp, Homo sapiens
gccacctccctgacccgtct

SEQ ID NO: 2612357 - DNA, 12 bp, Homo sapiens
gccacctctcca

SEQ ID NO: 2612358 - DNA, 22 bp, Homo sapiens
gccacctctccaagggcttctg

SEQ ID NO: 2612359 - DNA, 15 bp, Homo sapiens
gccacctctccctca

SEQ ID NO: 2612360 - DNA, 15 bp, Homo sapiens
gccacctgaggtggg

SEQ ID NO: 2612361 - DNA, 18 bp, Homo sapiens
gccacctgaggtgggccc

SEQ ID NO: 2612362 - DNA, 20 bp, Homo sapiens
gccacctgaggtgggcccag

SEQ ID NO: 2612363 - DNA, 14 bp, Homo sapiens
gccacctgccccct

SEQ ID NO: 2612364 - DNA, 18 bp, Homo sapiens
gccacctgcccccttctc

SEQ ID NO: 2612365 - DNA, 20 bp, Homo sapiens
gccacctggcattccttctg

SEQ ID NO: 2612366 - DNA, 20 bp, Homo sapiens
gccactacactccagcctga

SEQ ID NO: 2612367 - DNA, 22 bp, Homo sapiens
gccactacactccagcctgagc

SEQ ID NO: 2612368 - DNA, 14 bp, Homo sapiens
gccactcacacagc

SEQ ID NO: 2612369 - DNA, 17 bp, Homo sapiens
gccactcacacagccag

SEQ ID NO: 2612370 - DNA, 20 bp, Homo sapiens
gccactcacacagccaggtg

SEQ ID NO: 2612371 - DNA, 20 bp, Homo sapiens
gccactcaggaggctgaggc

SEQ ID NO: 2612372 - DNA, 12 bp, Homo sapiens
gccactctgcct

SEQ ID NO: 2612373 - DNA, 14 bp, Homo sapiens
gccactctgcctct

SEQ ID NO: 2612374 - DNA, 21 bp, Homo sapiens
gccactctgcctctgcctgca

SEQ ID NO: 2612375 - DNA, 22 bp, Homo sapiens
gccactctgcctctgcctgcat

SEQ ID NO: 2612376 - DNA, 14 bp, Homo sapiens
gccactgaagctgg

SEQ ID NO: 2612377 - DNA, 21 bp, Homo sapiens
gccactgcactccagcctggg

SEQ ID NO: 2612378 - DNA, 22 bp, Homo sapiens
gccactgcactccagcctgggc

SEQ ID NO: 2612379 - DNA, 17 bp, Homo sapiens
gccctccccatcccatg

SEQ ID NO: 2612380 - DNA, 21 bp, Homo sapiens
gccctcccttggaaacctgcc

SEQ ID NO: 2612381 - DNA, 22 bp, Homo sapiens
gccctccgacagccccctctgc

SEQ ID NO: 2612382 - DNA, 17 bp, Homo sapiens
gccctcctaccctgcgc

SEQ ID NO: 2612383 - DNA, 18 bp, Homo sapiens
gccctcctaccctgcgcc

SEQ ID NO: 2612384 - DNA, 14 bp, Homo sapiens
gccctcgctgccag

SEQ ID NO: 2612385 - DNA, 15 bp, Homo sapiens
gccctcgctgcttct

SEQ ID NO: 2612386 - DNA, 16 bp, Homo sapiens
gccctcgctgcttctg

SEQ ID NO: 2612387 - DNA, 16 bp, Homo sapiens
gccctctctgctctgc

SEQ ID NO: 2612388 - DNA, 12 bp, Homo sapiens
gccctgacctcc

SEQ ID NO: 2612389 - DNA, 17 bp, Homo sapiens
gccctgacctcccagcc

SEQ ID NO: 2612390 - DNA, 19 bp, Homo sapiens
gccctgacctcccagccct

SEQ ID NO: 2612391 - DNA, 15 bp, Homo sapiens
gccctgagctcggtg

SEQ ID NO: 2612392 - DNA, 16 bp, Homo sapiens
gccctgagctcggtgg

SEQ ID NO: 2612393 - DNA, 22 bp, Homo sapiens
gccctgaggtgaaagggagcta

SEQ ID NO: 2612394 - DNA, 21 bp, Homo sapiens
gccctgagtggatctccaagg

SEQ ID NO: 2612395 - DNA, 18 bp, Homo sapiens
gccctgcaaaaggactct

SEQ ID NO: 2612396 - DNA, 21 bp, Homo sapiens
gccctgcagaggggaaaccag

SEQ ID NO: 2612397 - DNA, 15 bp, Homo sapiens
gccctgcccacctgg

SEQ ID NO: 2612398 - DNA, 15 bp, Homo sapiens
gccctgccctagctc

SEQ ID NO: 2612399 - DNA, 17 bp, Homo sapiens
gccctgccctagctcca

SEQ ID NO: 2612400 - DNA, 12 bp, Homo sapiens
gccctgcctcct

SEQ ID NO: 2612401 - DNA, 11 bp, Homo sapiens
gccctgcctga

SEQ ID NO: 2612402 - DNA, 12 bp, Homo sapiens
gccctgcctgag

SEQ ID NO: 2612403 - DNA, 22 bp, Homo sapiens
gccctgcctgagggcccctctg

SEQ ID NO: 2612404 - DNA, 16 bp, Homo sapiens
gccctgctcctccctg

SEQ ID NO: 2612405 - DNA, 17 bp, Homo sapiens
gccctgctcctccctgg

SEQ ID NO: 2612406 - DNA, 18 bp, Homo sapiens
gccctgctcctccctggc

SEQ ID NO: 2612407 - DNA, 19 bp, Homo sapiens
gccctgctcctccctggct

SEQ ID NO: 2612408 - DNA, 23 bp, Homo sapiens
gccctgctgccgcctcccagcct

SEQ ID NO: 2612409 - DNA, 22 bp, Homo sapiens
gccctgctgctgacccagcctg

SEQ ID NO: 2612410 - DNA, 20 bp, Homo sapiens
gccctgctggccgcctcacc

SEQ ID NO: 2612411 - DNA, 22 bp, Homo sapiens
gccctgctggccgcctcacccc

SEQ ID NO: 2612412 - DNA, 21 bp, Homo sapiens
gccctggagccaactgctgct

SEQ ID NO: 2612413 - DNA, 23 bp, Homo sapiens
gccctggagccaactgctgcttt

SEQ ID NO: 2612414 - DNA, 15 bp, Homo sapiens
gccctggagtcatgc

SEQ ID NO: 2612415 - DNA, 12 bp, Homo sapiens
gccctggcagga

SEQ ID NO: 2612416 - DNA, 19 bp, Homo sapiens
gccctggcaggatgaccct

SEQ ID NO: 2612417 - DNA, 12 bp, Homo sapiens
gccctggccctg

SEQ ID NO: 2612418 - DNA, 12 bp, Homo sapiens
gccctggctctg

SEQ ID NO: 2612419 - DNA, 17 bp, Homo sapiens
gccctgggccacactga

SEQ ID NO: 2612420 - DNA, 16 bp, Homo sapiens
gccctgggctcggagg

SEQ ID NO: 2612421 - DNA, 17 bp, Homo sapiens
gccctgggctcggaggc

SEQ ID NO: 2612422 - DNA, 23 bp, Homo sapiens
gccctggtccagggaagctggcc

SEQ ID NO: 2612423 - DNA, 14 bp, Homo sapiens
gccctggtctcagc

SEQ ID NO: 2612424 - DNA, 18 bp, Homo sapiens
gccctggtggagaaagca

SEQ ID NO: 2612425 - DNA, 14 bp, Homo sapiens
gccctggtggcagt

SEQ ID NO: 2612426 - DNA, 20 bp, Homo sapiens
gccctggtggcagtgggagc

SEQ ID NO: 2612427 - DNA, 21 bp, Homo sapiens
gccctgtcgagacacttgcct

SEQ ID NO: 2612428 - DNA, 11 bp, Homo sapiens
gccctgtctgt

SEQ ID NO: 2612429 - DNA, 21 bp, Homo sapiens
gccctgtgggcccccaaatgg

SEQ ID NO: 2612430 - DNA, 20 bp, Homo sapiens
gcccttacacttactgttgt

SEQ ID NO: 2612431 - DNA, 19 bp, Homo sapiens
gcccttagcagggaaacag

SEQ ID NO: 2612432 - DNA, 20 bp, Homo sapiens
gcccttagcagggaaacagc

SEQ ID NO: 2612433 - DNA, 22 bp, Homo sapiens
gcccttagcagggaaacagcta

SEQ ID NO: 2612434 - DNA, 17 bp, Homo sapiens
gcccttattttcaagaa

SEQ ID NO: 2612435 - DNA, 15 bp, Homo sapiens
gcccttcaccccagt

SEQ ID NO: 2612436 - DNA, 21 bp, Homo sapiens
gcccttcaccccagtggccac

SEQ ID NO: 2612437 - DNA, 22 bp, Homo sapiens
gcccttccatgtcgcctctgca

SEQ ID NO: 2612438 - DNA, 15 bp, Homo sapiens
gcccttccctgtccc

SEQ ID NO: 2612439 - DNA, 17 bp, Homo sapiens
gcccttccctgtccctc

SEQ ID NO: 2612440 - DNA, 13 bp, Homo sapiens
gcccttctctcca

SEQ ID NO: 2612441 - DNA, 16 bp, Homo sapiens
gcccttctctccagcc

SEQ ID NO: 2612442 - DNA, 18 bp, Homo sapiens
gcccttctctccagcccc

SEQ ID NO: 2612443 - DNA, 21 bp, Homo sapiens
gcccttctctccagcccctgg

SEQ ID NO: 2612444 - DNA, 21 bp, Homo sapiens
gcccttgcagttcagcaccac

SEQ ID NO: 2612445 - DNA, 12 bp, Homo sapiens
gcccttgtccca

SEQ ID NO: 2612446 - DNA, 21 bp, Homo sapiens
gccctttgggaggctgaggcg

SEQ ID NO: 2612447 - DNA, 22 bp, Homo sapiens
gccgaccgaggctggagctggc

SEQ ID NO: 2612448 - DNA, 12 bp, Homo sapiens
gccgacctcagc

SEQ ID NO: 2612449 - DNA, 20 bp, Homo sapiens
gccgagaagccagtgcggca

SEQ ID NO: 2612450 - DNA, 18 bp, Homo sapiens
gccgagatcacgccactg

SEQ ID NO: 2612451 - DNA, 22 bp, Homo sapiens
gccgagctcgtgtatcctgggg

SEQ ID NO: 2612452 - DNA, 23 bp, Homo sapiens
gccgagctcgtgtatcctggggc

SEQ ID NO: 2612453 - DNA, 18 bp, Homo sapiens
gccgagggtcctggctcc

SEQ ID NO: 2612454 - DNA, 16 bp, Homo sapiens
gccgcaaaccacactg

SEQ ID NO: 2612455 - DNA, 22 bp, Homo sapiens
gccgcaaaccacactggactcc

SEQ ID NO: 2612456 - DNA, 19 bp, Homo sapiens
gccgcagctcttgcccttc

SEQ ID NO: 2612457 - DNA, 16 bp, Homo sapiens
gccgccatgctcctgg

SEQ ID NO: 2612458 - DNA, 14 bp, Homo sapiens
gccgccccacccag

SEQ ID NO: 2612459 - DNA, 15 bp, Homo sapiens
gccgccccacccaga

SEQ ID NO: 2612460 - DNA, 14 bp, Homo sapiens
gccgcctcaccccc

SEQ ID NO: 2612461 - DNA, 13 bp, Homo sapiens
gccgcctcccagc

SEQ ID NO: 2612462 - DNA, 15 bp, Homo sapiens
gccgcctcccagcct

SEQ ID NO: 2612463 - DNA, 19 bp, Homo sapiens
gccgcctcccagcctgggg

SEQ ID NO: 2612464 - DNA, 23 bp, Homo sapiens
gccgcctgcccgtctctctccca

SEQ ID NO: 2612465 - DNA, 17 bp, Homo sapiens
gccgcgtcgccctccca

SEQ ID NO: 2612466 - DNA, 15 bp, Homo sapiens
gccgctagaggcctg

SEQ ID NO: 2612467 - DNA, 16 bp, Homo sapiens
gccgctagaggcctga

SEQ ID NO: 2612468 - DNA, 19 bp, Homo sapiens
gccgctagaggcctgagga

SEQ ID NO: 2612469 - DNA, 19 bp, Homo sapiens
gccgctcctgtctgccagc

SEQ ID NO: 2612470 - DNA, 23 bp, Homo sapiens
gccgctcctgtctgccagccagc

SEQ ID NO: 2612471 - DNA, 17 bp, Homo sapiens
gccgctgtgagcccctg

SEQ ID NO: 2612472 - DNA, 23 bp, Homo sapiens
gccgctgtgagcccctggtcctg

SEQ ID NO: 2612473 - DNA, 21 bp, Homo sapiens
gccggcaaaactttggcactg

SEQ ID NO: 2612474 - DNA, 12 bp, Homo sapiens
gccggccctggg

SEQ ID NO: 2612475 - DNA, 14 bp, Homo sapiens
gccggccctggggc

SEQ ID NO: 2612476 - DNA, 12 bp, Homo sapiens
gccggcctctct

SEQ ID NO: 2612477 - DNA, 13 bp, Homo sapiens
gccggctggaaat

SEQ ID NO: 2612478 - DNA, 22 bp, Homo sapiens
gccggctggaaatgctgggctg

SEQ ID NO: 2612479 - DNA, 21 bp, Homo sapiens
gccggggacagaggcctgccc

SEQ ID NO: 2612480 - DNA, 22 bp, Homo sapiens
gccgggtactgagagtctgcac

SEQ ID NO: 2612481 - DNA, 20 bp, Homo sapiens
gccggtctgcaagtcagagg

SEQ ID NO: 2612482 - DNA, 14 bp, Homo sapiens
gccggtttgagtga

SEQ ID NO: 2612483 - DNA, 15 bp, Homo sapiens
gccgtaccccaccct

SEQ ID NO: 2612484 - DNA, 19 bp, Homo sapiens
gccgtaccccaccctcagc

SEQ ID NO: 2612485 - DNA, 18 bp, Homo sapiens
gccgtcctcccgggccct

SEQ ID NO: 2612486 - DNA, 19 bp, Homo sapiens
gccgtcctcccgggccctc

SEQ ID NO: 2612487 - DNA, 20 bp, Homo sapiens
gccgtcctcccgggccctcc

SEQ ID NO: 2612488 - DNA, 21 bp, Homo sapiens
gccgtcctcccgggccctccc

SEQ ID NO: 2612489 - DNA, 15 bp, Homo sapiens
gccgtctacctgagg

SEQ ID NO: 2612490 - DNA, 20 bp, Homo sapiens
gccgtctacctgaggggcct

SEQ ID NO: 2612491 - DNA, 11 bp, Homo sapiens
gccgtctcaac

SEQ ID NO: 2612492 - DNA, 19 bp, Homo sapiens
gccgtcttcactcgccccc

SEQ ID NO: 2612493 - DNA, 18 bp, Homo sapiens
gccgtgagttctcagggc

SEQ ID NO: 2612494 - DNA, 15 bp, Homo sapiens
gccgtgatgcctccc

SEQ ID NO: 2612495 - DNA, 17 bp, Homo sapiens
gccgtgatgctcaggct

SEQ ID NO: 2612496 - DNA, 12 bp, Homo sapiens
gccgtgcccagg

SEQ ID NO: 2612497 - DNA, 14 bp, Homo sapiens
gccgtgcccagggg

SEQ ID NO: 2612498 - DNA, 14 bp, Homo sapiens
gccgtgccctgccc

SEQ ID NO: 2612499 - DNA, 20 bp, Homo sapiens
gccgtgtaaccatggaccca

SEQ ID NO: 2612500 - DNA, 17 bp, Homo sapiens
gccgttgatgttggctg

SEQ ID NO: 2612501 - DNA, 14 bp, Homo sapiens
gcctaaaaatgcaa

SEQ ID NO: 2612502 - DNA, 16 bp, Homo sapiens
gcctaaaagtaaacat

SEQ ID NO: 2612503 - DNA, 17 bp, Homo sapiens
gcctaagtgcagccccg

SEQ ID NO: 2612504 - DNA, 14 bp, Homo sapiens
gcctaatccctggg

SEQ ID NO: 2612505 - DNA, 13 bp, Homo sapiens
gcctacctgctct

SEQ ID NO: 2612506 - DNA, 20 bp, Homo sapiens
gcctagatccacacacagag

SEQ ID NO: 2612507 - DNA, 23 bp, Homo sapiens
gcctagatccacacacagaggaa

SEQ ID NO: 2612508 - DNA, 19 bp, Homo sapiens
gcctagcatacgtacacat

SEQ ID NO: 2612509 - DNA, 20 bp, Homo sapiens
gcctagcatacgtacacatt

SEQ ID NO: 2612510 - DNA, 21 bp, Homo sapiens
gcctagcatacgtacacattt

SEQ ID NO: 2612511 - DNA, 16 bp, Homo sapiens
gcctagccgacctcag

SEQ ID NO: 2612512 - DNA, 19 bp, Homo sapiens
gcctagccgacctcagcct

SEQ ID NO: 2612513 - DNA, 23 bp, Homo sapiens
gcctagctgctacaaagaagaca

SEQ ID NO: 2612514 - DNA, 24 bp, Homo sapiens
gcctagctgctacaaagaagacat

SEQ ID NO: 2612515 - DNA, 22 bp, Homo sapiens
gcctaggggtcagggaccaagg

SEQ ID NO: 2612516 - DNA, 14 bp, Homo sapiens
gcctaggtgacaga

SEQ ID NO: 2612517 - DNA, 19 bp, Homo sapiens
gcctagtcccttccacacc

SEQ ID NO: 2612518 - DNA, 22 bp, Homo sapiens
gcctagtgaaggcttctctctg

SEQ ID NO: 2612519 - DNA, 23 bp, Homo sapiens
gcctagtgaaggcttctctctgt

SEQ ID NO: 2612520 - DNA, 20 bp, Homo sapiens
gcctatgcacatatggactc

SEQ ID NO: 2612521 - DNA, 22 bp, Homo sapiens
gcctatgcacatatggactctg

SEQ ID NO: 2612522 - DNA, 17 bp, Homo sapiens
gcctcaaccctccctca

SEQ ID NO: 2612523 - DNA, 17 bp, Homo sapiens
gctatccatttctcatg

SEQ ID NO: 2612524 - DNA, 20 bp, Homo sapiens
gctatcctgccaaaatcatt

SEQ ID NO: 2612525 - DNA, 16 bp, Homo sapiens
gctatctcccccagcc

SEQ ID NO: 2612526 - DNA, 17 bp, Homo sapiens
gctatctcccccagccc

SEQ ID NO: 2612527 - DNA, 21 bp, Homo sapiens
gctatctcccccagccccatc

SEQ ID NO: 2612528 - DNA, 13 bp, Homo sapiens
gctatctctgtgt

SEQ ID NO: 2612529 - DNA, 20 bp, Homo sapiens
gctatctctgtgtgcacaaa

SEQ ID NO: 2612530 - DNA, 17 bp, Homo sapiens
gctatctggtcaacctc

SEQ ID NO: 2612531 - DNA, 14 bp, Homo sapiens
gctatcttaatttt

SEQ ID NO: 2612532 - DNA, 15 bp, Homo sapiens
gctatcttaattttg

SEQ ID NO: 2612533 - DNA, 16 bp, Homo sapiens
gctatcttaattttgg

SEQ ID NO: 2612534 - DNA, 12 bp, Homo sapiens
gctatgcatttg

SEQ ID NO: 2612535 - DNA, 13 bp, Homo sapiens
gctatgggagccc

SEQ ID NO: 2612536 - DNA, 14 bp, Homo sapiens
gctatgggagcccc

SEQ ID NO: 2612537 - DNA, 17 bp, Homo sapiens
gctatgggagccccagg

SEQ ID NO: 2612538 - DNA, 19 bp, Homo sapiens
gctatggggatagatgtgt

SEQ ID NO: 2612539 - DNA, 16 bp, Homo sapiens
gctatggtgagatgca

SEQ ID NO: 2612540 - DNA, 22 bp, Homo sapiens
gctatggtgagatgcagctgga

SEQ ID NO: 2612541 - DNA, 19 bp, Homo sapiens
gctatgttttgacattttt

SEQ ID NO: 2612542 - DNA, 13 bp, Homo sapiens
gctattagccagg

SEQ ID NO: 2612543 - DNA, 19 bp, Homo sapiens
gctattagccaggatcatg

SEQ ID NO: 2612544 - DNA, 21 bp, Homo sapiens
gctattagccaggatcatggt

SEQ ID NO: 2612545 - DNA, 18 bp, Homo sapiens
gctattattttcactgta

SEQ ID NO: 2612546 - DNA, 18 bp, Homo sapiens
gctattcagtaataactc

SEQ ID NO: 2612547 - DNA, 19 bp, Homo sapiens
gctattcagtaataactct

SEQ ID NO: 2612548 - DNA, 22 bp, Homo sapiens
gctattgatataaataaaacat

SEQ ID NO: 2612549 - DNA, 22 bp, Homo sapiens
gctattgtttctttaagaaagt

SEQ ID NO: 2612550 - DNA, 13 bp, Homo sapiens
gctatttaaaact

SEQ ID NO: 2612551 - DNA, 14 bp, Homo sapiens
gctatttcatctat

SEQ ID NO: 2612552 - DNA, 15 bp, Homo sapiens
gctatttcatctatt

SEQ ID NO: 2612553 - DNA, 22 bp, Homo sapiens
gctatttttatttgtttgtgca

SEQ ID NO: 2612554 - DNA, 14 bp, Homo sapiens
gctcaaaggcacag

SEQ ID NO: 2612555 - DNA, 20 bp, Homo sapiens
gctcaaatctattcagacaa

SEQ ID NO: 2612556 - DNA, 22 bp, Homo sapiens
gctcaaatctattcagacaagc

SEQ ID NO: 2612557 - DNA, 22 bp, Homo sapiens
gctcaagcagcgaccgccccct

SEQ ID NO: 2612558 - DNA, 19 bp, Homo sapiens
gctcaagcaggaagttcaa

SEQ ID NO: 2612559 - DNA, 13 bp, Homo sapiens
gctcaaggaaagg

SEQ ID NO: 2612560 - DNA, 17 bp, Homo sapiens
gctcaaggcgtgaggat

SEQ ID NO: 2612561 - DNA, 21 bp, Homo sapiens
gctcaatattcctgaatgaaa

SEQ ID NO: 2612562 - DNA, 14 bp, Homo sapiens
gctcaatcctctaa

SEQ ID NO: 2612563 - DNA, 14 bp, Homo sapiens
gctcacaaaccatg

SEQ ID NO: 2612564 - DNA, 15 bp, Homo sapiens
gctcacacatgagat

SEQ ID NO: 2612565 - DNA, 12 bp, Homo sapiens
gctcaccagccc

SEQ ID NO: 2612566 - DNA, 13 bp, Homo sapiens
gctcaccagcccc

SEQ ID NO: 2612567 - DNA, 15 bp, Homo sapiens
gctcaccagccccag

SEQ ID NO: 2612568 - DNA, 16 bp, Homo sapiens
gctcaccccccacact

SEQ ID NO: 2612569 - DNA, 18 bp, Homo sapiens
gctcacccccttctccat

SEQ ID NO: 2612570 - DNA, 14 bp, Homo sapiens
gctcacctctccct

SEQ ID NO: 2612571 - DNA, 16 bp, Homo sapiens
gctcacctctcccttg

SEQ ID NO: 2612572 - DNA, 17 bp, Homo sapiens
gctcacctctcccttgg

SEQ ID NO: 2612573 - DNA, 18 bp, Homo sapiens
gctcacctctcccttgga

SEQ ID NO: 2612574 - DNA, 13 bp, Homo sapiens
gctcacctggggt

SEQ ID NO: 2612575 - DNA, 20 bp, Homo sapiens
gctcacctgttgcttacaat

SEQ ID NO: 2612576 - DNA, 23 bp, Homo sapiens
gctcacctgttgcttacaatttt

SEQ ID NO: 2612577 - DNA, 21 bp, Homo sapiens
gctcacgcctatgatcccagc

SEQ ID NO: 2612578 - DNA, 23 bp, Homo sapiens
gctcacgcctgtaatcccagcac

SEQ ID NO: 2612579 - DNA, 13 bp, Homo sapiens
gctcacgtgtgtg

SEQ ID NO: 2612580 - DNA, 17 bp, Homo sapiens
gctcactatgaatctat

SEQ ID NO: 2612581 - DNA, 16 bp, Homo sapiens
gctcactatggtgcca

SEQ ID NO: 2612582 - DNA, 19 bp, Homo sapiens
gctcactgtggtgtctgtg

SEQ ID NO: 2612583 - DNA, 16 bp, Homo sapiens
gctcagagagggcagg

SEQ ID NO: 2612584 - DNA, 18 bp, Homo sapiens
gctcagagagggcaggca

SEQ ID NO: 2612585 - DNA, 22 bp, Homo sapiens
gctcagagagggtgggagtggg

SEQ ID NO: 2612586 - DNA, 14 bp, Homo sapiens
gctcagcccacccc

SEQ ID NO: 2612587 - DNA, 15 bp, Homo sapiens
gctcagcccaccccc

SEQ ID NO: 2612588 - DNA, 17 bp, Homo sapiens
gctcagcccacccccct

SEQ ID NO: 2612589 - DNA, 18 bp, Homo sapiens
gctcagcctggtgggcct

SEQ ID NO: 2612590 - DNA, 15 bp, Homo sapiens
gctcagcgccagcct

SEQ ID NO: 2612591 - DNA, 20 bp, Homo sapiens
gctcagcggggacagctcct

SEQ ID NO: 2612592 - DNA, 23 bp, Homo sapiens
gctcagcggggacagctccttct

SEQ ID NO: 2612593 - DNA, 13 bp, Homo sapiens
gctcaggaggctt

SEQ ID NO: 2612594 - DNA, 24 bp, Homo sapiens
gctcaggcgatccacctgtctcag

SEQ ID NO: 2612595 - DNA, 15 bp, Homo sapiens
gctcagggaaaagca

SEQ ID NO: 2612596 - DNA, 18 bp, Homo sapiens
gctcagggcctggctcag

SEQ ID NO: 2612597 - DNA, 19 bp, Homo sapiens
gctcagggcctggctcagg

SEQ ID NO: 2612598 - DNA, 20 bp, Homo sapiens
gctcaggggcgtgtggctca

SEQ ID NO: 2612599 - DNA, 14 bp, Homo sapiens
gctcaggtgtccct

SEQ ID NO: 2612600 - DNA, 17 bp, Homo sapiens
gctcaggtgtccctgca

SEQ ID NO: 2612601 - DNA, 16 bp, Homo sapiens
gctcagttctagtctc

SEQ ID NO: 2612602 - DNA, 19 bp, Homo sapiens
gctcatcattctctgtctc

SEQ ID NO: 2612603 - DNA, 14 bp, Homo sapiens
gctcatttcaggat

SEQ ID NO: 2612604 - DNA, 16 bp, Homo sapiens
gctccaaaccctcgag

SEQ ID NO: 2612605 - DNA, 17 bp, Homo sapiens
gctccaaaccctcgagg

SEQ ID NO: 2612606 - DNA, 19 bp, Homo sapiens
gctccaaaccctcgaggcg

SEQ ID NO: 2612607 - DNA, 18 bp, Homo sapiens
gctccaagacctgttggt

SEQ ID NO: 2612608 - DNA, 22 bp, Homo sapiens
gctccaagacctgttggttcca

SEQ ID NO: 2612609 - DNA, 13 bp, Homo sapiens
gctccaagctccc

SEQ ID NO: 2612610 - DNA, 22 bp, Homo sapiens
gctccacaccctctcccaggac

SEQ ID NO: 2612611 - DNA, 23 bp, Homo sapiens
gctccacaccctctcccaggacc

SEQ ID NO: 2612612 - DNA, 19 bp, Homo sapiens
gctccaccaagaaagcagg

SEQ ID NO: 2612613 - DNA, 11 bp, Homo sapiens
gctccaccctt

SEQ ID NO: 2612614 - DNA, 17 bp, Homo sapiens
gctccacccttggcctg

SEQ ID NO: 2612615 - DNA, 19 bp, Homo sapiens
gctccacccttggcctgtc

SEQ ID NO: 2612616 - DNA, 12 bp, Homo sapiens
gctccactgtca

SEQ ID NO: 2612617 - DNA, 21 bp, Homo sapiens
gctccagacacatgtccaaga

SEQ ID NO: 2612618 - DNA, 17 bp, Homo sapiens
gctccagccaacccctg

SEQ ID NO: 2612619 - DNA, 18 bp, Homo sapiens
gctccagccaacccctgt

SEQ ID NO: 2612620 - DNA, 21 bp, Homo sapiens
gctccagctgttcagctggtt

SEQ ID NO: 2612621 - DNA, 14 bp, Homo sapiens
gctccaggagcagc

SEQ ID NO: 2612622 - DNA, 13 bp, Homo sapiens
gctccaggcaggc

SEQ ID NO: 2612623 - DNA, 21 bp, Homo sapiens
gctccaggcaggctaaggcgt

SEQ ID NO: 2612624 - DNA, 17 bp, Homo sapiens
gctccagtctgctgccc

SEQ ID NO: 2612625 - DNA, 20 bp, Homo sapiens
gctccagtctgctgccctcc

SEQ ID NO: 2612626 - DNA, 14 bp, Homo sapiens
gctccatctccact

SEQ ID NO: 2612627 - DNA, 12 bp, Homo sapiens
gctcccaggaac

SEQ ID NO: 2612628 - DNA, 17 bp, Homo sapiens
gctcccaggcattcccc

SEQ ID NO: 2612629 - DNA, 22 bp, Homo sapiens
gctcccaggcattccccaggag

SEQ ID NO: 2612630 - DNA, 23 bp, Homo sapiens
gctcccaggccgagaagccagtg

SEQ ID NO: 2612631 - DNA, 20 bp, Homo sapiens
gctccccactgcctactgca

SEQ ID NO: 2612632 - DNA, 13 bp, Homo sapiens
gctccccagccca

SEQ ID NO: 2612633 - DNA, 14 bp, Homo sapiens
gctccccagcccag

SEQ ID NO: 2612634 - DNA, 14 bp, Homo sapiens
gctccccagccctg

SEQ ID NO: 2612635 - DNA, 18 bp, Homo sapiens
gctcccccatcctcccct

SEQ ID NO: 2612636 - DNA, 13 bp, Homo sapiens
gctcccctcctct

SEQ ID NO: 2612637 - DNA, 15 bp, Homo sapiens
gctcccctcggagaa

SEQ ID NO: 2612638 - DNA, 21 bp, Homo sapiens
gctcccctcggagaagagctg

SEQ ID NO: 2612639 - DNA, 19 bp, Homo sapiens
gctccctcccctgccctgg

SEQ ID NO: 2612640 - DNA, 20 bp, Homo sapiens
gctccctcccctgccctggt

SEQ ID NO: 2612641 - DNA, 18 bp, Homo sapiens
gctccctgactgggagtt

SEQ ID NO: 2612642 - DNA, 18 bp, Homo sapiens
gctcccttcccacctctc

SEQ ID NO: 2612643 - DNA, 19 bp, Homo sapiens
gctcccttcccacctctct

SEQ ID NO: 2612644 - DNA, 20 bp, Homo sapiens
gctcccttcccacctctctc

SEQ ID NO: 2612645 - DNA, 15 bp, Homo sapiens
gctcccttgtgcgtg

SEQ ID NO: 2612646 - DNA, 22 bp, Homo sapiens
gctccgctttctacccagcgag

SEQ ID NO: 2612647 - DNA, 23 bp, Homo sapiens
gctccgctttctacccagcgagc

SEQ ID NO: 2612648 - DNA, 24 bp, Homo sapiens
gctccgctttctacccagcgagcc

SEQ ID NO: 2612649 - DNA, 13 bp, Homo sapiens
gctccgtgcctcc

SEQ ID NO: 2612650 - DNA, 14 bp, Homo sapiens
gctccgtgcctcca

SEQ ID NO: 2612651 - DNA, 16 bp, Homo sapiens
gctccgtgcctccacc

SEQ ID NO: 2612652 - DNA, 15 bp, Homo sapiens
gctcctatctgtgtt

SEQ ID NO: 2612653 - DNA, 18 bp, Homo sapiens
gctcctcaactcacctaa

SEQ ID NO: 2612654 - DNA, 20 bp, Homo sapiens
gctcctccctctgaggctgt

SEQ ID NO: 2612655 - DNA, 22 bp, Homo sapiens
gctcctccctctgaggctgtag

SEQ ID NO: 2612656 - DNA, 21 bp, Homo sapiens
gctcctccctggctgccctgg

SEQ ID NO: 2612657 - DNA, 12 bp, Homo sapiens
gctcctctccag

SEQ ID NO: 2612658 - DNA, 13 bp, Homo sapiens
gctcctctccagg

SEQ ID NO: 2612659 - DNA, 19 bp, Homo sapiens
gctcctctccccagcaagt

SEQ ID NO: 2612660 - DNA, 17 bp, Homo sapiens
gctcctctcctggagga

SEQ ID NO: 2612661 - DNA, 13 bp, Homo sapiens
gctcctctgggca

SEQ ID NO: 2612662 - DNA, 18 bp, Homo sapiens
gctcctgccttctgtcct

SEQ ID NO: 2612663 - DNA, 19 bp, Homo sapiens
gctcctgccttctgtcctg

SEQ ID NO: 2612664 - DNA, 20 bp, Homo sapiens
gctcctgctccacagccatc

SEQ ID NO: 2612665 - DNA, 15 bp, Homo sapiens
gctcctggcccactg

SEQ ID NO: 2612666 - DNA, 19 bp, Homo sapiens
gctcctggcccactgcatc

SEQ ID NO: 2612667 - DNA, 19 bp, Homo sapiens
gctcctggtcttgagatgt

SEQ ID NO: 2612668 - DNA, 18 bp, Homo sapiens
gcttgagggttgggctgg

SEQ ID NO: 2612669 - DNA, 14 bp, Homo sapiens
gcttgatttttgcc

SEQ ID NO: 2612670 - DNA, 22 bp, Homo sapiens
gcttgcactttgtaacatgttt

SEQ ID NO: 2612671 - DNA, 16 bp, Homo sapiens
gcttgccacagagcgg

SEQ ID NO: 2612672 - DNA, 19 bp, Homo sapiens
gcttgccctggtgcctcac

SEQ ID NO: 2612673 - DNA, 21 bp, Homo sapiens
gcttgcctagggcctggtcca

SEQ ID NO: 2612674 - DNA, 13 bp, Homo sapiens
gcttgcctgcagg

SEQ ID NO: 2612675 - DNA, 14 bp, Homo sapiens
gcttgcctgcaggc

SEQ ID NO: 2612676 - DNA, 16 bp, Homo sapiens
gcttgcgtatgtctgt

SEQ ID NO: 2612677 - DNA, 13 bp, Homo sapiens
gcttgctgagagg

SEQ ID NO: 2612678 - DNA, 12 bp, Homo sapiens
gcttggactgga

SEQ ID NO: 2612679 - DNA, 16 bp, Homo sapiens
gcttggagcagagggg

SEQ ID NO: 2612680 - DNA, 13 bp, Homo sapiens
gcttggaggaagg

SEQ ID NO: 2612681 - DNA, 14 bp, Homo sapiens
gcttggaggaagga

SEQ ID NO: 2612682 - DNA, 15 bp, Homo sapiens
gcttggaggaaggaa

SEQ ID NO: 2612683 - DNA, 14 bp, Homo sapiens
gcttgggcccagct

SEQ ID NO: 2612684 - DNA, 19 bp, Homo sapiens
gcttgggcccagctgggct

SEQ ID NO: 2612685 - DNA, 20 bp, Homo sapiens
gcttgggcccagctgggctc

SEQ ID NO: 2612686 - DNA, 24 bp, Homo sapiens
gcttgggggatgactagaggcagg

SEQ ID NO: 2612687 - DNA, 14 bp, Homo sapiens
gcttgggtggagaa

SEQ ID NO: 2612688 - DNA, 21 bp, Homo sapiens
gcttgggtggagaagccattg

SEQ ID NO: 2612689 - DNA, 19 bp, Homo sapiens
gcttgggtgtaacaggtct

SEQ ID NO: 2612690 - DNA, 22 bp, Homo sapiens
gcttgggtgtaacaggtctcct

SEQ ID NO: 2612691 - DNA, 12 bp, Homo sapiens
gcttgtacataa

SEQ ID NO: 2612692 - DNA, 15 bp, Homo sapiens
gcttgtcagagctgg

SEQ ID NO: 2612693 - DNA, 14 bp, Homo sapiens
gcttgtgcacaatt

SEQ ID NO: 2612694 - DNA, 14 bp, Homo sapiens
gcttgtggagcccc

SEQ ID NO: 2612695 - DNA, 19 bp, Homo sapiens
gcttgtggagccccacact

SEQ ID NO: 2612696 - DNA, 11 bp, Homo sapiens
gcttgtgtatc

SEQ ID NO: 2612697 - DNA, 18 bp, Homo sapiens
gcttgtgtatccattatc

SEQ ID NO: 2612698 - DNA, 15 bp, Homo sapiens
gcttgtgtgtttcac

SEQ ID NO: 2612699 - DNA, 20 bp, Homo sapiens
gcttgtgtgtttcactttta

SEQ ID NO: 2612700 - DNA, 20 bp, Homo sapiens
gcttgttgggattcctgacc

SEQ ID NO: 2612701 - DNA, 21 bp, Homo sapiens
gcttgttgggattcctgaccc

SEQ ID NO: 2612702 - DNA, 22 bp, Homo sapiens
gcttgttgggattcctgaccca

SEQ ID NO: 2612703 - DNA, 23 bp, Homo sapiens
gcttgttgggattcctgacccag

SEQ ID NO: 2612704 - DNA, 16 bp, Homo sapiens
gctttaaactcaggga

SEQ ID NO: 2612705 - DNA, 18 bp, Homo sapiens
gctttaaactcagggaca

SEQ ID NO: 2612706 - DNA, 20 bp, Homo sapiens
gctttaatatcatcagtatt

SEQ ID NO: 2612707 - DNA, 23 bp, Homo sapiens
gctttaatatcatcagtattgaa

SEQ ID NO: 2612708 - DNA, 20 bp, Homo sapiens
gctttatacgtgtagctata

SEQ ID NO: 2612709 - DNA, 15 bp, Homo sapiens
gctttatgtaataat

SEQ ID NO: 2612710 - DNA, 13 bp, Homo sapiens
gctttattcttca

SEQ ID NO: 2612711 - DNA, 12 bp, Homo sapiens
gctttcagtatt

SEQ ID NO: 2612712 - DNA, 20 bp, Homo sapiens
gctttcatgtaaactgtgca

SEQ ID NO: 2612713 - DNA, 16 bp, Homo sapiens
gctttcccttatcaaa

SEQ ID NO: 2612714 - DNA, 19 bp, Homo sapiens
gctttcctcatcaggccat

SEQ ID NO: 2612715 - DNA, 11 bp, Homo sapiens
gctttcctgaa

SEQ ID NO: 2612716 - DNA, 22 bp, Homo sapiens
gctttctacccagcgagccctg

SEQ ID NO: 2612717 - DNA, 16 bp, Homo sapiens
gctttctgttgtcatt

SEQ ID NO: 2612718 - DNA, 13 bp, Homo sapiens
gctttcttgctgg

SEQ ID NO: 2612719 - DNA, 18 bp, Homo sapiens
gctttgattaatccagaa

SEQ ID NO: 2612720 - DNA, 21 bp, Homo sapiens
gctttgattaatccagaataa

SEQ ID NO: 2612721 - DNA, 23 bp, Homo sapiens
gctttgcatgttccactaacccc

SEQ ID NO: 2612722 - DNA, 20 bp, Homo sapiens
gctttgcattcctacaaaga

SEQ ID NO: 2612723 - DNA, 22 bp, Homo sapiens
gctttgccttccacgctgtctc

SEQ ID NO: 2612724 - DNA, 24 bp, Homo sapiens
gctttgccttccacgctgtctcca

SEQ ID NO: 2612725 - DNA, 13 bp, Homo sapiens
gctttgctctgcc

SEQ ID NO: 2612726 - DNA, 15 bp, Homo sapiens
gcttttattaatgca

SEQ ID NO: 2612727 - DNA, 16 bp, Homo sapiens
gcttttcccaaaagcc

SEQ ID NO: 2612728 - DNA, 22 bp, Homo sapiens
gcttttccttggggcaggcagt

SEQ ID NO: 2612729 - DNA, 23 bp, Homo sapiens
gcttttccttggggcaggcagtg

SEQ ID NO: 2612730 - DNA, 19 bp, Homo sapiens
gcttttgtgcattatctag

SEQ ID NO: 2612731 - DNA, 21 bp, Homo sapiens
gctttttaattgttgtttctt

SEQ ID NO: 2612732 - DNA, 19 bp, Homo sapiens
ggaaaaaatgttggattta

SEQ ID NO: 2612733 - DNA, 13 bp, Homo sapiens
ggaaaaatattta

SEQ ID NO: 2612734 - DNA, 19 bp, Homo sapiens
ggaaaagcggacatcagct

SEQ ID NO: 2612735 - DNA, 20 bp, Homo sapiens
ggaaaaggcagggagcgagg

SEQ ID NO: 2612736 - DNA, 20 bp, Homo sapiens
ggaaaagggtcttgggaaat

SEQ ID NO: 2612737 - DNA, 14 bp, Homo sapiens
ggaaaataaattat

SEQ ID NO: 2612738 - DNA, 22 bp, Homo sapiens
ggaaaataccccatcattcatg

SEQ ID NO: 2612739 - DNA, 19 bp, Homo sapiens
ggaaaatcagcctgctcca

SEQ ID NO: 2612740 - DNA, 23 bp, Homo sapiens
ggaaaatcagcctgctccagctg

SEQ ID NO: 2612741 - DNA, 19 bp, Homo sapiens
ggaaaatctctttttgact

SEQ ID NO: 2612742 - DNA, 16 bp, Homo sapiens
ggaaaatgcattgtat

SEQ ID NO: 2612743 - DNA, 12 bp, Homo sapiens
ggaaaattattt

SEQ ID NO: 2612744 - DNA, 18 bp, Homo sapiens
ggaaaattttaaaaatac

SEQ ID NO: 2612745 - DNA, 23 bp, Homo sapiens
ggaaacaaagcttagcaggagag

SEQ ID NO: 2612746 - DNA, 22 bp, Homo sapiens
ggaaacagactcgattcatatt

SEQ ID NO: 2612747 - DNA, 15 bp, Homo sapiens
ggaaacaggaccaca

SEQ ID NO: 2612748 - DNA, 14 bp, Homo sapiens
ggaaacctgccctg

SEQ ID NO: 2612749 - DNA, 18 bp, Homo sapiens
ggaaacctgccctgcctg

SEQ ID NO: 2612750 - DNA, 15 bp, Homo sapiens
ggaaaccttggtgta

SEQ ID NO: 2612751 - DNA, 22 bp, Homo sapiens
ggaaactcacctgctggcccct

SEQ ID NO: 2612752 - DNA, 20 bp, Homo sapiens
ggaaagacttttccaaccct

SEQ ID NO: 2612753 - DNA, 15 bp, Homo sapiens
ggaaagcaataaatg

SEQ ID NO: 2612754 - DNA, 16 bp, Homo sapiens
ggaaagcacaggtggg

SEQ ID NO: 2612755 - DNA, 17 bp, Homo sapiens
ggaaagcacaggtgggc

SEQ ID NO: 2612756 - DNA, 13 bp, Homo sapiens
ggaaagcctctgc

SEQ ID NO: 2612757 - DNA, 12 bp, Homo sapiens
ggaaaggaattg

SEQ ID NO: 2612758 - DNA, 21 bp, Homo sapiens
ggaaaggagtagaaaaagcag

SEQ ID NO: 2612759 - DNA, 20 bp, Homo sapiens
ggaaaggcaaatgcccaagg

SEQ ID NO: 2612760 - DNA, 20 bp, Homo sapiens
ggaaaggctccaggagcagc

SEQ ID NO: 2612761 - DNA, 18 bp, Homo sapiens
ggaaaggggggagctggg

SEQ ID NO: 2612762 - DNA, 22 bp, Homo sapiens
ggaaagggggtcccagtgggag

SEQ ID NO: 2612763 - DNA, 14 bp, Homo sapiens
ggaaagtgtaaagc

SEQ ID NO: 2612764 - DNA, 16 bp, Homo sapiens
ggaaagtgtaaagcat

SEQ ID NO: 2612765 - DNA, 16 bp, Homo sapiens
ggaaataaaacctttc

SEQ ID NO: 2612766 - DNA, 19 bp, Homo sapiens
ggaaataaaacctttcaaa

SEQ ID NO: 2612767 - DNA, 20 bp, Homo sapiens
ggaaataaaacctttcaaat

SEQ ID NO: 2612768 - DNA, 22 bp, Homo sapiens
ggaaataaaacctttcaaattt

SEQ ID NO: 2612769 - DNA, 20 bp, Homo sapiens
ggaaataataaagatgctct

SEQ ID NO: 2612770 - DNA, 14 bp, Homo sapiens
ggaaatatatatgt

SEQ ID NO: 2612771 - DNA, 14 bp, Homo sapiens
ggaaatatgaatgc

SEQ ID NO: 2612772 - DNA, 17 bp, Homo sapiens
ggaaatatttagcaaat

SEQ ID NO: 2612773 - DNA, 15 bp, Homo sapiens
ggaaatgaaagaaag

SEQ ID NO: 2612774 - DNA, 18 bp, Homo sapiens
ggaaatgggcagagcaga

SEQ ID NO: 2612775 - DNA, 19 bp, Homo sapiens
ggaaatggtatgagctgag

SEQ ID NO: 2612776 - DNA, 19 bp, Homo sapiens
ggaaattaagaagaaacta

SEQ ID NO: 2612777 - DNA, 19 bp, Homo sapiens
ggaaattcccttcatctgg

SEQ ID NO: 2612778 - DNA, 22 bp, Homo sapiens
ggaaattcccttcatctggaac

SEQ ID NO: 2612779 - DNA, 18 bp, Homo sapiens
ggaacaaggagtcagaca

SEQ ID NO: 2612780 - DNA, 13 bp, Homo sapiens
ggaacaatctaaa

SEQ ID NO: 2612781 - DNA, 21 bp, Homo sapiens
ggaacagacaacagaagtcat

SEQ ID NO: 2612782 - DNA, 23 bp, Homo sapiens
ggaacagtgtttcccataatttt

SEQ ID NO: 2612783 - DNA, 19 bp, Homo sapiens
ggaaccagagccatggact

SEQ ID NO: 2612784 - DNA, 18 bp, Homo sapiens
ggaaccatgaagacagga

SEQ ID NO: 2612785 - DNA, 18 bp, Homo sapiens
ggaaccgcaggaagctgc

SEQ ID NO: 2612786 - DNA, 12 bp, Homo sapiens
ggaacctccttt

SEQ ID NO: 2612787 - DNA, 18 bp, Homo sapiens
ggaacggggtccttcaag

SEQ ID NO: 2612788 - DNA, 19 bp, Homo sapiens
ggaactctggcttccaggt

SEQ ID NO: 2612789 - DNA, 20 bp, Homo sapiens
ggaactctggcttccaggta

SEQ ID NO: 2612790 - DNA, 20 bp, Homo sapiens
ggaactgctgggcttggcag

SEQ ID NO: 2612791 - DNA, 14 bp, Homo sapiens
ggaactgtccagag

SEQ ID NO: 2612792 - DNA, 15 bp, Homo sapiens
ggaactgtccagaga

SEQ ID NO: 2612793 - DNA, 19 bp, Homo sapiens
ggaagaaagagaaggagcc

SEQ ID NO: 2612794 - DNA, 16 bp, Homo sapiens
ggaagaaattcctgta

SEQ ID NO: 2612795 - DNA, 13 bp, Homo sapiens
ggaagaacataga

SEQ ID NO: 2612796 - DNA, 14 bp, Homo sapiens
ggaagaacatagaa

SEQ ID NO: 2612797 - DNA, 14 bp, Homo sapiens
ggaagaattttaaa

SEQ ID NO: 2612798 - DNA, 19 bp, Homo sapiens
ggaagaattttaaaaatga

SEQ ID NO: 2612799 - DNA, 22 bp, Homo sapiens
ggaagacaatgtgaaaagaaaa

SEQ ID NO: 2612800 - DNA, 12 bp, Homo sapiens
ggaagacagaga

SEQ ID NO: 2612801 - DNA, 19 bp, Homo sapiens
ggaagaccccacccaagct

SEQ ID NO: 2612802 - DNA, 15 bp, Homo sapiens
ggaagacgaggccct

SEQ ID NO: 2612803 - DNA, 16 bp, Homo sapiens
ggaagacgaggccctc

SEQ ID NO: 2612804 - DNA, 15 bp, Homo sapiens
ggaagacgcctgagc

SEQ ID NO: 2612805 - DNA, 12 bp, Homo sapiens
ggaagactttgg

SEQ ID NO: 2612806 - DNA, 13 bp, Homo sapiens
ggaagactttgga

SEQ ID NO: 2612807 - DNA, 17 bp, Homo sapiens
ggaagactttggaaaga

SEQ ID NO: 2612808 - DNA, 18 bp, Homo sapiens
ggaagactttggaaagag

SEQ ID NO: 2612809 - DNA, 18 bp, Homo sapiens
ggaagagaggagttcaat

SEQ ID NO: 2612810 - DNA, 20 bp, Homo sapiens
ggaagagaggagttcaatga

SEQ ID NO: 2612811 - DNA, 21 bp, Homo sapiens
ggaagagaggagttcaatgat

SEQ ID NO: 2612812 - DNA, 15 bp, Homo sapiens
ggatggcgggtgggg

SEQ ID NO: 2612813 - DNA, 23 bp, Homo sapiens
ggatggcgggtgggggtggaata

SEQ ID NO: 2612814 - DNA, 12 bp, Homo sapiens
ggatgggaagga

SEQ ID NO: 2612815 - DNA, 16 bp, Homo sapiens
ggatgggctgcagcag

SEQ ID NO: 2612816 - DNA, 13 bp, Homo sapiens
ggatggtgccctg

SEQ ID NO: 2612817 - DNA, 18 bp, Homo sapiens
ggatgtccacagatgcct

SEQ ID NO: 2612818 - DNA, 13 bp, Homo sapiens
ggatgtcttcctt

SEQ ID NO: 2612819 - DNA, 23 bp, Homo sapiens
ggatgtggctgcagcagcggtgg

SEQ ID NO: 2612820 - DNA, 15 bp, Homo sapiens
ggatgtgggagggag

SEQ ID NO: 2612821 - DNA, 16 bp, Homo sapiens
ggatgtggtggcagtg

SEQ ID NO: 2612822 - DNA, 23 bp, Homo sapiens
ggatgttttaattccatgaatcg

SEQ ID NO: 2612823 - DNA, 22 bp, Homo sapiens
ggattaatggtcctgtgatgct

SEQ ID NO: 2612824 - DNA, 18 bp, Homo sapiens
ggattattttttcagacc

SEQ ID NO: 2612825 - DNA, 23 bp, Homo sapiens
ggattctactttaagcactacat

SEQ ID NO: 2612826 - DNA, 21 bp, Homo sapiens
ggattctggcctagtcccttc

SEQ ID NO: 2612827 - DNA, 18 bp, Homo sapiens
ggattctttccattatga

SEQ ID NO: 2612828 - DNA, 16 bp, Homo sapiens
ggattgaagccctcca

SEQ ID NO: 2612829 - DNA, 17 bp, Homo sapiens
ggattgcttgagcccag

SEQ ID NO: 2612830 - DNA, 16 bp, Homo sapiens
ggattggattatttaa

SEQ ID NO: 2612831 - DNA, 22 bp, Homo sapiens
ggattggattatttaataacat

SEQ ID NO: 2612832 - DNA, 20 bp, Homo sapiens
ggattggcttgtgtgtttca

SEQ ID NO: 2612833 - DNA, 12 bp, Homo sapiens
ggattggggaag

SEQ ID NO: 2612834 - DNA, 18 bp, Homo sapiens
ggattgggggctggtgcc

SEQ ID NO: 2612835 - DNA, 22 bp, Homo sapiens
ggattgtaaaaaaaaatgcctt

SEQ ID NO: 2612836 - DNA, 13 bp, Homo sapiens
ggattgtccccga

SEQ ID NO: 2612837 - DNA, 15 bp, Homo sapiens
ggattgttcctgtca

SEQ ID NO: 2612838 - DNA, 21 bp, Homo sapiens
ggatttaacagtcatttaaaa

SEQ ID NO: 2612839 - DNA, 20 bp, Homo sapiens
ggatttcatgatttcatttc

SEQ ID NO: 2612840 - DNA, 14 bp, Homo sapiens
ggatttcgtgggtc

SEQ ID NO: 2612841 - DNA, 14 bp, Homo sapiens
ggatttgccccttc

SEQ ID NO: 2612842 - DNA, 15 bp, Homo sapiens
ggcaaaaaggcagga

SEQ ID NO: 2612843 - DNA, 16 bp, Homo sapiens
ggcaaaatccttgctt

SEQ ID NO: 2612844 - DNA, 17 bp, Homo sapiens
ggcaaacttcagactga

SEQ ID NO: 2612845 - DNA, 22 bp, Homo sapiens
ggcaaagcacgaaatgttattt

SEQ ID NO: 2612846 - DNA, 20 bp, Homo sapiens
ggcaaagggagcagaactga

SEQ ID NO: 2612847 - DNA, 13 bp, Homo sapiens
ggcaaatgacttt

SEQ ID NO: 2612848 - DNA, 16 bp, Homo sapiens
ggcaaatgcccaaggg

SEQ ID NO: 2612849 - DNA, 16 bp, Homo sapiens
ggcaaattaacttgag

SEQ ID NO: 2612850 - DNA, 20 bp, Homo sapiens
ggcaaattaacttgagtttt

SEQ ID NO: 2612851 - DNA, 20 bp, Homo sapiens
ggcaaccacaggcagcattt

SEQ ID NO: 2612852 - DNA, 18 bp, Homo sapiens
ggcaaccccagttctgct

SEQ ID NO: 2612853 - DNA, 16 bp, Homo sapiens
ggcaacccccagcctg

SEQ ID NO: 2612854 - DNA, 19 bp, Homo sapiens
ggcaaccttgtctctatgc

SEQ ID NO: 2612855 - DNA, 14 bp, Homo sapiens
ggcaactgaggcag

SEQ ID NO: 2612856 - DNA, 23 bp, Homo sapiens
ggcaacttgggaactagactccc

SEQ ID NO: 2612857 - DNA, 19 bp, Homo sapiens
ggcaagcacctcctgcctc

SEQ ID NO: 2612858 - DNA, 23 bp, Homo sapiens
ggcaagctgtgacttctccaggt

SEQ ID NO: 2612859 - DNA, 16 bp, Homo sapiens
ggcaaggacacagatg

SEQ ID NO: 2612860 - DNA, 22 bp, Homo sapiens
ggcaaggcaggtgcctccaggt

SEQ ID NO: 2612861 - DNA, 22 bp, Homo sapiens
ggcaagtccctgactctctgtg

SEQ ID NO: 2612862 - DNA, 18 bp, Homo sapiens
ggcaatctattaatagct

SEQ ID NO: 2612863 - DNA, 17 bp, Homo sapiens
ggcacacgcctcccact

SEQ ID NO: 2612864 - DNA, 18 bp, Homo sapiens
ggcacacgcctcccactg

SEQ ID NO: 2612865 - DNA, 15 bp, Homo sapiens
ggcacaggccccctt

SEQ ID NO: 2612866 - DNA, 17 bp, Homo sapiens
ggcacagtatgtcccat

SEQ ID NO: 2612867 - DNA, 13 bp, Homo sapiens
ggcacatcagcac

SEQ ID NO: 2612868 - DNA, 21 bp, Homo sapiens
ggcacatcctatgcaatatat

SEQ ID NO: 2612869 - DNA, 12 bp, Homo sapiens
ggcaccagaggc

SEQ ID NO: 2612870 - DNA, 19 bp, Homo sapiens
ggcaccagaggctgcagaa

SEQ ID NO: 2612871 - DNA, 13 bp, Homo sapiens
ggcacccaccctg

SEQ ID NO: 2612872 - DNA, 20 bp, Homo sapiens
ggcacccagtgagcactccc

SEQ ID NO: 2612873 - DNA, 15 bp, Homo sapiens
ggcaccccctggaga

SEQ ID NO: 2612874 - DNA, 12 bp, Homo sapiens
ggcacccttctt

SEQ ID NO: 2612875 - DNA, 17 bp, Homo sapiens
ggcacccttctttcctc

SEQ ID NO: 2612876 - DNA, 18 bp, Homo sapiens
ggcacctatagtcccagc

SEQ ID NO: 2612877 - DNA, 19 bp, Homo sapiens
ggcacctatagtcccagct

SEQ ID NO: 2612878 - DNA, 18 bp, Homo sapiens
ggcactcaatgcagccag

SEQ ID NO: 2612879 - DNA, 23 bp, Homo sapiens
ggcactcaatgcagccagaccta

SEQ ID NO: 2612880 - DNA, 12 bp, Homo sapiens
ggcactgagccc

SEQ ID NO: 2612881 - DNA, 20 bp, Homo sapiens
ggcactgcttccagtgaggc

SEQ ID NO: 2612882 - DNA, 24 bp, Homo sapiens
ggcactgcttccagtgaggctctg

SEQ ID NO: 2612883 - DNA, 21 bp, Homo sapiens
ggcactgggatgagccgctgt

SEQ ID NO: 2612884 - DNA, 13 bp, Homo sapiens
ggcacttcacaga

SEQ ID NO: 2612885 - DNA, 14 bp, Homo sapiens
ggcacttcacagag

SEQ ID NO: 2612886 - DNA, 14 bp, Homo sapiens
ggcagaacagccgc

SEQ ID NO: 2612887 - DNA, 20 bp, Homo sapiens
ggcagaacagccgctcctgt

SEQ ID NO: 2612888 - DNA, 15 bp, Homo sapiens
ggcagaactgagctc

SEQ ID NO: 2612889 - DNA, 16 bp, Homo sapiens
ggcagaagacaccaga

SEQ ID NO: 2612890 - DNA, 17 bp, Homo sapiens
ggcagaaggcaaaccca

SEQ ID NO: 2612891 - DNA, 16 bp, Homo sapiens
ggcagaaggccaagag

SEQ ID NO: 2612892 - DNA, 23 bp, Homo sapiens
ggcagaatgctagctctgagcca

SEQ ID NO: 2612893 - DNA, 16 bp, Homo sapiens
ggcagacagcagctca

SEQ ID NO: 2612894 - DNA, 20 bp, Homo sapiens
ggcagacagcagctcaggca

SEQ ID NO: 2612895 - DNA, 14 bp, Homo sapiens
ggcagagaaagaag

SEQ ID NO: 2612896 - DNA, 17 bp, Homo sapiens
ggcagagcttggactgg

SEQ ID NO: 2612897 - DNA, 18 bp, Homo sapiens
ggcagaggttcatttcaa

SEQ ID NO: 2612898 - DNA, 18 bp, Homo sapiens
ggcagataatcagcctct

SEQ ID NO: 2612899 - DNA, 19 bp, Homo sapiens
ggcagataatcagcctctt

SEQ ID NO: 2612900 - DNA, 17 bp, Homo sapiens
ggcagatctgtgcccca

SEQ ID NO: 2612901 - DNA, 13 bp, Homo sapiens
ggcagattgaaaa

SEQ ID NO: 2612902 - DNA, 13 bp, Homo sapiens
ggcagcagccatc

SEQ ID NO: 2612903 - DNA, 21 bp, Homo sapiens
ggcagcagggctaccctgagc

SEQ ID NO: 2612904 - DNA, 19 bp, Homo sapiens
ggcagcagtgtgaggccag

SEQ ID NO: 2612905 - DNA, 19 bp, Homo sapiens
ggcagccaaacccatgagg

SEQ ID NO: 2612906 - DNA, 13 bp, Homo sapiens
ggcagccaggcca

SEQ ID NO: 2612907 - DNA, 13 bp, Homo sapiens
ggcagccaggctg

SEQ ID NO: 2612908 - DNA, 15 bp, Homo sapiens
ggcagccaggctgcc

SEQ ID NO: 2612909 - DNA, 23 bp, Homo sapiens
ggcagccccattctgcctgccca

SEQ ID NO: 2612910 - DNA, 13 bp, Homo sapiens
ggcagccctgtag

SEQ ID NO: 2612911 - DNA, 13 bp, Homo sapiens
ggcagccgagctc

SEQ ID NO: 2612912 - DNA, 23 bp, Homo sapiens
ggcagcgccaagcaacctgggtc

SEQ ID NO: 2612913 - DNA, 12 bp, Homo sapiens
ggcagctcacct

SEQ ID NO: 2612914 - DNA, 16 bp, Homo sapiens
ggcagctcacctctcc

SEQ ID NO: 2612915 - DNA, 22 bp, Homo sapiens
ggcagctcacctctcccttgga

SEQ ID NO: 2612916 - DNA, 15 bp, Homo sapiens
ggcagctcatctctg

SEQ ID NO: 2612917 - DNA, 14 bp, Homo sapiens
ggcagctgccagag

SEQ ID NO: 2612918 - DNA, 17 bp, Homo sapiens
ggcagctgccagagaag

SEQ ID NO: 2612919 - DNA, 19 bp, Homo sapiens
ggcagctgcggtccaccca

SEQ ID NO: 2612920 - DNA, 22 bp, Homo sapiens
ggcagctgcttttgtctatggg

SEQ ID NO: 2612921 - DNA, 16 bp, Homo sapiens
ggcagctggatgagac

SEQ ID NO: 2612922 - DNA, 12 bp, Homo sapiens
ggcagctgggcc

SEQ ID NO: 2612923 - DNA, 13 bp, Homo sapiens
ggcagcttgcccc

SEQ ID NO: 2612924 - DNA, 23 bp, Homo sapiens
ggcaggaaggagagcctgctgca

SEQ ID NO: 2612925 - DNA, 14 bp, Homo sapiens
ggcaggaaggctga

SEQ ID NO: 2612926 - DNA, 18 bp, Homo sapiens
ggcaggacaacgaggaag

SEQ ID NO: 2612927 - DNA, 15 bp, Homo sapiens
ggcaggacctcagag

SEQ ID NO: 2612928 - DNA, 14 bp, Homo sapiens
ggcaggagggccct

SEQ ID NO: 2612929 - DNA, 14 bp, Homo sapiens
ggcaggcagcgcca

SEQ ID NO: 2612930 - DNA, 10 bp, Homo sapiens
ggcaggcagt

SEQ ID NO: 2612931 - DNA, 17 bp, Homo sapiens
ggcaggctaaggcgtgg

SEQ ID NO: 2612932 - DNA, 18 bp, Homo sapiens
ggcaggctagaacctggc

SEQ ID NO: 2612933 - DNA, 22 bp, Homo sapiens
ggcaggctgtctggccaggcct

SEQ ID NO: 2612934 - DNA, 23 bp, Homo sapiens
ggcagggaaggggaggcagccgg

SEQ ID NO: 2612935 - DNA, 14 bp, Homo sapiens
ggcagggaccacac

SEQ ID NO: 2612936 - DNA, 13 bp, Homo sapiens
ggcagggagggga

SEQ ID NO: 2612937 - DNA, 15 bp, Homo sapiens
ggcagggcatctcct

SEQ ID NO: 2612938 - DNA, 17 bp, Homo sapiens
ggcagggccagggggtg

SEQ ID NO: 2612939 - DNA, 16 bp, Homo sapiens
ggcagggccccaggca

SEQ ID NO: 2612940 - DNA, 15 bp, Homo sapiens
ggcagggctcaggat

SEQ ID NO: 2612941 - DNA, 13 bp, Homo sapiens
ggcagggctctga

SEQ ID NO: 2612942 - DNA, 14 bp, Homo sapiens
ggcagggctctgat

SEQ ID NO: 2612943 - DNA, 15 bp, Homo sapiens
ggcagggctgactct

SEQ ID NO: 2612944 - DNA, 15 bp, Homo sapiens
ggcagggctgaggcc

SEQ ID NO: 2612945 - DNA, 15 bp, Homo sapiens
ggcagggtcaggaga

SEQ ID NO: 2612946 - DNA, 17 bp, Homo sapiens
ggcagggtcaggagagg

SEQ ID NO: 2612947 - DNA, 12 bp, Homo sapiens
ggcagggtccta

SEQ ID NO: 2612948 - DNA, 16 bp, Homo sapiens
ggcaggtgaccttctg

SEQ ID NO: 2612949 - DNA, 13 bp, Homo sapiens
ggcaggtgcctcc

SEQ ID NO: 2612950 - DNA, 18 bp, Homo sapiens
ggcaggtgcctccaggtg

SEQ ID NO: 2612951 - DNA, 20 bp, Homo sapiens
ggcaggttagaacctagaag

SEQ ID NO: 2612952 - DNA, 15 bp, Homo sapiens
ggcaggttggtgggg

SEQ ID NO: 2612953 - DNA, 14 bp, Homo sapiens
ggcagtaataaaaa

SEQ ID NO: 2612954 - DNA, 19 bp, Homo sapiens
ggcagtcgatagagctgta

SEQ ID NO: 2612955 - DNA, 19 bp, Homo sapiens
ggcagtcgggggctggcct

SEQ ID NO: 2612956 - DNA, 21 bp, Homo sapiens
ggcagtcgggggctggcctag

SEQ ID NO: 2612957 - DNA, 19 bp, Homo sapiens
ggctgctggcgcctctgca

SEQ ID NO: 2612958 - DNA, 14 bp, Homo sapiens
ggctgcttggcctt

SEQ ID NO: 2612959 - DNA, 14 bp, Homo sapiens
ggctggaatctgga

SEQ ID NO: 2612960 - DNA, 16 bp, Homo sapiens
ggctggacctatgtcc

SEQ ID NO: 2612961 - DNA, 19 bp, Homo sapiens
ggctggagtgcagtggcgt

SEQ ID NO: 2612962 - DNA, 17 bp, Homo sapiens
ggctggatctgtgaggg

SEQ ID NO: 2612963 - DNA, 21 bp, Homo sapiens
ggctggattttgaattttctt

SEQ ID NO: 2612964 - DNA, 16 bp, Homo sapiens
ggctggcagctctcca

SEQ ID NO: 2612965 - DNA, 21 bp, Homo sapiens
ggctggccactgcacagagct

SEQ ID NO: 2612966 - DNA, 17 bp, Homo sapiens
ggctggcccagccctgc

SEQ ID NO: 2612967 - DNA, 20 bp, Homo sapiens
ggctggcccagccctgctgg

SEQ ID NO: 2612968 - DNA, 19 bp, Homo sapiens
ggctggcctctggctctca

SEQ ID NO: 2612969 - DNA, 14 bp, Homo sapiens
ggctggccttcctg

SEQ ID NO: 2612970 - DNA, 21 bp, Homo sapiens
ggctggcgcagccaaggccga

SEQ ID NO: 2612971 - DNA, 16 bp, Homo sapiens
ggctggcgtgcagtgg

SEQ ID NO: 2612972 - DNA, 13 bp, Homo sapiens
ggctggctgggca

SEQ ID NO: 2612973 - DNA, 13 bp, Homo sapiens
ggctgggagagcc

SEQ ID NO: 2612974 - DNA, 23 bp, Homo sapiens
ggctgggagtagttgtctttcct

SEQ ID NO: 2612975 - DNA, 17 bp, Homo sapiens
ggctgggcaaggaggcc

SEQ ID NO: 2612976 - DNA, 13 bp, Homo sapiens
ggctgggcagcta

SEQ ID NO: 2612977 - DNA, 14 bp, Homo sapiens
ggctgggcccagaa

SEQ ID NO: 2612978 - DNA, 17 bp, Homo sapiens
ggctgggctcccttccc

SEQ ID NO: 2612979 - DNA, 18 bp, Homo sapiens
ggctgggctcccttccca

SEQ ID NO: 2612980 - DNA, 21 bp, Homo sapiens
ggctgggctcccttcccacct

SEQ ID NO: 2612981 - DNA, 11 bp, Homo sapiens
ggctgggcttc

SEQ ID NO: 2612982 - DNA, 21 bp, Homo sapiens
ggctggggaagtcctctgggt

SEQ ID NO: 2612983 - DNA, 16 bp, Homo sapiens
ggctggggctgacctt

SEQ ID NO: 2612984 - DNA, 16 bp, Homo sapiens
ggctgggggaagaagc

SEQ ID NO: 2612985 - DNA, 17 bp, Homo sapiens
ggctgggggcaggaggg

SEQ ID NO: 2612986 - DNA, 14 bp, Homo sapiens
ggctgggggcctca

SEQ ID NO: 2612987 - DNA, 17 bp, Homo sapiens
ggctggtagctcaggtg

SEQ ID NO: 2612988 - DNA, 16 bp, Homo sapiens
ggctggtgtcacctga

SEQ ID NO: 2612989 - DNA, 23 bp, Homo sapiens
ggctggttttgtaagatgctggg

SEQ ID NO: 2612990 - DNA, 15 bp, Homo sapiens
ggctgtagaaggaga

SEQ ID NO: 2612991 - DNA, 23 bp, Homo sapiens
ggctgtatcccatgagcctcagc

SEQ ID NO: 2612992 - DNA, 16 bp, Homo sapiens
ggctgtcagcaggaag

SEQ ID NO: 2612993 - DNA, 17 bp, Homo sapiens
ggctgtcagcaggaagc

SEQ ID NO: 2612994 - DNA, 23 bp, Homo sapiens
ggctgtccagttcccagaaggca

SEQ ID NO: 2612995 - DNA, 18 bp, Homo sapiens
ggctgtcttctcaggctc

SEQ ID NO: 2612996 - DNA, 19 bp, Homo sapiens
ggctgtcttctcaggctct

SEQ ID NO: 2612997 - DNA, 22 bp, Homo sapiens
ggctgtcttctcaggctctgcc

SEQ ID NO: 2612998 - DNA, 23 bp, Homo sapiens
ggctgtcttctcaggctctgccc

SEQ ID NO: 2612999 - DNA, 22 bp, Homo sapiens
ggctgtgggcctcaaggacttg

SEQ ID NO: 2613000 - DNA, 24 bp, Homo sapiens
ggctgtggtagggggtgtctcagg

SEQ ID NO: 2613001 - DNA, 20 bp, Homo sapiens
ggctgtgttctggtgaggcc

SEQ ID NO: 2613002 - DNA, 14 bp, Homo sapiens
ggctgttctggaag

SEQ ID NO: 2613003 - DNA, 13 bp, Homo sapiens
ggctgttgcatgg

SEQ ID NO: 2613004 - DNA, 12 bp, Homo sapiens
ggctgttggcac

SEQ ID NO: 2613005 - DNA, 17 bp, Homo sapiens
ggcttacacgtggagga

SEQ ID NO: 2613006 - DNA, 21 bp, Homo sapiens
ggcttagacttcgactcagga

SEQ ID NO: 2613007 - DNA, 15 bp, Homo sapiens
ggcttagtcactgag

SEQ ID NO: 2613008 - DNA, 16 bp, Homo sapiens
ggcttatccagctggt

SEQ ID NO: 2613009 - DNA, 18 bp, Homo sapiens
ggcttcactgtataaata

SEQ ID NO: 2613010 - DNA, 18 bp, Homo sapiens
ggcttcaggggagtcccg

SEQ ID NO: 2613011 - DNA, 15 bp, Homo sapiens
ggcttcagtggcagc

SEQ ID NO: 2613012 - DNA, 19 bp, Homo sapiens
ggcttcagtggcagctgct

SEQ ID NO: 2613013 - DNA, 16 bp, Homo sapiens
ggcttcatgccagcta

SEQ ID NO: 2613014 - DNA, 13 bp, Homo sapiens
ggcttccagagag

SEQ ID NO: 2613015 - DNA, 22 bp, Homo sapiens
ggcttccagagagtcctctgga

SEQ ID NO: 2613016 - DNA, 21 bp, Homo sapiens
ggcttccaggtatctccagga

SEQ ID NO: 2613017 - DNA, 18 bp, Homo sapiens
ggcttccatttgtgtgtg

SEQ ID NO: 2613018 - DNA, 17 bp, Homo sapiens
ggcttcccagtggctgc

SEQ ID NO: 2613019 - DNA, 19 bp, Homo sapiens
ggcttcccagtggctgctg

SEQ ID NO: 2613020 - DNA, 21 bp, Homo sapiens
ggcttcctcagttcctgccct

SEQ ID NO: 2613021 - DNA, 12 bp, Homo sapiens
ggcttcctcctc

SEQ ID NO: 2613022 - DNA, 12 bp, Homo sapiens
ggcttcctttct

SEQ ID NO: 2613023 - DNA, 20 bp, Homo sapiens
ggcttctcatacgtccacca

SEQ ID NO: 2613024 - DNA, 14 bp, Homo sapiens
ggcttctgcaccct

SEQ ID NO: 2613025 - DNA, 16 bp, Homo sapiens
ggcttctgcaccctcc

SEQ ID NO: 2613026 - DNA, 20 bp, Homo sapiens
ggcttctgcaccctccaccc

SEQ ID NO: 2613027 - DNA, 22 bp, Homo sapiens
ggcttctgcaccctccaccctg

SEQ ID NO: 2613028 - DNA, 23 bp, Homo sapiens
ggcttgcaagtatgttttagcat

SEQ ID NO: 2613029 - DNA, 15 bp, Homo sapiens
ggcttgctgagaggg

SEQ ID NO: 2613030 - DNA, 17 bp, Homo sapiens
ggcttgtcagagctggg

SEQ ID NO: 2613031 - DNA, 11 bp, Homo sapiens
ggctttcatgt

SEQ ID NO: 2613032 - DNA, 13 bp, Homo sapiens
ggctttctggaga

SEQ ID NO: 2613033 - DNA, 14 bp, Homo sapiens
ggctttctggagag

SEQ ID NO: 2613034 - DNA, 14 bp, Homo sapiens
ggctttgccagctt

SEQ ID NO: 2613035 - DNA, 22 bp, Homo sapiens
gggaacagactggaagcacagc

SEQ ID NO: 2613036 - DNA, 12 bp, Homo sapiens
gggaaccctgct

SEQ ID NO: 2613037 - DNA, 22 bp, Homo sapiens
gggaactcacctggggctgctg

SEQ ID NO: 2613038 - DNA, 18 bp, Homo sapiens
gggaagaagctctctcct

SEQ ID NO: 2613039 - DNA, 11 bp, Homo sapiens
gggaagagagg

SEQ ID NO: 2613040 - DNA, 14 bp, Homo sapiens
gggaagagggggcg

SEQ ID NO: 2613041 - DNA, 22 bp, Homo sapiens
gggaagcagaatagcaaggtgc

SEQ ID NO: 2613042 - DNA, 17 bp, Homo sapiens
gggaaggaactctggct

SEQ ID NO: 2613043 - DNA, 17 bp, Homo sapiens
gggaaggaggctggctt

SEQ ID NO: 2613044 - DNA, 13 bp, Homo sapiens
gggaaggatacaa

SEQ ID NO: 2613045 - DNA, 21 bp, Homo sapiens
gggaaggatacaaaagcatgt

SEQ ID NO: 2613046 - DNA, 23 bp, Homo sapiens
gggaaggatacaaaagcatgtga

SEQ ID NO: 2613047 - DNA, 14 bp, Homo sapiens
gggaagggacacac

SEQ ID NO: 2613048 - DNA, 16 bp, Homo sapiens
gggaagggggctggga

SEQ ID NO: 2613049 - DNA, 17 bp, Homo sapiens
gggaagtgaggaagcca

SEQ ID NO: 2613050 - DNA, 14 bp, Homo sapiens
gggaatgaggcttg

SEQ ID NO: 2613051 - DNA, 21 bp, Homo sapiens
gggaatgcctgagtgcctggc

SEQ ID NO: 2613052 - DNA, 15 bp, Homo sapiens
gggaatggcagctgc

SEQ ID NO: 2613053 - DNA, 19 bp, Homo sapiens
gggaatgtttgcctctgcc

SEQ ID NO: 2613054 - DNA, 14 bp, Homo sapiens
gggaattgtgtgat

SEQ ID NO: 2613055 - DNA, 18 bp, Homo sapiens
gggacaccagccaggctc

SEQ ID NO: 2613056 - DNA, 22 bp, Homo sapiens
gggacaccagccaggctctgtg

SEQ ID NO: 2613057 - DNA, 14 bp, Homo sapiens
gggacaccctgtga

SEQ ID NO: 2613058 - DNA, 17 bp, Homo sapiens
gggacacctgccctgcc

SEQ ID NO: 2613059 - DNA, 13 bp, Homo sapiens
gggacagagcaga

SEQ ID NO: 2613060 - DNA, 18 bp, Homo sapiens
gggacagaggcctgcccg

SEQ ID NO: 2613061 - DNA, 21 bp, Homo sapiens
gggacagctccttctgtccta

SEQ ID NO: 2613062 - DNA, 13 bp, Homo sapiens
gggacagggctgg

SEQ ID NO: 2613063 - DNA, 22 bp, Homo sapiens
gggacagggctggcccagccct

SEQ ID NO: 2613064 - DNA, 17 bp, Homo sapiens
gggaccaaggcaaggca

SEQ ID NO: 2613065 - DNA, 14 bp, Homo sapiens
gggaccagccaaga

SEQ ID NO: 2613066 - DNA, 18 bp, Homo sapiens
gggacccaggcacctgca

SEQ ID NO: 2613067 - DNA, 18 bp, Homo sapiens
gggacccccgccccctgc

SEQ ID NO: 2613068 - DNA, 21 bp, Homo sapiens
gggacccccgccccctgccct

SEQ ID NO: 2613069 - DNA, 16 bp, Homo sapiens
gggaccccgagcctgg

SEQ ID NO: 2613070 - DNA, 18 bp, Homo sapiens
gggaccccgagcctggct

SEQ ID NO: 2613071 - DNA, 20 bp, Homo sapiens
gggaccccgagcctggctcc

SEQ ID NO: 2613072 - DNA, 21 bp, Homo sapiens
gggacctggtaccctcctggc

SEQ ID NO: 2613073 - DNA, 15 bp, Homo sapiens
gggacctttagtggt

SEQ ID NO: 2613074 - DNA, 21 bp, Homo sapiens
gggacgcctgggggtgccagg

SEQ ID NO: 2613075 - DNA, 22 bp, Homo sapiens
gggacgcctgggggtgccagga

SEQ ID NO: 2613076 - DNA, 21 bp, Homo sapiens
gggacggggggccccagtcag

SEQ ID NO: 2613077 - DNA, 16 bp, Homo sapiens
gggactcaatgcactg

SEQ ID NO: 2613078 - DNA, 19 bp, Homo sapiens
gggactcaatgcactgaca

SEQ ID NO: 2613079 - DNA, 23 bp, Homo sapiens
gggactcaatgcactgacattgt

SEQ ID NO: 2613080 - DNA, 14 bp, Homo sapiens
gggactgagccagt

SEQ ID NO: 2613081 - DNA, 17 bp, Homo sapiens
gggactgagccagtccc

SEQ ID NO: 2613082 - DNA, 20 bp, Homo sapiens
gggactggggatgtgggagg

SEQ ID NO: 2613083 - DNA, 20 bp, Homo sapiens
gggactgggtttggacccca

SEQ ID NO: 2613084 - DNA, 14 bp, Homo sapiens
gggacttcttttca

SEQ ID NO: 2613085 - DNA, 15 bp, Homo sapiens
gggacttggaagctc

SEQ ID NO: 2613086 - DNA, 18 bp, Homo sapiens
gggacttggaagctccgc

SEQ ID NO: 2613087 - DNA, 16 bp, Homo sapiens
gggagaaattgacaga

SEQ ID NO: 2613088 - DNA, 22 bp, Homo sapiens
gggagaatgtcagtatgtggaa

SEQ ID NO: 2613089 - DNA, 20 bp, Homo sapiens
gggagactgggctgagggag

SEQ ID NO: 2613090 - DNA, 12 bp, Homo sapiens
gggagagacctc

SEQ ID NO: 2613091 - DNA, 22 bp, Homo sapiens
gggagagacctcatcaggatga

SEQ ID NO: 2613092 - DNA, 12 bp, Homo sapiens
gggagagagaga

SEQ ID NO: 2613093 - DNA, 15 bp, Homo sapiens
gggagagcaggctgg

SEQ ID NO: 2613094 - DNA, 23 bp, Homo sapiens
gggagagcaggctggcagctctc

SEQ ID NO: 2613095 - DNA, 17 bp, Homo sapiens
gggagagtgcaggcctg

SEQ ID NO: 2613096 - DNA, 19 bp, Homo sapiens
gggagatggatcaatcaaa

SEQ ID NO: 2613097 - DNA, 16 bp, Homo sapiens
gggagcactggagtgc

SEQ ID NO: 2613098 - DNA, 16 bp, Homo sapiens
gggagcagacaggagg

SEQ ID NO: 2613099 - DNA, 21 bp, Homo sapiens
gggagcaggcggtgggcaccc

SEQ ID NO: 2613100 - DNA, 15 bp, Homo sapiens
gggagcagggaggtc

SEQ ID NO: 2613101 - DNA, 20 bp, Homo sapiens
gggtggagaactcctagggt

SEQ ID NO: 2613102 - DNA, 16 bp, Homo sapiens
gggtggagaagccatt

SEQ ID NO: 2613103 - DNA, 19 bp, Homo sapiens
gggtggcaccagcagcctg

SEQ ID NO: 2613104 - DNA, 19 bp, Homo sapiens
gggtgggacaccctgtgat

SEQ ID NO: 2613105 - DNA, 19 bp, Homo sapiens
gggtgggagagcccagcca

SEQ ID NO: 2613106 - DNA, 12 bp, Homo sapiens
gggtgggcctct

SEQ ID NO: 2613107 - DNA, 16 bp, Homo sapiens
gggtggggtagggctg

SEQ ID NO: 2613108 - DNA, 13 bp, Homo sapiens
gggtggtcctgac

SEQ ID NO: 2613109 - DNA, 16 bp, Homo sapiens
gggtggtctgcaggca

SEQ ID NO: 2613110 - DNA, 23 bp, Homo sapiens
gggtgtatttattttcctcccca

SEQ ID NO: 2613111 - DNA, 16 bp, Homo sapiens
gggtgtgggaggcccg

SEQ ID NO: 2613112 - DNA, 23 bp, Homo sapiens
gggttcaagcgattcttctgctt

SEQ ID NO: 2613113 - DNA, 19 bp, Homo sapiens
gggttcagaaatgctgcct

SEQ ID NO: 2613114 - DNA, 21 bp, Homo sapiens
gggttcagaaatgctgcctgc

SEQ ID NO: 2613115 - DNA, 14 bp, Homo sapiens
gggttcctcttccc

SEQ ID NO: 2613116 - DNA, 15 bp, Homo sapiens
gggttctcacagtgg

SEQ ID NO: 2613117 - DNA, 19 bp, Homo sapiens
gggttctttcttcctctgc

SEQ ID NO: 2613118 - DNA, 21 bp, Homo sapiens
gggttgagcagggatcctggt

SEQ ID NO: 2613119 - DNA, 12 bp, Homo sapiens
gggttgggccca

SEQ ID NO: 2613120 - DNA, 15 bp, Homo sapiens
gggttgggctggtgt

SEQ ID NO: 2613121 - DNA, 21 bp, Homo sapiens
gggttgggttcatctgagcaa

SEQ ID NO: 2613122 - DNA, 21 bp, Homo sapiens
gggttgtgaggcctggccagg

SEQ ID NO: 2613123 - DNA, 15 bp, Homo sapiens
gggttgtgtgtctgt

SEQ ID NO: 2613124 - DNA, 20 bp, Homo sapiens
gggtttcaccatgttggcca

SEQ ID NO: 2613125 - DNA, 20 bp, Homo sapiens
gggtttcactgtgttagcca

SEQ ID NO: 2613126 - DNA, 19 bp, Homo sapiens
gggtttggaccccagctgg

SEQ ID NO: 2613127 - DNA, 20 bp, Homo sapiens
gggtttggcgggccaaggac

SEQ ID NO: 2613128 - DNA, 16 bp, Homo sapiens
gggttttccaccctgg

SEQ ID NO: 2613129 - DNA, 20 bp, Homo sapiens
ggtaaataccaagtatttat

SEQ ID NO: 2613130 - DNA, 22 bp, Homo sapiens
ggtaaatttccccaacagtgtg

SEQ ID NO: 2613131 - DNA, 14 bp, Homo sapiens
ggtaacagaacagc

SEQ ID NO: 2613132 - DNA, 15 bp, Homo sapiens
ggtaacagaacagct

SEQ ID NO: 2613133 - DNA, 13 bp, Homo sapiens
ggtaacaggcaga

SEQ ID NO: 2613134 - DNA, 21 bp, Homo sapiens
ggtaacagttcatgtttgctt

SEQ ID NO: 2613135 - DNA, 23 bp, Homo sapiens
ggtaagaagccgggaacagacaa

SEQ ID NO: 2613136 - DNA, 20 bp, Homo sapiens
ggtaagcacttaatgaatga

SEQ ID NO: 2613137 - DNA, 20 bp, Homo sapiens
ggtaaggaatacctgtcccc

SEQ ID NO: 2613138 - DNA, 19 bp, Homo sapiens
ggtaataagtactgtgtac

SEQ ID NO: 2613139 - DNA, 23 bp, Homo sapiens
ggtaattattttggtacttttat

SEQ ID NO: 2613140 - DNA, 16 bp, Homo sapiens
ggtacccactgctctg

SEQ ID NO: 2613141 - DNA, 17 bp, Homo sapiens
ggtacccactgctctgg

SEQ ID NO: 2613142 - DNA, 21 bp, Homo sapiens
ggtacccagccatctgcccag

SEQ ID NO: 2613143 - DNA, 19 bp, Homo sapiens
ggtacccctttctggctct

SEQ ID NO: 2613144 - DNA, 12 bp, Homo sapiens
ggtaccttgaac

SEQ ID NO: 2613145 - DNA, 18 bp, Homo sapiens
ggtaccttgaacactggg

SEQ ID NO: 2613146 - DNA, 22 bp, Homo sapiens
ggtacttgtggacacagctctt

SEQ ID NO: 2613147 - DNA, 21 bp, Homo sapiens
ggtacttttatgatgtatatt

SEQ ID NO: 2613148 - DNA, 19 bp, Homo sapiens
ggtagagattcattatttt

SEQ ID NO: 2613149 - DNA, 15 bp, Homo sapiens
ggtagagctgatcca

SEQ ID NO: 2613150 - DNA, 17 bp, Homo sapiens
ggtagagctgatccaga

SEQ ID NO: 2613151 - DNA, 21 bp, Homo sapiens
ggtagagctgatccagagcac

SEQ ID NO: 2613152 - DNA, 12 bp, Homo sapiens
ggtagcagctgg

SEQ ID NO: 2613153 - DNA, 13 bp, Homo sapiens
ggtagcagctgga

SEQ ID NO: 2613154 - DNA, 17 bp, Homo sapiens
ggtagctcaggtgggcg

SEQ ID NO: 2613155 - DNA, 19 bp, Homo sapiens
ggtagctgcccctggctct

SEQ ID NO: 2613156 - DNA, 16 bp, Homo sapiens
ggtaggaactgctggg

SEQ ID NO: 2613157 - DNA, 18 bp, Homo sapiens
ggtaggaactgctgggct

SEQ ID NO: 2613158 - DNA, 19 bp, Homo sapiens
ggtaggaggtttggatggg

SEQ ID NO: 2613159 - DNA, 14 bp, Homo sapiens
ggtaggcagagcct

SEQ ID NO: 2613160 - DNA, 19 bp, Homo sapiens
ggtaggtggcacactgggt

SEQ ID NO: 2613161 - DNA, 23 bp, Homo sapiens
ggtagtactcctgcaaaatttta

SEQ ID NO: 2613162 - DNA, 18 bp, Homo sapiens
ggtagttgcaattgaatt

SEQ ID NO: 2613163 - DNA, 20 bp, Homo sapiens
ggtataatggttgactgggt

SEQ ID NO: 2613164 - DNA, 13 bp, Homo sapiens
ggtatagaaatgc

SEQ ID NO: 2613165 - DNA, 14 bp, Homo sapiens
ggtatctccaggat

SEQ ID NO: 2613166 - DNA, 16 bp, Homo sapiens
ggtatgagctgagggg

SEQ ID NO: 2613167 - DNA, 14 bp, Homo sapiens
ggtatgtgtgtgta

SEQ ID NO: 2613168 - DNA, 14 bp, Homo sapiens
ggtattagaaagtg

SEQ ID NO: 2613169 - DNA, 14 bp, Homo sapiens
ggtattcctgcctc

SEQ ID NO: 2613170 - DNA, 22 bp, Homo sapiens
ggtcaaaccgcactcacccatg

SEQ ID NO: 2613171 - DNA, 20 bp, Homo sapiens
ggtcaagattttgaatgctt

SEQ ID NO: 2613172 - DNA, 18 bp, Homo sapiens
ggtcacaggactctgcct

SEQ ID NO: 2613173 - DNA, 16 bp, Homo sapiens
ggtcaccagctcctcc

SEQ ID NO: 2613174 - DNA, 16 bp, Homo sapiens
ggtcactctggcagct

SEQ ID NO: 2613175 - DNA, 22 bp, Homo sapiens
ggtcactctggcagctcagaga

SEQ ID NO: 2613176 - DNA, 14 bp, Homo sapiens
ggtcactgctgtca

SEQ ID NO: 2613177 - DNA, 16 bp, Homo sapiens
ggtcactggctctcca

SEQ ID NO: 2613178 - DNA, 14 bp, Homo sapiens
ggtcagagcctgca

SEQ ID NO: 2613179 - DNA, 17 bp, Homo sapiens
ggtcagggaccaaggac

SEQ ID NO: 2613180 - DNA, 19 bp, Homo sapiens
ggtcaggtgttcaagacca

SEQ ID NO: 2613181 - DNA, 16 bp, Homo sapiens
ggtcagtctggtggga

SEQ ID NO: 2613182 - DNA, 23 bp, Homo sapiens
ggtcatagcccagatcagctcct

SEQ ID NO: 2613183 - DNA, 15 bp, Homo sapiens
ggtcatttatgaaaa

SEQ ID NO: 2613184 - DNA, 16 bp, Homo sapiens
ggtccacccaggagcc

SEQ ID NO: 2613185 - DNA, 17 bp, Homo sapiens
ggtccacccaggagccc

SEQ ID NO: 2613186 - DNA, 14 bp, Homo sapiens
ggtccaccccatgt

SEQ ID NO: 2613187 - DNA, 17 bp, Homo sapiens
ggtccagccctggctga

SEQ ID NO: 2613188 - DNA, 21 bp, Homo sapiens
ggtccagggaagctggccgag

SEQ ID NO: 2613189 - DNA, 12 bp, Homo sapiens
ggtccagggagc

SEQ ID NO: 2613190 - DNA, 17 bp, Homo sapiens
ggtccaggggcccctcc

SEQ ID NO: 2613191 - DNA, 14 bp, Homo sapiens
ggtccatgggcaga

SEQ ID NO: 2613192 - DNA, 15 bp, Homo sapiens
ggtcccaagctgggc

SEQ ID NO: 2613193 - DNA, 16 bp, Homo sapiens
ggtcccaagctgggcc

SEQ ID NO: 2613194 - DNA, 19 bp, Homo sapiens
ggtcccaagctgggcccca

SEQ ID NO: 2613195 - DNA, 17 bp, Homo sapiens
ggtcccaccccacacac

SEQ ID NO: 2613196 - DNA, 15 bp, Homo sapiens
ggtcccagccacccc

SEQ ID NO: 2613197 - DNA, 14 bp, Homo sapiens
ggtcccaggcagag

SEQ ID NO: 2613198 - DNA, 18 bp, Homo sapiens
ggtcccagtgggaggggc

SEQ ID NO: 2613199 - DNA, 19 bp, Homo sapiens
ggtcccagtgggaggggca

SEQ ID NO: 2613200 - DNA, 21 bp, Homo sapiens
ggtcccagtgggaggggcagg

SEQ ID NO: 2613201 - DNA, 22 bp, Homo sapiens
ggtcccagtgggaggggcaggc

SEQ ID NO: 2613202 - DNA, 16 bp, Homo sapiens
ggtcccatccaggcag

SEQ ID NO: 2613203 - DNA, 22 bp, Homo sapiens
ggtccctgataacaacctggag

SEQ ID NO: 2613204 - DNA, 13 bp, Homo sapiens
ggtccctgggagg

SEQ ID NO: 2613205 - DNA, 23 bp, Homo sapiens
ggtcccttgcagctagttttcta

SEQ ID NO: 2613206 - DNA, 21 bp, Homo sapiens
ggtccggacactcctagagaa

SEQ ID NO: 2613207 - DNA, 23 bp, Homo sapiens
ggtcctagaaattccccaccctg

SEQ ID NO: 2613208 - DNA, 21 bp, Homo sapiens
ggtcctcagagaatttctacc

SEQ ID NO: 2613209 - DNA, 13 bp, Homo sapiens
ggtcctgagacct

SEQ ID NO: 2613210 - DNA, 17 bp, Homo sapiens
ggtcctgagggtcccca

SEQ ID NO: 2613211 - DNA, 12 bp, Homo sapiens
ggtcctggggcc

SEQ ID NO: 2613212 - DNA, 12 bp, Homo sapiens
ggtcctggggct

SEQ ID NO: 2613213 - DNA, 22 bp, Homo sapiens
ggtcctggggctctgtgcaggg

SEQ ID NO: 2613214 - DNA, 14 bp, Homo sapiens
ggtcctgtggcagg

SEQ ID NO: 2613215 - DNA, 17 bp, Homo sapiens
ggtcctgtggcaggcag

SEQ ID NO: 2613216 - DNA, 22 bp, Homo sapiens
ggtcctgtggcaggcagcgcca

SEQ ID NO: 2613217 - DNA, 20 bp, Homo sapiens
ggtccttggtgtgaccctct

SEQ ID NO: 2613218 - DNA, 21 bp, Homo sapiens
ggtcctttgggaaaggagaag

SEQ ID NO: 2613219 - DNA, 13 bp, Homo sapiens
ggtcggaaaacat

SEQ ID NO: 2613220 - DNA, 17 bp, Homo sapiens
ggtctattgtctgtatt

SEQ ID NO: 2613221 - DNA, 17 bp, Homo sapiens
ggtctcaaactcctgac

SEQ ID NO: 2613222 - DNA, 23 bp, Homo sapiens
ggtctcaaactcctgggctcagg

SEQ ID NO: 2613223 - DNA, 19 bp, Homo sapiens
ggtctcacagtgttgccca

SEQ ID NO: 2613224 - DNA, 22 bp, Homo sapiens
ggtctcactatgttgcccaggc

SEQ ID NO: 2613225 - DNA, 16 bp, Homo sapiens
ggtctcactctgtcgc

SEQ ID NO: 2613226 - DNA, 22 bp, Homo sapiens
ggtctcactctgtcgcccagtc

SEQ ID NO: 2613227 - DNA, 16 bp, Homo sapiens
ggtctccttggaaatc

SEQ ID NO: 2613228 - DNA, 22 bp, Homo sapiens
ggtctgaggggcaactgagtct

SEQ ID NO: 2613229 - DNA, 20 bp, Homo sapiens
ggtctgagtcatggccgggt

SEQ ID NO: 2613230 - DNA, 13 bp, Homo sapiens
ggtctgcaggcag

SEQ ID NO: 2613231 - DNA, 18 bp, Homo sapiens
ggtctgtgtctcttttct

SEQ ID NO: 2613232 - DNA, 19 bp, Homo sapiens
ggtctgtgtctcttttctc

SEQ ID NO: 2613233 - DNA, 17 bp, Homo sapiens
ggtctgtgtgtgtgtat

SEQ ID NO: 2613234 - DNA, 20 bp, Homo sapiens
ggtctgtgtgtgtgtatgtg

SEQ ID NO: 2613235 - DNA, 12 bp, Homo sapiens
ggtctgttcttt

SEQ ID NO: 2613236 - DNA, 17 bp, Homo sapiens
ggtctgttctttccaaa

SEQ ID NO: 2613237 - DNA, 20 bp, Homo sapiens
ggtctgttttcctttctcac

SEQ ID NO: 2613238 - DNA, 17 bp, Homo sapiens
ggtcttcccaggctggg

SEQ ID NO: 2613239 - DNA, 17 bp, Homo sapiens
ggtcttccctacctcag

SEQ ID NO: 2613240 - DNA, 22 bp, Homo sapiens
ggtcttccctacctcaggcagg

SEQ ID NO: 2613241 - DNA, 18 bp, Homo sapiens
ggtcttggagctgagcct

SEQ ID NO: 2613242 - DNA, 23 bp, Homo sapiens
ggtcttggagctgagcctctcac

SEQ ID NO: 2613243 - DNA, 13 bp, Homo sapiens
ggtcttgggaaat

SEQ ID NO: 2613244 - DNA, 20 bp, Homo sapiens
ggtcttgggaaatatgaatg

SEQ ID NO: 2613245 - DNA, 16 bp, Homo sapiens
gtatcagaggcctata

SEQ ID NO: 2613246 - DNA, 21 bp, Homo sapiens
gtatcaggaaatatatatgtg

SEQ ID NO: 2613247 - DNA, 21 bp, Homo sapiens
gtatcaggacccagaggaagg

SEQ ID NO: 2613248 - DNA, 18 bp, Homo sapiens
gtatcaggtgctgccatc

SEQ ID NO: 2613249 - DNA, 15 bp, Homo sapiens
gtatcatagaaatgt

SEQ ID NO: 2613250 - DNA, 14 bp, Homo sapiens
gtatcatgaagcct

SEQ ID NO: 2613251 - DNA, 19 bp, Homo sapiens
gtatccactttgcacagct

SEQ ID NO: 2613252 - DNA, 17 bp, Homo sapiens
gtatccattatcatgtg

SEQ ID NO: 2613253 - DNA, 18 bp, Homo sapiens
gtatccattatcatgtgt

SEQ ID NO: 2613254 - DNA, 19 bp, Homo sapiens
gtatccattatcatgtgta

SEQ ID NO: 2613255 - DNA, 21 bp, Homo sapiens
gtatccattatcatgtgtaat

SEQ ID NO: 2613256 - DNA, 19 bp, Homo sapiens
gtatcccatgagcctcagc

SEQ ID NO: 2613257 - DNA, 21 bp, Homo sapiens
gtatcccatgagcctcagcat

SEQ ID NO: 2613258 - DNA, 19 bp, Homo sapiens
gtatcctccaggtttttca

SEQ ID NO: 2613259 - DNA, 21 bp, Homo sapiens
gtatcctccaggtttttcaat

SEQ ID NO: 2613260 - DNA, 15 bp, Homo sapiens
gtatcgatgttatgt

SEQ ID NO: 2613261 - DNA, 15 bp, Homo sapiens
gtatcgtaaccagcc

SEQ ID NO: 2613262 - DNA, 17 bp, Homo sapiens
gtatcgtaaccagccag

SEQ ID NO: 2613263 - DNA, 13 bp, Homo sapiens
gtatctagtgcag

SEQ ID NO: 2613264 - DNA, 16 bp, Homo sapiens
gtatctagtgcagctg

SEQ ID NO: 2613265 - DNA, 20 bp, Homo sapiens
gtatctatatatgtgtatgt

SEQ ID NO: 2613266 - DNA, 14 bp, Homo sapiens
gtatctccaggatt

SEQ ID NO: 2613267 - DNA, 15 bp, Homo sapiens
gtatctgttctttaa

SEQ ID NO: 2613268 - DNA, 22 bp, Homo sapiens
gtatgaaagatggctgtgcctc

SEQ ID NO: 2613269 - DNA, 23 bp, Homo sapiens
gtatgaaagatggctgtgcctct

SEQ ID NO: 2613270 - DNA, 20 bp, Homo sapiens
gtatgactaaagagagaatg

SEQ ID NO: 2613271 - DNA, 21 bp, Homo sapiens
gtatgagtcaatgtgcagtgt

SEQ ID NO: 2613272 - DNA, 17 bp, Homo sapiens
gtatgatgtgttgtgat

SEQ ID NO: 2613273 - DNA, 17 bp, Homo sapiens
gtatggaatacagtgtt

SEQ ID NO: 2613274 - DNA, 18 bp, Homo sapiens
gtatggaatacagtgtta

SEQ ID NO: 2613275 - DNA, 15 bp, Homo sapiens
gtatggagctcagag

SEQ ID NO: 2613276 - DNA, 22 bp, Homo sapiens
gtatggcactggcattgtccct

SEQ ID NO: 2613277 - DNA, 21 bp, Homo sapiens
gtatgggttagggaaaacatt

SEQ ID NO: 2613278 - DNA, 13 bp, Homo sapiens
gtatggtggctgg

SEQ ID NO: 2613279 - DNA, 14 bp, Homo sapiens
gtatggtggctggg

SEQ ID NO: 2613280 - DNA, 14 bp, Homo sapiens
gtatgtaaacagga

SEQ ID NO: 2613281 - DNA, 15 bp, Homo sapiens
gtatgtataattcaa

SEQ ID NO: 2613282 - DNA, 17 bp, Homo sapiens
gtatgtggaagtgtggg

SEQ ID NO: 2613283 - DNA, 18 bp, Homo sapiens
gtatgtggaagtgtgggt

SEQ ID NO: 2613284 - DNA, 20 bp, Homo sapiens
gtatgtgggggtctgtgtgt

SEQ ID NO: 2613285 - DNA, 14 bp, Homo sapiens
gtatgtgtgtatgg

SEQ ID NO: 2613286 - DNA, 15 bp, Homo sapiens
gtatgtgtgtgtatg

SEQ ID NO: 2613287 - DNA, 18 bp, Homo sapiens
gtatgtgtgtgtatgcta

SEQ ID NO: 2613288 - DNA, 17 bp, Homo sapiens
gtatgtgtttgtgtgtg

SEQ ID NO: 2613289 - DNA, 21 bp, Homo sapiens
gtattactagaagatgaatac

SEQ ID NO: 2613290 - DNA, 19 bp, Homo sapiens
gtattataggccaaactgg

SEQ ID NO: 2613291 - DNA, 16 bp, Homo sapiens
gtattatgtctcttct

SEQ ID NO: 2613292 - DNA, 15 bp, Homo sapiens
gtattattctgcagc

SEQ ID NO: 2613293 - DNA, 20 bp, Homo sapiens
gtattccttttgtgtacagt

SEQ ID NO: 2613294 - DNA, 23 bp, Homo sapiens
gtattccttttgtgtacagtgtg

SEQ ID NO: 2613295 - DNA, 22 bp, Homo sapiens
gtattcttctcttccttttatc

SEQ ID NO: 2613296 - DNA, 18 bp, Homo sapiens
gtattctttgatgttaac

SEQ ID NO: 2613297 - DNA, 23 bp, Homo sapiens
gtattctttgatgttaacacatt

SEQ ID NO: 2613298 - DNA, 12 bp, Homo sapiens
gtattgaatcat

SEQ ID NO: 2613299 - DNA, 17 bp, Homo sapiens
gtattgaatcatgtagt

SEQ ID NO: 2613300 - DNA, 14 bp, Homo sapiens
gtattggcctggag

SEQ ID NO: 2613301 - DNA, 11 bp, Homo sapiens
gtattgttccc

SEQ ID NO: 2613302 - DNA, 18 bp, Homo sapiens
gtattgttcccagtgaca

SEQ ID NO: 2613303 - DNA, 15 bp, Homo sapiens
gtatttattccatat

SEQ ID NO: 2613304 - DNA, 22 bp, Homo sapiens
gtatttattccatattcatgta

SEQ ID NO: 2613305 - DNA, 21 bp, Homo sapiens
gtatttatttaaaagattcat

SEQ ID NO: 2613306 - DNA, 18 bp, Homo sapiens
gtatttattttcctcccc

SEQ ID NO: 2613307 - DNA, 23 bp, Homo sapiens
gtatttattttcctccccagcag

SEQ ID NO: 2613308 - DNA, 13 bp, Homo sapiens
gtatttcaaattg

SEQ ID NO: 2613309 - DNA, 12 bp, Homo sapiens
gtatttgtttgc

SEQ ID NO: 2613310 - DNA, 16 bp, Homo sapiens
gtattttccaagtgtg

SEQ ID NO: 2613311 - DNA, 13 bp, Homo sapiens
gtattttctttct

SEQ ID NO: 2613312 - DNA, 15 bp, Homo sapiens
gtattttctttctct

SEQ ID NO: 2613313 - DNA, 18 bp, Homo sapiens
gtattttgtattgtttca

SEQ ID NO: 2613314 - DNA, 19 bp, Homo sapiens
gtattttgtttttgtctta

SEQ ID NO: 2613315 - DNA, 22 bp, Homo sapiens
gtattttgtttttgtcttaaaa

SEQ ID NO: 2613316 - DNA, 17 bp, Homo sapiens
gtatttttttactaata

SEQ ID NO: 2613317 - DNA, 15 bp, Homo sapiens
gtcaaaagctggatt

SEQ ID NO: 2613318 - DNA, 17 bp, Homo sapiens
gtcaaacaaagccagaa

SEQ ID NO: 2613319 - DNA, 13 bp, Homo sapiens
gtcaaaccgcact

SEQ ID NO: 2613320 - DNA, 22 bp, Homo sapiens
gtcaaaccgcactcacccatgt

SEQ ID NO: 2613321 - DNA, 17 bp, Homo sapiens
gtcaaacgtgaaaatgc

SEQ ID NO: 2613322 - DNA, 16 bp, Homo sapiens
gtcaaactgtagaaat

SEQ ID NO: 2613323 - DNA, 20 bp, Homo sapiens
gtcaaactgtagaaatgatg

SEQ ID NO: 2613324 - DNA, 13 bp, Homo sapiens
gtcaacctcctgg

SEQ ID NO: 2613325 - DNA, 16 bp, Homo sapiens
gtcaacctcctggaca

SEQ ID NO: 2613326 - DNA, 15 bp, Homo sapiens
gtcaacttctggctc

SEQ ID NO: 2613327 - DNA, 19 bp, Homo sapiens
gtcaagagggtctgaggaa

SEQ ID NO: 2613328 - DNA, 16 bp, Homo sapiens
gtcaagtgaaaaagga

SEQ ID NO: 2613329 - DNA, 19 bp, Homo sapiens
gtcaagtgaaaaaggagga

SEQ ID NO: 2613330 - DNA, 17 bp, Homo sapiens
gtcaagtgcgtccacga

SEQ ID NO: 2613331 - DNA, 14 bp, Homo sapiens
gtcaagtgggatct

SEQ ID NO: 2613332 - DNA, 17 bp, Homo sapiens
gtcaagttcctttgggt

SEQ ID NO: 2613333 - DNA, 18 bp, Homo sapiens
gtcaagttgtgcttgttt

SEQ ID NO: 2613334 - DNA, 14 bp, Homo sapiens
gtcaatattaaata

SEQ ID NO: 2613335 - DNA, 16 bp, Homo sapiens
gtcaatattaaataca

SEQ ID NO: 2613336 - DNA, 20 bp, Homo sapiens
gtcaatattaaatacagaca

SEQ ID NO: 2613337 - DNA, 21 bp, Homo sapiens
gtcacaaatcctaaaagaagc

SEQ ID NO: 2613338 - DNA, 16 bp, Homo sapiens
gtcacacactttggct

SEQ ID NO: 2613339 - DNA, 12 bp, Homo sapiens
gtcacagcctca

SEQ ID NO: 2613340 - DNA, 16 bp, Homo sapiens
gtcacagcctcctctg

SEQ ID NO: 2613341 - DNA, 20 bp, Homo sapiens
gtcacaggaagtagaggagg

SEQ ID NO: 2613342 - DNA, 18 bp, Homo sapiens
gtcacaggactctgcctc

SEQ ID NO: 2613343 - DNA, 13 bp, Homo sapiens
gtcacagggccaa

SEQ ID NO: 2613344 - DNA, 14 bp, Homo sapiens
gtcacattcaggaa

SEQ ID NO: 2613345 - DNA, 12 bp, Homo sapiens
gtcaccaagccc

SEQ ID NO: 2613346 - DNA, 14 bp, Homo sapiens
gtcaccagctcctc

SEQ ID NO: 2613347 - DNA, 16 bp, Homo sapiens
gtcaccagctcctccc

SEQ ID NO: 2613348 - DNA, 15 bp, Homo sapiens
gtcaccatctcaggc

SEQ ID NO: 2613349 - DNA, 16 bp, Homo sapiens
gtcaccatctcaggcc

SEQ ID NO: 2613350 - DNA, 20 bp, Homo sapiens
gtcaccatctcaggccacct

SEQ ID NO: 2613351 - DNA, 20 bp, Homo sapiens
gtcacccaggctggagtaca

SEQ ID NO: 2613352 - DNA, 13 bp, Homo sapiens
gtcaccccggcca

SEQ ID NO: 2613353 - DNA, 17 bp, Homo sapiens
gtcaccccggccacctg

SEQ ID NO: 2613354 - DNA, 21 bp, Homo sapiens
gtcaccgtggaccttcctgcc

SEQ ID NO: 2613355 - DNA, 23 bp, Homo sapiens
gtcactacgtgactgtggcacac

SEQ ID NO: 2613356 - DNA, 22 bp, Homo sapiens
gtcactactcacagtctcttta

SEQ ID NO: 2613357 - DNA, 11 bp, Homo sapiens
gtcactcccaa

SEQ ID NO: 2613358 - DNA, 21 bp, Homo sapiens
gtcactcctggggcctcttgg

SEQ ID NO: 2613359 - DNA, 14 bp, Homo sapiens
gtcactctggcagc

SEQ ID NO: 2613360 - DNA, 19 bp, Homo sapiens
gtcactctggcagctcaga

SEQ ID NO: 2613361 - DNA, 22 bp, Homo sapiens
gtcactctggcagctcagagag

SEQ ID NO: 2613362 - DNA, 21 bp, Homo sapiens
gtcactgaaggcctggcccac

SEQ ID NO: 2613363 - DNA, 18 bp, Homo sapiens
gtcactgagacagcccgg

SEQ ID NO: 2613364 - DNA, 21 bp, Homo sapiens
gtcactgagacagcccgggct

SEQ ID NO: 2613365 - DNA, 14 bp, Homo sapiens
gtcactgcaggcac

SEQ ID NO: 2613366 - DNA, 10 bp, Homo sapiens
gtcactgctt

SEQ ID NO: 2613367 - DNA, 15 bp, Homo sapiens
gtcactgcttaactt

SEQ ID NO: 2613368 - DNA, 12 bp, Homo sapiens
gtcactggctct

SEQ ID NO: 2613369 - DNA, 17 bp, Homo sapiens
gtcactggctctccaag

SEQ ID NO: 2613370 - DNA, 18 bp, Homo sapiens
gtcactggctctccaagt

SEQ ID NO: 2613371 - DNA, 13 bp, Homo sapiens
gtcactgtttctc

SEQ ID NO: 2613372 - DNA, 18 bp, Homo sapiens
gtcacttcgcgtgccctc

SEQ ID NO: 2613373 - DNA, 24 bp, Homo sapiens
gtcacttcgcgtgccctcgctgct

SEQ ID NO: 2613374 - DNA, 15 bp, Homo sapiens
gtcagactgctggga

SEQ ID NO: 2613375 - DNA, 24 bp, Homo sapiens
gtcagactgctgggactggccagg

SEQ ID NO: 2613376 - DNA, 22 bp, Homo sapiens
gtcagactggctggctgcagtg

SEQ ID NO: 2613377 - DNA, 17 bp, Homo sapiens
gtcagagaggagtcaga

SEQ ID NO: 2613378 - DNA, 12 bp, Homo sapiens
gtcagagctggg

SEQ ID NO: 2613379 - DNA, 13 bp, Homo sapiens
gtcagaggatggc

SEQ ID NO: 2613380 - DNA, 16 bp, Homo sapiens
gtcagaggatggccag

SEQ ID NO: 2613381 - DNA, 19 bp, Homo sapiens
gtcagaggatggccagtgt

SEQ ID NO: 2613382 - DNA, 21 bp, Homo sapiens
gtcagaggctaattctgcaga

SEQ ID NO: 2613383 - DNA, 14 bp, Homo sapiens
gtcagccagggcca

SEQ ID NO: 2613384 - DNA, 21 bp, Homo sapiens
gtcagccgagccgggcctggg

SEQ ID NO: 2613385 - DNA, 15 bp, Homo sapiens
gtcagcctccagcct

SEQ ID NO: 2613386 - DNA, 16 bp, Homo sapiens
gtcagcctctctccca

SEQ ID NO: 2613387 - DNA, 21 bp, Homo sapiens
gtcagcgcaggtttagtttac

SEQ ID NO: 2613388 - DNA, 20 bp, Homo sapiens
gtcagcgtgcttagcctcct

SEQ ID NO: 2613389 - DNA, 19 bp, Homo sapiens
gtcagctactaatgatgtt

SEQ ID NO: 2613390 - DNA, 14 bp, Homo sapiens
gtcttcctgacact

SEQ ID NO: 2613391 - DNA, 20 bp, Homo sapiens
gtcttcgtacagttcttcgg

SEQ ID NO: 2613392 - DNA, 15 bp, Homo sapiens
gtcttctcaggctct

SEQ ID NO: 2613393 - DNA, 19 bp, Homo sapiens
gtcttctcaggctctgccc

SEQ ID NO: 2613394 - DNA, 22 bp, Homo sapiens
gtcttctcaggctctgccctgc

SEQ ID NO: 2613395 - DNA, 16 bp, Homo sapiens
gtcttctcatagcatt

SEQ ID NO: 2613396 - DNA, 19 bp, Homo sapiens
gtcttctcatagcattaac

SEQ ID NO: 2613397 - DNA, 17 bp, Homo sapiens
gtcttctgcctgttata

SEQ ID NO: 2613398 - DNA, 16 bp, Homo sapiens
gtcttgaactcctggc

SEQ ID NO: 2613399 - DNA, 16 bp, Homo sapiens
gtcttgcaatggcagc

SEQ ID NO: 2613400 - DNA, 19 bp, Homo sapiens
gtcttgcaatggcagcctt

SEQ ID NO: 2613401 - DNA, 23 bp, Homo sapiens
gtcttgcaatggcagccttggca

SEQ ID NO: 2613402 - DNA, 22 bp, Homo sapiens
gtcttgctatggggagaaaaga

SEQ ID NO: 2613403 - DNA, 14 bp, Homo sapiens
gtcttggacactgt

SEQ ID NO: 2613404 - DNA, 18 bp, Homo sapiens
gtcttggacactgtacaa

SEQ ID NO: 2613405 - DNA, 17 bp, Homo sapiens
gtcttggagctgagcct

SEQ ID NO: 2613406 - DNA, 23 bp, Homo sapiens
gtcttggagctgagcctctcacc

SEQ ID NO: 2613407 - DNA, 15 bp, Homo sapiens
gtcttggcggcagca

SEQ ID NO: 2613408 - DNA, 20 bp, Homo sapiens
gtcttggctttcatgttatt

SEQ ID NO: 2613409 - DNA, 15 bp, Homo sapiens
gtcttggtattctta

SEQ ID NO: 2613410 - DNA, 15 bp, Homo sapiens
gtcttgtacatgtgt

SEQ ID NO: 2613411 - DNA, 20 bp, Homo sapiens
gtcttgtgtttctttagttt

SEQ ID NO: 2613412 - DNA, 17 bp, Homo sapiens
gtctttaggcagcagct

SEQ ID NO: 2613413 - DNA, 15 bp, Homo sapiens
gtctttcacagctcc

SEQ ID NO: 2613414 - DNA, 20 bp, Homo sapiens
gtctttgtaagagtgtagaa

SEQ ID NO: 2613415 - DNA, 11 bp, Homo sapiens
gtcttttcatc

SEQ ID NO: 2613416 - DNA, 14 bp, Homo sapiens
gtcttttcttgcat

SEQ ID NO: 2613417 - DNA, 19 bp, Homo sapiens
gtcttttcttgcatgaggc

SEQ ID NO: 2613418 - DNA, 14 bp, Homo sapiens
gtcttttgaatatt

SEQ ID NO: 2613419 - DNA, 13 bp, Homo sapiens
gtctttttttgta

SEQ ID NO: 2613420 - DNA, 17 bp, Homo sapiens
gtctttttttgtattat

SEQ ID NO: 2613421 - DNA, 18 bp, Homo sapiens
gtcttttttttaatgtgc

SEQ ID NO: 2613422 - DNA, 22 bp, Homo sapiens
gtcttttttttaatgtgctgtg

SEQ ID NO: 2613423 - DNA, 15 bp, Homo sapiens
gtgaaaaaaaaaatg

SEQ ID NO: 2613424 - DNA, 14 bp, Homo sapiens
gtgaaaagaaaaat

SEQ ID NO: 2613425 - DNA, 19 bp, Homo sapiens
gtgaaaataggtatacagt

SEQ ID NO: 2613426 - DNA, 16 bp, Homo sapiens
gtgaaacacaccaggc

SEQ ID NO: 2613427 - DNA, 20 bp, Homo sapiens
gtgaaacacaccaggctgtg

SEQ ID NO: 2613428 - DNA, 23 bp, Homo sapiens
gtgaaacacaccaggctgtgggc

SEQ ID NO: 2613429 - DNA, 18 bp, Homo sapiens
gtgaaaccttttttaaga

SEQ ID NO: 2613430 - DNA, 21 bp, Homo sapiens
gtgaaaccttttttaagattt

SEQ ID NO: 2613431 - DNA, 19 bp, Homo sapiens
gtgaaactaacagataagc

SEQ ID NO: 2613432 - DNA, 21 bp, Homo sapiens
gtgaaactgcttgtttcctag

SEQ ID NO: 2613433 - DNA, 20 bp, Homo sapiens
gtgaaagcatcacttgggat

SEQ ID NO: 2613434 - DNA, 21 bp, Homo sapiens
gtgaacaaatttacagagaca

SEQ ID NO: 2613435 - DNA, 24 bp, Homo sapiens
gtgaacatttatcaatcagtataa

SEQ ID NO: 2613436 - DNA, 12 bp, Homo sapiens
gtgaaccaaaga

SEQ ID NO: 2613437 - DNA, 22 bp, Homo sapiens
gtgaaccaaagagactggagca

SEQ ID NO: 2613438 - DNA, 14 bp, Homo sapiens
gtgaacgatttaga

SEQ ID NO: 2613439 - DNA, 14 bp, Homo sapiens
gtgaactcagccaa

SEQ ID NO: 2613440 - DNA, 19 bp, Homo sapiens
gtgaactcagccaagcaca

SEQ ID NO: 2613441 - DNA, 19 bp, Homo sapiens
gtgaacttgggccactgtg

SEQ ID NO: 2613442 - DNA, 23 bp, Homo sapiens
gtgaagacaatgacttactgtac

SEQ ID NO: 2613443 - DNA, 19 bp, Homo sapiens
gtgaagagggagaagcatg

SEQ ID NO: 2613444 - DNA, 15 bp, Homo sapiens
gtgaagaggggcagc

SEQ ID NO: 2613445 - DNA, 20 bp, Homo sapiens
gtgaaggccgagaagcaaga

SEQ ID NO: 2613446 - DNA, 22 bp, Homo sapiens
gtgaaggcttctctctgtggga

SEQ ID NO: 2613447 - DNA, 17 bp, Homo sapiens
gtgaaggtcctgctatt

SEQ ID NO: 2613448 - DNA, 16 bp, Homo sapiens
gtgaatcacgtaaagc

SEQ ID NO: 2613449 - DNA, 15 bp, Homo sapiens
gtgaatctaaaagct

SEQ ID NO: 2613450 - DNA, 15 bp, Homo sapiens
gtgaatggattggat

SEQ ID NO: 2613451 - DNA, 22 bp, Homo sapiens
gtgaattgcctgcagagagaag

SEQ ID NO: 2613452 - DNA, 16 bp, Homo sapiens
gtgaatttgaatgaaa

SEQ ID NO: 2613453 - DNA, 18 bp, Homo sapiens
gtgaatttgaatgaaaaa

SEQ ID NO: 2613454 - DNA, 14 bp, Homo sapiens
gtgaatttttctct

SEQ ID NO: 2613455 - DNA, 15 bp, Homo sapiens
gtgaatttttctcta

SEQ ID NO: 2613456 - DNA, 16 bp, Homo sapiens
gtgacaacacttgtgt

SEQ ID NO: 2613457 - DNA, 23 bp, Homo sapiens
gtgacaagctcctggtcttgaga

SEQ ID NO: 2613458 - DNA, 14 bp, Homo sapiens
gtgacaaggcccca

SEQ ID NO: 2613459 - DNA, 19 bp, Homo sapiens
gtgacaaggccccagagac

SEQ ID NO: 2613460 - DNA, 12 bp, Homo sapiens
gtgacacagcag

SEQ ID NO: 2613461 - DNA, 19 bp, Homo sapiens
gtgacacagcagcttcacc

SEQ ID NO: 2613462 - DNA, 13 bp, Homo sapiens
gtgacagaggcag

SEQ ID NO: 2613463 - DNA, 18 bp, Homo sapiens
gtgacagagttcactata

SEQ ID NO: 2613464 - DNA, 22 bp, Homo sapiens
gtgacagggaagctacaggtta

SEQ ID NO: 2613465 - DNA, 14 bp, Homo sapiens
gtgacatcagtggc

SEQ ID NO: 2613466 - DNA, 15 bp, Homo sapiens
gtgacatcagtggca

SEQ ID NO: 2613467 - DNA, 18 bp, Homo sapiens
gtgacatcagtggcatgg

SEQ ID NO: 2613468 - DNA, 13 bp, Homo sapiens
gtgacatgtaaca

SEQ ID NO: 2613469 - DNA, 16 bp, Homo sapiens
gtgacatgtgaaacct

SEQ ID NO: 2613470 - DNA, 17 bp, Homo sapiens
gtgaccaatgatggtca

SEQ ID NO: 2613471 - DNA, 17 bp, Homo sapiens
gtgaccaggcatcctcc

SEQ ID NO: 2613472 - DNA, 12 bp, Homo sapiens
gtgacctctgcc

SEQ ID NO: 2613473 - DNA, 23 bp, Homo sapiens
gtgacctgccccgcccagctgca

SEQ ID NO: 2613474 - DNA, 19 bp, Homo sapiens
gtgacggtcccacactggt

SEQ ID NO: 2613475 - DNA, 19 bp, Homo sapiens
gtgactccaggagaggagc

SEQ ID NO: 2613476 - DNA, 16 bp, Homo sapiens
gtgactctttttaggg

SEQ ID NO: 2613477 - DNA, 20 bp, Homo sapiens
gtgactctttttagggccag

SEQ ID NO: 2613478 - DNA, 22 bp, Homo sapiens
gtgactctttttagggccaggc

SEQ ID NO: 2613479 - DNA, 16 bp, Homo sapiens
gtgactgaatttcttt

SEQ ID NO: 2613480 - DNA, 17 bp, Homo sapiens
gtgactgcgatcttcag

SEQ ID NO: 2613481 - DNA, 15 bp, Homo sapiens
gtgacttctccaggt

SEQ ID NO: 2613482 - DNA, 15 bp, Homo sapiens
gtgagaactactcag

SEQ ID NO: 2613483 - DNA, 18 bp, Homo sapiens
gtgagacagtccagcctg

SEQ ID NO: 2613484 - DNA, 18 bp, Homo sapiens
gtgagactctgtctcaaa

SEQ ID NO: 2613485 - DNA, 17 bp, Homo sapiens
gtgagagagatgggagc

SEQ ID NO: 2613486 - DNA, 12 bp, Homo sapiens
gtgagagctggg

SEQ ID NO: 2613487 - DNA, 16 bp, Homo sapiens
gtgagatgcagctgga

SEQ ID NO: 2613488 - DNA, 14 bp, Homo sapiens
gtgagcacagccta

SEQ ID NO: 2613489 - DNA, 19 bp, Homo sapiens
gtgagcactcccaagtcta

SEQ ID NO: 2613490 - DNA, 15 bp, Homo sapiens
gtgagccactgcacc

SEQ ID NO: 2613491 - DNA, 18 bp, Homo sapiens
gtgagcccatggccctcc

SEQ ID NO: 2613492 - DNA, 16 bp, Homo sapiens
gtgaggaccactcctg

SEQ ID NO: 2613493 - DNA, 15 bp, Homo sapiens
gtgaggagctgctgg

SEQ ID NO: 2613494 - DNA, 15 bp, Homo sapiens
gtgaggccagggcag

SEQ ID NO: 2613495 - DNA, 15 bp, Homo sapiens
gtgaggcccagggag

SEQ ID NO: 2613496 - DNA, 19 bp, Homo sapiens
gtgaggggtaaaagctgat

SEQ ID NO: 2613497 - DNA, 15 bp, Homo sapiens
gtgagggtcccatgt

SEQ ID NO: 2613498 - DNA, 16 bp, Homo sapiens
gtgagggtcccatgtg

SEQ ID NO: 2613499 - DNA, 19 bp, Homo sapiens
gtgaggtgcagagtgccca

SEQ ID NO: 2613500 - DNA, 21 bp, Homo sapiens
gtgaggtgcagagtgcccaga

SEQ ID NO: 2613501 - DNA, 14 bp, Homo sapiens
gtgagtaagagctg

SEQ ID NO: 2613502 - DNA, 19 bp, Homo sapiens
gtgagtactacagtcctcc

SEQ ID NO: 2613503 - DNA, 21 bp, Homo sapiens
gtgagtactacagtcctccca

SEQ ID NO: 2613504 - DNA, 22 bp, Homo sapiens
gtgagtcgaggacagggaggtg

SEQ ID NO: 2613505 - DNA, 19 bp, Homo sapiens
gtgagtcttggcggcagca

SEQ ID NO: 2613506 - DNA, 21 bp, Homo sapiens
gtgagtcttggcggcagcagc

SEQ ID NO: 2613507 - DNA, 15 bp, Homo sapiens
gtgagtgtgtgcaag

SEQ ID NO: 2613508 - DNA, 14 bp, Homo sapiens
gtgagttctcaggg

SEQ ID NO: 2613509 - DNA, 20 bp, Homo sapiens
gtgagttctcagggctcctg

SEQ ID NO: 2613510 - DNA, 17 bp, Homo sapiens
gtgagttgatagcacag

SEQ ID NO: 2613511 - DNA, 13 bp, Homo sapiens
gtgataaactttg

SEQ ID NO: 2613512 - DNA, 15 bp, Homo sapiens
gtgatacaatgctgt

SEQ ID NO: 2613513 - DNA, 17 bp, Homo sapiens
gtgatacaatgctgtgc

SEQ ID NO: 2613514 - DNA, 20 bp, Homo sapiens
gtgatcagaccataatgtta

SEQ ID NO: 2613515 - DNA, 15 bp, Homo sapiens
gtgatcctcccacct

SEQ ID NO: 2613516 - DNA, 23 bp, Homo sapiens
gtgatcctcccacctcagcctcc

SEQ ID NO: 2613517 - DNA, 22 bp, Homo sapiens
gtgatcttggcttactgcagcc

SEQ ID NO: 2613518 - DNA, 15 bp, Homo sapiens
gtgatgaactttctc

SEQ ID NO: 2613519 - DNA, 22 bp, Homo sapiens
gtgatgaagaaaagtgggccag

SEQ ID NO: 2613520 - DNA, 15 bp, Homo sapiens
gtgatgctgggctgg

SEQ ID NO: 2613521 - DNA, 16 bp, Homo sapiens
gtgatggggccctgcc

SEQ ID NO: 2613522 - DNA, 22 bp, Homo sapiens
gtgatgtttaacaggaagatct

SEQ ID NO: 2613523 - DNA, 15 bp, Homo sapiens
gtgattaaacgtgca

SEQ ID NO: 2613524 - DNA, 19 bp, Homo sapiens
gtgattagaggcagatctg

SEQ ID NO: 2613525 - DNA, 16 bp, Homo sapiens
gtgattctaatgtctt

SEQ ID NO: 2613526 - DNA, 18 bp, Homo sapiens
gtgattctcctgcctcag

SEQ ID NO: 2613527 - DNA, 17 bp, Homo sapiens
gtgattgggaataaata

SEQ ID NO: 2613528 - DNA, 18 bp, Homo sapiens
gtgatttagaactgtatg

SEQ ID NO: 2613529 - DNA, 19 bp, Homo sapiens
gtgatttcagagagggcag

SEQ ID NO: 2613530 - DNA, 18 bp, Homo sapiens
gtgatttttgtaattttt

SEQ ID NO: 2613531 - DNA, 12 bp, Homo sapiens
gtgcaacagcac

SEQ ID NO: 2613532 - DNA, 20 bp, Homo sapiens
gtgcaagagactctggcctc

SEQ ID NO: 2613533 - DNA, 12 bp, Homo sapiens
gtgcacacacca

SEQ ID NO: 2613534 - DNA, 16 bp, Homo sapiens
gttctttaggagattt

SEQ ID NO: 2613535 - DNA, 14 bp, Homo sapiens
gttctttccaaagt

SEQ ID NO: 2613536 - DNA, 14 bp, Homo sapiens
gttctttcttcctc

SEQ ID NO: 2613537 - DNA, 15 bp, Homo sapiens
gttctttcttcctct

SEQ ID NO: 2613538 - DNA, 18 bp, Homo sapiens
gttgaaaattcaaaaagt

SEQ ID NO: 2613539 - DNA, 22 bp, Homo sapiens
gttgaaaattcaaaaagtgttt

SEQ ID NO: 2613540 - DNA, 20 bp, Homo sapiens
gttgacacctcgcccctgct

SEQ ID NO: 2613541 - DNA, 17 bp, Homo sapiens
gttgacagttctgaaga

SEQ ID NO: 2613542 - DNA, 20 bp, Homo sapiens
gttgacttgacagaacactg

SEQ ID NO: 2613543 - DNA, 18 bp, Homo sapiens
gttgactttagggactca

SEQ ID NO: 2613544 - DNA, 14 bp, Homo sapiens
gttgactttcaggt

SEQ ID NO: 2613545 - DNA, 20 bp, Homo sapiens
gttgagaattgtgctcaaaa

SEQ ID NO: 2613546 - DNA, 19 bp, Homo sapiens
gttgagcagggatcctggt

SEQ ID NO: 2613547 - DNA, 19 bp, Homo sapiens
gttgagccccaagtcctga

SEQ ID NO: 2613548 - DNA, 16 bp, Homo sapiens
gttgaggggctcctgg

SEQ ID NO: 2613549 - DNA, 21 bp, Homo sapiens
gttgaggtccagccctggctg

SEQ ID NO: 2613550 - DNA, 22 bp, Homo sapiens
gttgaggtccagccctggctga

SEQ ID NO: 2613551 - DNA, 16 bp, Homo sapiens
gttgaggtggtctgaa

SEQ ID NO: 2613552 - DNA, 22 bp, Homo sapiens
gttgagttcaggtagctgcccc

SEQ ID NO: 2613553 - DNA, 18 bp, Homo sapiens
gttgataaattccactgg

SEQ ID NO: 2613554 - DNA, 14 bp, Homo sapiens
gttgataactttgc

SEQ ID NO: 2613555 - DNA, 14 bp, Homo sapiens
gttgatagcacaga

SEQ ID NO: 2613556 - DNA, 22 bp, Homo sapiens
gttgatagcacagaccctgccc

SEQ ID NO: 2613557 - DNA, 22 bp, Homo sapiens
gttgatgatctttgcagacagg

SEQ ID NO: 2613558 - DNA, 14 bp, Homo sapiens
gttgattgctaaat

SEQ ID NO: 2613559 - DNA, 15 bp, Homo sapiens
gttgattgctaaatg

SEQ ID NO: 2613560 - DNA, 22 bp, Homo sapiens
gttgattgctaaatgtaacagt

SEQ ID NO: 2613561 - DNA, 15 bp, Homo sapiens
gttgcacccagccct

SEQ ID NO: 2613562 - DNA, 14 bp, Homo sapiens
gttgcactgatatt

SEQ ID NO: 2613563 - DNA, 16 bp, Homo sapiens
gttgcatgatgtattt

SEQ ID NO: 2613564 - DNA, 23 bp, Homo sapiens
gttgccagtcaccccggccacct

SEQ ID NO: 2613565 - DNA, 14 bp, Homo sapiens
gttgcccaggcagg

SEQ ID NO: 2613566 - DNA, 17 bp, Homo sapiens
gttgcccaggcaggtct

SEQ ID NO: 2613567 - DNA, 23 bp, Homo sapiens
gttgcccaggcaggtcttgaact

SEQ ID NO: 2613568 - DNA, 17 bp, Homo sapiens
gttgcccaggctggcgt

SEQ ID NO: 2613569 - DNA, 21 bp, Homo sapiens
gttgcccaggctggcgtgcag

SEQ ID NO: 2613570 - DNA, 18 bp, Homo sapiens
gttgccttaaagaaagtc

SEQ ID NO: 2613571 - DNA, 19 bp, Homo sapiens
gttgccttgaaccacttcc

SEQ ID NO: 2613572 - DNA, 21 bp, Homo sapiens
gttgccttgaaccacttccct

SEQ ID NO: 2613573 - DNA, 13 bp, Homo sapiens
gttgcggggggag

SEQ ID NO: 2613574 - DNA, 15 bp, Homo sapiens
gttgcggggggaggg

SEQ ID NO: 2613575 - DNA, 18 bp, Homo sapiens
gttgctcaaaaaatgagc

SEQ ID NO: 2613576 - DNA, 18 bp, Homo sapiens
gttgctggttgctgtgtg

SEQ ID NO: 2613577 - DNA, 19 bp, Homo sapiens
gttgctggttgctgtgtgg

SEQ ID NO: 2613578 - DNA, 16 bp, Homo sapiens
gttgcttacaattttt

SEQ ID NO: 2613579 - DNA, 15 bp, Homo sapiens
gttgctttgccctgg

SEQ ID NO: 2613580 - DNA, 16 bp, Homo sapiens
gttggaaagcaggtgg

SEQ ID NO: 2613581 - DNA, 23 bp, Homo sapiens
gttggaaatagaaatttccagag

SEQ ID NO: 2613582 - DNA, 18 bp, Homo sapiens
gttggaaatattcatgct

SEQ ID NO: 2613583 - DNA, 22 bp, Homo sapiens
gttggaatgaattaaataaacc

SEQ ID NO: 2613584 - DNA, 20 bp, Homo sapiens
gttggacccgctctggacca

SEQ ID NO: 2613585 - DNA, 19 bp, Homo sapiens
gttggagagctagaacctg

SEQ ID NO: 2613586 - DNA, 19 bp, Homo sapiens
gttggagcctgcagggtgg

SEQ ID NO: 2613587 - DNA, 13 bp, Homo sapiens
gttggatcttcaa

SEQ ID NO: 2613588 - DNA, 14 bp, Homo sapiens
gttggccaggctgg

SEQ ID NO: 2613589 - DNA, 16 bp, Homo sapiens
gttggctgggcccaga

SEQ ID NO: 2613590 - DNA, 12 bp, Homo sapiens
gttggctggggg

SEQ ID NO: 2613591 - DNA, 19 bp, Homo sapiens
gttggctgggggcctcagt

SEQ ID NO: 2613592 - DNA, 17 bp, Homo sapiens
gttgggaatgaggcttg

SEQ ID NO: 2613593 - DNA, 15 bp, Homo sapiens
gttgggagcactgga

SEQ ID NO: 2613594 - DNA, 22 bp, Homo sapiens
gttgggattgggggctggtgcc

SEQ ID NO: 2613595 - DNA, 17 bp, Homo sapiens
gttgggcccagatctgg

SEQ ID NO: 2613596 - DNA, 18 bp, Homo sapiens
gttggttccaagccctgg

SEQ ID NO: 2613597 - DNA, 14 bp, Homo sapiens
gttgtaaatattta

SEQ ID NO: 2613598 - DNA, 13 bp, Homo sapiens
gttgtaactaggc

SEQ ID NO: 2613599 - DNA, 23 bp, Homo sapiens
gttgtacaaataaagtcccaggt

SEQ ID NO: 2613600 - DNA, 20 bp, Homo sapiens
gttgtacatttatgatttaa

SEQ ID NO: 2613601 - DNA, 20 bp, Homo sapiens
gttgtagaatgtattgtacc

SEQ ID NO: 2613602 - DNA, 22 bp, Homo sapiens
gttgtattctttgatgttaaca

SEQ ID NO: 2613603 - DNA, 17 bp, Homo sapiens
gttgtcaagtctctgct

SEQ ID NO: 2613604 - DNA, 15 bp, Homo sapiens
gttgtcctatgggag

SEQ ID NO: 2613605 - DNA, 19 bp, Homo sapiens
gttgtcctccccttgggcg

SEQ ID NO: 2613606 - DNA, 13 bp, Homo sapiens
gttgtgaggcctg

SEQ ID NO: 2613607 - DNA, 14 bp, Homo sapiens
gttgtgaggcctgg

SEQ ID NO: 2613608 - DNA, 19 bp, Homo sapiens
gttgtggaaagcctctgct

SEQ ID NO: 2613609 - DNA, 16 bp, Homo sapiens
gttgtgggtgggagag

SEQ ID NO: 2613610 - DNA, 17 bp, Homo sapiens
gttgttaatgaaaatgt

SEQ ID NO: 2613611 - DNA, 20 bp, Homo sapiens
gttgtttacttaaagattta

SEQ ID NO: 2613612 - DNA, 13 bp, Homo sapiens
gttgtttctttct

SEQ ID NO: 2613613 - DNA, 15 bp, Homo sapiens
gttgtttctttctag

SEQ ID NO: 2613614 - DNA, 20 bp, Homo sapiens
gttgtttgattcagacagct

SEQ ID NO: 2613615 - DNA, 23 bp, Homo sapiens
gttgtttgattcagacagctgcc

SEQ ID NO: 2613616 - DNA, 17 bp, Homo sapiens
gttgtttgtatgtataa

SEQ ID NO: 2613617 - DNA, 10 bp, Homo sapiens
gtttaaaatc

SEQ ID NO: 2613618 - DNA, 16 bp, Homo sapiens
gtttaaaatcatttct

SEQ ID NO: 2613619 - DNA, 16 bp, Homo sapiens
gtttaaactgattcat

SEQ ID NO: 2613620 - DNA, 21 bp, Homo sapiens
gtttaaactgattcataataa

SEQ ID NO: 2613621 - DNA, 17 bp, Homo sapiens
gtttaaacttctctgaa

SEQ ID NO: 2613622 - DNA, 16 bp, Homo sapiens
gtttaaagagaggtta

SEQ ID NO: 2613623 - DNA, 19 bp, Homo sapiens
gtttaaataaagtatcatg

SEQ ID NO: 2613624 - DNA, 23 bp, Homo sapiens
gtttaaataaagtatcatgcatt

SEQ ID NO: 2613625 - DNA, 14 bp, Homo sapiens
gtttaactcagatc

SEQ ID NO: 2613626 - DNA, 15 bp, Homo sapiens
gtttaactcagatca

SEQ ID NO: 2613627 - DNA, 22 bp, Homo sapiens
gtttaactcagatcactactgc

SEQ ID NO: 2613628 - DNA, 19 bp, Homo sapiens
gtttaatattgagaaagaa

SEQ ID NO: 2613629 - DNA, 19 bp, Homo sapiens
gtttacaagcccccccttc

SEQ ID NO: 2613630 - DNA, 22 bp, Homo sapiens
gtttacaagcccccccttccac

SEQ ID NO: 2613631 - DNA, 16 bp, Homo sapiens
gtttacactctttgta

SEQ ID NO: 2613632 - DNA, 17 bp, Homo sapiens
gtttacaggtggacaca

SEQ ID NO: 2613633 - DNA, 16 bp, Homo sapiens
gtttacctgaataaat

SEQ ID NO: 2613634 - DNA, 18 bp, Homo sapiens
gtttacttatcttatgcc

SEQ ID NO: 2613635 - DNA, 16 bp, Homo sapiens
gtttagaagaagtgtg

SEQ ID NO: 2613636 - DNA, 15 bp, Homo sapiens
gtttagttaaatgag

SEQ ID NO: 2613637 - DNA, 20 bp, Homo sapiens
gtttatagcaaacttggaat

SEQ ID NO: 2613638 - DNA, 12 bp, Homo sapiens
gtttatataaat

SEQ ID NO: 2613639 - DNA, 17 bp, Homo sapiens
gtttatcattcaagtgt

SEQ ID NO: 2613640 - DNA, 20 bp, Homo sapiens
gtttatcattcaagtgtaaa

SEQ ID NO: 2613641 - DNA, 14 bp, Homo sapiens
gtttatgattccac

SEQ ID NO: 2613642 - DNA, 17 bp, Homo sapiens
gtttatgcaaggaagga

SEQ ID NO: 2613643 - DNA, 15 bp, Homo sapiens
gtttatggcctcagc

SEQ ID NO: 2613644 - DNA, 22 bp, Homo sapiens
gtttatggcctcagctgcctca

SEQ ID NO: 2613645 - DNA, 14 bp, Homo sapiens
gtttatttcttaaa

SEQ ID NO: 2613646 - DNA, 17 bp, Homo sapiens
gtttatttttcatattg

SEQ ID NO: 2613647 - DNA, 18 bp, Homo sapiens
gtttatttttcatattgt

SEQ ID NO: 2613648 - DNA, 16 bp, Homo sapiens
gtttcaaaataaaaac

SEQ ID NO: 2613649 - DNA, 19 bp, Homo sapiens
gtttcaaacacaaatgcag

SEQ ID NO: 2613650 - DNA, 13 bp, Homo sapiens
gtttcaaacttta

SEQ ID NO: 2613651 - DNA, 17 bp, Homo sapiens
gtttcaaactttactat

SEQ ID NO: 2613652 - DNA, 21 bp, Homo sapiens
gtttcaatgtgattctaatgt

SEQ ID NO: 2613653 - DNA, 16 bp, Homo sapiens
gtttcaattgcatctc

SEQ ID NO: 2613654 - DNA, 21 bp, Homo sapiens
gtttcactttcacatagatgt

SEQ ID NO: 2613655 - DNA, 17 bp, Homo sapiens
gtttcagatatatatca

SEQ ID NO: 2613656 - DNA, 19 bp, Homo sapiens
gtttcaggatacatgtgcc

SEQ ID NO: 2613657 - DNA, 18 bp, Homo sapiens
gtttcatgttttgtgact

SEQ ID NO: 2613658 - DNA, 19 bp, Homo sapiens
gtttcatgttttgtgacta

SEQ ID NO: 2613659 - DNA, 13 bp, Homo sapiens
gtttcccataatt

SEQ ID NO: 2613660 - DNA, 15 bp, Homo sapiens
gtttcccataatttt

SEQ ID NO: 2613661 - DNA, 21 bp, Homo sapiens
gtttcccataattttcttcat

SEQ ID NO: 2613662 - DNA, 16 bp, Homo sapiens
gtttcctgcaggccag

SEQ ID NO: 2613663 - DNA, 21 bp, Homo sapiens
gtttcctggcactgcttccag

SEQ ID NO: 2613664 - DNA, 23 bp, Homo sapiens
gtttcctttcatttactgtggct

SEQ ID NO: 2613665 - DNA, 21 bp, Homo sapiens
gtttcgagaagctgctctgga

SEQ ID NO: 2613666 - DNA, 20 bp, Homo sapiens
gtttcgtgaagtatactgta

SEQ ID NO: 2613667 - DNA, 14 bp, Homo sapiens
gtttcgtttctgta

SEQ ID NO: 2613668 - DNA, 22 bp, Homo sapiens
gtttctaaaggctacctttgta

SEQ ID NO: 2613669 - DNA, 15 bp, Homo sapiens
gtttctacctcccag

SEQ ID NO: 2613670 - DNA, 19 bp, Homo sapiens
gtttctcagatccttgttt

SEQ ID NO: 2613671 - DNA, 14 bp, Homo sapiens
gtttctcagctccc

SEQ ID NO: 2613672 - DNA, 19 bp, Homo sapiens
gtttctcagctcccatttc

SEQ ID NO: 2613673 - DNA, 15 bp, Homo sapiens
gtttctccccctggg

SEQ ID NO: 2613674 - DNA, 23 bp, Homo sapiens
gtttctccccctgggctctgccc

SEQ ID NO: 2613675 - DNA, 12 bp, Homo sapiens
gtttctctgctg

SEQ ID NO: 2613676 - DNA, 12 bp, Homo sapiens
gtttctgactct

SEQ ID NO: 2613677 - DNA, 16 bp, Homo sapiens
gtttctgcctctgagg

SEQ ID NO: 2613678 - DNA, 22 bp, Homo sapiens
taaagtgtaaatcctttttctt

SEQ ID NO: 2613679 - DNA, 14 bp, Homo sapiens
taaagtgtattttt

SEQ ID NO: 2613680 - DNA, 17 bp, Homo sapiens
taaagtgtgttgttgct

SEQ ID NO: 2613681 - DNA, 17 bp, Homo sapiens
taaagtgtgtttctatg

SEQ ID NO: 2613682 - DNA, 15 bp, Homo sapiens
taaagttagtctact

SEQ ID NO: 2613683 - DNA, 16 bp, Homo sapiens
taaagttagtctactc

SEQ ID NO: 2613684 - DNA, 23 bp, Homo sapiens
taaagttctgtactcaaatgtag

SEQ ID NO: 2613685 - DNA, 14 bp, Homo sapiens
taaagtttctcaga

SEQ ID NO: 2613686 - DNA, 13 bp, Homo sapiens
taaataaaagaaa

SEQ ID NO: 2613687 - DNA, 21 bp, Homo sapiens
taaataaaagaaaaaatatct

SEQ ID NO: 2613688 - DNA, 20 bp, Homo sapiens
taaataaaagcagcatctgc

SEQ ID NO: 2613689 - DNA, 19 bp, Homo sapiens
taaataaaagtgatcaata

SEQ ID NO: 2613690 - DNA, 14 bp, Homo sapiens
taaataaaatttgt

SEQ ID NO: 2613691 - DNA, 13 bp, Homo sapiens
taaataaaccctt

SEQ ID NO: 2613692 - DNA, 22 bp, Homo sapiens
taaataaatgtatcttattcac

SEQ ID NO: 2613693 - DNA, 22 bp, Homo sapiens
taaataagaaacaactctttga

SEQ ID NO: 2613694 - DNA, 18 bp, Homo sapiens
taaatacacaacacacac

SEQ ID NO: 2613695 - DNA, 14 bp, Homo sapiens
taaatacagacact

SEQ ID NO: 2613696 - DNA, 18 bp, Homo sapiens
taaatacagacactaagt

SEQ ID NO: 2613697 - DNA, 17 bp, Homo sapiens
taaataccagacacgta

SEQ ID NO: 2613698 - DNA, 15 bp, Homo sapiens
taaatagcattctct

SEQ ID NO: 2613699 - DNA, 16 bp, Homo sapiens
taaatagctatatcca

SEQ ID NO: 2613700 - DNA, 19 bp, Homo sapiens
taaatagctatatccatgt

SEQ ID NO: 2613701 - DNA, 21 bp, Homo sapiens
taaataggagaggatgagagc

SEQ ID NO: 2613702 - DNA, 21 bp, Homo sapiens
taaatatatctatattattgt

SEQ ID NO: 2613703 - DNA, 17 bp, Homo sapiens
taaatatatttaagata

SEQ ID NO: 2613704 - DNA, 18 bp, Homo sapiens
taaatatcttctgatttg

SEQ ID NO: 2613705 - DNA, 17 bp, Homo sapiens
taaatatgcagtgatat

SEQ ID NO: 2613706 - DNA, 18 bp, Homo sapiens
taaatatgttttttagat

SEQ ID NO: 2613707 - DNA, 10 bp, Homo sapiens
taaatattta

SEQ ID NO: 2613708 - DNA, 17 bp, Homo sapiens
taaatatttacatatga

SEQ ID NO: 2613709 - DNA, 19 bp, Homo sapiens
taaatatttacatatgaaa

SEQ ID NO: 2613710 - DNA, 17 bp, Homo sapiens
taaatatttatgtagat

SEQ ID NO: 2613711 - DNA, 14 bp, Homo sapiens
taaatatttcaaga

SEQ ID NO: 2613712 - DNA, 12 bp, Homo sapiens
taaatatttcct

SEQ ID NO: 2613713 - DNA, 14 bp, Homo sapiens
taaatatttcctta

SEQ ID NO: 2613714 - DNA, 14 bp, Homo sapiens
taaatcaatgtcac

SEQ ID NO: 2613715 - DNA, 11 bp, Homo sapiens
taaatcagtgg

SEQ ID NO: 2613716 - DNA, 14 bp, Homo sapiens
taaatcattaatac

SEQ ID NO: 2613717 - DNA, 17 bp, Homo sapiens
taaatcctttactgtta

SEQ ID NO: 2613718 - DNA, 18 bp, Homo sapiens
taaatcgcttttgataat

SEQ ID NO: 2613719 - DNA, 20 bp, Homo sapiens
taaatctatgaagtatataa

SEQ ID NO: 2613720 - DNA, 15 bp, Homo sapiens
taaatctccaaaata

SEQ ID NO: 2613721 - DNA, 18 bp, Homo sapiens
taaatctccaaaataaaa

SEQ ID NO: 2613722 - DNA, 15 bp, Homo sapiens
taaatctctaatatg

SEQ ID NO: 2613723 - DNA, 12 bp, Homo sapiens
taaatctgtgat

SEQ ID NO: 2613724 - DNA, 18 bp, Homo sapiens
taaatgaaaatcgtgaca

SEQ ID NO: 2613725 - DNA, 14 bp, Homo sapiens
taaatgaaattgta

SEQ ID NO: 2613726 - DNA, 15 bp, Homo sapiens
taaatgaaattgtaa

SEQ ID NO: 2613727 - DNA, 16 bp, Homo sapiens
taaatgaaattgtaaa

SEQ ID NO: 2613728 - DNA, 16 bp, Homo sapiens
taaatgaagcagcttt

SEQ ID NO: 2613729 - DNA, 12 bp, Homo sapiens
taaatgaatgtt

SEQ ID NO: 2613730 - DNA, 17 bp, Homo sapiens
taaatgaggggcctcag

SEQ ID NO: 2613731 - DNA, 18 bp, Homo sapiens
taaatgcaatatgtatta

SEQ ID NO: 2613732 - DNA, 16 bp, Homo sapiens
taaatgcataaatgca

SEQ ID NO: 2613733 - DNA, 20 bp, Homo sapiens
taaatgcatatcctgagcca

SEQ ID NO: 2613734 - DNA, 14 bp, Homo sapiens
taaatgcattatag

SEQ ID NO: 2613735 - DNA, 13 bp, Homo sapiens
taaatgcccagcc

SEQ ID NO: 2613736 - DNA, 14 bp, Homo sapiens
taaatgcccagccc

SEQ ID NO: 2613737 - DNA, 16 bp, Homo sapiens
taaatgcccagcccct

SEQ ID NO: 2613738 - DNA, 14 bp, Homo sapiens
taaatgctattttt

SEQ ID NO: 2613739 - DNA, 15 bp, Homo sapiens
taaatgctatttttt

SEQ ID NO: 2613740 - DNA, 23 bp, Homo sapiens
taaatgctattttttattttact

SEQ ID NO: 2613741 - DNA, 17 bp, Homo sapiens
taaatggaaaaaatgat

SEQ ID NO: 2613742 - DNA, 17 bp, Homo sapiens
taaatggggctcacaaa

SEQ ID NO: 2613743 - DNA, 17 bp, Homo sapiens
taaatgggggtgcattt

SEQ ID NO: 2613744 - DNA, 16 bp, Homo sapiens
taaatgggtagagaaa

SEQ ID NO: 2613745 - DNA, 14 bp, Homo sapiens
taaatggtatagca

SEQ ID NO: 2613746 - DNA, 18 bp, Homo sapiens
taaatgtaacagtctgat

SEQ ID NO: 2613747 - DNA, 19 bp, Homo sapiens
taaatgtaacagtctgatc

SEQ ID NO: 2613748 - DNA, 23 bp, Homo sapiens
taaatgtcttttttttaatgtgc

SEQ ID NO: 2613749 - DNA, 16 bp, Homo sapiens
taaatgtgccttcatt

SEQ ID NO: 2613750 - DNA, 16 bp, Homo sapiens
taaatgtgcttttaaa

SEQ ID NO: 2613751 - DNA, 13 bp, Homo sapiens
taaatgtggtaaa

SEQ ID NO: 2613752 - DNA, 20 bp, Homo sapiens
taaatgtttttctatgtagt

SEQ ID NO: 2613753 - DNA, 18 bp, Homo sapiens
taaattaaaactgaattg

SEQ ID NO: 2613754 - DNA, 15 bp, Homo sapiens
taaattaacttttat

SEQ ID NO: 2613755 - DNA, 18 bp, Homo sapiens
taaattaacttttataaa

SEQ ID NO: 2613756 - DNA, 13 bp, Homo sapiens
taaattatgttta

SEQ ID NO: 2613757 - DNA, 16 bp, Homo sapiens
taaattatttattatt

SEQ ID NO: 2613758 - DNA, 17 bp, Homo sapiens
taaattcacaatagaaa

SEQ ID NO: 2613759 - DNA, 22 bp, Homo sapiens
taaattcacctagtctaaggat

SEQ ID NO: 2613760 - DNA, 23 bp, Homo sapiens
taaattcagatatatttttcaca

SEQ ID NO: 2613761 - DNA, 20 bp, Homo sapiens
taaattcattttaattttgt

SEQ ID NO: 2613762 - DNA, 13 bp, Homo sapiens
taaattccactgg

SEQ ID NO: 2613763 - DNA, 14 bp, Homo sapiens
taaattccactgga

SEQ ID NO: 2613764 - DNA, 15 bp, Homo sapiens
taaattgctgtgtat

SEQ ID NO: 2613765 - DNA, 17 bp, Homo sapiens
taaatttatttcaaaaa

SEQ ID NO: 2613766 - DNA, 16 bp, Homo sapiens
taaatttgtaagtttc

SEQ ID NO: 2613767 - DNA, 20 bp, Homo sapiens
taaatttgtaagtttcaggt

SEQ ID NO: 2613768 - DNA, 14 bp, Homo sapiens
taaatttttttcct

SEQ ID NO: 2613769 - DNA, 22 bp, Homo sapiens
taacaaaacactcggcatttca

SEQ ID NO: 2613770 - DNA, 21 bp, Homo sapiens
taacaaacatcactctgctgc

SEQ ID NO: 2613771 - DNA, 17 bp, Homo sapiens
taacaagatctttcagg

SEQ ID NO: 2613772 - DNA, 13 bp, Homo sapiens
taacaagccaccc

SEQ ID NO: 2613773 - DNA, 16 bp, Homo sapiens
taacaataactactgt

SEQ ID NO: 2613774 - DNA, 19 bp, Homo sapiens
taacaatgatatatggata

SEQ ID NO: 2613775 - DNA, 12 bp, Homo sapiens
taacaatgttaa

SEQ ID NO: 2613776 - DNA, 19 bp, Homo sapiens
taacaatgttaaggaaact

SEQ ID NO: 2613777 - DNA, 22 bp, Homo sapiens
taacaatgttaaggaaactctt

SEQ ID NO: 2613778 - DNA, 14 bp, Homo sapiens
taacaattcctcta

SEQ ID NO: 2613779 - DNA, 13 bp, Homo sapiens
taacaatttcctt

SEQ ID NO: 2613780 - DNA, 16 bp, Homo sapiens
taacaatttctgtcct

SEQ ID NO: 2613781 - DNA, 22 bp, Homo sapiens
taacaatttctgtccttcagat

SEQ ID NO: 2613782 - DNA, 17 bp, Homo sapiens
taacacaagtcctgtga

SEQ ID NO: 2613783 - DNA, 15 bp, Homo sapiens
taacacacagctccc

SEQ ID NO: 2613784 - DNA, 19 bp, Homo sapiens
taacacagtgccttcaata

SEQ ID NO: 2613785 - DNA, 11 bp, Homo sapiens
taacacattat

SEQ ID NO: 2613786 - DNA, 22 bp, Homo sapiens
taacacattatcgggagcagtg

SEQ ID NO: 2613787 - DNA, 17 bp, Homo sapiens
taacacatttgattctg

SEQ ID NO: 2613788 - DNA, 17 bp, Homo sapiens
taacacattttgtataa

SEQ ID NO: 2613789 - DNA, 19 bp, Homo sapiens
taacacattttgtataatt

SEQ ID NO: 2613790 - DNA, 18 bp, Homo sapiens
taacaccatgattaacca

SEQ ID NO: 2613791 - DNA, 14 bp, Homo sapiens
taacacctgatgtg

SEQ ID NO: 2613792 - DNA, 16 bp, Homo sapiens
taacacctgatgtgta

SEQ ID NO: 2613793 - DNA, 19 bp, Homo sapiens
taacactatgtttatttac

SEQ ID NO: 2613794 - DNA, 11 bp, Homo sapiens
taacagaaagg

SEQ ID NO: 2613795 - DNA, 13 bp, Homo sapiens
taacagaaatgta

SEQ ID NO: 2613796 - DNA, 12 bp, Homo sapiens
taacagaacagc

SEQ ID NO: 2613797 - DNA, 20 bp, Homo sapiens
taacagaacagcttcaggtt

SEQ ID NO: 2613798 - DNA, 15 bp, Homo sapiens
taacagatgcaatgt

SEQ ID NO: 2613799 - DNA, 21 bp, Homo sapiens
taacagatgcaatgtgctact

SEQ ID NO: 2613800 - DNA, 12 bp, Homo sapiens
taacagctgagg

SEQ ID NO: 2613801 - DNA, 15 bp, Homo sapiens
taacagctgaggtct

SEQ ID NO: 2613802 - DNA, 21 bp, Homo sapiens
taacaggaagatcttaaattt

SEQ ID NO: 2613803 - DNA, 14 bp, Homo sapiens
taacaggtctcctc

SEQ ID NO: 2613804 - DNA, 21 bp, Homo sapiens
taacaggttattttagtttct

SEQ ID NO: 2613805 - DNA, 22 bp, Homo sapiens
taacaggttattttagtttctg

SEQ ID NO: 2613806 - DNA, 21 bp, Homo sapiens
taacagtgcatattcctttct

SEQ ID NO: 2613807 - DNA, 13 bp, Homo sapiens
taacatatttact

SEQ ID NO: 2613808 - DNA, 23 bp, Homo sapiens
taacatggacatgatcttcttta

SEQ ID NO: 2613809 - DNA, 17 bp, Homo sapiens
taacatgtaattaagta

SEQ ID NO: 2613810 - DNA, 15 bp, Homo sapiens
taacatgtatcccaa

SEQ ID NO: 2613811 - DNA, 19 bp, Homo sapiens
taacattaccttactgtgg

SEQ ID NO: 2613812 - DNA, 22 bp, Homo sapiens
taacattctgtaaaatgtctgt

SEQ ID NO: 2613813 - DNA, 20 bp, Homo sapiens
taacattgggtcctgggtct

SEQ ID NO: 2613814 - DNA, 13 bp, Homo sapiens
taacattttaaat

SEQ ID NO: 2613815 - DNA, 23 bp, Homo sapiens
taaccacaaagcacagtttgaac

SEQ ID NO: 2613816 - DNA, 13 bp, Homo sapiens
taaccacggaaaa

SEQ ID NO: 2613817 - DNA, 19 bp, Homo sapiens
taaccacttaaaaaatgtc

SEQ ID NO: 2613818 - DNA, 20 bp, Homo sapiens
taaccacttaaaaaatgtcc

SEQ ID NO: 2613819 - DNA, 20 bp, Homo sapiens
taaccagccagatcctcttg

SEQ ID NO: 2613820 - DNA, 14 bp, Homo sapiens
taaccatttgcact

SEQ ID NO: 2613821 - DNA, 13 bp, Homo sapiens
taaccccagctcc

SEQ ID NO: 2613822 - DNA, 19 bp, Homo sapiens
taaccccagctccctagga

SEQ ID NO: 2613823 - DNA, 15 bp, Homo sapiens
taaccccaggccccg

SEQ ID NO: 2613824 - DNA, 16 bp, Homo sapiens
tactgatatattttac

SEQ ID NO: 2613825 - DNA, 17 bp, Homo sapiens
tactgatcatgcattgt

SEQ ID NO: 2613826 - DNA, 23 bp, Homo sapiens
tactgatgttcctagtgaaagag

SEQ ID NO: 2613827 - DNA, 21 bp, Homo sapiens
tactgatttcctttggagctt

SEQ ID NO: 2613828 - DNA, 17 bp, Homo sapiens
tactgatttttgtgatt

SEQ ID NO: 2613829 - DNA, 15 bp, Homo sapiens
tactgcagctttaca

SEQ ID NO: 2613830 - DNA, 19 bp, Homo sapiens
tactgcagctttacatgca

SEQ ID NO: 2613831 - DNA, 23 bp, Homo sapiens
tactgcagctttacatgcaattt

SEQ ID NO: 2613832 - DNA, 17 bp, Homo sapiens
tactgcatactttttaa

SEQ ID NO: 2613833 - DNA, 22 bp, Homo sapiens
tactgcatactttttaaatgta

SEQ ID NO: 2613834 - DNA, 11 bp, Homo sapiens
tactgccaaag

SEQ ID NO: 2613835 - DNA, 12 bp, Homo sapiens
tactgccagatg

SEQ ID NO: 2613836 - DNA, 18 bp, Homo sapiens
tactgccagatgctgatg

SEQ ID NO: 2613837 - DNA, 21 bp, Homo sapiens
tactgccagatgctgatgttc

SEQ ID NO: 2613838 - DNA, 23 bp, Homo sapiens
tactggtccaaaagattgctgaa

SEQ ID NO: 2613839 - DNA, 12 bp, Homo sapiens
tactgtaaagaa

SEQ ID NO: 2613840 - DNA, 13 bp, Homo sapiens
tactgtaaagaaa

SEQ ID NO: 2613841 - DNA, 14 bp, Homo sapiens
tactgtacttaata

SEQ ID NO: 2613842 - DNA, 12 bp, Homo sapiens
tactgtagtttt

SEQ ID NO: 2613843 - DNA, 13 bp, Homo sapiens
tactgtagttttt

SEQ ID NO: 2613844 - DNA, 18 bp, Homo sapiens
tactgtcaaaataatttt

SEQ ID NO: 2613845 - DNA, 19 bp, Homo sapiens
tactgtctggttttaacaa

SEQ ID NO: 2613846 - DNA, 21 bp, Homo sapiens
tactgtctggttttaacaatt

SEQ ID NO: 2613847 - DNA, 13 bp, Homo sapiens
tactgtgactgat

SEQ ID NO: 2613848 - DNA, 18 bp, Homo sapiens
tactgtggaaaagaaaca

SEQ ID NO: 2613849 - DNA, 16 bp, Homo sapiens
tactgtggaggaagga

SEQ ID NO: 2613850 - DNA, 18 bp, Homo sapiens
tactgtggaggaaggatt

SEQ ID NO: 2613851 - DNA, 22 bp, Homo sapiens
tactgtgtacagaattctgcta

SEQ ID NO: 2613852 - DNA, 12 bp, Homo sapiens
tactgtgttcct

SEQ ID NO: 2613853 - DNA, 19 bp, Homo sapiens
tactgtgttcctggcaata

SEQ ID NO: 2613854 - DNA, 17 bp, Homo sapiens
tactgttctgtgtcttt

SEQ ID NO: 2613855 - DNA, 17 bp, Homo sapiens
tacttaaatgaaagcat

SEQ ID NO: 2613856 - DNA, 20 bp, Homo sapiens
tacttaaatggaaaaaatga

SEQ ID NO: 2613857 - DNA, 13 bp, Homo sapiens
tacttaatttctt

SEQ ID NO: 2613858 - DNA, 17 bp, Homo sapiens
tacttaccatatgtgct

SEQ ID NO: 2613859 - DNA, 13 bp, Homo sapiens
tacttattccaga

SEQ ID NO: 2613860 - DNA, 16 bp, Homo sapiens
tacttcaaaagtattt

SEQ ID NO: 2613861 - DNA, 23 bp, Homo sapiens
tacttcaagttaaagtgaataac

SEQ ID NO: 2613862 - DNA, 15 bp, Homo sapiens
tacttcactttaatt

SEQ ID NO: 2613863 - DNA, 22 bp, Homo sapiens
tacttcactttaattctcatgt

SEQ ID NO: 2613864 - DNA, 23 bp, Homo sapiens
tacttcctgtgacttcagctctg

SEQ ID NO: 2613865 - DNA, 18 bp, Homo sapiens
tacttcgtcttctaattt

SEQ ID NO: 2613866 - DNA, 14 bp, Homo sapiens
tacttgtcaaagaa

SEQ ID NO: 2613867 - DNA, 13 bp, Homo sapiens
tacttgtggacac

SEQ ID NO: 2613868 - DNA, 22 bp, Homo sapiens
tacttgttcaaaatatgttctt

SEQ ID NO: 2613869 - DNA, 21 bp, Homo sapiens
tactttgcctttccataatca

SEQ ID NO: 2613870 - DNA, 17 bp, Homo sapiens
tactttgccttttgcaa

SEQ ID NO: 2613871 - DNA, 19 bp, Homo sapiens
tactttgccttttgcaaac

SEQ ID NO: 2613872 - DNA, 22 bp, Homo sapiens
tactttgtacaaagaccacaca

SEQ ID NO: 2613873 - DNA, 16 bp, Homo sapiens
tactttgtctgaaaaa

SEQ ID NO: 2613874 - DNA, 21 bp, Homo sapiens
tacttttaaacagtgagcctg

SEQ ID NO: 2613875 - DNA, 19 bp, Homo sapiens
tacttttatgatgtatatt

SEQ ID NO: 2613876 - DNA, 15 bp, Homo sapiens
tacttttgccctttg

SEQ ID NO: 2613877 - DNA, 13 bp, Homo sapiens
tactttttcctgg

SEQ ID NO: 2613878 - DNA, 16 bp, Homo sapiens
tagaaaaaccctgccc

SEQ ID NO: 2613879 - DNA, 22 bp, Homo sapiens
tagaaaaaccctgcccccaaat

SEQ ID NO: 2613880 - DNA, 16 bp, Homo sapiens
tagaaaacataatctt

SEQ ID NO: 2613881 - DNA, 13 bp, Homo sapiens
tagaaaactgaaa

SEQ ID NO: 2613882 - DNA, 21 bp, Homo sapiens
tagaaaagaaaaaaaaaatat

SEQ ID NO: 2613883 - DNA, 23 bp, Homo sapiens
tagaaaatttgttattttgcaac

SEQ ID NO: 2613884 - DNA, 23 bp, Homo sapiens
tagaaacatggttttgaaatgct

SEQ ID NO: 2613885 - DNA, 15 bp, Homo sapiens
tagaaaccttaatat

SEQ ID NO: 2613886 - DNA, 15 bp, Homo sapiens
tagaaagaagatgaa

SEQ ID NO: 2613887 - DNA, 22 bp, Homo sapiens
tagaaagccaaatcaaaatatg

SEQ ID NO: 2613888 - DNA, 15 bp, Homo sapiens
tagaaaggggcccag

SEQ ID NO: 2613889 - DNA, 16 bp, Homo sapiens
tagaaataaatagcta

SEQ ID NO: 2613890 - DNA, 19 bp, Homo sapiens
tagaaataaatagctatat

SEQ ID NO: 2613891 - DNA, 11 bp, Homo sapiens
tagaaataagt

SEQ ID NO: 2613892 - DNA, 15 bp, Homo sapiens
tagaaatataattga

SEQ ID NO: 2613893 - DNA, 14 bp, Homo sapiens
tagaaatatgattt

SEQ ID NO: 2613894 - DNA, 15 bp, Homo sapiens
tagaaatttccagag

SEQ ID NO: 2613895 - DNA, 19 bp, Homo sapiens
tagaaatttttcagatgct

SEQ ID NO: 2613896 - DNA, 20 bp, Homo sapiens
tagaacaaaggacagagtat

SEQ ID NO: 2613897 - DNA, 23 bp, Homo sapiens
tagaacagagaaagaggaagctt

SEQ ID NO: 2613898 - DNA, 14 bp, Homo sapiens
tagaacatccctgc

SEQ ID NO: 2613899 - DNA, 22 bp, Homo sapiens
tagaacatggagagctagaacc

SEQ ID NO: 2613900 - DNA, 22 bp, Homo sapiens
tagaaccaccaacaagcaagct

SEQ ID NO: 2613901 - DNA, 15 bp, Homo sapiens
tagaaccactatgaa

SEQ ID NO: 2613902 - DNA, 23 bp, Homo sapiens
tagaaccaggcaacttgggaact

SEQ ID NO: 2613903 - DNA, 22 bp, Homo sapiens
tagaacctggagagctagaacc

SEQ ID NO: 2613904 - DNA, 17 bp, Homo sapiens
tagaacctggagggctg

SEQ ID NO: 2613905 - DNA, 19 bp, Homo sapiens
tagaactcagttttaacta

SEQ ID NO: 2613906 - DNA, 23 bp, Homo sapiens
tagaactctccatcttattttca

SEQ ID NO: 2613907 - DNA, 20 bp, Homo sapiens
tagaactgtatgtcagacat

SEQ ID NO: 2613908 - DNA, 16 bp, Homo sapiens
tagaacttgaccccct

SEQ ID NO: 2613909 - DNA, 21 bp, Homo sapiens
tagaagactctaccagactgt

SEQ ID NO: 2613910 - DNA, 16 bp, Homo sapiens
tagaagatcctacccc

SEQ ID NO: 2613911 - DNA, 22 bp, Homo sapiens
tagaagcattccttctttgata

SEQ ID NO: 2613912 - DNA, 23 bp, Homo sapiens
tagaagcattccttctttgataa

SEQ ID NO: 2613913 - DNA, 14 bp, Homo sapiens
tagaagctggagga

SEQ ID NO: 2613914 - DNA, 22 bp, Homo sapiens
tagaagggccagtcctgcctgg

SEQ ID NO: 2613915 - DNA, 21 bp, Homo sapiens
tagaaggtcggaggcttggga

SEQ ID NO: 2613916 - DNA, 20 bp, Homo sapiens
tagaagtaggaagtgaaaat

SEQ ID NO: 2613917 - DNA, 20 bp, Homo sapiens
tagaagttactgaatgcacc

SEQ ID NO: 2613918 - DNA, 13 bp, Homo sapiens
tagaagtttttgt

SEQ ID NO: 2613919 - DNA, 14 bp, Homo sapiens
tagaagtttttgta

SEQ ID NO: 2613920 - DNA, 22 bp, Homo sapiens
tagaagtttttgtactgtaaag

SEQ ID NO: 2613921 - DNA, 15 bp, Homo sapiens
tagaatatttattac

SEQ ID NO: 2613922 - DNA, 21 bp, Homo sapiens
tagaatcagcctaggggtcag

SEQ ID NO: 2613923 - DNA, 16 bp, Homo sapiens
tagaatgtattgtacc

SEQ ID NO: 2613924 - DNA, 18 bp, Homo sapiens
tagaatgtattgtacctt

SEQ ID NO: 2613925 - DNA, 22 bp, Homo sapiens
tagaatgtattgtaccttttaa

SEQ ID NO: 2613926 - DNA, 18 bp, Homo sapiens
tagaatgtgttttctgaa

SEQ ID NO: 2613927 - DNA, 20 bp, Homo sapiens
tagaatgtgttttctgaata

SEQ ID NO: 2613928 - DNA, 12 bp, Homo sapiens
tagaattattta

SEQ ID NO: 2613929 - DNA, 16 bp, Homo sapiens
tagaattatttaaaca

SEQ ID NO: 2613930 - DNA, 15 bp, Homo sapiens
tagaattccctctct

SEQ ID NO: 2613931 - DNA, 20 bp, Homo sapiens
tagaatttattcaattcctc

SEQ ID NO: 2613932 - DNA, 22 bp, Homo sapiens
tagaatttattcaattcctctg

SEQ ID NO: 2613933 - DNA, 23 bp, Homo sapiens
tagaatttattcaattcctctgg

SEQ ID NO: 2613934 - DNA, 14 bp, Homo sapiens
tagacaaatactca

SEQ ID NO: 2613935 - DNA, 15 bp, Homo sapiens
tagacaaatactcat

SEQ ID NO: 2613936 - DNA, 16 bp, Homo sapiens
tagacaaatactcatg

SEQ ID NO: 2613937 - DNA, 20 bp, Homo sapiens
tagacaaatactcatgtgta

SEQ ID NO: 2613938 - DNA, 22 bp, Homo sapiens
tagacaagtccagcctggcaag

SEQ ID NO: 2613939 - DNA, 21 bp, Homo sapiens
tagacagagtctcactgttgc

SEQ ID NO: 2613940 - DNA, 17 bp, Homo sapiens
tagacagtccctgccaa

SEQ ID NO: 2613941 - DNA, 21 bp, Homo sapiens
tagacagtccctgccaatgga

SEQ ID NO: 2613942 - DNA, 13 bp, Homo sapiens
tagacattctgtc

SEQ ID NO: 2613943 - DNA, 21 bp, Homo sapiens
tagacatttctcttactgcaa

SEQ ID NO: 2613944 - DNA, 15 bp, Homo sapiens
tagacccatcttctt

SEQ ID NO: 2613945 - DNA, 12 bp, Homo sapiens
tagacctcagcc

SEQ ID NO: 2613946 - DNA, 14 bp, Homo sapiens
tagacctcagcctg

SEQ ID NO: 2613947 - DNA, 19 bp, Homo sapiens
tagactcatcttactgtac

SEQ ID NO: 2613948 - DNA, 18 bp, Homo sapiens
tagacttaatagaaacat

SEQ ID NO: 2613949 - DNA, 15 bp, Homo sapiens
tagacttgaaatact

SEQ ID NO: 2613950 - DNA, 18 bp, Homo sapiens
tagacttgtgctgatcgt

SEQ ID NO: 2613951 - DNA, 19 bp, Homo sapiens
tagagaacgcagccctaga

SEQ ID NO: 2613952 - DNA, 15 bp, Homo sapiens
tagagacagaagcag

SEQ ID NO: 2613953 - DNA, 16 bp, Homo sapiens
tagagagagaccactt

SEQ ID NO: 2613954 - DNA, 17 bp, Homo sapiens
tagagatagtacataaa

SEQ ID NO: 2613955 - DNA, 20 bp, Homo sapiens
tagagatcatcctttccagc

SEQ ID NO: 2613956 - DNA, 17 bp, Homo sapiens
tagagatctggttttgc

SEQ ID NO: 2613957 - DNA, 20 bp, Homo sapiens
tagagatctggttttgctat

SEQ ID NO: 2613958 - DNA, 23 bp, Homo sapiens
tagagatgtttttaaaagtttca

SEQ ID NO: 2613959 - DNA, 17 bp, Homo sapiens
tagagattacctcctga

SEQ ID NO: 2613960 - DNA, 20 bp, Homo sapiens
tagagcacctagtccagtga

SEQ ID NO: 2613961 - DNA, 20 bp, Homo sapiens
tagagcaggcgttcagctca

SEQ ID NO: 2613962 - DNA, 15 bp, Homo sapiens
tagagcattgccatt

SEQ ID NO: 2613963 - DNA, 14 bp, Homo sapiens
tagagctgatccag

SEQ ID NO: 2613964 - DNA, 18 bp, Homo sapiens
tagaggaaaaaaatgact

SEQ ID NO: 2613965 - DNA, 22 bp, Homo sapiens
tagaggaaaaaaatgactaaaa

SEQ ID NO: 2613966 - DNA, 16 bp, Homo sapiens
tagaggccagcctggc

SEQ ID NO: 2613967 - DNA, 19 bp, Homo sapiens
tatcagcctgtctcttcca

SEQ ID NO: 2613968 - DNA, 22 bp, Homo sapiens
tatcagcctgtctcttccatat

SEQ ID NO: 2613969 - DNA, 21 bp, Homo sapiens
tatcaggacccagaggaaggg

SEQ ID NO: 2613970 - DNA, 23 bp, Homo sapiens
tatcaggtctcccacgtgggaga

SEQ ID NO: 2613971 - DNA, 17 bp, Homo sapiens
tatcaggtgctgccatc

SEQ ID NO: 2613972 - DNA, 9 bp, Homo sapiens
tatcagtag

SEQ ID NO: 2613973 - DNA, 15 bp, Homo sapiens
tatcagtgacagagt

SEQ ID NO: 2613974 - DNA, 20 bp, Homo sapiens
tatcagtgacagagttcact

SEQ ID NO: 2613975 - DNA, 17 bp, Homo sapiens
tatcagtgtaagccctg

SEQ ID NO: 2613976 - DNA, 20 bp, Homo sapiens
tatcagtttgtcctgtagag

SEQ ID NO: 2613977 - DNA, 18 bp, Homo sapiens
tatcatagaaatgtaact

SEQ ID NO: 2613978 - DNA, 14 bp, Homo sapiens
tatcatcagtattg

SEQ ID NO: 2613979 - DNA, 17 bp, Homo sapiens
tatcatccacattgttt

SEQ ID NO: 2613980 - DNA, 22 bp, Homo sapiens
tatcatccacattgttttaaaa

SEQ ID NO: 2613981 - DNA, 19 bp, Homo sapiens
tatcatgcatgtcctgtaa

SEQ ID NO: 2613982 - DNA, 15 bp, Homo sapiens
tatcatggagtgacg

SEQ ID NO: 2613983 - DNA, 21 bp, Homo sapiens
tatcatgtcaaacgtgaaaat

SEQ ID NO: 2613984 - DNA, 17 bp, Homo sapiens
tatcatttttgtacagt

SEQ ID NO: 2613985 - DNA, 21 bp, Homo sapiens
tatcatttttgtacagtttgc

SEQ ID NO: 2613986 - DNA, 22 bp, Homo sapiens
tatcatttttgtacagtttgct

SEQ ID NO: 2613987 - DNA, 23 bp, Homo sapiens
tatccacagagagtcccactgcc

SEQ ID NO: 2613988 - DNA, 22 bp, Homo sapiens
tatccatgtactgtagtttttc

SEQ ID NO: 2613989 - DNA, 15 bp, Homo sapiens
tatccattatcatgt

SEQ ID NO: 2613990 - DNA, 17 bp, Homo sapiens
tatccattatcatgtgt

SEQ ID NO: 2613991 - DNA, 19 bp, Homo sapiens
tatccattatcatgtgtaa

SEQ ID NO: 2613992 - DNA, 19 bp, Homo sapiens
tatccctactgtaatttgt

SEQ ID NO: 2613993 - DNA, 19 bp, Homo sapiens
tatcctacaacaagagttt

SEQ ID NO: 2613994 - DNA, 15 bp, Homo sapiens
tatcctccaggtttt

SEQ ID NO: 2613995 - DNA, 17 bp, Homo sapiens
tatcctccaggtttttc

SEQ ID NO: 2613996 - DNA, 18 bp, Homo sapiens
tatcctccaggtttttca

SEQ ID NO: 2613997 - DNA, 20 bp, Homo sapiens
tatcctccaggtttttcaat

SEQ ID NO: 2613998 - DNA, 22 bp, Homo sapiens
tatcctccaggtttttcaatta

SEQ ID NO: 2613999 - DNA, 23 bp, Homo sapiens
tatcctccaggtttttcaattaa

SEQ ID NO: 2614000 - DNA, 12 bp, Homo sapiens
tatcctctgtaa

SEQ ID NO: 2614001 - DNA, 16 bp, Homo sapiens
tatcctgaaatttcag

SEQ ID NO: 2614002 - DNA, 22 bp, Homo sapiens
tatcctgcttctgatatgcagt

SEQ ID NO: 2614003 - DNA, 10 bp, Homo sapiens
tatcctgggg

SEQ ID NO: 2614004 - DNA, 15 bp, Homo sapiens
tatcgaaataacaat

SEQ ID NO: 2614005 - DNA, 16 bp, Homo sapiens
tatcgaaataacaatg

SEQ ID NO: 2614006 - DNA, 19 bp, Homo sapiens
tatcgaaataacaatgtta

SEQ ID NO: 2614007 - DNA, 20 bp, Homo sapiens
tatcgaaataacaatgttaa

SEQ ID NO: 2614008 - DNA, 15 bp, Homo sapiens
tatcgggagcagtgt

SEQ ID NO: 2614009 - DNA, 17 bp, Homo sapiens
tatcgggagcagtgtct

SEQ ID NO: 2614010 - DNA, 18 bp, Homo sapiens
tatcgggagcagtgtctt

SEQ ID NO: 2614011 - DNA, 21 bp, Homo sapiens
tatcgtaaccagccagatcct

SEQ ID NO: 2614012 - DNA, 16 bp, Homo sapiens
tatctaaattgaataa

SEQ ID NO: 2614013 - DNA, 21 bp, Homo sapiens
tatctaaattgaataatggta

SEQ ID NO: 2614014 - DNA, 16 bp, Homo sapiens
tatctaatacctctgt

SEQ ID NO: 2614015 - DNA, 21 bp, Homo sapiens
tatctaatatgtaacaagcca

SEQ ID NO: 2614016 - DNA, 21 bp, Homo sapiens
tatctacatcttttttcacaa

SEQ ID NO: 2614017 - DNA, 16 bp, Homo sapiens
tatctagatactgtat

SEQ ID NO: 2614018 - DNA, 20 bp, Homo sapiens
tatctagtgcagctgatttt

SEQ ID NO: 2614019 - DNA, 16 bp, Homo sapiens
tatctatatataattc

SEQ ID NO: 2614020 - DNA, 21 bp, Homo sapiens
tatctatatataattctgtac

SEQ ID NO: 2614021 - DNA, 19 bp, Homo sapiens
tatctatatgtacttgtca

SEQ ID NO: 2614022 - DNA, 13 bp, Homo sapiens
tatctatcttata

SEQ ID NO: 2614023 - DNA, 17 bp, Homo sapiens
tatctcaaaactgcact

SEQ ID NO: 2614024 - DNA, 16 bp, Homo sapiens
tatctcccccagcccc

SEQ ID NO: 2614025 - DNA, 17 bp, Homo sapiens
tatctctatttaatatt

SEQ ID NO: 2614026 - DNA, 12 bp, Homo sapiens
tatctctctgtg

SEQ ID NO: 2614027 - DNA, 18 bp, Homo sapiens
tatctctgaagcatgttt

SEQ ID NO: 2614028 - DNA, 11 bp, Homo sapiens
tatctctgtgt

SEQ ID NO: 2614029 - DNA, 17 bp, Homo sapiens
tatctctgtgtgcacaa

SEQ ID NO: 2614030 - DNA, 18 bp, Homo sapiens
tatctctgtgtgcacaaa

SEQ ID NO: 2614031 - DNA, 12 bp, Homo sapiens
tatctctgtgtt

SEQ ID NO: 2614032 - DNA, 22 bp, Homo sapiens
tatctcttttgaatccatgctt

SEQ ID NO: 2614033 - DNA, 14 bp, Homo sapiens
tatctgaaaatgta

SEQ ID NO: 2614034 - DNA, 15 bp, Homo sapiens
tatctgaaaatgtat

SEQ ID NO: 2614035 - DNA, 17 bp, Homo sapiens
tatctgctgtccagaca

SEQ ID NO: 2614036 - DNA, 20 bp, Homo sapiens
tatctgcttcagtggagaat

SEQ ID NO: 2614037 - DNA, 19 bp, Homo sapiens
tatctgggattctacttta

SEQ ID NO: 2614038 - DNA, 11 bp, Homo sapiens
tatctgtattt

SEQ ID NO: 2614039 - DNA, 20 bp, Homo sapiens
tatctgtcatttgagcaggg

SEQ ID NO: 2614040 - DNA, 18 bp, Homo sapiens
tatctgtgcgtgaaacac

SEQ ID NO: 2614041 - DNA, 14 bp, Homo sapiens
tatctgttctttaa

SEQ ID NO: 2614042 - DNA, 15 bp, Homo sapiens
tatcttgtctctggg

SEQ ID NO: 2614043 - DNA, 17 bp, Homo sapiens
tatcttgtctctgggct

SEQ ID NO: 2614044 - DNA, 18 bp, Homo sapiens
tatcttgtttttccacta

SEQ ID NO: 2614045 - DNA, 19 bp, Homo sapiens
tatctttcgcacagcagtt

SEQ ID NO: 2614046 - DNA, 23 bp, Homo sapiens
tatctttcgtgataaactttgct

SEQ ID NO: 2614047 - DNA, 14 bp, Homo sapiens
tatctttgccaccc

SEQ ID NO: 2614048 - DNA, 22 bp, Homo sapiens
tatctttgccaccctcatgctg

SEQ ID NO: 2614049 - DNA, 14 bp, Homo sapiens
tatgaaataaagaa

SEQ ID NO: 2614050 - DNA, 15 bp, Homo sapiens
tatgaagaaaaaata

SEQ ID NO: 2614051 - DNA, 14 bp, Homo sapiens
tatgaagacataaa

SEQ ID NO: 2614052 - DNA, 21 bp, Homo sapiens
tatgaagctacctcaaacttc

SEQ ID NO: 2614053 - DNA, 14 bp, Homo sapiens
tatgaagtatataa

SEQ ID NO: 2614054 - DNA, 16 bp, Homo sapiens
tatgaagtatataatg

SEQ ID NO: 2614055 - DNA, 12 bp, Homo sapiens
tatgaataacat

SEQ ID NO: 2614056 - DNA, 21 bp, Homo sapiens
tatgaatctattatactgtat

SEQ ID NO: 2614057 - DNA, 23 bp, Homo sapiens
tatgaatctattatactgtatta

SEQ ID NO: 2614058 - DNA, 21 bp, Homo sapiens
tatgaatgcccccagctggcc

SEQ ID NO: 2614059 - DNA, 12 bp, Homo sapiens
tatgactaaaga

SEQ ID NO: 2614060 - DNA, 13 bp, Homo sapiens
tatgactaaagag

SEQ ID NO: 2614061 - DNA, 17 bp, Homo sapiens
tatgactaaagagagaa

SEQ ID NO: 2614062 - DNA, 21 bp, Homo sapiens
tatgactaaagagagaatgta

SEQ ID NO: 2614063 - DNA, 22 bp, Homo sapiens
tatgactgctccccagccctgg

SEQ ID NO: 2614064 - DNA, 13 bp, Homo sapiens
tatgaggcatttg

SEQ ID NO: 2614065 - DNA, 15 bp, Homo sapiens
tatgagggaaaatga

SEQ ID NO: 2614066 - DNA, 16 bp, Homo sapiens
tatgagtcaatgtgca

SEQ ID NO: 2614067 - DNA, 23 bp, Homo sapiens
tatgagtcaatgtgcagtgtagc

SEQ ID NO: 2614068 - DNA, 17 bp, Homo sapiens
tatgagtttcatagcta

SEQ ID NO: 2614069 - DNA, 22 bp, Homo sapiens
tatgagtttttgatagctttat

SEQ ID NO: 2614070 - DNA, 18 bp, Homo sapiens
tatgatgtgttgtgatag

SEQ ID NO: 2614071 - DNA, 15 bp, Homo sapiens
tatgatttggaaaat

SEQ ID NO: 2614072 - DNA, 18 bp, Homo sapiens
tatgatttggaaaataaa

SEQ ID NO: 2614073 - DNA, 14 bp, Homo sapiens
tatgcaaagcactg

SEQ ID NO: 2614074 - DNA, 15 bp, Homo sapiens
tatgcaaagcactga

SEQ ID NO: 2614075 - DNA, 20 bp, Homo sapiens
tatgcaaggaaggaaagaaa

SEQ ID NO: 2614076 - DNA, 16 bp, Homo sapiens
tatgcaatttcctttt

SEQ ID NO: 2614077 - DNA, 19 bp, Homo sapiens
tatgcacatatggactctg

SEQ ID NO: 2614078 - DNA, 20 bp, Homo sapiens
tatgcacatatggactctgc

SEQ ID NO: 2614079 - DNA, 19 bp, Homo sapiens
tatgcaccttgtgtctgta

SEQ ID NO: 2614080 - DNA, 15 bp, Homo sapiens
tatgcacgaccttgg

SEQ ID NO: 2614081 - DNA, 14 bp, Homo sapiens
tatgcataaagtca

SEQ ID NO: 2614082 - DNA, 22 bp, Homo sapiens
tatgcatttaaatacagtcttc

SEQ ID NO: 2614083 - DNA, 23 bp, Homo sapiens
tatgcatttgaaaattttgatgt

SEQ ID NO: 2614084 - DNA, 22 bp, Homo sapiens
tatgccacgggaagtttagaga

SEQ ID NO: 2614085 - DNA, 12 bp, Homo sapiens
tatgcccagttt

SEQ ID NO: 2614086 - DNA, 20 bp, Homo sapiens
tatgccgaatgccctcaggg

SEQ ID NO: 2614087 - DNA, 19 bp, Homo sapiens
tatgcctctcctttgtata

SEQ ID NO: 2614088 - DNA, 16 bp, Homo sapiens
tatgcctttaaatctg

SEQ ID NO: 2614089 - DNA, 19 bp, Homo sapiens
tatgctctcgcacctttcc

SEQ ID NO: 2614090 - DNA, 14 bp, Homo sapiens
tatgctctgcatgt

SEQ ID NO: 2614091 - DNA, 19 bp, Homo sapiens
tatgctctgcatgttacat

SEQ ID NO: 2614092 - DNA, 20 bp, Homo sapiens
tatgctgccaaattttggcc

SEQ ID NO: 2614093 - DNA, 22 bp, Homo sapiens
tatgctgccaaattttggccaa

SEQ ID NO: 2614094 - DNA, 16 bp, Homo sapiens
tatgcttactgatata

SEQ ID NO: 2614095 - DNA, 15 bp, Homo sapiens
tatgctttgaatgta

SEQ ID NO: 2614096 - DNA, 19 bp, Homo sapiens
tatggaagggtttgtggct

SEQ ID NO: 2614097 - DNA, 22 bp, Homo sapiens
tatggaagggtttgtggctggg

SEQ ID NO: 2614098 - DNA, 20 bp, Homo sapiens
tatggaatttttcattgata

SEQ ID NO: 2614099 - DNA, 16 bp, Homo sapiens
tatggacggtgctcca

SEQ ID NO: 2614100 - DNA, 18 bp, Homo sapiens
tatggagctcagagaggg

SEQ ID NO: 2614101 - DNA, 13 bp, Homo sapiens
tatggataatgcc

SEQ ID NO: 2614102 - DNA, 15 bp, Homo sapiens
tatggcagaagacac

SEQ ID NO: 2614103 - DNA, 16 bp, Homo sapiens
tatggcagaagacacc

SEQ ID NO: 2614104 - DNA, 20 bp, Homo sapiens
tatggccctggcctagcata

SEQ ID NO: 2614105 - DNA, 21 bp, Homo sapiens
tatggccctggcctagcatac

SEQ ID NO: 2614106 - DNA, 23 bp, Homo sapiens
tatggcctcagctgcctcacttc

SEQ ID NO: 2614107 - DNA, 16 bp, Homo sapiens
tatggctataggtgct

SEQ ID NO: 2614108 - DNA, 16 bp, Homo sapiens
tatggcttttgtgcat

SEQ ID NO: 2614109 - DNA, 21 bp, Homo sapiens
tatggcttttgtgcattatct

SEQ ID NO: 2614110 - DNA, 22 bp, Homo sapiens
tatgggtgtgtgtttgtgtgag

SEQ ID NO: 2614111 - DNA, 22 bp, Homo sapiens
tcacacatgagcatcaggccag

SEQ ID NO: 2614112 - DNA, 23 bp, Homo sapiens
tcacacatgagcatcaggccagg

SEQ ID NO: 2614113 - DNA, 13 bp, Homo sapiens
tcacaccagccat

SEQ ID NO: 2614114 - DNA, 21 bp, Homo sapiens
tcacacccaccgtccgccctg

SEQ ID NO: 2614115 - DNA, 23 bp, Homo sapiens
tcacacccaccgtccgccctgct

SEQ ID NO: 2614116 - DNA, 20 bp, Homo sapiens
tcacacctagcgtcagtatt

SEQ ID NO: 2614117 - DNA, 22 bp, Homo sapiens
tcacacgtctggcttcacagat

SEQ ID NO: 2614118 - DNA, 11 bp, Homo sapiens
tcacactggga

SEQ ID NO: 2614119 - DNA, 20 bp, Homo sapiens
tcacacttccaccagcctgc

SEQ ID NO: 2614120 - DNA, 23 bp, Homo sapiens
tcacacttctgtgagacccccac

SEQ ID NO: 2614121 - DNA, 15 bp, Homo sapiens
tcacagacctggagc

SEQ ID NO: 2614122 - DNA, 19 bp, Homo sapiens
tcacagacctggagcccct

SEQ ID NO: 2614123 - DNA, 22 bp, Homo sapiens
tcacagacctggagcccctggg

SEQ ID NO: 2614124 - DNA, 23 bp, Homo sapiens
tcacagacctggagcccctgggt

SEQ ID NO: 2614125 - DNA, 21 bp, Homo sapiens
tcacagagacattcctccgag

SEQ ID NO: 2614126 - DNA, 23 bp, Homo sapiens
tcacagagacattcctccgagcc

SEQ ID NO: 2614127 - DNA, 14 bp, Homo sapiens
tcacagagtgtgct

SEQ ID NO: 2614128 - DNA, 21 bp, Homo sapiens
tcacagatgtgtgattcacag

SEQ ID NO: 2614129 - DNA, 23 bp, Homo sapiens
tcacagcaagtcactggccagtg

SEQ ID NO: 2614130 - DNA, 17 bp, Homo sapiens
tcacagccagactggca

SEQ ID NO: 2614131 - DNA, 20 bp, Homo sapiens
tcacagcctcctctgtctgc

SEQ ID NO: 2614132 - DNA, 22 bp, Homo sapiens
tcacagcctcctctgtctgccc

SEQ ID NO: 2614133 - DNA, 16 bp, Homo sapiens
tcacagctcctcccac

SEQ ID NO: 2614134 - DNA, 19 bp, Homo sapiens
tcacagcttcagccaggag

SEQ ID NO: 2614135 - DNA, 19 bp, Homo sapiens
tcacaggaagtagaggagg

SEQ ID NO: 2614136 - DNA, 18 bp, Homo sapiens
tcacaggactctgcctcc

SEQ ID NO: 2614137 - DNA, 23 bp, Homo sapiens
tcacaggactctgcctcctcttc

SEQ ID NO: 2614138 - DNA, 15 bp, Homo sapiens
tcacaggcaggtcca

SEQ ID NO: 2614139 - DNA, 16 bp, Homo sapiens
tcacaggcaggtccag

SEQ ID NO: 2614140 - DNA, 17 bp, Homo sapiens
tcacaggcaggtccagg

SEQ ID NO: 2614141 - DNA, 19 bp, Homo sapiens
tcacagggcagagccggga

SEQ ID NO: 2614142 - DNA, 12 bp, Homo sapiens
tcacagggccaa

SEQ ID NO: 2614143 - DNA, 16 bp, Homo sapiens
tcacagggccccagaa

SEQ ID NO: 2614144 - DNA, 19 bp, Homo sapiens
tcacagggttgggcccaga

SEQ ID NO: 2614145 - DNA, 19 bp, Homo sapiens
tcacagtccttaccagcag

SEQ ID NO: 2614146 - DNA, 23 bp, Homo sapiens
tcacagtccttaccagcagagca

SEQ ID NO: 2614147 - DNA, 21 bp, Homo sapiens
tcacagtctctttaatcttca

SEQ ID NO: 2614148 - DNA, 23 bp, Homo sapiens
tcacagtctctttaatcttcagt

SEQ ID NO: 2614149 - DNA, 17 bp, Homo sapiens
tcacagtgggagccagg

SEQ ID NO: 2614150 - DNA, 18 bp, Homo sapiens
tcacagtgggagccaggg

SEQ ID NO: 2614151 - DNA, 18 bp, Homo sapiens
tcacagtgtttgcaatgg

SEQ ID NO: 2614152 - DNA, 13 bp, Homo sapiens
tcacagttgacaa

SEQ ID NO: 2614153 - DNA, 23 bp, Homo sapiens
tcacagttttggttgctttaata

SEQ ID NO: 2614154 - DNA, 17 bp, Homo sapiens
tcacataaaacctcatt

SEQ ID NO: 2614155 - DNA, 12 bp, Homo sapiens
tcacatatctgt

SEQ ID NO: 2614156 - DNA, 20 bp, Homo sapiens
tcacatattgatttccgtta

SEQ ID NO: 2614157 - DNA, 13 bp, Homo sapiens
tcacatcacagga

SEQ ID NO: 2614158 - DNA, 14 bp, Homo sapiens
tcacatctttcaca

SEQ ID NO: 2614159 - DNA, 17 bp, Homo sapiens
tcacatctttcacactt

SEQ ID NO: 2614160 - DNA, 20 bp, Homo sapiens
tcacatctttcacacttcca

SEQ ID NO: 2614161 - DNA, 14 bp, Homo sapiens
tcacatgaccacat

SEQ ID NO: 2614162 - DNA, 23 bp, Homo sapiens
tcacatgagctatttccattcca

SEQ ID NO: 2614163 - DNA, 21 bp, Homo sapiens
tcacatggcctatgcacatat

SEQ ID NO: 2614164 - DNA, 15 bp, Homo sapiens
tcacatgtatgtttt

SEQ ID NO: 2614165 - DNA, 19 bp, Homo sapiens
tcacattaatatttgctga

SEQ ID NO: 2614166 - DNA, 19 bp, Homo sapiens
tcacattactgtatatact

SEQ ID NO: 2614167 - DNA, 19 bp, Homo sapiens
tcacattcttataaatatg

SEQ ID NO: 2614168 - DNA, 21 bp, Homo sapiens
tcacattcttataaatatgaa

SEQ ID NO: 2614169 - DNA, 19 bp, Homo sapiens
tcaccaaatcagctgctac

SEQ ID NO: 2614170 - DNA, 21 bp, Homo sapiens
tcaccaaatcagctgctacta

SEQ ID NO: 2614171 - DNA, 13 bp, Homo sapiens
tcaccacctctcc

SEQ ID NO: 2614172 - DNA, 19 bp, Homo sapiens
tcaccagaggaatcactct

SEQ ID NO: 2614173 - DNA, 21 bp, Homo sapiens
tcaccagatttgctaatttat

SEQ ID NO: 2614174 - DNA, 13 bp, Homo sapiens
tcaccagcaccaa

SEQ ID NO: 2614175 - DNA, 19 bp, Homo sapiens
tcaccagcaccaacaccac

SEQ ID NO: 2614176 - DNA, 16 bp, Homo sapiens
tcaccagccccagtgc

SEQ ID NO: 2614177 - DNA, 19 bp, Homo sapiens
tcaccagcccggcctgctc

SEQ ID NO: 2614178 - DNA, 14 bp, Homo sapiens
tcaccagctgcctc

SEQ ID NO: 2614179 - DNA, 17 bp, Homo sapiens
tcaccatctcaggccac

SEQ ID NO: 2614180 - DNA, 21 bp, Homo sapiens
tcaccatctcaggccacctgc

SEQ ID NO: 2614181 - DNA, 15 bp, Homo sapiens
tcaccatgttggcca

SEQ ID NO: 2614182 - DNA, 17 bp, Homo sapiens
tcaccatttgattatgt

SEQ ID NO: 2614183 - DNA, 23 bp, Homo sapiens
tcaccatttggcaatgccatcat

SEQ ID NO: 2614184 - DNA, 19 bp, Homo sapiens
tcacccaagagattgttgt

SEQ ID NO: 2614185 - DNA, 16 bp, Homo sapiens
tcacccagacagctcc

SEQ ID NO: 2614186 - DNA, 12 bp, Homo sapiens
tcacccatgtgc

SEQ ID NO: 2614187 - DNA, 12 bp, Homo sapiens
tcaccccaccct

SEQ ID NO: 2614188 - DNA, 14 bp, Homo sapiens
tcaccccagcccca

SEQ ID NO: 2614189 - DNA, 20 bp, Homo sapiens
tcaccccagccccaaaactc

SEQ ID NO: 2614190 - DNA, 13 bp, Homo sapiens
tcacccccagctt

SEQ ID NO: 2614191 - DNA, 19 bp, Homo sapiens
tcaccccctcgggtctcct

SEQ ID NO: 2614192 - DNA, 15 bp, Homo sapiens
tcaccccggccacct

SEQ ID NO: 2614193 - DNA, 17 bp, Homo sapiens
tcaccccggccacctgc

SEQ ID NO: 2614194 - DNA, 18 bp, Homo sapiens
tcaccccggccacctgcg

SEQ ID NO: 2614195 - DNA, 14 bp, Homo sapiens
tcacccctgccctg

SEQ ID NO: 2614196 - DNA, 18 bp, Homo sapiens
tcacccgtccagaccttg

SEQ ID NO: 2614197 - DNA, 14 bp, Homo sapiens
tcaccctccacctc

SEQ ID NO: 2614198 - DNA, 20 bp, Homo sapiens
tcaccctccacctcttcacc

SEQ ID NO: 2614199 - DNA, 21 bp, Homo sapiens
tcaccctgtccaaactgccta

SEQ ID NO: 2614200 - DNA, 20 bp, Homo sapiens
tcaccgcagtcgtcgcacag

SEQ ID NO: 2614201 - DNA, 22 bp, Homo sapiens
tcaccgcagtcgtcgcacagtc

SEQ ID NO: 2614202 - DNA, 23 bp, Homo sapiens
tcaccggagctttcaaagaagga

SEQ ID NO: 2614203 - DNA, 15 bp, Homo sapiens
tcaccgtgggctccc

SEQ ID NO: 2614204 - DNA, 14 bp, Homo sapiens
tcacctaactcata

SEQ ID NO: 2614205 - DNA, 14 bp, Homo sapiens
tcacctcccctcct

SEQ ID NO: 2614206 - DNA, 15 bp, Homo sapiens
tcacctcccctcctt

SEQ ID NO: 2614207 - DNA, 19 bp, Homo sapiens
tcacctctggactggctag

SEQ ID NO: 2614208 - DNA, 21 bp, Homo sapiens
tcacctgagcccggatgcttc

SEQ ID NO: 2614209 - DNA, 19 bp, Homo sapiens
tcacctgagtcaccctacc

SEQ ID NO: 2614210 - DNA, 12 bp, Homo sapiens
tcacctgattca

SEQ ID NO: 2614211 - DNA, 15 bp, Homo sapiens
tcacctgctggcccc

SEQ ID NO: 2614212 - DNA, 17 bp, Homo sapiens
tcacctgctggcccctc

SEQ ID NO: 2614213 - DNA, 17 bp, Homo sapiens
tcacctgggcacctggg

SEQ ID NO: 2614214 - DNA, 17 bp, Homo sapiens
tcacctggggctgctgg

SEQ ID NO: 2614215 - DNA, 19 bp, Homo sapiens
tcacctgtaaacctgagtc

SEQ ID NO: 2614216 - DNA, 17 bp, Homo sapiens
tcacctgtactcttccg

SEQ ID NO: 2614217 - DNA, 18 bp, Homo sapiens
tcacctgtactcttccga

SEQ ID NO: 2614218 - DNA, 20 bp, Homo sapiens
tcacctgtgcttcgggccct

SEQ ID NO: 2614219 - DNA, 14 bp, Homo sapiens
tcacctttgtcccc

SEQ ID NO: 2614220 - DNA, 21 bp, Homo sapiens
tcacgattgtcatcaggagaa

SEQ ID NO: 2614221 - DNA, 15 bp, Homo sapiens
tcacgcacctcccat

SEQ ID NO: 2614222 - DNA, 17 bp, Homo sapiens
tcacgcacctcccatcc

SEQ ID NO: 2614223 - DNA, 13 bp, Homo sapiens
tcacgccactgca

SEQ ID NO: 2614224 - DNA, 14 bp, Homo sapiens
tcacgccactgcac

SEQ ID NO: 2614225 - DNA, 22 bp, Homo sapiens
tcacgccactgcactccagcct

SEQ ID NO: 2614226 - DNA, 23 bp, Homo sapiens
tcacgcctgtaatcccagcactt

SEQ ID NO: 2614227 - DNA, 19 bp, Homo sapiens
tcacgcctgtaatcctagc

SEQ ID NO: 2614228 - DNA, 16 bp, Homo sapiens
tcacgctttcctgaat

SEQ ID NO: 2614229 - DNA, 14 bp, Homo sapiens
tcacggaagagcct

SEQ ID NO: 2614230 - DNA, 16 bp, Homo sapiens
tcacggaagagccttg

SEQ ID NO: 2614231 - DNA, 17 bp, Homo sapiens
tcacggaagagccttgc

SEQ ID NO: 2614232 - DNA, 15 bp, Homo sapiens
tcacggctcactgca

SEQ ID NO: 2614233 - DNA, 22 bp, Homo sapiens
tcacgggagatttcttgttgct

SEQ ID NO: 2614234 - DNA, 18 bp, Homo sapiens
tcacgtaaagctagaaat

SEQ ID NO: 2614235 - DNA, 19 bp, Homo sapiens
tcacgtaaagctagaaatg

SEQ ID NO: 2614236 - DNA, 12 bp, Homo sapiens
tcacgtgtgtga

SEQ ID NO: 2614237 - DNA, 17 bp, Homo sapiens
tcacgtgtgtgactcag

SEQ ID NO: 2614238 - DNA, 14 bp, Homo sapiens
tcactactgcagtc

SEQ ID NO: 2614239 - DNA, 23 bp, Homo sapiens
tcactataggtcatacaatccat

SEQ ID NO: 2614240 - DNA, 21 bp, Homo sapiens
tcactatataggcatcacatt

SEQ ID NO: 2614241 - DNA, 22 bp, Homo sapiens
tcactatgaatctattatactg

SEQ ID NO: 2614242 - DNA, 14 bp, Homo sapiens
tcactatggtgcca

SEQ ID NO: 2614243 - DNA, 20 bp, Homo sapiens
tcactatgttgcccaggcag

SEQ ID NO: 2614244 - DNA, 21 bp, Homo sapiens
tcactatgttgcccaggcagg

SEQ ID NO: 2614245 - DNA, 20 bp, Homo sapiens
tcactatttttatttatatt

SEQ ID NO: 2614246 - DNA, 19 bp, Homo sapiens
tcactcccttctacctgcc

SEQ ID NO: 2614247 - DNA, 17 bp, Homo sapiens
tcactccggtgtgcctg

SEQ ID NO: 2614248 - DNA, 22 bp, Homo sapiens
tcactccggtgtgcctgcagcc

SEQ ID NO: 2614249 - DNA, 15 bp, Homo sapiens
tcactctctgaagat

SEQ ID NO: 2614250 - DNA, 12 bp, Homo sapiens
tcactctggcag

SEQ ID NO: 2614251 - DNA, 14 bp, Homo sapiens
tcactctggcagct

SEQ ID NO: 2614252 - DNA, 18 bp, Homo sapiens
tcactctggcagctcaga

SEQ ID NO: 2614253 - DNA, 20 bp, Homo sapiens
tcactctggcagctcagaga

SEQ ID NO: 2614254 - DNA, 23 bp, Homo sapiens
tctcaaagttttgaaaagctatt

SEQ ID NO: 2614255 - DNA, 21 bp, Homo sapiens
tctcaacccttttgtctgcct

SEQ ID NO: 2614256 - DNA, 23 bp, Homo sapiens
tctcaacccttttgtctgcctct

SEQ ID NO: 2614257 - DNA, 21 bp, Homo sapiens
tctcaacctaccaccccttcc

SEQ ID NO: 2614258 - DNA, 23 bp, Homo sapiens
tctcaagggctagcatccctgag

SEQ ID NO: 2614259 - DNA, 20 bp, Homo sapiens
tctcaaggtgggccttgcta

SEQ ID NO: 2614260 - DNA, 12 bp, Homo sapiens
tctcaatttcta

SEQ ID NO: 2614261 - DNA, 21 bp, Homo sapiens
tctcacacatgagcatcaggc

SEQ ID NO: 2614262 - DNA, 12 bp, Homo sapiens
tctcacagtggg

SEQ ID NO: 2614263 - DNA, 22 bp, Homo sapiens
tctcacagtgggagccagggct

SEQ ID NO: 2614264 - DNA, 15 bp, Homo sapiens
tctcaccccatccca

SEQ ID NO: 2614265 - DNA, 17 bp, Homo sapiens
tctcaccccatcccaca

SEQ ID NO: 2614266 - DNA, 21 bp, Homo sapiens
tctcaccccatcccacaccct

SEQ ID NO: 2614267 - DNA, 15 bp, Homo sapiens
tctcacctgtactct

SEQ ID NO: 2614268 - DNA, 22 bp, Homo sapiens
tctcacgggcatgggcactccc

SEQ ID NO: 2614269 - DNA, 22 bp, Homo sapiens
tctcactatgttgcccaggcag

SEQ ID NO: 2614270 - DNA, 23 bp, Homo sapiens
tctcactatgttgcccaggcagg

SEQ ID NO: 2614271 - DNA, 11 bp, Homo sapiens
tctcactcctt

SEQ ID NO: 2614272 - DNA, 13 bp, Homo sapiens
tctcactccttga

SEQ ID NO: 2614273 - DNA, 17 bp, Homo sapiens
tctcactggatgcaaag

SEQ ID NO: 2614274 - DNA, 20 bp, Homo sapiens
tctcactgtgggaaggccag

SEQ ID NO: 2614275 - DNA, 21 bp, Homo sapiens
tctcactgtgggaaggccagc

SEQ ID NO: 2614276 - DNA, 14 bp, Homo sapiens
tctcactgttgccc

SEQ ID NO: 2614277 - DNA, 15 bp, Homo sapiens
tctcactgttgccca

SEQ ID NO: 2614278 - DNA, 13 bp, Homo sapiens
tctcacttgtgcc

SEQ ID NO: 2614279 - DNA, 20 bp, Homo sapiens
tctcagaaggcaaatgactt

SEQ ID NO: 2614280 - DNA, 22 bp, Homo sapiens
tctcagaaggcaaatgactttg

SEQ ID NO: 2614281 - DNA, 19 bp, Homo sapiens
tctcagaaggtattccttt

SEQ ID NO: 2614282 - DNA, 17 bp, Homo sapiens
tctcagaatctcaaata

SEQ ID NO: 2614283 - DNA, 16 bp, Homo sapiens
tctcagactgcatgta

SEQ ID NO: 2614284 - DNA, 21 bp, Homo sapiens
tctcagactttggaaaatgca

SEQ ID NO: 2614285 - DNA, 19 bp, Homo sapiens
tctcagagctacttgggcc

SEQ ID NO: 2614286 - DNA, 14 bp, Homo sapiens
tctcagatatttat

SEQ ID NO: 2614287 - DNA, 17 bp, Homo sapiens
tctcagatccttgtttc

SEQ ID NO: 2614288 - DNA, 18 bp, Homo sapiens
tctcagatccttgtttca

SEQ ID NO: 2614289 - DNA, 21 bp, Homo sapiens
tctcagcaatgattactcttt

SEQ ID NO: 2614290 - DNA, 23 bp, Homo sapiens
tctcagcagcgaccacccctgcc

SEQ ID NO: 2614291 - DNA, 11 bp, Homo sapiens
tctcagcctcc

SEQ ID NO: 2614292 - DNA, 12 bp, Homo sapiens
tctcagcctccc

SEQ ID NO: 2614293 - DNA, 21 bp, Homo sapiens
tctcagctccaggtggctctg

SEQ ID NO: 2614294 - DNA, 17 bp, Homo sapiens
tctcagctcccatttct

SEQ ID NO: 2614295 - DNA, 22 bp, Homo sapiens
tctcagctcccatttctactct

SEQ ID NO: 2614296 - DNA, 16 bp, Homo sapiens
tctcaggacctaggga

SEQ ID NO: 2614297 - DNA, 21 bp, Homo sapiens
tctcaggacctagggatgttc

SEQ ID NO: 2614298 - DNA, 14 bp, Homo sapiens
tctcaggagcacag

SEQ ID NO: 2614299 - DNA, 19 bp, Homo sapiens
tctcaggagcacaggcagc

SEQ ID NO: 2614300 - DNA, 22 bp, Homo sapiens
tctcaggatcccctctcttcct

SEQ ID NO: 2614301 - DNA, 20 bp, Homo sapiens
tctcaggcatgcctgtgtga

SEQ ID NO: 2614302 - DNA, 21 bp, Homo sapiens
tctcaggcatgcctgtgtgac

SEQ ID NO: 2614303 - DNA, 19 bp, Homo sapiens
tctcaggccacctgccccc

SEQ ID NO: 2614304 - DNA, 23 bp, Homo sapiens
tctcagggctcctgccttctgtc

SEQ ID NO: 2614305 - DNA, 15 bp, Homo sapiens
tctcagggtctctgc

SEQ ID NO: 2614306 - DNA, 19 bp, Homo sapiens
tctcagggtctctgctgcc

SEQ ID NO: 2614307 - DNA, 14 bp, Homo sapiens
tctcagtcatgcat

SEQ ID NO: 2614308 - DNA, 23 bp, Homo sapiens
tctcagtcatgcataaatatgca

SEQ ID NO: 2614309 - DNA, 13 bp, Homo sapiens
tctcagtctctga

SEQ ID NO: 2614310 - DNA, 16 bp, Homo sapiens
tctcagtttgtgtgtc

SEQ ID NO: 2614311 - DNA, 19 bp, Homo sapiens
tctcatcactcccctccaa

SEQ ID NO: 2614312 - DNA, 15 bp, Homo sapiens
tctcatcctgcaggc

SEQ ID NO: 2614313 - DNA, 18 bp, Homo sapiens
tctcatgaatctgcaatg

SEQ ID NO: 2614314 - DNA, 18 bp, Homo sapiens
tctcatgtatcatctgga

SEQ ID NO: 2614315 - DNA, 18 bp, Homo sapiens
tctcatgttttccattgt

SEQ ID NO: 2614316 - DNA, 16 bp, Homo sapiens
tctcattacttttgaa

SEQ ID NO: 2614317 - DNA, 16 bp, Homo sapiens
tctcattccagaggaa

SEQ ID NO: 2614318 - DNA, 18 bp, Homo sapiens
tctcatttagaacttgca

SEQ ID NO: 2614319 - DNA, 15 bp, Homo sapiens
tctccaagaatgctg

SEQ ID NO: 2614320 - DNA, 16 bp, Homo sapiens
tctccaagcaggacat

SEQ ID NO: 2614321 - DNA, 18 bp, Homo sapiens
tctccaagcaggacatgg

SEQ ID NO: 2614322 - DNA, 19 bp, Homo sapiens
tctccaagcaggacatgga

SEQ ID NO: 2614323 - DNA, 16 bp, Homo sapiens
tctccaaggaccaggt

SEQ ID NO: 2614324 - DNA, 21 bp, Homo sapiens
tctccaagggcttctgcaccc

SEQ ID NO: 2614325 - DNA, 20 bp, Homo sapiens
tctccaagtgccagaggtgg

SEQ ID NO: 2614326 - DNA, 17 bp, Homo sapiens
tctccacctgccaggga

SEQ ID NO: 2614327 - DNA, 16 bp, Homo sapiens
tctccacctgctccca

SEQ ID NO: 2614328 - DNA, 15 bp, Homo sapiens
tctccagacccccac

SEQ ID NO: 2614329 - DNA, 19 bp, Homo sapiens
tctccagacccccacccct

SEQ ID NO: 2614330 - DNA, 14 bp, Homo sapiens
tctccagcccctgg

SEQ ID NO: 2614331 - DNA, 16 bp, Homo sapiens
tctccagcccctggat

SEQ ID NO: 2614332 - DNA, 19 bp, Homo sapiens
tctccagctgggctctgca

SEQ ID NO: 2614333 - DNA, 18 bp, Homo sapiens
tctccaggaaggcggggc

SEQ ID NO: 2614334 - DNA, 23 bp, Homo sapiens
tctccaggcacccttctttcctc

SEQ ID NO: 2614335 - DNA, 15 bp, Homo sapiens
tctccaggcgccggc

SEQ ID NO: 2614336 - DNA, 16 bp, Homo sapiens
tctccaggctgtatcc

SEQ ID NO: 2614337 - DNA, 19 bp, Homo sapiens
tctccatccacatgggagc

SEQ ID NO: 2614338 - DNA, 16 bp, Homo sapiens
tctccatctctctggc

SEQ ID NO: 2614339 - DNA, 14 bp, Homo sapiens
tctccatggccctg

SEQ ID NO: 2614340 - DNA, 18 bp, Homo sapiens
tctccatggccctgcaaa

SEQ ID NO: 2614341 - DNA, 19 bp, Homo sapiens
tctccatggcttcctcctc

SEQ ID NO: 2614342 - DNA, 15 bp, Homo sapiens
tctcccacgtgggag

SEQ ID NO: 2614343 - DNA, 16 bp, Homo sapiens
tctcccagataatgtg

SEQ ID NO: 2614344 - DNA, 17 bp, Homo sapiens
tctcccagctctagaca

SEQ ID NO: 2614345 - DNA, 23 bp, Homo sapiens
tctcccaggccaggctccttcct

SEQ ID NO: 2614346 - DNA, 18 bp, Homo sapiens
tctcccagtctacccaga

SEQ ID NO: 2614347 - DNA, 12 bp, Homo sapiens
tctcccatcccc

SEQ ID NO: 2614348 - DNA, 13 bp, Homo sapiens
tctcccatccccc

SEQ ID NO: 2614349 - DNA, 18 bp, Homo sapiens
tctcccatccccctgccc

SEQ ID NO: 2614350 - DNA, 13 bp, Homo sapiens
tctcccatggagc

SEQ ID NO: 2614351 - DNA, 18 bp, Homo sapiens
tctcccatggagccccag

SEQ ID NO: 2614352 - DNA, 21 bp, Homo sapiens
tctcccatggagccccagccc

SEQ ID NO: 2614353 - DNA, 22 bp, Homo sapiens
tctcccatggagccccagcccc

SEQ ID NO: 2614354 - DNA, 20 bp, Homo sapiens
tctccccagggttcagtcct

SEQ ID NO: 2614355 - DNA, 13 bp, Homo sapiens
tctcccccagccc

SEQ ID NO: 2614356 - DNA, 17 bp, Homo sapiens
tctcccccagccccatc

SEQ ID NO: 2614357 - DNA, 22 bp, Homo sapiens
tctcccccagccccatcctctg

SEQ ID NO: 2614358 - DNA, 16 bp, Homo sapiens
tctcccccccccctcc

SEQ ID NO: 2614359 - DNA, 14 bp, Homo sapiens
tctccccctgggct

SEQ ID NO: 2614360 - DNA, 13 bp, Homo sapiens
tctcccctcaaag

SEQ ID NO: 2614361 - DNA, 18 bp, Homo sapiens
tctcccctcagagtgcaa

SEQ ID NO: 2614362 - DNA, 17 bp, Homo sapiens
tctcccctgccctgctg

SEQ ID NO: 2614363 - DNA, 14 bp, Homo sapiens
tctcccgctgctgc

SEQ ID NO: 2614364 - DNA, 15 bp, Homo sapiens
tctcccgctgctgct

SEQ ID NO: 2614365 - DNA, 13 bp, Homo sapiens
tctcccgtcaggg

SEQ ID NO: 2614366 - DNA, 20 bp, Homo sapiens
tctcccgtcagggcccaagt

SEQ ID NO: 2614367 - DNA, 23 bp, Homo sapiens
tctccctcaacaagggagagacc

SEQ ID NO: 2614368 - DNA, 22 bp, Homo sapiens
tctccctcttctcaagtgcctt

SEQ ID NO: 2614369 - DNA, 13 bp, Homo sapiens
tctccctggccct

SEQ ID NO: 2614370 - DNA, 21 bp, Homo sapiens
tctcccttggattgtccccga

SEQ ID NO: 2614371 - DNA, 23 bp, Homo sapiens
tctccgaccagacaccttgacag

SEQ ID NO: 2614372 - DNA, 23 bp, Homo sapiens
tctcctcactcccttctacctgc

SEQ ID NO: 2614373 - DNA, 12 bp, Homo sapiens
tctcctcccagg

SEQ ID NO: 2614374 - DNA, 13 bp, Homo sapiens
tctcctctgctgc

SEQ ID NO: 2614375 - DNA, 15 bp, Homo sapiens
tctcctctgctgctg

SEQ ID NO: 2614376 - DNA, 18 bp, Homo sapiens
tctcctctgctgctggct

SEQ ID NO: 2614377 - DNA, 22 bp, Homo sapiens
tctcctcttgccactgcctctt

SEQ ID NO: 2614378 - DNA, 19 bp, Homo sapiens
tctcctgcctcagcctccc

SEQ ID NO: 2614379 - DNA, 22 bp, Homo sapiens
tctcctgcctgtagcagtgaga

SEQ ID NO: 2614380 - DNA, 21 bp, Homo sapiens
tctcctggaaatattaagaaa

SEQ ID NO: 2614381 - DNA, 12 bp, Homo sapiens
tctcctggagga

SEQ ID NO: 2614382 - DNA, 19 bp, Homo sapiens
tctcctgtacctcttgagc

SEQ ID NO: 2614383 - DNA, 23 bp, Homo sapiens
tctcctgtgcatgggtgaaggga

SEQ ID NO: 2614384 - DNA, 16 bp, Homo sapiens
tctcctgtgcccacat

SEQ ID NO: 2614385 - DNA, 14 bp, Homo sapiens
tctcctgtttttct

SEQ ID NO: 2614386 - DNA, 17 bp, Homo sapiens
tctccttagtcttctca

SEQ ID NO: 2614387 - DNA, 18 bp, Homo sapiens
tctccttcacctttgtcc

SEQ ID NO: 2614388 - DNA, 20 bp, Homo sapiens
tctccttcacctttgtcccc

SEQ ID NO: 2614389 - DNA, 17 bp, Homo sapiens
tctcctttgcactgagg

SEQ ID NO: 2614390 - DNA, 22 bp, Homo sapiens
tctcctttgcactgagggccac

SEQ ID NO: 2614391 - DNA, 22 bp, Homo sapiens
tctcctttgctgaggcctccag

SEQ ID NO: 2614392 - DNA, 19 bp, Homo sapiens
tctcggactaagcctacct

SEQ ID NO: 2614393 - DNA, 19 bp, Homo sapiens
tctcgtggtaggactgtag

SEQ ID NO: 2614394 - DNA, 19 bp, Homo sapiens
tctctaaagagtttatttt

SEQ ID NO: 2614395 - DNA, 21 bp, Homo sapiens
tctctaactcagaaacatcag

SEQ ID NO: 2614396 - DNA, 20 bp, Homo sapiens
tctctactcctacctcagcc

SEQ ID NO: 2614397 - DNA, 19 bp, Homo sapiens
tcttccatcatgtccccaa

SEQ ID NO: 2614398 - DNA, 21 bp, Homo sapiens
tcttcccagggtagcccgcct

SEQ ID NO: 2614399 - DNA, 16 bp, Homo sapiens
tcttccccttgccctt

SEQ ID NO: 2614400 - DNA, 13 bp, Homo sapiens
tcttccctacctc

SEQ ID NO: 2614401 - DNA, 14 bp, Homo sapiens
tcttccctacctca

SEQ ID NO: 2614402 - DNA, 21 bp, Homo sapiens
tcttcccttttacatactgct

SEQ ID NO: 2614403 - DNA, 23 bp, Homo sapiens
tcttcctagttttctcctcccag

SEQ ID NO: 2614404 - DNA, 14 bp, Homo sapiens
tcttcctcccaagt

SEQ ID NO: 2614405 - DNA, 17 bp, Homo sapiens
tcttcctccgaggccag

SEQ ID NO: 2614406 - DNA, 16 bp, Homo sapiens
tcttcctctgaggctg

SEQ ID NO: 2614407 - DNA, 16 bp, Homo sapiens
tcttcgggaagagagg

SEQ ID NO: 2614408 - DNA, 15 bp, Homo sapiens
tcttcgtacagttct

SEQ ID NO: 2614409 - DNA, 20 bp, Homo sapiens
tcttctaatttcaaaaatat

SEQ ID NO: 2614410 - DNA, 16 bp, Homo sapiens
tcttctattttattcc

SEQ ID NO: 2614411 - DNA, 13 bp, Homo sapiens
tcttctcaagtgc

SEQ ID NO: 2614412 - DNA, 17 bp, Homo sapiens
tcttctcaagtgcctta

SEQ ID NO: 2614413 - DNA, 21 bp, Homo sapiens
tcttctcagaaggcaaatgac

SEQ ID NO: 2614414 - DNA, 14 bp, Homo sapiens
tcttctcaggctct

SEQ ID NO: 2614415 - DNA, 18 bp, Homo sapiens
tcttctcatagcattaac

SEQ ID NO: 2614416 - DNA, 13 bp, Homo sapiens
tcttctccaggct

SEQ ID NO: 2614417 - DNA, 19 bp, Homo sapiens
tcttctgaactcaaactga

SEQ ID NO: 2614418 - DNA, 15 bp, Homo sapiens
tcttctgacgtgcct

SEQ ID NO: 2614419 - DNA, 21 bp, Homo sapiens
tcttctgagctatttcatcta

SEQ ID NO: 2614420 - DNA, 20 bp, Homo sapiens
tcttctgcccaattggagga

SEQ ID NO: 2614421 - DNA, 19 bp, Homo sapiens
tcttctgccggccctgggg

SEQ ID NO: 2614422 - DNA, 16 bp, Homo sapiens
tcttctgcctgttata

SEQ ID NO: 2614423 - DNA, 12 bp, Homo sapiens
tcttctgctcca

SEQ ID NO: 2614424 - DNA, 13 bp, Homo sapiens
tcttctgctccac

SEQ ID NO: 2614425 - DNA, 14 bp, Homo sapiens
tcttctgctccacc

SEQ ID NO: 2614426 - DNA, 19 bp, Homo sapiens
tcttctgctccacccttgg

SEQ ID NO: 2614427 - DNA, 20 bp, Homo sapiens
tcttctgctccacccttggc

SEQ ID NO: 2614428 - DNA, 19 bp, Homo sapiens
tcttctggagtctccagtg

SEQ ID NO: 2614429 - DNA, 17 bp, Homo sapiens
tcttctgggagggcagc

SEQ ID NO: 2614430 - DNA, 23 bp, Homo sapiens
tcttctgggagggcagcagggct

SEQ ID NO: 2614431 - DNA, 21 bp, Homo sapiens
tcttctgtacgtctgacaggc

SEQ ID NO: 2614432 - DNA, 22 bp, Homo sapiens
tcttctgtacgtctgacaggca

SEQ ID NO: 2614433 - DNA, 18 bp, Homo sapiens
tcttctgttttctgtttc

SEQ ID NO: 2614434 - DNA, 13 bp, Homo sapiens
tcttcttaactta

SEQ ID NO: 2614435 - DNA, 18 bp, Homo sapiens
tcttcttaagacttttgg

SEQ ID NO: 2614436 - DNA, 13 bp, Homo sapiens
tcttcttcaccat

SEQ ID NO: 2614437 - DNA, 15 bp, Homo sapiens
tcttcttcaccattt

SEQ ID NO: 2614438 - DNA, 14 bp, Homo sapiens
tcttcttcttcaga

SEQ ID NO: 2614439 - DNA, 15 bp, Homo sapiens
tcttcttcttcagaa

SEQ ID NO: 2614440 - DNA, 17 bp, Homo sapiens
tcttcttgaaattttaa

SEQ ID NO: 2614441 - DNA, 21 bp, Homo sapiens
tcttcttgaacactcatgctg

SEQ ID NO: 2614442 - DNA, 23 bp, Homo sapiens
tcttcttgaacactcatgctgaa

SEQ ID NO: 2614443 - DNA, 16 bp, Homo sapiens
tcttcttggtctcagt

SEQ ID NO: 2614444 - DNA, 19 bp, Homo sapiens
tcttcttttgagcaacttt

SEQ ID NO: 2614445 - DNA, 15 bp, Homo sapiens
tcttcttttgtgaag

SEQ ID NO: 2614446 - DNA, 17 bp, Homo sapiens
tcttctttttgctgttg

SEQ ID NO: 2614447 - DNA, 20 bp, Homo sapiens
tcttctttttgctgttgttt

SEQ ID NO: 2614448 - DNA, 17 bp, Homo sapiens
tcttctttttttgtgat

SEQ ID NO: 2614449 - DNA, 21 bp, Homo sapiens
tcttgaaatataggaacttaa

SEQ ID NO: 2614450 - DNA, 13 bp, Homo sapiens
tcttgaatttaat

SEQ ID NO: 2614451 - DNA, 23 bp, Homo sapiens
tcttgaatttaataatctgtagg

SEQ ID NO: 2614452 - DNA, 18 bp, Homo sapiens
tcttgaatttctaaaaaa

SEQ ID NO: 2614453 - DNA, 20 bp, Homo sapiens
tcttgacaccagctgttctg

SEQ ID NO: 2614454 - DNA, 19 bp, Homo sapiens
tcttgacattcaaggcatt

SEQ ID NO: 2614455 - DNA, 11 bp, Homo sapiens
tcttgacccta

SEQ ID NO: 2614456 - DNA, 17 bp, Homo sapiens
tcttgagcaagttcctt

SEQ ID NO: 2614457 - DNA, 16 bp, Homo sapiens
tcttgagcctgggagg

SEQ ID NO: 2614458 - DNA, 18 bp, Homo sapiens
tcttgagccttgaacttt

SEQ ID NO: 2614459 - DNA, 16 bp, Homo sapiens
tcttgaggccaggagt

SEQ ID NO: 2614460 - DNA, 21 bp, Homo sapiens
tcttgatacccccctctgtct

SEQ ID NO: 2614461 - DNA, 22 bp, Homo sapiens
tcttgatacccccctctgtctt

SEQ ID NO: 2614462 - DNA, 15 bp, Homo sapiens
tcttgatctgttctg

SEQ ID NO: 2614463 - DNA, 13 bp, Homo sapiens
tcttgatgcatgc

SEQ ID NO: 2614464 - DNA, 14 bp, Homo sapiens
tcttgcacccgcct

SEQ ID NO: 2614465 - DNA, 15 bp, Homo sapiens
tcttgcacccgcctc

SEQ ID NO: 2614466 - DNA, 18 bp, Homo sapiens
tcttgcacccgcctctcc

SEQ ID NO: 2614467 - DNA, 19 bp, Homo sapiens
tcttgcacccgcctctccc

SEQ ID NO: 2614468 - DNA, 15 bp, Homo sapiens
tcttgcatgaggcta

SEQ ID NO: 2614469 - DNA, 23 bp, Homo sapiens
tcttgcatggcaaggactgcagg

SEQ ID NO: 2614470 - DNA, 21 bp, Homo sapiens
tcttgccccccaccccagcct

SEQ ID NO: 2614471 - DNA, 15 bp, Homo sapiens
tcttgcccttccctg

SEQ ID NO: 2614472 - DNA, 20 bp, Homo sapiens
tcttgcccttccctgtccct

SEQ ID NO: 2614473 - DNA, 21 bp, Homo sapiens
tcttgcccttccctgtccctc

SEQ ID NO: 2614474 - DNA, 11 bp, Homo sapiens
tcttgctctgc

SEQ ID NO: 2614475 - DNA, 14 bp, Homo sapiens
tcttgctctgctga

SEQ ID NO: 2614476 - DNA, 22 bp, Homo sapiens
tcttgctggttgtcatttttgc

SEQ ID NO: 2614477 - DNA, 16 bp, Homo sapiens
tcttggaaagaaacaa

SEQ ID NO: 2614478 - DNA, 14 bp, Homo sapiens
tcttggacctctgc

SEQ ID NO: 2614479 - DNA, 18 bp, Homo sapiens
tcttggacctctgctctg

SEQ ID NO: 2614480 - DNA, 21 bp, Homo sapiens
tcttggagctgagcctctcac

SEQ ID NO: 2614481 - DNA, 13 bp, Homo sapiens
tcttggcagtcac

SEQ ID NO: 2614482 - DNA, 15 bp, Homo sapiens
tcttggcggcagcag

SEQ ID NO: 2614483 - DNA, 15 bp, Homo sapiens
tcttggctttcatgt

SEQ ID NO: 2614484 - DNA, 16 bp, Homo sapiens
tcttggctttcatgtt

SEQ ID NO: 2614485 - DNA, 11 bp, Homo sapiens
tcttgggaaat

SEQ ID NO: 2614486 - DNA, 20 bp, Homo sapiens
tcttgggaaatatgaatgcc

SEQ ID NO: 2614487 - DNA, 16 bp, Homo sapiens
tcttgggactgggttt

SEQ ID NO: 2614488 - DNA, 22 bp, Homo sapiens
tcttgggactgggtttggaccc

SEQ ID NO: 2614489 - DNA, 22 bp, Homo sapiens
tcttgggggacagggctggccc

SEQ ID NO: 2614490 - DNA, 24 bp, Homo sapiens
tcttgggggacagggctggcccag

SEQ ID NO: 2614491 - DNA, 22 bp, Homo sapiens
tcttggtaaatttccccaacag

SEQ ID NO: 2614492 - DNA, 15 bp, Homo sapiens
tcttggtcctgctgc

SEQ ID NO: 2614493 - DNA, 18 bp, Homo sapiens
tcttggttcataaatgaa

SEQ ID NO: 2614494 - DNA, 13 bp, Homo sapiens
tcttggttgagga

SEQ ID NO: 2614495 - DNA, 17 bp, Homo sapiens
tcttggttggctggcct

SEQ ID NO: 2614496 - DNA, 15 bp, Homo sapiens
tcttggtttccttcc

SEQ ID NO: 2614497 - DNA, 17 bp, Homo sapiens
tcttgtacatgtgtagc

SEQ ID NO: 2614498 - DNA, 14 bp, Homo sapiens
tcttgtattaagaa

SEQ ID NO: 2614499 - DNA, 22 bp, Homo sapiens
tcttgtattaagaatgaaatac

SEQ ID NO: 2614500 - DNA, 23 bp, Homo sapiens
tcttgtccatgtggttcttcaaa

SEQ ID NO: 2614501 - DNA, 15 bp, Homo sapiens
tcttgtctctgggct

SEQ ID NO: 2614502 - DNA, 12 bp, Homo sapiens
tcttgtgtttct

SEQ ID NO: 2614503 - DNA, 14 bp, Homo sapiens
tcttgtttcaattc

SEQ ID NO: 2614504 - DNA, 22 bp, Homo sapiens
tcttgtttcttttcacatagct

SEQ ID NO: 2614505 - DNA, 13 bp, Homo sapiens
tcttgtttttcca

SEQ ID NO: 2614506 - DNA, 21 bp, Homo sapiens
tcttgtttttccactactgct

SEQ ID NO: 2614507 - DNA, 21 bp, Homo sapiens
tctttaaaatttaagtatctt

SEQ ID NO: 2614508 - DNA, 14 bp, Homo sapiens
tctttaagaaagta

SEQ ID NO: 2614509 - DNA, 18 bp, Homo sapiens
tctttaatgtcacaggca

SEQ ID NO: 2614510 - DNA, 19 bp, Homo sapiens
tctttaatgtcacaggcag

SEQ ID NO: 2614511 - DNA, 13 bp, Homo sapiens
tctttacctgaga

SEQ ID NO: 2614512 - DNA, 18 bp, Homo sapiens
tctttacctgagaccagt

SEQ ID NO: 2614513 - DNA, 15 bp, Homo sapiens
tctttacttcatgga

SEQ ID NO: 2614514 - DNA, 19 bp, Homo sapiens
tctttagagcattgccatt

SEQ ID NO: 2614515 - DNA, 20 bp, Homo sapiens
tctttataattctactttga

SEQ ID NO: 2614516 - DNA, 16 bp, Homo sapiens
tctttatactgtaatt

SEQ ID NO: 2614517 - DNA, 19 bp, Homo sapiens
tctttcaaattgagagaat

SEQ ID NO: 2614518 - DNA, 18 bp, Homo sapiens
tctttcaacttgcatcca

SEQ ID NO: 2614519 - DNA, 10 bp, Homo sapiens
tctttcacat

SEQ ID NO: 2614520 - DNA, 20 bp, Homo sapiens
tctttcaggggggttgtgag

SEQ ID NO: 2614521 - DNA, 22 bp, Homo sapiens
tctttccacggagccactcctc

SEQ ID NO: 2614522 - DNA, 23 bp, Homo sapiens
tctttccacggagccactcctct

SEQ ID NO: 2614523 - DNA, 11 bp, Homo sapiens
tctttcctgtc

SEQ ID NO: 2614524 - DNA, 18 bp, Homo sapiens
tctttctaatgtgtgaat

SEQ ID NO: 2614525 - DNA, 16 bp, Homo sapiens
tctttctactctgaac

SEQ ID NO: 2614526 - DNA, 21 bp, Homo sapiens
tctttctagtggtctttgtaa

SEQ ID NO: 2614527 - DNA, 22 bp, Homo sapiens
tctttctagtggtctttgtaag

SEQ ID NO: 2614528 - DNA, 15 bp, Homo sapiens
tctttctctcctttc

SEQ ID NO: 2614529 - DNA, 16 bp, Homo sapiens
tctttctgatgtcaaa

SEQ ID NO: 2614530 - DNA, 18 bp, Homo sapiens
tctttctggctatgcatt

SEQ ID NO: 2614531 - DNA, 20 bp, Homo sapiens
tctttctggctatgcatttg

SEQ ID NO: 2614532 - DNA, 20 bp, Homo sapiens
tctttcttacaaggaaggtg

SEQ ID NO: 2614533 - DNA, 16 bp, Homo sapiens
tctttcttcctctgct

SEQ ID NO: 2614534 - DNA, 17 bp, Homo sapiens
tctttcttcctctgctg

SEQ ID NO: 2614535 - DNA, 21 bp, Homo sapiens
tctttgaaatagtctgtgtga

SEQ ID NO: 2614536 - DNA, 22 bp, Homo sapiens
tctttgaaatagtctgtgtgaa

SEQ ID NO: 2614537 - DNA, 14 bp, Homo sapiens
tctttgaatgcttt

SEQ ID NO: 2614538 - DNA, 17 bp, Homo sapiens
tctttgagatagaagaa

SEQ ID NO: 2614539 - DNA, 14 bp, Homo sapiens
tctttgataatgtt

SEQ ID NO: 2614540 - DNA, 20 bp, Homo sapiens
tctttgatacttgttcaaaa

SEQ ID NO: 2614541 - DNA, 17 bp, Homo sapiens
tctttgatgttaacaca

SEQ ID NO: 2614542 - DNA, 23 bp, Homo sapiens
tgacctgtggggatttctcccag

SEQ ID NO: 2614543 - DNA, 14 bp, Homo sapiens
tgacctgtgtcact

SEQ ID NO: 2614544 - DNA, 22 bp, Homo sapiens
tgaccttagtgtttctgtgcat

SEQ ID NO: 2614545 - DNA, 18 bp, Homo sapiens
tgaccttcctcgcagaga

SEQ ID NO: 2614546 - DNA, 23 bp, Homo sapiens
tgaccttcctcgcagagaggcca

SEQ ID NO: 2614547 - DNA, 17 bp, Homo sapiens
tgaccttctaggaagct

SEQ ID NO: 2614548 - DNA, 20 bp, Homo sapiens
tgaccttgaggagtcttgtg

SEQ ID NO: 2614549 - DNA, 21 bp, Homo sapiens
tgaccttgtacctctctttga

SEQ ID NO: 2614550 - DNA, 19 bp, Homo sapiens
tgacgcctgccctccccag

SEQ ID NO: 2614551 - DNA, 20 bp, Homo sapiens
tgacggaagccaacttggct

SEQ ID NO: 2614552 - DNA, 19 bp, Homo sapiens
tgacggtcccacactggtg

SEQ ID NO: 2614553 - DNA, 18 bp, Homo sapiens
tgacgtgcacctgtactc

SEQ ID NO: 2614554 - DNA, 19 bp, Homo sapiens
tgacgtgcacctgtactca

SEQ ID NO: 2614555 - DNA, 18 bp, Homo sapiens
tgacgtgccttttgcacc

SEQ ID NO: 2614556 - DNA, 23 bp, Homo sapiens
tgacgtgccttttgcacccctcc

SEQ ID NO: 2614557 - DNA, 14 bp, Homo sapiens
tgactaaaaatatt

SEQ ID NO: 2614558 - DNA, 13 bp, Homo sapiens
tgactaattgtat

SEQ ID NO: 2614559 - DNA, 20 bp, Homo sapiens
tgactaattgtataacaggt

SEQ ID NO: 2614560 - DNA, 16 bp, Homo sapiens
tgactacagtcaggaa

SEQ ID NO: 2614561 - DNA, 17 bp, Homo sapiens
tgactacagtcaggaaa

SEQ ID NO: 2614562 - DNA, 21 bp, Homo sapiens
tgactagaagggccagtcctg

SEQ ID NO: 2614563 - DNA, 21 bp, Homo sapiens
tgactagaggcagggagggga

SEQ ID NO: 2614564 - DNA, 17 bp, Homo sapiens
tgactagggattcaggc

SEQ ID NO: 2614565 - DNA, 19 bp, Homo sapiens
tgactagtgaggaaagatt

SEQ ID NO: 2614566 - DNA, 14 bp, Homo sapiens
tgactatatagaga

SEQ ID NO: 2614567 - DNA, 17 bp, Homo sapiens
tgactatatagagatgt

SEQ ID NO: 2614568 - DNA, 15 bp, Homo sapiens
tgactcaacatgtta

SEQ ID NO: 2614569 - DNA, 20 bp, Homo sapiens
tgactcacaagaagaccaga

SEQ ID NO: 2614570 - DNA, 21 bp, Homo sapiens
tgactcagcatacctgctggt

SEQ ID NO: 2614571 - DNA, 13 bp, Homo sapiens
tgactcagggctc

SEQ ID NO: 2614572 - DNA, 18 bp, Homo sapiens
tgactcagggctcctggg

SEQ ID NO: 2614573 - DNA, 12 bp, Homo sapiens
tgactccaggag

SEQ ID NO: 2614574 - DNA, 22 bp, Homo sapiens
tgactcccttaaaatagaaata

SEQ ID NO: 2614575 - DNA, 16 bp, Homo sapiens
tgactccgctggaggt

SEQ ID NO: 2614576 - DNA, 14 bp, Homo sapiens
tgactccttgtggt

SEQ ID NO: 2614577 - DNA, 15 bp, Homo sapiens
tgactcgtgctgcat

SEQ ID NO: 2614578 - DNA, 15 bp, Homo sapiens
tgactctctgtgacc

SEQ ID NO: 2614579 - DNA, 15 bp, Homo sapiens
tgactctgaaatctg

SEQ ID NO: 2614580 - DNA, 13 bp, Homo sapiens
tgactctgccccc

SEQ ID NO: 2614581 - DNA, 18 bp, Homo sapiens
tgactctgccccctgctg

SEQ ID NO: 2614582 - DNA, 23 bp, Homo sapiens
tgactctttttagggccaggcag

SEQ ID NO: 2614583 - DNA, 11 bp, Homo sapiens
tgactgagctt

SEQ ID NO: 2614584 - DNA, 20 bp, Homo sapiens
tgactgatgctttcagatta

SEQ ID NO: 2614585 - DNA, 21 bp, Homo sapiens
tgactgctccccagccctggc

SEQ ID NO: 2614586 - DNA, 23 bp, Homo sapiens
tgactgctccccagccctggctc

SEQ ID NO: 2614587 - DNA, 21 bp, Homo sapiens
tgactgggtttctctgtatag

SEQ ID NO: 2614588 - DNA, 23 bp, Homo sapiens
tgactggtgttatcaccgtgggc

SEQ ID NO: 2614589 - DNA, 14 bp, Homo sapiens
tgactgtatataaa

SEQ ID NO: 2614590 - DNA, 21 bp, Homo sapiens
tgactgttttctcttgagagg

SEQ ID NO: 2614591 - DNA, 13 bp, Homo sapiens
tgacttactgtac

SEQ ID NO: 2614592 - DNA, 19 bp, Homo sapiens
tgacttactgtacatgaaa

SEQ ID NO: 2614593 - DNA, 23 bp, Homo sapiens
tgacttctaagtaaaaccacagc

SEQ ID NO: 2614594 - DNA, 16 bp, Homo sapiens
tgactttcctctttgg

SEQ ID NO: 2614595 - DNA, 16 bp, Homo sapiens
tgactttgctctttct

SEQ ID NO: 2614596 - DNA, 12 bp, Homo sapiens
tgacttttgtat

SEQ ID NO: 2614597 - DNA, 17 bp, Homo sapiens
tgagaaaaagctcctgt

SEQ ID NO: 2614598 - DNA, 23 bp, Homo sapiens
tgagaaaccttattgtacctctc

SEQ ID NO: 2614599 - DNA, 16 bp, Homo sapiens
tgagaaagactattca

SEQ ID NO: 2614600 - DNA, 17 bp, Homo sapiens
tgagaaagactattcaa

SEQ ID NO: 2614601 - DNA, 13 bp, Homo sapiens
tgagaaatgcata

SEQ ID NO: 2614602 - DNA, 15 bp, Homo sapiens
tgagaagagggcctg

SEQ ID NO: 2614603 - DNA, 16 bp, Homo sapiens
tgagaagagggcctgt

SEQ ID NO: 2614604 - DNA, 20 bp, Homo sapiens
tgagaagagggcctgtggga

SEQ ID NO: 2614605 - DNA, 16 bp, Homo sapiens
tgagaagattgtgaat

SEQ ID NO: 2614606 - DNA, 22 bp, Homo sapiens
tgagaaggagtcagaaactgtt

SEQ ID NO: 2614607 - DNA, 13 bp, Homo sapiens
tgagaaggcagcc

SEQ ID NO: 2614608 - DNA, 14 bp, Homo sapiens
tgagaaggcagcca

SEQ ID NO: 2614609 - DNA, 20 bp, Homo sapiens
tgagaaggcagccaccagcg

SEQ ID NO: 2614610 - DNA, 19 bp, Homo sapiens
tgagaagtccccttccatc

SEQ ID NO: 2614611 - DNA, 16 bp, Homo sapiens
tgagaatcaaaactct

SEQ ID NO: 2614612 - DNA, 18 bp, Homo sapiens
tgagaatctatatttaac

SEQ ID NO: 2614613 - DNA, 15 bp, Homo sapiens
tgagaattccaagga

SEQ ID NO: 2614614 - DNA, 20 bp, Homo sapiens
tgagaattgtgctcaaaatt

SEQ ID NO: 2614615 - DNA, 19 bp, Homo sapiens
tgagaatttaaaaataaga

SEQ ID NO: 2614616 - DNA, 13 bp, Homo sapiens
tgagaattttaaa

SEQ ID NO: 2614617 - DNA, 11 bp, Homo sapiens
tgagacagagt

SEQ ID NO: 2614618 - DNA, 22 bp, Homo sapiens
tgagacagcccgggctctgcct

SEQ ID NO: 2614619 - DNA, 15 bp, Homo sapiens
tgagacaggagaatc

SEQ ID NO: 2614620 - DNA, 18 bp, Homo sapiens
tgagacagtccagcctgg

SEQ ID NO: 2614621 - DNA, 17 bp, Homo sapiens
tgagacagtgggaaata

SEQ ID NO: 2614622 - DNA, 18 bp, Homo sapiens
tgagacagtttcttagct

SEQ ID NO: 2614623 - DNA, 21 bp, Homo sapiens
tgagacagtttcttagctttt

SEQ ID NO: 2614624 - DNA, 17 bp, Homo sapiens
tgagaccagcctgggca

SEQ ID NO: 2614625 - DNA, 18 bp, Homo sapiens
tgagacccagccctcatc

SEQ ID NO: 2614626 - DNA, 20 bp, Homo sapiens
tgagacccagccctcatccc

SEQ ID NO: 2614627 - DNA, 15 bp, Homo sapiens
tgagacccccacacc

SEQ ID NO: 2614628 - DNA, 16 bp, Homo sapiens
tgagacccctggcctc

SEQ ID NO: 2614629 - DNA, 15 bp, Homo sapiens
tgagaccctgtctct

SEQ ID NO: 2614630 - DNA, 23 bp, Homo sapiens
tgagactctcttaggagcagagc

SEQ ID NO: 2614631 - DNA, 14 bp, Homo sapiens
tgagactctgtctc

SEQ ID NO: 2614632 - DNA, 22 bp, Homo sapiens
tgagactgcgggatggtcctgg

SEQ ID NO: 2614633 - DNA, 18 bp, Homo sapiens
tgagactgggtctcgctt

SEQ ID NO: 2614634 - DNA, 14 bp, Homo sapiens
tgagacttgctctc

SEQ ID NO: 2614635 - DNA, 15 bp, Homo sapiens
tgagagaagggacac

SEQ ID NO: 2614636 - DNA, 18 bp, Homo sapiens
tgagagaattgtatcatt

SEQ ID NO: 2614637 - DNA, 12 bp, Homo sapiens
tgagagactttt

SEQ ID NO: 2614638 - DNA, 17 bp, Homo sapiens
tgagagagatgggagct

SEQ ID NO: 2614639 - DNA, 21 bp, Homo sapiens
tgagagagatgggagctcctc

SEQ ID NO: 2614640 - DNA, 22 bp, Homo sapiens
tgagagagatgggagctcctct

SEQ ID NO: 2614641 - DNA, 15 bp, Homo sapiens
tgagagcccagaggt

SEQ ID NO: 2614642 - DNA, 16 bp, Homo sapiens
tgagagcccagaggta

SEQ ID NO: 2614643 - DNA, 19 bp, Homo sapiens
tgagagcccagaggtaaca

SEQ ID NO: 2614644 - DNA, 20 bp, Homo sapiens
tgagagcccagaggtaacag

SEQ ID NO: 2614645 - DNA, 12 bp, Homo sapiens
tgagagccccag

SEQ ID NO: 2614646 - DNA, 22 bp, Homo sapiens
tgagagccccagctgacatgga

SEQ ID NO: 2614647 - DNA, 23 bp, Homo sapiens
tgagaggatgaatgtatgtgcac

SEQ ID NO: 2614648 - DNA, 20 bp, Homo sapiens
tgagaggcaatgattgttaa

SEQ ID NO: 2614649 - DNA, 14 bp, Homo sapiens
tgagaggggaacag

SEQ ID NO: 2614650 - DNA, 19 bp, Homo sapiens
tgagaggggaacagactgg

SEQ ID NO: 2614651 - DNA, 23 bp, Homo sapiens
tgagagtatttaggcagattgaa

SEQ ID NO: 2614652 - DNA, 20 bp, Homo sapiens
tgagagtctgcacttaacaa

SEQ ID NO: 2614653 - DNA, 18 bp, Homo sapiens
tgagagttttgtcttgaa

SEQ ID NO: 2614654 - DNA, 21 bp, Homo sapiens
tgagataccagcgaggaggct

SEQ ID NO: 2614655 - DNA, 15 bp, Homo sapiens
tgagatagaagaact

SEQ ID NO: 2614656 - DNA, 16 bp, Homo sapiens
tgagatagaagaactg

SEQ ID NO: 2614657 - DNA, 16 bp, Homo sapiens
tgagatagcattgtga

SEQ ID NO: 2614658 - DNA, 23 bp, Homo sapiens
tgagatagcattgtgaactgaca

SEQ ID NO: 2614659 - DNA, 19 bp, Homo sapiens
tgagatagtagcatacatt

SEQ ID NO: 2614660 - DNA, 14 bp, Homo sapiens
tgagatcagcctgg

SEQ ID NO: 2614661 - DNA, 23 bp, Homo sapiens
tgagatctaagcctttccataag

SEQ ID NO: 2614662 - DNA, 18 bp, Homo sapiens
tgagatggagtctcactc

SEQ ID NO: 2614663 - DNA, 14 bp, Homo sapiens
tgagattttggtat

SEQ ID NO: 2614664 - DNA, 16 bp, Homo sapiens
tgagcaaatgtggctc

SEQ ID NO: 2614665 - DNA, 14 bp, Homo sapiens
tgagcaattctcct

SEQ ID NO: 2614666 - DNA, 13 bp, Homo sapiens
tgagcaccagggg

SEQ ID NO: 2614667 - DNA, 16 bp, Homo sapiens
tgagcaccaggggatg

SEQ ID NO: 2614668 - DNA, 20 bp, Homo sapiens
tgagcacggccaacaaagct

SEQ ID NO: 2614669 - DNA, 17 bp, Homo sapiens
tgagcactcccaagtct

SEQ ID NO: 2614670 - DNA, 18 bp, Homo sapiens
tgagcactcccaagtcta

SEQ ID NO: 2614671 - DNA, 13 bp, Homo sapiens
tgagcactgtagg

SEQ ID NO: 2614672 - DNA, 15 bp, Homo sapiens
tgagcagggctcagc

SEQ ID NO: 2614673 - DNA, 17 bp, Homo sapiens
tgagcagggctcagcgg

SEQ ID NO: 2614674 - DNA, 23 bp, Homo sapiens
tgagcagtgagttacagcgagag

SEQ ID NO: 2614675 - DNA, 16 bp, Homo sapiens
tgagcatcacagtttt

SEQ ID NO: 2614676 - DNA, 17 bp, Homo sapiens
tgagcatcacagttttg

SEQ ID NO: 2614677 - DNA, 14 bp, Homo sapiens
tgagcatcaggcca

SEQ ID NO: 2614678 - DNA, 15 bp, Homo sapiens
tgagcatcaggccag

SEQ ID NO: 2614679 - DNA, 21 bp, Homo sapiens
tgagcatcaggccaggccctc

SEQ ID NO: 2614680 - DNA, 12 bp, Homo sapiens
tgagccactgca

SEQ ID NO: 2614681 - DNA, 13 bp, Homo sapiens
tgagccactgcac

SEQ ID NO: 2614682 - DNA, 21 bp, Homo sapiens
tgagccactgcaccgggccac

SEQ ID NO: 2614683 - DNA, 17 bp, Homo sapiens
tgagccagtcccagggg

SEQ ID NO: 2614684 - DNA, 20 bp, Homo sapiens
tgagcccactgcccaccccc

SEQ ID NO: 2614685 - DNA, 23 bp, Homo sapiens
tgagcccactgcccaccccctca

SEQ ID NO: 2614686 - DNA, 17 bp, Homo sapiens
tgcacgcccatgtgtga

SEQ ID NO: 2614687 - DNA, 15 bp, Homo sapiens
tgcacggctgctgag

SEQ ID NO: 2614688 - DNA, 21 bp, Homo sapiens
tgcacggtgggccttgctggg

SEQ ID NO: 2614689 - DNA, 12 bp, Homo sapiens
tgcacgtggaga

SEQ ID NO: 2614690 - DNA, 15 bp, Homo sapiens
tgcacgtgtgtgcac

SEQ ID NO: 2614691 - DNA, 17 bp, Homo sapiens
tgcacgttatggtgttt

SEQ ID NO: 2614692 - DNA, 19 bp, Homo sapiens
tgcacgttatggtgtttct

SEQ ID NO: 2614693 - DNA, 19 bp, Homo sapiens
tgcactactcctctgcagt

SEQ ID NO: 2614694 - DNA, 23 bp, Homo sapiens
tgcactactcctctgcagtgcct

SEQ ID NO: 2614695 - DNA, 12 bp, Homo sapiens
tgcactccagcc

SEQ ID NO: 2614696 - DNA, 13 bp, Homo sapiens
tgcactccagcct

SEQ ID NO: 2614697 - DNA, 17 bp, Homo sapiens
tgcactccagcctgagc

SEQ ID NO: 2614698 - DNA, 18 bp, Homo sapiens
tgcactccagcctgggca

SEQ ID NO: 2614699 - DNA, 12 bp, Homo sapiens
tgcactcccctg

SEQ ID NO: 2614700 - DNA, 19 bp, Homo sapiens
tgcactcccctgctgggtg

SEQ ID NO: 2614701 - DNA, 18 bp, Homo sapiens
tgcactctaaaaggttca

SEQ ID NO: 2614702 - DNA, 17 bp, Homo sapiens
tgcactgagggccacac

SEQ ID NO: 2614703 - DNA, 18 bp, Homo sapiens
tgcactggagtccagtct

SEQ ID NO: 2614704 - DNA, 19 bp, Homo sapiens
tgcactggagtccagtctc

SEQ ID NO: 2614705 - DNA, 21 bp, Homo sapiens
tgcactggagtccagtctctt

SEQ ID NO: 2614706 - DNA, 20 bp, Homo sapiens
tgcactggggagcccgtctc

SEQ ID NO: 2614707 - DNA, 16 bp, Homo sapiens
tgcactgtcaagatga

SEQ ID NO: 2614708 - DNA, 15 bp, Homo sapiens
tgcactgtcactttg

SEQ ID NO: 2614709 - DNA, 23 bp, Homo sapiens
tgcactgtcactttgctctgggt

SEQ ID NO: 2614710 - DNA, 13 bp, Homo sapiens
tgcactgttcccc

SEQ ID NO: 2614711 - DNA, 14 bp, Homo sapiens
tgcactgttccccc

SEQ ID NO: 2614712 - DNA, 19 bp, Homo sapiens
tgcactgttccccctgtgc

SEQ ID NO: 2614713 - DNA, 20 bp, Homo sapiens
tgcactgttccccctgtgca

SEQ ID NO: 2614714 - DNA, 23 bp, Homo sapiens
tgcacttaacaagctcccaggcc

SEQ ID NO: 2614715 - DNA, 16 bp, Homo sapiens
tgcacttaaggcactc

SEQ ID NO: 2614716 - DNA, 21 bp, Homo sapiens
tgcacttaaggcactctgtta

SEQ ID NO: 2614717 - DNA, 15 bp, Homo sapiens
tgcactttgttctgg

SEQ ID NO: 2614718 - DNA, 18 bp, Homo sapiens
tgcactttgttctggctc

SEQ ID NO: 2614719 - DNA, 15 bp, Homo sapiens
tgcagaagacagtat

SEQ ID NO: 2614720 - DNA, 13 bp, Homo sapiens
tgcagaaggccaa

SEQ ID NO: 2614721 - DNA, 20 bp, Homo sapiens
tgcagacctgtcctcctggt

SEQ ID NO: 2614722 - DNA, 21 bp, Homo sapiens
tgcagacctgtcctcctggtg

SEQ ID NO: 2614723 - DNA, 16 bp, Homo sapiens
tgcagactctacagag

SEQ ID NO: 2614724 - DNA, 13 bp, Homo sapiens
tgcagagagaagc

SEQ ID NO: 2614725 - DNA, 21 bp, Homo sapiens
tgcagagagccattttgtgaa

SEQ ID NO: 2614726 - DNA, 21 bp, Homo sapiens
tgcagagcaggaaacatgact

SEQ ID NO: 2614727 - DNA, 15 bp, Homo sapiens
tgcagagctgaagat

SEQ ID NO: 2614728 - DNA, 19 bp, Homo sapiens
tgcagagggtactttaaga

SEQ ID NO: 2614729 - DNA, 14 bp, Homo sapiens
tgcagagtcagcag

SEQ ID NO: 2614730 - DNA, 17 bp, Homo sapiens
tgcagagtcctgcacag

SEQ ID NO: 2614731 - DNA, 14 bp, Homo sapiens
tgcagagtgcccag

SEQ ID NO: 2614732 - DNA, 18 bp, Homo sapiens
tgcagagtgcccagaact

SEQ ID NO: 2614733 - DNA, 20 bp, Homo sapiens
tgcagagtttccaaaaccag

SEQ ID NO: 2614734 - DNA, 19 bp, Homo sapiens
tgcagataaacagtagtga

SEQ ID NO: 2614735 - DNA, 14 bp, Homo sapiens
tgcagatgacaaaa

SEQ ID NO: 2614736 - DNA, 13 bp, Homo sapiens
tgcagattcattt

SEQ ID NO: 2614737 - DNA, 17 bp, Homo sapiens
tgcagcactcacacagg

SEQ ID NO: 2614738 - DNA, 17 bp, Homo sapiens
tgcagcatatgaggatg

SEQ ID NO: 2614739 - DNA, 22 bp, Homo sapiens
tgcagcatgacctgtgaccagc

SEQ ID NO: 2614740 - DNA, 23 bp, Homo sapiens
tgcagcatgacctgtgaccagca

SEQ ID NO: 2614741 - DNA, 21 bp, Homo sapiens
tgcagccagacctattcctcc

SEQ ID NO: 2614742 - DNA, 12 bp, Homo sapiens
tgcagcccatgc

SEQ ID NO: 2614743 - DNA, 13 bp, Homo sapiens
tgcagcccatgcc

SEQ ID NO: 2614744 - DNA, 14 bp, Homo sapiens
tgcagcccatgccc

SEQ ID NO: 2614745 - DNA, 19 bp, Homo sapiens
tgcagcccatgcccacctg

SEQ ID NO: 2614746 - DNA, 21 bp, Homo sapiens
tgcagcccatgcccacctgcc

SEQ ID NO: 2614747 - DNA, 21 bp, Homo sapiens
tgcagcctcaacctcctgggc

SEQ ID NO: 2614748 - DNA, 23 bp, Homo sapiens
tgcagcctcaacctcctgggcta

SEQ ID NO: 2614749 - DNA, 16 bp, Homo sapiens
tgcagcctcacagtcc

SEQ ID NO: 2614750 - DNA, 20 bp, Homo sapiens
tgcagcctgtcctgggctgg

SEQ ID NO: 2614751 - DNA, 16 bp, Homo sapiens
tgcagctcactaccct

SEQ ID NO: 2614752 - DNA, 16 bp, Homo sapiens
tgcagctgatgttgga

SEQ ID NO: 2614753 - DNA, 15 bp, Homo sapiens
tgcagcttctgtcct

SEQ ID NO: 2614754 - DNA, 16 bp, Homo sapiens
tgcagcttctgtcctg

SEQ ID NO: 2614755 - DNA, 15 bp, Homo sapiens
tgcagctttacatgc

SEQ ID NO: 2614756 - DNA, 16 bp, Homo sapiens
tgcaggaataaggcct

SEQ ID NO: 2614757 - DNA, 14 bp, Homo sapiens
tgcaggacctcagg

SEQ ID NO: 2614758 - DNA, 16 bp, Homo sapiens
tgcaggacctcaggtg

SEQ ID NO: 2614759 - DNA, 23 bp, Homo sapiens
tgcaggagttaaaaagggcaggg

SEQ ID NO: 2614760 - DNA, 19 bp, Homo sapiens
tgcaggcaccttagtggct

SEQ ID NO: 2614761 - DNA, 18 bp, Homo sapiens
tgcaggcagccaggccac

SEQ ID NO: 2614762 - DNA, 21 bp, Homo sapiens
tgcaggcatgcatgtgcttgt

SEQ ID NO: 2614763 - DNA, 20 bp, Homo sapiens
tgcaggccaagagcagaggc

SEQ ID NO: 2614764 - DNA, 23 bp, Homo sapiens
tgcaggctggcaccgccttctct

SEQ ID NO: 2614765 - DNA, 22 bp, Homo sapiens
tgcagggaaaattatttgcata

SEQ ID NO: 2614766 - DNA, 22 bp, Homo sapiens
tgcagggggtgtgtctgctcag

SEQ ID NO: 2614767 - DNA, 17 bp, Homo sapiens
tgcagggtggtgctggg

SEQ ID NO: 2614768 - DNA, 18 bp, Homo sapiens
tgcagggtggtgctggga

SEQ ID NO: 2614769 - DNA, 19 bp, Homo sapiens
tgcagtagagtcatctcca

SEQ ID NO: 2614770 - DNA, 22 bp, Homo sapiens
tgcagtagagtcatctccatca

SEQ ID NO: 2614771 - DNA, 14 bp, Homo sapiens
tgcagtagattttc

SEQ ID NO: 2614772 - DNA, 15 bp, Homo sapiens
tgcagtatgaaaata

SEQ ID NO: 2614773 - DNA, 16 bp, Homo sapiens
tgcagtatgaaaataa

SEQ ID NO: 2614774 - DNA, 17 bp, Homo sapiens
tgcagtattgagcactg

SEQ ID NO: 2614775 - DNA, 19 bp, Homo sapiens
tgcagtctggctgagccct

SEQ ID NO: 2614776 - DNA, 22 bp, Homo sapiens
tgcagtgacgtgcacctgtact

SEQ ID NO: 2614777 - DNA, 15 bp, Homo sapiens
tgcagtgagccaaga

SEQ ID NO: 2614778 - DNA, 14 bp, Homo sapiens
tgcagtgagccgag

SEQ ID NO: 2614779 - DNA, 16 bp, Homo sapiens
tgcagttgacagcagg

SEQ ID NO: 2614780 - DNA, 19 bp, Homo sapiens
tgcagtttgagacaggaga

SEQ ID NO: 2614781 - DNA, 12 bp, Homo sapiens
tgcagttttcct

SEQ ID NO: 2614782 - DNA, 15 bp, Homo sapiens
tgcagtttttcagag

SEQ ID NO: 2614783 - DNA, 15 bp, Homo sapiens
tgcataaatatgcag

SEQ ID NO: 2614784 - DNA, 19 bp, Homo sapiens
tgcataaatatgcagtgat

SEQ ID NO: 2614785 - DNA, 10 bp, Homo sapiens
tgcatacaca

SEQ ID NO: 2614786 - DNA, 23 bp, Homo sapiens
tgcatacacacacacacacagcc

SEQ ID NO: 2614787 - DNA, 21 bp, Homo sapiens
tgcataccacttttgttcttg

SEQ ID NO: 2614788 - DNA, 16 bp, Homo sapiens
tgcatacttcaaaagt

SEQ ID NO: 2614789 - DNA, 18 bp, Homo sapiens
tgcatacttcaaaagtat

SEQ ID NO: 2614790 - DNA, 19 bp, Homo sapiens
tgcatactttttaaatgta

SEQ ID NO: 2614791 - DNA, 20 bp, Homo sapiens
tgcatagattccctgagcag

SEQ ID NO: 2614792 - DNA, 20 bp, Homo sapiens
tgcataggtgatctcattta

SEQ ID NO: 2614793 - DNA, 22 bp, Homo sapiens
tgcatagtaccaatcattttaa

SEQ ID NO: 2614794 - DNA, 21 bp, Homo sapiens
tgcatagtattccattgtgtg

SEQ ID NO: 2614795 - DNA, 20 bp, Homo sapiens
tgcatataacttatattgta

SEQ ID NO: 2614796 - DNA, 17 bp, Homo sapiens
tgcatatatacatatat

SEQ ID NO: 2614797 - DNA, 13 bp, Homo sapiens
tgcatattgtaca

SEQ ID NO: 2614798 - DNA, 16 bp, Homo sapiens
tgcatattgtacactt

SEQ ID NO: 2614799 - DNA, 16 bp, Homo sapiens
tgcatattgtattact

SEQ ID NO: 2614800 - DNA, 16 bp, Homo sapiens
tgcatccaaaggtgct

SEQ ID NO: 2614801 - DNA, 16 bp, Homo sapiens
tgcatccccttggctg

SEQ ID NO: 2614802 - DNA, 18 bp, Homo sapiens
tgcatcgagtcaaaactc

SEQ ID NO: 2614803 - DNA, 17 bp, Homo sapiens
tgcatcgtttcatcttc

SEQ ID NO: 2614804 - DNA, 13 bp, Homo sapiens
tgcatctcccaga

SEQ ID NO: 2614805 - DNA, 19 bp, Homo sapiens
tgcatctgggattcccacc

SEQ ID NO: 2614806 - DNA, 17 bp, Homo sapiens
tgcatcttactgaaggt

SEQ ID NO: 2614807 - DNA, 13 bp, Homo sapiens
tgcatgaaggttt

SEQ ID NO: 2614808 - DNA, 19 bp, Homo sapiens
tgcatgaataaaattattc

SEQ ID NO: 2614809 - DNA, 22 bp, Homo sapiens
tgcatgagctacgcctgcctcc

SEQ ID NO: 2614810 - DNA, 19 bp, Homo sapiens
tgcatgcactgttccccct

SEQ ID NO: 2614811 - DNA, 19 bp, Homo sapiens
tgcatggaaacctgaaaaa

SEQ ID NO: 2614812 - DNA, 19 bp, Homo sapiens
tgcatggaaattcccttca

SEQ ID NO: 2614813 - DNA, 13 bp, Homo sapiens
tgcatggagcagg

SEQ ID NO: 2614814 - DNA, 19 bp, Homo sapiens
tgcatggcacttgcatctg

SEQ ID NO: 2614815 - DNA, 20 bp, Homo sapiens
tgcatggcacttgcatctgt

SEQ ID NO: 2614816 - DNA, 18 bp, Homo sapiens
tgcatggctccagaaatg

SEQ ID NO: 2614817 - DNA, 20 bp, Homo sapiens
tgcatggctccagaaatgtc

SEQ ID NO: 2614818 - DNA, 16 bp, Homo sapiens
tgcatgggtgaaggga

SEQ ID NO: 2614819 - DNA, 15 bp, Homo sapiens
tgcatgtatgtcttg

SEQ ID NO: 2614820 - DNA, 16 bp, Homo sapiens
tgcatgtgaagaaagg

SEQ ID NO: 2614821 - DNA, 14 bp, Homo sapiens
tgcatgtgactctg

SEQ ID NO: 2614822 - DNA, 15 bp, Homo sapiens
tgcatgtgactctga

SEQ ID NO: 2614823 - DNA, 12 bp, Homo sapiens
tgcatgtgtgcg

SEQ ID NO: 2614824 - DNA, 13 bp, Homo sapiens
tgcatgtgtgtgc

SEQ ID NO: 2614825 - DNA, 19 bp, Homo sapiens
tgcatgttacataagataa

SEQ ID NO: 2614826 - DNA, 15 bp, Homo sapiens
tgcatgtttgtgatt

SEQ ID NO: 2614827 - DNA, 19 bp, Homo sapiens
tgcattaaaagaaaataaa

SEQ ID NO: 2614828 - DNA, 17 bp, Homo sapiens
tgcattacagagaggag

SEQ ID NO: 2614829 - DNA, 19 bp, Homo sapiens
tgcattagaaatagacagt

SEQ ID NO: 2614830 - DNA, 18 bp, Homo sapiens
tgctctcctcttgccact

SEQ ID NO: 2614831 - DNA, 22 bp, Homo sapiens
tgctctcctcttgccactgcct

SEQ ID NO: 2614832 - DNA, 19 bp, Homo sapiens
tgctctcgcacctttccaa

SEQ ID NO: 2614833 - DNA, 17 bp, Homo sapiens
tgctctgaggcttccag

SEQ ID NO: 2614834 - DNA, 19 bp, Homo sapiens
tgctctgatccctctacag

SEQ ID NO: 2614835 - DNA, 19 bp, Homo sapiens
tgctctgcaggcaccttag

SEQ ID NO: 2614836 - DNA, 22 bp, Homo sapiens
tgctctgcgtgtcacctgtgct

SEQ ID NO: 2614837 - DNA, 21 bp, Homo sapiens
tgctctgctgacagacacagg

SEQ ID NO: 2614838 - DNA, 22 bp, Homo sapiens
tgctctgctgacagacacaggc

SEQ ID NO: 2614839 - DNA, 14 bp, Homo sapiens
tgctctggaatttg

SEQ ID NO: 2614840 - DNA, 16 bp, Homo sapiens
tgctctggacaggcat

SEQ ID NO: 2614841 - DNA, 22 bp, Homo sapiens
tgctctgtcttctttgcccaca

SEQ ID NO: 2614842 - DNA, 12 bp, Homo sapiens
tgctcttagctg

SEQ ID NO: 2614843 - DNA, 15 bp, Homo sapiens
tgctcttagctgtct

SEQ ID NO: 2614844 - DNA, 23 bp, Homo sapiens
tgctcttctgtggaccactgcat

SEQ ID NO: 2614845 - DNA, 18 bp, Homo sapiens
tgctcttgtcctagcttg

SEQ ID NO: 2614846 - DNA, 19 bp, Homo sapiens
tgctcttgtcctagcttgg

SEQ ID NO: 2614847 - DNA, 19 bp, Homo sapiens
tgctgaacattgcatataa

SEQ ID NO: 2614848 - DNA, 21 bp, Homo sapiens
tgctgaacattgcatataact

SEQ ID NO: 2614849 - DNA, 22 bp, Homo sapiens
tgctgaagggaccttgaagggt

SEQ ID NO: 2614850 - DNA, 18 bp, Homo sapiens
tgctgaatggttttcaaa

SEQ ID NO: 2614851 - DNA, 20 bp, Homo sapiens
tgctgaatgttgggactgct

SEQ ID NO: 2614852 - DNA, 16 bp, Homo sapiens
tgctgacagacacagg

SEQ ID NO: 2614853 - DNA, 23 bp, Homo sapiens
tgctgacagacacaggcccggct

SEQ ID NO: 2614854 - DNA, 23 bp, Homo sapiens
tgctgagcctgtaaaataaaagg

SEQ ID NO: 2614855 - DNA, 14 bp, Homo sapiens
tgctgagggaccag

SEQ ID NO: 2614856 - DNA, 17 bp, Homo sapiens
tgctgagggaccagcca

SEQ ID NO: 2614857 - DNA, 19 bp, Homo sapiens
tgctgagggaccagccaag

SEQ ID NO: 2614858 - DNA, 15 bp, Homo sapiens
tgctgagtctgaagg

SEQ ID NO: 2614859 - DNA, 18 bp, Homo sapiens
tgctgagtctgaaggctg

SEQ ID NO: 2614860 - DNA, 22 bp, Homo sapiens
tgctgagtctgaaggctgggtt

SEQ ID NO: 2614861 - DNA, 15 bp, Homo sapiens
tgctgagttggtgtt

SEQ ID NO: 2614862 - DNA, 17 bp, Homo sapiens
tgctgatgtcctcacca

SEQ ID NO: 2614863 - DNA, 13 bp, Homo sapiens
tgctgatgttcag

SEQ ID NO: 2614864 - DNA, 15 bp, Homo sapiens
tgctgatgttcagtg

SEQ ID NO: 2614865 - DNA, 23 bp, Homo sapiens
tgctgatgttcagtgtaatttct

SEQ ID NO: 2614866 - DNA, 14 bp, Homo sapiens
tgctgcaaacctga

SEQ ID NO: 2614867 - DNA, 20 bp, Homo sapiens
tgctgcaaggcctttctgtg

SEQ ID NO: 2614868 - DNA, 23 bp, Homo sapiens
tgctgcaaggcctttctgtgtgt

SEQ ID NO: 2614869 - DNA, 16 bp, Homo sapiens
tgctgcagttgccagt

SEQ ID NO: 2614870 - DNA, 17 bp, Homo sapiens
tgctgcatttaaaagat

SEQ ID NO: 2614871 - DNA, 18 bp, Homo sapiens
tgctgcatttaaaagata

SEQ ID NO: 2614872 - DNA, 11 bp, Homo sapiens
tgctgccatcc

SEQ ID NO: 2614873 - DNA, 14 bp, Homo sapiens
tgctgccatccagg

SEQ ID NO: 2614874 - DNA, 14 bp, Homo sapiens
tgctgcccagcctc

SEQ ID NO: 2614875 - DNA, 16 bp, Homo sapiens
tgctgcccagcctcca

SEQ ID NO: 2614876 - DNA, 18 bp, Homo sapiens
tgctgccccatcagtgct

SEQ ID NO: 2614877 - DNA, 19 bp, Homo sapiens
tgctgccccatcagtgctc

SEQ ID NO: 2614878 - DNA, 17 bp, Homo sapiens
tgctgcccgctctgcag

SEQ ID NO: 2614879 - DNA, 13 bp, Homo sapiens
tgctgccctccat

SEQ ID NO: 2614880 - DNA, 11 bp, Homo sapiens
tgctgccctgt

SEQ ID NO: 2614881 - DNA, 14 bp, Homo sapiens
tgctgccctgtgag

SEQ ID NO: 2614882 - DNA, 15 bp, Homo sapiens
tgctgccctgtgagt

SEQ ID NO: 2614883 - DNA, 19 bp, Homo sapiens
tgctgccgccccacccaga

SEQ ID NO: 2614884 - DNA, 14 bp, Homo sapiens
tgctgcctccagaa

SEQ ID NO: 2614885 - DNA, 22 bp, Homo sapiens
tgctgcctccccaaccctgccc

SEQ ID NO: 2614886 - DNA, 13 bp, Homo sapiens
tgctgcctgcctg

SEQ ID NO: 2614887 - DNA, 14 bp, Homo sapiens
tgctgcctgcctgt

SEQ ID NO: 2614888 - DNA, 15 bp, Homo sapiens
tgctgctacttaatt

SEQ ID NO: 2614889 - DNA, 19 bp, Homo sapiens
tgctgctatcctgccaaaa

SEQ ID NO: 2614890 - DNA, 15 bp, Homo sapiens
tgctgctgcgccctt

SEQ ID NO: 2614891 - DNA, 16 bp, Homo sapiens
tgctgcttccctctgc

SEQ ID NO: 2614892 - DNA, 20 bp, Homo sapiens
tgctgcttccctctgcctgt

SEQ ID NO: 2614893 - DNA, 21 bp, Homo sapiens
tgctgcttccctctgcctgtc

SEQ ID NO: 2614894 - DNA, 16 bp, Homo sapiens
tgctgctttcccctgt

SEQ ID NO: 2614895 - DNA, 19 bp, Homo sapiens
tgctgctttcccctgtggg

SEQ ID NO: 2614896 - DNA, 20 bp, Homo sapiens
tgctgcttttccttggggca

SEQ ID NO: 2614897 - DNA, 20 bp, Homo sapiens
tgctgctttttgaggtggca

SEQ ID NO: 2614898 - DNA, 14 bp, Homo sapiens
tgctggagatgttt

SEQ ID NO: 2614899 - DNA, 13 bp, Homo sapiens
tgctggagctctg

SEQ ID NO: 2614900 - DNA, 13 bp, Homo sapiens
tgctggaggactg

SEQ ID NO: 2614901 - DNA, 16 bp, Homo sapiens
tgctggatattttcaa

SEQ ID NO: 2614902 - DNA, 22 bp, Homo sapiens
tgctggatcacagctgctttct

SEQ ID NO: 2614903 - DNA, 15 bp, Homo sapiens
tgctggcccctcacc

SEQ ID NO: 2614904 - DNA, 22 bp, Homo sapiens
tgctggcccctcacctgggcac

SEQ ID NO: 2614905 - DNA, 15 bp, Homo sapiens
tgctggccgcctcac

SEQ ID NO: 2614906 - DNA, 17 bp, Homo sapiens
tgctggccgcctcaccc

SEQ ID NO: 2614907 - DNA, 13 bp, Homo sapiens
tgctggctcttct

SEQ ID NO: 2614908 - DNA, 18 bp, Homo sapiens
tgctggctgttggctggg

SEQ ID NO: 2614909 - DNA, 17 bp, Homo sapiens
tgctgggactggccagg

SEQ ID NO: 2614910 - DNA, 17 bp, Homo sapiens
tgctgggcttgtctgta

SEQ ID NO: 2614911 - DNA, 18 bp, Homo sapiens
tgctggggcaagtccctg

SEQ ID NO: 2614912 - DNA, 17 bp, Homo sapiens
tgctgggttggtgcaca

SEQ ID NO: 2614913 - DNA, 23 bp, Homo sapiens
tgctgggttggtgcacagtgatt

SEQ ID NO: 2614914 - DNA, 16 bp, Homo sapiens
tgctggtcacagcctc

SEQ ID NO: 2614915 - DNA, 17 bp, Homo sapiens
tgctggtcacagcctcc

SEQ ID NO: 2614916 - DNA, 14 bp, Homo sapiens
tgctggtgtcctga

SEQ ID NO: 2614917 - DNA, 16 bp, Homo sapiens
tgctggtgtcctgacc

SEQ ID NO: 2614918 - DNA, 17 bp, Homo sapiens
tgctggtgtcctgacca

SEQ ID NO: 2614919 - DNA, 17 bp, Homo sapiens
tgctggttgctgtgtgg

SEQ ID NO: 2614920 - DNA, 15 bp, Homo sapiens
tgctggttttcctaa

SEQ ID NO: 2614921 - DNA, 14 bp, Homo sapiens
tgctgtactagaga

SEQ ID NO: 2614922 - DNA, 13 bp, Homo sapiens
tgctgtccctccc

SEQ ID NO: 2614923 - DNA, 14 bp, Homo sapiens
tgctgtcctaggcc

SEQ ID NO: 2614924 - DNA, 23 bp, Homo sapiens
tgctgtcctaggccacaccatct

SEQ ID NO: 2614925 - DNA, 13 bp, Homo sapiens
tgctgtgaaaaaa

SEQ ID NO: 2614926 - DNA, 17 bp, Homo sapiens
tgctgtggccagggtga

SEQ ID NO: 2614927 - DNA, 23 bp, Homo sapiens
tgctgtggccagggtgagagctg

SEQ ID NO: 2614928 - DNA, 14 bp, Homo sapiens
tgctgtggcctggg

SEQ ID NO: 2614929 - DNA, 14 bp, Homo sapiens
tgctgtgggaacga

SEQ ID NO: 2614930 - DNA, 19 bp, Homo sapiens
tgctgtgggaacgagaggg

SEQ ID NO: 2614931 - DNA, 22 bp, Homo sapiens
tgctgtgggaacgagaggggaa

SEQ ID NO: 2614932 - DNA, 16 bp, Homo sapiens
tgctgtggggctggta

SEQ ID NO: 2614933 - DNA, 23 bp, Homo sapiens
tgctgtggggctggtagctcagg

SEQ ID NO: 2614934 - DNA, 23 bp, Homo sapiens
tgctgtggtgtgtccccctctgt

SEQ ID NO: 2614935 - DNA, 12 bp, Homo sapiens
tgctgtgtaaag

SEQ ID NO: 2614936 - DNA, 17 bp, Homo sapiens
tgctgtgtaaagttagt

SEQ ID NO: 2614937 - DNA, 16 bp, Homo sapiens
tgctgtgtatctgata

SEQ ID NO: 2614938 - DNA, 15 bp, Homo sapiens
tgctgttgattgcta

SEQ ID NO: 2614939 - DNA, 22 bp, Homo sapiens
tgctgttgattgctaaatgtaa

SEQ ID NO: 2614940 - DNA, 19 bp, Homo sapiens
tgctgttgatttctttcca

SEQ ID NO: 2614941 - DNA, 11 bp, Homo sapiens
tgctgtttcct

SEQ ID NO: 2614942 - DNA, 18 bp, Homo sapiens
tgctgttttgttctgtgg

SEQ ID NO: 2614943 - DNA, 14 bp, Homo sapiens
tgcttaatgaaaag

SEQ ID NO: 2614944 - DNA, 21 bp, Homo sapiens
tgcttacaattccctgctgtc

SEQ ID NO: 2614945 - DNA, 22 bp, Homo sapiens
tgcttacaattccctgctgtcg

SEQ ID NO: 2614946 - DNA, 15 bp, Homo sapiens
tgcttacacatctca

SEQ ID NO: 2614947 - DNA, 16 bp, Homo sapiens
tgcttacacatctcag

SEQ ID NO: 2614948 - DNA, 17 bp, Homo sapiens
tgcttacatttttacaa

SEQ ID NO: 2614949 - DNA, 15 bp, Homo sapiens
tgcttagcctcctga

SEQ ID NO: 2614950 - DNA, 18 bp, Homo sapiens
tgcttagcctcctgacct

SEQ ID NO: 2614951 - DNA, 14 bp, Homo sapiens
tgcttaggatgttt

SEQ ID NO: 2614952 - DNA, 23 bp, Homo sapiens
tgcttaggatgtttttcatgaaa

SEQ ID NO: 2614953 - DNA, 14 bp, Homo sapiens
tgcttagtaatgct

SEQ ID NO: 2614954 - DNA, 18 bp, Homo sapiens
tgcttagtaatgctacgt

SEQ ID NO: 2614955 - DNA, 17 bp, Homo sapiens
tgcttataggtggcctc

SEQ ID NO: 2614956 - DNA, 22 bp, Homo sapiens
tgcttatgcagtttttcagagt

SEQ ID NO: 2614957 - DNA, 21 bp, Homo sapiens
tgcttattgttccaagacatt

SEQ ID NO: 2614958 - DNA, 13 bp, Homo sapiens
tgcttcaaaaaca

SEQ ID NO: 2614959 - DNA, 17 bp, Homo sapiens
tgcttcaaatccatcca

SEQ ID NO: 2614960 - DNA, 23 bp, Homo sapiens
tgcttcaatacccaaatcctctc

SEQ ID NO: 2614961 - DNA, 15 bp, Homo sapiens
tgcttcaattaataa

SEQ ID NO: 2614962 - DNA, 15 bp, Homo sapiens
tgcttcagcctgagg

SEQ ID NO: 2614963 - DNA, 23 bp, Homo sapiens
tgcttcagcctgaggctgagact

SEQ ID NO: 2614964 - DNA, 18 bp, Homo sapiens
tgcttcataaatgaagca

SEQ ID NO: 2614965 - DNA, 19 bp, Homo sapiens
tgcttccagtgaggctctg

SEQ ID NO: 2614966 - DNA, 22 bp, Homo sapiens
tgcttccagtgaggctctgccc

SEQ ID NO: 2614967 - DNA, 15 bp, Homo sapiens
tgcttcccatcctac

SEQ ID NO: 2614968 - DNA, 17 bp, Homo sapiens
tgcttcccattgtggct

SEQ ID NO: 2614969 - DNA, 12 bp, Homo sapiens
tgcttctcactg

SEQ ID NO: 2614970 - DNA, 17 bp, Homo sapiens
tgcttctccatgagaca

SEQ ID NO: 2614971 - DNA, 14 bp, Homo sapiens
tgcttctctacaga

SEQ ID NO: 2614972 - DNA, 16 bp, Homo sapiens
tgcttcttcagagact

SEQ ID NO: 2614973 - DNA, 15 bp, Homo sapiens
tgcttctttcatttt

SEQ ID NO: 2614974 - DNA, 20 bp, Homo sapiens
tgcttgacataatttcactg

SEQ ID NO: 2614975 - DNA, 15 bp, Homo sapiens
tggctagagtcctca

SEQ ID NO: 2614976 - DNA, 15 bp, Homo sapiens
tggctataggtgcta

SEQ ID NO: 2614977 - DNA, 21 bp, Homo sapiens
tggctatatggcaagaaagct

SEQ ID NO: 2614978 - DNA, 17 bp, Homo sapiens
tggctatgcatttgaaa

SEQ ID NO: 2614979 - DNA, 22 bp, Homo sapiens
tggctattagagatcaacccct

SEQ ID NO: 2614980 - DNA, 15 bp, Homo sapiens
tggctatttaaaact

SEQ ID NO: 2614981 - DNA, 20 bp, Homo sapiens
tggctcactatgaatctatt

SEQ ID NO: 2614982 - DNA, 21 bp, Homo sapiens
tggctcactatggtgccaatg

SEQ ID NO: 2614983 - DNA, 20 bp, Homo sapiens
tggctcaggtggggtcactc

SEQ ID NO: 2614984 - DNA, 20 bp, Homo sapiens
tggctccaaaccctcgaggc

SEQ ID NO: 2614985 - DNA, 13 bp, Homo sapiens
tggctccagcacc

SEQ ID NO: 2614986 - DNA, 15 bp, Homo sapiens
tggctccagtctgct

SEQ ID NO: 2614987 - DNA, 19 bp, Homo sapiens
tggctccagtctgctgccc

SEQ ID NO: 2614988 - DNA, 20 bp, Homo sapiens
tggctccagtctgctgccct

SEQ ID NO: 2614989 - DNA, 19 bp, Homo sapiens
tggctcccacaggcagctt

SEQ ID NO: 2614990 - DNA, 14 bp, Homo sapiens
tggctcccatgacc

SEQ ID NO: 2614991 - DNA, 13 bp, Homo sapiens
tggctcccctcta

SEQ ID NO: 2614992 - DNA, 20 bp, Homo sapiens
tggctcccggagggccctga

SEQ ID NO: 2614993 - DNA, 22 bp, Homo sapiens
tggctcctcaaacagtaggttg

SEQ ID NO: 2614994 - DNA, 21 bp, Homo sapiens
tggctcctgaggggcatctgc

SEQ ID NO: 2614995 - DNA, 20 bp, Homo sapiens
tggctctccaagtgccagag

SEQ ID NO: 2614996 - DNA, 20 bp, Homo sapiens
tggctctgaggtgcctgtcc

SEQ ID NO: 2614997 - DNA, 21 bp, Homo sapiens
tggctctgaggtgcctgtccc

SEQ ID NO: 2614998 - DNA, 22 bp, Homo sapiens
tggctctgaggtgcctgtccca

SEQ ID NO: 2614999 - DNA, 13 bp, Homo sapiens
tggctcttccagg

SEQ ID NO: 2615000 - DNA, 23 bp, Homo sapiens
tggctcttgatacccccctctgt

SEQ ID NO: 2615001 - DNA, 13 bp, Homo sapiens
tggctgaactcat

SEQ ID NO: 2615002 - DNA, 12 bp, Homo sapiens
tggctgaaggac

SEQ ID NO: 2615003 - DNA, 16 bp, Homo sapiens
tggctgaaggactgtg

SEQ ID NO: 2615004 - DNA, 19 bp, Homo sapiens
tggctgagatatgaacata

SEQ ID NO: 2615005 - DNA, 19 bp, Homo sapiens
tggctgagcggatgcatct

SEQ ID NO: 2615006 - DNA, 20 bp, Homo sapiens
tggctgaggatttcaagcct

SEQ ID NO: 2615007 - DNA, 13 bp, Homo sapiens
tggctgcagggag

SEQ ID NO: 2615008 - DNA, 14 bp, Homo sapiens
tggctgcagggagt

SEQ ID NO: 2615009 - DNA, 20 bp, Homo sapiens
tggctgccccaacctgctga

SEQ ID NO: 2615010 - DNA, 13 bp, Homo sapiens
tggctgccctggc

SEQ ID NO: 2615011 - DNA, 15 bp, Homo sapiens
tggctgccctggccc

SEQ ID NO: 2615012 - DNA, 16 bp, Homo sapiens
tggctgccctggccct

SEQ ID NO: 2615013 - DNA, 17 bp, Homo sapiens
tggctgccctggccctg

SEQ ID NO: 2615014 - DNA, 22 bp, Homo sapiens
tggctgccttgtgaaggaatta

SEQ ID NO: 2615015 - DNA, 11 bp, Homo sapiens
tggctgctgaa

SEQ ID NO: 2615016 - DNA, 12 bp, Homo sapiens
tggctgctgaag

SEQ ID NO: 2615017 - DNA, 15 bp, Homo sapiens
tggctgctgaagctg

SEQ ID NO: 2615018 - DNA, 21 bp, Homo sapiens
tggctgctgaagctgcctgct

SEQ ID NO: 2615019 - DNA, 11 bp, Homo sapiens
tggctgctgcc

SEQ ID NO: 2615020 - DNA, 12 bp, Homo sapiens
tggctgctgccc

SEQ ID NO: 2615021 - DNA, 23 bp, Homo sapiens
tggctggagacgggtgggcggct

SEQ ID NO: 2615022 - DNA, 19 bp, Homo sapiens
tggctggatgaaattttct

SEQ ID NO: 2615023 - DNA, 17 bp, Homo sapiens
tggctggcccgtcatgt

SEQ ID NO: 2615024 - DNA, 21 bp, Homo sapiens
tggctggccttccacttggct

SEQ ID NO: 2615025 - DNA, 15 bp, Homo sapiens
tggctgggaactcac

SEQ ID NO: 2615026 - DNA, 14 bp, Homo sapiens
tggctgggggcctc

SEQ ID NO: 2615027 - DNA, 17 bp, Homo sapiens
tggctgggggcctcagt

SEQ ID NO: 2615028 - DNA, 22 bp, Homo sapiens
tggctggttagaggttcccttt

SEQ ID NO: 2615029 - DNA, 15 bp, Homo sapiens
tggctgtgaggcccc

SEQ ID NO: 2615030 - DNA, 15 bp, Homo sapiens
tggctgtgcctctgc

SEQ ID NO: 2615031 - DNA, 16 bp, Homo sapiens
tggctgttggctgggg

SEQ ID NO: 2615032 - DNA, 18 bp, Homo sapiens
tggctgttggctgggggc

SEQ ID NO: 2615033 - DNA, 15 bp, Homo sapiens
tggcttatccagctg

SEQ ID NO: 2615034 - DNA, 17 bp, Homo sapiens
tggcttcacggaagagc

SEQ ID NO: 2615035 - DNA, 20 bp, Homo sapiens
tggcttcacggaagagcctt

SEQ ID NO: 2615036 - DNA, 23 bp, Homo sapiens
tggcttcacggaagagccttgcg

SEQ ID NO: 2615037 - DNA, 21 bp, Homo sapiens
tggcttctcatacgtccacca

SEQ ID NO: 2615038 - DNA, 22 bp, Homo sapiens
tggcttctcatacgtccaccat

SEQ ID NO: 2615039 - DNA, 14 bp, Homo sapiens
tggcttctggagcc

SEQ ID NO: 2615040 - DNA, 17 bp, Homo sapiens
tggcttgccacagctct

SEQ ID NO: 2615041 - DNA, 18 bp, Homo sapiens
tggcttgtgtgtttcact

SEQ ID NO: 2615042 - DNA, 21 bp, Homo sapiens
tggctttcccggactgcaagc

SEQ ID NO: 2615043 - DNA, 20 bp, Homo sapiens
tggctttctcccactgagtt

SEQ ID NO: 2615044 - DNA, 23 bp, Homo sapiens
tggctttctccgactgctaggga

SEQ ID NO: 2615045 - DNA, 20 bp, Homo sapiens
tggctttgtgattcaatctg

SEQ ID NO: 2615046 - DNA, 17 bp, Homo sapiens
tggcttttattaatgca

SEQ ID NO: 2615047 - DNA, 15 bp, Homo sapiens
tgggaaacagaggct

SEQ ID NO: 2615048 - DNA, 17 bp, Homo sapiens
tgggaaagcattgtaaa

SEQ ID NO: 2615049 - DNA, 20 bp, Homo sapiens
tgggaaagccacctctccct

SEQ ID NO: 2615050 - DNA, 21 bp, Homo sapiens
tgggaaagccacctctccctc

SEQ ID NO: 2615051 - DNA, 17 bp, Homo sapiens
tgggaaaggagtagaaa

SEQ ID NO: 2615052 - DNA, 17 bp, Homo sapiens
tgggaaataagagagaa

SEQ ID NO: 2615053 - DNA, 22 bp, Homo sapiens
tgggaaatggtatgagctgagg

SEQ ID NO: 2615054 - DNA, 16 bp, Homo sapiens
tgggaacgagagggga

SEQ ID NO: 2615055 - DNA, 17 bp, Homo sapiens
tgggaactcacctgggg

SEQ ID NO: 2615056 - DNA, 18 bp, Homo sapiens
tgggaactcacctggggc

SEQ ID NO: 2615057 - DNA, 18 bp, Homo sapiens
tgggaactgcagacctgt

SEQ ID NO: 2615058 - DNA, 21 bp, Homo sapiens
tgggaagacatggggaggaag

SEQ ID NO: 2615059 - DNA, 17 bp, Homo sapiens
tgggaagacgaggccct

SEQ ID NO: 2615060 - DNA, 17 bp, Homo sapiens
tgggaagataggctctg

SEQ ID NO: 2615061 - DNA, 19 bp, Homo sapiens
tgggaaggggacccccgcc

SEQ ID NO: 2615062 - DNA, 12 bp, Homo sapiens
tgggaatgaagc

SEQ ID NO: 2615063 - DNA, 14 bp, Homo sapiens
tgggaatgaagctt

SEQ ID NO: 2615064 - DNA, 19 bp, Homo sapiens
tgggaatgaagcttgtgta

SEQ ID NO: 2615065 - DNA, 18 bp, Homo sapiens
tgggaatgaggcttgctg

SEQ ID NO: 2615066 - DNA, 19 bp, Homo sapiens
tgggacaaatcaagcttca

SEQ ID NO: 2615067 - DNA, 17 bp, Homo sapiens
tgggaccaaacctagcc

SEQ ID NO: 2615068 - DNA, 23 bp, Homo sapiens
tgggaccgccagatggggcctct

SEQ ID NO: 2615069 - DNA, 15 bp, Homo sapiens
tgggacctttagtgg

SEQ ID NO: 2615070 - DNA, 14 bp, Homo sapiens
tgggactgagccag

SEQ ID NO: 2615071 - DNA, 18 bp, Homo sapiens
tgggactgctaaataaaa

SEQ ID NO: 2615072 - DNA, 23 bp, Homo sapiens
tgggactggccaggtttctgccc

SEQ ID NO: 2615073 - DNA, 19 bp, Homo sapiens
tgggactgggtttggaccc

SEQ ID NO: 2615074 - DNA, 17 bp, Homo sapiens
tgggacttccttgctct

SEQ ID NO: 2615075 - DNA, 20 bp, Homo sapiens
tgggacttccttgctctccc

SEQ ID NO: 2615076 - DNA, 15 bp, Homo sapiens
tgggacttcttttca

SEQ ID NO: 2615077 - DNA, 19 bp, Homo sapiens
tgggagaaattgacagatc

SEQ ID NO: 2615078 - DNA, 21 bp, Homo sapiens
tgggagacaagaaatccctgt

SEQ ID NO: 2615079 - DNA, 18 bp, Homo sapiens
tgggagactgctgagtca

SEQ ID NO: 2615080 - DNA, 14 bp, Homo sapiens
tgggagagcccagc

SEQ ID NO: 2615081 - DNA, 21 bp, Homo sapiens
tgggagatatatttttaagat

SEQ ID NO: 2615082 - DNA, 13 bp, Homo sapiens
tgggagcactgga

SEQ ID NO: 2615083 - DNA, 23 bp, Homo sapiens
tgggagcagcccgctgagtggac

SEQ ID NO: 2615084 - DNA, 13 bp, Homo sapiens
tgggagccccagg

SEQ ID NO: 2615085 - DNA, 18 bp, Homo sapiens
tgggagccgggtctgcct

SEQ ID NO: 2615086 - DNA, 14 bp, Homo sapiens
tgggagctcctctc

SEQ ID NO: 2615087 - DNA, 15 bp, Homo sapiens
tgggagctcctctcc

SEQ ID NO: 2615088 - DNA, 16 bp, Homo sapiens
tgggagctcctctcct

SEQ ID NO: 2615089 - DNA, 19 bp, Homo sapiens
tgggagctcctctcctgga

SEQ ID NO: 2615090 - DNA, 23 bp, Homo sapiens
tgggagctcctctcctggaggat

SEQ ID NO: 2615091 - DNA, 14 bp, Homo sapiens
tgggagctgcctgt

SEQ ID NO: 2615092 - DNA, 17 bp, Homo sapiens
tgggagctgcctgttca

SEQ ID NO: 2615093 - DNA, 22 bp, Homo sapiens
tgggagctgcctgttcagctcc

SEQ ID NO: 2615094 - DNA, 21 bp, Homo sapiens
tgggaggatctcttgagcctg

SEQ ID NO: 2615095 - DNA, 21 bp, Homo sapiens
tgggaggattgcttgagctca

SEQ ID NO: 2615096 - DNA, 19 bp, Homo sapiens
tgggaggcaagaggggtgg

SEQ ID NO: 2615097 - DNA, 20 bp, Homo sapiens
tgggaggccaaggtgggagg

SEQ ID NO: 2615098 - DNA, 19 bp, Homo sapiens
tgggaggctgagatgggag

SEQ ID NO: 2615099 - DNA, 13 bp, Homo sapiens
tgggaggctgagg

SEQ ID NO: 2615100 - DNA, 14 bp, Homo sapiens
tgggaggcttcccc

SEQ ID NO: 2615101 - DNA, 17 bp, Homo sapiens
tgggagggagcagacag

SEQ ID NO: 2615102 - DNA, 19 bp, Homo sapiens
tgggagggcagcagggcta

SEQ ID NO: 2615103 - DNA, 12 bp, Homo sapiens
tgggaggggcag

SEQ ID NO: 2615104 - DNA, 18 bp, Homo sapiens
tgggaggggcaggctgac

SEQ ID NO: 2615105 - DNA, 23 bp, Homo sapiens
tgggaggtcaaggctgcagtgag

SEQ ID NO: 2615106 - DNA, 22 bp, Homo sapiens
tgggagttgatcgcctttccca

SEQ ID NO: 2615107 - DNA, 13 bp, Homo sapiens
tgggataggaaaa

SEQ ID NO: 2615108 - DNA, 15 bp, Homo sapiens
tgggatcctccaggt

SEQ ID NO: 2615109 - DNA, 18 bp, Homo sapiens
tgggatcctccaggtgca

SEQ ID NO: 2615110 - DNA, 13 bp, Homo sapiens
tgggatctgcccc

SEQ ID NO: 2615111 - DNA, 17 bp, Homo sapiens
tgggatggtggagggcc

SEQ ID NO: 2615112 - DNA, 19 bp, Homo sapiens
tgggatgtccacagatgcc

SEQ ID NO: 2615113 - DNA, 23 bp, Homo sapiens
tgggattcccaccaaggtcttca

SEQ ID NO: 2615114 - DNA, 21 bp, Homo sapiens
tgggattcctgacccaggccg

SEQ ID NO: 2615115 - DNA, 17 bp, Homo sapiens
tgggattctactttaag

SEQ ID NO: 2615116 - DNA, 22 bp, Homo sapiens
tgggattctactttaagcacta

SEQ ID NO: 2615117 - DNA, 18 bp, Homo sapiens
tgggattgggggctggtg

SEQ ID NO: 2615118 - DNA, 14 bp, Homo sapiens
tgggcaaacaggca

SEQ ID NO: 2615119 - DNA, 15 bp, Homo sapiens
tgtcacacagggcag

SEQ ID NO: 2615120 - DNA, 13 bp, Homo sapiens
tgtcacaccagcc

SEQ ID NO: 2615121 - DNA, 14 bp, Homo sapiens
tgtcacaccagcca

SEQ ID NO: 2615122 - DNA, 13 bp, Homo sapiens
tgtcacaggcagg

SEQ ID NO: 2615123 - DNA, 14 bp, Homo sapiens
tgtcacaggcaggt

SEQ ID NO: 2615124 - DNA, 17 bp, Homo sapiens
tgtcacagggactgaaa

SEQ ID NO: 2615125 - DNA, 11 bp, Homo sapiens
tgtcacagggc

SEQ ID NO: 2615126 - DNA, 13 bp, Homo sapiens
tgtcacagggcca

SEQ ID NO: 2615127 - DNA, 18 bp, Homo sapiens
tgtcaccctccacctctt

SEQ ID NO: 2615128 - DNA, 19 bp, Homo sapiens
tgtcaccggatcctgggtg

SEQ ID NO: 2615129 - DNA, 22 bp, Homo sapiens
tgtcaccgtgagcagctttgga

SEQ ID NO: 2615130 - DNA, 21 bp, Homo sapiens
tgtcaccgtggaccttcctgc

SEQ ID NO: 2615131 - DNA, 22 bp, Homo sapiens
tgtcaccgtggaccttcctgcc

SEQ ID NO: 2615132 - DNA, 13 bp, Homo sapiens
tgtcacctgaaga

SEQ ID NO: 2615133 - DNA, 16 bp, Homo sapiens
tgtcacgattgtcatc

SEQ ID NO: 2615134 - DNA, 16 bp, Homo sapiens
tgtcactactcacagt

SEQ ID NO: 2615135 - DNA, 15 bp, Homo sapiens
tgtcactgcaggcac

SEQ ID NO: 2615136 - DNA, 15 bp, Homo sapiens
tgtcactgtggtcct

SEQ ID NO: 2615137 - DNA, 17 bp, Homo sapiens
tgtcactgtttctctgc

SEQ ID NO: 2615138 - DNA, 18 bp, Homo sapiens
tgtcactgtttctctgct

SEQ ID NO: 2615139 - DNA, 14 bp, Homo sapiens
tgtcactttgctct

SEQ ID NO: 2615140 - DNA, 21 bp, Homo sapiens
tgtcagaactagaatttgatt

SEQ ID NO: 2615141 - DNA, 20 bp, Homo sapiens
tgtcagacctatttgacata

SEQ ID NO: 2615142 - DNA, 15 bp, Homo sapiens
tgtcagatacaatgt

SEQ ID NO: 2615143 - DNA, 21 bp, Homo sapiens
tgtcagctactaatgatgttt

SEQ ID NO: 2615144 - DNA, 23 bp, Homo sapiens
tgtcagctactgcggaaaaggaa

SEQ ID NO: 2615145 - DNA, 20 bp, Homo sapiens
tgtcagctcccctcggagaa

SEQ ID NO: 2615146 - DNA, 21 bp, Homo sapiens
tgtcagctcccctcggagaag

SEQ ID NO: 2615147 - DNA, 23 bp, Homo sapiens
tgtcagctcccctcggagaagag

SEQ ID NO: 2615148 - DNA, 14 bp, Homo sapiens
tgtcaggagagcag

SEQ ID NO: 2615149 - DNA, 16 bp, Homo sapiens
tgtcaggagagcagcg

SEQ ID NO: 2615150 - DNA, 16 bp, Homo sapiens
tgtcaggctgctggcg

SEQ ID NO: 2615151 - DNA, 17 bp, Homo sapiens
tgtcaggctgctggcgc

SEQ ID NO: 2615152 - DNA, 19 bp, Homo sapiens
tgtcaggctgctggcgcct

SEQ ID NO: 2615153 - DNA, 23 bp, Homo sapiens
tgtcaggctgctggcgcctctgc

SEQ ID NO: 2615154 - DNA, 24 bp, Homo sapiens
tgtcaggctgctggcgcctctgca

SEQ ID NO: 2615155 - DNA, 16 bp, Homo sapiens
tgtcaggtggggcagc

SEQ ID NO: 2615156 - DNA, 15 bp, Homo sapiens
tgtcatcagccacca

SEQ ID NO: 2615157 - DNA, 21 bp, Homo sapiens
tgtcatcagccaccatcctat

SEQ ID NO: 2615158 - DNA, 13 bp, Homo sapiens
tgtcatctcagct

SEQ ID NO: 2615159 - DNA, 15 bp, Homo sapiens
tgtcatctcagtgct

SEQ ID NO: 2615160 - DNA, 14 bp, Homo sapiens
tgtcatgcccccct

SEQ ID NO: 2615161 - DNA, 16 bp, Homo sapiens
tgtcatgcccccctca

SEQ ID NO: 2615162 - DNA, 17 bp, Homo sapiens
tgtcatgcccccctcaa

SEQ ID NO: 2615163 - DNA, 18 bp, Homo sapiens
tgtcattaaaataaataa

SEQ ID NO: 2615164 - DNA, 13 bp, Homo sapiens
tgtcattaaaggt

SEQ ID NO: 2615165 - DNA, 19 bp, Homo sapiens
tgtcattaccagacggttc

SEQ ID NO: 2615166 - DNA, 20 bp, Homo sapiens
tgtcatttgagcagggctca

SEQ ID NO: 2615167 - DNA, 23 bp, Homo sapiens
tgtcatttgctggagctctgccc

SEQ ID NO: 2615168 - DNA, 12 bp, Homo sapiens
tgtcatttgctt

SEQ ID NO: 2615169 - DNA, 15 bp, Homo sapiens
tgtcattttctccat

SEQ ID NO: 2615170 - DNA, 17 bp, Homo sapiens
tgtccaaactgcctaag

SEQ ID NO: 2615171 - DNA, 17 bp, Homo sapiens
tgtccaaagcagggtct

SEQ ID NO: 2615172 - DNA, 14 bp, Homo sapiens
tgtccaagaagccc

SEQ ID NO: 2615173 - DNA, 16 bp, Homo sapiens
tgtccaagaagcccag

SEQ ID NO: 2615174 - DNA, 18 bp, Homo sapiens
tgtccaagtgtgtgtgcg

SEQ ID NO: 2615175 - DNA, 21 bp, Homo sapiens
tgtccacccacctatgtgcca

SEQ ID NO: 2615176 - DNA, 17 bp, Homo sapiens
tgtccacgactgtctcc

SEQ ID NO: 2615177 - DNA, 19 bp, Homo sapiens
tgtccacgactgtctccat

SEQ ID NO: 2615178 - DNA, 13 bp, Homo sapiens
tgtccactgtgta

SEQ ID NO: 2615179 - DNA, 15 bp, Homo sapiens
tgtccagaagaatat

SEQ ID NO: 2615180 - DNA, 16 bp, Homo sapiens
tgtccagaagaatatt

SEQ ID NO: 2615181 - DNA, 20 bp, Homo sapiens
tgtccagaagaatattcagg

SEQ ID NO: 2615182 - DNA, 14 bp, Homo sapiens
tgtccagacagcct

SEQ ID NO: 2615183 - DNA, 15 bp, Homo sapiens
tgtccagacagcctg

SEQ ID NO: 2615184 - DNA, 23 bp, Homo sapiens
tgtccagagagagaagtgcccct

SEQ ID NO: 2615185 - DNA, 21 bp, Homo sapiens
tgtccagagagcaactctgag

SEQ ID NO: 2615186 - DNA, 14 bp, Homo sapiens
tgtccagcctgggc

SEQ ID NO: 2615187 - DNA, 19 bp, Homo sapiens
tgtccaggcactgctgccc

SEQ ID NO: 2615188 - DNA, 17 bp, Homo sapiens
tgtccagggccctgagc

SEQ ID NO: 2615189 - DNA, 23 bp, Homo sapiens
tgtcccacccccacccccagctc

SEQ ID NO: 2615190 - DNA, 13 bp, Homo sapiens
tgtcccacctctt

SEQ ID NO: 2615191 - DNA, 15 bp, Homo sapiens
tgtcccactatctgg

SEQ ID NO: 2615192 - DNA, 14 bp, Homo sapiens
tgtcccaggtcctc

SEQ ID NO: 2615193 - DNA, 19 bp, Homo sapiens
tgtcccatgacccacccct

SEQ ID NO: 2615194 - DNA, 19 bp, Homo sapiens
tgtcccatggacactccag

SEQ ID NO: 2615195 - DNA, 22 bp, Homo sapiens
tgtcccatggacactccagtgc

SEQ ID NO: 2615196 - DNA, 19 bp, Homo sapiens
tgtccccaaatccgaacct

SEQ ID NO: 2615197 - DNA, 21 bp, Homo sapiens
tgtccccaaatccgaacctcc

SEQ ID NO: 2615198 - DNA, 22 bp, Homo sapiens
tgtccccaaatccgaacctcct

SEQ ID NO: 2615199 - DNA, 12 bp, Homo sapiens
tgtccccacact

SEQ ID NO: 2615200 - DNA, 16 bp, Homo sapiens
tgtccccacactccta

SEQ ID NO: 2615201 - DNA, 13 bp, Homo sapiens
tgtcccccagctc

SEQ ID NO: 2615202 - DNA, 16 bp, Homo sapiens
tgtcccccagctctgg

SEQ ID NO: 2615203 - DNA, 17 bp, Homo sapiens
tgtcccccagctctggt

SEQ ID NO: 2615204 - DNA, 16 bp, Homo sapiens
tgtccccgacccttgc

SEQ ID NO: 2615205 - DNA, 18 bp, Homo sapiens
tgtcccctccactgtcac

SEQ ID NO: 2615206 - DNA, 21 bp, Homo sapiens
tgtcccggggtcctgtggcag

SEQ ID NO: 2615207 - DNA, 17 bp, Homo sapiens
tgtccctatgcatatca

SEQ ID NO: 2615208 - DNA, 21 bp, Homo sapiens
tgtccctcactgttgaatttt

SEQ ID NO: 2615209 - DNA, 14 bp, Homo sapiens
tgtccctccccctt

SEQ ID NO: 2615210 - DNA, 12 bp, Homo sapiens
tgtccctccggg

SEQ ID NO: 2615211 - DNA, 16 bp, Homo sapiens
tgtcccttaaacaaaa

SEQ ID NO: 2615212 - DNA, 22 bp, Homo sapiens
tgtccgctgggtggtaccctct

SEQ ID NO: 2615213 - DNA, 20 bp, Homo sapiens
tgtcctaaggacacactaat

SEQ ID NO: 2615214 - DNA, 16 bp, Homo sapiens
tgtcctacccaccctc

SEQ ID NO: 2615215 - DNA, 12 bp, Homo sapiens
tgtcctactctg

SEQ ID NO: 2615216 - DNA, 17 bp, Homo sapiens
tgtcctccagaagcctc

SEQ ID NO: 2615217 - DNA, 12 bp, Homo sapiens
tgtcctcctggt

SEQ ID NO: 2615218 - DNA, 15 bp, Homo sapiens
tgtcctcttgctcaa

SEQ ID NO: 2615219 - DNA, 12 bp, Homo sapiens
tgtcctgaccac

SEQ ID NO: 2615220 - DNA, 14 bp, Homo sapiens
tgtcctgaccaccc

SEQ ID NO: 2615221 - DNA, 22 bp, Homo sapiens
tgtcctgaccaccctcccctct

SEQ ID NO: 2615222 - DNA, 19 bp, Homo sapiens
tgtcctgatggtcagctcc

SEQ ID NO: 2615223 - DNA, 20 bp, Homo sapiens
tgtcctgggagtgagctggt

SEQ ID NO: 2615224 - DNA, 13 bp, Homo sapiens
tgtcctggtgtca

SEQ ID NO: 2615225 - DNA, 15 bp, Homo sapiens
tgtcctggttcccgt

SEQ ID NO: 2615226 - DNA, 24 bp, Homo sapiens
tgtcctgtagttgcgtggactctg

SEQ ID NO: 2615227 - DNA, 20 bp, Homo sapiens
tgtccttacccatctgcacc

SEQ ID NO: 2615228 - DNA, 11 bp, Homo sapiens
tgtccttagca

SEQ ID NO: 2615229 - DNA, 13 bp, Homo sapiens
tgtcctttccctt

SEQ ID NO: 2615230 - DNA, 14 bp, Homo sapiens
tgtcctttcccttc

SEQ ID NO: 2615231 - DNA, 16 bp, Homo sapiens
tgtcctttttgttatt

SEQ ID NO: 2615232 - DNA, 15 bp, Homo sapiens
tgtcgcccagtctgg

SEQ ID NO: 2615233 - DNA, 17 bp, Homo sapiens
tgtcgctctgctggcct

SEQ ID NO: 2615234 - DNA, 21 bp, Homo sapiens
tgtcggcctctaaccccaggc

SEQ ID NO: 2615235 - DNA, 23 bp, Homo sapiens
tgtcggcctctaaccccaggccc

SEQ ID NO: 2615236 - DNA, 23 bp, Homo sapiens
tgtcggttttttttaaataaaag

SEQ ID NO: 2615237 - DNA, 17 bp, Homo sapiens
tgtctaaaacaataaaa

SEQ ID NO: 2615238 - DNA, 19 bp, Homo sapiens
tgtctacagagaacctgga

SEQ ID NO: 2615239 - DNA, 17 bp, Homo sapiens
tgtctaggcaggacctg

SEQ ID NO: 2615240 - DNA, 19 bp, Homo sapiens
tgtctaggcaggacctgtg

SEQ ID NO: 2615241 - DNA, 23 bp, Homo sapiens
tgtctagttgtttgattcagaca

SEQ ID NO: 2615242 - DNA, 15 bp, Homo sapiens
tgtctatgggactca

SEQ ID NO: 2615243 - DNA, 14 bp, Homo sapiens
tgtctattcagctt

SEQ ID NO: 2615244 - DNA, 21 bp, Homo sapiens
tgtctcaaaaaaagaaaaaga

SEQ ID NO: 2615245 - DNA, 14 bp, Homo sapiens
tgtctcacactggc

SEQ ID NO: 2615246 - DNA, 17 bp, Homo sapiens
tgtctcaggtccctgca

SEQ ID NO: 2615247 - DNA, 21 bp, Homo sapiens
tgtctcagtccatgaagatgt

SEQ ID NO: 2615248 - DNA, 13 bp, Homo sapiens
tgtctcatcccca

SEQ ID NO: 2615249 - DNA, 16 bp, Homo sapiens
tgtctcatccccaggg

SEQ ID NO: 2615250 - DNA, 20 bp, Homo sapiens
tgtctcatgtgtgctcttct

SEQ ID NO: 2615251 - DNA, 22 bp, Homo sapiens
tgtctccagacccccacccctt

SEQ ID NO: 2615252 - DNA, 15 bp, Homo sapiens
tgtctccatggccct

SEQ ID NO: 2615253 - DNA, 16 bp, Homo sapiens
tgtctctagccacttt

SEQ ID NO: 2615254 - DNA, 13 bp, Homo sapiens
tgtctctggcctg

SEQ ID NO: 2615255 - DNA, 20 bp, Homo sapiens
tgtctcttggtcctgctgca

SEQ ID NO: 2615256 - DNA, 18 bp, Homo sapiens
tgtctcttttctctttct

SEQ ID NO: 2615257 - DNA, 22 bp, Homo sapiens
tgtctgaaaaattcctttgtgt

SEQ ID NO: 2615258 - DNA, 18 bp, Homo sapiens
tgtctgagagtttagttg

SEQ ID NO: 2615259 - DNA, 20 bp, Homo sapiens
tgtctgagccctcaaagtga

SEQ ID NO: 2615260 - DNA, 20 bp, Homo sapiens
tgtctgatctgtgctttcca

SEQ ID NO: 2615261 - DNA, 14 bp, Homo sapiens
tgtctgcacccagg

SEQ ID NO: 2615262 - DNA, 15 bp, Homo sapiens
tgtctgcacccaggg

SEQ ID NO: 2615263 - DNA, 16 bp, Homo sapiens
tgtctgccagccagca

SEQ ID NO: 2615264 - DNA, 13 bp, Homo sapiens
tgtttattaacaa

SEQ ID NO: 2615265 - DNA, 13 bp, Homo sapiens
tgtttattccttg

SEQ ID NO: 2615266 - DNA, 22 bp, Homo sapiens
tgtttatttataagcagattta

SEQ ID NO: 2615267 - DNA, 15 bp, Homo sapiens
tgtttatttatcagt

SEQ ID NO: 2615268 - DNA, 14 bp, Homo sapiens
tgtttatttttcat

SEQ ID NO: 2615269 - DNA, 18 bp, Homo sapiens
tgtttatttttcatattg

SEQ ID NO: 2615270 - DNA, 17 bp, Homo sapiens
tgtttcaaacacaaatg

SEQ ID NO: 2615271 - DNA, 17 bp, Homo sapiens
tgtttcaagtggggctc

SEQ ID NO: 2615272 - DNA, 18 bp, Homo sapiens
tgtttccaacctggagta

SEQ ID NO: 2615273 - DNA, 15 bp, Homo sapiens
tgtttccaatgttta

SEQ ID NO: 2615274 - DNA, 21 bp, Homo sapiens
tgtttccaatgtttagcaaat

SEQ ID NO: 2615275 - DNA, 23 bp, Homo sapiens
tgtttccaatgtttagcaaatac

SEQ ID NO: 2615276 - DNA, 11 bp, Homo sapiens
tgtttcctgag

SEQ ID NO: 2615277 - DNA, 20 bp, Homo sapiens
tgtttcctggcactgcttcc

SEQ ID NO: 2615278 - DNA, 15 bp, Homo sapiens
tgtttccttcagtgc

SEQ ID NO: 2615279 - DNA, 15 bp, Homo sapiens
tgtttcgtgaagtat

SEQ ID NO: 2615280 - DNA, 21 bp, Homo sapiens
tgtttctaataaagaaagcag

SEQ ID NO: 2615281 - DNA, 21 bp, Homo sapiens
tgtttctagcactggcctgca

SEQ ID NO: 2615282 - DNA, 15 bp, Homo sapiens
tgtttctccccctgg

SEQ ID NO: 2615283 - DNA, 17 bp, Homo sapiens
tgtttctccccctgggc

SEQ ID NO: 2615284 - DNA, 17 bp, Homo sapiens
tgtttctccttctgaaa

SEQ ID NO: 2615285 - DNA, 22 bp, Homo sapiens
tgtttctgcagtagtctctgtg

SEQ ID NO: 2615286 - DNA, 13 bp, Homo sapiens
tgtttctgttatt

SEQ ID NO: 2615287 - DNA, 18 bp, Homo sapiens
tgtttcttccaaagcaca

SEQ ID NO: 2615288 - DNA, 15 bp, Homo sapiens
tgtttcttttcacat

SEQ ID NO: 2615289 - DNA, 14 bp, Homo sapiens
tgtttgagaaatta

SEQ ID NO: 2615290 - DNA, 13 bp, Homo sapiens
tgtttgatgcatt

SEQ ID NO: 2615291 - DNA, 22 bp, Homo sapiens
tgtttgcacgttatggtgtttc

SEQ ID NO: 2615292 - DNA, 15 bp, Homo sapiens
tgtttgccatacttt

SEQ ID NO: 2615293 - DNA, 18 bp, Homo sapiens
tgtttgcttattgttcca

SEQ ID NO: 2615294 - DNA, 21 bp, Homo sapiens
tgtttgcttattgttccaaga

SEQ ID NO: 2615295 - DNA, 18 bp, Homo sapiens
tgtttggaatattgtcca

SEQ ID NO: 2615296 - DNA, 16 bp, Homo sapiens
tgtttggttctggggc

SEQ ID NO: 2615297 - DNA, 16 bp, Homo sapiens
tgtttgtcttctcccc

SEQ ID NO: 2615298 - DNA, 17 bp, Homo sapiens
tgttttaagaggcaggg

SEQ ID NO: 2615299 - DNA, 22 bp, Homo sapiens
tgttttaaggatgcttgtacat

SEQ ID NO: 2615300 - DNA, 23 bp, Homo sapiens
tgttttaaggatgcttgtacata

SEQ ID NO: 2615301 - DNA, 22 bp, Homo sapiens
tgttttagacaaatactcatgt

SEQ ID NO: 2615302 - DNA, 23 bp, Homo sapiens
tgttttaggttaaaaaaaggcat

SEQ ID NO: 2615303 - DNA, 15 bp, Homo sapiens
tgttttccagctcct

SEQ ID NO: 2615304 - DNA, 15 bp, Homo sapiens
tgttttctcttgaga

SEQ ID NO: 2615305 - DNA, 22 bp, Homo sapiens
tgttttgaatggtgttgtatgc

SEQ ID NO: 2615306 - DNA, 20 bp, Homo sapiens
tgttttgataaagtagtaaa

SEQ ID NO: 2615307 - DNA, 13 bp, Homo sapiens
tgttttgcacttt

SEQ ID NO: 2615308 - DNA, 14 bp, Homo sapiens
tgttttgcactttt

SEQ ID NO: 2615309 - DNA, 20 bp, Homo sapiens
tgtttttaaaaatcataaac

SEQ ID NO: 2615310 - DNA, 13 bp, Homo sapiens
tgtttttcacatt

SEQ ID NO: 2615311 - DNA, 20 bp, Homo sapiens
tgtttttgaaggcagaaagc

SEQ ID NO: 2615312 - DNA, 13 bp, Homo sapiens
tgtttttgtctta

SEQ ID NO: 2615313 - DNA, 21 bp, Homo sapiens
tgttttttagatcaaatactt

SEQ ID NO: 2615314 - DNA, 19 bp, Homo sapiens
tgttttttgaaaacatggt

SEQ ID NO: 2615315 - DNA, 16 bp, Homo sapiens
ttaaaaaaaaaggcat

SEQ ID NO: 2615316 - DNA, 13 bp, Homo sapiens
ttaaaaaaaatcc

SEQ ID NO: 2615317 - DNA, 11 bp, Homo sapiens
ttaaaaaacaa

SEQ ID NO: 2615318 - DNA, 13 bp, Homo sapiens
ttaaaaaacttgt

SEQ ID NO: 2615319 - DNA, 16 bp, Homo sapiens
ttaaaaaatggaacat

SEQ ID NO: 2615320 - DNA, 12 bp, Homo sapiens
ttaaaaaatgtc

SEQ ID NO: 2615321 - DNA, 17 bp, Homo sapiens
ttaaaaagaaacaagat

SEQ ID NO: 2615322 - DNA, 12 bp, Homo sapiens
ttaaaaatgcaa

SEQ ID NO: 2615323 - DNA, 20 bp, Homo sapiens
ttaaaaatggtttaaatggt

SEQ ID NO: 2615324 - DNA, 16 bp, Homo sapiens
ttaaaaatgtaaatat

SEQ ID NO: 2615325 - DNA, 17 bp, Homo sapiens
ttaaaaatgtaaatatt

SEQ ID NO: 2615326 - DNA, 17 bp, Homo sapiens
ttaaaacaacactcaca

SEQ ID NO: 2615327 - DNA, 21 bp, Homo sapiens
ttaaaacagacactggcatgg

SEQ ID NO: 2615328 - DNA, 13 bp, Homo sapiens
ttaaaacatgtaa

SEQ ID NO: 2615329 - DNA, 14 bp, Homo sapiens
ttaaaactgaagtc

SEQ ID NO: 2615330 - DNA, 18 bp, Homo sapiens
ttaaaactgaagtctgaa

SEQ ID NO: 2615331 - DNA, 19 bp, Homo sapiens
ttaaaactgaagtctgaaa

SEQ ID NO: 2615332 - DNA, 21 bp, Homo sapiens
ttaaaactgaagtctgaaatt

SEQ ID NO: 2615333 - DNA, 22 bp, Homo sapiens
ttaaaagaatattttaacttcc

SEQ ID NO: 2615334 - DNA, 13 bp, Homo sapiens
ttaaaagaatggg

SEQ ID NO: 2615335 - DNA, 20 bp, Homo sapiens
ttaaaagaatgggcagttac

SEQ ID NO: 2615336 - DNA, 14 bp, Homo sapiens
ttaaaagacactgt

SEQ ID NO: 2615337 - DNA, 14 bp, Homo sapiens
ttaaaagatacagt

SEQ ID NO: 2615338 - DNA, 18 bp, Homo sapiens
ttaaaagatgaaaatatt

SEQ ID NO: 2615339 - DNA, 20 bp, Homo sapiens
ttaaaaggatttttatcttt

SEQ ID NO: 2615340 - DNA, 17 bp, Homo sapiens
ttaaaagttgaattttt

SEQ ID NO: 2615341 - DNA, 17 bp, Homo sapiens
ttaaaagtttcaatgtg

SEQ ID NO: 2615342 - DNA, 22 bp, Homo sapiens
ttaaaagtttcaatgtgattct

SEQ ID NO: 2615343 - DNA, 20 bp, Homo sapiens
ttaaaataagcactgtgcta

SEQ ID NO: 2615344 - DNA, 19 bp, Homo sapiens
ttaaaatattcctgcattt

SEQ ID NO: 2615345 - DNA, 22 bp, Homo sapiens
ttaaaatcatttctgcatcagc

SEQ ID NO: 2615346 - DNA, 18 bp, Homo sapiens
ttaaaattgtgatgtgtc

SEQ ID NO: 2615347 - DNA, 12 bp, Homo sapiens
ttaaaatttatt

SEQ ID NO: 2615348 - DNA, 15 bp, Homo sapiens
ttaaacaggcccagc

SEQ ID NO: 2615349 - DNA, 16 bp, Homo sapiens
ttaaacaggcccagca

SEQ ID NO: 2615350 - DNA, 13 bp, Homo sapiens
ttaaacccatttt

SEQ ID NO: 2615351 - DNA, 18 bp, Homo sapiens
ttaaacctctcttctacc

SEQ ID NO: 2615352 - DNA, 13 bp, Homo sapiens
ttaaacggattat

SEQ ID NO: 2615353 - DNA, 23 bp, Homo sapiens
ttaaacggattattttttcagac

SEQ ID NO: 2615354 - DNA, 20 bp, Homo sapiens
ttaaactaaggccctcttga

SEQ ID NO: 2615355 - DNA, 14 bp, Homo sapiens
ttaaactcagggac

SEQ ID NO: 2615356 - DNA, 16 bp, Homo sapiens
ttaaacttaatctaaa

SEQ ID NO: 2615357 - DNA, 18 bp, Homo sapiens
ttaaacttaatctaaatg

SEQ ID NO: 2615358 - DNA, 17 bp, Homo sapiens
ttaaacttctctgaagg

SEQ ID NO: 2615359 - DNA, 14 bp, Homo sapiens
ttaaagcaaaggag

SEQ ID NO: 2615360 - DNA, 22 bp, Homo sapiens
ttaaagcagagggactttgtat

SEQ ID NO: 2615361 - DNA, 18 bp, Homo sapiens
ttaaagcagtgcttctca

SEQ ID NO: 2615362 - DNA, 15 bp, Homo sapiens
ttaaagcatttactt

SEQ ID NO: 2615363 - DNA, 17 bp, Homo sapiens
ttaaagcatttactttg

SEQ ID NO: 2615364 - DNA, 15 bp, Homo sapiens
ttaaagctgcctgta

SEQ ID NO: 2615365 - DNA, 20 bp, Homo sapiens
ttaaaggaaggttctggtgt

SEQ ID NO: 2615366 - DNA, 17 bp, Homo sapiens
ttaaaggatgttggtgt

SEQ ID NO: 2615367 - DNA, 16 bp, Homo sapiens
ttaaagtatatattta

SEQ ID NO: 2615368 - DNA, 19 bp, Homo sapiens
ttaaagtcgagcttttcta

SEQ ID NO: 2615369 - DNA, 11 bp, Homo sapiens
ttaaataaaag

SEQ ID NO: 2615370 - DNA, 14 bp, Homo sapiens
ttaaataaaagtga

SEQ ID NO: 2615371 - DNA, 17 bp, Homo sapiens
ttaaataaagtatcatg

SEQ ID NO: 2615372 - DNA, 19 bp, Homo sapiens
ttaaataaagtatcatgca

SEQ ID NO: 2615373 - DNA, 15 bp, Homo sapiens
ttaaataaatcataa

SEQ ID NO: 2615374 - DNA, 13 bp, Homo sapiens
ttaaataatgtga

SEQ ID NO: 2615375 - DNA, 16 bp, Homo sapiens
ttaaataatgtgaaac

SEQ ID NO: 2615376 - DNA, 13 bp, Homo sapiens
ttaaatacagtct

SEQ ID NO: 2615377 - DNA, 12 bp, Homo sapiens
ttaaatataatt

SEQ ID NO: 2615378 - DNA, 14 bp, Homo sapiens
ttaaatctgtgatg

SEQ ID NO: 2615379 - DNA, 16 bp, Homo sapiens
ttaaatctgtgatgat

SEQ ID NO: 2615380 - DNA, 15 bp, Homo sapiens
ttaaatgaaagcatg

SEQ ID NO: 2615381 - DNA, 14 bp, Homo sapiens
ttaaatgaaattgt

SEQ ID NO: 2615382 - DNA, 18 bp, Homo sapiens
ttaaatgcacctggaata

SEQ ID NO: 2615383 - DNA, 13 bp, Homo sapiens
ttaaatgcccagc

SEQ ID NO: 2615384 - DNA, 14 bp, Homo sapiens
ttaaatgcccagcc

SEQ ID NO: 2615385 - DNA, 15 bp, Homo sapiens
ttaaatgcccagccc

SEQ ID NO: 2615386 - DNA, 16 bp, Homo sapiens
ttaaatgcccagcccc

SEQ ID NO: 2615387 - DNA, 20 bp, Homo sapiens
ttaaatggaaaaaatgatgt

SEQ ID NO: 2615388 - DNA, 23 bp, Homo sapiens
ttaaatgggctactttgtccttt

SEQ ID NO: 2615389 - DNA, 16 bp, Homo sapiens
ttaaatgtaaataatc

SEQ ID NO: 2615390 - DNA, 13 bp, Homo sapiens
ttaaatttgtaag

SEQ ID NO: 2615391 - DNA, 14 bp, Homo sapiens
ttaaatttgtaagt

SEQ ID NO: 2615392 - DNA, 21 bp, Homo sapiens
ttaaatttgtaagtttcaggt

SEQ ID NO: 2615393 - DNA, 15 bp, Homo sapiens
ttaaattttaattta

SEQ ID NO: 2615394 - DNA, 16 bp, Homo sapiens
ttaaattttaatttat

SEQ ID NO: 2615395 - DNA, 20 bp, Homo sapiens
ttaaattttaccctttagac

SEQ ID NO: 2615396 - DNA, 23 bp, Homo sapiens
ttaaattttaccctttagactgt

SEQ ID NO: 2615397 - DNA, 23 bp, Homo sapiens
ttaacaaacatcactctgctgct

SEQ ID NO: 2615398 - DNA, 18 bp, Homo sapiens
ttaacaataactactgtg

SEQ ID NO: 2615399 - DNA, 20 bp, Homo sapiens
ttaacaataactactgtgtt

SEQ ID NO: 2615400 - DNA, 23 bp, Homo sapiens
ttaacaataactactgtgttcct

SEQ ID NO: 2615401 - DNA, 17 bp, Homo sapiens
ttaacaatgatatatgg

SEQ ID NO: 2615402 - DNA, 16 bp, Homo sapiens
ttaacacaagtcctgt

SEQ ID NO: 2615403 - DNA, 12 bp, Homo sapiens
ttaacacatttt

SEQ ID NO: 2615404 - DNA, 19 bp, Homo sapiens
ttaacactgcttgtgtttt

SEQ ID NO: 2615405 - DNA, 12 bp, Homo sapiens
ttaacagaaatg

SEQ ID NO: 2615406 - DNA, 13 bp, Homo sapiens
ttaacagaaatgt

SEQ ID NO: 2615407 - DNA, 14 bp, Homo sapiens
ttaacagaaatgta

SEQ ID NO: 2615408 - DNA, 20 bp, Homo sapiens
ttaacagaaatgtacagcaa

SEQ ID NO: 2615409 - DNA, 16 bp, Homo sapiens
ttaacagtcatttaaa

SEQ ID NO: 2615410 - DNA, 16 bp, Homo sapiens
ttatttttttctgatt

SEQ ID NO: 2615411 - DNA, 18 bp, Homo sapiens
ttcaaaaaaacactagtt

SEQ ID NO: 2615412 - DNA, 18 bp, Homo sapiens
ttcaaaaaaataaaataa

SEQ ID NO: 2615413 - DNA, 17 bp, Homo sapiens
ttcaaaaccttttgaaa

SEQ ID NO: 2615414 - DNA, 21 bp, Homo sapiens
ttcaaaagaatcagaaacagg

SEQ ID NO: 2615415 - DNA, 20 bp, Homo sapiens
ttcaaaagtattttcctgta

SEQ ID NO: 2615416 - DNA, 14 bp, Homo sapiens
ttcaaaataaaaac

SEQ ID NO: 2615417 - DNA, 17 bp, Homo sapiens
ttcaaaataaaaatgag

SEQ ID NO: 2615418 - DNA, 16 bp, Homo sapiens
ttcaaaatatgttctt

SEQ ID NO: 2615419 - DNA, 13 bp, Homo sapiens
ttcaaagatattt

SEQ ID NO: 2615420 - DNA, 23 bp, Homo sapiens
ttcaaagcaccaaaataagaaaa

SEQ ID NO: 2615421 - DNA, 13 bp, Homo sapiens
ttcaaagccagcg

SEQ ID NO: 2615422 - DNA, 23 bp, Homo sapiens
ttcaaagccagcgtcctcctctg

SEQ ID NO: 2615423 - DNA, 16 bp, Homo sapiens
ttcaaagcttgaagat

SEQ ID NO: 2615424 - DNA, 18 bp, Homo sapiens
ttcaaattgagagaatgg

SEQ ID NO: 2615425 - DNA, 14 bp, Homo sapiens
ttcaactgaaaaga

SEQ ID NO: 2615426 - DNA, 19 bp, Homo sapiens
ttcaagaaaagtaagccct

SEQ ID NO: 2615427 - DNA, 20 bp, Homo sapiens
ttcaagaaactgaggaattt

SEQ ID NO: 2615428 - DNA, 22 bp, Homo sapiens
ttcaagaaagcttcaaactgca

SEQ ID NO: 2615429 - DNA, 21 bp, Homo sapiens
ttcaagcgattcttctgcttc

SEQ ID NO: 2615430 - DNA, 18 bp, Homo sapiens
ttcaagtggggctcgcca

SEQ ID NO: 2615431 - DNA, 17 bp, Homo sapiens
ttcaagttagctcagga

SEQ ID NO: 2615432 - DNA, 13 bp, Homo sapiens
ttcaataaagtat

SEQ ID NO: 2615433 - DNA, 16 bp, Homo sapiens
ttcaatctgtaaactg

SEQ ID NO: 2615434 - DNA, 20 bp, Homo sapiens
ttcaatctgtaaactgtgta

SEQ ID NO: 2615435 - DNA, 16 bp, Homo sapiens
ttcaatgatagtaaga

SEQ ID NO: 2615436 - DNA, 15 bp, Homo sapiens
ttcaatgatctaggt

SEQ ID NO: 2615437 - DNA, 19 bp, Homo sapiens
ttcaatgatctaggtttaa

SEQ ID NO: 2615438 - DNA, 22 bp, Homo sapiens
ttcaatgatctaggtttaactc

SEQ ID NO: 2615439 - DNA, 16 bp, Homo sapiens
ttcaatggctgctgaa

SEQ ID NO: 2615440 - DNA, 23 bp, Homo sapiens
ttcaatggtttgcaaggaagcca

SEQ ID NO: 2615441 - DNA, 21 bp, Homo sapiens
ttcaatgtgattctaatgtct

SEQ ID NO: 2615442 - DNA, 11 bp, Homo sapiens
ttcaattaaac

SEQ ID NO: 2615443 - DNA, 18 bp, Homo sapiens
ttcaattaaacggattat

SEQ ID NO: 2615444 - DNA, 13 bp, Homo sapiens
ttcaattcagtgc

SEQ ID NO: 2615445 - DNA, 13 bp, Homo sapiens
ttcaattcctggg

SEQ ID NO: 2615446 - DNA, 19 bp, Homo sapiens
ttcaatttccaagagctga

SEQ ID NO: 2615447 - DNA, 11 bp, Homo sapiens
ttcacaaataa

SEQ ID NO: 2615448 - DNA, 22 bp, Homo sapiens
ttcacaagacccaaaaggcaga

SEQ ID NO: 2615449 - DNA, 19 bp, Homo sapiens
ttcacacctgactctgaaa

SEQ ID NO: 2615450 - DNA, 21 bp, Homo sapiens
ttcacacctgactctgaaatc

SEQ ID NO: 2615451 - DNA, 14 bp, Homo sapiens
ttcacactctcaca

SEQ ID NO: 2615452 - DNA, 12 bp, Homo sapiens
ttcacacttcca

SEQ ID NO: 2615453 - DNA, 21 bp, Homo sapiens
ttcacagagtgtgctggagga

SEQ ID NO: 2615454 - DNA, 20 bp, Homo sapiens
ttcacagatgggtgcttgga

SEQ ID NO: 2615455 - DNA, 13 bp, Homo sapiens
ttcacagctcctc

SEQ ID NO: 2615456 - DNA, 10 bp, Homo sapiens
ttcacaggcg

SEQ ID NO: 2615457 - DNA, 18 bp, Homo sapiens
ttcacatagctgtctaga

SEQ ID NO: 2615458 - DNA, 21 bp, Homo sapiens
ttcacatcctgtgtttctagg

SEQ ID NO: 2615459 - DNA, 19 bp, Homo sapiens
ttcacatgagctatttcca

SEQ ID NO: 2615460 - DNA, 12 bp, Homo sapiens
ttcacattctta

SEQ ID NO: 2615461 - DNA, 12 bp, Homo sapiens
ttcaccagagca

SEQ ID NO: 2615462 - DNA, 18 bp, Homo sapiens
ttcaccagatttgctaat

SEQ ID NO: 2615463 - DNA, 21 bp, Homo sapiens
ttcaccccagtggccactcag

SEQ ID NO: 2615464 - DNA, 19 bp, Homo sapiens
ttcaccccctttcctggac

SEQ ID NO: 2615465 - DNA, 22 bp, Homo sapiens
ttcaccctgtccaaactgccta

SEQ ID NO: 2615466 - DNA, 18 bp, Homo sapiens
ttcacctgtaaacctgag

SEQ ID NO: 2615467 - DNA, 21 bp, Homo sapiens
ttcacctgtttttaagctgtt

SEQ ID NO: 2615468 - DNA, 22 bp, Homo sapiens
ttcaccttgggatgatgcctca

SEQ ID NO: 2615469 - DNA, 17 bp, Homo sapiens
ttcacgaagtgttgcat

SEQ ID NO: 2615470 - DNA, 15 bp, Homo sapiens
ttcacgagagcccgg

SEQ ID NO: 2615471 - DNA, 18 bp, Homo sapiens
ttcacggaagagccttgc

SEQ ID NO: 2615472 - DNA, 13 bp, Homo sapiens
ttcactaaagcag

SEQ ID NO: 2615473 - DNA, 20 bp, Homo sapiens
ttcactatttttatttatat

SEQ ID NO: 2615474 - DNA, 21 bp, Homo sapiens
ttcactccggtgtgcctgcag

SEQ ID NO: 2615475 - DNA, 12 bp, Homo sapiens
ttcactctctga

SEQ ID NO: 2615476 - DNA, 22 bp, Homo sapiens
ttcactgaagaaaccttcagat

SEQ ID NO: 2615477 - DNA, 16 bp, Homo sapiens
ttcactggagttacat

SEQ ID NO: 2615478 - DNA, 20 bp, Homo sapiens
ttcactgtaagactcattcc

SEQ ID NO: 2615479 - DNA, 15 bp, Homo sapiens
ttcactgtataaata

SEQ ID NO: 2615480 - DNA, 16 bp, Homo sapiens
ttcactgtataaatag

SEQ ID NO: 2615481 - DNA, 22 bp, Homo sapiens
ttcactgtcctccaagccagcg

SEQ ID NO: 2615482 - DNA, 16 bp, Homo sapiens
ttcacttcatcttctc

SEQ ID NO: 2615483 - DNA, 20 bp, Homo sapiens
ttcacttttgacaaaggcaa

SEQ ID NO: 2615484 - DNA, 13 bp, Homo sapiens
ttcagaaagcatt

SEQ ID NO: 2615485 - DNA, 19 bp, Homo sapiens
ttcagaaagcattacattt

SEQ ID NO: 2615486 - DNA, 15 bp, Homo sapiens
ttcagaaatgctgcc

SEQ ID NO: 2615487 - DNA, 16 bp, Homo sapiens
ttcagaaatgctgcct

SEQ ID NO: 2615488 - DNA, 17 bp, Homo sapiens
ttcagaaatgctgcctg

SEQ ID NO: 2615489 - DNA, 21 bp, Homo sapiens
ttcagaaatgctgcctgcctg

SEQ ID NO: 2615490 - DNA, 13 bp, Homo sapiens
ttcagaaatgtgt

SEQ ID NO: 2615491 - DNA, 20 bp, Homo sapiens
ttcagaaattggaacagaat

SEQ ID NO: 2615492 - DNA, 21 bp, Homo sapiens
ttcagaaattggaacagaatg

SEQ ID NO: 2615493 - DNA, 20 bp, Homo sapiens
ttcagacaagcaacaggttt

SEQ ID NO: 2615494 - DNA, 21 bp, Homo sapiens
ttcagacaagcaacaggtttt

SEQ ID NO: 2615495 - DNA, 14 bp, Homo sapiens
ttcagacagctgcc

SEQ ID NO: 2615496 - DNA, 21 bp, Homo sapiens
ttcagacagctgcctgggatc

SEQ ID NO: 2615497 - DNA, 14 bp, Homo sapiens
ttcagagagctggt

SEQ ID NO: 2615498 - DNA, 23 bp, Homo sapiens
ttcagagctgacacaggatgaag

SEQ ID NO: 2615499 - DNA, 23 bp, Homo sapiens
ttcagataactgttatttataat

SEQ ID NO: 2615500 - DNA, 12 bp, Homo sapiens
ttcagatacatg

SEQ ID NO: 2615501 - DNA, 22 bp, Homo sapiens
ttcagatataaaagactgacca

SEQ ID NO: 2615502 - DNA, 17 bp, Homo sapiens
ttcagatctctaacttc

SEQ ID NO: 2615503 - DNA, 19 bp, Homo sapiens
ttcagatgtcttctgcctg

SEQ ID NO: 2615504 - DNA, 21 bp, Homo sapiens
ttcagattcccagagcaaaat

SEQ ID NO: 2615505 - DNA, 16 bp, Homo sapiens
ttcagcaccaccctag

SEQ ID NO: 2615506 - DNA, 16 bp, Homo sapiens
ttcagcatatttatag

SEQ ID NO: 2615507 - DNA, 13 bp, Homo sapiens
ttcagccaggagc

SEQ ID NO: 2615508 - DNA, 20 bp, Homo sapiens
ttcagcccatatttcatcgt

SEQ ID NO: 2615509 - DNA, 23 bp, Homo sapiens
ttcagccctaaatctagactcaa

SEQ ID NO: 2615510 - DNA, 20 bp, Homo sapiens
ttcagcctagccgacctcag

SEQ ID NO: 2615511 - DNA, 22 bp, Homo sapiens
ttcagcctagccgacctcagcc

SEQ ID NO: 2615512 - DNA, 23 bp, Homo sapiens
ttcagcctagccgacctcagcct

SEQ ID NO: 2615513 - DNA, 12 bp, Homo sapiens
ttcagcctctgg

SEQ ID NO: 2615514 - DNA, 24 bp, Homo sapiens
ttcagcgatgtatgcagctatctg

SEQ ID NO: 2615515 - DNA, 12 bp, Homo sapiens
ttcagctccagc

SEQ ID NO: 2615516 - DNA, 15 bp, Homo sapiens
ttcagctccagctca

SEQ ID NO: 2615517 - DNA, 22 bp, Homo sapiens
ttcagctccagctcaccagccc

SEQ ID NO: 2615518 - DNA, 24 bp, Homo sapiens
ttcagctctgcaagaattgaagca

SEQ ID NO: 2615519 - DNA, 17 bp, Homo sapiens
ttcagctgacttttctg

SEQ ID NO: 2615520 - DNA, 18 bp, Homo sapiens
ttcagctgcatacagttt

SEQ ID NO: 2615521 - DNA, 21 bp, Homo sapiens
ttcagctggttgaggtttcaa

SEQ ID NO: 2615522 - DNA, 22 bp, Homo sapiens
ttcagcttcgtttattttcaag

SEQ ID NO: 2615523 - DNA, 15 bp, Homo sapiens
ttcaggaagctcagg

SEQ ID NO: 2615524 - DNA, 17 bp, Homo sapiens
ttcaggaagctcagggc

SEQ ID NO: 2615525 - DNA, 21 bp, Homo sapiens
ttcaggacttaacggctccag

SEQ ID NO: 2615526 - DNA, 20 bp, Homo sapiens
ttcaggcgattctcctgcct

SEQ ID NO: 2615527 - DNA, 23 bp, Homo sapiens
ttcagggaaccgttattataatt

SEQ ID NO: 2615528 - DNA, 19 bp, Homo sapiens
ttcaggggactcagccctg

SEQ ID NO: 2615529 - DNA, 21 bp, Homo sapiens
ttcaggggggttgtgaggcct

SEQ ID NO: 2615530 - DNA, 16 bp, Homo sapiens
ttcagggttggcccct

SEQ ID NO: 2615531 - DNA, 19 bp, Homo sapiens
ttcagggttggcccctgcc

SEQ ID NO: 2615532 - DNA, 22 bp, Homo sapiens
ttcagggttggcccctgcccgg

SEQ ID NO: 2615533 - DNA, 17 bp, Homo sapiens
ttcaggtaacaggcaga

SEQ ID NO: 2615534 - DNA, 19 bp, Homo sapiens
ttcaggtagctgcccctgg

SEQ ID NO: 2615535 - DNA, 13 bp, Homo sapiens
ttcaggtgacatg

SEQ ID NO: 2615536 - DNA, 14 bp, Homo sapiens
ttcaggtgacatgt

SEQ ID NO: 2615537 - DNA, 16 bp, Homo sapiens
ttcaggtgacatgtga

SEQ ID NO: 2615538 - DNA, 17 bp, Homo sapiens
ttcaggtgacatgtgaa

SEQ ID NO: 2615539 - DNA, 18 bp, Homo sapiens
ttcaggtgacatgtgaaa

SEQ ID NO: 2615540 - DNA, 19 bp, Homo sapiens
ttcaggtgacatgtgaaac

SEQ ID NO: 2615541 - DNA, 22 bp, Homo sapiens
ttcaggtgacatgtgaaacctt

SEQ ID NO: 2615542 - DNA, 19 bp, Homo sapiens
ttcaggttatcgaaataac

SEQ ID NO: 2615543 - DNA, 15 bp, Homo sapiens
ttcagtaaaaaacaa

SEQ ID NO: 2615544 - DNA, 13 bp, Homo sapiens
ttcagtggcagct

SEQ ID NO: 2615545 - DNA, 14 bp, Homo sapiens
ttcagtggcagctg

SEQ ID NO: 2615546 - DNA, 16 bp, Homo sapiens
ttcagtgtaatttctt

SEQ ID NO: 2615547 - DNA, 12 bp, Homo sapiens
ttcagtgtacat

SEQ ID NO: 2615548 - DNA, 22 bp, Homo sapiens
ttcagtgttaaatgtgatgaat

SEQ ID NO: 2615549 - DNA, 16 bp, Homo sapiens
ttcagttacagaaagt

SEQ ID NO: 2615550 - DNA, 18 bp, Homo sapiens
ttcagttgatcactggca

SEQ ID NO: 2615551 - DNA, 19 bp, Homo sapiens
ttcagtttcaattcagtgc

SEQ ID NO: 2615552 - DNA, 15 bp, Homo sapiens
ttcataaatgaattt

SEQ ID NO: 2615553 - DNA, 18 bp, Homo sapiens
ttctaccctagccattcc

SEQ ID NO: 2615554 - DNA, 13 bp, Homo sapiens
ttctacctcccag

SEQ ID NO: 2615555 - DNA, 19 bp, Homo sapiens
ttctaccttgaggtctttt

SEQ ID NO: 2615556 - DNA, 13 bp, Homo sapiens
ttctacgccaggg

SEQ ID NO: 2615557 - DNA, 17 bp, Homo sapiens
ttctactcttaagtttc

SEQ ID NO: 2615558 - DNA, 23 bp, Homo sapiens
ttctagaaagcctgttcccctca

SEQ ID NO: 2615559 - DNA, 22 bp, Homo sapiens
ttctagaacatccctgccagct

SEQ ID NO: 2615560 - DNA, 15 bp, Homo sapiens
ttctagaatttatca

SEQ ID NO: 2615561 - DNA, 14 bp, Homo sapiens
ttctagagaagagg

SEQ ID NO: 2615562 - DNA, 12 bp, Homo sapiens
ttctagcactgg

SEQ ID NO: 2615563 - DNA, 21 bp, Homo sapiens
ttctagcccgaatacaaacac

SEQ ID NO: 2615564 - DNA, 22 bp, Homo sapiens
ttctagctagaaatatgatttt

SEQ ID NO: 2615565 - DNA, 20 bp, Homo sapiens
ttctagctgttgagctgttt

SEQ ID NO: 2615566 - DNA, 21 bp, Homo sapiens
ttctagctgttgagctgtttt

SEQ ID NO: 2615567 - DNA, 23 bp, Homo sapiens
ttctaggaagaattttaaaaatg

SEQ ID NO: 2615568 - DNA, 18 bp, Homo sapiens
ttctaggtggcaaggctg

SEQ ID NO: 2615569 - DNA, 21 bp, Homo sapiens
ttctagtctcctttgcactga

SEQ ID NO: 2615570 - DNA, 15 bp, Homo sapiens
ttctagtggtctttg

SEQ ID NO: 2615571 - DNA, 14 bp, Homo sapiens
ttctagtttgcatt

SEQ ID NO: 2615572 - DNA, 22 bp, Homo sapiens
ttctataagttttatgttaaat

SEQ ID NO: 2615573 - DNA, 23 bp, Homo sapiens
ttctatatgaatttaaatataat

SEQ ID NO: 2615574 - DNA, 18 bp, Homo sapiens
ttctatcatttttgtaca

SEQ ID NO: 2615575 - DNA, 20 bp, Homo sapiens
ttctatcatttttgtacagt

SEQ ID NO: 2615576 - DNA, 22 bp, Homo sapiens
ttctatgtgacaattttgtaca

SEQ ID NO: 2615577 - DNA, 17 bp, Homo sapiens
ttctattgttactctgg

SEQ ID NO: 2615578 - DNA, 19 bp, Homo sapiens
ttctattgttactctggtt

SEQ ID NO: 2615579 - DNA, 17 bp, Homo sapiens
ttctatttctcctccat

SEQ ID NO: 2615580 - DNA, 22 bp, Homo sapiens
ttctcaaacctgtttaaatatt

SEQ ID NO: 2615581 - DNA, 17 bp, Homo sapiens
ttctcaaagttttgaaa

SEQ ID NO: 2615582 - DNA, 22 bp, Homo sapiens
ttctcaaagttttgaaaagcta

SEQ ID NO: 2615583 - DNA, 12 bp, Homo sapiens
ttctcaaataaa

SEQ ID NO: 2615584 - DNA, 21 bp, Homo sapiens
ttctcaacaaagcacagtgtt

SEQ ID NO: 2615585 - DNA, 15 bp, Homo sapiens
ttctcaagccctgca

SEQ ID NO: 2615586 - DNA, 11 bp, Homo sapiens
ttctcaagtgc

SEQ ID NO: 2615587 - DNA, 15 bp, Homo sapiens
ttctcacacccaccg

SEQ ID NO: 2615588 - DNA, 18 bp, Homo sapiens
ttctcactgttccctctg

SEQ ID NO: 2615589 - DNA, 21 bp, Homo sapiens
ttctcagaaggcaaatgactt

SEQ ID NO: 2615590 - DNA, 13 bp, Homo sapiens
ttctcagaatctc

SEQ ID NO: 2615591 - DNA, 23 bp, Homo sapiens
ttctcagactttggaaaatgcat

SEQ ID NO: 2615592 - DNA, 13 bp, Homo sapiens
ttctcagatattt

SEQ ID NO: 2615593 - DNA, 18 bp, Homo sapiens
ttctcagctcccatttct

SEQ ID NO: 2615594 - DNA, 13 bp, Homo sapiens
ttctcagggctcc

SEQ ID NO: 2615595 - DNA, 18 bp, Homo sapiens
ttctcagggctcctgcct

SEQ ID NO: 2615596 - DNA, 17 bp, Homo sapiens
ttctcagggtctctgct

SEQ ID NO: 2615597 - DNA, 13 bp, Homo sapiens
ttctcatagcatt

SEQ ID NO: 2615598 - DNA, 14 bp, Homo sapiens
ttctcatagcatta

SEQ ID NO: 2615599 - DNA, 17 bp, Homo sapiens
ttctcatagcattaact

SEQ ID NO: 2615600 - DNA, 24 bp, Homo sapiens
ttctcataggaaaagtacatttaa

SEQ ID NO: 2615601 - DNA, 14 bp, Homo sapiens
ttctcatgatccaa

SEQ ID NO: 2615602 - DNA, 16 bp, Homo sapiens
ttctccaagcaggaca

SEQ ID NO: 2615603 - DNA, 13 bp, Homo sapiens
ttctccaccctgc

SEQ ID NO: 2615604 - DNA, 21 bp, Homo sapiens
ttctccacctcccacaaagga

SEQ ID NO: 2615605 - DNA, 12 bp, Homo sapiens
ttctccacctgc

SEQ ID NO: 2615606 - DNA, 18 bp, Homo sapiens
ttctccacctgccaggga

SEQ ID NO: 2615607 - DNA, 23 bp, Homo sapiens
ttctccatgagacacatctcctc

SEQ ID NO: 2615608 - DNA, 13 bp, Homo sapiens
ttctcccacactg

SEQ ID NO: 2615609 - DNA, 14 bp, Homo sapiens
ttctcccaggaagc

SEQ ID NO: 2615610 - DNA, 15 bp, Homo sapiens
ttctcccaggaagct

SEQ ID NO: 2615611 - DNA, 17 bp, Homo sapiens
ttctccccctgggctct

SEQ ID NO: 2615612 - DNA, 18 bp, Homo sapiens
ttctccccctgggctctg

SEQ ID NO: 2615613 - DNA, 20 bp, Homo sapiens
ttctccctcatttcaggagc

SEQ ID NO: 2615614 - DNA, 23 bp, Homo sapiens
ttctcctccatgggagaaaatag

SEQ ID NO: 2615615 - DNA, 21 bp, Homo sapiens
ttctccttgtgttactaagtt

SEQ ID NO: 2615616 - DNA, 20 bp, Homo sapiens
ttctctaaaatagccactta

SEQ ID NO: 2615617 - DNA, 18 bp, Homo sapiens
ttctctaagttccactga

SEQ ID NO: 2615618 - DNA, 20 bp, Homo sapiens
ttctctactttgaggaaacc

SEQ ID NO: 2615619 - DNA, 20 bp, Homo sapiens
ttctctagtttgattaaatt

SEQ ID NO: 2615620 - DNA, 14 bp, Homo sapiens
ttctctccagcccc

SEQ ID NO: 2615621 - DNA, 15 bp, Homo sapiens
ttctctgaagggagg

SEQ ID NO: 2615622 - DNA, 16 bp, Homo sapiens
ttctctgagctgtgca

SEQ ID NO: 2615623 - DNA, 20 bp, Homo sapiens
ttctctgaggacactaacca

SEQ ID NO: 2615624 - DNA, 16 bp, Homo sapiens
ttctctgccctccaag

SEQ ID NO: 2615625 - DNA, 17 bp, Homo sapiens
ttctctgccctccaaga

SEQ ID NO: 2615626 - DNA, 15 bp, Homo sapiens
ttctctggagccaag

SEQ ID NO: 2615627 - DNA, 12 bp, Homo sapiens
ttctctgtctca

SEQ ID NO: 2615628 - DNA, 16 bp, Homo sapiens
ttctcttactgcaaat

SEQ ID NO: 2615629 - DNA, 21 bp, Homo sapiens
ttctcttccactctccttgct

SEQ ID NO: 2615630 - DNA, 12 bp, Homo sapiens
ttctcttcctgt

SEQ ID NO: 2615631 - DNA, 20 bp, Homo sapiens
ttctcttccttttatcagta

SEQ ID NO: 2615632 - DNA, 13 bp, Homo sapiens
ttctctttctctc

SEQ ID NO: 2615633 - DNA, 16 bp, Homo sapiens
ttctctttctctcctt

SEQ ID NO: 2615634 - DNA, 19 bp, Homo sapiens
ttctgaatacaaagtgatg

SEQ ID NO: 2615635 - DNA, 11 bp, Homo sapiens
ttctgaatatg

SEQ ID NO: 2615636 - DNA, 16 bp, Homo sapiens
ttctgaatgctgctac

SEQ ID NO: 2615637 - DNA, 23 bp, Homo sapiens
ttctgacatcttagtatttgcat

SEQ ID NO: 2615638 - DNA, 15 bp, Homo sapiens
ttctgacattaacag

SEQ ID NO: 2615639 - DNA, 20 bp, Homo sapiens
ttctgacattaacagttttc

SEQ ID NO: 2615640 - DNA, 23 bp, Homo sapiens
ttctgacattaacagttttccat

SEQ ID NO: 2615641 - DNA, 20 bp, Homo sapiens
ttctgaccacagcatcattt

SEQ ID NO: 2615642 - DNA, 18 bp, Homo sapiens
ttctgacccatgctgccc

SEQ ID NO: 2615643 - DNA, 23 bp, Homo sapiens
ttctgacccatgctgccctgtga

SEQ ID NO: 2615644 - DNA, 21 bp, Homo sapiens
ttctgaccctgcttcaaatat

SEQ ID NO: 2615645 - DNA, 15 bp, Homo sapiens
ttctgactctgagct

SEQ ID NO: 2615646 - DNA, 13 bp, Homo sapiens
ttctgactgctga

SEQ ID NO: 2615647 - DNA, 21 bp, Homo sapiens
ttctgagcccgggctgcctgg

SEQ ID NO: 2615648 - DNA, 16 bp, Homo sapiens
ttctgagctatttcat

SEQ ID NO: 2615649 - DNA, 20 bp, Homo sapiens
ttctgagtttcattctcctg

SEQ ID NO: 2615650 - DNA, 23 bp, Homo sapiens
ttctgagtttcattctcctgcct

SEQ ID NO: 2615651 - DNA, 17 bp, Homo sapiens
ttctgattagaaatgac

SEQ ID NO: 2615652 - DNA, 12 bp, Homo sapiens
ttctgattccac

SEQ ID NO: 2615653 - DNA, 11 bp, Homo sapiens
ttctgattgta

SEQ ID NO: 2615654 - DNA, 22 bp, Homo sapiens
ttctgattgtaacgttgctgtg

SEQ ID NO: 2615655 - DNA, 23 bp, Homo sapiens
ttctgattgtaacgttgctgtgg

SEQ ID NO: 2615656 - DNA, 22 bp, Homo sapiens
ttctgcaagcacatctgcattt

SEQ ID NO: 2615657 - DNA, 12 bp, Homo sapiens
ttctgcaccctc

SEQ ID NO: 2615658 - DNA, 13 bp, Homo sapiens
ttctgcaccctcc

SEQ ID NO: 2615659 - DNA, 19 bp, Homo sapiens
ttctgcaccctccaccctg

SEQ ID NO: 2615660 - DNA, 16 bp, Homo sapiens
ttctgcatcagctgct

SEQ ID NO: 2615661 - DNA, 23 bp, Homo sapiens
ttctgcattttattctggatgga

SEQ ID NO: 2615662 - DNA, 15 bp, Homo sapiens
ttctgccagggagct

SEQ ID NO: 2615663 - DNA, 15 bp, Homo sapiens
ttctgccatattctg

SEQ ID NO: 2615664 - DNA, 17 bp, Homo sapiens
ttctgccggccctgggg

SEQ ID NO: 2615665 - DNA, 14 bp, Homo sapiens
ttctgcctctgagg

SEQ ID NO: 2615666 - DNA, 22 bp, Homo sapiens
ttctgcctttggggacttttct

SEQ ID NO: 2615667 - DNA, 17 bp, Homo sapiens
ttctgctccacccttgg

SEQ ID NO: 2615668 - DNA, 16 bp, Homo sapiens
ttctgctcctctccag

SEQ ID NO: 2615669 - DNA, 18 bp, Homo sapiens
ttctgctggaaacagact

SEQ ID NO: 2615670 - DNA, 21 bp, Homo sapiens
ttctgctggataaaatgaggt

SEQ ID NO: 2615671 - DNA, 13 bp, Homo sapiens
ttctgctggcctg

SEQ ID NO: 2615672 - DNA, 14 bp, Homo sapiens
ttctgcttaggaga

SEQ ID NO: 2615673 - DNA, 15 bp, Homo sapiens
ttctgcttcagcctc

SEQ ID NO: 2615674 - DNA, 16 bp, Homo sapiens
ttctgcttcagcctcc

SEQ ID NO: 2615675 - DNA, 15 bp, Homo sapiens
ttctgctttcatctt

SEQ ID NO: 2615676 - DNA, 15 bp, Homo sapiens
ttctggagtctccag

SEQ ID NO: 2615677 - DNA, 17 bp, Homo sapiens
ttctggagtctccagtg

SEQ ID NO: 2615678 - DNA, 20 bp, Homo sapiens
ttctggctgccccaacctgc

SEQ ID NO: 2615679 - DNA, 11 bp, Homo sapiens
ttctgggacac

SEQ ID NO: 2615680 - DNA, 16 bp, Homo sapiens
ttctgggaggaagcag

SEQ ID NO: 2615681 - DNA, 16 bp, Homo sapiens
ttctgggcttcatctg

SEQ ID NO: 2615682 - DNA, 21 bp, Homo sapiens
ttctggggcccctttttactc

SEQ ID NO: 2615683 - DNA, 14 bp, Homo sapiens
ttctgggtggcctc

SEQ ID NO: 2615684 - DNA, 18 bp, Homo sapiens
ttctgggtggcctcggga

SEQ ID NO: 2615685 - DNA, 15 bp, Homo sapiens
ttctggtactctcct

SEQ ID NO: 2615686 - DNA, 19 bp, Homo sapiens
ttctggtagatagaaataa

SEQ ID NO: 2615687 - DNA, 20 bp, Homo sapiens
ttctgtaaactcaaaactta

SEQ ID NO: 2615688 - DNA, 15 bp, Homo sapiens
ttctgtacatagcct

SEQ ID NO: 2615689 - DNA, 22 bp, Homo sapiens
ttctgtacatagcctatattta

SEQ ID NO: 2615690 - DNA, 22 bp, Homo sapiens
ttctgtacatgcattgagctct

SEQ ID NO: 2615691 - DNA, 13 bp, Homo sapiens
ttctgtagattct

SEQ ID NO: 2615692 - DNA, 18 bp, Homo sapiens
ttctgtattttgtttttg

SEQ ID NO: 2615693 - DNA, 14 bp, Homo sapiens
ttctgtcaagaaga

SEQ ID NO: 2615694 - DNA, 21 bp, Homo sapiens
ttctgtccgagctttgaaaat

SEQ ID NO: 2615695 - DNA, 21 bp, Homo sapiens
ttctgtcgccttagcatgttt

SEQ ID NO: 2615696 - DNA, 14 bp, Homo sapiens
ttctgtctctgcct

SEQ ID NO: 2615697 - DNA, 21 bp, Homo sapiens
ttgtaaaaaaaaatgcctttg

SEQ ID NO: 2615698 - DNA, 23 bp, Homo sapiens
ttgtaaaaaaaaatgcctttgag

SEQ ID NO: 2615699 - DNA, 19 bp, Homo sapiens
ttgtaaaaacagcattgct

SEQ ID NO: 2615700 - DNA, 20 bp, Homo sapiens
ttgtaaaacctgtcaatgat

SEQ ID NO: 2615701 - DNA, 21 bp, Homo sapiens
ttgtaaaacctgtcaatgata

SEQ ID NO: 2615702 - DNA, 23 bp, Homo sapiens
ttgtaaaacctgtcaatgataca

SEQ ID NO: 2615703 - DNA, 14 bp, Homo sapiens
ttgtaaacatgtgt

SEQ ID NO: 2615704 - DNA, 15 bp, Homo sapiens
ttgtaaacatgtgtt

SEQ ID NO: 2615705 - DNA, 22 bp, Homo sapiens
ttgtaaactcaaaatatttgta

SEQ ID NO: 2615706 - DNA, 23 bp, Homo sapiens
ttgtaaagtgtggtcccaacagg

SEQ ID NO: 2615707 - DNA, 19 bp, Homo sapiens
ttgtaaatatttatgtaaa

SEQ ID NO: 2615708 - DNA, 14 bp, Homo sapiens
ttgtaaatgtgctt

SEQ ID NO: 2615709 - DNA, 15 bp, Homo sapiens
ttgtaaattaacttt

SEQ ID NO: 2615710 - DNA, 19 bp, Homo sapiens
ttgtaaatttatgtgatgg

SEQ ID NO: 2615711 - DNA, 14 bp, Homo sapiens
ttgtaacctcagct

SEQ ID NO: 2615712 - DNA, 18 bp, Homo sapiens
ttgtaacctcagctctgg

SEQ ID NO: 2615713 - DNA, 15 bp, Homo sapiens
ttgtaacgttgctgt

SEQ ID NO: 2615714 - DNA, 16 bp, Homo sapiens
ttgtaacgttgctgtg

SEQ ID NO: 2615715 - DNA, 19 bp, Homo sapiens
ttgtaacgttgctgtggga

SEQ ID NO: 2615716 - DNA, 20 bp, Homo sapiens
ttgtaacgttgctgtgggaa

SEQ ID NO: 2615717 - DNA, 21 bp, Homo sapiens
ttgtaacgttgctgtgggaac

SEQ ID NO: 2615718 - DNA, 17 bp, Homo sapiens
ttgtaagagtgtagaag

SEQ ID NO: 2615719 - DNA, 13 bp, Homo sapiens
ttgtaagatgctg

SEQ ID NO: 2615720 - DNA, 18 bp, Homo sapiens
ttgtaagtttcaggtgac

SEQ ID NO: 2615721 - DNA, 19 bp, Homo sapiens
ttgtaagtttcaggtgaca

SEQ ID NO: 2615722 - DNA, 15 bp, Homo sapiens
ttgtaatcgttatgt

SEQ ID NO: 2615723 - DNA, 15 bp, Homo sapiens
ttgtaatgttactga

SEQ ID NO: 2615724 - DNA, 17 bp, Homo sapiens
ttgtaattctaaatgaa

SEQ ID NO: 2615725 - DNA, 19 bp, Homo sapiens
ttgtaattgcttacatttt

SEQ ID NO: 2615726 - DNA, 21 bp, Homo sapiens
ttgtaatttaaacaggcccag

SEQ ID NO: 2615727 - DNA, 22 bp, Homo sapiens
ttgtaatttaaacaggcccagc

SEQ ID NO: 2615728 - DNA, 14 bp, Homo sapiens
ttgtacaaataaag

SEQ ID NO: 2615729 - DNA, 18 bp, Homo sapiens
ttgtacagacgtatgctt

SEQ ID NO: 2615730 - DNA, 19 bp, Homo sapiens
ttgtacagacgtatgctta

SEQ ID NO: 2615731 - DNA, 12 bp, Homo sapiens
ttgtacagtttt

SEQ ID NO: 2615732 - DNA, 13 bp, Homo sapiens
ttgtacagttttt

SEQ ID NO: 2615733 - DNA, 16 bp, Homo sapiens
ttgtacagtttttatt

SEQ ID NO: 2615734 - DNA, 18 bp, Homo sapiens
ttgtacatatgtaaaata

SEQ ID NO: 2615735 - DNA, 21 bp, Homo sapiens
ttgtacatatttgtggaataa

SEQ ID NO: 2615736 - DNA, 17 bp, Homo sapiens
ttgtacatttatgattt

SEQ ID NO: 2615737 - DNA, 23 bp, Homo sapiens
ttgtacatttatgatttaataaa

SEQ ID NO: 2615738 - DNA, 19 bp, Homo sapiens
ttgtagaatgtattgtacc

SEQ ID NO: 2615739 - DNA, 15 bp, Homo sapiens
ttgtagagccagggt

SEQ ID NO: 2615740 - DNA, 19 bp, Homo sapiens
ttgtaggggtcaaagaaat

SEQ ID NO: 2615741 - DNA, 18 bp, Homo sapiens
ttgtagtaaagaaattta

SEQ ID NO: 2615742 - DNA, 15 bp, Homo sapiens
ttgtagtagtctcat

SEQ ID NO: 2615743 - DNA, 17 bp, Homo sapiens
ttgtataacaggttatt

SEQ ID NO: 2615744 - DNA, 15 bp, Homo sapiens
ttgtataattgtatc

SEQ ID NO: 2615745 - DNA, 16 bp, Homo sapiens
ttgtataattgtatcg

SEQ ID NO: 2615746 - DNA, 17 bp, Homo sapiens
ttgtataattgtatcgt

SEQ ID NO: 2615747 - DNA, 14 bp, Homo sapiens
ttgtatagtgtaaa

SEQ ID NO: 2615748 - DNA, 11 bp, Homo sapiens
ttgtatatatc

SEQ ID NO: 2615749 - DNA, 18 bp, Homo sapiens
ttgtatattatggaagat

SEQ ID NO: 2615750 - DNA, 20 bp, Homo sapiens
ttgtatattatggaagattt

SEQ ID NO: 2615751 - DNA, 15 bp, Homo sapiens
ttgtatatttgtaca

SEQ ID NO: 2615752 - DNA, 19 bp, Homo sapiens
ttgtatcatttgaacaact

SEQ ID NO: 2615753 - DNA, 18 bp, Homo sapiens
ttgtatcgatgttatgta

SEQ ID NO: 2615754 - DNA, 21 bp, Homo sapiens
ttgtatcgatgttatgtaaaa

SEQ ID NO: 2615755 - DNA, 15 bp, Homo sapiens
ttgtatcgtatagct

SEQ ID NO: 2615756 - DNA, 17 bp, Homo sapiens
ttgtatctagtgcagct

SEQ ID NO: 2615757 - DNA, 20 bp, Homo sapiens
ttgtatctagtgcagctgat

SEQ ID NO: 2615758 - DNA, 21 bp, Homo sapiens
ttgtatctagtgcagctgatt

SEQ ID NO: 2615759 - DNA, 14 bp, Homo sapiens
ttgtatctcttttg

SEQ ID NO: 2615760 - DNA, 12 bp, Homo sapiens
ttgtatgccttt

SEQ ID NO: 2615761 - DNA, 14 bp, Homo sapiens
ttgtattaaagaca

SEQ ID NO: 2615762 - DNA, 12 bp, Homo sapiens
ttgtattaagaa

SEQ ID NO: 2615763 - DNA, 18 bp, Homo sapiens
ttgtattaagaatgaaat

SEQ ID NO: 2615764 - DNA, 19 bp, Homo sapiens
ttgtattctctcctgtacc

SEQ ID NO: 2615765 - DNA, 16 bp, Homo sapiens
ttgtattctctgagct

SEQ ID NO: 2615766 - DNA, 13 bp, Homo sapiens
ttgtattctttga

SEQ ID NO: 2615767 - DNA, 18 bp, Homo sapiens
ttgtatttattccatatt

SEQ ID NO: 2615768 - DNA, 20 bp, Homo sapiens
ttgtattttactaataaaat

SEQ ID NO: 2615769 - DNA, 12 bp, Homo sapiens
ttgtattttcca

SEQ ID NO: 2615770 - DNA, 20 bp, Homo sapiens
ttgtcaagtctctgctggcc

SEQ ID NO: 2615771 - DNA, 19 bp, Homo sapiens
ttgtcaatatttaaacatg

SEQ ID NO: 2615772 - DNA, 14 bp, Homo sapiens
ttgtcagactttaa

SEQ ID NO: 2615773 - DNA, 18 bp, Homo sapiens
ttgtcagactttaaagaa

SEQ ID NO: 2615774 - DNA, 15 bp, Homo sapiens
ttgtcagagctggga

SEQ ID NO: 2615775 - DNA, 15 bp, Homo sapiens
ttgtcagtatctgta

SEQ ID NO: 2615776 - DNA, 21 bp, Homo sapiens
ttgtcatcattgtatatatgt

SEQ ID NO: 2615777 - DNA, 12 bp, Homo sapiens
ttgtcattttct

SEQ ID NO: 2615778 - DNA, 21 bp, Homo sapiens
ttgtccaacccgaggcccgca

SEQ ID NO: 2615779 - DNA, 19 bp, Homo sapiens
ttgtccaattgttgacagt

SEQ ID NO: 2615780 - DNA, 22 bp, Homo sapiens
ttgtccaattgttgacagttct

SEQ ID NO: 2615781 - DNA, 13 bp, Homo sapiens
ttgtccattgtcc

SEQ ID NO: 2615782 - DNA, 19 bp, Homo sapiens
ttgtcccactatctgggtg

SEQ ID NO: 2615783 - DNA, 11 bp, Homo sapiens
ttgtccccaca

SEQ ID NO: 2615784 - DNA, 16 bp, Homo sapiens
ttgtccccgacccttg

SEQ ID NO: 2615785 - DNA, 16 bp, Homo sapiens
ttgtccgctgggtggt

SEQ ID NO: 2615786 - DNA, 17 bp, Homo sapiens
ttgtcctttcccttcag

SEQ ID NO: 2615787 - DNA, 17 bp, Homo sapiens
ttgtctaaaacaataaa

SEQ ID NO: 2615788 - DNA, 18 bp, Homo sapiens
ttgtctaaaacaataaaa

SEQ ID NO: 2615789 - DNA, 20 bp, Homo sapiens
ttgtctatgggactcaatgc

SEQ ID NO: 2615790 - DNA, 19 bp, Homo sapiens
ttgtctctatgccagctca

SEQ ID NO: 2615791 - DNA, 13 bp, Homo sapiens
ttgtcttgaaaga

SEQ ID NO: 2615792 - DNA, 14 bp, Homo sapiens
ttgtcttgaaagat

SEQ ID NO: 2615793 - DNA, 15 bp, Homo sapiens
ttgtcttgaatgtct

SEQ ID NO: 2615794 - DNA, 14 bp, Homo sapiens
ttgtgaagtacata

SEQ ID NO: 2615795 - DNA, 20 bp, Homo sapiens
ttgtgacctgaagttcacca

SEQ ID NO: 2615796 - DNA, 18 bp, Homo sapiens
ttgtgattatttcacttt

SEQ ID NO: 2615797 - DNA, 16 bp, Homo sapiens
ttgtgatttgactgtt

SEQ ID NO: 2615798 - DNA, 16 bp, Homo sapiens
ttgtggacacagctct

SEQ ID NO: 2615799 - DNA, 23 bp, Homo sapiens
ttgtggatttaacagaaatgtac

SEQ ID NO: 2615800 - DNA, 19 bp, Homo sapiens
ttgtggctcctatctgtgt

SEQ ID NO: 2615801 - DNA, 14 bp, Homo sapiens
ttgtggctgggggc

SEQ ID NO: 2615802 - DNA, 22 bp, Homo sapiens
ttgtgtaacaattttaatgcta

SEQ ID NO: 2615803 - DNA, 19 bp, Homo sapiens
ttgtgtaatagaaaactga

SEQ ID NO: 2615804 - DNA, 15 bp, Homo sapiens
ttgtgtacagttatt

SEQ ID NO: 2615805 - DNA, 20 bp, Homo sapiens
ttgtgtatccattatcatgt

SEQ ID NO: 2615806 - DNA, 20 bp, Homo sapiens
ttgtgtatcgtaaccagcca

SEQ ID NO: 2615807 - DNA, 15 bp, Homo sapiens
ttgtgtctgtacacg

SEQ ID NO: 2615808 - DNA, 14 bp, Homo sapiens
ttgtgtgatttaag

SEQ ID NO: 2615809 - DNA, 16 bp, Homo sapiens
ttgtgtgtgggagtgt

SEQ ID NO: 2615810 - DNA, 15 bp, Homo sapiens
ttgtgtgttatttaa

SEQ ID NO: 2615811 - DNA, 16 bp, Homo sapiens
ttgtgtgttatttaaa

SEQ ID NO: 2615812 - DNA, 13 bp, Homo sapiens
ttgtgtgttgtct

SEQ ID NO: 2615813 - DNA, 13 bp, Homo sapiens
ttgtgtgtttcac

SEQ ID NO: 2615814 - DNA, 15 bp, Homo sapiens
ttgtgttactaagtt

SEQ ID NO: 2615815 - DNA, 13 bp, Homo sapiens
ttgtgttcacctt

SEQ ID NO: 2615816 - DNA, 20 bp, Homo sapiens
ttgtgttcccatttcagctg

SEQ ID NO: 2615817 - DNA, 19 bp, Homo sapiens
ttgtgtttctttagttttt

SEQ ID NO: 2615818 - DNA, 18 bp, Homo sapiens
ttgtgtttttaatttatt

SEQ ID NO: 2615819 - DNA, 22 bp, Homo sapiens
ttgttaagtctaaatatttcct

SEQ ID NO: 2615820 - DNA, 13 bp, Homo sapiens
ttgttatcagtaa

SEQ ID NO: 2615821 - DNA, 14 bp, Homo sapiens
ttgttattatataa

SEQ ID NO: 2615822 - DNA, 23 bp, Homo sapiens
ttgttattatataattacatatt

SEQ ID NO: 2615823 - DNA, 13 bp, Homo sapiens
ttgttattttcag

SEQ ID NO: 2615824 - DNA, 22 bp, Homo sapiens
ttgttattttgcaacctcgctg

SEQ ID NO: 2615825 - DNA, 22 bp, Homo sapiens
ttgttccaagacattgtcaata

SEQ ID NO: 2615826 - DNA, 19 bp, Homo sapiens
ttgttccccatcatctgtg

SEQ ID NO: 2615827 - DNA, 20 bp, Homo sapiens
ttgttctggctcttccaggc

SEQ ID NO: 2615828 - DNA, 20 bp, Homo sapiens
ttgttcttggtttgtaaatt

SEQ ID NO: 2615829 - DNA, 21 bp, Homo sapiens
ttgttgataaattccactgga

SEQ ID NO: 2615830 - DNA, 22 bp, Homo sapiens
ttgttgggattcctgacccagg

SEQ ID NO: 2615831 - DNA, 20 bp, Homo sapiens
ttgttgttattttttgagaa

SEQ ID NO: 2615832 - DNA, 14 bp, Homo sapiens
ttgtttaaaatcat

SEQ ID NO: 2615833 - DNA, 17 bp, Homo sapiens
ttgtttaaaatcatttc

SEQ ID NO: 2615834 - DNA, 21 bp, Homo sapiens
ttgtttacagcactactctgt

SEQ ID NO: 2615835 - DNA, 20 bp, Homo sapiens
ttgtttatttatcagtgaca

SEQ ID NO: 2615836 - DNA, 16 bp, Homo sapiens
ttgtttcaattgcatc

SEQ ID NO: 2615837 - DNA, 15 bp, Homo sapiens
ttgtttcttccaaag

SEQ ID NO: 2615838 - DNA, 15 bp, Homo sapiens
ttgtttctttctagt

SEQ ID NO: 2615839 - DNA, 15 bp, Homo sapiens
ttgtttgagaaatta

SEQ ID NO: 2615840 - DNA, 19 bp, Homo sapiens
ttgtttgctcacctggggt

SEQ ID NO: 2615841 - DNA, 22 bp, Homo sapiens
ttgtttgtatgtataattcaaa

SEQ ID NO: 2615842 - DNA, 16 bp, Homo sapiens
tttccttggctggtgc

SEQ ID NO: 2615843 - DNA, 19 bp, Homo sapiens
tttccttggggcaggcagt

SEQ ID NO: 2615844 - DNA, 22 bp, Homo sapiens
tttcctttaaaaaaatttaagt

SEQ ID NO: 2615845 - DNA, 23 bp, Homo sapiens
tttcctttaaaaaaatttaagtg

SEQ ID NO: 2615846 - DNA, 16 bp, Homo sapiens
tttcctttgtcatcat

SEQ ID NO: 2615847 - DNA, 16 bp, Homo sapiens
tttccttttttaaaaa

SEQ ID NO: 2615848 - DNA, 15 bp, Homo sapiens
tttcgagaagctgct

SEQ ID NO: 2615849 - DNA, 19 bp, Homo sapiens
tttcgagaagctgctctgg

SEQ ID NO: 2615850 - DNA, 21 bp, Homo sapiens
tttcgtgggtctgttttcctt

SEQ ID NO: 2615851 - DNA, 18 bp, Homo sapiens
tttctaaagccttaagtc

SEQ ID NO: 2615852 - DNA, 14 bp, Homo sapiens
tttctaatgagata

SEQ ID NO: 2615853 - DNA, 18 bp, Homo sapiens
tttctacagtattatgta

SEQ ID NO: 2615854 - DNA, 18 bp, Homo sapiens
tttctacccagcgagccc

SEQ ID NO: 2615855 - DNA, 14 bp, Homo sapiens
tttctacctcccag

SEQ ID NO: 2615856 - DNA, 15 bp, Homo sapiens
tttctactctgaact

SEQ ID NO: 2615857 - DNA, 16 bp, Homo sapiens
tttctagacttgtgct

SEQ ID NO: 2615858 - DNA, 20 bp, Homo sapiens
tttctagctagaaatatgat

SEQ ID NO: 2615859 - DNA, 19 bp, Homo sapiens
tttctagctgttgagctgt

SEQ ID NO: 2615860 - DNA, 21 bp, Homo sapiens
tttctagctgttgagctgttt

SEQ ID NO: 2615861 - DNA, 16 bp, Homo sapiens
tttctaggaagaattt

SEQ ID NO: 2615862 - DNA, 15 bp, Homo sapiens
tttctagggaaatga

SEQ ID NO: 2615863 - DNA, 14 bp, Homo sapiens
tttctatcacatat

SEQ ID NO: 2615864 - DNA, 21 bp, Homo sapiens
tttctatgacacatgcaaggt

SEQ ID NO: 2615865 - DNA, 13 bp, Homo sapiens
tttctattccaaa

SEQ ID NO: 2615866 - DNA, 13 bp, Homo sapiens
tttctcaaagttt

SEQ ID NO: 2615867 - DNA, 16 bp, Homo sapiens
tttctcaaagttttga

SEQ ID NO: 2615868 - DNA, 16 bp, Homo sapiens
tttctcagttttcata

SEQ ID NO: 2615869 - DNA, 18 bp, Homo sapiens
tttctccagccagcaatg

SEQ ID NO: 2615870 - DNA, 11 bp, Homo sapiens
tttctccagct

SEQ ID NO: 2615871 - DNA, 20 bp, Homo sapiens
tttctcccaggccaggctcc

SEQ ID NO: 2615872 - DNA, 18 bp, Homo sapiens
tttctcccagtcatttaa

SEQ ID NO: 2615873 - DNA, 14 bp, Homo sapiens
tttctccccctggg

SEQ ID NO: 2615874 - DNA, 15 bp, Homo sapiens
tttctccccctgggc

SEQ ID NO: 2615875 - DNA, 21 bp, Homo sapiens
tttctccctctcactgtctga

SEQ ID NO: 2615876 - DNA, 14 bp, Homo sapiens
tttctcctccatgg

SEQ ID NO: 2615877 - DNA, 22 bp, Homo sapiens
tttctctaacttcaaggcccat

SEQ ID NO: 2615878 - DNA, 20 bp, Homo sapiens
tttctctgatttgcaaaaaa

SEQ ID NO: 2615879 - DNA, 20 bp, Homo sapiens
tttctctggggtatttgggg

SEQ ID NO: 2615880 - DNA, 12 bp, Homo sapiens
tttctcttgggc

SEQ ID NO: 2615881 - DNA, 12 bp, Homo sapiens
tttctctttctc

SEQ ID NO: 2615882 - DNA, 14 bp, Homo sapiens
tttctctttctcct

SEQ ID NO: 2615883 - DNA, 16 bp, Homo sapiens
tttctgaaaatataac

SEQ ID NO: 2615884 - DNA, 20 bp, Homo sapiens
tttctgaaaattaacactgc

SEQ ID NO: 2615885 - DNA, 15 bp, Homo sapiens
tttctgaagtggact

SEQ ID NO: 2615886 - DNA, 15 bp, Homo sapiens
tttctgagaaagact

SEQ ID NO: 2615887 - DNA, 12 bp, Homo sapiens
tttctgagcccg

SEQ ID NO: 2615888 - DNA, 11 bp, Homo sapiens
tttctgattgt

SEQ ID NO: 2615889 - DNA, 14 bp, Homo sapiens
tttctgcatcagct

SEQ ID NO: 2615890 - DNA, 18 bp, Homo sapiens
tttctggaatgtaatcaa

SEQ ID NO: 2615891 - DNA, 15 bp, Homo sapiens
tttctggctatgcat

SEQ ID NO: 2615892 - DNA, 18 bp, Homo sapiens
tttctggctatgcatttg

SEQ ID NO: 2615893 - DNA, 19 bp, Homo sapiens
tttctggctatgcatttga

SEQ ID NO: 2615894 - DNA, 19 bp, Homo sapiens
tttctgggctgtctattct

SEQ ID NO: 2615895 - DNA, 19 bp, Homo sapiens
tttctggtagatagaaata

SEQ ID NO: 2615896 - DNA, 23 bp, Homo sapiens
tttctgtccttttggcactgaga

SEQ ID NO: 2615897 - DNA, 20 bp, Homo sapiens
tttctgtgtgcaccttacca

SEQ ID NO: 2615898 - DNA, 20 bp, Homo sapiens
tttctgttctttctggctat

SEQ ID NO: 2615899 - DNA, 15 bp, Homo sapiens
tttctgttgaagttt

SEQ ID NO: 2615900 - DNA, 17 bp, Homo sapiens
tttctgttgtcattgct

SEQ ID NO: 2615901 - DNA, 16 bp, Homo sapiens
tttcttaaacaaatgt

SEQ ID NO: 2615902 - DNA, 18 bp, Homo sapiens
tttcttaaaccttcagtt

SEQ ID NO: 2615903 - DNA, 13 bp, Homo sapiens
tttcttaaataat

SEQ ID NO: 2615904 - DNA, 15 bp, Homo sapiens
tttcttaaatgggct

SEQ ID NO: 2615905 - DNA, 17 bp, Homo sapiens
tttcttacataattttt

SEQ ID NO: 2615906 - DNA, 23 bp, Homo sapiens
tttcttagggaaggatacaaaag

SEQ ID NO: 2615907 - DNA, 18 bp, Homo sapiens
tttcttatttaacttaac

SEQ ID NO: 2615908 - DNA, 18 bp, Homo sapiens
tttcttcaacatcaatgt

SEQ ID NO: 2615909 - DNA, 21 bp, Homo sapiens
tttcttcaacatcaatgttca

SEQ ID NO: 2615910 - DNA, 19 bp, Homo sapiens
tttcttcatgcaatgacat

SEQ ID NO: 2615911 - DNA, 22 bp, Homo sapiens
tttcttcatgcaatgacatctt

SEQ ID NO: 2615912 - DNA, 11 bp, Homo sapiens
tttcttcctct

SEQ ID NO: 2615913 - DNA, 14 bp, Homo sapiens
tttcttcctctgct

SEQ ID NO: 2615914 - DNA, 16 bp, Homo sapiens
tttcttcctctgctga

SEQ ID NO: 2615915 - DNA, 12 bp, Homo sapiens
tttcttcttccc

SEQ ID NO: 2615916 - DNA, 16 bp, Homo sapiens
tttcttgcagatcaaa

SEQ ID NO: 2615917 - DNA, 11 bp, Homo sapiens
tttcttgctgg

SEQ ID NO: 2615918 - DNA, 13 bp, Homo sapiens
tttctttaaaaga

SEQ ID NO: 2615919 - DNA, 21 bp, Homo sapiens
tttctttagagcattgccatt

SEQ ID NO: 2615920 - DNA, 21 bp, Homo sapiens
tttctttagtttttgtgaagt

SEQ ID NO: 2615921 - DNA, 13 bp, Homo sapiens
tttctttcaactt

SEQ ID NO: 2615922 - DNA, 19 bp, Homo sapiens
tttctttcaacttgcatcc

SEQ ID NO: 2615923 - DNA, 13 bp, Homo sapiens
tttctttccagag

SEQ ID NO: 2615924 - DNA, 21 bp, Homo sapiens
tttctttgcctgttcagttac

SEQ ID NO: 2615925 - DNA, 22 bp, Homo sapiens
tttgaaaaattcctattgtgat

SEQ ID NO: 2615926 - DNA, 18 bp, Homo sapiens
tttgaaaagctattagcc

SEQ ID NO: 2615927 - DNA, 14 bp, Homo sapiens
tttgaaataataaa

SEQ ID NO: 2615928 - DNA, 18 bp, Homo sapiens
tttgaaattaacctctca

SEQ ID NO: 2615929 - DNA, 16 bp, Homo sapiens
tttgaactcagatctg

SEQ ID NO: 2615930 - DNA, 16 bp, Homo sapiens
tttgaagcagttgtgt

SEQ ID NO: 2615931 - DNA, 18 bp, Homo sapiens
tttgaagcagttgtgtca

SEQ ID NO: 2615932 - DNA, 16 bp, Homo sapiens
tttgaagtacaattgt

SEQ ID NO: 2615933 - DNA, 22 bp, Homo sapiens
tttgaagtcataccaatgaaaa

SEQ ID NO: 2615934 - DNA, 18 bp, Homo sapiens
tttgaatataaacactat

SEQ ID NO: 2615935 - DNA, 14 bp, Homo sapiens
tttgaatgaaaaat

SEQ ID NO: 2615936 - DNA, 16 bp, Homo sapiens
tttgaatgcttcctga

SEQ ID NO: 2615937 - DNA, 12 bp, Homo sapiens
tttgacctctgc

SEQ ID NO: 2615938 - DNA, 21 bp, Homo sapiens
tttgacctctgcagcaataaa

SEQ ID NO: 2615939 - DNA, 19 bp, Homo sapiens
tttgacgccatcccagccc

SEQ ID NO: 2615940 - DNA, 19 bp, Homo sapiens
tttgacgggaaacaaaact

SEQ ID NO: 2615941 - DNA, 19 bp, Homo sapiens
tttgactgaagatgcagct

SEQ ID NO: 2615942 - DNA, 15 bp, Homo sapiens
tttgactggatattc

SEQ ID NO: 2615943 - DNA, 19 bp, Homo sapiens
tttgactgtttttacccat

SEQ ID NO: 2615944 - DNA, 13 bp, Homo sapiens
tttgagacagagt

SEQ ID NO: 2615945 - DNA, 18 bp, Homo sapiens
tttgagacagtttcttag

SEQ ID NO: 2615946 - DNA, 22 bp, Homo sapiens
tttgagacagtttcttagcttt

SEQ ID NO: 2615947 - DNA, 16 bp, Homo sapiens
tttgagaccagcctgg

SEQ ID NO: 2615948 - DNA, 21 bp, Homo sapiens
tttgagagaaatatgaagaac

SEQ ID NO: 2615949 - DNA, 20 bp, Homo sapiens
tttgaggtcaagtaagaaga

SEQ ID NO: 2615950 - DNA, 14 bp, Homo sapiens
tttgataaagtagt

SEQ ID NO: 2615951 - DNA, 18 bp, Homo sapiens
tttgataaagtttctcag

SEQ ID NO: 2615952 - DNA, 23 bp, Homo sapiens
tttgataatgttaaatttgtaag

SEQ ID NO: 2615953 - DNA, 23 bp, Homo sapiens
tttgatatccaaagctgaataca

SEQ ID NO: 2615954 - DNA, 19 bp, Homo sapiens
tttgatattaaaggagtta

SEQ ID NO: 2615955 - DNA, 14 bp, Homo sapiens
tttgatccaagctg

SEQ ID NO: 2615956 - DNA, 18 bp, Homo sapiens
tttgattaatccagaata

SEQ ID NO: 2615957 - DNA, 16 bp, Homo sapiens
tttgattattgtattt

SEQ ID NO: 2615958 - DNA, 18 bp, Homo sapiens
tttgattcagacagctgc

SEQ ID NO: 2615959 - DNA, 15 bp, Homo sapiens
tttgcaaaggagctc

SEQ ID NO: 2615960 - DNA, 17 bp, Homo sapiens
tttgcaagtcatggctg

SEQ ID NO: 2615961 - DNA, 18 bp, Homo sapiens
tttgcaagtcatggctgt

SEQ ID NO: 2615962 - DNA, 12 bp, Homo sapiens
tttgcacagctc

SEQ ID NO: 2615963 - DNA, 12 bp, Homo sapiens
tttgcacccctc

SEQ ID NO: 2615964 - DNA, 13 bp, Homo sapiens
tttgcacccctcc

SEQ ID NO: 2615965 - DNA, 20 bp, Homo sapiens
tttgcactggagttctatgc

SEQ ID NO: 2615966 - DNA, 14 bp, Homo sapiens
tttgcagacaggca

SEQ ID NO: 2615967 - DNA, 22 bp, Homo sapiens
tttgcataacaattcctctact

SEQ ID NO: 2615968 - DNA, 13 bp, Homo sapiens
tttgcattcaaat

SEQ ID NO: 2615969 - DNA, 23 bp, Homo sapiens
tttgcatttaaaacagacactgg

SEQ ID NO: 2615970 - DNA, 18 bp, Homo sapiens
tttgccaccctcatgctg

SEQ ID NO: 2615971 - DNA, 14 bp, Homo sapiens
tttgccatgggctt

SEQ ID NO: 2615972 - DNA, 20 bp, Homo sapiens
tttgccatgggcttcactgt

SEQ ID NO: 2615973 - DNA, 13 bp, Homo sapiens
tttgccctcccat

SEQ ID NO: 2615974 - DNA, 14 bp, Homo sapiens
tttgcctgagggcg

SEQ ID NO: 2615975 - DNA, 14 bp, Homo sapiens
tttgcctgttcagt

SEQ ID NO: 2615976 - DNA, 15 bp, Homo sapiens
tttgcctgttcagtt

SEQ ID NO: 2615977 - DNA, 23 bp, Homo sapiens
tttgcctgttcagttacagaaag

SEQ ID NO: 2615978 - DNA, 21 bp, Homo sapiens
tttgccttgggctgctcctca

SEQ ID NO: 2615979 - DNA, 19 bp, Homo sapiens
tttgccttttgcaaacttt

SEQ ID NO: 2615980 - DNA, 13 bp, Homo sapiens
tttgctagttttt

SEQ ID NO: 2615981 - DNA, 23 bp, Homo sapiens
tttgctattgacaagtcatttta

SEQ ID NO: 2615982 - DNA, 16 bp, Homo sapiens
tttgctcacctggggt

SEQ ID NO: 2615983 - DNA, 18 bp, Homo sapiens
tttgctcttcaagaaatc

SEQ ID NO: 2615984 - DNA, 19 bp, Homo sapiens
tttgctgagcatgtactga

SEQ ID NO: 2615985 - DNA, 20 bp, Homo sapiens
tttgctggagctctgcccat

SEQ ID NO: 2615986 - DNA, 22 bp, Homo sapiens
tttgctggggccgaaagaacag

SEQ ID NO: 2615987 - DNA, 14 bp, Homo sapiens
aaaaagaaacaaga

SEQ ID NO: 2615988 - DNA, 13 bp, Homo sapiens
aaaaagcttcccc

SEQ ID NO: 2615989 - DNA, 21 bp, Homo sapiens
aaaaaggatgcacagagttgt

SEQ ID NO: 2615990 - DNA, 21 bp, Homo sapiens
aaaaagggatccgtacattca

SEQ ID NO: 2615991 - DNA, 22 bp, Homo sapiens
aaaaagggcagggcatctcctg

SEQ ID NO: 2615992 - DNA, 15 bp, Homo sapiens
aaaaagtattatttt

SEQ ID NO: 2615993 - DNA, 20 bp, Homo sapiens
aaaaagtcagactgctggga

SEQ ID NO: 2615994 - DNA, 16 bp, Homo sapiens
aaaaagtgacacagca

SEQ ID NO: 2615995 - DNA, 23 bp, Homo sapiens
aaaaagtgtttatttttcatatt

SEQ ID NO: 2615996 - DNA, 21 bp, Homo sapiens
aaaaataaaaactgactcctt

SEQ ID NO: 2615997 - DNA, 21 bp, Homo sapiens
aaaaataaatttggttctaat

SEQ ID NO: 2615998 - DNA, 19 bp, Homo sapiens
aaaaataatctatttctat

SEQ ID NO: 2615999 - DNA, 14 bp, Homo sapiens
aaaaatacatgcat

SEQ ID NO: 2616000 - DNA, 14 bp, Homo sapiens
aaaaatacatttta

SEQ ID NO: 2616001 - DNA, 15 bp, Homo sapiens
aaaaatacttgtcaa

SEQ ID NO: 2616002 - DNA, 20 bp, Homo sapiens
aaaaatatggaacttctaat

SEQ ID NO: 2616003 - DNA, 17 bp, Homo sapiens
aaaaatcataaactgtg

SEQ ID NO: 2616004 - DNA, 14 bp, Homo sapiens
aaaaatctcaaatt

SEQ ID NO: 2616005 - DNA, 22 bp, Homo sapiens
aaaaatctgaccaaaacaaaca

SEQ ID NO: 2616006 - DNA, 20 bp, Homo sapiens
aaaaatgcaaatcctatgtg

SEQ ID NO: 2616007 - DNA, 21 bp, Homo sapiens
aaaaatgcacgtagctgaggc

SEQ ID NO: 2616008 - DNA, 15 bp, Homo sapiens
aaaaatgcctttgag

SEQ ID NO: 2616009 - DNA, 14 bp, Homo sapiens
aaaaatgctgaaca

SEQ ID NO: 2616010 - DNA, 16 bp, Homo sapiens
aaaaatgctgaacatt

SEQ ID NO: 2616011 - DNA, 18 bp, Homo sapiens
aaaaatgtgcaaaacagc

SEQ ID NO: 2616012 - DNA, 20 bp, Homo sapiens
aaaaatgttaaaatgtattc

SEQ ID NO: 2616013 - DNA, 13 bp, Homo sapiens
aaaaattagctga

SEQ ID NO: 2616014 - DNA, 21 bp, Homo sapiens
aaaaatttaaagggtgtactt

SEQ ID NO: 2616015 - DNA, 16 bp, Homo sapiens
aaaaatttaagcattg

SEQ ID NO: 2616016 - DNA, 20 bp, Homo sapiens
aaaaatttaagcattgtttg

SEQ ID NO: 2616017 - DNA, 15 bp, Homo sapiens
aaaacaaatgccaca

SEQ ID NO: 2616018 - DNA, 18 bp, Homo sapiens
aaaacaacttctttgtaa

SEQ ID NO: 2616019 - DNA, 15 bp, Homo sapiens
aaaacaatattgttt

SEQ ID NO: 2616020 - DNA, 18 bp, Homo sapiens
aaaacaatattgtttcta

SEQ ID NO: 2616021 - DNA, 19 bp, Homo sapiens
aaaacaatcatttgctttt

SEQ ID NO: 2616022 - DNA, 13 bp, Homo sapiens
aaaacacagcaag

SEQ ID NO: 2616023 - DNA, 18 bp, Homo sapiens
aaaacacagcaagggtga

SEQ ID NO: 2616024 - DNA, 12 bp, Homo sapiens
aaaacacatttt

SEQ ID NO: 2616025 - DNA, 17 bp, Homo sapiens
aaaacacatttttctta

SEQ ID NO: 2616026 - DNA, 15 bp, Homo sapiens
aaaacacctagcttt

SEQ ID NO: 2616027 - DNA, 18 bp, Homo sapiens
aaaacagaacatcattag

SEQ ID NO: 2616028 - DNA, 17 bp, Homo sapiens
aaaacagacactggcat

SEQ ID NO: 2616029 - DNA, 20 bp, Homo sapiens
aaaacataatcttctgcctt

SEQ ID NO: 2616030 - DNA, 24 bp, Homo sapiens
aaaacataatcttctgccttctca

SEQ ID NO: 2616031 - DNA, 16 bp, Homo sapiens
aaaacatccagataca

SEQ ID NO: 2616032 - DNA, 14 bp, Homo sapiens
aaaacatggtagaa

SEQ ID NO: 2616033 - DNA, 21 bp, Homo sapiens
aaaacattttttaatagaata

SEQ ID NO: 2616034 - DNA, 21 bp, Homo sapiens
aaaaccaatgttctctcttct

SEQ ID NO: 2616035 - DNA, 19 bp, Homo sapiens
aaaaccacagccctgtcag

SEQ ID NO: 2616036 - DNA, 16 bp, Homo sapiens
aaaaccactagaactc

SEQ ID NO: 2616037 - DNA, 20 bp, Homo sapiens
aaaacctaagtcctttatgt

SEQ ID NO: 2616038 - DNA, 21 bp, Homo sapiens
aaaacctaagtcctttatgtg

SEQ ID NO: 2616039 - DNA, 16 bp, Homo sapiens
aaaacggccctcttga

SEQ ID NO: 2616040 - DNA, 17 bp, Homo sapiens
aaaacgttttattgtgt

SEQ ID NO: 2616041 - DNA, 13 bp, Homo sapiens
aaaactcattttt

SEQ ID NO: 2616042 - DNA, 18 bp, Homo sapiens
aaaactgaaaatctaata

SEQ ID NO: 2616043 - DNA, 23 bp, Homo sapiens
aaaactgaaagtgaaagtccaga

SEQ ID NO: 2616044 - DNA, 18 bp, Homo sapiens
aaaactgaagtctgaaat

SEQ ID NO: 2616045 - DNA, 23 bp, Homo sapiens
aaaactgctgactgttttctctt

SEQ ID NO: 2616046 - DNA, 17 bp, Homo sapiens
aaaacttaacatattta

SEQ ID NO: 2616047 - DNA, 12 bp, Homo sapiens
aaaacttctttt

SEQ ID NO: 2616048 - DNA, 13 bp, Homo sapiens
aaaacttttctca

SEQ ID NO: 2616049 - DNA, 9 bp, Homo sapiens
aaaagaaaa

SEQ ID NO: 2616050 - DNA, 17 bp, Homo sapiens
aaaagaaaaaaaaagaa

SEQ ID NO: 2616051 - DNA, 18 bp, Homo sapiens
aaaagaaaaaaaaagaaa

SEQ ID NO: 2616052 - DNA, 22 bp, Homo sapiens
aaaagaaaaaaaaagaaaaaag

SEQ ID NO: 2616053 - DNA, 17 bp, Homo sapiens
aaaagaaagaaaatcag

SEQ ID NO: 2616054 - DNA, 10 bp, Homo sapiens
aaaagaaagc

SEQ ID NO: 2616055 - DNA, 13 bp, Homo sapiens
aaaagacaattct

SEQ ID NO: 2616056 - DNA, 13 bp, Homo sapiens
aaaagacagggct

SEQ ID NO: 2616057 - DNA, 22 bp, Homo sapiens
aaaagaggaaagaatgaaagag

SEQ ID NO: 2616058 - DNA, 13 bp, Homo sapiens
aaaagataaagat

SEQ ID NO: 2616059 - DNA, 20 bp, Homo sapiens
aaaagatacgactttatttt

SEQ ID NO: 2616060 - DNA, 13 bp, Homo sapiens
aaaagatgcttct

SEQ ID NO: 2616061 - DNA, 14 bp, Homo sapiens
aaaagatgtagatt

SEQ ID NO: 2616062 - DNA, 22 bp, Homo sapiens
aaaagatgtagatttatttcat

SEQ ID NO: 2616063 - DNA, 23 bp, Homo sapiens
aaaagatgtagatttatttcatc

SEQ ID NO: 2616064 - DNA, 14 bp, Homo sapiens
aaaagattgctgaa

SEQ ID NO: 2616065 - DNA, 18 bp, Homo sapiens
aaaagattgctgaaattt

SEQ ID NO: 2616066 - DNA, 21 bp, Homo sapiens
aaaagattgctgaaattttat

SEQ ID NO: 2616067 - DNA, 13 bp, Homo sapiens
aaaagatttgttt

SEQ ID NO: 2616068 - DNA, 12 bp, Homo sapiens
aaaagcaagact

SEQ ID NO: 2616069 - DNA, 20 bp, Homo sapiens
aaaagctatggtgagatgca

SEQ ID NO: 2616070 - DNA, 21 bp, Homo sapiens
aaaagctattagccaggatca

SEQ ID NO: 2616071 - DNA, 18 bp, Homo sapiens
aaaagctcatattttgta

SEQ ID NO: 2616072 - DNA, 12 bp, Homo sapiens
aaaagctcctgt

SEQ ID NO: 2616073 - DNA, 13 bp, Homo sapiens
aaaagctcctgtc

SEQ ID NO: 2616074 - DNA, 16 bp, Homo sapiens
aaaaggacacctttta

SEQ ID NO: 2616075 - DNA, 13 bp, Homo sapiens
aaaaggatgcaca

SEQ ID NO: 2616076 - DNA, 14 bp, Homo sapiens
aaaaggatgcacag

SEQ ID NO: 2616077 - DNA, 15 bp, Homo sapiens
aaaaggatgcacaga

SEQ ID NO: 2616078 - DNA, 22 bp, Homo sapiens
aaaaggatgcacagagttgtta

SEQ ID NO: 2616079 - DNA, 15 bp, Homo sapiens
aaaaggccaaacctc

SEQ ID NO: 2616080 - DNA, 14 bp, Homo sapiens
aaaagggaagtcta

SEQ ID NO: 2616081 - DNA, 20 bp, Homo sapiens
aaaagggaagttgtgccttt

SEQ ID NO: 2616082 - DNA, 14 bp, Homo sapiens
aaaaggtaaaactt

SEQ ID NO: 2616083 - DNA, 23 bp, Homo sapiens
aaaaggtaaaactttttatattt

SEQ ID NO: 2616084 - DNA, 15 bp, Homo sapiens
aaaaggtattaaatt

SEQ ID NO: 2616085 - DNA, 19 bp, Homo sapiens
aaaagtcttcactctctga

SEQ ID NO: 2616086 - DNA, 23 bp, Homo sapiens
aaaagtcttcactctctgaagat

SEQ ID NO: 2616087 - DNA, 13 bp, Homo sapiens
aaaagtgtttatt

SEQ ID NO: 2616088 - DNA, 21 bp, Homo sapiens
aaaagtgtttatttttcatat

SEQ ID NO: 2616089 - DNA, 12 bp, Homo sapiens
aaaagttattaa

SEQ ID NO: 2616090 - DNA, 18 bp, Homo sapiens
aaaagttctgcagataaa

SEQ ID NO: 2616091 - DNA, 12 bp, Homo sapiens
aaaagtttcaat

SEQ ID NO: 2616092 - DNA, 13 bp, Homo sapiens
aaaagtttcaatg

SEQ ID NO: 2616093 - DNA, 18 bp, Homo sapiens
aaaagtttcaatgtgatt

SEQ ID NO: 2616094 - DNA, 17 bp, Homo sapiens
aaaagttttatttttct

SEQ ID NO: 2616095 - DNA, 15 bp, Homo sapiens
aaaataaaaaaaaga

SEQ ID NO: 2616096 - DNA, 21 bp, Homo sapiens
aaaataaaaaaaagaaaaaag

SEQ ID NO: 2616097 - DNA, 11 bp, Homo sapiens
aaaataaaaac

SEQ ID NO: 2616098 - DNA, 17 bp, Homo sapiens
aaaataaaaagtgacac

SEQ ID NO: 2616099 - DNA, 21 bp, Homo sapiens
aaaataaaaagtgacacagca

SEQ ID NO: 2616100 - DNA, 22 bp, Homo sapiens
aaaataaaaagtgacacagcag

SEQ ID NO: 2616101 - DNA, 13 bp, Homo sapiens
aaaataaaaagtt

SEQ ID NO: 2616102 - DNA, 14 bp, Homo sapiens
aaaataaaactttt

SEQ ID NO: 2616103 - DNA, 12 bp, Homo sapiens
aaaataaacaaa

SEQ ID NO: 2616104 - DNA, 14 bp, Homo sapiens
aaaataaacaaata

SEQ ID NO: 2616105 - DNA, 12 bp, Homo sapiens
aaaataaattat

SEQ ID NO: 2616106 - DNA, 12 bp, Homo sapiens
aaaataagaaaa

SEQ ID NO: 2616107 - DNA, 13 bp, Homo sapiens
aaaataataataa

SEQ ID NO: 2616108 - DNA, 14 bp, Homo sapiens
aaaataattctaaa

SEQ ID NO: 2616109 - DNA, 16 bp, Homo sapiens
aaaataattgatttca

SEQ ID NO: 2616110 - DNA, 14 bp, Homo sapiens
aaaatacaaaatta

SEQ ID NO: 2616111 - DNA, 14 bp, Homo sapiens
aaaatacacactca

SEQ ID NO: 2616112 - DNA, 13 bp, Homo sapiens
aaaatacatttta

SEQ ID NO: 2616113 - DNA, 15 bp, Homo sapiens
aaaataccagccagt

SEQ ID NO: 2616114 - DNA, 22 bp, Homo sapiens
aaaatactatttttactgccac

SEQ ID NO: 2616115 - DNA, 20 bp, Homo sapiens
aaaatactgccagatgctga

SEQ ID NO: 2616116 - DNA, 22 bp, Homo sapiens
aaaatagcaacactctatattt

SEQ ID NO: 2616117 - DNA, 10 bp, Homo sapiens
aaaatagcca

SEQ ID NO: 2616118 - DNA, 18 bp, Homo sapiens
aaaataggtatacagtgg

SEQ ID NO: 2616119 - DNA, 10 bp, Homo sapiens
aaaatataac

SEQ ID NO: 2616120 - DNA, 12 bp, Homo sapiens
aaaatatactgt

SEQ ID NO: 2616121 - DNA, 13 bp, Homo sapiens
aaaatatactgta

SEQ ID NO: 2616122 - DNA, 15 bp, Homo sapiens
aaaatatactgtaaa

SEQ ID NO: 2616123 - DNA, 17 bp, Homo sapiens
aaaatatactgtaaaga

SEQ ID NO: 2616124 - DNA, 20 bp, Homo sapiens
aaaatatactgtaaagaaag

SEQ ID NO: 2616125 - DNA, 18 bp, Homo sapiens
aaaatatctgaaatgtga

SEQ ID NO: 2616126 - DNA, 20 bp, Homo sapiens
aaaatatggaacttctaata

SEQ ID NO: 2616127 - DNA, 21 bp, Homo sapiens
aaaatatggaacttctaatat

SEQ ID NO: 2616128 - DNA, 14 bp, Homo sapiens
aaaatatgttcttt

SEQ ID NO: 2616129 - DNA, 18 bp, Homo sapiens
aaaatattttataatttt

SEQ ID NO: 2616130 - DNA, 20 bp, Homo sapiens
aaaatattttcatacagcat

SEQ ID NO: 2616131 - DNA, 23 bp, Homo sapiens
aaaatattttttatatatacagt

SEQ ID NO: 2616132 - DNA, 21 bp, Homo sapiens
aaaatcagcctgctccagctg

SEQ ID NO: 2616133 - DNA, 15 bp, Homo sapiens
aaatctaccttctgt

SEQ ID NO: 2616134 - DNA, 17 bp, Homo sapiens
aaatctaccttctgtag

SEQ ID NO: 2616135 - DNA, 18 bp, Homo sapiens
aaatctaccttctgtagt

SEQ ID NO: 2616136 - DNA, 15 bp, Homo sapiens
aaatctcaaatttct

SEQ ID NO: 2616137 - DNA, 22 bp, Homo sapiens
aaatctccaaaataaaactttt

SEQ ID NO: 2616138 - DNA, 11 bp, Homo sapiens
aaatctgaaga

SEQ ID NO: 2616139 - DNA, 21 bp, Homo sapiens
aaatctgtccaaaggaggctg

SEQ ID NO: 2616140 - DNA, 17 bp, Homo sapiens
aaatcttggcacagaaa

SEQ ID NO: 2616141 - DNA, 11 bp, Homo sapiens
aaatgaaaatt

SEQ ID NO: 2616142 - DNA, 18 bp, Homo sapiens
aaatgaaagcatgtctca

SEQ ID NO: 2616143 - DNA, 20 bp, Homo sapiens
aaatgaaagtataactgagt

SEQ ID NO: 2616144 - DNA, 22 bp, Homo sapiens
aaatgaaattactacaaaattt

SEQ ID NO: 2616145 - DNA, 15 bp, Homo sapiens
aaatgaaattgtaaa

SEQ ID NO: 2616146 - DNA, 14 bp, Homo sapiens
aaatgaactgaagt

SEQ ID NO: 2616147 - DNA, 21 bp, Homo sapiens
aaatgaactgaagtttcacat

SEQ ID NO: 2616148 - DNA, 18 bp, Homo sapiens
aaatgaagcagctttaaa

SEQ ID NO: 2616149 - DNA, 22 bp, Homo sapiens
aaatgaaggttaggatttaaca

SEQ ID NO: 2616150 - DNA, 20 bp, Homo sapiens
aaatgaagtgcaaatttgat

SEQ ID NO: 2616151 - DNA, 19 bp, Homo sapiens
aaatgactaaaaaacaaag

SEQ ID NO: 2616152 - DNA, 12 bp, Homo sapiens
aaatgagtgtgt

SEQ ID NO: 2616153 - DNA, 16 bp, Homo sapiens
aaatgatcttttcaag

SEQ ID NO: 2616154 - DNA, 22 bp, Homo sapiens
aaatgatgatgtggaagaactt

SEQ ID NO: 2616155 - DNA, 21 bp, Homo sapiens
aaatgattttatctgtgaatt

SEQ ID NO: 2616156 - DNA, 13 bp, Homo sapiens
aaatgcaaatcct

SEQ ID NO: 2616157 - DNA, 16 bp, Homo sapiens
aaatgcaacaacatgt

SEQ ID NO: 2616158 - DNA, 13 bp, Homo sapiens
aaatgcaatatgt

SEQ ID NO: 2616159 - DNA, 16 bp, Homo sapiens
aaatgcaatatgtatt

SEQ ID NO: 2616160 - DNA, 22 bp, Homo sapiens
aaatgcagggattgctgccact

SEQ ID NO: 2616161 - DNA, 20 bp, Homo sapiens
aaatgcattataggatcatt

SEQ ID NO: 2616162 - DNA, 15 bp, Homo sapiens
aaatgcccagcccct

SEQ ID NO: 2616163 - DNA, 13 bp, Homo sapiens
aaatgctgcctgc

SEQ ID NO: 2616164 - DNA, 14 bp, Homo sapiens
aaatgctgcctgcc

SEQ ID NO: 2616165 - DNA, 16 bp, Homo sapiens
aaatgctgcctgcctg

SEQ ID NO: 2616166 - DNA, 22 bp, Homo sapiens
aaatgctggtttttcagttttc

SEQ ID NO: 2616167 - DNA, 22 bp, Homo sapiens
aaatggccatttgctttttcac

SEQ ID NO: 2616168 - DNA, 15 bp, Homo sapiens
aaatgggacttcttt

SEQ ID NO: 2616169 - DNA, 22 bp, Homo sapiens
aaatgggacttcttttcacatt

SEQ ID NO: 2616170 - DNA, 18 bp, Homo sapiens
aaatgggcagagcagaga

SEQ ID NO: 2616171 - DNA, 20 bp, Homo sapiens
aaatgggcagagcagagacc

SEQ ID NO: 2616172 - DNA, 16 bp, Homo sapiens
aaatgggggtgcattt

SEQ ID NO: 2616173 - DNA, 18 bp, Homo sapiens
aaatgggggtgcatttga

SEQ ID NO: 2616174 - DNA, 19 bp, Homo sapiens
aaatgggtagagaaacact

SEQ ID NO: 2616175 - DNA, 22 bp, Homo sapiens
aaatgggttggtgcttctaacc

SEQ ID NO: 2616176 - DNA, 16 bp, Homo sapiens
aaatggtcgcccagga

SEQ ID NO: 2616177 - DNA, 11 bp, Homo sapiens
aaatggtgcct

SEQ ID NO: 2616178 - DNA, 14 bp, Homo sapiens
aaatggtgtttttt

SEQ ID NO: 2616179 - DNA, 11 bp, Homo sapiens
aaatggttaaa

SEQ ID NO: 2616180 - DNA, 22 bp, Homo sapiens
aaatgtaaagatatttttatct

SEQ ID NO: 2616181 - DNA, 15 bp, Homo sapiens
aaatgtaaatattct

SEQ ID NO: 2616182 - DNA, 14 bp, Homo sapiens
aaatgtaagatcgt

SEQ ID NO: 2616183 - DNA, 16 bp, Homo sapiens
aaatgtaagggaaact

SEQ ID NO: 2616184 - DNA, 22 bp, Homo sapiens
aaatgtaagggaaactgccagc

SEQ ID NO: 2616185 - DNA, 15 bp, Homo sapiens
aaatgtactgagatt

SEQ ID NO: 2616186 - DNA, 17 bp, Homo sapiens
aaatgtatcttattcac

SEQ ID NO: 2616187 - DNA, 15 bp, Homo sapiens
aaatgtcagatacaa

SEQ ID NO: 2616188 - DNA, 22 bp, Homo sapiens
aaatgtcagatacaatgtattt

SEQ ID NO: 2616189 - DNA, 21 bp, Homo sapiens
aaatgtctctttaatgtcaca

SEQ ID NO: 2616190 - DNA, 13 bp, Homo sapiens
aaatgtcttgtgt

SEQ ID NO: 2616191 - DNA, 13 bp, Homo sapiens
aaatgtgatgaat

SEQ ID NO: 2616192 - DNA, 21 bp, Homo sapiens
aaatgtgatgaatactgtatt

SEQ ID NO: 2616193 - DNA, 17 bp, Homo sapiens
aaatgtgatttttctga

SEQ ID NO: 2616194 - DNA, 21 bp, Homo sapiens
aaatgttattttttaattatt

SEQ ID NO: 2616195 - DNA, 21 bp, Homo sapiens
aaatgttcagaaggttgctct

SEQ ID NO: 2616196 - DNA, 15 bp, Homo sapiens
aaatgttctttgggg

SEQ ID NO: 2616197 - DNA, 19 bp, Homo sapiens
aaatgttggatttataaat

SEQ ID NO: 2616198 - DNA, 17 bp, Homo sapiens
aaatgttggtcatttta

SEQ ID NO: 2616199 - DNA, 23 bp, Homo sapiens
aaatgtttttctgccagggagct

SEQ ID NO: 2616200 - DNA, 21 bp, Homo sapiens
aaattaaaaaaaaaaaacttt

SEQ ID NO: 2616201 - DNA, 17 bp, Homo sapiens
aaattaacagtcctaac

SEQ ID NO: 2616202 - DNA, 20 bp, Homo sapiens
aaattaaccatagatgtaga

SEQ ID NO: 2616203 - DNA, 21 bp, Homo sapiens
aaattaacttttataaacttt

SEQ ID NO: 2616204 - DNA, 22 bp, Homo sapiens
aaattaacttttataaacttta

SEQ ID NO: 2616205 - DNA, 13 bp, Homo sapiens
aaattaagaagaa

SEQ ID NO: 2616206 - DNA, 14 bp, Homo sapiens
aaattaagaagaaa

SEQ ID NO: 2616207 - DNA, 17 bp, Homo sapiens
aaattaagggttaagaa

SEQ ID NO: 2616208 - DNA, 22 bp, Homo sapiens
aaattacacccaaagaggtatt

SEQ ID NO: 2616209 - DNA, 17 bp, Homo sapiens
aaattactttgtgaata

SEQ ID NO: 2616210 - DNA, 15 bp, Homo sapiens
aaattagccgggcgt

SEQ ID NO: 2616211 - DNA, 15 bp, Homo sapiens
aaattaggaataaat

SEQ ID NO: 2616212 - DNA, 21 bp, Homo sapiens
aaattagttagccaatatttt

SEQ ID NO: 2616213 - DNA, 22 bp, Homo sapiens
aaattataacttaaaatatttt

SEQ ID NO: 2616214 - DNA, 15 bp, Homo sapiens
aaattatatcaattt

SEQ ID NO: 2616215 - DNA, 19 bp, Homo sapiens
aaattatgtatgtttacat

SEQ ID NO: 2616216 - DNA, 14 bp, Homo sapiens
aaattattaatgaa

SEQ ID NO: 2616217 - DNA, 23 bp, Homo sapiens
aaattattagtttacatcatttt

SEQ ID NO: 2616218 - DNA, 15 bp, Homo sapiens
aaattatttaataaa

SEQ ID NO: 2616219 - DNA, 21 bp, Homo sapiens
aaattatttgtgtaatagaaa

SEQ ID NO: 2616220 - DNA, 15 bp, Homo sapiens
aaattattttaaaca

SEQ ID NO: 2616221 - DNA, 16 bp, Homo sapiens
aaattattttaaacaa

SEQ ID NO: 2616222 - DNA, 14 bp, Homo sapiens
aaattcaaaaagtg

SEQ ID NO: 2616223 - DNA, 19 bp, Homo sapiens
aaattcacaagttgtgttt

SEQ ID NO: 2616224 - DNA, 16 bp, Homo sapiens
aaattcacaatagaaa

SEQ ID NO: 2616225 - DNA, 22 bp, Homo sapiens
aaattcaccccctttcctggac

SEQ ID NO: 2616226 - DNA, 20 bp, Homo sapiens
aaattcagatatatttttca

SEQ ID NO: 2616227 - DNA, 16 bp, Homo sapiens
aaattcatattctgtc

SEQ ID NO: 2616228 - DNA, 16 bp, Homo sapiens
aaattccccaccctga

SEQ ID NO: 2616229 - DNA, 18 bp, Homo sapiens
aaattccctggcctttca

SEQ ID NO: 2616230 - DNA, 18 bp, Homo sapiens
aaattcctattgtgattt

SEQ ID NO: 2616231 - DNA, 14 bp, Homo sapiens
aaattcctgtagca

SEQ ID NO: 2616232 - DNA, 22 bp, Homo sapiens
aaattccttagcttagacctca

SEQ ID NO: 2616233 - DNA, 22 bp, Homo sapiens
aaattctataggaacatatgaa

SEQ ID NO: 2616234 - DNA, 13 bp, Homo sapiens
aaattctgtttct

SEQ ID NO: 2616235 - DNA, 14 bp, Homo sapiens
aaattgctccttga

SEQ ID NO: 2616236 - DNA, 14 bp, Homo sapiens
aaattgctgtgtat

SEQ ID NO: 2616237 - DNA, 13 bp, Homo sapiens
aaattgcttgaaa

SEQ ID NO: 2616238 - DNA, 15 bp, Homo sapiens
aaattgggaaaggag

SEQ ID NO: 2616239 - DNA, 20 bp, Homo sapiens
aaattgggaaaggagtagaa

SEQ ID NO: 2616240 - DNA, 22 bp, Homo sapiens
aaattgtatctagtgcagctga

SEQ ID NO: 2616241 - DNA, 23 bp, Homo sapiens
aaattgtccgtgttcatacattt

SEQ ID NO: 2616242 - DNA, 12 bp, Homo sapiens
aaattgtgatgt

SEQ ID NO: 2616243 - DNA, 23 bp, Homo sapiens
aaatttaaagggtgtacttatat

SEQ ID NO: 2616244 - DNA, 15 bp, Homo sapiens
aaatttaagcattgt

SEQ ID NO: 2616245 - DNA, 16 bp, Homo sapiens
aaatttaagcattgtt

SEQ ID NO: 2616246 - DNA, 17 bp, Homo sapiens
aaatttaagcattgttt

SEQ ID NO: 2616247 - DNA, 21 bp, Homo sapiens
aaatttaagtgcgtgtgtaga

SEQ ID NO: 2616248 - DNA, 17 bp, Homo sapiens
aaatttaattcatgttt

SEQ ID NO: 2616249 - DNA, 12 bp, Homo sapiens
aaatttcagatt

SEQ ID NO: 2616250 - DNA, 16 bp, Homo sapiens
aaatttccagtacctt

SEQ ID NO: 2616251 - DNA, 20 bp, Homo sapiens
aaatttccccaacagtgtga

SEQ ID NO: 2616252 - DNA, 14 bp, Homo sapiens
aaatttctggacct

SEQ ID NO: 2616253 - DNA, 16 bp, Homo sapiens
aaatttgaagaatgaa

SEQ ID NO: 2616254 - DNA, 15 bp, Homo sapiens
aaatttggttctaat

SEQ ID NO: 2616255 - DNA, 16 bp, Homo sapiens
aaatttggttctaata

SEQ ID NO: 2616256 - DNA, 16 bp, Homo sapiens
aaatttgtaagtttca

SEQ ID NO: 2616257 - DNA, 14 bp, Homo sapiens
aaattttaatttat

SEQ ID NO: 2616258 - DNA, 21 bp, Homo sapiens
aaattttataaaattaagcaa

SEQ ID NO: 2616259 - DNA, 12 bp, Homo sapiens
aaattttatatg

SEQ ID NO: 2616260 - DNA, 13 bp, Homo sapiens
aaattttattcct

SEQ ID NO: 2616261 - DNA, 12 bp, Homo sapiens
aaattttggcca

SEQ ID NO: 2616262 - DNA, 21 bp, Homo sapiens
aaatttttcagatgcttctgg

SEQ ID NO: 2616263 - DNA, 15 bp, Homo sapiens
aaattttttttcatg

SEQ ID NO: 2616264 - DNA, 17 bp, Homo sapiens
aaattttttttttaata

SEQ ID NO: 2616265 - DNA, 16 bp, Homo sapiens
aacaaaaagcttcccc

SEQ ID NO: 2616266 - DNA, 13 bp, Homo sapiens
aacaaaaattgtc

SEQ ID NO: 2616267 - DNA, 12 bp, Homo sapiens
aacaaaatagaa

SEQ ID NO: 2616268 - DNA, 19 bp, Homo sapiens
aacaaaatttgtttgaaat

SEQ ID NO: 2616269 - DNA, 17 bp, Homo sapiens
aacaaagcacagtgtta

SEQ ID NO: 2616270 - DNA, 15 bp, Homo sapiens
aacaaagctgttgat

SEQ ID NO: 2616271 - DNA, 16 bp, Homo sapiens
aacaaagcttagcagg

SEQ ID NO: 2616272 - DNA, 18 bp, Homo sapiens
aacaaagggttttaatgt

SEQ ID NO: 2616273 - DNA, 13 bp, Homo sapiens
aacaaatatgcaa

SEQ ID NO: 2616274 - DNA, 14 bp, Homo sapiens
aacaaatgtgaagg

SEQ ID NO: 2616275 - DNA, 13 bp, Homo sapiens
aacaacatgtata

SEQ ID NO: 2616276 - DNA, 14 bp, Homo sapiens
aacaacctcaactg

SEQ ID NO: 2616277 - DNA, 15 bp, Homo sapiens
aacaactctttgaga

SEQ ID NO: 2616278 - DNA, 12 bp, Homo sapiens
aagacatgtctg

SEQ ID NO: 2616279 - DNA, 16 bp, Homo sapiens
aagacatgtctgttct

SEQ ID NO: 2616280 - DNA, 22 bp, Homo sapiens
aagaccccacccaagcttggca

SEQ ID NO: 2616281 - DNA, 13 bp, Homo sapiens
aagacccttctcg

SEQ ID NO: 2616282 - DNA, 12 bp, Homo sapiens
aagacctggcaa

SEQ ID NO: 2616283 - DNA, 18 bp, Homo sapiens
aagaccttctccttcacc

SEQ ID NO: 2616284 - DNA, 22 bp, Homo sapiens
aagacgctgtgctgccctgccc

SEQ ID NO: 2616285 - DNA, 23 bp, Homo sapiens
aagacgtgattttgctgtagaag

SEQ ID NO: 2616286 - DNA, 17 bp, Homo sapiens
aagactcattccctaga

SEQ ID NO: 2616287 - DNA, 22 bp, Homo sapiens
aagactctaccagactgtgtat

SEQ ID NO: 2616288 - DNA, 15 bp, Homo sapiens
aagactgagcacctg

SEQ ID NO: 2616289 - DNA, 11 bp, Homo sapiens
aagactggctt

SEQ ID NO: 2616290 - DNA, 13 bp, Homo sapiens
aagactgtaatga

SEQ ID NO: 2616291 - DNA, 16 bp, Homo sapiens
aagactttggaaagag

SEQ ID NO: 2616292 - DNA, 21 bp, Homo sapiens
aagacttttccaaccctcatc

SEQ ID NO: 2616293 - DNA, 14 bp, Homo sapiens
aagagaaaagaaaa

SEQ ID NO: 2616294 - DNA, 14 bp, Homo sapiens
aagagacagtcacc

SEQ ID NO: 2616295 - DNA, 21 bp, Homo sapiens
aagagacctacctcaggttgc

SEQ ID NO: 2616296 - DNA, 15 bp, Homo sapiens
aagagactctggcct

SEQ ID NO: 2616297 - DNA, 13 bp, Homo sapiens
aagagagaaaata

SEQ ID NO: 2616298 - DNA, 16 bp, Homo sapiens
aagagagaaaataaaa

SEQ ID NO: 2616299 - DNA, 15 bp, Homo sapiens
aagagagatgttttg

SEQ ID NO: 2616300 - DNA, 15 bp, Homo sapiens
aagagaggacacaaa

SEQ ID NO: 2616301 - DNA, 14 bp, Homo sapiens
aagagaggagttca

SEQ ID NO: 2616302 - DNA, 16 bp, Homo sapiens
aagagaggagttcaat

SEQ ID NO: 2616303 - DNA, 17 bp, Homo sapiens
aagagaggagttcaatg

SEQ ID NO: 2616304 - DNA, 20 bp, Homo sapiens
aagagaggagttcaatgatc

SEQ ID NO: 2616305 - DNA, 22 bp, Homo sapiens
aagagaggagttcaatgatcta

SEQ ID NO: 2616306 - DNA, 15 bp, Homo sapiens
aagagattcctgagc

SEQ ID NO: 2616307 - DNA, 16 bp, Homo sapiens
aagagattgtggtttc

SEQ ID NO: 2616308 - DNA, 23 bp, Homo sapiens
aagagcaggcacatggaggagct

SEQ ID NO: 2616309 - DNA, 9 bp, Homo sapiens
aagagccat

SEQ ID NO: 2616310 - DNA, 21 bp, Homo sapiens
aagagccatgtagaagctgca

SEQ ID NO: 2616311 - DNA, 18 bp, Homo sapiens
aagagctgttcacagcca

SEQ ID NO: 2616312 - DNA, 23 bp, Homo sapiens
aagaggaatgaagtactcataca

SEQ ID NO: 2616313 - DNA, 23 bp, Homo sapiens
aagaggccctgtctgtacctaac

SEQ ID NO: 2616314 - DNA, 13 bp, Homo sapiens
aagaggctgaggc

SEQ ID NO: 2616315 - DNA, 14 bp, Homo sapiens
aagaggctgaggca

SEQ ID NO: 2616316 - DNA, 17 bp, Homo sapiens
aagaggctggtgctgtg

SEQ ID NO: 2616317 - DNA, 18 bp, Homo sapiens
aagagggagaagcatgaa

SEQ ID NO: 2616318 - DNA, 22 bp, Homo sapiens
aagagggagggagggctccaga

SEQ ID NO: 2616319 - DNA, 19 bp, Homo sapiens
aagaggggaccagaagcca

SEQ ID NO: 2616320 - DNA, 11 bp, Homo sapiens
aagaggggcag

SEQ ID NO: 2616321 - DNA, 15 bp, Homo sapiens
aagaggggcagccct

SEQ ID NO: 2616322 - DNA, 18 bp, Homo sapiens
aagaggttttaaaaaaat

SEQ ID NO: 2616323 - DNA, 18 bp, Homo sapiens
aagagtaaaggaaatgat

SEQ ID NO: 2616324 - DNA, 13 bp, Homo sapiens
aagagtagacatt

SEQ ID NO: 2616325 - DNA, 23 bp, Homo sapiens
aagagtagcaagttctagagaag

SEQ ID NO: 2616326 - DNA, 14 bp, Homo sapiens
aagagtagcatttc

SEQ ID NO: 2616327 - DNA, 17 bp, Homo sapiens
aagagtagcatttcatt

SEQ ID NO: 2616328 - DNA, 14 bp, Homo sapiens
aagagtaggaagac

SEQ ID NO: 2616329 - DNA, 22 bp, Homo sapiens
aagagtagttgatgttgcattt

SEQ ID NO: 2616330 - DNA, 19 bp, Homo sapiens
aagagtgggggagagcagg

SEQ ID NO: 2616331 - DNA, 20 bp, Homo sapiens
aagagtgggggagagcaggc

SEQ ID NO: 2616332 - DNA, 12 bp, Homo sapiens
aagagtgtactg

SEQ ID NO: 2616333 - DNA, 13 bp, Homo sapiens
aagagtgtagaag

SEQ ID NO: 2616334 - DNA, 16 bp, Homo sapiens
aagagtgtagaagcat

SEQ ID NO: 2616335 - DNA, 19 bp, Homo sapiens
aagagttgagtgatagagc

SEQ ID NO: 2616336 - DNA, 13 bp, Homo sapiens
aagataaatgtgc

SEQ ID NO: 2616337 - DNA, 21 bp, Homo sapiens
aagataacaagatctttcagg

SEQ ID NO: 2616338 - DNA, 15 bp, Homo sapiens
aagataacttgagca

SEQ ID NO: 2616339 - DNA, 15 bp, Homo sapiens
aagataataatatat

SEQ ID NO: 2616340 - DNA, 21 bp, Homo sapiens
aagataatattaaggaagaca

SEQ ID NO: 2616341 - DNA, 12 bp, Homo sapiens
aagataattata

SEQ ID NO: 2616342 - DNA, 13 bp, Homo sapiens
aagatacctaaaa

SEQ ID NO: 2616343 - DNA, 14 bp, Homo sapiens
aagatagcagggca

SEQ ID NO: 2616344 - DNA, 14 bp, Homo sapiens
aagataggctctgc

SEQ ID NO: 2616345 - DNA, 16 bp, Homo sapiens
aagataggctctgcac

SEQ ID NO: 2616346 - DNA, 20 bp, Homo sapiens
aagatataactattgcccag

SEQ ID NO: 2616347 - DNA, 21 bp, Homo sapiens
aagatatatacacaggatcct

SEQ ID NO: 2616348 - DNA, 18 bp, Homo sapiens
aagatatttatatatatt

SEQ ID NO: 2616349 - DNA, 17 bp, Homo sapiens
aagatattttgctttgt

SEQ ID NO: 2616350 - DNA, 20 bp, Homo sapiens
aagatattttgctttgtgat

SEQ ID NO: 2616351 - DNA, 19 bp, Homo sapiens
aagatatttttatctttat

SEQ ID NO: 2616352 - DNA, 17 bp, Homo sapiens
aagatcaaaataaaaag

SEQ ID NO: 2616353 - DNA, 15 bp, Homo sapiens
aagatcccctcagga

SEQ ID NO: 2616354 - DNA, 16 bp, Homo sapiens
aagatcccctcaggac

SEQ ID NO: 2616355 - DNA, 14 bp, Homo sapiens
aagatcgttagtat

SEQ ID NO: 2616356 - DNA, 17 bp, Homo sapiens
aagatcgttctctgcct

SEQ ID NO: 2616357 - DNA, 17 bp, Homo sapiens
aagatctgtgcagcccc

SEQ ID NO: 2616358 - DNA, 14 bp, Homo sapiens
aagatgaagaggat

SEQ ID NO: 2616359 - DNA, 15 bp, Homo sapiens
aagatgacattgcta

SEQ ID NO: 2616360 - DNA, 20 bp, Homo sapiens
aagatgacattgctaagatg

SEQ ID NO: 2616361 - DNA, 22 bp, Homo sapiens
aagatgacattgctaagatgct

SEQ ID NO: 2616362 - DNA, 17 bp, Homo sapiens
aagatgagagaactgga

SEQ ID NO: 2616363 - DNA, 18 bp, Homo sapiens
aagatgagagaactggag

SEQ ID NO: 2616364 - DNA, 20 bp, Homo sapiens
aagatgcaaggaccaggact

SEQ ID NO: 2616365 - DNA, 24 bp, Homo sapiens
aagatgcccactgaggaatgatga

SEQ ID NO: 2616366 - DNA, 15 bp, Homo sapiens
aagatgctctatctt

SEQ ID NO: 2616367 - DNA, 10 bp, Homo sapiens
aagatgctgg

SEQ ID NO: 2616368 - DNA, 20 bp, Homo sapiens
aagatgctgggttggtgcac

SEQ ID NO: 2616369 - DNA, 19 bp, Homo sapiens
aagatgcttctcactgcca

SEQ ID NO: 2616370 - DNA, 14 bp, Homo sapiens
aagatggattctca

SEQ ID NO: 2616371 - DNA, 23 bp, Homo sapiens
aagatggcacttataaccaaagc

SEQ ID NO: 2616372 - DNA, 22 bp, Homo sapiens
aagatggcccagctccccaaga

SEQ ID NO: 2616373 - DNA, 17 bp, Homo sapiens
aagatggctgactttgc

SEQ ID NO: 2616374 - DNA, 18 bp, Homo sapiens
aagatgggcagctagttc

SEQ ID NO: 2616375 - DNA, 19 bp, Homo sapiens
aagatgtagaggagaaact

SEQ ID NO: 2616376 - DNA, 20 bp, Homo sapiens
aagatgtcctccttgttcta

SEQ ID NO: 2616377 - DNA, 13 bp, Homo sapiens
aagattagaagct

SEQ ID NO: 2616378 - DNA, 23 bp, Homo sapiens
aagattcacacctgactctgaaa

SEQ ID NO: 2616379 - DNA, 20 bp, Homo sapiens
aagattcatttttaatcatg

SEQ ID NO: 2616380 - DNA, 13 bp, Homo sapiens
aagattctttccc

SEQ ID NO: 2616381 - DNA, 16 bp, Homo sapiens
aagattctttcccaat

SEQ ID NO: 2616382 - DNA, 16 bp, Homo sapiens
aagattgctgaaattt

SEQ ID NO: 2616383 - DNA, 17 bp, Homo sapiens
aagatttatcaaatcag

SEQ ID NO: 2616384 - DNA, 18 bp, Homo sapiens
aagatttatcaaatcagt

SEQ ID NO: 2616385 - DNA, 17 bp, Homo sapiens
aagatttccaagtgcca

SEQ ID NO: 2616386 - DNA, 16 bp, Homo sapiens
aagatttccatataaa

SEQ ID NO: 2616387 - DNA, 16 bp, Homo sapiens
aagatttgctttaatt

SEQ ID NO: 2616388 - DNA, 17 bp, Homo sapiens
aagatttggaataaagt

SEQ ID NO: 2616389 - DNA, 17 bp, Homo sapiens
aagattttgaatgcttc

SEQ ID NO: 2616390 - DNA, 21 bp, Homo sapiens
aagattttgaatgcttcctga

SEQ ID NO: 2616391 - DNA, 13 bp, Homo sapiens
aagcaaaatatta

SEQ ID NO: 2616392 - DNA, 12 bp, Homo sapiens
aagcaaacacat

SEQ ID NO: 2616393 - DNA, 22 bp, Homo sapiens
aagcaaagactttcctcttagt

SEQ ID NO: 2616394 - DNA, 17 bp, Homo sapiens
aagcaaagcaccagctt

SEQ ID NO: 2616395 - DNA, 11 bp, Homo sapiens
aagcaaaggtg

SEQ ID NO: 2616396 - DNA, 14 bp, Homo sapiens
aagcaacaggtttt

SEQ ID NO: 2616397 - DNA, 17 bp, Homo sapiens
aagcaacccaaatgttc

SEQ ID NO: 2616398 - DNA, 20 bp, Homo sapiens
aagcaacctgggtccaaata

SEQ ID NO: 2616399 - DNA, 23 bp, Homo sapiens
aagcaacctgggtccaaataaaa

SEQ ID NO: 2616400 - DNA, 14 bp, Homo sapiens
aagcaataaatgaa

SEQ ID NO: 2616401 - DNA, 20 bp, Homo sapiens
aagcaataatggtcccatcc

SEQ ID NO: 2616402 - DNA, 16 bp, Homo sapiens
aagcaattccaacctt

SEQ ID NO: 2616403 - DNA, 19 bp, Homo sapiens
aagcacagaaggaggagga

SEQ ID NO: 2616404 - DNA, 15 bp, Homo sapiens
aagcacagtgcctgc

SEQ ID NO: 2616405 - DNA, 19 bp, Homo sapiens
aagcacagtggtggcaggg

SEQ ID NO: 2616406 - DNA, 18 bp, Homo sapiens
aagcacagtgttaaatga

SEQ ID NO: 2616407 - DNA, 14 bp, Homo sapiens
aagcacagtttgaa

SEQ ID NO: 2616408 - DNA, 15 bp, Homo sapiens
aagcacagtttgaac

SEQ ID NO: 2616409 - DNA, 18 bp, Homo sapiens
aagcacagtttgaacaaa

SEQ ID NO: 2616410 - DNA, 16 bp, Homo sapiens
aagcacatctgcattt

SEQ ID NO: 2616411 - DNA, 16 bp, Homo sapiens
aagcaccaaaataaga

SEQ ID NO: 2616412 - DNA, 19 bp, Homo sapiens
aagcaccaaaataagaaaa

SEQ ID NO: 2616413 - DNA, 14 bp, Homo sapiens
aagcaccaagctca

SEQ ID NO: 2616414 - DNA, 19 bp, Homo sapiens
aagcaccagcttctccagg

SEQ ID NO: 2616415 - DNA, 14 bp, Homo sapiens
aagcacctcctgcc

SEQ ID NO: 2616416 - DNA, 17 bp, Homo sapiens
aagcacctcctgcctcg

SEQ ID NO: 2616417 - DNA, 19 bp, Homo sapiens
aagcaccttagctggcatt

SEQ ID NO: 2616418 - DNA, 17 bp, Homo sapiens
aagcactacataaactg

SEQ ID NO: 2616419 - DNA, 23 bp, Homo sapiens
aagcactacataaactgacttta

SEQ ID NO: 2616420 - DNA, 16 bp, Homo sapiens
aagcactgacttctaa

SEQ ID NO: 2616421 - DNA, 12 bp, Homo sapiens
aagcactgtgct

SEQ ID NO: 2616422 - DNA, 18 bp, Homo sapiens
aagcactttgggattctt

SEQ ID NO: 2616423 - DNA, 19 bp, Homo sapiens
aagcagatgcaaagaggca

SEQ ID NO: 2616424 - DNA, 12 bp, Homo sapiens
aatatgatttta

SEQ ID NO: 2616425 - DNA, 15 bp, Homo sapiens
aatatgcaaagcact

SEQ ID NO: 2616426 - DNA, 24 bp, Homo sapiens
aatatgcaaagcactgacttctaa

SEQ ID NO: 2616427 - DNA, 18 bp, Homo sapiens
aatatgcacacagtgctt

SEQ ID NO: 2616428 - DNA, 15 bp, Homo sapiens
aatatgcacacattt

SEQ ID NO: 2616429 - DNA, 22 bp, Homo sapiens
aatatgcagtgatatggcagaa

SEQ ID NO: 2616430 - DNA, 17 bp, Homo sapiens
aatatgcctttttgaag

SEQ ID NO: 2616431 - DNA, 14 bp, Homo sapiens
aatatgctgccaaa

SEQ ID NO: 2616432 - DNA, 22 bp, Homo sapiens
aatatgctgccaaattttggcc

SEQ ID NO: 2616433 - DNA, 17 bp, Homo sapiens
aatatggaacttctaat

SEQ ID NO: 2616434 - DNA, 18 bp, Homo sapiens
aatatggaacttctaata

SEQ ID NO: 2616435 - DNA, 18 bp, Homo sapiens
aatatggtgtacattctt

SEQ ID NO: 2616436 - DNA, 14 bp, Homo sapiens
aatattaaatacag

SEQ ID NO: 2616437 - DNA, 19 bp, Homo sapiens
aatattaaatacagacact

SEQ ID NO: 2616438 - DNA, 14 bp, Homo sapiens
aatattagatgtga

SEQ ID NO: 2616439 - DNA, 16 bp, Homo sapiens
aatattagatgtgatt

SEQ ID NO: 2616440 - DNA, 15 bp, Homo sapiens
aatattatactaaga

SEQ ID NO: 2616441 - DNA, 18 bp, Homo sapiens
aatattcatagtttaatt

SEQ ID NO: 2616442 - DNA, 20 bp, Homo sapiens
aatattcccctatctctaga

SEQ ID NO: 2616443 - DNA, 15 bp, Homo sapiens
aatattcctgcattt

SEQ ID NO: 2616444 - DNA, 16 bp, Homo sapiens
aatattgagaaagaaa

SEQ ID NO: 2616445 - DNA, 13 bp, Homo sapiens
aatattgtttcta

SEQ ID NO: 2616446 - DNA, 17 bp, Homo sapiens
aatatttaaacagcagt

SEQ ID NO: 2616447 - DNA, 19 bp, Homo sapiens
aatatttaaacagcagtgt

SEQ ID NO: 2616448 - DNA, 17 bp, Homo sapiens
aatatttaagatagttt

SEQ ID NO: 2616449 - DNA, 14 bp, Homo sapiens
aatatttagcaaat

SEQ ID NO: 2616450 - DNA, 17 bp, Homo sapiens
aatatttatatatttat

SEQ ID NO: 2616451 - DNA, 14 bp, Homo sapiens
aatatttatatttc

SEQ ID NO: 2616452 - DNA, 13 bp, Homo sapiens
aatatttattacc

SEQ ID NO: 2616453 - DNA, 17 bp, Homo sapiens
aatatttattacctctg

SEQ ID NO: 2616454 - DNA, 16 bp, Homo sapiens
aatatttccatatgga

SEQ ID NO: 2616455 - DNA, 21 bp, Homo sapiens
aatattttccatgaaaatgca

SEQ ID NO: 2616456 - DNA, 13 bp, Homo sapiens
aatattttgaatc

SEQ ID NO: 2616457 - DNA, 20 bp, Homo sapiens
aatattttgaatcaataata

SEQ ID NO: 2616458 - DNA, 17 bp, Homo sapiens
aatattttttatatata

SEQ ID NO: 2616459 - DNA, 19 bp, Homo sapiens
aatattttttatatataca

SEQ ID NO: 2616460 - DNA, 18 bp, Homo sapiens
aatattttttcttttcta

SEQ ID NO: 2616461 - DNA, 10 bp, Homo sapiens
aatcaaaact

SEQ ID NO: 2616462 - DNA, 16 bp, Homo sapiens
aatcaaagacatggaa

SEQ ID NO: 2616463 - DNA, 16 bp, Homo sapiens
aatcaaagcaatgcat

SEQ ID NO: 2616464 - DNA, 18 bp, Homo sapiens
aatcaaagcaatgcattt

SEQ ID NO: 2616465 - DNA, 22 bp, Homo sapiens
aatcaaatatgcaaagcactga

SEQ ID NO: 2616466 - DNA, 23 bp, Homo sapiens
aatcaagcctctggtcacatggc

SEQ ID NO: 2616467 - DNA, 23 bp, Homo sapiens
aatcaagggcaaaaagtctacat

SEQ ID NO: 2616468 - DNA, 23 bp, Homo sapiens
aatcaagttggcttctaatcaaa

SEQ ID NO: 2616469 - DNA, 13 bp, Homo sapiens
aatcaataaacga

SEQ ID NO: 2616470 - DNA, 16 bp, Homo sapiens
aatcaataaacgattt

SEQ ID NO: 2616471 - DNA, 12 bp, Homo sapiens
aatcaataatat

SEQ ID NO: 2616472 - DNA, 20 bp, Homo sapiens
aatcaatttaaacccatttt

SEQ ID NO: 2616473 - DNA, 16 bp, Homo sapiens
aatcacgctttcctga

SEQ ID NO: 2616474 - DNA, 18 bp, Homo sapiens
aatcactctgtccttgga

SEQ ID NO: 2616475 - DNA, 23 bp, Homo sapiens
aatcagcctaggggtcagggacc

SEQ ID NO: 2616476 - DNA, 12 bp, Homo sapiens
aatcagcctctt

SEQ ID NO: 2616477 - DNA, 19 bp, Homo sapiens
aatcagcctgctccagctg

SEQ ID NO: 2616478 - DNA, 18 bp, Homo sapiens
aatcagggaggtcatttt

SEQ ID NO: 2616479 - DNA, 19 bp, Homo sapiens
aatcagggaggtcattttg

SEQ ID NO: 2616480 - DNA, 20 bp, Homo sapiens
aatcagtctatccacagaga

SEQ ID NO: 2616481 - DNA, 20 bp, Homo sapiens
aatcataagatatttttcat

SEQ ID NO: 2616482 - DNA, 23 bp, Homo sapiens
aatcataagatatttttcatgat

SEQ ID NO: 2616483 - DNA, 18 bp, Homo sapiens
aatcatataataaatgta

SEQ ID NO: 2616484 - DNA, 15 bp, Homo sapiens
aatcatctataaaga

SEQ ID NO: 2616485 - DNA, 20 bp, Homo sapiens
aatcatgaagatatttttcc

SEQ ID NO: 2616486 - DNA, 15 bp, Homo sapiens
aatcatggtttttct

SEQ ID NO: 2616487 - DNA, 15 bp, Homo sapiens
aatcatgtgaacccg

SEQ ID NO: 2616488 - DNA, 15 bp, Homo sapiens
aatcattctcgattt

SEQ ID NO: 2616489 - DNA, 19 bp, Homo sapiens
aatcattgctttgaagcag

SEQ ID NO: 2616490 - DNA, 22 bp, Homo sapiens
aatcattgctttgaagcagttg

SEQ ID NO: 2616491 - DNA, 18 bp, Homo sapiens
aatcatttgttcaaagct

SEQ ID NO: 2616492 - DNA, 19 bp, Homo sapiens
aatcattttaattattatt

SEQ ID NO: 2616493 - DNA, 22 bp, Homo sapiens
aatcattttaattattattctt

SEQ ID NO: 2616494 - DNA, 22 bp, Homo sapiens
aatccaagatattttaaaatct

SEQ ID NO: 2616495 - DNA, 12 bp, Homo sapiens
aatccacccatc

SEQ ID NO: 2616496 - DNA, 15 bp, Homo sapiens
aatccactcccaggc

SEQ ID NO: 2616497 - DNA, 23 bp, Homo sapiens
aatccatctaaatacctgccctg

SEQ ID NO: 2616498 - DNA, 12 bp, Homo sapiens
aatccatgtaag

SEQ ID NO: 2616499 - DNA, 17 bp, Homo sapiens
aatccatgttagttttt

SEQ ID NO: 2616500 - DNA, 18 bp, Homo sapiens
aatcccacccacatgtga

SEQ ID NO: 2616501 - DNA, 15 bp, Homo sapiens
aatcccccttgccac

SEQ ID NO: 2616502 - DNA, 18 bp, Homo sapiens
aatcccccttgccacccc

SEQ ID NO: 2616503 - DNA, 17 bp, Homo sapiens
aatcccgccacctatct

SEQ ID NO: 2616504 - DNA, 17 bp, Homo sapiens
aatccctgggcattgct

SEQ ID NO: 2616505 - DNA, 21 bp, Homo sapiens
aatccctgggcattgctttcc

SEQ ID NO: 2616506 - DNA, 17 bp, Homo sapiens
aatccctgtttaatatt

SEQ ID NO: 2616507 - DNA, 12 bp, Homo sapiens
aatccgaacctc

SEQ ID NO: 2616508 - DNA, 20 bp, Homo sapiens
aatcctattctcgggctgag

SEQ ID NO: 2616509 - DNA, 15 bp, Homo sapiens
aatcctcactgggtg

SEQ ID NO: 2616510 - DNA, 18 bp, Homo sapiens
aatcctcttcctctgagg

SEQ ID NO: 2616511 - DNA, 20 bp, Homo sapiens
aatcctcttcctctgaggct

SEQ ID NO: 2616512 - DNA, 12 bp, Homo sapiens
aatcctgccccc

SEQ ID NO: 2616513 - DNA, 21 bp, Homo sapiens
aatcctggggaacatagaact

SEQ ID NO: 2616514 - DNA, 13 bp, Homo sapiens
aatccttgcttat

SEQ ID NO: 2616515 - DNA, 17 bp, Homo sapiens
aatccttgcttatgaca

SEQ ID NO: 2616516 - DNA, 18 bp, Homo sapiens
aatccttgcttatgacat

SEQ ID NO: 2616517 - DNA, 20 bp, Homo sapiens
aatcctttttctttataaac

SEQ ID NO: 2616518 - DNA, 17 bp, Homo sapiens
aatcgaggaaccagagc

SEQ ID NO: 2616519 - DNA, 18 bp, Homo sapiens
aatcgaggaaccagagcc

SEQ ID NO: 2616520 - DNA, 19 bp, Homo sapiens
aatcgaggaaccagagcca

SEQ ID NO: 2616521 - DNA, 13 bp, Homo sapiens
aatcgatggggga

SEQ ID NO: 2616522 - DNA, 21 bp, Homo sapiens
aatcggatctggggctctggg

SEQ ID NO: 2616523 - DNA, 17 bp, Homo sapiens
aatcgttatgtgtgtat

SEQ ID NO: 2616524 - DNA, 14 bp, Homo sapiens
aatctaaagccagt

SEQ ID NO: 2616525 - DNA, 17 bp, Homo sapiens
aatctaatattaaaaat

SEQ ID NO: 2616526 - DNA, 20 bp, Homo sapiens
aatctaatattaaaaatatg

SEQ ID NO: 2616527 - DNA, 15 bp, Homo sapiens
aatctaccttctgta

SEQ ID NO: 2616528 - DNA, 16 bp, Homo sapiens
aatctaccttctgtag

SEQ ID NO: 2616529 - DNA, 22 bp, Homo sapiens
aatctaccttctgtagttttat

SEQ ID NO: 2616530 - DNA, 12 bp, Homo sapiens
aatctattatac

SEQ ID NO: 2616531 - DNA, 17 bp, Homo sapiens
aatctattatactgtat

SEQ ID NO: 2616532 - DNA, 19 bp, Homo sapiens
aatctattcagacaagcaa

SEQ ID NO: 2616533 - DNA, 17 bp, Homo sapiens
aatctattgggttcatt

SEQ ID NO: 2616534 - DNA, 12 bp, Homo sapiens
aatctatttcta

SEQ ID NO: 2616535 - DNA, 20 bp, Homo sapiens
aatctcaaattctcaaccta

SEQ ID NO: 2616536 - DNA, 16 bp, Homo sapiens
aatctcaaatttctaa

SEQ ID NO: 2616537 - DNA, 17 bp, Homo sapiens
aatctcaaatttctaaa

SEQ ID NO: 2616538 - DNA, 18 bp, Homo sapiens
aatctcaaatttctaaat

SEQ ID NO: 2616539 - DNA, 22 bp, Homo sapiens
aatctcaccccatcccacaccc

SEQ ID NO: 2616540 - DNA, 22 bp, Homo sapiens
aatctcagcaatgattactctt

SEQ ID NO: 2616541 - DNA, 23 bp, Homo sapiens
aatctcataggttgccaataata

SEQ ID NO: 2616542 - DNA, 13 bp, Homo sapiens
aatctccaaaata

SEQ ID NO: 2616543 - DNA, 14 bp, Homo sapiens
aatctccaaaataa

SEQ ID NO: 2616544 - DNA, 15 bp, Homo sapiens
aatctcgtttcaaaa

SEQ ID NO: 2616545 - DNA, 16 bp, Homo sapiens
aatctctccattcccg

SEQ ID NO: 2616546 - DNA, 21 bp, Homo sapiens
aatctggaccccatctgtgaa

SEQ ID NO: 2616547 - DNA, 22 bp, Homo sapiens
aatctggaccccatctgtgaat

SEQ ID NO: 2616548 - DNA, 15 bp, Homo sapiens
aatctggactcctct

SEQ ID NO: 2616549 - DNA, 16 bp, Homo sapiens
aatctggactcctctg

SEQ ID NO: 2616550 - DNA, 12 bp, Homo sapiens
aatctgtaaact

SEQ ID NO: 2616551 - DNA, 16 bp, Homo sapiens
aatctgtaaactgtgt

SEQ ID NO: 2616552 - DNA, 23 bp, Homo sapiens
aatctgtaaactgtgtattccaa

SEQ ID NO: 2616553 - DNA, 20 bp, Homo sapiens
aatctgtatctgtagtgaga

SEQ ID NO: 2616554 - DNA, 20 bp, Homo sapiens
aatctgtccaaaggaggctg

SEQ ID NO: 2616555 - DNA, 13 bp, Homo sapiens
aatctgtgtacaa

SEQ ID NO: 2616556 - DNA, 17 bp, Homo sapiens
aatctgtgtacaaagaa

SEQ ID NO: 2616557 - DNA, 18 bp, Homo sapiens
aatctgtgtacaaagaaa

SEQ ID NO: 2616558 - DNA, 19 bp, Homo sapiens
aatctgtgtacaaagaaat

SEQ ID NO: 2616559 - DNA, 17 bp, Homo sapiens
aatctgtttgatccctg

SEQ ID NO: 2616560 - DNA, 18 bp, Homo sapiens
aatcttacagctgggtgg

SEQ ID NO: 2616561 - DNA, 15 bp, Homo sapiens
aatcttatattccat

SEQ ID NO: 2616562 - DNA, 22 bp, Homo sapiens
aatcttcagttttatctttaat

SEQ ID NO: 2616563 - DNA, 19 bp, Homo sapiens
aatctttctttacctgaga

SEQ ID NO: 2616564 - DNA, 22 bp, Homo sapiens
aatctttcttttgattcttcct

SEQ ID NO: 2616565 - DNA, 21 bp, Homo sapiens
aatcttttaaaaattcaaatg

SEQ ID NO: 2616566 - DNA, 16 bp, Homo sapiens
aatcttttcacaaata

SEQ ID NO: 2616567 - DNA, 14 bp, Homo sapiens
aatgaaaaattctc

SEQ ID NO: 2616568 - DNA, 17 bp, Homo sapiens
acacaggcccggctcca

SEQ ID NO: 2616569 - DNA, 23 bp, Homo sapiens
acacaggcccggctccaggctcc

SEQ ID NO: 2616570 - DNA, 24 bp, Homo sapiens
acacaggcccggctccaggctcct

SEQ ID NO: 2616571 - DNA, 18 bp, Homo sapiens
acacagtattacttctgc

SEQ ID NO: 2616572 - DNA, 22 bp, Homo sapiens
acacagtattacttctgctaca

SEQ ID NO: 2616573 - DNA, 17 bp, Homo sapiens
acacatagcatgtaatg

SEQ ID NO: 2616574 - DNA, 22 bp, Homo sapiens
acacatcagcttgccctgttaa

SEQ ID NO: 2616575 - DNA, 20 bp, Homo sapiens
acacatccctaatgtgtgcc

SEQ ID NO: 2616576 - DNA, 13 bp, Homo sapiens
acacatcttccct

SEQ ID NO: 2616577 - DNA, 13 bp, Homo sapiens
acacatctttcct

SEQ ID NO: 2616578 - DNA, 18 bp, Homo sapiens
acacatgatcctgcaatt

SEQ ID NO: 2616579 - DNA, 18 bp, Homo sapiens
acacatgcaaggtcattt

SEQ ID NO: 2616580 - DNA, 20 bp, Homo sapiens
acacatgcaaggtcattttt

SEQ ID NO: 2616581 - DNA, 18 bp, Homo sapiens
acacatgcatacacacac

SEQ ID NO: 2616582 - DNA, 19 bp, Homo sapiens
acacatgtccaagaagccc

SEQ ID NO: 2616583 - DNA, 20 bp, Homo sapiens
acacattatcgggagcagtg

SEQ ID NO: 2616584 - DNA, 16 bp, Homo sapiens
acacattcaataagca

SEQ ID NO: 2616585 - DNA, 12 bp, Homo sapiens
acacattttgta

SEQ ID NO: 2616586 - DNA, 13 bp, Homo sapiens
acacattttgtat

SEQ ID NO: 2616587 - DNA, 21 bp, Homo sapiens
acacattttgtataattgtat

SEQ ID NO: 2616588 - DNA, 14 bp, Homo sapiens
acacattttttaaa

SEQ ID NO: 2616589 - DNA, 22 bp, Homo sapiens
acacattttttaaatgcacctg

SEQ ID NO: 2616590 - DNA, 12 bp, Homo sapiens
acaccacagaca

SEQ ID NO: 2616591 - DNA, 18 bp, Homo sapiens
acaccacagacacacaca

SEQ ID NO: 2616592 - DNA, 21 bp, Homo sapiens
acaccacagacacacacacgc

SEQ ID NO: 2616593 - DNA, 18 bp, Homo sapiens
acaccacctcactcctgt

SEQ ID NO: 2616594 - DNA, 20 bp, Homo sapiens
acaccactacattctgttaa

SEQ ID NO: 2616595 - DNA, 13 bp, Homo sapiens
acaccagagccca

SEQ ID NO: 2616596 - DNA, 18 bp, Homo sapiens
acaccagagcccaccttg

SEQ ID NO: 2616597 - DNA, 14 bp, Homo sapiens
acaccagccaggct

SEQ ID NO: 2616598 - DNA, 16 bp, Homo sapiens
acaccagccaggctct

SEQ ID NO: 2616599 - DNA, 17 bp, Homo sapiens
acaccagccaggctctg

SEQ ID NO: 2616600 - DNA, 17 bp, Homo sapiens
acaccaggagtccctgg

SEQ ID NO: 2616601 - DNA, 19 bp, Homo sapiens
acaccaggagtccctggta

SEQ ID NO: 2616602 - DNA, 22 bp, Homo sapiens
acaccaggccgtcctcccgggc

SEQ ID NO: 2616603 - DNA, 19 bp, Homo sapiens
acacccaaagaggtattta

SEQ ID NO: 2616604 - DNA, 20 bp, Homo sapiens
acacccaaagaggtatttat

SEQ ID NO: 2616605 - DNA, 22 bp, Homo sapiens
acacccaccgtccgccctgctc

SEQ ID NO: 2616606 - DNA, 13 bp, Homo sapiens
acacccagcccac

SEQ ID NO: 2616607 - DNA, 19 bp, Homo sapiens
acacccagcccacttctgc

SEQ ID NO: 2616608 - DNA, 13 bp, Homo sapiens
acaccctcccccg

SEQ ID NO: 2616609 - DNA, 16 bp, Homo sapiens
acaccctcccccgcca

SEQ ID NO: 2616610 - DNA, 19 bp, Homo sapiens
acaccctcccccgccactc

SEQ ID NO: 2616611 - DNA, 17 bp, Homo sapiens
acaccctctcccaggac

SEQ ID NO: 2616612 - DNA, 13 bp, Homo sapiens
acaccctgtactg

SEQ ID NO: 2616613 - DNA, 18 bp, Homo sapiens
acaccctgtgatggggcc

SEQ ID NO: 2616614 - DNA, 15 bp, Homo sapiens
acaccgagggcgacc

SEQ ID NO: 2616615 - DNA, 22 bp, Homo sapiens
acaccgccacatggcttcctcc

SEQ ID NO: 2616616 - DNA, 17 bp, Homo sapiens
acaccgtgtaaaccaaa

SEQ ID NO: 2616617 - DNA, 20 bp, Homo sapiens
acaccgtgtaaaccaaagcc

SEQ ID NO: 2616618 - DNA, 15 bp, Homo sapiens
acacctaactcacct

SEQ ID NO: 2616619 - DNA, 21 bp, Homo sapiens
acacctcagaggctgttcttg

SEQ ID NO: 2616620 - DNA, 19 bp, Homo sapiens
acacctctgcacaagctgc

SEQ ID NO: 2616621 - DNA, 18 bp, Homo sapiens
acacctgactctgaaatc

SEQ ID NO: 2616622 - DNA, 17 bp, Homo sapiens
acacctgagccagcctg

SEQ ID NO: 2616623 - DNA, 17 bp, Homo sapiens
acacctgatgtgtacat

SEQ ID NO: 2616624 - DNA, 17 bp, Homo sapiens
acacctgggcttaagaa

SEQ ID NO: 2616625 - DNA, 19 bp, Homo sapiens
acacctgtagtcccagcta

SEQ ID NO: 2616626 - DNA, 14 bp, Homo sapiens
acaccttccagctc

SEQ ID NO: 2616627 - DNA, 16 bp, Homo sapiens
acaccttccagctcct

SEQ ID NO: 2616628 - DNA, 20 bp, Homo sapiens
acaccttccagctcctgtaa

SEQ ID NO: 2616629 - DNA, 15 bp, Homo sapiens
acaccttgacagggc

SEQ ID NO: 2616630 - DNA, 15 bp, Homo sapiens
acaccttttaactca

SEQ ID NO: 2616631 - DNA, 14 bp, Homo sapiens
acacgagcaggcta

SEQ ID NO: 2616632 - DNA, 13 bp, Homo sapiens
acacgcacacaca

SEQ ID NO: 2616633 - DNA, 18 bp, Homo sapiens
acacgcacgcacacacac

SEQ ID NO: 2616634 - DNA, 15 bp, Homo sapiens
acacgcgtgcacaca

SEQ ID NO: 2616635 - DNA, 17 bp, Homo sapiens
acacggaggcatctgca

SEQ ID NO: 2616636 - DNA, 20 bp, Homo sapiens
acacgggagccgctggcaga

SEQ ID NO: 2616637 - DNA, 16 bp, Homo sapiens
acacgggggcagctga

SEQ ID NO: 2616638 - DNA, 19 bp, Homo sapiens
acacggtttgaagcctgga

SEQ ID NO: 2616639 - DNA, 22 bp, Homo sapiens
acacggtttgaagcctggaaca

SEQ ID NO: 2616640 - DNA, 20 bp, Homo sapiens
acacgtggaggaatgctccc

SEQ ID NO: 2616641 - DNA, 21 bp, Homo sapiens
acacgtggaggaatgctcccc

SEQ ID NO: 2616642 - DNA, 15 bp, Homo sapiens
acactaaccacgctg

SEQ ID NO: 2616643 - DNA, 20 bp, Homo sapiens
acactaaccacgctggacct

SEQ ID NO: 2616644 - DNA, 14 bp, Homo sapiens
acactaacctgacc

SEQ ID NO: 2616645 - DNA, 14 bp, Homo sapiens
acactaagggtgta

SEQ ID NO: 2616646 - DNA, 17 bp, Homo sapiens
acactaattcctttcta

SEQ ID NO: 2616647 - DNA, 23 bp, Homo sapiens
acactaattcctttctatcctac

SEQ ID NO: 2616648 - DNA, 14 bp, Homo sapiens
acactacattagaa

SEQ ID NO: 2616649 - DNA, 20 bp, Homo sapiens
acactagcccaatgaaatga

SEQ ID NO: 2616650 - DNA, 13 bp, Homo sapiens
acactagcctctc

SEQ ID NO: 2616651 - DNA, 18 bp, Homo sapiens
acactagttttgtgccag

SEQ ID NO: 2616652 - DNA, 19 bp, Homo sapiens
acactagttttgtgccagc

SEQ ID NO: 2616653 - DNA, 15 bp, Homo sapiens
acactatatctgtat

SEQ ID NO: 2616654 - DNA, 17 bp, Homo sapiens
acactcaaatcaagaaa

SEQ ID NO: 2616655 - DNA, 18 bp, Homo sapiens
acactcaaatcaagaaac

SEQ ID NO: 2616656 - DNA, 15 bp, Homo sapiens
acactcaagaagcag

SEQ ID NO: 2616657 - DNA, 16 bp, Homo sapiens
acactcaagaagcagg

SEQ ID NO: 2616658 - DNA, 13 bp, Homo sapiens
acactcatgctga

SEQ ID NO: 2616659 - DNA, 16 bp, Homo sapiens
acactcattgacctga

SEQ ID NO: 2616660 - DNA, 17 bp, Homo sapiens
acactcattgacctgag

SEQ ID NO: 2616661 - DNA, 21 bp, Homo sapiens
acactcattgacctgaggccc

SEQ ID NO: 2616662 - DNA, 21 bp, Homo sapiens
acactccaattaaggatttta

SEQ ID NO: 2616663 - DNA, 14 bp, Homo sapiens
acactccagtgaga

SEQ ID NO: 2616664 - DNA, 16 bp, Homo sapiens
acactccagtgccagc

SEQ ID NO: 2616665 - DNA, 19 bp, Homo sapiens
acactccagtgccagcaat

SEQ ID NO: 2616666 - DNA, 17 bp, Homo sapiens
acactcccctgcactgg

SEQ ID NO: 2616667 - DNA, 16 bp, Homo sapiens
acactcctacacctaa

SEQ ID NO: 2616668 - DNA, 23 bp, Homo sapiens
acactcctagagaacgcagccct

SEQ ID NO: 2616669 - DNA, 16 bp, Homo sapiens
acactcgcccgcccac

SEQ ID NO: 2616670 - DNA, 12 bp, Homo sapiens
acactctttgta

SEQ ID NO: 2616671 - DNA, 17 bp, Homo sapiens
acactgaaatatacaca

SEQ ID NO: 2616672 - DNA, 18 bp, Homo sapiens
acactgaaatatacacac

SEQ ID NO: 2616673 - DNA, 14 bp, Homo sapiens
acactgaggcaggg

SEQ ID NO: 2616674 - DNA, 17 bp, Homo sapiens
acactgaggcagggaag

SEQ ID NO: 2616675 - DNA, 22 bp, Homo sapiens
acactgcactcttaagcttccg

SEQ ID NO: 2616676 - DNA, 23 bp, Homo sapiens
acactgcttgtgtttttaactca

SEQ ID NO: 2616677 - DNA, 16 bp, Homo sapiens
acactggactccggcc

SEQ ID NO: 2616678 - DNA, 12 bp, Homo sapiens
acactggcccct

SEQ ID NO: 2616679 - DNA, 16 bp, Homo sapiens
acactggcccctagaa

SEQ ID NO: 2616680 - DNA, 13 bp, Homo sapiens
acactgggacttg

SEQ ID NO: 2616681 - DNA, 23 bp, Homo sapiens
acactgggagaggtgccagcaac

SEQ ID NO: 2616682 - DNA, 15 bp, Homo sapiens
acactgggggagggg

SEQ ID NO: 2616683 - DNA, 16 bp, Homo sapiens
acactgggggagggga

SEQ ID NO: 2616684 - DNA, 20 bp, Homo sapiens
acactggggtgccgcctgcc

SEQ ID NO: 2616685 - DNA, 21 bp, Homo sapiens
acactggggtgccgcctgccc

SEQ ID NO: 2616686 - DNA, 18 bp, Homo sapiens
acactggtattcctgcct

SEQ ID NO: 2616687 - DNA, 14 bp, Homo sapiens
acactggtgactgc

SEQ ID NO: 2616688 - DNA, 21 bp, Homo sapiens
acactggtgtgacctgagggc

SEQ ID NO: 2616689 - DNA, 21 bp, Homo sapiens
acactgtatttgtatctctga

SEQ ID NO: 2616690 - DNA, 22 bp, Homo sapiens
acactgtctggtttcaccgagg

SEQ ID NO: 2616691 - DNA, 18 bp, Homo sapiens
acactgtgcacatctgtg

SEQ ID NO: 2616692 - DNA, 20 bp, Homo sapiens
acactgtgcacatctgtgtc

SEQ ID NO: 2616693 - DNA, 14 bp, Homo sapiens
acactgtgccctgg

SEQ ID NO: 2616694 - DNA, 16 bp, Homo sapiens
acactgtgccctggtg

SEQ ID NO: 2616695 - DNA, 22 bp, Homo sapiens
acactgtgctgagtctgaaggc

SEQ ID NO: 2616696 - DNA, 15 bp, Homo sapiens
acactgttctctgcc

SEQ ID NO: 2616697 - DNA, 16 bp, Homo sapiens
acactgttctctgccc

SEQ ID NO: 2616698 - DNA, 18 bp, Homo sapiens
acactgttctctgccctc

SEQ ID NO: 2616699 - DNA, 23 bp, Homo sapiens
acactgtttacaagaaaaaatga

SEQ ID NO: 2616700 - DNA, 20 bp, Homo sapiens
acactgtttcaaactttact

SEQ ID NO: 2616701 - DNA, 23 bp, Homo sapiens
acactgtttcaaactttactatg

SEQ ID NO: 2616702 - DNA, 15 bp, Homo sapiens
acacttaaaaatggt

SEQ ID NO: 2616703 - DNA, 13 bp, Homo sapiens
acacttaacagat

SEQ ID NO: 2616704 - DNA, 13 bp, Homo sapiens
acacttcagagag

SEQ ID NO: 2616705 - DNA, 16 bp, Homo sapiens
acacttcagagagctg

SEQ ID NO: 2616706 - DNA, 17 bp, Homo sapiens
acacttccaccagcctg

SEQ ID NO: 2616707 - DNA, 14 bp, Homo sapiens
acacttcctgtcca

SEQ ID NO: 2616708 - DNA, 20 bp, Homo sapiens
acacttctgtgagaccccca

SEQ ID NO: 2616709 - DNA, 23 bp, Homo sapiens
acacttctgtgagacccccacac

SEQ ID NO: 2616710 - DNA, 13 bp, Homo sapiens
acacttgtgtgtg

SEQ ID NO: 2616711 - DNA, 18 bp, Homo sapiens
acacttgtgtgtgggctg

SEQ ID NO: 2616712 - DNA, 21 bp, Homo sapiens
accaacatactcccatctgtg

SEQ ID NO: 2616713 - DNA, 14 bp, Homo sapiens
accaacgtctgtgc

SEQ ID NO: 2616714 - DNA, 14 bp, Homo sapiens
accaactcttgcag

SEQ ID NO: 2616715 - DNA, 12 bp, Homo sapiens
accaactttctg

SEQ ID NO: 2616716 - DNA, 19 bp, Homo sapiens
accaactttctgtaaactc

SEQ ID NO: 2616717 - DNA, 16 bp, Homo sapiens
accaagaagatgtctt

SEQ ID NO: 2616718 - DNA, 19 bp, Homo sapiens
accaagaagcctttcctgt

SEQ ID NO: 2616719 - DNA, 16 bp, Homo sapiens
accaagactctgaaat

SEQ ID NO: 2616720 - DNA, 20 bp, Homo sapiens
accaagagagaaagaagtag

SEQ ID NO: 2616721 - DNA, 13 bp, Homo sapiens
accaagcaggaaa

SEQ ID NO: 2616722 - DNA, 14 bp, Homo sapiens
accaagcaggaagc

SEQ ID NO: 2616723 - DNA, 17 bp, Homo sapiens
accaagcaggaagctca

SEQ ID NO: 2616724 - DNA, 16 bp, Homo sapiens
accaaggacccctcac

SEQ ID NO: 2616725 - DNA, 18 bp, Homo sapiens
accaaggacccctcacct

SEQ ID NO: 2616726 - DNA, 17 bp, Homo sapiens
accaaggcaaggcaggt

SEQ ID NO: 2616727 - DNA, 18 bp, Homo sapiens
accaaggcaaggcaggtg

SEQ ID NO: 2616728 - DNA, 19 bp, Homo sapiens
accaaggcaaggcaggtgc

SEQ ID NO: 2616729 - DNA, 20 bp, Homo sapiens
accaaggcaaggcaggtgcc

SEQ ID NO: 2616730 - DNA, 15 bp, Homo sapiens
accaagtatttatta

SEQ ID NO: 2616731 - DNA, 23 bp, Homo sapiens
accaagttataaatcaatgtcac

SEQ ID NO: 2616732 - DNA, 13 bp, Homo sapiens
accaatagattcc

SEQ ID NO: 2616733 - DNA, 15 bp, Homo sapiens
accaatattgtacag

SEQ ID NO: 2616734 - DNA, 19 bp, Homo sapiens
accaatattgtacagtttt

SEQ ID NO: 2616735 - DNA, 11 bp, Homo sapiens
accaatatttg

SEQ ID NO: 2616736 - DNA, 13 bp, Homo sapiens
accaatcatttta

SEQ ID NO: 2616737 - DNA, 17 bp, Homo sapiens
accaatgaaaaaatgta

SEQ ID NO: 2616738 - DNA, 17 bp, Homo sapiens
accaatgcatgcagcca

SEQ ID NO: 2616739 - DNA, 18 bp, Homo sapiens
accaatgcatgcagccac

SEQ ID NO: 2616740 - DNA, 18 bp, Homo sapiens
accaatgcttttatcaaa

SEQ ID NO: 2616741 - DNA, 19 bp, Homo sapiens
accaatgcttttatcaaac

SEQ ID NO: 2616742 - DNA, 14 bp, Homo sapiens
accacaaaaattga

SEQ ID NO: 2616743 - DNA, 18 bp, Homo sapiens
accacaaatagtgctcgc

SEQ ID NO: 2616744 - DNA, 15 bp, Homo sapiens
accacaccaaacctc

SEQ ID NO: 2616745 - DNA, 23 bp, Homo sapiens
accacacccagcccacttctgcc

SEQ ID NO: 2616746 - DNA, 15 bp, Homo sapiens
accacacctccctga

SEQ ID NO: 2616747 - DNA, 22 bp, Homo sapiens
accacacctccctgaaccatcc

SEQ ID NO: 2616748 - DNA, 16 bp, Homo sapiens
accacacttcctgtcc

SEQ ID NO: 2616749 - DNA, 16 bp, Homo sapiens
accacagacacacaca

SEQ ID NO: 2616750 - DNA, 11 bp, Homo sapiens
accacagcagt

SEQ ID NO: 2616751 - DNA, 17 bp, Homo sapiens
accacagccctgtcagt

SEQ ID NO: 2616752 - DNA, 15 bp, Homo sapiens
accacagctgctgga

SEQ ID NO: 2616753 - DNA, 17 bp, Homo sapiens
accacagggttcaaaat

SEQ ID NO: 2616754 - DNA, 22 bp, Homo sapiens
accacagggttcaaaatgtctg

SEQ ID NO: 2616755 - DNA, 22 bp, Homo sapiens
accacaggttcatgccaccatg

SEQ ID NO: 2616756 - DNA, 13 bp, Homo sapiens
accacagtgtctg

SEQ ID NO: 2616757 - DNA, 20 bp, Homo sapiens
accacatcttgctctgctga

SEQ ID NO: 2616758 - DNA, 21 bp, Homo sapiens
accacatcttgctctgctgac

SEQ ID NO: 2616759 - DNA, 17 bp, Homo sapiens
accacatctttatctgt

SEQ ID NO: 2616760 - DNA, 18 bp, Homo sapiens
accacatgtgcacatgca

SEQ ID NO: 2616761 - DNA, 20 bp, Homo sapiens
accaccacacccagcccact

SEQ ID NO: 2616762 - DNA, 22 bp, Homo sapiens
accaccactggccaccaggctg

SEQ ID NO: 2616763 - DNA, 24 bp, Homo sapiens
accaccactggccaccaggctggc

SEQ ID NO: 2616764 - DNA, 23 bp, Homo sapiens
accacccactctcctctgcctca

SEQ ID NO: 2616765 - DNA, 14 bp, Homo sapiens
accaccccccactc

SEQ ID NO: 2616766 - DNA, 14 bp, Homo sapiens
accacccctgcctc

SEQ ID NO: 2616767 - DNA, 15 bp, Homo sapiens
accacccctgcctcc

SEQ ID NO: 2616768 - DNA, 20 bp, Homo sapiens
accacccctgcctccaccct

SEQ ID NO: 2616769 - DNA, 13 bp, Homo sapiens
accaccctcccct

SEQ ID NO: 2616770 - DNA, 18 bp, Homo sapiens
accaccctcccctctctt

SEQ ID NO: 2616771 - DNA, 23 bp, Homo sapiens
accaccctcccctctcttgcacc

SEQ ID NO: 2616772 - DNA, 13 bp, Homo sapiens
accaccgctcccc

SEQ ID NO: 2616773 - DNA, 15 bp, Homo sapiens
accaccgctccccag

SEQ ID NO: 2616774 - DNA, 17 bp, Homo sapiens
accaccgctccccagcc

SEQ ID NO: 2616775 - DNA, 15 bp, Homo sapiens
accacctcactcctg

SEQ ID NO: 2616776 - DNA, 14 bp, Homo sapiens
accacctccctcac

SEQ ID NO: 2616777 - DNA, 16 bp, Homo sapiens
accactacattctgtt

SEQ ID NO: 2616778 - DNA, 21 bp, Homo sapiens
accactgcactccagcctggg

SEQ ID NO: 2616779 - DNA, 13 bp, Homo sapiens
accactgcagaag

SEQ ID NO: 2616780 - DNA, 14 bp, Homo sapiens
accactggccacca

SEQ ID NO: 2616781 - DNA, 15 bp, Homo sapiens
accactggccaccag

SEQ ID NO: 2616782 - DNA, 16 bp, Homo sapiens
accactggccaccagg

SEQ ID NO: 2616783 - DNA, 17 bp, Homo sapiens
accactggccaccaggc

SEQ ID NO: 2616784 - DNA, 18 bp, Homo sapiens
accactggccaccaggct

SEQ ID NO: 2616785 - DNA, 20 bp, Homo sapiens
accactgtaaaatgaaatta

SEQ ID NO: 2616786 - DNA, 18 bp, Homo sapiens
accacttaaaaaatgtcc

SEQ ID NO: 2616787 - DNA, 14 bp, Homo sapiens
accacttcagctga

SEQ ID NO: 2616788 - DNA, 13 bp, Homo sapiens
accacttcattct

SEQ ID NO: 2616789 - DNA, 17 bp, Homo sapiens
accacttcattcttgaa

SEQ ID NO: 2616790 - DNA, 22 bp, Homo sapiens
accagacaccttgacagggcac

SEQ ID NO: 2616791 - DNA, 19 bp, Homo sapiens
accagacggttcaccagcc

SEQ ID NO: 2616792 - DNA, 14 bp, Homo sapiens
accagagccatgga

SEQ ID NO: 2616793 - DNA, 17 bp, Homo sapiens
accagagccatggactc

SEQ ID NO: 2616794 - DNA, 14 bp, Homo sapiens
accagagcccacct

SEQ ID NO: 2616795 - DNA, 22 bp, Homo sapiens
accagagcccaccttggctcaa

SEQ ID NO: 2616796 - DNA, 14 bp, Homo sapiens
accagagccccaca

SEQ ID NO: 2616797 - DNA, 20 bp, Homo sapiens
accagagccccacacggagg

SEQ ID NO: 2616798 - DNA, 21 bp, Homo sapiens
accagaggctgcagaaggcca

SEQ ID NO: 2616799 - DNA, 18 bp, Homo sapiens
accagatgatgggggagg

SEQ ID NO: 2616800 - DNA, 14 bp, Homo sapiens
accagcagaaatgc

SEQ ID NO: 2616801 - DNA, 12 bp, Homo sapiens
accagcagagca

SEQ ID NO: 2616802 - DNA, 13 bp, Homo sapiens
accagcagcctgg

SEQ ID NO: 2616803 - DNA, 17 bp, Homo sapiens
accagcagcctggaccc

SEQ ID NO: 2616804 - DNA, 17 bp, Homo sapiens
accagccagtaaatggg

SEQ ID NO: 2616805 - DNA, 21 bp, Homo sapiens
accagccattggctatttaaa

SEQ ID NO: 2616806 - DNA, 17 bp, Homo sapiens
accagccccagtgccca

SEQ ID NO: 2616807 - DNA, 20 bp, Homo sapiens
accagccccagtgcccacag

SEQ ID NO: 2616808 - DNA, 19 bp, Homo sapiens
accagcctccatgctgcct

SEQ ID NO: 2616809 - DNA, 21 bp, Homo sapiens
accagcctccatgctgcctcc

SEQ ID NO: 2616810 - DNA, 20 bp, Homo sapiens
accagcctgaccaacatggt

SEQ ID NO: 2616811 - DNA, 14 bp, Homo sapiens
accagcctgggcag

SEQ ID NO: 2616812 - DNA, 19 bp, Homo sapiens
accagcctttctcccaggc

SEQ ID NO: 2616813 - DNA, 13 bp, Homo sapiens
accagcgcccgct

SEQ ID NO: 2616814 - DNA, 17 bp, Homo sapiens
accagcgcccgctgggc

SEQ ID NO: 2616815 - DNA, 18 bp, Homo sapiens
accagcgcccgctgggct

SEQ ID NO: 2616816 - DNA, 23 bp, Homo sapiens
accagcgcccgctgggctgagcc

SEQ ID NO: 2616817 - DNA, 15 bp, Homo sapiens
accagctgcctcttc

SEQ ID NO: 2616818 - DNA, 10 bp, Homo sapiens
accagctggg

SEQ ID NO: 2616819 - DNA, 20 bp, Homo sapiens
accagctggggcgtggggag

SEQ ID NO: 2616820 - DNA, 16 bp, Homo sapiens
accagcttctccaggc

SEQ ID NO: 2616821 - DNA, 15 bp, Homo sapiens
accaggactccctcc

SEQ ID NO: 2616822 - DNA, 22 bp, Homo sapiens
accaggagtccctggtaataag

SEQ ID NO: 2616823 - DNA, 20 bp, Homo sapiens
accaggctggcgcagccaag

SEQ ID NO: 2616824 - DNA, 20 bp, Homo sapiens
accagggagcccctttgatg

SEQ ID NO: 2616825 - DNA, 19 bp, Homo sapiens
accagggcctgagccaagc

SEQ ID NO: 2616826 - DNA, 22 bp, Homo sapiens
accagggcgaacgacaatagct

SEQ ID NO: 2616827 - DNA, 24 bp, Homo sapiens
accaggggtgatttcagagagggc

SEQ ID NO: 2616828 - DNA, 20 bp, Homo sapiens
accagggttgaccccagagg

SEQ ID NO: 2616829 - DNA, 21 bp, Homo sapiens
accagggttgaccccagagga

SEQ ID NO: 2616830 - DNA, 20 bp, Homo sapiens
accaggtgttctacactcat

SEQ ID NO: 2616831 - DNA, 23 bp, Homo sapiens
accaggtgttctacactcatctt

SEQ ID NO: 2616832 - DNA, 14 bp, Homo sapiens
accaggttgaaaga

SEQ ID NO: 2616833 - DNA, 16 bp, Homo sapiens
accagtgaaccaaaga

SEQ ID NO: 2616834 - DNA, 13 bp, Homo sapiens
accagtgtagcct

SEQ ID NO: 2616835 - DNA, 16 bp, Homo sapiens
accagtgtagccttgc

SEQ ID NO: 2616836 - DNA, 13 bp, Homo sapiens
accagtgtcccct

SEQ ID NO: 2616837 - DNA, 18 bp, Homo sapiens
accagtgtcccctccact

SEQ ID NO: 2616838 - DNA, 21 bp, Homo sapiens
accagtgttgtggatttaaca

SEQ ID NO: 2616839 - DNA, 20 bp, Homo sapiens
accagttgggagcactggag

SEQ ID NO: 2616840 - DNA, 18 bp, Homo sapiens
accataatgttacattat

SEQ ID NO: 2616841 - DNA, 15 bp, Homo sapiens
accatactgagggac

SEQ ID NO: 2616842 - DNA, 15 bp, Homo sapiens
accatcaagccacca

SEQ ID NO: 2616843 - DNA, 23 bp, Homo sapiens
accatcagaaacaccctcacact

SEQ ID NO: 2616844 - DNA, 17 bp, Homo sapiens
accatcatgtctggcta

SEQ ID NO: 2616845 - DNA, 19 bp, Homo sapiens
accatcattggaaatgaaa

SEQ ID NO: 2616846 - DNA, 22 bp, Homo sapiens
accatccactctaccctcccac

SEQ ID NO: 2616847 - DNA, 17 bp, Homo sapiens
accatccgccagggccc

SEQ ID NO: 2616848 - DNA, 13 bp, Homo sapiens
accatctaatagc

SEQ ID NO: 2616849 - DNA, 14 bp, Homo sapiens
accatctcaggcca

SEQ ID NO: 2616850 - DNA, 21 bp, Homo sapiens
accatctcaggccacctgccc

SEQ ID NO: 2616851 - DNA, 14 bp, Homo sapiens
accatgaagacagg

SEQ ID NO: 2616852 - DNA, 15 bp, Homo sapiens
accatgaagacagga

SEQ ID NO: 2616853 - DNA, 20 bp, Homo sapiens
accatgaagagatttttcat

SEQ ID NO: 2616854 - DNA, 14 bp, Homo sapiens
accatgcagagcgc

SEQ ID NO: 2616855 - DNA, 20 bp, Homo sapiens
accatgggaccaggtcttgg

SEQ ID NO: 2616856 - DNA, 17 bp, Homo sapiens
accatgtacatgaagaa

SEQ ID NO: 2616857 - DNA, 16 bp, Homo sapiens
acctcctccacaccag

SEQ ID NO: 2616858 - DNA, 13 bp, Homo sapiens
acctcctgggcta

SEQ ID NO: 2616859 - DNA, 16 bp, Homo sapiens
acctcctgtctctggc

SEQ ID NO: 2616860 - DNA, 17 bp, Homo sapiens
acctcctttctcttctc

SEQ ID NO: 2616861 - DNA, 19 bp, Homo sapiens
acctcggtgccttcctctt

SEQ ID NO: 2616862 - DNA, 18 bp, Homo sapiens
acctctaaaacagtcctt

SEQ ID NO: 2616863 - DNA, 18 bp, Homo sapiens
acctctcatcagtgtcct

SEQ ID NO: 2616864 - DNA, 22 bp, Homo sapiens
acctctccaagggcttctgcac

SEQ ID NO: 2616865 - DNA, 12 bp, Homo sapiens
acctctccctca

SEQ ID NO: 2616866 - DNA, 13 bp, Homo sapiens
acctctcccttgg

SEQ ID NO: 2616867 - DNA, 23 bp, Homo sapiens
acctctcccttggattgtccccg

SEQ ID NO: 2616868 - DNA, 20 bp, Homo sapiens
acctctcctttggccattcc

SEQ ID NO: 2616869 - DNA, 14 bp, Homo sapiens
acctctctcactcc

SEQ ID NO: 2616870 - DNA, 19 bp, Homo sapiens
acctctctcactccttgaa

SEQ ID NO: 2616871 - DNA, 18 bp, Homo sapiens
acctctgcacaagctgca

SEQ ID NO: 2616872 - DNA, 18 bp, Homo sapiens
acctctgcagcaataaag

SEQ ID NO: 2616873 - DNA, 20 bp, Homo sapiens
acctctgcagcaataaagca

SEQ ID NO: 2616874 - DNA, 15 bp, Homo sapiens
acctctggactggct

SEQ ID NO: 2616875 - DNA, 15 bp, Homo sapiens
acctctgtgtgctcc

SEQ ID NO: 2616876 - DNA, 19 bp, Homo sapiens
acctctgttcagtgtaaat

SEQ ID NO: 2616877 - DNA, 20 bp, Homo sapiens
acctcttaacaatttctgtc

SEQ ID NO: 2616878 - DNA, 14 bp, Homo sapiens
acctcttccccaga

SEQ ID NO: 2616879 - DNA, 23 bp, Homo sapiens
acctcttccccagaaaggagact

SEQ ID NO: 2616880 - DNA, 17 bp, Homo sapiens
acctcttctcttcctgt

SEQ ID NO: 2616881 - DNA, 21 bp, Homo sapiens
acctcttctcttcctgtaaca

SEQ ID NO: 2616882 - DNA, 20 bp, Homo sapiens
acctcttgagccttgaactt

SEQ ID NO: 2616883 - DNA, 22 bp, Homo sapiens
acctctttattttttgattgaa

SEQ ID NO: 2616884 - DNA, 18 bp, Homo sapiens
acctgaaaacactgtgca

SEQ ID NO: 2616885 - DNA, 16 bp, Homo sapiens
acctgacactcccttg

SEQ ID NO: 2616886 - DNA, 22 bp, Homo sapiens
acctgacagatgtcagccgagc

SEQ ID NO: 2616887 - DNA, 16 bp, Homo sapiens
acctgacccctgctca

SEQ ID NO: 2616888 - DNA, 18 bp, Homo sapiens
acctgaccgtgggcgggg

SEQ ID NO: 2616889 - DNA, 20 bp, Homo sapiens
acctgaccgtgggcggggcc

SEQ ID NO: 2616890 - DNA, 22 bp, Homo sapiens
acctgactcgtctgactgtgtg

SEQ ID NO: 2616891 - DNA, 15 bp, Homo sapiens
acctgactctgaaat

SEQ ID NO: 2616892 - DNA, 19 bp, Homo sapiens
acctgactctgaaatctga

SEQ ID NO: 2616893 - DNA, 23 bp, Homo sapiens
acctgactctgaaatctgaagac

SEQ ID NO: 2616894 - DNA, 12 bp, Homo sapiens
acctgagcccca

SEQ ID NO: 2616895 - DNA, 16 bp, Homo sapiens
acctgaggcccttctc

SEQ ID NO: 2616896 - DNA, 16 bp, Homo sapiens
acctgaggtgggccca

SEQ ID NO: 2616897 - DNA, 14 bp, Homo sapiens
acctgatcaatgac

SEQ ID NO: 2616898 - DNA, 21 bp, Homo sapiens
acctgatggcacttagctatc

SEQ ID NO: 2616899 - DNA, 15 bp, Homo sapiens
acctgatgtgtacat

SEQ ID NO: 2616900 - DNA, 22 bp, Homo sapiens
acctgatgtgtacatcccatgt

SEQ ID NO: 2616901 - DNA, 17 bp, Homo sapiens
acctgattgtgtctctt

SEQ ID NO: 2616902 - DNA, 11 bp, Homo sapiens
acctgattttt

SEQ ID NO: 2616903 - DNA, 17 bp, Homo sapiens
acctgattttttttcct

SEQ ID NO: 2616904 - DNA, 15 bp, Homo sapiens
acctgcaaaaaatag

SEQ ID NO: 2616905 - DNA, 15 bp, Homo sapiens
acctgcaggccaaga

SEQ ID NO: 2616906 - DNA, 19 bp, Homo sapiens
acctgcaggccaagagcag

SEQ ID NO: 2616907 - DNA, 13 bp, Homo sapiens
acctgccactcac

SEQ ID NO: 2616908 - DNA, 21 bp, Homo sapiens
acctgccagcctggcttctgg

SEQ ID NO: 2616909 - DNA, 13 bp, Homo sapiens
acctgccagggac

SEQ ID NO: 2616910 - DNA, 15 bp, Homo sapiens
acctgccagggacag

SEQ ID NO: 2616911 - DNA, 18 bp, Homo sapiens
acctgcccccttctccca

SEQ ID NO: 2616912 - DNA, 16 bp, Homo sapiens
acctgccccgcccagc

SEQ ID NO: 2616913 - DNA, 17 bp, Homo sapiens
acctgccccgcccagct

SEQ ID NO: 2616914 - DNA, 12 bp, Homo sapiens
acctgccctgcc

SEQ ID NO: 2616915 - DNA, 13 bp, Homo sapiens
acctgccctgcct

SEQ ID NO: 2616916 - DNA, 17 bp, Homo sapiens
acctgcctcacagctgg

SEQ ID NO: 2616917 - DNA, 21 bp, Homo sapiens
acctgcctcccttcatgcatg

SEQ ID NO: 2616918 - DNA, 22 bp, Homo sapiens
acctgcctcccttcatgcatgg

SEQ ID NO: 2616919 - DNA, 18 bp, Homo sapiens
acctgcctcctgcctgcc

SEQ ID NO: 2616920 - DNA, 16 bp, Homo sapiens
acctgcggctgctgtg

SEQ ID NO: 2616921 - DNA, 19 bp, Homo sapiens
acctgcggtgctatctccc

SEQ ID NO: 2616922 - DNA, 17 bp, Homo sapiens
acctgctcccaggccag

SEQ ID NO: 2616923 - DNA, 12 bp, Homo sapiens
acctgctctcct

SEQ ID NO: 2616924 - DNA, 20 bp, Homo sapiens
acctgctgagggaccagcca

SEQ ID NO: 2616925 - DNA, 21 bp, Homo sapiens
acctgctggcccctcacctgg

SEQ ID NO: 2616926 - DNA, 17 bp, Homo sapiens
acctgctgggtaaactg

SEQ ID NO: 2616927 - DNA, 21 bp, Homo sapiens
acctgcttgggtggagaagcc

SEQ ID NO: 2616928 - DNA, 22 bp, Homo sapiens
acctgcttgggtggagaagcca

SEQ ID NO: 2616929 - DNA, 23 bp, Homo sapiens
acctgcttgggtggagaagccat

SEQ ID NO: 2616930 - DNA, 20 bp, Homo sapiens
acctggagagccagaacctg

SEQ ID NO: 2616931 - DNA, 22 bp, Homo sapiens
acctggagagccagaacctgga

SEQ ID NO: 2616932 - DNA, 23 bp, Homo sapiens
acctggagagccagaacctggag

SEQ ID NO: 2616933 - DNA, 13 bp, Homo sapiens
acctggagagcta

SEQ ID NO: 2616934 - DNA, 23 bp, Homo sapiens
acctggagagctagaacctggag

SEQ ID NO: 2616935 - DNA, 15 bp, Homo sapiens
acctggagcccctgg

SEQ ID NO: 2616936 - DNA, 13 bp, Homo sapiens
acctggagggcta

SEQ ID NO: 2616937 - DNA, 20 bp, Homo sapiens
acctggagggctagaacctg

SEQ ID NO: 2616938 - DNA, 22 bp, Homo sapiens
acctggagggctagaacctggc

SEQ ID NO: 2616939 - DNA, 16 bp, Homo sapiens
acctggagttcctgaa

SEQ ID NO: 2616940 - DNA, 20 bp, Homo sapiens
acctggcaagctagaacctg

SEQ ID NO: 2616941 - DNA, 13 bp, Homo sapiens
acctggccacctg

SEQ ID NO: 2616942 - DNA, 20 bp, Homo sapiens
acctggcctctgcactcccc

SEQ ID NO: 2616943 - DNA, 13 bp, Homo sapiens
acctggggagtgg

SEQ ID NO: 2616944 - DNA, 24 bp, Homo sapiens
acctggggagtgggacagagtctg

SEQ ID NO: 2616945 - DNA, 15 bp, Homo sapiens
acctggggctgctgg

SEQ ID NO: 2616946 - DNA, 18 bp, Homo sapiens
acctggggtgtgggaggc

SEQ ID NO: 2616947 - DNA, 21 bp, Homo sapiens
acctgggtaactagggaagat

SEQ ID NO: 2616948 - DNA, 17 bp, Homo sapiens
acctgggtccaaataaa

SEQ ID NO: 2616949 - DNA, 23 bp, Homo sapiens
acctgggtccaaataaaaactaa

SEQ ID NO: 2616950 - DNA, 16 bp, Homo sapiens
acctggtaccctcctg

SEQ ID NO: 2616951 - DNA, 19 bp, Homo sapiens
acctggtaccctcctggct

SEQ ID NO: 2616952 - DNA, 21 bp, Homo sapiens
acctggtcacaggactctgcc

SEQ ID NO: 2616953 - DNA, 22 bp, Homo sapiens
acctggtcacaggactctgcct

SEQ ID NO: 2616954 - DNA, 10 bp, Homo sapiens
acctggtgct

SEQ ID NO: 2616955 - DNA, 17 bp, Homo sapiens
acctgtaacttttgtaa

SEQ ID NO: 2616956 - DNA, 20 bp, Homo sapiens
acctgtaacttttgtaaata

SEQ ID NO: 2616957 - DNA, 12 bp, Homo sapiens
acctgtactcag

SEQ ID NO: 2616958 - DNA, 24 bp, Homo sapiens
acctgtcaaacaaagccagaagct

SEQ ID NO: 2616959 - DNA, 22 bp, Homo sapiens
acctgtcaatgatacagtccct

SEQ ID NO: 2616960 - DNA, 15 bp, Homo sapiens
acctgtcatgccccc

SEQ ID NO: 2616961 - DNA, 17 bp, Homo sapiens
acctgtcatgcccccct

SEQ ID NO: 2616962 - DNA, 12 bp, Homo sapiens
acctgtccccct

SEQ ID NO: 2616963 - DNA, 15 bp, Homo sapiens
acctgtccccctgac

SEQ ID NO: 2616964 - DNA, 18 bp, Homo sapiens
acctgtcctcctggtggg

SEQ ID NO: 2616965 - DNA, 13 bp, Homo sapiens
acctgtctcacca

SEQ ID NO: 2616966 - DNA, 23 bp, Homo sapiens
acctgtgcttcgggcccttccca

SEQ ID NO: 2616967 - DNA, 21 bp, Homo sapiens
acctgtggggatttctcccag

SEQ ID NO: 2616968 - DNA, 16 bp, Homo sapiens
acctgttgcttacaat

SEQ ID NO: 2616969 - DNA, 18 bp, Homo sapiens
acctgttttcgcacctac

SEQ ID NO: 2616970 - DNA, 16 bp, Homo sapiens
acctgtttttaagctg

SEQ ID NO: 2616971 - DNA, 18 bp, Homo sapiens
acctgtttttaagctgtt

SEQ ID NO: 2616972 - DNA, 19 bp, Homo sapiens
acctgtttttaagctgttt

SEQ ID NO: 2616973 - DNA, 21 bp, Homo sapiens
accttactgtggaggaaggat

SEQ ID NO: 2616974 - DNA, 17 bp, Homo sapiens
accttagacagtccctg

SEQ ID NO: 2616975 - DNA, 18 bp, Homo sapiens
accttagattagctctgg

SEQ ID NO: 2616976 - DNA, 19 bp, Homo sapiens
accttagtgtttctgtgca

SEQ ID NO: 2616977 - DNA, 21 bp, Homo sapiens
accttagtgtttctgtgcatg

SEQ ID NO: 2616978 - DNA, 23 bp, Homo sapiens
accttatctgtgcgtgaaacaca

SEQ ID NO: 2616979 - DNA, 14 bp, Homo sapiens
accttattgtacct

SEQ ID NO: 2616980 - DNA, 15 bp, Homo sapiens
accttcaataaagta

SEQ ID NO: 2616981 - DNA, 17 bp, Homo sapiens
accttcaataaagtatc

SEQ ID NO: 2616982 - DNA, 23 bp, Homo sapiens
accttcaataaagtatctacatg

SEQ ID NO: 2616983 - DNA, 18 bp, Homo sapiens
accttcaattcctgggcc

SEQ ID NO: 2616984 - DNA, 13 bp, Homo sapiens
accttcctcgcag

SEQ ID NO: 2616985 - DNA, 15 bp, Homo sapiens
accttcctcgcagag

SEQ ID NO: 2616986 - DNA, 11 bp, Homo sapiens
accttcctgcc

SEQ ID NO: 2616987 - DNA, 14 bp, Homo sapiens
accttctccaaatg

SEQ ID NO: 2616988 - DNA, 12 bp, Homo sapiens
accttctccttc

SEQ ID NO: 2616989 - DNA, 22 bp, Homo sapiens
accttctccttcacctttgtcc

SEQ ID NO: 2616990 - DNA, 18 bp, Homo sapiens
accttgaacactggggga

SEQ ID NO: 2616991 - DNA, 14 bp, Homo sapiens
accttgacagggca

SEQ ID NO: 2616992 - DNA, 16 bp, Homo sapiens
accttgacagggcaca

SEQ ID NO: 2616993 - DNA, 19 bp, Homo sapiens
accttgaggagtcttgtgt

SEQ ID NO: 2616994 - DNA, 11 bp, Homo sapiens
accttgaggtc

SEQ ID NO: 2616995 - DNA, 15 bp, Homo sapiens
accttgcaacacaca

SEQ ID NO: 2616996 - DNA, 16 bp, Homo sapiens
accttgcaacacacag

SEQ ID NO: 2616997 - DNA, 17 bp, Homo sapiens
accttgcaacacacaga

SEQ ID NO: 2616998 - DNA, 19 bp, Homo sapiens
accttgcaacacacagaca

SEQ ID NO: 2616999 - DNA, 19 bp, Homo sapiens
accttgcatctcattgctc

SEQ ID NO: 2617000 - DNA, 19 bp, Homo sapiens
accttgctttgatggaata

SEQ ID NO: 2617001 - DNA, 21 bp, Homo sapiens
actcattcaaaagttgaaatt

SEQ ID NO: 2617002 - DNA, 14 bp, Homo sapiens
actcattgacctga

SEQ ID NO: 2617003 - DNA, 16 bp, Homo sapiens
actcattgacctgagg

SEQ ID NO: 2617004 - DNA, 16 bp, Homo sapiens
actcatttttttaatt

SEQ ID NO: 2617005 - DNA, 19 bp, Homo sapiens
actcatttttttaatttat

SEQ ID NO: 2617006 - DNA, 22 bp, Homo sapiens
actccaaaatgttggtcatttt

SEQ ID NO: 2617007 - DNA, 15 bp, Homo sapiens
actccaaagaaatgt

SEQ ID NO: 2617008 - DNA, 17 bp, Homo sapiens
actccaattaaggattt

SEQ ID NO: 2617009 - DNA, 15 bp, Homo sapiens
actccacccatccta

SEQ ID NO: 2617010 - DNA, 15 bp, Homo sapiens
actccactttcatag

SEQ ID NO: 2617011 - DNA, 14 bp, Homo sapiens
actccagcctgggc

SEQ ID NO: 2617012 - DNA, 21 bp, Homo sapiens
actccagtgccaacaatccta

SEQ ID NO: 2617013 - DNA, 19 bp, Homo sapiens
actccagtgccagcaatga

SEQ ID NO: 2617014 - DNA, 18 bp, Homo sapiens
actccagtggtgaagaaa

SEQ ID NO: 2617015 - DNA, 18 bp, Homo sapiens
actccagttaaaaaaaat

SEQ ID NO: 2617016 - DNA, 19 bp, Homo sapiens
actccatctcaaaaaataa

SEQ ID NO: 2617017 - DNA, 14 bp, Homo sapiens
actccatgagaagc

SEQ ID NO: 2617018 - DNA, 17 bp, Homo sapiens
actccatgagcacccca

SEQ ID NO: 2617019 - DNA, 15 bp, Homo sapiens
actcccaagctggac

SEQ ID NO: 2617020 - DNA, 12 bp, Homo sapiens
actccccaggcc

SEQ ID NO: 2617021 - DNA, 13 bp, Homo sapiens
actccccaggcca

SEQ ID NO: 2617022 - DNA, 15 bp, Homo sapiens
actccccaggccagg

SEQ ID NO: 2617023 - DNA, 11 bp, Homo sapiens
actcccctcca

SEQ ID NO: 2617024 - DNA, 20 bp, Homo sapiens
actccccttgagctgagatg

SEQ ID NO: 2617025 - DNA, 16 bp, Homo sapiens
actccctcctcacctc

SEQ ID NO: 2617026 - DNA, 22 bp, Homo sapiens
actccctcctcacctctggact

SEQ ID NO: 2617027 - DNA, 19 bp, Homo sapiens
actcccttctacctgccac

SEQ ID NO: 2617028 - DNA, 20 bp, Homo sapiens
actcccttctacctgccact

SEQ ID NO: 2617029 - DNA, 22 bp, Homo sapiens
actcccttggtggcaagagccc

SEQ ID NO: 2617030 - DNA, 14 bp, Homo sapiens
actccgctggaggt

SEQ ID NO: 2617031 - DNA, 22 bp, Homo sapiens
actccgctggaggtggggcctg

SEQ ID NO: 2617032 - DNA, 19 bp, Homo sapiens
actccggcctgatgacaga

SEQ ID NO: 2617033 - DNA, 19 bp, Homo sapiens
actccggtgtgcctgcagc

SEQ ID NO: 2617034 - DNA, 20 bp, Homo sapiens
actccggtgtgcctgcagcc

SEQ ID NO: 2617035 - DNA, 21 bp, Homo sapiens
actccggtgtgcctgcagccc

SEQ ID NO: 2617036 - DNA, 13 bp, Homo sapiens
actcctaggcagg

SEQ ID NO: 2617037 - DNA, 16 bp, Homo sapiens
actcctaggcaggaca

SEQ ID NO: 2617038 - DNA, 21 bp, Homo sapiens
actcctaggcaggacatgctg

SEQ ID NO: 2617039 - DNA, 21 bp, Homo sapiens
actcctcaaaagcaaatgaga

SEQ ID NO: 2617040 - DNA, 16 bp, Homo sapiens
actcctcagggttgag

SEQ ID NO: 2617041 - DNA, 19 bp, Homo sapiens
actcctcagggttgaggtc

SEQ ID NO: 2617042 - DNA, 23 bp, Homo sapiens
actcctcctccaaaggcccccta

SEQ ID NO: 2617043 - DNA, 20 bp, Homo sapiens
actcctctgactcagggctc

SEQ ID NO: 2617044 - DNA, 21 bp, Homo sapiens
actcctgagacccctggcctc

SEQ ID NO: 2617045 - DNA, 23 bp, Homo sapiens
actcctgagacccctggcctccg

SEQ ID NO: 2617046 - DNA, 15 bp, Homo sapiens
actcctgcaaaattt

SEQ ID NO: 2617047 - DNA, 18 bp, Homo sapiens
actcctgcaaaattttat

SEQ ID NO: 2617048 - DNA, 12 bp, Homo sapiens
actcctgcaggc

SEQ ID NO: 2617049 - DNA, 14 bp, Homo sapiens
actcctgcaggcag

SEQ ID NO: 2617050 - DNA, 16 bp, Homo sapiens
actcctgcaggcagcc

SEQ ID NO: 2617051 - DNA, 12 bp, Homo sapiens
actcctggcctc

SEQ ID NO: 2617052 - DNA, 14 bp, Homo sapiens
actcctggcctcaa

SEQ ID NO: 2617053 - DNA, 14 bp, Homo sapiens
actcctgggttgag

SEQ ID NO: 2617054 - DNA, 12 bp, Homo sapiens
actccttagaga

SEQ ID NO: 2617055 - DNA, 18 bp, Homo sapiens
actccttgtggtttatgt

SEQ ID NO: 2617056 - DNA, 19 bp, Homo sapiens
actcgaggactgtatttgt

SEQ ID NO: 2617057 - DNA, 19 bp, Homo sapiens
actcgattcatattgaata

SEQ ID NO: 2617058 - DNA, 15 bp, Homo sapiens
actcgcccgcccact

SEQ ID NO: 2617059 - DNA, 16 bp, Homo sapiens
actcgtctgactgtgt

SEQ ID NO: 2617060 - DNA, 19 bp, Homo sapiens
actctaaaaggttcaggga

SEQ ID NO: 2617061 - DNA, 21 bp, Homo sapiens
actctaatagtgcttaaaaat

SEQ ID NO: 2617062 - DNA, 20 bp, Homo sapiens
actctaattcccattttgca

SEQ ID NO: 2617063 - DNA, 21 bp, Homo sapiens
actctaattcccattttgcaa

SEQ ID NO: 2617064 - DNA, 15 bp, Homo sapiens
actctacagaggcca

SEQ ID NO: 2617065 - DNA, 19 bp, Homo sapiens
actctacccatattacaga

SEQ ID NO: 2617066 - DNA, 18 bp, Homo sapiens
actctaccctcttagaaa

SEQ ID NO: 2617067 - DNA, 21 bp, Homo sapiens
actctaccctcttagaaaaac

SEQ ID NO: 2617068 - DNA, 22 bp, Homo sapiens
actctacctcatatcagtttgc

SEQ ID NO: 2617069 - DNA, 16 bp, Homo sapiens
actctatcaagtatta

SEQ ID NO: 2617070 - DNA, 23 bp, Homo sapiens
actctcccatggcttaatgcttc

SEQ ID NO: 2617071 - DNA, 15 bp, Homo sapiens
actctccccacacta

SEQ ID NO: 2617072 - DNA, 23 bp, Homo sapiens
actctcctagagacagaagcagg

SEQ ID NO: 2617073 - DNA, 16 bp, Homo sapiens
actctcctctgcctca

SEQ ID NO: 2617074 - DNA, 16 bp, Homo sapiens
actctcctctgctgct

SEQ ID NO: 2617075 - DNA, 19 bp, Homo sapiens
actctcctctgctgctggc

SEQ ID NO: 2617076 - DNA, 21 bp, Homo sapiens
actctcctctgctgctggctg

SEQ ID NO: 2617077 - DNA, 17 bp, Homo sapiens
actctccttgctaccca

SEQ ID NO: 2617078 - DNA, 18 bp, Homo sapiens
actctctgaacccctccc

SEQ ID NO: 2617079 - DNA, 19 bp, Homo sapiens
actctctgaacccctccct

SEQ ID NO: 2617080 - DNA, 21 bp, Homo sapiens
actctctgaacccctccctcc

SEQ ID NO: 2617081 - DNA, 17 bp, Homo sapiens
actctgaaatctgaaga

SEQ ID NO: 2617082 - DNA, 16 bp, Homo sapiens
actctgaaatgaagat

SEQ ID NO: 2617083 - DNA, 9 bp, Homo sapiens
actctgaac

SEQ ID NO: 2617084 - DNA, 14 bp, Homo sapiens
actctgaagcctct

SEQ ID NO: 2617085 - DNA, 16 bp, Homo sapiens
actctgaagcctctgg

SEQ ID NO: 2617086 - DNA, 21 bp, Homo sapiens
actctgaagggcatcatgcat

SEQ ID NO: 2617087 - DNA, 21 bp, Homo sapiens
actctgaggctctttctgggc

SEQ ID NO: 2617088 - DNA, 23 bp, Homo sapiens
actctgaggctctttctgggcca

SEQ ID NO: 2617089 - DNA, 17 bp, Homo sapiens
actctgcacatgtcttg

SEQ ID NO: 2617090 - DNA, 14 bp, Homo sapiens
actctgcactactc

SEQ ID NO: 2617091 - DNA, 13 bp, Homo sapiens
actctgccagcca

SEQ ID NO: 2617092 - DNA, 13 bp, Homo sapiens
actctgccccctg

SEQ ID NO: 2617093 - DNA, 15 bp, Homo sapiens
actctgccccctgct

SEQ ID NO: 2617094 - DNA, 17 bp, Homo sapiens
actctgccccctgctgg

SEQ ID NO: 2617095 - DNA, 18 bp, Homo sapiens
actctgccccctgctggc

SEQ ID NO: 2617096 - DNA, 12 bp, Homo sapiens
actctgcctcct

SEQ ID NO: 2617097 - DNA, 11 bp, Homo sapiens
actctgcctct

SEQ ID NO: 2617098 - DNA, 14 bp, Homo sapiens
actctgctgcttag

SEQ ID NO: 2617099 - DNA, 18 bp, Homo sapiens
actctgcttgatttttgc

SEQ ID NO: 2617100 - DNA, 13 bp, Homo sapiens
actctgcttgtta

SEQ ID NO: 2617101 - DNA, 16 bp, Homo sapiens
actctggcagctcaga

SEQ ID NO: 2617102 - DNA, 20 bp, Homo sapiens
actctggcagctcagagagg

SEQ ID NO: 2617103 - DNA, 23 bp, Homo sapiens
actctggctggtttggaatgctt

SEQ ID NO: 2617104 - DNA, 17 bp, Homo sapiens
actctggcttccaggta

SEQ ID NO: 2617105 - DNA, 15 bp, Homo sapiens
actctggttctttgt

SEQ ID NO: 2617106 - DNA, 17 bp, Homo sapiens
actctgtctcagtccat

SEQ ID NO: 2617107 - DNA, 16 bp, Homo sapiens
actctgtcttcacctg

SEQ ID NO: 2617108 - DNA, 15 bp, Homo sapiens
actctgtggccaaag

SEQ ID NO: 2617109 - DNA, 21 bp, Homo sapiens
actctgtgtcaggtggggcag

SEQ ID NO: 2617110 - DNA, 15 bp, Homo sapiens
actctgttatttaga

SEQ ID NO: 2617111 - DNA, 11 bp, Homo sapiens
actcttaaaac

SEQ ID NO: 2617112 - DNA, 13 bp, Homo sapiens
actcttaagccat

SEQ ID NO: 2617113 - DNA, 16 bp, Homo sapiens
actcttaagtttctca

SEQ ID NO: 2617114 - DNA, 22 bp, Homo sapiens
actcttaagtttctcagctccc

SEQ ID NO: 2617115 - DNA, 19 bp, Homo sapiens
actcttaggaagagaaacc

SEQ ID NO: 2617116 - DNA, 22 bp, Homo sapiens
actcttatctcagtcatgcata

SEQ ID NO: 2617117 - DNA, 22 bp, Homo sapiens
actcttccgaaaaatcctcttc

SEQ ID NO: 2617118 - DNA, 19 bp, Homo sapiens
actcttcttaacttaaatt

SEQ ID NO: 2617119 - DNA, 16 bp, Homo sapiens
actcttcttgaaattt

SEQ ID NO: 2617120 - DNA, 14 bp, Homo sapiens
actcttgacctcag

SEQ ID NO: 2617121 - DNA, 14 bp, Homo sapiens
actcttgctctttc

SEQ ID NO: 2617122 - DNA, 11 bp, Homo sapiens
actctttcaaa

SEQ ID NO: 2617123 - DNA, 16 bp, Homo sapiens
actctttgagaaacaa

SEQ ID NO: 2617124 - DNA, 16 bp, Homo sapiens
actctttgagatagaa

SEQ ID NO: 2617125 - DNA, 13 bp, Homo sapiens
actctttgtaaga

SEQ ID NO: 2617126 - DNA, 19 bp, Homo sapiens
actctttttagggccaggc

SEQ ID NO: 2617127 - DNA, 20 bp, Homo sapiens
actctttttagggccaggca

SEQ ID NO: 2617128 - DNA, 15 bp, Homo sapiens
actgaaaacatctgg

SEQ ID NO: 2617129 - DNA, 17 bp, Homo sapiens
actgaaaacctctcctc

SEQ ID NO: 2617130 - DNA, 23 bp, Homo sapiens
actgaaaatctaatattaaaaat

SEQ ID NO: 2617131 - DNA, 19 bp, Homo sapiens
actgaaaatgtgctatact

SEQ ID NO: 2617132 - DNA, 19 bp, Homo sapiens
actgaacatgtacactggt

SEQ ID NO: 2617133 - DNA, 13 bp, Homo sapiens
actgaacttcagg

SEQ ID NO: 2617134 - DNA, 21 bp, Homo sapiens
actgaactttgctgagcctgt

SEQ ID NO: 2617135 - DNA, 18 bp, Homo sapiens
actgaagccagaaataaa

SEQ ID NO: 2617136 - DNA, 15 bp, Homo sapiens
actgaagcctgcagg

SEQ ID NO: 2617137 - DNA, 20 bp, Homo sapiens
actgaaggcctggcccacag

SEQ ID NO: 2617138 - DNA, 17 bp, Homo sapiens
actgaaggtaaaattga

SEQ ID NO: 2617139 - DNA, 16 bp, Homo sapiens
actgaagtctgaaatt

SEQ ID NO: 2617140 - DNA, 17 bp, Homo sapiens
actgaagtgcttagtgt

SEQ ID NO: 2617141 - DNA, 16 bp, Homo sapiens
actgaagtttcacatg

SEQ ID NO: 2617142 - DNA, 18 bp, Homo sapiens
actgaatatttatatttc

SEQ ID NO: 2617143 - DNA, 16 bp, Homo sapiens
actgaatgaaaccccc

SEQ ID NO: 2617144 - DNA, 20 bp, Homo sapiens
actgaatgaggtcagcatgt

SEQ ID NO: 2617145 - DNA, 22 bp, Homo sapiens
actgaatgcttctgacttcata

SEQ ID NO: 2617146 - DNA, 20 bp, Homo sapiens
acttgatgtgccattttaaa

SEQ ID NO: 2617147 - DNA, 11 bp, Homo sapiens
acttgcatttc

SEQ ID NO: 2617148 - DNA, 18 bp, Homo sapiens
acttgcatttttgcagga

SEQ ID NO: 2617149 - DNA, 22 bp, Homo sapiens
acttgccgcgtcgccctcccag

SEQ ID NO: 2617150 - DNA, 23 bp, Homo sapiens
acttgctctctggccttttccta

SEQ ID NO: 2617151 - DNA, 17 bp, Homo sapiens
acttgctgcctgaagaa

SEQ ID NO: 2617152 - DNA, 18 bp, Homo sapiens
acttgctgttttgttctg

SEQ ID NO: 2617153 - DNA, 14 bp, Homo sapiens
acttggaagctccg

SEQ ID NO: 2617154 - DNA, 21 bp, Homo sapiens
acttggaatttgtaacctcag

SEQ ID NO: 2617155 - DNA, 22 bp, Homo sapiens
acttggaatttgtaacctcagc

SEQ ID NO: 2617156 - DNA, 19 bp, Homo sapiens
acttggagccccagtgcca

SEQ ID NO: 2617157 - DNA, 15 bp, Homo sapiens
acttggcaacagaag

SEQ ID NO: 2617158 - DNA, 18 bp, Homo sapiens
acttggcatcagctggcg

SEQ ID NO: 2617159 - DNA, 17 bp, Homo sapiens
acttggctacacaggga

SEQ ID NO: 2617160 - DNA, 11 bp, Homo sapiens
acttggctttc

SEQ ID NO: 2617161 - DNA, 13 bp, Homo sapiens
acttggctttcat

SEQ ID NO: 2617162 - DNA, 20 bp, Homo sapiens
acttgggagacctgtaatca

SEQ ID NO: 2617163 - DNA, 22 bp, Homo sapiens
acttgggaggctgagatgggag

SEQ ID NO: 2617164 - DNA, 17 bp, Homo sapiens
acttgggccatagctcc

SEQ ID NO: 2617165 - DNA, 15 bp, Homo sapiens
acttgggtcttccct

SEQ ID NO: 2617166 - DNA, 20 bp, Homo sapiens
acttgtaaatgtggtaaaga

SEQ ID NO: 2617167 - DNA, 14 bp, Homo sapiens
acttgtatatttgt

SEQ ID NO: 2617168 - DNA, 13 bp, Homo sapiens
acttgtcaaagaa

SEQ ID NO: 2617169 - DNA, 14 bp, Homo sapiens
acttgtcaaagaag

SEQ ID NO: 2617170 - DNA, 14 bp, Homo sapiens
acttgtcaatattt

SEQ ID NO: 2617171 - DNA, 22 bp, Homo sapiens
acttgtccccaaatccgaacct

SEQ ID NO: 2617172 - DNA, 23 bp, Homo sapiens
acttgtccttttgtaccatggtg

SEQ ID NO: 2617173 - DNA, 15 bp, Homo sapiens
acttgtctaaataag

SEQ ID NO: 2617174 - DNA, 20 bp, Homo sapiens
acttgtctaaataagtttgc

SEQ ID NO: 2617175 - DNA, 22 bp, Homo sapiens
acttgtctaaataagtttgcaa

SEQ ID NO: 2617176 - DNA, 18 bp, Homo sapiens
acttgtctttggaccctg

SEQ ID NO: 2617177 - DNA, 16 bp, Homo sapiens
acttgtctttttctgg

SEQ ID NO: 2617178 - DNA, 18 bp, Homo sapiens
acttgtgccaacactcaa

SEQ ID NO: 2617179 - DNA, 22 bp, Homo sapiens
acttgtgctgatcgtgctaaat

SEQ ID NO: 2617180 - DNA, 18 bp, Homo sapiens
acttgtggacacagctct

SEQ ID NO: 2617181 - DNA, 16 bp, Homo sapiens
acttgtgtctctgtgc

SEQ ID NO: 2617182 - DNA, 21 bp, Homo sapiens
acttgtgtctctgtgctttta

SEQ ID NO: 2617183 - DNA, 15 bp, Homo sapiens
acttgttccagctct

SEQ ID NO: 2617184 - DNA, 17 bp, Homo sapiens
acttgttttatgctcag

SEQ ID NO: 2617185 - DNA, 21 bp, Homo sapiens
actttaaaggaaaaaatgttg

SEQ ID NO: 2617186 - DNA, 19 bp, Homo sapiens
actttaattaccaacctgt

SEQ ID NO: 2617187 - DNA, 15 bp, Homo sapiens
actttacatgacaca

SEQ ID NO: 2617188 - DNA, 18 bp, Homo sapiens
actttacatgacacagct

SEQ ID NO: 2617189 - DNA, 20 bp, Homo sapiens
actttacatgacacagcttt

SEQ ID NO: 2617190 - DNA, 17 bp, Homo sapiens
actttacccaaaaacta

SEQ ID NO: 2617191 - DNA, 22 bp, Homo sapiens
actttaccttttttatacataa

SEQ ID NO: 2617192 - DNA, 21 bp, Homo sapiens
actttagagtagcatgagaga

SEQ ID NO: 2617193 - DNA, 14 bp, Homo sapiens
actttagatgctga

SEQ ID NO: 2617194 - DNA, 23 bp, Homo sapiens
actttatctaatacctctgtgtg

SEQ ID NO: 2617195 - DNA, 20 bp, Homo sapiens
actttatttatacactgtct

SEQ ID NO: 2617196 - DNA, 15 bp, Homo sapiens
actttcacatagatg

SEQ ID NO: 2617197 - DNA, 18 bp, Homo sapiens
actttcaggtactaaata

SEQ ID NO: 2617198 - DNA, 18 bp, Homo sapiens
actttcagtgaaagcatc

SEQ ID NO: 2617199 - DNA, 19 bp, Homo sapiens
actttcattaaagcattta

SEQ ID NO: 2617200 - DNA, 21 bp, Homo sapiens
actttcctcttagtcgagcca

SEQ ID NO: 2617201 - DNA, 21 bp, Homo sapiens
actttcctctttggtctacac

SEQ ID NO: 2617202 - DNA, 16 bp, Homo sapiens
actttcgtacattggc

SEQ ID NO: 2617203 - DNA, 15 bp, Homo sapiens
actttctagattaag

SEQ ID NO: 2617204 - DNA, 19 bp, Homo sapiens
actttctcttcatactttt

SEQ ID NO: 2617205 - DNA, 12 bp, Homo sapiens
actttgaaggac

SEQ ID NO: 2617206 - DNA, 12 bp, Homo sapiens
actttgacctct

SEQ ID NO: 2617207 - DNA, 13 bp, Homo sapiens
actttgacctctg

SEQ ID NO: 2617208 - DNA, 16 bp, Homo sapiens
actttgacctctgcag

SEQ ID NO: 2617209 - DNA, 18 bp, Homo sapiens
actttgacctctgcagca

SEQ ID NO: 2617210 - DNA, 15 bp, Homo sapiens
actttgactttttgc

SEQ ID NO: 2617211 - DNA, 21 bp, Homo sapiens
actttgactttttgcatttaa

SEQ ID NO: 2617212 - DNA, 23 bp, Homo sapiens
actttgccagcttttcctccctt

SEQ ID NO: 2617213 - DNA, 17 bp, Homo sapiens
actttgctctttcttga

SEQ ID NO: 2617214 - DNA, 13 bp, Homo sapiens
actttggaaagag

SEQ ID NO: 2617215 - DNA, 23 bp, Homo sapiens
actttggaaagagtaggaagact

SEQ ID NO: 2617216 - DNA, 22 bp, Homo sapiens
actttggagtcccctcacctcc

SEQ ID NO: 2617217 - DNA, 14 bp, Homo sapiens
actttggctgcatg

SEQ ID NO: 2617218 - DNA, 19 bp, Homo sapiens
actttgggaggctgaggcg

SEQ ID NO: 2617219 - DNA, 20 bp, Homo sapiens
actttgggataggaaaaatg

SEQ ID NO: 2617220 - DNA, 14 bp, Homo sapiens
actttgtctgaaaa

SEQ ID NO: 2617221 - DNA, 15 bp, Homo sapiens
actttgtctgaaaaa

SEQ ID NO: 2617222 - DNA, 19 bp, Homo sapiens
actttgtggatgtcttcct

SEQ ID NO: 2617223 - DNA, 18 bp, Homo sapiens
actttgtgttcaccttgt

SEQ ID NO: 2617224 - DNA, 20 bp, Homo sapiens
actttgttagtttctccaag

SEQ ID NO: 2617225 - DNA, 11 bp, Homo sapiens
actttgttcac

SEQ ID NO: 2617226 - DNA, 17 bp, Homo sapiens
actttgttctggctctt

SEQ ID NO: 2617227 - DNA, 23 bp, Homo sapiens
actttgttctggctcttccaggc

SEQ ID NO: 2617228 - DNA, 12 bp, Homo sapiens
acttttaaacag

SEQ ID NO: 2617229 - DNA, 15 bp, Homo sapiens
acttttaaacagtga

SEQ ID NO: 2617230 - DNA, 15 bp, Homo sapiens
acttttataaacttt

SEQ ID NO: 2617231 - DNA, 11 bp, Homo sapiens
acttttataat

SEQ ID NO: 2617232 - DNA, 19 bp, Homo sapiens
acttttataataaaaggaa

SEQ ID NO: 2617233 - DNA, 19 bp, Homo sapiens
acttttatgatgtatattt

SEQ ID NO: 2617234 - DNA, 20 bp, Homo sapiens
acttttcataacctagcctt

SEQ ID NO: 2617235 - DNA, 17 bp, Homo sapiens
acttttccattcccaat

SEQ ID NO: 2617236 - DNA, 16 bp, Homo sapiens
acttttcttaaacctt

SEQ ID NO: 2617237 - DNA, 16 bp, Homo sapiens
acttttggttaagtct

SEQ ID NO: 2617238 - DNA, 17 bp, Homo sapiens
actttttatattttata

SEQ ID NO: 2617239 - DNA, 15 bp, Homo sapiens
actttttctttatgt

SEQ ID NO: 2617240 - DNA, 13 bp, Homo sapiens
actttttgcattt

SEQ ID NO: 2617241 - DNA, 18 bp, Homo sapiens
actttttggtttgcagat

SEQ ID NO: 2617242 - DNA, 21 bp, Homo sapiens
acttttttggggatatgctta

SEQ ID NO: 2617243 - DNA, 16 bp, Homo sapiens
acttttttttgagaat

SEQ ID NO: 2617244 - DNA, 17 bp, Homo sapiens
acttttttttgtatgtt

SEQ ID NO: 2617245 - DNA, 16 bp, Homo sapiens
agaaaaaaaaagaaaa

SEQ ID NO: 2617246 - DNA, 18 bp, Homo sapiens
agaaaaaagagaaaagaa

SEQ ID NO: 2617247 - DNA, 10 bp, Homo sapiens
agaaaaaagt

SEQ ID NO: 2617248 - DNA, 16 bp, Homo sapiens
agaaaaaatacatttt

SEQ ID NO: 2617249 - DNA, 18 bp, Homo sapiens
agaaaaaatacattttat

SEQ ID NO: 2617250 - DNA, 22 bp, Homo sapiens
agaaaaaatacattttatatta

SEQ ID NO: 2617251 - DNA, 17 bp, Homo sapiens
agaaaaaatattttccc

SEQ ID NO: 2617252 - DNA, 23 bp, Homo sapiens
agaaaaaatattttcctgccagg

SEQ ID NO: 2617253 - DNA, 13 bp, Homo sapiens
agaaaaagaaaaa

SEQ ID NO: 2617254 - DNA, 20 bp, Homo sapiens
agaaaaagcaataacctcaa

SEQ ID NO: 2617255 - DNA, 20 bp, Homo sapiens
agaaaaagctcctgtcctcc

SEQ ID NO: 2617256 - DNA, 15 bp, Homo sapiens
agaaaaattattgta

SEQ ID NO: 2617257 - DNA, 20 bp, Homo sapiens
agaaaacaaaaaaacctcta

SEQ ID NO: 2617258 - DNA, 12 bp, Homo sapiens
agaaaacagaaa

SEQ ID NO: 2617259 - DNA, 21 bp, Homo sapiens
agaaaactcctttagcaggtg

SEQ ID NO: 2617260 - DNA, 14 bp, Homo sapiens
agaaaacttctttt

SEQ ID NO: 2617261 - DNA, 17 bp, Homo sapiens
agaaaagaaaaaaaaag

SEQ ID NO: 2617262 - DNA, 17 bp, Homo sapiens
agaaaagacatgaatat

SEQ ID NO: 2617263 - DNA, 19 bp, Homo sapiens
agaaaagagatattttaaa

SEQ ID NO: 2617264 - DNA, 17 bp, Homo sapiens
agaaaagataaagatga

SEQ ID NO: 2617265 - DNA, 20 bp, Homo sapiens
agaaaagatacgactttatt

SEQ ID NO: 2617266 - DNA, 17 bp, Homo sapiens
agaaaataaaaaaaaga

SEQ ID NO: 2617267 - DNA, 18 bp, Homo sapiens
agaaaataaaaagttaaa

SEQ ID NO: 2617268 - DNA, 15 bp, Homo sapiens
agaaaataccaagga

SEQ ID NO: 2617269 - DNA, 13 bp, Homo sapiens
agaaaatatactg

SEQ ID NO: 2617270 - DNA, 18 bp, Homo sapiens
agaaacaacaatttctac

SEQ ID NO: 2617271 - DNA, 22 bp, Homo sapiens
agaaacacactgaggcagggaa

SEQ ID NO: 2617272 - DNA, 23 bp, Homo sapiens
agaaacacgaactttagctgcat

SEQ ID NO: 2617273 - DNA, 15 bp, Homo sapiens
agaaacagagacagg

SEQ ID NO: 2617274 - DNA, 12 bp, Homo sapiens
agaaacagtgag

SEQ ID NO: 2617275 - DNA, 13 bp, Homo sapiens
agaaacagtgagt

SEQ ID NO: 2617276 - DNA, 20 bp, Homo sapiens
agaaacagttaactttcaga

SEQ ID NO: 2617277 - DNA, 14 bp, Homo sapiens
agaaacatcagtta

SEQ ID NO: 2617278 - DNA, 14 bp, Homo sapiens
agaaacatggtttt

SEQ ID NO: 2617279 - DNA, 14 bp, Homo sapiens
agaaacattgaaga

SEQ ID NO: 2617280 - DNA, 15 bp, Homo sapiens
agaaacccagactga

SEQ ID NO: 2617281 - DNA, 16 bp, Homo sapiens
agaaaccttattgtac

SEQ ID NO: 2617282 - DNA, 13 bp, Homo sapiens
agaaactgaggaa

SEQ ID NO: 2617283 - DNA, 18 bp, Homo sapiens
agaaactgaggaattttc

SEQ ID NO: 2617284 - DNA, 13 bp, Homo sapiens
agaaactggaact

SEQ ID NO: 2617285 - DNA, 15 bp, Homo sapiens
agaaactggaactct

SEQ ID NO: 2617286 - DNA, 14 bp, Homo sapiens
agaaactgtagtct

SEQ ID NO: 2617287 - DNA, 23 bp, Homo sapiens
agaaacttaaggttacctttgtt

SEQ ID NO: 2617288 - DNA, 14 bp, Homo sapiens
agaaacttccaaat

SEQ ID NO: 2617289 - DNA, 22 bp, Homo sapiens
agaaactttattcaagtaaaaa

SEQ ID NO: 2617290 - DNA, 22 bp, Homo sapiens
agaaagaaacccgacagaggga

SEQ ID NO: 2617291 - DNA, 13 bp, Homo sapiens
agagactggagca

SEQ ID NO: 2617292 - DNA, 17 bp, Homo sapiens
agagactggagcatctg

SEQ ID NO: 2617293 - DNA, 13 bp, Homo sapiens
agagactgggaag

SEQ ID NO: 2617294 - DNA, 23 bp, Homo sapiens
agagactgggaagataggctctg

SEQ ID NO: 2617295 - DNA, 17 bp, Homo sapiens
agagacttttaatcaga

SEQ ID NO: 2617296 - DNA, 17 bp, Homo sapiens
agagagaaaataaaaag

SEQ ID NO: 2617297 - DNA, 22 bp, Homo sapiens
agagagaaaataaaaagttaaa

SEQ ID NO: 2617298 - DNA, 18 bp, Homo sapiens
agagagaagacccttctc

SEQ ID NO: 2617299 - DNA, 19 bp, Homo sapiens
agagagaagtgcccctgct

SEQ ID NO: 2617300 - DNA, 16 bp, Homo sapiens
agagagaccacttttc

SEQ ID NO: 2617301 - DNA, 17 bp, Homo sapiens
agagagatgggagctcc

SEQ ID NO: 2617302 - DNA, 19 bp, Homo sapiens
agagagcaagacgctgtgc

SEQ ID NO: 2617303 - DNA, 23 bp, Homo sapiens
agagagcaagacgctgtgctgcc

SEQ ID NO: 2617304 - DNA, 18 bp, Homo sapiens
agagagcgagcgctaccc

SEQ ID NO: 2617305 - DNA, 18 bp, Homo sapiens
agagagcttaatgataat

SEQ ID NO: 2617306 - DNA, 14 bp, Homo sapiens
agagaggagttcaa

SEQ ID NO: 2617307 - DNA, 14 bp, Homo sapiens
agagaggccttttg

SEQ ID NO: 2617308 - DNA, 15 bp, Homo sapiens
agagagggagaagaa

SEQ ID NO: 2617309 - DNA, 19 bp, Homo sapiens
agagagggagaagaagtca

SEQ ID NO: 2617310 - DNA, 14 bp, Homo sapiens
agagagggcaggca

SEQ ID NO: 2617311 - DNA, 15 bp, Homo sapiens
agagagggcaggcat

SEQ ID NO: 2617312 - DNA, 20 bp, Homo sapiens
agagagggtggtgacctctg

SEQ ID NO: 2617313 - DNA, 22 bp, Homo sapiens
agagagggtggtgacctctgcc

SEQ ID NO: 2617314 - DNA, 18 bp, Homo sapiens
agagagtcccactgcctc

SEQ ID NO: 2617315 - DNA, 20 bp, Homo sapiens
agagagtcccactgcctcag

SEQ ID NO: 2617316 - DNA, 21 bp, Homo sapiens
agagagtcccactgcctcagg

SEQ ID NO: 2617317 - DNA, 21 bp, Homo sapiens
agagatcatcctttccagcat

SEQ ID NO: 2617318 - DNA, 12 bp, Homo sapiens
agagatgaatta

SEQ ID NO: 2617319 - DNA, 17 bp, Homo sapiens
agagatgactgagtcct

SEQ ID NO: 2617320 - DNA, 21 bp, Homo sapiens
agagatgggagctcctctcct

SEQ ID NO: 2617321 - DNA, 24 bp, Homo sapiens
agagatgggagctcctctcctgga

SEQ ID NO: 2617322 - DNA, 17 bp, Homo sapiens
agagatgtgcacccatg

SEQ ID NO: 2617323 - DNA, 12 bp, Homo sapiens
agagatgttttt

SEQ ID NO: 2617324 - DNA, 19 bp, Homo sapiens
agagattacctcctgagaa

SEQ ID NO: 2617325 - DNA, 14 bp, Homo sapiens
agagcaactctgag

SEQ ID NO: 2617326 - DNA, 19 bp, Homo sapiens
agagcaagacgctgtgctg

SEQ ID NO: 2617327 - DNA, 23 bp, Homo sapiens
agagcaagacgctgtgctgccct

SEQ ID NO: 2617328 - DNA, 23 bp, Homo sapiens
agagcaagatcctgtctttaagg

SEQ ID NO: 2617329 - DNA, 21 bp, Homo sapiens
agagcaatgcccgtaatgctt

SEQ ID NO: 2617330 - DNA, 14 bp, Homo sapiens
agagcacactgtag

SEQ ID NO: 2617331 - DNA, 20 bp, Homo sapiens
agagcacacttggcccaagt

SEQ ID NO: 2617332 - DNA, 16 bp, Homo sapiens
agagcacccctctctg

SEQ ID NO: 2617333 - DNA, 20 bp, Homo sapiens
agagcaccttcctcacttcc

SEQ ID NO: 2617334 - DNA, 23 bp, Homo sapiens
agagcagaacggagccccaggcc

SEQ ID NO: 2617335 - DNA, 17 bp, Homo sapiens
agagcagagaccatccc

SEQ ID NO: 2617336 - DNA, 19 bp, Homo sapiens
agagcagcagtgaaaacaa

SEQ ID NO: 2617337 - DNA, 17 bp, Homo sapiens
agagcagcctgtggcat

SEQ ID NO: 2617338 - DNA, 23 bp, Homo sapiens
agagcagcggggcgaagcccagg

SEQ ID NO: 2617339 - DNA, 23 bp, Homo sapiens
agagcatcctgcttctaccatgt

SEQ ID NO: 2617340 - DNA, 19 bp, Homo sapiens
agagcattacgtgagccag

SEQ ID NO: 2617341 - DNA, 19 bp, Homo sapiens
agagcattgaattggagag

SEQ ID NO: 2617342 - DNA, 17 bp, Homo sapiens
agagcattgcatggaca

SEQ ID NO: 2617343 - DNA, 15 bp, Homo sapiens
agagcattgccattc

SEQ ID NO: 2617344 - DNA, 18 bp, Homo sapiens
agagcattgccattccct

SEQ ID NO: 2617345 - DNA, 20 bp, Homo sapiens
agagcatttccaacaccaca

SEQ ID NO: 2617346 - DNA, 15 bp, Homo sapiens
agagccaccaagagg

SEQ ID NO: 2617347 - DNA, 13 bp, Homo sapiens
agagccagagaag

SEQ ID NO: 2617348 - DNA, 16 bp, Homo sapiens
agagccagagaagtga

SEQ ID NO: 2617349 - DNA, 21 bp, Homo sapiens
agagccagagaagtgacaggg

SEQ ID NO: 2617350 - DNA, 13 bp, Homo sapiens
agagccagcaact

SEQ ID NO: 2617351 - DNA, 13 bp, Homo sapiens
agagccagggtct

SEQ ID NO: 2617352 - DNA, 18 bp, Homo sapiens
agagccatgtagaagctg

SEQ ID NO: 2617353 - DNA, 13 bp, Homo sapiens
agagcccacgccc

SEQ ID NO: 2617354 - DNA, 18 bp, Homo sapiens
agagcccacgcccccact

SEQ ID NO: 2617355 - DNA, 14 bp, Homo sapiens
agagccccacacgg

SEQ ID NO: 2617356 - DNA, 14 bp, Homo sapiens
agagccccagctga

SEQ ID NO: 2617357 - DNA, 15 bp, Homo sapiens
agagccccagctgac

SEQ ID NO: 2617358 - DNA, 17 bp, Homo sapiens
agagcccgggagctgct

SEQ ID NO: 2617359 - DNA, 17 bp, Homo sapiens
agagcctgcaggtgctg

SEQ ID NO: 2617360 - DNA, 12 bp, Homo sapiens
agagcctgctgc

SEQ ID NO: 2617361 - DNA, 13 bp, Homo sapiens
agagcctggagaa

SEQ ID NO: 2617362 - DNA, 15 bp, Homo sapiens
agagcctggagaagc

SEQ ID NO: 2617363 - DNA, 18 bp, Homo sapiens
agagcctggtgctgctgc

SEQ ID NO: 2617364 - DNA, 17 bp, Homo sapiens
agagccttccaggggtg

SEQ ID NO: 2617365 - DNA, 21 bp, Homo sapiens
agagccttgcggaaggttcta

SEQ ID NO: 2617366 - DNA, 20 bp, Homo sapiens
agagcgccgtgagttctcag

SEQ ID NO: 2617367 - DNA, 21 bp, Homo sapiens
agagctaacccttatctgtaa

SEQ ID NO: 2617368 - DNA, 18 bp, Homo sapiens
agagctagaacatggaga

SEQ ID NO: 2617369 - DNA, 22 bp, Homo sapiens
agagctagaacatggagagcta

SEQ ID NO: 2617370 - DNA, 23 bp, Homo sapiens
agagctagaacccggcaggctag

SEQ ID NO: 2617371 - DNA, 22 bp, Homo sapiens
agagctagaacctggagaacta

SEQ ID NO: 2617372 - DNA, 18 bp, Homo sapiens
agagctagaacctggagg

SEQ ID NO: 2617373 - DNA, 22 bp, Homo sapiens
agagctagaacctggagggcta

SEQ ID NO: 2617374 - DNA, 23 bp, Homo sapiens
agagctatttaatggccggctgg

SEQ ID NO: 2617375 - DNA, 17 bp, Homo sapiens
agagctgatccagagca

SEQ ID NO: 2617376 - DNA, 13 bp, Homo sapiens
agagctgccctcc

SEQ ID NO: 2617377 - DNA, 15 bp, Homo sapiens
agagctgctctggaa

SEQ ID NO: 2617378 - DNA, 15 bp, Homo sapiens
agagctggagcctgg

SEQ ID NO: 2617379 - DNA, 22 bp, Homo sapiens
agagctgggaggcatggccctg

SEQ ID NO: 2617380 - DNA, 19 bp, Homo sapiens
agagctgggtgtcaagagg

SEQ ID NO: 2617381 - DNA, 15 bp, Homo sapiens
agagctggtgtctga

SEQ ID NO: 2617382 - DNA, 17 bp, Homo sapiens
agagctgtattaagcca

SEQ ID NO: 2617383 - DNA, 21 bp, Homo sapiens
agagctgttcacagccagact

SEQ ID NO: 2617384 - DNA, 16 bp, Homo sapiens
agagcttccctgactc

SEQ ID NO: 2617385 - DNA, 22 bp, Homo sapiens
agagctttctgtccttttggca

SEQ ID NO: 2617386 - DNA, 21 bp, Homo sapiens
agaggaaaagtaaggtgcagt

SEQ ID NO: 2617387 - DNA, 19 bp, Homo sapiens
agaggaaatattgctgggg

SEQ ID NO: 2617388 - DNA, 14 bp, Homo sapiens
agaggaaccaaccc

SEQ ID NO: 2617389 - DNA, 19 bp, Homo sapiens
agaggaactgtccagagag

SEQ ID NO: 2617390 - DNA, 16 bp, Homo sapiens
agaggaaggagaggag

SEQ ID NO: 2617391 - DNA, 16 bp, Homo sapiens
agaggaaggggccaga

SEQ ID NO: 2617392 - DNA, 18 bp, Homo sapiens
agaggaaggggccagagg

SEQ ID NO: 2617393 - DNA, 14 bp, Homo sapiens
agaggacttttctt

SEQ ID NO: 2617394 - DNA, 16 bp, Homo sapiens
agaggagagccagaga

SEQ ID NO: 2617395 - DNA, 13 bp, Homo sapiens
agaggagaggggc

SEQ ID NO: 2617396 - DNA, 14 bp, Homo sapiens
agaggagtcagaga

SEQ ID NO: 2617397 - DNA, 14 bp, Homo sapiens
agaggagttcaatg

SEQ ID NO: 2617398 - DNA, 19 bp, Homo sapiens
agaggagttcaatgatcta

SEQ ID NO: 2617399 - DNA, 13 bp, Homo sapiens
agaggatgagagc

SEQ ID NO: 2617400 - DNA, 14 bp, Homo sapiens
agaggatgagagcc

SEQ ID NO: 2617401 - DNA, 18 bp, Homo sapiens
agaggatgagagcccaga

SEQ ID NO: 2617402 - DNA, 15 bp, Homo sapiens
agaggatggccagtg

SEQ ID NO: 2617403 - DNA, 13 bp, Homo sapiens
agaggcagagaaa

SEQ ID NO: 2617404 - DNA, 20 bp, Homo sapiens
agaggcagagaaagaagaga

SEQ ID NO: 2617405 - DNA, 19 bp, Homo sapiens
agaggcagccccattctgc

SEQ ID NO: 2617406 - DNA, 24 bp, Homo sapiens
agaggcagccccattctgcctgcc

SEQ ID NO: 2617407 - DNA, 13 bp, Homo sapiens
agaggcagggagg

SEQ ID NO: 2617408 - DNA, 17 bp, Homo sapiens
agaggcagggaggggac

SEQ ID NO: 2617409 - DNA, 22 bp, Homo sapiens
agaggcaggggcttgctttgca

SEQ ID NO: 2617410 - DNA, 19 bp, Homo sapiens
agaggccatgggcctcctg

SEQ ID NO: 2617411 - DNA, 14 bp, Homo sapiens
agaggcgggccagc

SEQ ID NO: 2617412 - DNA, 22 bp, Homo sapiens
agaggctcgttgactggctgtg

SEQ ID NO: 2617413 - DNA, 16 bp, Homo sapiens
agaggctggtgctgtg

SEQ ID NO: 2617414 - DNA, 14 bp, Homo sapiens
agagggaagaaaag

SEQ ID NO: 2617415 - DNA, 15 bp, Homo sapiens
agagggacctctccc

SEQ ID NO: 2617416 - DNA, 13 bp, Homo sapiens
agagggagaagaa

SEQ ID NO: 2617417 - DNA, 15 bp, Homo sapiens
agagggagaagaagt

SEQ ID NO: 2617418 - DNA, 16 bp, Homo sapiens
agagggagaagcatga

SEQ ID NO: 2617419 - DNA, 20 bp, Homo sapiens
agagggagggagggctccag

SEQ ID NO: 2617420 - DNA, 21 bp, Homo sapiens
agagggagggagggctccaga

SEQ ID NO: 2617421 - DNA, 22 bp, Homo sapiens
agagggagggagggctccagac

SEQ ID NO: 2617422 - DNA, 23 bp, Homo sapiens
agagggcatgcgcacaaggctga

SEQ ID NO: 2617423 - DNA, 18 bp, Homo sapiens
agagggccaagacttggc

SEQ ID NO: 2617424 - DNA, 14 bp, Homo sapiens
agagggcccaggca

SEQ ID NO: 2617425 - DNA, 16 bp, Homo sapiens
agagggcccaggcagg

SEQ ID NO: 2617426 - DNA, 21 bp, Homo sapiens
agagggcccaggcaggccacc

SEQ ID NO: 2617427 - DNA, 20 bp, Homo sapiens
agaggggaataatagaagaa

SEQ ID NO: 2617428 - DNA, 13 bp, Homo sapiens
agaggggctgtcc

SEQ ID NO: 2617429 - DNA, 23 bp, Homo sapiens
agagggggtggcctcccaactca

SEQ ID NO: 2617430 - DNA, 16 bp, Homo sapiens
agaggggtggagactg

SEQ ID NO: 2617431 - DNA, 19 bp, Homo sapiens
agagggtggtgacctctgc

SEQ ID NO: 2617432 - DNA, 22 bp, Homo sapiens
agagggtggtgacctctgcctg

SEQ ID NO: 2617433 - DNA, 16 bp, Homo sapiens
agaggtaaaagtgtga

SEQ ID NO: 2617434 - DNA, 19 bp, Homo sapiens
agaggtaaaagtgtgagca

SEQ ID NO: 2617435 - DNA, 14 bp, Homo sapiens
agcacttggagcca

SEQ ID NO: 2617436 - DNA, 23 bp, Homo sapiens
agcacttggagccaagggttcag

SEQ ID NO: 2617437 - DNA, 21 bp, Homo sapiens
agcactttgggaggccaaggt

SEQ ID NO: 2617438 - DNA, 21 bp, Homo sapiens
agcactttgggaggctgaggc

SEQ ID NO: 2617439 - DNA, 22 bp, Homo sapiens
agcactttgggaggctgaggcg

SEQ ID NO: 2617440 - DNA, 15 bp, Homo sapiens
agcagaaatctagaa

SEQ ID NO: 2617441 - DNA, 19 bp, Homo sapiens
agcagaaatgccttaccct

SEQ ID NO: 2617442 - DNA, 14 bp, Homo sapiens
agcagaactgaacc

SEQ ID NO: 2617443 - DNA, 16 bp, Homo sapiens
agcagaagtggagctg

SEQ ID NO: 2617444 - DNA, 19 bp, Homo sapiens
agcagaatagcaaggtgct

SEQ ID NO: 2617445 - DNA, 22 bp, Homo sapiens
agcagaccaccccgcctgccct

SEQ ID NO: 2617446 - DNA, 21 bp, Homo sapiens
agcagagaatgaaagggccca

SEQ ID NO: 2617447 - DNA, 16 bp, Homo sapiens
agcagagaccatccct

SEQ ID NO: 2617448 - DNA, 20 bp, Homo sapiens
agcagagaccatccctgaag

SEQ ID NO: 2617449 - DNA, 20 bp, Homo sapiens
agcagagcaccttagacagt

SEQ ID NO: 2617450 - DNA, 15 bp, Homo sapiens
agcagagctctgccg

SEQ ID NO: 2617451 - DNA, 13 bp, Homo sapiens
agcagaggcactg

SEQ ID NO: 2617452 - DNA, 15 bp, Homo sapiens
agcagaggcactggg

SEQ ID NO: 2617453 - DNA, 20 bp, Homo sapiens
agcagatacatatgagtgtg

SEQ ID NO: 2617454 - DNA, 13 bp, Homo sapiens
agcagatgcaaag

SEQ ID NO: 2617455 - DNA, 18 bp, Homo sapiens
agcagatgcaaagaggca

SEQ ID NO: 2617456 - DNA, 19 bp, Homo sapiens
agcagatgcaaagaggcaa

SEQ ID NO: 2617457 - DNA, 12 bp, Homo sapiens
agcagatgcaga

SEQ ID NO: 2617458 - DNA, 13 bp, Homo sapiens
agcagatgcagag

SEQ ID NO: 2617459 - DNA, 17 bp, Homo sapiens
agcagatgcagagagcc

SEQ ID NO: 2617460 - DNA, 21 bp, Homo sapiens
agcagatgcagagagccattt

SEQ ID NO: 2617461 - DNA, 20 bp, Homo sapiens
agcagattggagaaaccctt

SEQ ID NO: 2617462 - DNA, 21 bp, Homo sapiens
agcagattttaattttgaata

SEQ ID NO: 2617463 - DNA, 20 bp, Homo sapiens
agcagccaagctccttggga

SEQ ID NO: 2617464 - DNA, 21 bp, Homo sapiens
agcagccaagctccttgggag

SEQ ID NO: 2617465 - DNA, 11 bp, Homo sapiens
agcagccacat

SEQ ID NO: 2617466 - DNA, 16 bp, Homo sapiens
agcagccagctctcag

SEQ ID NO: 2617467 - DNA, 18 bp, Homo sapiens
agcagccagctctcagcc

SEQ ID NO: 2617468 - DNA, 19 bp, Homo sapiens
agcagccagctctcagcca

SEQ ID NO: 2617469 - DNA, 21 bp, Homo sapiens
agcagcgaccacccctgcctc

SEQ ID NO: 2617470 - DNA, 23 bp, Homo sapiens
agcagcgaccgccccctcctcta

SEQ ID NO: 2617471 - DNA, 21 bp, Homo sapiens
agcagcggggcgaagcccagg

SEQ ID NO: 2617472 - DNA, 15 bp, Homo sapiens
agcagcggtggcctc

SEQ ID NO: 2617473 - DNA, 17 bp, Homo sapiens
agcagctatctctcagt

SEQ ID NO: 2617474 - DNA, 13 bp, Homo sapiens
agcagctcttgct

SEQ ID NO: 2617475 - DNA, 23 bp, Homo sapiens
agcagctcttgctaatcagtgtc

SEQ ID NO: 2617476 - DNA, 18 bp, Homo sapiens
agcagcttagactaaggc

SEQ ID NO: 2617477 - DNA, 15 bp, Homo sapiens
agcagcttcaccaga

SEQ ID NO: 2617478 - DNA, 23 bp, Homo sapiens
agcaggaaatgaaaatgtcttgt

SEQ ID NO: 2617479 - DNA, 14 bp, Homo sapiens
agcaggagaggaga

SEQ ID NO: 2617480 - DNA, 19 bp, Homo sapiens
agcaggagaggagagccag

SEQ ID NO: 2617481 - DNA, 22 bp, Homo sapiens
agcaggagaggagagccagaga

SEQ ID NO: 2617482 - DNA, 15 bp, Homo sapiens
agcaggaggcccctg

SEQ ID NO: 2617483 - DNA, 23 bp, Homo sapiens
agcaggaggcccctggcccagcg

SEQ ID NO: 2617484 - DNA, 14 bp, Homo sapiens
agcaggcacatgga

SEQ ID NO: 2617485 - DNA, 20 bp, Homo sapiens
agcaggctactgtcagctcc

SEQ ID NO: 2617486 - DNA, 22 bp, Homo sapiens
agcaggctggcagctctccagt

SEQ ID NO: 2617487 - DNA, 13 bp, Homo sapiens
agcagggaaacag

SEQ ID NO: 2617488 - DNA, 14 bp, Homo sapiens
agcagggaaacagc

SEQ ID NO: 2617489 - DNA, 20 bp, Homo sapiens
agcagggagggcttctgcca

SEQ ID NO: 2617490 - DNA, 14 bp, Homo sapiens
agcagggctcagcg

SEQ ID NO: 2617491 - DNA, 22 bp, Homo sapiens
agcagggctcagcggggacagc

SEQ ID NO: 2617492 - DNA, 16 bp, Homo sapiens
agcagggctgctgtga

SEQ ID NO: 2617493 - DNA, 18 bp, Homo sapiens
agcagggtagtctggttt

SEQ ID NO: 2617494 - DNA, 16 bp, Homo sapiens
agcaggtggcatctct

SEQ ID NO: 2617495 - DNA, 13 bp, Homo sapiens
agcaggtggggag

SEQ ID NO: 2617496 - DNA, 18 bp, Homo sapiens
agcaggtggtcctgagac

SEQ ID NO: 2617497 - DNA, 22 bp, Homo sapiens
agcagtagaaataatatgcatt

SEQ ID NO: 2617498 - DNA, 19 bp, Homo sapiens
agcagtcctgcctcagcct

SEQ ID NO: 2617499 - DNA, 22 bp, Homo sapiens
agcagtcctgcctcagcctccg

SEQ ID NO: 2617500 - DNA, 22 bp, Homo sapiens
agcagtgaatgattcagtgtta

SEQ ID NO: 2617501 - DNA, 16 bp, Homo sapiens
agcagtgagaaaaagc

SEQ ID NO: 2617502 - DNA, 15 bp, Homo sapiens
agcagtgcaggcaca

SEQ ID NO: 2617503 - DNA, 17 bp, Homo sapiens
agcagtgccttccataa

SEQ ID NO: 2617504 - DNA, 12 bp, Homo sapiens
agcagtggacac

SEQ ID NO: 2617505 - DNA, 19 bp, Homo sapiens
agcagtggacaccaggagt

SEQ ID NO: 2617506 - DNA, 13 bp, Homo sapiens
agcagtgtcatca

SEQ ID NO: 2617507 - DNA, 16 bp, Homo sapiens
agcagtgtcttccata

SEQ ID NO: 2617508 - DNA, 17 bp, Homo sapiens
agcagtgtcttccataa

SEQ ID NO: 2617509 - DNA, 15 bp, Homo sapiens
agcagtgtgaggcca

SEQ ID NO: 2617510 - DNA, 23 bp, Homo sapiens
agcagttgaaaagactccaaaga

SEQ ID NO: 2617511 - DNA, 19 bp, Homo sapiens
agcagtttctgtcctgctg

SEQ ID NO: 2617512 - DNA, 23 bp, Homo sapiens
agcataaaaattagccaagtgtg

SEQ ID NO: 2617513 - DNA, 17 bp, Homo sapiens
agcataagtttctggga

SEQ ID NO: 2617514 - DNA, 14 bp, Homo sapiens
agcatacatttata

SEQ ID NO: 2617515 - DNA, 20 bp, Homo sapiens
agcatacatttataatgttt

SEQ ID NO: 2617516 - DNA, 13 bp, Homo sapiens
agcataccaacac

SEQ ID NO: 2617517 - DNA, 19 bp, Homo sapiens
agcatacctttattgtgat

SEQ ID NO: 2617518 - DNA, 18 bp, Homo sapiens
agcatacgtacacatttt

SEQ ID NO: 2617519 - DNA, 19 bp, Homo sapiens
agcatacgtacacatttta

SEQ ID NO: 2617520 - DNA, 21 bp, Homo sapiens
agcatacgtacacattttatt

SEQ ID NO: 2617521 - DNA, 13 bp, Homo sapiens
agcatcaaactct

SEQ ID NO: 2617522 - DNA, 19 bp, Homo sapiens
agcatcacctcaggccagg

SEQ ID NO: 2617523 - DNA, 14 bp, Homo sapiens
agcatcaggccagg

SEQ ID NO: 2617524 - DNA, 20 bp, Homo sapiens
agcatcattttgcattcaaa

SEQ ID NO: 2617525 - DNA, 24 bp, Homo sapiens
agcatccatgtgtggactcaagtc

SEQ ID NO: 2617526 - DNA, 21 bp, Homo sapiens
agcatcccttgaccaggcctg

SEQ ID NO: 2617527 - DNA, 22 bp, Homo sapiens
agcatcccttgaccaggcctgg

SEQ ID NO: 2617528 - DNA, 23 bp, Homo sapiens
agcatcccttgaccaggcctggg

SEQ ID NO: 2617529 - DNA, 17 bp, Homo sapiens
agcatcctggcacccgg

SEQ ID NO: 2617530 - DNA, 21 bp, Homo sapiens
agcatccttttctgcagaggg

SEQ ID NO: 2617531 - DNA, 14 bp, Homo sapiens
agcatctcatgagt

SEQ ID NO: 2617532 - DNA, 22 bp, Homo sapiens
agcatctcttgaggccaggagt

SEQ ID NO: 2617533 - DNA, 14 bp, Homo sapiens
agcatgaaaaagca

SEQ ID NO: 2617534 - DNA, 17 bp, Homo sapiens
agcatgacaagccccag

SEQ ID NO: 2617535 - DNA, 21 bp, Homo sapiens
agcatgacaagccccaggcag

SEQ ID NO: 2617536 - DNA, 23 bp, Homo sapiens
agcatgcctggatggggctgcac

SEQ ID NO: 2617537 - DNA, 13 bp, Homo sapiens
agcatggctgtga

SEQ ID NO: 2617538 - DNA, 19 bp, Homo sapiens
agcatgggcctggccacct

SEQ ID NO: 2617539 - DNA, 21 bp, Homo sapiens
agcatgtactgagccttgtaa

SEQ ID NO: 2617540 - DNA, 17 bp, Homo sapiens
agcatgttgctgaggag

SEQ ID NO: 2617541 - DNA, 17 bp, Homo sapiens
agcatgtttcatgtttt

SEQ ID NO: 2617542 - DNA, 18 bp, Homo sapiens
agcatgtttcatgttttg

SEQ ID NO: 2617543 - DNA, 15 bp, Homo sapiens
agcattacaaattgc

SEQ ID NO: 2617544 - DNA, 18 bp, Homo sapiens
agcattcacaacttgttt

SEQ ID NO: 2617545 - DNA, 15 bp, Homo sapiens
agcattcagagagca

SEQ ID NO: 2617546 - DNA, 17 bp, Homo sapiens
agcattcagagagcagc

SEQ ID NO: 2617547 - DNA, 15 bp, Homo sapiens
agcattccaacaaag

SEQ ID NO: 2617548 - DNA, 17 bp, Homo sapiens
agcattccaacaaaggg

SEQ ID NO: 2617549 - DNA, 16 bp, Homo sapiens
agcattccttctttga

SEQ ID NO: 2617550 - DNA, 13 bp, Homo sapiens
agcattgcatgga

SEQ ID NO: 2617551 - DNA, 14 bp, Homo sapiens
agcattgccattcc

SEQ ID NO: 2617552 - DNA, 17 bp, Homo sapiens
agcattgctttctgaaa

SEQ ID NO: 2617553 - DNA, 21 bp, Homo sapiens
agcattgtttgcttattgttc

SEQ ID NO: 2617554 - DNA, 20 bp, Homo sapiens
agcatttagtccaatgtctt

SEQ ID NO: 2617555 - DNA, 21 bp, Homo sapiens
agcatttcattcttctctagc

SEQ ID NO: 2617556 - DNA, 17 bp, Homo sapiens
agcatttccaacaccac

SEQ ID NO: 2617557 - DNA, 19 bp, Homo sapiens
agcatttccaacaccacag

SEQ ID NO: 2617558 - DNA, 22 bp, Homo sapiens
agcatttccaacaccacagaca

SEQ ID NO: 2617559 - DNA, 13 bp, Homo sapiens
agcatttctgaag

SEQ ID NO: 2617560 - DNA, 15 bp, Homo sapiens
agcattttgctaaat

SEQ ID NO: 2617561 - DNA, 22 bp, Homo sapiens
agcattttgctaaatgtgaatg

SEQ ID NO: 2617562 - DNA, 16 bp, Homo sapiens
agccaaaccctgtctg

SEQ ID NO: 2617563 - DNA, 12 bp, Homo sapiens
agccaaagccaa

SEQ ID NO: 2617564 - DNA, 19 bp, Homo sapiens
agccaaagctaggcctggc

SEQ ID NO: 2617565 - DNA, 17 bp, Homo sapiens
agccaaatcaaaatatg

SEQ ID NO: 2617566 - DNA, 19 bp, Homo sapiens
agccaacacccatctgttt

SEQ ID NO: 2617567 - DNA, 23 bp, Homo sapiens
agccaacaccctgtctaaaaaac

SEQ ID NO: 2617568 - DNA, 18 bp, Homo sapiens
agccaacagaagcttcca

SEQ ID NO: 2617569 - DNA, 15 bp, Homo sapiens
agccaacaggtggca

SEQ ID NO: 2617570 - DNA, 21 bp, Homo sapiens
agccaacagtcaaaacagaga

SEQ ID NO: 2617571 - DNA, 16 bp, Homo sapiens
agccaacccctgtgga

SEQ ID NO: 2617572 - DNA, 20 bp, Homo sapiens
agccaacttggctttcccgg

SEQ ID NO: 2617573 - DNA, 15 bp, Homo sapiens
agccaacttgtaaat

SEQ ID NO: 2617574 - DNA, 19 bp, Homo sapiens
agccaacttgtaaatacac

SEQ ID NO: 2617575 - DNA, 20 bp, Homo sapiens
agccaacttgtaaatacacc

SEQ ID NO: 2617576 - DNA, 15 bp, Homo sapiens
agccaacttttgcat

SEQ ID NO: 2617577 - DNA, 13 bp, Homo sapiens
agccaagcagcca

SEQ ID NO: 2617578 - DNA, 19 bp, Homo sapiens
agctctccagtcaggaggc

SEQ ID NO: 2617579 - DNA, 18 bp, Homo sapiens
agctctccggtctctctc

SEQ ID NO: 2617580 - DNA, 18 bp, Homo sapiens
agctctgaaaccagtgtt

SEQ ID NO: 2617581 - DNA, 14 bp, Homo sapiens
agctctgcagccca

SEQ ID NO: 2617582 - DNA, 22 bp, Homo sapiens
agctctgctcctctccccagca

SEQ ID NO: 2617583 - DNA, 17 bp, Homo sapiens
agctctggaccagcctg

SEQ ID NO: 2617584 - DNA, 12 bp, Homo sapiens
agctctggctga

SEQ ID NO: 2617585 - DNA, 16 bp, Homo sapiens
agctctggctgaaccc

SEQ ID NO: 2617586 - DNA, 15 bp, Homo sapiens
agctctgggagagga

SEQ ID NO: 2617587 - DNA, 20 bp, Homo sapiens
agctctggtgacaccagcct

SEQ ID NO: 2617588 - DNA, 12 bp, Homo sapiens
agctctgtatca

SEQ ID NO: 2617589 - DNA, 14 bp, Homo sapiens
agctctgtcctggg

SEQ ID NO: 2617590 - DNA, 23 bp, Homo sapiens
agctctgtcctgggagtgagctg

SEQ ID NO: 2617591 - DNA, 15 bp, Homo sapiens
agctctgtttcggtt

SEQ ID NO: 2617592 - DNA, 15 bp, Homo sapiens
agctcttcaggcctc

SEQ ID NO: 2617593 - DNA, 17 bp, Homo sapiens
agctcttcaggcctccc

SEQ ID NO: 2617594 - DNA, 17 bp, Homo sapiens
agctcttctccaggctg

SEQ ID NO: 2617595 - DNA, 17 bp, Homo sapiens
agctcttctccccaggt

SEQ ID NO: 2617596 - DNA, 20 bp, Homo sapiens
agctcttctccccaggtgtg

SEQ ID NO: 2617597 - DNA, 12 bp, Homo sapiens
agctcttgccct

SEQ ID NO: 2617598 - DNA, 15 bp, Homo sapiens
agctcttgcccttcc

SEQ ID NO: 2617599 - DNA, 16 bp, Homo sapiens
agctcttgcccttccc

SEQ ID NO: 2617600 - DNA, 12 bp, Homo sapiens
agctgaaaatat

SEQ ID NO: 2617601 - DNA, 22 bp, Homo sapiens
agctgaacagccaaatgcatgg

SEQ ID NO: 2617602 - DNA, 16 bp, Homo sapiens
agctgaagattttgga

SEQ ID NO: 2617603 - DNA, 15 bp, Homo sapiens
agctgaatacattct

SEQ ID NO: 2617604 - DNA, 19 bp, Homo sapiens
agctgacacaaacctgcct

SEQ ID NO: 2617605 - DNA, 21 bp, Homo sapiens
agctgacacaaacctgcctgg

SEQ ID NO: 2617606 - DNA, 23 bp, Homo sapiens
agctgacccagccccttgagaaa

SEQ ID NO: 2617607 - DNA, 12 bp, Homo sapiens
agctgacctctg

SEQ ID NO: 2617608 - DNA, 15 bp, Homo sapiens
agctgagcagggaga

SEQ ID NO: 2617609 - DNA, 14 bp, Homo sapiens
agctgagcaggtgt

SEQ ID NO: 2617610 - DNA, 23 bp, Homo sapiens
agctgaggggggccgtgcccagg

SEQ ID NO: 2617611 - DNA, 21 bp, Homo sapiens
agctgaggtctcttgagggag

SEQ ID NO: 2617612 - DNA, 21 bp, Homo sapiens
agctgatacaaattgcagact

SEQ ID NO: 2617613 - DNA, 19 bp, Homo sapiens
agctgatccagagcacaga

SEQ ID NO: 2617614 - DNA, 17 bp, Homo sapiens
agctgatgttggaagag

SEQ ID NO: 2617615 - DNA, 20 bp, Homo sapiens
agctgattttaacaataact

SEQ ID NO: 2617616 - DNA, 24 bp, Homo sapiens
agctgcacagggcagctgggccca

SEQ ID NO: 2617617 - DNA, 18 bp, Homo sapiens
agctgcaccctcaggcag

SEQ ID NO: 2617618 - DNA, 19 bp, Homo sapiens
agctgcaccctcaggcagg

SEQ ID NO: 2617619 - DNA, 16 bp, Homo sapiens
agctgcagagccaccc

SEQ ID NO: 2617620 - DNA, 19 bp, Homo sapiens
agctgcatcctccaagaat

SEQ ID NO: 2617621 - DNA, 14 bp, Homo sapiens
agctgccccagcca

SEQ ID NO: 2617622 - DNA, 15 bp, Homo sapiens
agctgccccagccag

SEQ ID NO: 2617623 - DNA, 11 bp, Homo sapiens
agctgccctcc

SEQ ID NO: 2617624 - DNA, 22 bp, Homo sapiens
agctgccctccttgtccaccca

SEQ ID NO: 2617625 - DNA, 23 bp, Homo sapiens
agctgcctgcttttcactgctgc

SEQ ID NO: 2617626 - DNA, 21 bp, Homo sapiens
agctgcctgggatccctcatc

SEQ ID NO: 2617627 - DNA, 22 bp, Homo sapiens
agctgcctgtagttaggaaata

SEQ ID NO: 2617628 - DNA, 16 bp, Homo sapiens
agctgcctgttcagct

SEQ ID NO: 2617629 - DNA, 20 bp, Homo sapiens
agctgcggtccacccaggag

SEQ ID NO: 2617630 - DNA, 21 bp, Homo sapiens
agctgcggtccacccaggagc

SEQ ID NO: 2617631 - DNA, 15 bp, Homo sapiens
agctgctacaaagaa

SEQ ID NO: 2617632 - DNA, 20 bp, Homo sapiens
agctgctacaaagaagacat

SEQ ID NO: 2617633 - DNA, 22 bp, Homo sapiens
agctgctacaaagaagacatgt

SEQ ID NO: 2617634 - DNA, 23 bp, Homo sapiens
agctgctctgaattagtccttgc

SEQ ID NO: 2617635 - DNA, 14 bp, Homo sapiens
agctgctctggaaa

SEQ ID NO: 2617636 - DNA, 14 bp, Homo sapiens
agctgctgaaacaa

SEQ ID NO: 2617637 - DNA, 20 bp, Homo sapiens
agctgctgaaacaacaaata

SEQ ID NO: 2617638 - DNA, 14 bp, Homo sapiens
agctgctggagact

SEQ ID NO: 2617639 - DNA, 23 bp, Homo sapiens
agctgctggagactcctaggcag

SEQ ID NO: 2617640 - DNA, 14 bp, Homo sapiens
agctgcttgtgtcc

SEQ ID NO: 2617641 - DNA, 22 bp, Homo sapiens
agctgcttttgtctatgggact

SEQ ID NO: 2617642 - DNA, 22 bp, Homo sapiens
agctggaggactagaacctgga

SEQ ID NO: 2617643 - DNA, 14 bp, Homo sapiens
agctggccccgccg

SEQ ID NO: 2617644 - DNA, 15 bp, Homo sapiens
agctggccccgccgc

SEQ ID NO: 2617645 - DNA, 18 bp, Homo sapiens
agctggccccgccgcctg

SEQ ID NO: 2617646 - DNA, 20 bp, Homo sapiens
agctggccgagggtcctggc

SEQ ID NO: 2617647 - DNA, 18 bp, Homo sapiens
agctggcgtctgtcttca

SEQ ID NO: 2617648 - DNA, 15 bp, Homo sapiens
agctgggactacagg

SEQ ID NO: 2617649 - DNA, 16 bp, Homo sapiens
agctgggactacaggc

SEQ ID NO: 2617650 - DNA, 18 bp, Homo sapiens
agctgggactacaggcac

SEQ ID NO: 2617651 - DNA, 20 bp, Homo sapiens
agctgggactacaggcaccc

SEQ ID NO: 2617652 - DNA, 19 bp, Homo sapiens
agctgggaggcaagagggg

SEQ ID NO: 2617653 - DNA, 14 bp, Homo sapiens
agctgggaggcatg

SEQ ID NO: 2617654 - DNA, 16 bp, Homo sapiens
agctgggcagaaggcc

SEQ ID NO: 2617655 - DNA, 18 bp, Homo sapiens
agctgggcagaaggccaa

SEQ ID NO: 2617656 - DNA, 16 bp, Homo sapiens
agctgggccccagccc

SEQ ID NO: 2617657 - DNA, 20 bp, Homo sapiens
agctggggcgtggggagggc

SEQ ID NO: 2617658 - DNA, 18 bp, Homo sapiens
agctgggggccatgagct

SEQ ID NO: 2617659 - DNA, 20 bp, Homo sapiens
agctgggggccatgagctcc

SEQ ID NO: 2617660 - DNA, 20 bp, Homo sapiens
agctgggtggcactgccatg

SEQ ID NO: 2617661 - DNA, 17 bp, Homo sapiens
agctgggtgtcaagagg

SEQ ID NO: 2617662 - DNA, 15 bp, Homo sapiens
agctggtagttagta

SEQ ID NO: 2617663 - DNA, 21 bp, Homo sapiens
agctggtagttagtagcatgt

SEQ ID NO: 2617664 - DNA, 22 bp, Homo sapiens
agctggtagttagtagcatgtt

SEQ ID NO: 2617665 - DNA, 16 bp, Homo sapiens
agctggtcccactcag

SEQ ID NO: 2617666 - DNA, 21 bp, Homo sapiens
agctggtcccactcagtccat

SEQ ID NO: 2617667 - DNA, 13 bp, Homo sapiens
agctggtgcatta

SEQ ID NO: 2617668 - DNA, 17 bp, Homo sapiens
agctggtgcattacaga

SEQ ID NO: 2617669 - DNA, 18 bp, Homo sapiens
agctggtgcattacagag

SEQ ID NO: 2617670 - DNA, 18 bp, Homo sapiens
agctggtgtctgattgtt

SEQ ID NO: 2617671 - DNA, 17 bp, Homo sapiens
agctgtaagaagagact

SEQ ID NO: 2617672 - DNA, 23 bp, Homo sapiens
agctgtaagaagagactgggaag

SEQ ID NO: 2617673 - DNA, 17 bp, Homo sapiens
agctgtaaggcatgaag

SEQ ID NO: 2617674 - DNA, 21 bp, Homo sapiens
agctgtacttcgtcttctaat

SEQ ID NO: 2617675 - DNA, 20 bp, Homo sapiens
agctgtagtagccctttctg

SEQ ID NO: 2617676 - DNA, 21 bp, Homo sapiens
agctgtagtagccctttctgt

SEQ ID NO: 2617677 - DNA, 11 bp, Homo sapiens
agctgtattga

SEQ ID NO: 2617678 - DNA, 15 bp, Homo sapiens
agctgtattgaatca

SEQ ID NO: 2617679 - DNA, 21 bp, Homo sapiens
agctgtcacttcgcgtgccct

SEQ ID NO: 2617680 - DNA, 18 bp, Homo sapiens
agctgtgagacagtggga

SEQ ID NO: 2617681 - DNA, 10 bp, Homo sapiens
agctgtgcag

SEQ ID NO: 2617682 - DNA, 19 bp, Homo sapiens
agctgtgcaggtggggaga

SEQ ID NO: 2617683 - DNA, 21 bp, Homo sapiens
agctgtgctctggacaggcat

SEQ ID NO: 2617684 - DNA, 19 bp, Homo sapiens
agctgtggactttgttcac

SEQ ID NO: 2617685 - DNA, 13 bp, Homo sapiens
agctgtgtgaaat

SEQ ID NO: 2617686 - DNA, 14 bp, Homo sapiens
agctgtgtgaaata

SEQ ID NO: 2617687 - DNA, 23 bp, Homo sapiens
agctgtgtgaaataccagtgtgg

SEQ ID NO: 2617688 - DNA, 14 bp, Homo sapiens
agctgttcacagcc

SEQ ID NO: 2617689 - DNA, 15 bp, Homo sapiens
agctgttctgtccct

SEQ ID NO: 2617690 - DNA, 14 bp, Homo sapiens
agctgttgagctgt

SEQ ID NO: 2617691 - DNA, 17 bp, Homo sapiens
agctgttgagctgtttt

SEQ ID NO: 2617692 - DNA, 22 bp, Homo sapiens
agctgttggcctctgcaaagga

SEQ ID NO: 2617693 - DNA, 15 bp, Homo sapiens
agctgttgtacattt

SEQ ID NO: 2617694 - DNA, 16 bp, Homo sapiens
agctgttgtacattta

SEQ ID NO: 2617695 - DNA, 16 bp, Homo sapiens
agctgtttaagatggg

SEQ ID NO: 2617696 - DNA, 16 bp, Homo sapiens
agctgtttactaggga

SEQ ID NO: 2617697 - DNA, 17 bp, Homo sapiens
agctgtttatggcctca

SEQ ID NO: 2617698 - DNA, 18 bp, Homo sapiens
agctgtttatggcctcag

SEQ ID NO: 2617699 - DNA, 13 bp, Homo sapiens
agctgtttgtcat

SEQ ID NO: 2617700 - DNA, 15 bp, Homo sapiens
agctgttttccctga

SEQ ID NO: 2617701 - DNA, 14 bp, Homo sapiens
agctgttttcttct

SEQ ID NO: 2617702 - DNA, 20 bp, Homo sapiens
agcttaaaggggctagagtg

SEQ ID NO: 2617703 - DNA, 15 bp, Homo sapiens
agcttacaagccagc

SEQ ID NO: 2617704 - DNA, 20 bp, Homo sapiens
agcttaccagaagcttccat

SEQ ID NO: 2617705 - DNA, 22 bp, Homo sapiens
agcttaccagaagcttccatag

SEQ ID NO: 2617706 - DNA, 15 bp, Homo sapiens
agcttagacctcagc

SEQ ID NO: 2617707 - DNA, 16 bp, Homo sapiens
agcttagacctcagcc

SEQ ID NO: 2617708 - DNA, 20 bp, Homo sapiens
agcttagacctcagcctgtg

SEQ ID NO: 2617709 - DNA, 15 bp, Homo sapiens
agcttagagcctccc

SEQ ID NO: 2617710 - DNA, 16 bp, Homo sapiens
agcttagcaggagagg

SEQ ID NO: 2617711 - DNA, 22 bp, Homo sapiens
agcttagcaggagaggagagcc

SEQ ID NO: 2617712 - DNA, 18 bp, Homo sapiens
agcttcaccccaatccca

SEQ ID NO: 2617713 - DNA, 21 bp, Homo sapiens
agcttcagaagtttggcaata

SEQ ID NO: 2617714 - DNA, 15 bp, Homo sapiens
agcttcagccaggag

SEQ ID NO: 2617715 - DNA, 11 bp, Homo sapiens
agcttcaggtt

SEQ ID NO: 2617716 - DNA, 23 bp, Homo sapiens
agcttcaggttatcgaaataaca

SEQ ID NO: 2617717 - DNA, 19 bp, Homo sapiens
agcttcatttcctgtgtct

SEQ ID NO: 2617718 - DNA, 19 bp, Homo sapiens
agcttcatttgtgtcaatg

SEQ ID NO: 2617719 - DNA, 17 bp, Homo sapiens
agcttccagtccaatct

SEQ ID NO: 2617720 - DNA, 22 bp, Homo sapiens
agcttcctacccacacctctgc

SEQ ID NO: 2617721 - DNA, 17 bp, Homo sapiens
agcttctatcccaggag

SEQ ID NO: 2617722 - DNA, 22 bp, Homo sapiens
aggctatggacagggcatgcca

SEQ ID NO: 2617723 - DNA, 21 bp, Homo sapiens
aggctattgtcccctaaacca

SEQ ID NO: 2617724 - DNA, 11 bp, Homo sapiens
aggctcagaga

SEQ ID NO: 2617725 - DNA, 24 bp, Homo sapiens
aggctcagagatgtgcacccatgg

SEQ ID NO: 2617726 - DNA, 18 bp, Homo sapiens
aggctcagtctcaggagc

SEQ ID NO: 2617727 - DNA, 19 bp, Homo sapiens
aggctcagtctcaggagca

SEQ ID NO: 2617728 - DNA, 22 bp, Homo sapiens
aggctcatagggaagacctgct

SEQ ID NO: 2617729 - DNA, 13 bp, Homo sapiens
aggctcctgtgct

SEQ ID NO: 2617730 - DNA, 17 bp, Homo sapiens
aggctcgagcatgcctg

SEQ ID NO: 2617731 - DNA, 21 bp, Homo sapiens
aggctcgagcatgcctggatg

SEQ ID NO: 2617732 - DNA, 17 bp, Homo sapiens
aggctctgcacagatgg

SEQ ID NO: 2617733 - DNA, 12 bp, Homo sapiens
aggctctgccct

SEQ ID NO: 2617734 - DNA, 14 bp, Homo sapiens
aggctctgccctgc

SEQ ID NO: 2617735 - DNA, 23 bp, Homo sapiens
aggctctgccctgccctagctcc

SEQ ID NO: 2617736 - DNA, 14 bp, Homo sapiens
aggctctgcccttg

SEQ ID NO: 2617737 - DNA, 16 bp, Homo sapiens
aggctctgcccttggt

SEQ ID NO: 2617738 - DNA, 21 bp, Homo sapiens
aggctctgtgctgaccctcct

SEQ ID NO: 2617739 - DNA, 22 bp, Homo sapiens
aggctctgtgctgaccctcctg

SEQ ID NO: 2617740 - DNA, 16 bp, Homo sapiens
aggctcttctccccag

SEQ ID NO: 2617741 - DNA, 15 bp, Homo sapiens
aggctcttctgacta

SEQ ID NO: 2617742 - DNA, 22 bp, Homo sapiens
aggctctttggggtcagccagg

SEQ ID NO: 2617743 - DNA, 17 bp, Homo sapiens
aggctgaaagaggccaa

SEQ ID NO: 2617744 - DNA, 14 bp, Homo sapiens
aggctgaccaagag

SEQ ID NO: 2617745 - DNA, 22 bp, Homo sapiens
aggctgaccaagagagaaagaa

SEQ ID NO: 2617746 - DNA, 14 bp, Homo sapiens
aggctgagacagga

SEQ ID NO: 2617747 - DNA, 20 bp, Homo sapiens
aggctgaggaaaggccagct

SEQ ID NO: 2617748 - DNA, 11 bp, Homo sapiens
aggctgaggac

SEQ ID NO: 2617749 - DNA, 20 bp, Homo sapiens
aggctgataattccagtggt

SEQ ID NO: 2617750 - DNA, 21 bp, Homo sapiens
aggctgcagaaggccaagaat

SEQ ID NO: 2617751 - DNA, 12 bp, Homo sapiens
aggctgctggcg

SEQ ID NO: 2617752 - DNA, 13 bp, Homo sapiens
aggctgcttggga

SEQ ID NO: 2617753 - DNA, 15 bp, Homo sapiens
aggctggagcccagg

SEQ ID NO: 2617754 - DNA, 22 bp, Homo sapiens
aggctggatcctagccttatcc

SEQ ID NO: 2617755 - DNA, 15 bp, Homo sapiens
aggctggcagctctc

SEQ ID NO: 2617756 - DNA, 19 bp, Homo sapiens
aggctggcagctctccagt

SEQ ID NO: 2617757 - DNA, 21 bp, Homo sapiens
aggctggcagctctccagtca

SEQ ID NO: 2617758 - DNA, 22 bp, Homo sapiens
aggctggcgcagccaaggccga

SEQ ID NO: 2617759 - DNA, 17 bp, Homo sapiens
aggctggcgtgcagtgg

SEQ ID NO: 2617760 - DNA, 20 bp, Homo sapiens
aggctggcttgtcccctcct

SEQ ID NO: 2617761 - DNA, 22 bp, Homo sapiens
aggctggcttgtcccctcctca

SEQ ID NO: 2617762 - DNA, 16 bp, Homo sapiens
aggctgggagagcctt

SEQ ID NO: 2617763 - DNA, 13 bp, Homo sapiens
aggctgggcaagg

SEQ ID NO: 2617764 - DNA, 18 bp, Homo sapiens
aggctgggctcccttccc

SEQ ID NO: 2617765 - DNA, 23 bp, Homo sapiens
aggctgggctcccttcccacctc

SEQ ID NO: 2617766 - DNA, 19 bp, Homo sapiens
aggctgggcttcagtggca

SEQ ID NO: 2617767 - DNA, 21 bp, Homo sapiens
aggctgggcttcagtggcagc

SEQ ID NO: 2617768 - DNA, 18 bp, Homo sapiens
aggctggggaagtcctct

SEQ ID NO: 2617769 - DNA, 21 bp, Homo sapiens
aggctggggaagtcctctggg

SEQ ID NO: 2617770 - DNA, 12 bp, Homo sapiens
aggctggggctg

SEQ ID NO: 2617771 - DNA, 16 bp, Homo sapiens
aggctggggctgacct

SEQ ID NO: 2617772 - DNA, 18 bp, Homo sapiens
aggctgggttctgatcct

SEQ ID NO: 2617773 - DNA, 23 bp, Homo sapiens
aggctggtgctgtggccagggtg

SEQ ID NO: 2617774 - DNA, 20 bp, Homo sapiens
aggctgtcttctcaggctct

SEQ ID NO: 2617775 - DNA, 14 bp, Homo sapiens
aggctgtgctccct

SEQ ID NO: 2617776 - DNA, 24 bp, Homo sapiens
aggctgtgctccctggttctgatg

SEQ ID NO: 2617777 - DNA, 18 bp, Homo sapiens
aggcttaatacctgggtg

SEQ ID NO: 2617778 - DNA, 13 bp, Homo sapiens
aggcttccagaga

SEQ ID NO: 2617779 - DNA, 15 bp, Homo sapiens
aggcttgcctgcagg

SEQ ID NO: 2617780 - DNA, 16 bp, Homo sapiens
aggcttgcctgcaggc

SEQ ID NO: 2617781 - DNA, 17 bp, Homo sapiens
aggcttgcctgcaggca

SEQ ID NO: 2617782 - DNA, 18 bp, Homo sapiens
aggcttgtcagagctggg

SEQ ID NO: 2617783 - DNA, 20 bp, Homo sapiens
aggcttgtcagagctgggag

SEQ ID NO: 2617784 - DNA, 16 bp, Homo sapiens
agggaaaagcagctct

SEQ ID NO: 2617785 - DNA, 19 bp, Homo sapiens
agggaaactgccagcaacg

SEQ ID NO: 2617786 - DNA, 22 bp, Homo sapiens
agggaaaggctctgaaagccag

SEQ ID NO: 2617787 - DNA, 14 bp, Homo sapiens
agggaacagtgagg

SEQ ID NO: 2617788 - DNA, 19 bp, Homo sapiens
agggaacggggtccttcaa

SEQ ID NO: 2617789 - DNA, 15 bp, Homo sapiens
agggaagagaaagtg

SEQ ID NO: 2617790 - DNA, 19 bp, Homo sapiens
agggaagcactgcctccct

SEQ ID NO: 2617791 - DNA, 13 bp, Homo sapiens
agggaagctggcc

SEQ ID NO: 2617792 - DNA, 14 bp, Homo sapiens
agggaagggcctgc

SEQ ID NO: 2617793 - DNA, 16 bp, Homo sapiens
agggaagggcctgcca

SEQ ID NO: 2617794 - DNA, 18 bp, Homo sapiens
agggaagggcctgccaca

SEQ ID NO: 2617795 - DNA, 13 bp, Homo sapiens
agggaagttttgt

SEQ ID NO: 2617796 - DNA, 18 bp, Homo sapiens
agggaatgaacctggagg

SEQ ID NO: 2617797 - DNA, 14 bp, Homo sapiens
agggaatgcctgag

SEQ ID NO: 2617798 - DNA, 15 bp, Homo sapiens
agggaatggcacagc

SEQ ID NO: 2617799 - DNA, 15 bp, Homo sapiens
agggacaccagccag

SEQ ID NO: 2617800 - DNA, 20 bp, Homo sapiens
agggacaccagccaggctct

SEQ ID NO: 2617801 - DNA, 20 bp, Homo sapiens
agggacagagggggtggcct

SEQ ID NO: 2617802 - DNA, 23 bp, Homo sapiens
agggacagagggggtggcctccc

SEQ ID NO: 2617803 - DNA, 22 bp, Homo sapiens
agggacatgttttgataaagta

SEQ ID NO: 2617804 - DNA, 24 bp, Homo sapiens
agggacatgttttgataaagtagt

SEQ ID NO: 2617805 - DNA, 16 bp, Homo sapiens
agggaccaactgggcc

SEQ ID NO: 2617806 - DNA, 17 bp, Homo sapiens
agggaccaactgggccc

SEQ ID NO: 2617807 - DNA, 20 bp, Homo sapiens
agggaccagccaagagggct

SEQ ID NO: 2617808 - DNA, 15 bp, Homo sapiens
agggacccctgccct

SEQ ID NO: 2617809 - DNA, 13 bp, Homo sapiens
agggacctctccc

SEQ ID NO: 2617810 - DNA, 13 bp, Homo sapiens
agggacgcctggg

SEQ ID NO: 2617811 - DNA, 18 bp, Homo sapiens
agggacgcctgggggtgc

SEQ ID NO: 2617812 - DNA, 17 bp, Homo sapiens
agggactaggagcactg

SEQ ID NO: 2617813 - DNA, 14 bp, Homo sapiens
agggactctgaagc

SEQ ID NO: 2617814 - DNA, 19 bp, Homo sapiens
agggactctgaagcctctg

SEQ ID NO: 2617815 - DNA, 22 bp, Homo sapiens
agggactctgaagcctctggga

SEQ ID NO: 2617816 - DNA, 12 bp, Homo sapiens
agggacttaaaa

SEQ ID NO: 2617817 - DNA, 13 bp, Homo sapiens
agggacttaaaaa

SEQ ID NO: 2617818 - DNA, 23 bp, Homo sapiens
agggacttctgtcttcacaacag

SEQ ID NO: 2617819 - DNA, 18 bp, Homo sapiens
agggacttggaagctccg

SEQ ID NO: 2617820 - DNA, 13 bp, Homo sapiens
agggagaaatgtt

SEQ ID NO: 2617821 - DNA, 22 bp, Homo sapiens
agggagaaggatctagaatgtg

SEQ ID NO: 2617822 - DNA, 18 bp, Homo sapiens
agggagaagggatggagg

SEQ ID NO: 2617823 - DNA, 13 bp, Homo sapiens
agggagagaagat

SEQ ID NO: 2617824 - DNA, 15 bp, Homo sapiens
agggagagccagctc

SEQ ID NO: 2617825 - DNA, 17 bp, Homo sapiens
agggagcagacaggagg

SEQ ID NO: 2617826 - DNA, 14 bp, Homo sapiens
agggagcatggctg

SEQ ID NO: 2617827 - DNA, 21 bp, Homo sapiens
agggaggaatcgaggaaccag

SEQ ID NO: 2617828 - DNA, 23 bp, Homo sapiens
agggaggaatcgaggaaccagag

SEQ ID NO: 2617829 - DNA, 17 bp, Homo sapiens
agggaggaggccacctc

SEQ ID NO: 2617830 - DNA, 20 bp, Homo sapiens
agggaggaggccacctctcc

SEQ ID NO: 2617831 - DNA, 21 bp, Homo sapiens
agggaggaggccacctctcca

SEQ ID NO: 2617832 - DNA, 15 bp, Homo sapiens
agggagggagggctc

SEQ ID NO: 2617833 - DNA, 12 bp, Homo sapiens
agggagggctcc

SEQ ID NO: 2617834 - DNA, 15 bp, Homo sapiens
agggagggctccaga

SEQ ID NO: 2617835 - DNA, 22 bp, Homo sapiens
agggagggctccagacacatgt

SEQ ID NO: 2617836 - DNA, 12 bp, Homo sapiens
agggaggggact

SEQ ID NO: 2617837 - DNA, 17 bp, Homo sapiens
agggaggtgaccccagg

SEQ ID NO: 2617838 - DNA, 21 bp, Homo sapiens
agggaggtggggatgagaaga

SEQ ID NO: 2617839 - DNA, 15 bp, Homo sapiens
agggagtcccctccc

SEQ ID NO: 2617840 - DNA, 16 bp, Homo sapiens
agggagtcccctcccc

SEQ ID NO: 2617841 - DNA, 20 bp, Homo sapiens
agggagtgacagaggcagcc

SEQ ID NO: 2617842 - DNA, 18 bp, Homo sapiens
agggatatataagatgga

SEQ ID NO: 2617843 - DNA, 14 bp, Homo sapiens
agggatcacagggc

SEQ ID NO: 2617844 - DNA, 17 bp, Homo sapiens
agggatcacagggcccc

SEQ ID NO: 2617845 - DNA, 22 bp, Homo sapiens
agggatccctcatctgtccctc

SEQ ID NO: 2617846 - DNA, 18 bp, Homo sapiens
agggatgctgcctgagtc

SEQ ID NO: 2617847 - DNA, 19 bp, Homo sapiens
agggatgctgcctgagtca

SEQ ID NO: 2617848 - DNA, 15 bp, Homo sapiens
agggatggaaaagga

SEQ ID NO: 2617849 - DNA, 16 bp, Homo sapiens
agggatggattccaac

SEQ ID NO: 2617850 - DNA, 13 bp, Homo sapiens
agggatggcgggt

SEQ ID NO: 2617851 - DNA, 18 bp, Homo sapiens
agggatggcgggtggggg

SEQ ID NO: 2617852 - DNA, 18 bp, Homo sapiens
agggatgttctggccctc

SEQ ID NO: 2617853 - DNA, 15 bp, Homo sapiens
agggattagggagag

SEQ ID NO: 2617854 - DNA, 16 bp, Homo sapiens
agggattgctgccact

SEQ ID NO: 2617855 - DNA, 19 bp, Homo sapiens
agggattttagtcacacgt

SEQ ID NO: 2617856 - DNA, 14 bp, Homo sapiens
agggcaagggccat

SEQ ID NO: 2617857 - DNA, 21 bp, Homo sapiens
agggcaccctagttctacctc

SEQ ID NO: 2617858 - DNA, 13 bp, Homo sapiens
agggcactggagc

SEQ ID NO: 2617859 - DNA, 23 bp, Homo sapiens
agggcacttcacagagtgtgctg

SEQ ID NO: 2617860 - DNA, 17 bp, Homo sapiens
agggcagaacactaacc

SEQ ID NO: 2617861 - DNA, 17 bp, Homo sapiens
agggcagctgggcccaa

SEQ ID NO: 2617862 - DNA, 18 bp, Homo sapiens
agggcagctgggcccaac

SEQ ID NO: 2617863 - DNA, 18 bp, Homo sapiens
agggcagcttgccccggc

SEQ ID NO: 2617864 - DNA, 19 bp, Homo sapiens
agggcaggaaggagagcct

SEQ ID NO: 2617865 - DNA, 23 bp, Homo sapiens
agggcaggaaggagagcctgctg

SEQ ID NO: 2617866 - DNA, 18 bp, Homo sapiens
aggttaggatttaacagt

SEQ ID NO: 2617867 - DNA, 14 bp, Homo sapiens
aggttcaaagatat

SEQ ID NO: 2617868 - DNA, 17 bp, Homo sapiens
aggttcaaagatatttt

SEQ ID NO: 2617869 - DNA, 16 bp, Homo sapiens
aggttcccagagatga

SEQ ID NO: 2617870 - DNA, 17 bp, Homo sapiens
aggttcttagtgtcact

SEQ ID NO: 2617871 - DNA, 17 bp, Homo sapiens
aggttgaggggctcctg

SEQ ID NO: 2617872 - DNA, 14 bp, Homo sapiens
aggttgataacttt

SEQ ID NO: 2617873 - DNA, 16 bp, Homo sapiens
aggttgataactttgc

SEQ ID NO: 2617874 - DNA, 18 bp, Homo sapiens
aggttgataactttgctt

SEQ ID NO: 2617875 - DNA, 20 bp, Homo sapiens
aggttgggaatgaggcttgc

SEQ ID NO: 2617876 - DNA, 23 bp, Homo sapiens
aggttgggagaatgtcagtatgt

SEQ ID NO: 2617877 - DNA, 16 bp, Homo sapiens
aggttggggtgtacta

SEQ ID NO: 2617878 - DNA, 17 bp, Homo sapiens
aggtttaactcagatca

SEQ ID NO: 2617879 - DNA, 18 bp, Homo sapiens
aggtttaactcagatcac

SEQ ID NO: 2617880 - DNA, 23 bp, Homo sapiens
aggtttaactcagatcactactg

SEQ ID NO: 2617881 - DNA, 14 bp, Homo sapiens
aggtttctgaaaat

SEQ ID NO: 2617882 - DNA, 22 bp, Homo sapiens
aggtttctggtctctaggctgg

SEQ ID NO: 2617883 - DNA, 13 bp, Homo sapiens
aggttttgtaaag

SEQ ID NO: 2617884 - DNA, 22 bp, Homo sapiens
aggttttgtttgctatcttaat

SEQ ID NO: 2617885 - DNA, 21 bp, Homo sapiens
aggtttttcaattaaacggat

SEQ ID NO: 2617886 - DNA, 22 bp, Homo sapiens
aggtttttcaattaaacggatt

SEQ ID NO: 2617887 - DNA, 19 bp, Homo sapiens
aggtttttgtttgtttcct

SEQ ID NO: 2617888 - DNA, 19 bp, Homo sapiens
aggtttttttccttctgaa

SEQ ID NO: 2617889 - DNA, 20 bp, Homo sapiens
agtaaaaccacagcagttga

SEQ ID NO: 2617890 - DNA, 14 bp, Homo sapiens
agtaaactatttat

SEQ ID NO: 2617891 - DNA, 20 bp, Homo sapiens
agtaaagaaatttaaaagac

SEQ ID NO: 2617892 - DNA, 18 bp, Homo sapiens
agtaaagccgttgtttac

SEQ ID NO: 2617893 - DNA, 14 bp, Homo sapiens
agtaaagctaaaat

SEQ ID NO: 2617894 - DNA, 17 bp, Homo sapiens
agtaaagctaaaatgat

SEQ ID NO: 2617895 - DNA, 22 bp, Homo sapiens
agtaaatggcttatccagctgg

SEQ ID NO: 2617896 - DNA, 20 bp, Homo sapiens
agtaaatgggggtgcatttg

SEQ ID NO: 2617897 - DNA, 23 bp, Homo sapiens
agtaacaggaaaccacttatcac

SEQ ID NO: 2617898 - DNA, 14 bp, Homo sapiens
agtaaccatttgca

SEQ ID NO: 2617899 - DNA, 12 bp, Homo sapiens
agtaacctgggt

SEQ ID NO: 2617900 - DNA, 19 bp, Homo sapiens
agtaactgccatcaagatg

SEQ ID NO: 2617901 - DNA, 17 bp, Homo sapiens
agtaacttacttaggtg

SEQ ID NO: 2617902 - DNA, 14 bp, Homo sapiens
agtaactttatgtg

SEQ ID NO: 2617903 - DNA, 16 bp, Homo sapiens
agtaactttatgtgta

SEQ ID NO: 2617904 - DNA, 20 bp, Homo sapiens
agtaactttatgtgtaaata

SEQ ID NO: 2617905 - DNA, 20 bp, Homo sapiens
agtaagaaagtgaagcaaat

SEQ ID NO: 2617906 - DNA, 14 bp, Homo sapiens
agtaagagctggtg

SEQ ID NO: 2617907 - DNA, 16 bp, Homo sapiens
agtaagtgccttccat

SEQ ID NO: 2617908 - DNA, 17 bp, Homo sapiens
agtaataaactgtgttt

SEQ ID NO: 2617909 - DNA, 14 bp, Homo sapiens
agtaatcccgccac

SEQ ID NO: 2617910 - DNA, 17 bp, Homo sapiens
agtaatcccgccaccta

SEQ ID NO: 2617911 - DNA, 19 bp, Homo sapiens
agtaatcccgccacctatc

SEQ ID NO: 2617912 - DNA, 13 bp, Homo sapiens
agtaatctgtgta

SEQ ID NO: 2617913 - DNA, 19 bp, Homo sapiens
agtaatctgtgtacaaaga

SEQ ID NO: 2617914 - DNA, 17 bp, Homo sapiens
agtaatgctacgtgtga

SEQ ID NO: 2617915 - DNA, 21 bp, Homo sapiens
agtaatgctacgtgtgatttt

SEQ ID NO: 2617916 - DNA, 14 bp, Homo sapiens
agtaattctcaggc

SEQ ID NO: 2617917 - DNA, 13 bp, Homo sapiens
agtaatttattgt

SEQ ID NO: 2617918 - DNA, 22 bp, Homo sapiens
agtaatttattgtttttccttg

SEQ ID NO: 2617919 - DNA, 23 bp, Homo sapiens
agtaatttattgtttttccttgt

SEQ ID NO: 2617920 - DNA, 15 bp, Homo sapiens
agtaatttgtagatt

SEQ ID NO: 2617921 - DNA, 21 bp, Homo sapiens
agtacactgtttcaaacttta

SEQ ID NO: 2617922 - DNA, 14 bp, Homo sapiens
agtacaggcagcac

SEQ ID NO: 2617923 - DNA, 17 bp, Homo sapiens
agtacaggcagcacaga

SEQ ID NO: 2617924 - DNA, 18 bp, Homo sapiens
agtacatattaggaaaat

SEQ ID NO: 2617925 - DNA, 15 bp, Homo sapiens
agtacccaaaagctc

SEQ ID NO: 2617926 - DNA, 15 bp, Homo sapiens
agtacctataaagta

SEQ ID NO: 2617927 - DNA, 12 bp, Homo sapiens
agtacctcctgt

SEQ ID NO: 2617928 - DNA, 12 bp, Homo sapiens
agtacctggagg

SEQ ID NO: 2617929 - DNA, 15 bp, Homo sapiens
agtacgttattgttg

SEQ ID NO: 2617930 - DNA, 15 bp, Homo sapiens
agtacgttgtgcatt

SEQ ID NO: 2617931 - DNA, 17 bp, Homo sapiens
agtacgttgtgcatttg

SEQ ID NO: 2617932 - DNA, 18 bp, Homo sapiens
agtacgttgtgcatttgg

SEQ ID NO: 2617933 - DNA, 21 bp, Homo sapiens
agtactcctgcaaaattttat

SEQ ID NO: 2617934 - DNA, 15 bp, Homo sapiens
agtactggcatggta

SEQ ID NO: 2617935 - DNA, 17 bp, Homo sapiens
agtacttctccaccctg

SEQ ID NO: 2617936 - DNA, 21 bp, Homo sapiens
agtacttctccaccctgctct

SEQ ID NO: 2617937 - DNA, 12 bp, Homo sapiens
agtacttctttt

SEQ ID NO: 2617938 - DNA, 11 bp, Homo sapiens
agtacttgaaa

SEQ ID NO: 2617939 - DNA, 19 bp, Homo sapiens
agtacttgaaatctaggat

SEQ ID NO: 2617940 - DNA, 23 bp, Homo sapiens
agtacttgggagacctgtaatca

SEQ ID NO: 2617941 - DNA, 19 bp, Homo sapiens
agtagaaataatatgcatt

SEQ ID NO: 2617942 - DNA, 16 bp, Homo sapiens
agtagaaggtcggagg

SEQ ID NO: 2617943 - DNA, 21 bp, Homo sapiens
agtagaagtcttagatgtata

SEQ ID NO: 2617944 - DNA, 16 bp, Homo sapiens
agtagagtcatctcca

SEQ ID NO: 2617945 - DNA, 16 bp, Homo sapiens
agtagattttctttaa

SEQ ID NO: 2617946 - DNA, 16 bp, Homo sapiens
agtagcaagttctaga

SEQ ID NO: 2617947 - DNA, 22 bp, Homo sapiens
agtagcaagttctagagaagag

SEQ ID NO: 2617948 - DNA, 14 bp, Homo sapiens
agtagcatttcatt

SEQ ID NO: 2617949 - DNA, 15 bp, Homo sapiens
agtagcatttcattc

SEQ ID NO: 2617950 - DNA, 14 bp, Homo sapiens
agtagctgggacta

SEQ ID NO: 2617951 - DNA, 21 bp, Homo sapiens
agtagctgggactacaggcac

SEQ ID NO: 2617952 - DNA, 16 bp, Homo sapiens
agtaggaagactttgg

SEQ ID NO: 2617953 - DNA, 18 bp, Homo sapiens
agtaggaagactttggaa

SEQ ID NO: 2617954 - DNA, 22 bp, Homo sapiens
agtaggaagactttggaaagac

SEQ ID NO: 2617955 - DNA, 23 bp, Homo sapiens
agtaggttggaagctagctcccc

SEQ ID NO: 2617956 - DNA, 14 bp, Homo sapiens
agtagtcatttcat

SEQ ID NO: 2617957 - DNA, 15 bp, Homo sapiens
agtatatctggacaa

SEQ ID NO: 2617958 - DNA, 16 bp, Homo sapiens
agtatatctggacaag

SEQ ID NO: 2617959 - DNA, 22 bp, Homo sapiens
agtatatctggacaagccaact

SEQ ID NO: 2617960 - DNA, 14 bp, Homo sapiens
agtatattatgtat

SEQ ID NO: 2617961 - DNA, 17 bp, Homo sapiens
agtatattatgtattta

SEQ ID NO: 2617962 - DNA, 13 bp, Homo sapiens
agtatattttctt

SEQ ID NO: 2617963 - DNA, 18 bp, Homo sapiens
agtatattttcttttcct

SEQ ID NO: 2617964 - DNA, 21 bp, Homo sapiens
agtatcaaatattagatgtga

SEQ ID NO: 2617965 - DNA, 22 bp, Homo sapiens
agtatcaaatattagatgtgat

SEQ ID NO: 2617966 - DNA, 18 bp, Homo sapiens
agtatcaggtctcccacg

SEQ ID NO: 2617967 - DNA, 13 bp, Homo sapiens
agtatcctccagg

SEQ ID NO: 2617968 - DNA, 16 bp, Homo sapiens
agtatcctccaggttt

SEQ ID NO: 2617969 - DNA, 18 bp, Homo sapiens
agtatctcctcgcaagct

SEQ ID NO: 2617970 - DNA, 16 bp, Homo sapiens
agtatgaggcatttgt

SEQ ID NO: 2617971 - DNA, 21 bp, Homo sapiens
agtatgaggcatttgtttgaa

SEQ ID NO: 2617972 - DNA, 20 bp, Homo sapiens
agtatgcttggactgaaggg

SEQ ID NO: 2617973 - DNA, 17 bp, Homo sapiens
agtatggtggctgggtt

SEQ ID NO: 2617974 - DNA, 19 bp, Homo sapiens
agtatgtggaagtgtgggt

SEQ ID NO: 2617975 - DNA, 18 bp, Homo sapiens
agtatgtgtttgtgtgtg

SEQ ID NO: 2617976 - DNA, 18 bp, Homo sapiens
agtatgttttagcatgtg

SEQ ID NO: 2617977 - DNA, 14 bp, Homo sapiens
agtattataccttt

SEQ ID NO: 2617978 - DNA, 18 bp, Homo sapiens
agtattattttccaaaag

SEQ ID NO: 2617979 - DNA, 22 bp, Homo sapiens
agtattccattgtgtgagtgta

SEQ ID NO: 2617980 - DNA, 14 bp, Homo sapiens
agtattgaagcatt

SEQ ID NO: 2617981 - DNA, 21 bp, Homo sapiens
agtattgaagcattttataaa

SEQ ID NO: 2617982 - DNA, 14 bp, Homo sapiens
agtatttatatatt

SEQ ID NO: 2617983 - DNA, 23 bp, Homo sapiens
agtatttatatatttataactca

SEQ ID NO: 2617984 - DNA, 16 bp, Homo sapiens
agtatttcatgctggg

SEQ ID NO: 2617985 - DNA, 23 bp, Homo sapiens
agtatttgaaactgaatgtttat

SEQ ID NO: 2617986 - DNA, 14 bp, Homo sapiens
agtattttcctgta

SEQ ID NO: 2617987 - DNA, 17 bp, Homo sapiens
agtattttggttcttag

SEQ ID NO: 2617988 - DNA, 18 bp, Homo sapiens
agtattttggttcttagt

SEQ ID NO: 2617989 - DNA, 15 bp, Homo sapiens
agtcaaactgtgcca

SEQ ID NO: 2617990 - DNA, 12 bp, Homo sapiens
agtcaagaaaaa

SEQ ID NO: 2617991 - DNA, 20 bp, Homo sapiens
agtcaagtgcgtccacgagc

SEQ ID NO: 2617992 - DNA, 23 bp, Homo sapiens
agtcacacagtattacttctgct

SEQ ID NO: 2617993 - DNA, 22 bp, Homo sapiens
agtcacagagataattctagct

SEQ ID NO: 2617994 - DNA, 14 bp, Homo sapiens
agtcacatcacagg

SEQ ID NO: 2617995 - DNA, 14 bp, Homo sapiens
agtcaccaagccca

SEQ ID NO: 2617996 - DNA, 17 bp, Homo sapiens
agtcaccccggccacct

SEQ ID NO: 2617997 - DNA, 19 bp, Homo sapiens
agtcaccctacctgtgcct

SEQ ID NO: 2617998 - DNA, 20 bp, Homo sapiens
agtcaccctacctgtgcctg

SEQ ID NO: 2617999 - DNA, 15 bp, Homo sapiens
agtcactgagacagc

SEQ ID NO: 2618000 - DNA, 19 bp, Homo sapiens
agtcactgagacagcccgg

SEQ ID NO: 2618001 - DNA, 14 bp, Homo sapiens
agtcactgcctctc

SEQ ID NO: 2618002 - DNA, 23 bp, Homo sapiens
agtcacttgatgtgccattttaa

SEQ ID NO: 2618003 - DNA, 17 bp, Homo sapiens
agtcactttttttttcc

SEQ ID NO: 2618004 - DNA, 17 bp, Homo sapiens
agtcagaggatggccag

SEQ ID NO: 2618005 - DNA, 19 bp, Homo sapiens
agtcagaggatggccagtg

SEQ ID NO: 2618006 - DNA, 20 bp, Homo sapiens
agtcagaggatggccagtgt

SEQ ID NO: 2618007 - DNA, 22 bp, Homo sapiens
agtcaggccttaattttcagta

SEQ ID NO: 2618008 - DNA, 17 bp, Homo sapiens
agtcaggggcagctgac

SEQ ID NO: 2618009 - DNA, 21 bp, Homo sapiens
agtcagtcatgatggcaccac

SEQ ID NO: 2618010 - DNA, 20 bp, Homo sapiens
agttgtagaatgtattgtac

SEQ ID NO: 2618011 - DNA, 14 bp, Homo sapiens
agttgtatctcttt

SEQ ID NO: 2618012 - DNA, 15 bp, Homo sapiens
agttgtatctctttt

SEQ ID NO: 2618013 - DNA, 19 bp, Homo sapiens
agttgtcaagtctctgctg

SEQ ID NO: 2618014 - DNA, 21 bp, Homo sapiens
agttgtgaccttagtgtttct

SEQ ID NO: 2618015 - DNA, 18 bp, Homo sapiens
agttgtgcacatggctta

SEQ ID NO: 2618016 - DNA, 18 bp, Homo sapiens
agttgtgccttttatagc

SEQ ID NO: 2618017 - DNA, 18 bp, Homo sapiens
agttgtggaaagcctctg

SEQ ID NO: 2618018 - DNA, 20 bp, Homo sapiens
agttgtggaaagcctctgct

SEQ ID NO: 2618019 - DNA, 21 bp, Homo sapiens
agttgtggaaagcctctgctg

SEQ ID NO: 2618020 - DNA, 13 bp, Homo sapiens
agttgttacattt

SEQ ID NO: 2618021 - DNA, 16 bp, Homo sapiens
agttgttacattttta

SEQ ID NO: 2618022 - DNA, 14 bp, Homo sapiens
agttgttggcctcc

SEQ ID NO: 2618023 - DNA, 15 bp, Homo sapiens
agttgtttcattgac

SEQ ID NO: 2618024 - DNA, 13 bp, Homo sapiens
agttgtttgcatg

SEQ ID NO: 2618025 - DNA, 18 bp, Homo sapiens
agtttaattgacttattt

SEQ ID NO: 2618026 - DNA, 23 bp, Homo sapiens
agtttacaagtgtatatcagaaa

SEQ ID NO: 2618027 - DNA, 22 bp, Homo sapiens
agtttacatcatttttgtatct

SEQ ID NO: 2618028 - DNA, 15 bp, Homo sapiens
agtttactattttac

SEQ ID NO: 2618029 - DNA, 16 bp, Homo sapiens
agtttactattttact

SEQ ID NO: 2618030 - DNA, 22 bp, Homo sapiens
agtttattgacaataatttcag

SEQ ID NO: 2618031 - DNA, 12 bp, Homo sapiens
agtttcaatgtg

SEQ ID NO: 2618032 - DNA, 16 bp, Homo sapiens
agtttcaatgtgattc

SEQ ID NO: 2618033 - DNA, 16 bp, Homo sapiens
agtttcaattcagtgc

SEQ ID NO: 2618034 - DNA, 18 bp, Homo sapiens
agtttcaggtgacatgtg

SEQ ID NO: 2618035 - DNA, 20 bp, Homo sapiens
agtttcaggtgacatgtgaa

SEQ ID NO: 2618036 - DNA, 20 bp, Homo sapiens
agtttcattctcctgcctgt

SEQ ID NO: 2618037 - DNA, 22 bp, Homo sapiens
agtttctcagatccttgtttca

SEQ ID NO: 2618038 - DNA, 23 bp, Homo sapiens
agtttctcagatccttgtttcaa

SEQ ID NO: 2618039 - DNA, 12 bp, Homo sapiens
agtttctcagct

SEQ ID NO: 2618040 - DNA, 15 bp, Homo sapiens
agtttctccaagcag

SEQ ID NO: 2618041 - DNA, 21 bp, Homo sapiens
agtttctccaagcaggacatg

SEQ ID NO: 2618042 - DNA, 14 bp, Homo sapiens
agtttctcttttca

SEQ ID NO: 2618043 - DNA, 17 bp, Homo sapiens
agtttctgggacctcag

SEQ ID NO: 2618044 - DNA, 16 bp, Homo sapiens
agtttctgttctgtgg

SEQ ID NO: 2618045 - DNA, 21 bp, Homo sapiens
agtttctgttctgtggaaagt

SEQ ID NO: 2618046 - DNA, 22 bp, Homo sapiens
agtttctgttctgtggaaagtg

SEQ ID NO: 2618047 - DNA, 14 bp, Homo sapiens
agtttcttagcttt

SEQ ID NO: 2618048 - DNA, 15 bp, Homo sapiens
agtttcttagctttt

SEQ ID NO: 2618049 - DNA, 14 bp, Homo sapiens
agtttgattaaatt

SEQ ID NO: 2618050 - DNA, 18 bp, Homo sapiens
agtttgattaaattcttg

SEQ ID NO: 2618051 - DNA, 20 bp, Homo sapiens
agtttgattaaattcttgca

SEQ ID NO: 2618052 - DNA, 22 bp, Homo sapiens
agtttgattaaattcttgcaaa

SEQ ID NO: 2618053 - DNA, 14 bp, Homo sapiens
agtttgattattca

SEQ ID NO: 2618054 - DNA, 18 bp, Homo sapiens
agtttgattattcagtgt

SEQ ID NO: 2618055 - DNA, 15 bp, Homo sapiens
agtttgcattcctga

SEQ ID NO: 2618056 - DNA, 18 bp, Homo sapiens
agtttggattcttatgta

SEQ ID NO: 2618057 - DNA, 20 bp, Homo sapiens
agtttggttcacttacagat

SEQ ID NO: 2618058 - DNA, 23 bp, Homo sapiens
agtttgtacagacgtatgcttat

SEQ ID NO: 2618059 - DNA, 17 bp, Homo sapiens
agtttgtataacttctt

SEQ ID NO: 2618060 - DNA, 18 bp, Homo sapiens
agtttgtcacatgaaaca

SEQ ID NO: 2618061 - DNA, 22 bp, Homo sapiens
agtttgttagtatgaggcattt

SEQ ID NO: 2618062 - DNA, 18 bp, Homo sapiens
agttttaactagaattta

SEQ ID NO: 2618063 - DNA, 20 bp, Homo sapiens
agttttactctgctgcaaaa

SEQ ID NO: 2618064 - DNA, 15 bp, Homo sapiens
agttttagttgcaga

SEQ ID NO: 2618065 - DNA, 19 bp, Homo sapiens
agttttatcacatgtatgt

SEQ ID NO: 2618066 - DNA, 20 bp, Homo sapiens
agttttatcacatgtatgtt

SEQ ID NO: 2618067 - DNA, 13 bp, Homo sapiens
agttttatcattt

SEQ ID NO: 2618068 - DNA, 22 bp, Homo sapiens
agttttcactcttattgcccac

SEQ ID NO: 2618069 - DNA, 17 bp, Homo sapiens
agttttcagaacctctt

SEQ ID NO: 2618070 - DNA, 21 bp, Homo sapiens
agttttcagaacctcttcccc

SEQ ID NO: 2618071 - DNA, 12 bp, Homo sapiens
agttttcagtgg

SEQ ID NO: 2618072 - DNA, 18 bp, Homo sapiens
agttttctgagaaagact

SEQ ID NO: 2618073 - DNA, 14 bp, Homo sapiens
agttttgaaaagct

SEQ ID NO: 2618074 - DNA, 15 bp, Homo sapiens
agttttgaaaagcta

SEQ ID NO: 2618075 - DNA, 16 bp, Homo sapiens
agttttgaaaagctat

SEQ ID NO: 2618076 - DNA, 21 bp, Homo sapiens
agtttttacctaccacagtgt

SEQ ID NO: 2618077 - DNA, 23 bp, Homo sapiens
agtttttatggcttttgtgcatt

SEQ ID NO: 2618078 - DNA, 16 bp, Homo sapiens
agtttttgatagcttt

SEQ ID NO: 2618079 - DNA, 12 bp, Homo sapiens
agtttttgttct

SEQ ID NO: 2618080 - DNA, 20 bp, Homo sapiens
agtttttgttcttaattgca

SEQ ID NO: 2618081 - DNA, 17 bp, Homo sapiens
agttttttctcttgggc

SEQ ID NO: 2618082 - DNA, 13 bp, Homo sapiens
ataaaaaaaagaa

SEQ ID NO: 2618083 - DNA, 18 bp, Homo sapiens
ataaaaaaaagaaaaaag

SEQ ID NO: 2618084 - DNA, 17 bp, Homo sapiens
ataaaaaaacaatcatt

SEQ ID NO: 2618085 - DNA, 19 bp, Homo sapiens
ataaaaaaacaatcatttg

SEQ ID NO: 2618086 - DNA, 13 bp, Homo sapiens
ataaaaagttaaa

SEQ ID NO: 2618087 - DNA, 22 bp, Homo sapiens
ataaaaataaatttggttctaa

SEQ ID NO: 2618088 - DNA, 16 bp, Homo sapiens
ataaaaatatgtacaa

SEQ ID NO: 2618089 - DNA, 12 bp, Homo sapiens
ataaaaatggat

SEQ ID NO: 2618090 - DNA, 15 bp, Homo sapiens
ataaaaattctgaat

SEQ ID NO: 2618091 - DNA, 18 bp, Homo sapiens
ataaaacaggtcaataca

SEQ ID NO: 2618092 - DNA, 13 bp, Homo sapiens
ataaaacattaat

SEQ ID NO: 2618093 - DNA, 18 bp, Homo sapiens
ataaaacattttcacaca

SEQ ID NO: 2618094 - DNA, 20 bp, Homo sapiens
ataaaacattttcacacaat

SEQ ID NO: 2618095 - DNA, 11 bp, Homo sapiens
ataaaaccttt

SEQ ID NO: 2618096 - DNA, 15 bp, Homo sapiens
ataaaagaaaaaata

SEQ ID NO: 2618097 - DNA, 20 bp, Homo sapiens
ataaaagcaattccaacctt

SEQ ID NO: 2618098 - DNA, 15 bp, Homo sapiens
ataaaagcataaatg

SEQ ID NO: 2618099 - DNA, 15 bp, Homo sapiens
ataaaagctatggtg

SEQ ID NO: 2618100 - DNA, 19 bp, Homo sapiens
ataaaaggcaaatgtgtac

SEQ ID NO: 2618101 - DNA, 20 bp, Homo sapiens
ataaaaggtcggaccagctt

SEQ ID NO: 2618102 - DNA, 22 bp, Homo sapiens
ataaaagtgatcaataaaatgt

SEQ ID NO: 2618103 - DNA, 13 bp, Homo sapiens
ataaaataaagta

SEQ ID NO: 2618104 - DNA, 16 bp, Homo sapiens
ataaaataaagtatat

SEQ ID NO: 2618105 - DNA, 16 bp, Homo sapiens
ataaaataattctaaa

SEQ ID NO: 2618106 - DNA, 18 bp, Homo sapiens
ataaaataattctaaagg

SEQ ID NO: 2618107 - DNA, 18 bp, Homo sapiens
ataaaatcatgtacattt

SEQ ID NO: 2618108 - DNA, 13 bp, Homo sapiens
ataaaatgtgatt

SEQ ID NO: 2618109 - DNA, 13 bp, Homo sapiens
ataaaatttgttg

SEQ ID NO: 2618110 - DNA, 16 bp, Homo sapiens
ataaaatttgttgcat

SEQ ID NO: 2618111 - DNA, 23 bp, Homo sapiens
ataaaattttttttcatgtttta

SEQ ID NO: 2618112 - DNA, 15 bp, Homo sapiens
ataaacaagaccacg

SEQ ID NO: 2618113 - DNA, 23 bp, Homo sapiens
ataaacaagaccacgtttctaaa

SEQ ID NO: 2618114 - DNA, 17 bp, Homo sapiens
ataaacacccatgaatc

SEQ ID NO: 2618115 - DNA, 17 bp, Homo sapiens
ataaacatcacacacac

SEQ ID NO: 2618116 - DNA, 21 bp, Homo sapiens
ataaacccagttgccatctgc

SEQ ID NO: 2618117 - DNA, 18 bp, Homo sapiens
ataaacgatttaattctc

SEQ ID NO: 2618118 - DNA, 19 bp, Homo sapiens
ataaacgatttaattctct

SEQ ID NO: 2618119 - DNA, 20 bp, Homo sapiens
ataaacgtgatgatcagctg

SEQ ID NO: 2618120 - DNA, 17 bp, Homo sapiens
ataaagaaattgcaata

SEQ ID NO: 2618121 - DNA, 15 bp, Homo sapiens
ataaagaacaaggta

SEQ ID NO: 2618122 - DNA, 23 bp, Homo sapiens
ataaagaagcaataaagaagagt

SEQ ID NO: 2618123 - DNA, 14 bp, Homo sapiens
ataaagaccacttt

SEQ ID NO: 2618124 - DNA, 13 bp, Homo sapiens
ataaagagttaga

SEQ ID NO: 2618125 - DNA, 23 bp, Homo sapiens
ataaagatgatctactcagaaat

SEQ ID NO: 2618126 - DNA, 15 bp, Homo sapiens
ataaagatgttaaaa

SEQ ID NO: 2618127 - DNA, 19 bp, Homo sapiens
ataaaggtggtatgtgtgt

SEQ ID NO: 2618128 - DNA, 20 bp, Homo sapiens
ataaaggtggtatgtgtgtg

SEQ ID NO: 2618129 - DNA, 13 bp, Homo sapiens
ataaagtagtaaa

SEQ ID NO: 2618130 - DNA, 18 bp, Homo sapiens
ataaagtagtaaaaatta

SEQ ID NO: 2618131 - DNA, 22 bp, Homo sapiens
ataaagttgaagctaagattta

SEQ ID NO: 2618132 - DNA, 17 bp, Homo sapiens
ataaagttggtgacaga

SEQ ID NO: 2618133 - DNA, 18 bp, Homo sapiens
ataaagttggtgacagat

SEQ ID NO: 2618134 - DNA, 13 bp, Homo sapiens
ataaagtttctca

SEQ ID NO: 2618135 - DNA, 15 bp, Homo sapiens
ataaataaaaatgga

SEQ ID NO: 2618136 - DNA, 14 bp, Homo sapiens
ataaatagctatat

SEQ ID NO: 2618137 - DNA, 21 bp, Homo sapiens
ataaatagctatatccatgta

SEQ ID NO: 2618138 - DNA, 16 bp, Homo sapiens
ataaataggagaggat

SEQ ID NO: 2618139 - DNA, 12 bp, Homo sapiens
ataaatatgaag

SEQ ID NO: 2618140 - DNA, 14 bp, Homo sapiens
ataaatatgcagtg

SEQ ID NO: 2618141 - DNA, 14 bp, Homo sapiens
ataaatatttatgt

SEQ ID NO: 2618142 - DNA, 14 bp, Homo sapiens
ataaatcgcttttg

SEQ ID NO: 2618143 - DNA, 11 bp, Homo sapiens
ataaatgaagc

SEQ ID NO: 2618144 - DNA, 17 bp, Homo sapiens
ataaatgaagcagcttt

SEQ ID NO: 2618145 - DNA, 16 bp, Homo sapiens
ataaatgattcttagt

SEQ ID NO: 2618146 - DNA, 18 bp, Homo sapiens
ataaatgattcttagtga

SEQ ID NO: 2618147 - DNA, 21 bp, Homo sapiens
ataaatgctattttttatttt

SEQ ID NO: 2618148 - DNA, 23 bp, Homo sapiens
ataaatgctattttttattttac

SEQ ID NO: 2618149 - DNA, 17 bp, Homo sapiens
ataaatgtcattaaaat

SEQ ID NO: 2618150 - DNA, 20 bp, Homo sapiens
ataaatgtcttttttttaat

SEQ ID NO: 2618151 - DNA, 22 bp, Homo sapiens
ataaatgtcttttttttaatgt

SEQ ID NO: 2618152 - DNA, 13 bp, Homo sapiens
ataaattatgttt

SEQ ID NO: 2618153 - DNA, 21 bp, Homo sapiens
ataaattattagtttacatca

SEQ ID NO: 2618154 - DNA, 14 bp, Homo sapiens
ataaattatttatt

SEQ ID NO: 2618155 - DNA, 15 bp, Homo sapiens
atattcattgtataa

SEQ ID NO: 2618156 - DNA, 23 bp, Homo sapiens
atattcattgtataaaaatagaa

SEQ ID NO: 2618157 - DNA, 18 bp, Homo sapiens
atattccatatattagca

SEQ ID NO: 2618158 - DNA, 17 bp, Homo sapiens
atattcctgaatgaaat

SEQ ID NO: 2618159 - DNA, 21 bp, Homo sapiens
atattcctgcatttgtgaaat

SEQ ID NO: 2618160 - DNA, 14 bp, Homo sapiens
atattcttatgtat

SEQ ID NO: 2618161 - DNA, 23 bp, Homo sapiens
atattcttatgtatgtgaaagtt

SEQ ID NO: 2618162 - DNA, 15 bp, Homo sapiens
atattgatatgctta

SEQ ID NO: 2618163 - DNA, 19 bp, Homo sapiens
atattgatttccgttaaaa

SEQ ID NO: 2618164 - DNA, 16 bp, Homo sapiens
atattgcatatgcata

SEQ ID NO: 2618165 - DNA, 12 bp, Homo sapiens
atattgtaagaa

SEQ ID NO: 2618166 - DNA, 14 bp, Homo sapiens
atattgtaagaaat

SEQ ID NO: 2618167 - DNA, 15 bp, Homo sapiens
atattgtaagaaata

SEQ ID NO: 2618168 - DNA, 12 bp, Homo sapiens
atattgtacact

SEQ ID NO: 2618169 - DNA, 13 bp, Homo sapiens
atattgtgaagta

SEQ ID NO: 2618170 - DNA, 21 bp, Homo sapiens
atattgtgccaatatgtattg

SEQ ID NO: 2618171 - DNA, 13 bp, Homo sapiens
atattgttttcag

SEQ ID NO: 2618172 - DNA, 18 bp, Homo sapiens
atatttacatatgaaatt

SEQ ID NO: 2618173 - DNA, 21 bp, Homo sapiens
atatttacatgaattgcattt

SEQ ID NO: 2618174 - DNA, 14 bp, Homo sapiens
atatttacgtatga

SEQ ID NO: 2618175 - DNA, 19 bp, Homo sapiens
atatttacttcttatacat

SEQ ID NO: 2618176 - DNA, 15 bp, Homo sapiens
atatttataactcat

SEQ ID NO: 2618177 - DNA, 23 bp, Homo sapiens
atatttataactcatcataaaat

SEQ ID NO: 2618178 - DNA, 15 bp, Homo sapiens
atatttatagtcaca

SEQ ID NO: 2618179 - DNA, 20 bp, Homo sapiens
atatttatgtagatgtgcat

SEQ ID NO: 2618180 - DNA, 18 bp, Homo sapiens
atatttatgtctatttaa

SEQ ID NO: 2618181 - DNA, 16 bp, Homo sapiens
atatttattacctctg

SEQ ID NO: 2618182 - DNA, 14 bp, Homo sapiens
atatttattgtgct

SEQ ID NO: 2618183 - DNA, 23 bp, Homo sapiens
atatttattgtttatttatcagt

SEQ ID NO: 2618184 - DNA, 17 bp, Homo sapiens
atatttatttatttatt

SEQ ID NO: 2618185 - DNA, 18 bp, Homo sapiens
atatttccatatggattt

SEQ ID NO: 2618186 - DNA, 21 bp, Homo sapiens
atatttccctcccctggggac

SEQ ID NO: 2618187 - DNA, 11 bp, Homo sapiens
atatttgtaca

SEQ ID NO: 2618188 - DNA, 22 bp, Homo sapiens
atatttgtatcacaaatcttaa

SEQ ID NO: 2618189 - DNA, 17 bp, Homo sapiens
atatttgtgtatttaac

SEQ ID NO: 2618190 - DNA, 16 bp, Homo sapiens
atattttaaaatgaga

SEQ ID NO: 2618191 - DNA, 23 bp, Homo sapiens
atattttacattcttggaaagtc

SEQ ID NO: 2618192 - DNA, 14 bp, Homo sapiens
atattttataattt

SEQ ID NO: 2618193 - DNA, 15 bp, Homo sapiens
atattttattatata

SEQ ID NO: 2618194 - DNA, 23 bp, Homo sapiens
atattttcttccaagcaaaggtg

SEQ ID NO: 2618195 - DNA, 13 bp, Homo sapiens
atattttgaatca

SEQ ID NO: 2618196 - DNA, 19 bp, Homo sapiens
atattttgggaatcttttc

SEQ ID NO: 2618197 - DNA, 13 bp, Homo sapiens
atattttgtatat

SEQ ID NO: 2618198 - DNA, 21 bp, Homo sapiens
atattttgtatatatctgctt

SEQ ID NO: 2618199 - DNA, 14 bp, Homo sapiens
atatttttaagata

SEQ ID NO: 2618200 - DNA, 16 bp, Homo sapiens
atatttttaagataat

SEQ ID NO: 2618201 - DNA, 15 bp, Homo sapiens
atatttttaattaaa

SEQ ID NO: 2618202 - DNA, 13 bp, Homo sapiens
atatttttataga

SEQ ID NO: 2618203 - DNA, 16 bp, Homo sapiens
atatttttatatttag

SEQ ID NO: 2618204 - DNA, 15 bp, Homo sapiens
atatttttatcttta

SEQ ID NO: 2618205 - DNA, 18 bp, Homo sapiens
atatttttggttgtcaat

SEQ ID NO: 2618206 - DNA, 21 bp, Homo sapiens
atatttttggttgtcaatatt

SEQ ID NO: 2618207 - DNA, 14 bp, Homo sapiens
atcaaaagaaagaa

SEQ ID NO: 2618208 - DNA, 13 bp, Homo sapiens
atcaaaagacaat

SEQ ID NO: 2618209 - DNA, 14 bp, Homo sapiens
atcaaaataaaaag

SEQ ID NO: 2618210 - DNA, 17 bp, Homo sapiens
atcaaactgaagccaga

SEQ ID NO: 2618211 - DNA, 12 bp, Homo sapiens
atcaaagcaatg

SEQ ID NO: 2618212 - DNA, 11 bp, Homo sapiens
atcaaatactt

SEQ ID NO: 2618213 - DNA, 15 bp, Homo sapiens
atcaaatactttaaa

SEQ ID NO: 2618214 - DNA, 22 bp, Homo sapiens
atcaaatactttaaaggaaaaa

SEQ ID NO: 2618215 - DNA, 14 bp, Homo sapiens
atcaaatatgcaaa

SEQ ID NO: 2618216 - DNA, 15 bp, Homo sapiens
atcaaatatgcaaag

SEQ ID NO: 2618217 - DNA, 16 bp, Homo sapiens
atcaaatatgcaaagc

SEQ ID NO: 2618218 - DNA, 17 bp, Homo sapiens
atcaaatatgcaaagca

SEQ ID NO: 2618219 - DNA, 15 bp, Homo sapiens
atcaaatattagatg

SEQ ID NO: 2618220 - DNA, 16 bp, Homo sapiens
atcaaatattagatgt

SEQ ID NO: 2618221 - DNA, 18 bp, Homo sapiens
atcaaatattagatgtga

SEQ ID NO: 2618222 - DNA, 17 bp, Homo sapiens
atcaaatggaagacaca

SEQ ID NO: 2618223 - DNA, 14 bp, Homo sapiens
atcaacagataaat

SEQ ID NO: 2618224 - DNA, 14 bp, Homo sapiens
atcaacatttctca

SEQ ID NO: 2618225 - DNA, 20 bp, Homo sapiens
atcaaccccttcgctcctgt

SEQ ID NO: 2618226 - DNA, 13 bp, Homo sapiens
atcaactctaata

SEQ ID NO: 2618227 - DNA, 11 bp, Homo sapiens
atcaactgaat

SEQ ID NO: 2618228 - DNA, 12 bp, Homo sapiens
atcaagaaagtc

SEQ ID NO: 2618229 - DNA, 23 bp, Homo sapiens
atcaagaatggggatcacagaga

SEQ ID NO: 2618230 - DNA, 15 bp, Homo sapiens
atcaagagctgccct

SEQ ID NO: 2618231 - DNA, 16 bp, Homo sapiens
atcaagagctgccctc

SEQ ID NO: 2618232 - DNA, 17 bp, Homo sapiens
atcaagagctgccctcc

SEQ ID NO: 2618233 - DNA, 20 bp, Homo sapiens
atcaagagctgccctccttg

SEQ ID NO: 2618234 - DNA, 13 bp, Homo sapiens
atcaagcccttta

SEQ ID NO: 2618235 - DNA, 16 bp, Homo sapiens
atcaagctagaaggcc

SEQ ID NO: 2618236 - DNA, 17 bp, Homo sapiens
atcaagctagaaggcca

SEQ ID NO: 2618237 - DNA, 13 bp, Homo sapiens
atcaagtattata

SEQ ID NO: 2618238 - DNA, 15 bp, Homo sapiens
atcaagtgtgcttta

SEQ ID NO: 2618239 - DNA, 16 bp, Homo sapiens
atcaagtgtgctttag

SEQ ID NO: 2618240 - DNA, 22 bp, Homo sapiens
atcaagttggcttctaatcaaa

SEQ ID NO: 2618241 - DNA, 16 bp, Homo sapiens
atcaataaaatgtgat

SEQ ID NO: 2618242 - DNA, 16 bp, Homo sapiens
atcaataatatatttt

SEQ ID NO: 2618243 - DNA, 18 bp, Homo sapiens
atcaataatatattttct

SEQ ID NO: 2618244 - DNA, 20 bp, Homo sapiens
atcaataatatattttctgt

SEQ ID NO: 2618245 - DNA, 20 bp, Homo sapiens
atcaatattgtcattcctgt

SEQ ID NO: 2618246 - DNA, 22 bp, Homo sapiens
atcaatattgtcattcctgtat

SEQ ID NO: 2618247 - DNA, 13 bp, Homo sapiens
atcaatcaactta

SEQ ID NO: 2618248 - DNA, 20 bp, Homo sapiens
atcaatcatctgtgtgaaaa

SEQ ID NO: 2618249 - DNA, 21 bp, Homo sapiens
atcaatggcgcagtgcctctg

SEQ ID NO: 2618250 - DNA, 13 bp, Homo sapiens
atcaatgttcatt

SEQ ID NO: 2618251 - DNA, 18 bp, Homo sapiens
atcaatgttcattgtaat

SEQ ID NO: 2618252 - DNA, 13 bp, Homo sapiens
atcaattaaatgt

SEQ ID NO: 2618253 - DNA, 14 bp, Homo sapiens
atcaattaaatgta

SEQ ID NO: 2618254 - DNA, 15 bp, Homo sapiens
atcaattaaatgtag

SEQ ID NO: 2618255 - DNA, 16 bp, Homo sapiens
atcaattcatatctat

SEQ ID NO: 2618256 - DNA, 13 bp, Homo sapiens
atcaatttaaaaa

SEQ ID NO: 2618257 - DNA, 15 bp, Homo sapiens
atcaatttaaaccca

SEQ ID NO: 2618258 - DNA, 11 bp, Homo sapiens
atcacacacac

SEQ ID NO: 2618259 - DNA, 14 bp, Homo sapiens
atcacagagacatt

SEQ ID NO: 2618260 - DNA, 12 bp, Homo sapiens
atcacagctgct

SEQ ID NO: 2618261 - DNA, 14 bp, Homo sapiens
atcacagcttcagc

SEQ ID NO: 2618262 - DNA, 19 bp, Homo sapiens
atcacagggcagagccggg

SEQ ID NO: 2618263 - DNA, 16 bp, Homo sapiens
atcacagggccccaga

SEQ ID NO: 2618264 - DNA, 20 bp, Homo sapiens
atcacagggttgggcccaga

SEQ ID NO: 2618265 - DNA, 14 bp, Homo sapiens
atcacatgtatgtt

SEQ ID NO: 2618266 - DNA, 16 bp, Homo sapiens
atcacattatttgcat

SEQ ID NO: 2618267 - DNA, 22 bp, Homo sapiens
atcacattatttgcatgttacc

SEQ ID NO: 2618268 - DNA, 19 bp, Homo sapiens
atcaccaacgtctgtgcca

SEQ ID NO: 2618269 - DNA, 13 bp, Homo sapiens
atcaccagacagg

SEQ ID NO: 2618270 - DNA, 21 bp, Homo sapiens
atcaccagcccggcctgctcc

SEQ ID NO: 2618271 - DNA, 15 bp, Homo sapiens
atcacctcaggccag

SEQ ID NO: 2618272 - DNA, 15 bp, Homo sapiens
atcaccttaggcagg

SEQ ID NO: 2618273 - DNA, 20 bp, Homo sapiens
atcaccttaggcagggaagt

SEQ ID NO: 2618274 - DNA, 14 bp, Homo sapiens
atcacgccactgca

SEQ ID NO: 2618275 - DNA, 13 bp, Homo sapiens
atcacgctttcct

SEQ ID NO: 2618276 - DNA, 21 bp, Homo sapiens
atcacgtaaagctagaaatga

SEQ ID NO: 2618277 - DNA, 20 bp, Homo sapiens
atcactaatactaattcatt

SEQ ID NO: 2618278 - DNA, 12 bp, Homo sapiens
atcactcccctc

SEQ ID NO: 2618279 - DNA, 14 bp, Homo sapiens
atcactcccctcca

SEQ ID NO: 2618280 - DNA, 21 bp, Homo sapiens
atcactctgctgcttagacat

SEQ ID NO: 2618281 - DNA, 13 bp, Homo sapiens
atcactctgtcct

SEQ ID NO: 2618282 - DNA, 14 bp, Homo sapiens
atcactgaactttg

SEQ ID NO: 2618283 - DNA, 10 bp, Homo sapiens
atcactggag

SEQ ID NO: 2618284 - DNA, 15 bp, Homo sapiens
atcactggagcccag

SEQ ID NO: 2618285 - DNA, 13 bp, Homo sapiens
atcactggatgaa

SEQ ID NO: 2618286 - DNA, 18 bp, Homo sapiens
atcactggcaatgaaaaa

SEQ ID NO: 2618287 - DNA, 20 bp, Homo sapiens
atcacttaggaaatggcttt

SEQ ID NO: 2618288 - DNA, 16 bp, Homo sapiens
atcactttctcagttt

SEQ ID NO: 2618289 - DNA, 14 bp, Homo sapiens
atcacttttcagtg

SEQ ID NO: 2618290 - DNA, 16 bp, Homo sapiens
atcagaaacaccctca

SEQ ID NO: 2618291 - DNA, 13 bp, Homo sapiens
atcagaacagcag

SEQ ID NO: 2618292 - DNA, 22 bp, Homo sapiens
atcagaagaccacaaaaattga

SEQ ID NO: 2618293 - DNA, 13 bp, Homo sapiens
atcagaagataac

SEQ ID NO: 2618294 - DNA, 17 bp, Homo sapiens
atcagaagataacttga

SEQ ID NO: 2618295 - DNA, 12 bp, Homo sapiens
atcagaattctc

SEQ ID NO: 2618296 - DNA, 16 bp, Homo sapiens
atcagaccataatgtt

SEQ ID NO: 2618297 - DNA, 20 bp, Homo sapiens
atcagaccataatgttacat

SEQ ID NO: 2618298 - DNA, 21 bp, Homo sapiens
atcagagcagcagtgaaaaca

SEQ ID NO: 2618299 - DNA, 15 bp, Homo sapiens
atcagaggcctataa

SEQ ID NO: 2618300 - DNA, 18 bp, Homo sapiens
atcagatcatttcaaaac

SEQ ID NO: 2618301 - DNA, 22 bp, Homo sapiens
atcagatcatttcaaaactcat

SEQ ID NO: 2618302 - DNA, 23 bp, Homo sapiens
atgaacttcgcatcaaaagacaa

SEQ ID NO: 2618303 - DNA, 15 bp, Homo sapiens
atgaagaaaaaatac

SEQ ID NO: 2618304 - DNA, 19 bp, Homo sapiens
atgaagaaaaaatacattt

SEQ ID NO: 2618305 - DNA, 20 bp, Homo sapiens
atgaagaaaaaatacatttt

SEQ ID NO: 2618306 - DNA, 20 bp, Homo sapiens
atgaagagatttttcatgat

SEQ ID NO: 2618307 - DNA, 22 bp, Homo sapiens
atgaagattctcctgtgctaga

SEQ ID NO: 2618308 - DNA, 14 bp, Homo sapiens
atgaagcaaacaca

SEQ ID NO: 2618309 - DNA, 13 bp, Homo sapiens
atgaagcagcttt

SEQ ID NO: 2618310 - DNA, 16 bp, Homo sapiens
atgaagcccaataaac

SEQ ID NO: 2618311 - DNA, 18 bp, Homo sapiens
atgaagcttgtgtatcca

SEQ ID NO: 2618312 - DNA, 21 bp, Homo sapiens
atgaagtaatatgcacacatt

SEQ ID NO: 2618313 - DNA, 23 bp, Homo sapiens
atgaagtaatatgcacacatttt

SEQ ID NO: 2618314 - DNA, 16 bp, Homo sapiens
atgaagtatataatgg

SEQ ID NO: 2618315 - DNA, 14 bp, Homo sapiens
atgaagtctctgaa

SEQ ID NO: 2618316 - DNA, 19 bp, Homo sapiens
atgaagtttccttggctgg

SEQ ID NO: 2618317 - DNA, 23 bp, Homo sapiens
atgaagtttccttggctggtgca

SEQ ID NO: 2618318 - DNA, 18 bp, Homo sapiens
atgaatcccacccacatg

SEQ ID NO: 2618319 - DNA, 16 bp, Homo sapiens
atgaatcttttccact

SEQ ID NO: 2618320 - DNA, 13 bp, Homo sapiens
atgaatgaatggc

SEQ ID NO: 2618321 - DNA, 19 bp, Homo sapiens
atgaatgaggtcccaggca

SEQ ID NO: 2618322 - DNA, 17 bp, Homo sapiens
atgaatgggcaaaactg

SEQ ID NO: 2618323 - DNA, 19 bp, Homo sapiens
atgaatgtatgtgcactgt

SEQ ID NO: 2618324 - DNA, 22 bp, Homo sapiens
atgaatgtttacactctttgta

SEQ ID NO: 2618325 - DNA, 14 bp, Homo sapiens
atgaattaaagtgg

SEQ ID NO: 2618326 - DNA, 16 bp, Homo sapiens
atgaattaaataaacc

SEQ ID NO: 2618327 - DNA, 13 bp, Homo sapiens
atgaattgcattt

SEQ ID NO: 2618328 - DNA, 16 bp, Homo sapiens
atgaatttaaatataa

SEQ ID NO: 2618329 - DNA, 19 bp, Homo sapiens
atgacaaaaattcaactca

SEQ ID NO: 2618330 - DNA, 23 bp, Homo sapiens
atgacaaaaattcaactcagact

SEQ ID NO: 2618331 - DNA, 18 bp, Homo sapiens
atgacaagccccaggcag

SEQ ID NO: 2618332 - DNA, 14 bp, Homo sapiens
atgacacatgcaag

SEQ ID NO: 2618333 - DNA, 22 bp, Homo sapiens
atgacacatgcaaggtcatttt

SEQ ID NO: 2618334 - DNA, 16 bp, Homo sapiens
atgacaggtaaattaa

SEQ ID NO: 2618335 - DNA, 22 bp, Homo sapiens
atgacagttatactgtcggttt

SEQ ID NO: 2618336 - DNA, 14 bp, Homo sapiens
atgacatcacttgt

SEQ ID NO: 2618337 - DNA, 18 bp, Homo sapiens
atgacatcacttgtacaa

SEQ ID NO: 2618338 - DNA, 19 bp, Homo sapiens
atgacatcacttgtacaaa

SEQ ID NO: 2618339 - DNA, 18 bp, Homo sapiens
atgacattcatgcctggc

SEQ ID NO: 2618340 - DNA, 14 bp, Homo sapiens
atgacattgctaag

SEQ ID NO: 2618341 - DNA, 22 bp, Homo sapiens
atgacatttatatcacatgttt

SEQ ID NO: 2618342 - DNA, 14 bp, Homo sapiens
atgacattttgcca

SEQ ID NO: 2618343 - DNA, 16 bp, Homo sapiens
atgacccaaagaccaa

SEQ ID NO: 2618344 - DNA, 16 bp, Homo sapiens
atgacccacccctgtg

SEQ ID NO: 2618345 - DNA, 21 bp, Homo sapiens
atgacctgtgaccagcactgt

SEQ ID NO: 2618346 - DNA, 16 bp, Homo sapiens
atgacggaagaacata

SEQ ID NO: 2618347 - DNA, 19 bp, Homo sapiens
atgactaaagagagaatgt

SEQ ID NO: 2618348 - DNA, 20 bp, Homo sapiens
atgactaaagagagaatgta

SEQ ID NO: 2618349 - DNA, 23 bp, Homo sapiens
atgactaaagagagaatgtagat

SEQ ID NO: 2618350 - DNA, 15 bp, Homo sapiens
atgactagaggcagg

SEQ ID NO: 2618351 - DNA, 22 bp, Homo sapiens
atgactcccttaaaatagaaat

SEQ ID NO: 2618352 - DNA, 13 bp, Homo sapiens
atgactgtagaat

SEQ ID NO: 2618353 - DNA, 17 bp, Homo sapiens
atgactgtgattttcag

SEQ ID NO: 2618354 - DNA, 14 bp, Homo sapiens
atgacttactgtac

SEQ ID NO: 2618355 - DNA, 16 bp, Homo sapiens
atgactttattgcatc

SEQ ID NO: 2618356 - DNA, 15 bp, Homo sapiens
atgagaaggcagcca

SEQ ID NO: 2618357 - DNA, 23 bp, Homo sapiens
atgagacttccaaacctgacaga

SEQ ID NO: 2618358 - DNA, 15 bp, Homo sapiens
atgagacttgctctc

SEQ ID NO: 2618359 - DNA, 14 bp, Homo sapiens
atgagagcccagag

SEQ ID NO: 2618360 - DNA, 18 bp, Homo sapiens
atgagagcccagaggtaa

SEQ ID NO: 2618361 - DNA, 20 bp, Homo sapiens
atgagagcccagaggtaaca

SEQ ID NO: 2618362 - DNA, 16 bp, Homo sapiens
atgagatattaaacca

SEQ ID NO: 2618363 - DNA, 22 bp, Homo sapiens
atgagatctaagcctttccata

SEQ ID NO: 2618364 - DNA, 18 bp, Homo sapiens
atgagattgttttatcat

SEQ ID NO: 2618365 - DNA, 22 bp, Homo sapiens
atgagattgttttatcatgaca

SEQ ID NO: 2618366 - DNA, 18 bp, Homo sapiens
atgagcatcaggccaggc

SEQ ID NO: 2618367 - DNA, 21 bp, Homo sapiens
atgagcatcaggccaggccct

SEQ ID NO: 2618368 - DNA, 17 bp, Homo sapiens
atgagcatggagctggc

SEQ ID NO: 2618369 - DNA, 21 bp, Homo sapiens
atgagccaccgcgcccagcct

SEQ ID NO: 2618370 - DNA, 19 bp, Homo sapiens
atgagcctacgctgaagat

SEQ ID NO: 2618371 - DNA, 12 bp, Homo sapiens
atgagcctcagc

SEQ ID NO: 2618372 - DNA, 15 bp, Homo sapiens
atgagcctcagcatc

SEQ ID NO: 2618373 - DNA, 19 bp, Homo sapiens
atgagcctcagcatcctgg

SEQ ID NO: 2618374 - DNA, 12 bp, Homo sapiens
atgagcctggca

SEQ ID NO: 2618375 - DNA, 13 bp, Homo sapiens
atgagcctggcaa

SEQ ID NO: 2618376 - DNA, 14 bp, Homo sapiens
atgagctatgtatt

SEQ ID NO: 2618377 - DNA, 15 bp, Homo sapiens
atgagctatgtatta

SEQ ID NO: 2618378 - DNA, 16 bp, Homo sapiens
atgagctatgtattaa

SEQ ID NO: 2618379 - DNA, 16 bp, Homo sapiens
atgagctccagacccc

SEQ ID NO: 2618380 - DNA, 17 bp, Homo sapiens
atgagctccagaccccc

SEQ ID NO: 2618381 - DNA, 21 bp, Homo sapiens
atgagctccagacccccagca

SEQ ID NO: 2618382 - DNA, 22 bp, Homo sapiens
atgagctccagacccccagcaa

SEQ ID NO: 2618383 - DNA, 14 bp, Homo sapiens
atgagctcctcttc

SEQ ID NO: 2618384 - DNA, 22 bp, Homo sapiens
atgagctcctcttcctggcttc

SEQ ID NO: 2618385 - DNA, 21 bp, Homo sapiens
atgagctcgcatttgtcaatg

SEQ ID NO: 2618386 - DNA, 13 bp, Homo sapiens
atgagctgagggg

SEQ ID NO: 2618387 - DNA, 22 bp, Homo sapiens
atgagctttatgtaataatgtg

SEQ ID NO: 2618388 - DNA, 15 bp, Homo sapiens
atgaggcttgctgag

SEQ ID NO: 2618389 - DNA, 17 bp, Homo sapiens
atgaggcttgctgagag

SEQ ID NO: 2618390 - DNA, 18 bp, Homo sapiens
atgaggcttgctgagagg

SEQ ID NO: 2618391 - DNA, 14 bp, Homo sapiens
atgagggactggaa

SEQ ID NO: 2618392 - DNA, 16 bp, Homo sapiens
atgagggatcacaggg

SEQ ID NO: 2618393 - DNA, 15 bp, Homo sapiens
atgaggtactgagag

SEQ ID NO: 2618394 - DNA, 18 bp, Homo sapiens
atgaggtcagagcctgca

SEQ ID NO: 2618395 - DNA, 18 bp, Homo sapiens
atgaggtcccaggcagag

SEQ ID NO: 2618396 - DNA, 18 bp, Homo sapiens
atgaggttgcttactaag

SEQ ID NO: 2618397 - DNA, 16 bp, Homo sapiens
atgagtcaatgtgcag

SEQ ID NO: 2618398 - DNA, 19 bp, Homo sapiens
atgagtcaatgtgcagtgt

SEQ ID NO: 2618399 - DNA, 21 bp, Homo sapiens
atgagtccttgaaaatatttt

SEQ ID NO: 2618400 - DNA, 17 bp, Homo sapiens
atgagtgcgtgctcagt

SEQ ID NO: 2618401 - DNA, 17 bp, Homo sapiens
atgatacaagattagaa

SEQ ID NO: 2618402 - DNA, 21 bp, Homo sapiens
atgatatgtaaacataattct

SEQ ID NO: 2618403 - DNA, 18 bp, Homo sapiens
atgatcagctgtttgtca

SEQ ID NO: 2618404 - DNA, 22 bp, Homo sapiens
atgatcatttgcccttaaggac

SEQ ID NO: 2618405 - DNA, 16 bp, Homo sapiens
atgatcctaggcattt

SEQ ID NO: 2618406 - DNA, 18 bp, Homo sapiens
atgatctactcagaaatt

SEQ ID NO: 2618407 - DNA, 14 bp, Homo sapiens
atgatctctctgaa

SEQ ID NO: 2618408 - DNA, 15 bp, Homo sapiens
atgatcttgtgacat

SEQ ID NO: 2618409 - DNA, 18 bp, Homo sapiens
atgatctttgcagacagg

SEQ ID NO: 2618410 - DNA, 19 bp, Homo sapiens
atgatctttgcagacaggc

SEQ ID NO: 2618411 - DNA, 18 bp, Homo sapiens
atgatgaaatgaggtcag

SEQ ID NO: 2618412 - DNA, 18 bp, Homo sapiens
atgatgatgggaattgtg

SEQ ID NO: 2618413 - DNA, 20 bp, Homo sapiens
atgatgatgtggaagaactt

SEQ ID NO: 2618414 - DNA, 17 bp, Homo sapiens
atgatgccaacctctgg

SEQ ID NO: 2618415 - DNA, 12 bp, Homo sapiens
atgatgtatatt

SEQ ID NO: 2618416 - DNA, 15 bp, Homo sapiens
atgatgtccagaaga

SEQ ID NO: 2618417 - DNA, 18 bp, Homo sapiens
atgatgtccagaagaata

SEQ ID NO: 2618418 - DNA, 23 bp, Homo sapiens
atgatgtccagaagaatattcag

SEQ ID NO: 2618419 - DNA, 19 bp, Homo sapiens
atgatgtgggtcaaggaat

SEQ ID NO: 2618420 - DNA, 14 bp, Homo sapiens
atgatgtgttgtga

SEQ ID NO: 2618421 - DNA, 15 bp, Homo sapiens
atgatgtttcacata

SEQ ID NO: 2618422 - DNA, 21 bp, Homo sapiens
atgatgtttcgtgaagtatac

SEQ ID NO: 2618423 - DNA, 19 bp, Homo sapiens
atgattactctttgagata

SEQ ID NO: 2618424 - DNA, 14 bp, Homo sapiens
atgattcagaaatt

SEQ ID NO: 2618425 - DNA, 16 bp, Homo sapiens
atgattcagtgttaaa

SEQ ID NO: 2618426 - DNA, 22 bp, Homo sapiens
atgattccttgatggagatatt

SEQ ID NO: 2618427 - DNA, 23 bp, Homo sapiens
atgattctaatttttaagcaaaa

SEQ ID NO: 2618428 - DNA, 14 bp, Homo sapiens
atgattggattatt

SEQ ID NO: 2618429 - DNA, 21 bp, Homo sapiens
atgattggattattcatttaa

SEQ ID NO: 2618430 - DNA, 18 bp, Homo sapiens
atgattgtaaaatagctt

SEQ ID NO: 2618431 - DNA, 18 bp, Homo sapiens
atgatttaaaacatgtaa

SEQ ID NO: 2618432 - DNA, 18 bp, Homo sapiens
atgatttaataaaataat

SEQ ID NO: 2618433 - DNA, 20 bp, Homo sapiens
atgatttcatgctatctctg

SEQ ID NO: 2618434 - DNA, 18 bp, Homo sapiens
atgattttatttgacaaa

SEQ ID NO: 2618435 - DNA, 11 bp, Homo sapiens
atgatttttag

SEQ ID NO: 2618436 - DNA, 15 bp, Homo sapiens
atgatttttgtcatc

SEQ ID NO: 2618437 - DNA, 21 bp, Homo sapiens
atgatttttttttcatacact

SEQ ID NO: 2618438 - DNA, 12 bp, Homo sapiens
atgcaaaaagaa

SEQ ID NO: 2618439 - DNA, 15 bp, Homo sapiens
atgcaaagaaaatca

SEQ ID NO: 2618440 - DNA, 16 bp, Homo sapiens
atgcaaagaggcaaga

SEQ ID NO: 2618441 - DNA, 19 bp, Homo sapiens
atgcaaatcctatgtgatt

SEQ ID NO: 2618442 - DNA, 20 bp, Homo sapiens
atgcaaggaaggaaagaaag

SEQ ID NO: 2618443 - DNA, 15 bp, Homo sapiens
atgcaaggaccagga

SEQ ID NO: 2618444 - DNA, 15 bp, Homo sapiens
atgcaatatatctaa

SEQ ID NO: 2618445 - DNA, 13 bp, Homo sapiens
atgcacacatttt

SEQ ID NO: 2618446 - DNA, 21 bp, Homo sapiens
atgtggggtccccatcatccc

SEQ ID NO: 2618447 - DNA, 22 bp, Homo sapiens
atgtggtggcacaggccccctt

SEQ ID NO: 2618448 - DNA, 15 bp, Homo sapiens
atgtggttacacact

SEQ ID NO: 2618449 - DNA, 17 bp, Homo sapiens
atgtggttatttctctg

SEQ ID NO: 2618450 - DNA, 13 bp, Homo sapiens
atgtgtaagtatt

SEQ ID NO: 2618451 - DNA, 16 bp, Homo sapiens
atgtgtaatcaataaa

SEQ ID NO: 2618452 - DNA, 19 bp, Homo sapiens
atgtgtacatcccatgtaa

SEQ ID NO: 2618453 - DNA, 14 bp, Homo sapiens
atgtgtagcctgtg

SEQ ID NO: 2618454 - DNA, 17 bp, Homo sapiens
atgtgtattttattaca

SEQ ID NO: 2618455 - DNA, 21 bp, Homo sapiens
atgtgtcactactcacagtct

SEQ ID NO: 2618456 - DNA, 16 bp, Homo sapiens
atgtgtgagtgtgtgc

SEQ ID NO: 2618457 - DNA, 15 bp, Homo sapiens
atgtgtgcatgtgtg

SEQ ID NO: 2618458 - DNA, 21 bp, Homo sapiens
atgtgtgtccacgactgtctc

SEQ ID NO: 2618459 - DNA, 11 bp, Homo sapiens
atgtgtgtgca

SEQ ID NO: 2618460 - DNA, 13 bp, Homo sapiens
atgtgtgtgtatg

SEQ ID NO: 2618461 - DNA, 15 bp, Homo sapiens
atgtgtgtgtatgct

SEQ ID NO: 2618462 - DNA, 19 bp, Homo sapiens
atgtgtgtgtatgctacta

SEQ ID NO: 2618463 - DNA, 15 bp, Homo sapiens
atgtgtgtgtatgtt

SEQ ID NO: 2618464 - DNA, 22 bp, Homo sapiens
atgtgtgtgtgttgtgtgtggg

SEQ ID NO: 2618465 - DNA, 23 bp, Homo sapiens
atgtgtgtgtgttgtgtgtggga

SEQ ID NO: 2618466 - DNA, 15 bp, Homo sapiens
atgtgtgtttaaata

SEQ ID NO: 2618467 - DNA, 17 bp, Homo sapiens
atgtgtgtttaaataaa

SEQ ID NO: 2618468 - DNA, 18 bp, Homo sapiens
atgtgtttggttctgggg

SEQ ID NO: 2618469 - DNA, 15 bp, Homo sapiens
atgttaaaatgtatt

SEQ ID NO: 2618470 - DNA, 17 bp, Homo sapiens
atgttaaatttgtaagt

SEQ ID NO: 2618471 - DNA, 18 bp, Homo sapiens
atgttaaatttgtaagtt

SEQ ID NO: 2618472 - DNA, 20 bp, Homo sapiens
atgttaaatttgtaagtttc

SEQ ID NO: 2618473 - DNA, 15 bp, Homo sapiens
atgttaacacatttt

SEQ ID NO: 2618474 - DNA, 21 bp, Homo sapiens
atgttaacacattttgtataa

SEQ ID NO: 2618475 - DNA, 19 bp, Homo sapiens
atgttaaggaaactcttat

SEQ ID NO: 2618476 - DNA, 23 bp, Homo sapiens
atgttaattcagcactgatttca

SEQ ID NO: 2618477 - DNA, 17 bp, Homo sapiens
atgttacatcacagtgt

SEQ ID NO: 2618478 - DNA, 20 bp, Homo sapiens
atgttacatctgttttaaat

SEQ ID NO: 2618479 - DNA, 14 bp, Homo sapiens
atgttacattatta

SEQ ID NO: 2618480 - DNA, 18 bp, Homo sapiens
atgttactgatcatgcat

SEQ ID NO: 2618481 - DNA, 21 bp, Homo sapiens
atgttagaggttttaaagtga

SEQ ID NO: 2618482 - DNA, 18 bp, Homo sapiens
atgttaggaaaatttcac

SEQ ID NO: 2618483 - DNA, 16 bp, Homo sapiens
atgttagggtgctctg

SEQ ID NO: 2618484 - DNA, 13 bp, Homo sapiens
atgttatatattt

SEQ ID NO: 2618485 - DNA, 17 bp, Homo sapiens
atgttatgcataaagtc

SEQ ID NO: 2618486 - DNA, 18 bp, Homo sapiens
atgttatgcataaagtca

SEQ ID NO: 2618487 - DNA, 13 bp, Homo sapiens
atgttatgtaaaa

SEQ ID NO: 2618488 - DNA, 18 bp, Homo sapiens
atgttatttatatattgg

SEQ ID NO: 2618489 - DNA, 18 bp, Homo sapiens
atgttattttctgttgaa

SEQ ID NO: 2618490 - DNA, 20 bp, Homo sapiens
atgttattttttaattatta

SEQ ID NO: 2618491 - DNA, 14 bp, Homo sapiens
atgttcagtgtaat

SEQ ID NO: 2618492 - DNA, 21 bp, Homo sapiens
atgttcatcatcctaagctat

SEQ ID NO: 2618493 - DNA, 15 bp, Homo sapiens
atgttccactaaccc

SEQ ID NO: 2618494 - DNA, 15 bp, Homo sapiens
atgttcctagtgaaa

SEQ ID NO: 2618495 - DNA, 16 bp, Homo sapiens
atgttcctagtgaaag

SEQ ID NO: 2618496 - DNA, 17 bp, Homo sapiens
atgttcctagtgaaaga

SEQ ID NO: 2618497 - DNA, 19 bp, Homo sapiens
atgttcctgaattctattt

SEQ ID NO: 2618498 - DNA, 17 bp, Homo sapiens
atgttctctcttctcca

SEQ ID NO: 2618499 - DNA, 15 bp, Homo sapiens
atgttctgacattaa

SEQ ID NO: 2618500 - DNA, 17 bp, Homo sapiens
atgttctgacattaaca

SEQ ID NO: 2618501 - DNA, 13 bp, Homo sapiens
atgttctgctttc

SEQ ID NO: 2618502 - DNA, 11 bp, Homo sapiens
atgttctggga

SEQ ID NO: 2618503 - DNA, 15 bp, Homo sapiens
atgttctgggacaca

SEQ ID NO: 2618504 - DNA, 14 bp, Homo sapiens
atgttcttaattct

SEQ ID NO: 2618505 - DNA, 20 bp, Homo sapiens
atgttcttagtggatgttct

SEQ ID NO: 2618506 - DNA, 22 bp, Homo sapiens
atgttgaatgcccacaggcaaa

SEQ ID NO: 2618507 - DNA, 18 bp, Homo sapiens
atgttgagccaggcctgg

SEQ ID NO: 2618508 - DNA, 19 bp, Homo sapiens
atgttgctggactgtcata

SEQ ID NO: 2618509 - DNA, 18 bp, Homo sapiens
atgttggatttataaatg

SEQ ID NO: 2618510 - DNA, 20 bp, Homo sapiens
atgttggatttataaatgct

SEQ ID NO: 2618511 - DNA, 18 bp, Homo sapiens
atgttggtcattttatgt

SEQ ID NO: 2618512 - DNA, 18 bp, Homo sapiens
atgttgtaaacaggaagc

SEQ ID NO: 2618513 - DNA, 12 bp, Homo sapiens
atgttgttattt

SEQ ID NO: 2618514 - DNA, 13 bp, Homo sapiens
atgttgttattta

SEQ ID NO: 2618515 - DNA, 13 bp, Homo sapiens
atgtttacatatc

SEQ ID NO: 2618516 - DNA, 20 bp, Homo sapiens
atgtttacatatcacctcat

SEQ ID NO: 2618517 - DNA, 16 bp, Homo sapiens
atgtttatgagccaga

SEQ ID NO: 2618518 - DNA, 21 bp, Homo sapiens
atgtttatgagccagacaaat

SEQ ID NO: 2618519 - DNA, 22 bp, Homo sapiens
atgtttcgctgatatatgtgtt

SEQ ID NO: 2618520 - DNA, 22 bp, Homo sapiens
atgtttctgcagtagtctctgt

SEQ ID NO: 2618521 - DNA, 15 bp, Homo sapiens
atgtttcttctaggt

SEQ ID NO: 2618522 - DNA, 18 bp, Homo sapiens
atgtttgcttcataaatg

SEQ ID NO: 2618523 - DNA, 23 bp, Homo sapiens
atgtttgggcagaagggagaagg

SEQ ID NO: 2618524 - DNA, 10 bp, Homo sapiens
atgtttgtgg

SEQ ID NO: 2618525 - DNA, 15 bp, Homo sapiens
atgtttgtggcctca

SEQ ID NO: 2618526 - DNA, 18 bp, Homo sapiens
atgtttgtggcctcagaa

SEQ ID NO: 2618527 - DNA, 15 bp, Homo sapiens
atgttttaattccat

SEQ ID NO: 2618528 - DNA, 22 bp, Homo sapiens
atgttttagacaaatactcatg

SEQ ID NO: 2618529 - DNA, 19 bp, Homo sapiens
atgttttagagttaacaat

SEQ ID NO: 2618530 - DNA, 12 bp, Homo sapiens
atgttttagcat

SEQ ID NO: 2618531 - DNA, 19 bp, Homo sapiens
atgttttccagctcctcat

SEQ ID NO: 2618532 - DNA, 14 bp, Homo sapiens
atgttttccatgag

SEQ ID NO: 2618533 - DNA, 20 bp, Homo sapiens
atgttttctgaaaatataac

SEQ ID NO: 2618534 - DNA, 14 bp, Homo sapiens
atgttttgacattt

SEQ ID NO: 2618535 - DNA, 15 bp, Homo sapiens
atgttttggtatctg

SEQ ID NO: 2618536 - DNA, 17 bp, Homo sapiens
atgttttgtgactatat

SEQ ID NO: 2618537 - DNA, 21 bp, Homo sapiens
atgttttgtgactatatagag

SEQ ID NO: 2618538 - DNA, 14 bp, Homo sapiens
atgtttttgaaggc

SEQ ID NO: 2618539 - DNA, 17 bp, Homo sapiens
atgtttttgtgtatttg

SEQ ID NO: 2618540 - DNA, 19 bp, Homo sapiens
atgtttttgttcaaagcca

SEQ ID NO: 2618541 - DNA, 21 bp, Homo sapiens
atgtttttgttttctttgaat

SEQ ID NO: 2618542 - DNA, 22 bp, Homo sapiens
atgttttttagatcaaatactt

SEQ ID NO: 2618543 - DNA, 17 bp, Homo sapiens
attaaaaaatttccagt

SEQ ID NO: 2618544 - DNA, 19 bp, Homo sapiens
attaaaaatctcaaatttc

SEQ ID NO: 2618545 - DNA, 22 bp, Homo sapiens
attaaaaatctcaaatttctaa

SEQ ID NO: 2618546 - DNA, 23 bp, Homo sapiens
attaaaaatctcaaatttctaaa

SEQ ID NO: 2618547 - DNA, 22 bp, Homo sapiens
attaaaaatgaaattatttata

SEQ ID NO: 2618548 - DNA, 21 bp, Homo sapiens
attaaaacaatattgtttcta

SEQ ID NO: 2618549 - DNA, 20 bp, Homo sapiens
attaaaactgaagtctgaaa

SEQ ID NO: 2618550 - DNA, 22 bp, Homo sapiens
attaaaactgaagtctgaaatt

SEQ ID NO: 2618551 - DNA, 22 bp, Homo sapiens
attaaaagggattacccaagca

SEQ ID NO: 2618552 - DNA, 19 bp, Homo sapiens
attaaaataaataaatgca

SEQ ID NO: 2618553 - DNA, 22 bp, Homo sapiens
attaaaatatggctataaatat

SEQ ID NO: 2618554 - DNA, 13 bp, Homo sapiens
attaaaatcttaa

SEQ ID NO: 2618555 - DNA, 13 bp, Homo sapiens
attaaaatgaata

SEQ ID NO: 2618556 - DNA, 20 bp, Homo sapiens
attaaaatgattgtaaaata

SEQ ID NO: 2618557 - DNA, 18 bp, Homo sapiens
attaaacagatttttaca

SEQ ID NO: 2618558 - DNA, 14 bp, Homo sapiens
attaaacggattat

SEQ ID NO: 2618559 - DNA, 20 bp, Homo sapiens
attaaacggattattttttc

SEQ ID NO: 2618560 - DNA, 21 bp, Homo sapiens
attaaacttaatctaaatgga

SEQ ID NO: 2618561 - DNA, 20 bp, Homo sapiens
attaaagcatttactttgaa

SEQ ID NO: 2618562 - DNA, 18 bp, Homo sapiens
attaaagctaaagtatct

SEQ ID NO: 2618563 - DNA, 19 bp, Homo sapiens
attaaatacagacactaag

SEQ ID NO: 2618564 - DNA, 20 bp, Homo sapiens
attaaatacagacactaagt

SEQ ID NO: 2618565 - DNA, 18 bp, Homo sapiens
attaaatctatgaagtat

SEQ ID NO: 2618566 - DNA, 15 bp, Homo sapiens
attaaatgcccagcc

SEQ ID NO: 2618567 - DNA, 17 bp, Homo sapiens
attaaatgcccagcccc

SEQ ID NO: 2618568 - DNA, 19 bp, Homo sapiens
attaaatgcccagcccctt

SEQ ID NO: 2618569 - DNA, 13 bp, Homo sapiens
attaaattaggaa

SEQ ID NO: 2618570 - DNA, 14 bp, Homo sapiens
attaaattcttgca

SEQ ID NO: 2618571 - DNA, 15 bp, Homo sapiens
attaaatttaattag

SEQ ID NO: 2618572 - DNA, 18 bp, Homo sapiens
attaacaacaataacact

SEQ ID NO: 2618573 - DNA, 16 bp, Homo sapiens
attaacagttttccat

SEQ ID NO: 2618574 - DNA, 22 bp, Homo sapiens
attaacattgggaaatcttata

SEQ ID NO: 2618575 - DNA, 18 bp, Homo sapiens
attaaccacttcagctga

SEQ ID NO: 2618576 - DNA, 18 bp, Homo sapiens
attaaccagaaatccagt

SEQ ID NO: 2618577 - DNA, 17 bp, Homo sapiens
attaactaatctattgg

SEQ ID NO: 2618578 - DNA, 15 bp, Homo sapiens
attaacttagcatgt

SEQ ID NO: 2618579 - DNA, 17 bp, Homo sapiens
attaacttttataaact

SEQ ID NO: 2618580 - DNA, 20 bp, Homo sapiens
attaagatggattctcagat

SEQ ID NO: 2618581 - DNA, 17 bp, Homo sapiens
attaagattgaggcctg

SEQ ID NO: 2618582 - DNA, 16 bp, Homo sapiens
attaagccctcttcca

SEQ ID NO: 2618583 - DNA, 17 bp, Homo sapiens
attaagccctcttccat

SEQ ID NO: 2618584 - DNA, 20 bp, Homo sapiens
attaagccctcttccatcat

SEQ ID NO: 2618585 - DNA, 20 bp, Homo sapiens
attaaggattttatgcttta

SEQ ID NO: 2618586 - DNA, 16 bp, Homo sapiens
attaagtactatgtat

SEQ ID NO: 2618587 - DNA, 19 bp, Homo sapiens
attaagttgttaataaaag

SEQ ID NO: 2618588 - DNA, 20 bp, Homo sapiens
attaagttgttaataaaagt

SEQ ID NO: 2618589 - DNA, 18 bp, Homo sapiens
attaatagcttttattgt

SEQ ID NO: 2618590 - DNA, 17 bp, Homo sapiens
attttgatgttttaagg

SEQ ID NO: 2618591 - DNA, 14 bp, Homo sapiens
attttgattattgt

SEQ ID NO: 2618592 - DNA, 18 bp, Homo sapiens
attttgattattgtattt

SEQ ID NO: 2618593 - DNA, 15 bp, Homo sapiens
attttgcaaaatttc

SEQ ID NO: 2618594 - DNA, 12 bp, Homo sapiens
attttgcagcag

SEQ ID NO: 2618595 - DNA, 14 bp, Homo sapiens
attttgcagcagtg

SEQ ID NO: 2618596 - DNA, 22 bp, Homo sapiens
attttgcccttccatagcctaa

SEQ ID NO: 2618597 - DNA, 14 bp, Homo sapiens
attttgctggaata

SEQ ID NO: 2618598 - DNA, 20 bp, Homo sapiens
attttgctttgtgatttttg

SEQ ID NO: 2618599 - DNA, 15 bp, Homo sapiens
attttgggaatcttt

SEQ ID NO: 2618600 - DNA, 23 bp, Homo sapiens
attttggggtacccactgctctg

SEQ ID NO: 2618601 - DNA, 15 bp, Homo sapiens
attttggtactttta

SEQ ID NO: 2618602 - DNA, 20 bp, Homo sapiens
attttggtattacactgtat

SEQ ID NO: 2618603 - DNA, 21 bp, Homo sapiens
attttggtattacactgtatt

SEQ ID NO: 2618604 - DNA, 15 bp, Homo sapiens
attttggttgtattc

SEQ ID NO: 2618605 - DNA, 17 bp, Homo sapiens
attttgtaaactcaaaa

SEQ ID NO: 2618606 - DNA, 19 bp, Homo sapiens
attttgtaacgaagacaca

SEQ ID NO: 2618607 - DNA, 17 bp, Homo sapiens
attttgtataattgtat

SEQ ID NO: 2618608 - DNA, 23 bp, Homo sapiens
attttgtcatataagattcatat

SEQ ID NO: 2618609 - DNA, 20 bp, Homo sapiens
attttgtggctttctttctt

SEQ ID NO: 2618610 - DNA, 19 bp, Homo sapiens
attttgttgctgttttgat

SEQ ID NO: 2618611 - DNA, 20 bp, Homo sapiens
attttgttgcttttgtgaac

SEQ ID NO: 2618612 - DNA, 22 bp, Homo sapiens
attttgtttttgtcttaaaaag

SEQ ID NO: 2618613 - DNA, 16 bp, Homo sapiens
atttttaagtgctgca

SEQ ID NO: 2618614 - DNA, 15 bp, Homo sapiens
atttttaatcatgaa

SEQ ID NO: 2618615 - DNA, 15 bp, Homo sapiens
atttttaatgggggt

SEQ ID NO: 2618616 - DNA, 14 bp, Homo sapiens
atttttactgccac

SEQ ID NO: 2618617 - DNA, 16 bp, Homo sapiens
atttttagtaaagaca

SEQ ID NO: 2618618 - DNA, 15 bp, Homo sapiens
atttttatatttagt

SEQ ID NO: 2618619 - DNA, 16 bp, Homo sapiens
atttttattaaattat

SEQ ID NO: 2618620 - DNA, 16 bp, Homo sapiens
atttttcagatataaa

SEQ ID NO: 2618621 - DNA, 19 bp, Homo sapiens
atttttcatgattttgaaa

SEQ ID NO: 2618622 - DNA, 12 bp, Homo sapiens
atttttctaaaa

SEQ ID NO: 2618623 - DNA, 19 bp, Homo sapiens
atttttctggaggttgata

SEQ ID NO: 2618624 - DNA, 13 bp, Homo sapiens
atttttgatttat

SEQ ID NO: 2618625 - DNA, 15 bp, Homo sapiens
atttttgccttcatt

SEQ ID NO: 2618626 - DNA, 19 bp, Homo sapiens
atttttggcagtctgaatt

SEQ ID NO: 2618627 - DNA, 17 bp, Homo sapiens
atttttggttgaataaa

SEQ ID NO: 2618628 - DNA, 19 bp, Homo sapiens
atttttgtagagccagggt

SEQ ID NO: 2618629 - DNA, 23 bp, Homo sapiens
atttttgtcttatatatatttct

SEQ ID NO: 2618630 - DNA, 14 bp, Homo sapiens
atttttgtcttgtg

SEQ ID NO: 2618631 - DNA, 16 bp, Homo sapiens
atttttgtttctacct

SEQ ID NO: 2618632 - DNA, 22 bp, Homo sapiens
atttttgtttcttccaaagcac

SEQ ID NO: 2618633 - DNA, 13 bp, Homo sapiens
attttttaaatgc

SEQ ID NO: 2618634 - DNA, 16 bp, Homo sapiens
attttttaaggaaaca

SEQ ID NO: 2618635 - DNA, 16 bp, Homo sapiens
attttttaagtattta

SEQ ID NO: 2618636 - DNA, 17 bp, Homo sapiens
attttttaagtatttat

SEQ ID NO: 2618637 - DNA, 19 bp, Homo sapiens
attttttaagtatttatat

SEQ ID NO: 2618638 - DNA, 18 bp, Homo sapiens
attttttatatatacagt

SEQ ID NO: 2618639 - DNA, 16 bp, Homo sapiens
attttttatcatgcat

SEQ ID NO: 2618640 - DNA, 15 bp, Homo sapiens
attttttattttact

SEQ ID NO: 2618641 - DNA, 16 bp, Homo sapiens
attttttcagaccgaa

SEQ ID NO: 2618642 - DNA, 16 bp, Homo sapiens
atttttttattactga

SEQ ID NO: 2618643 - DNA, 15 bp, Homo sapiens
atttttttcaatatt

SEQ ID NO: 2618644 - DNA, 14 bp, Homo sapiens
atttttttctgatt

SEQ ID NO: 2618645 - DNA, 15 bp, Homo sapiens
atttttttctgattg

SEQ ID NO: 2618646 - DNA, 21 bp, Homo sapiens
atttttttctgattgtaacgt

SEQ ID NO: 2618647 - DNA, 16 bp, Homo sapiens
attttttttcatgttt

SEQ ID NO: 2618648 - DNA, 17 bp, Homo sapiens
attttttttctgttata

SEQ ID NO: 2618649 - DNA, 18 bp, Homo sapiens
attttttttctgttatat

SEQ ID NO: 2618650 - DNA, 14 bp, Homo sapiens
atttttttttcata

SEQ ID NO: 2618651 - DNA, 21 bp, Homo sapiens
atttttttttcatacacttat

SEQ ID NO: 2618652 - DNA, 19 bp, Homo sapiens
attttttttttaaattatt

SEQ ID NO: 2618653 - DNA, 23 bp, Homo sapiens
caaaaaaatactgccagatgctg

SEQ ID NO: 2618654 - DNA, 15 bp, Homo sapiens
caaaaaactcgagga

SEQ ID NO: 2618655 - DNA, 14 bp, Homo sapiens
caaaaaactgcagt

SEQ ID NO: 2618656 - DNA, 14 bp, Homo sapiens
caaaaagaccagac

SEQ ID NO: 2618657 - DNA, 14 bp, Homo sapiens
caaaaagcttcccc

SEQ ID NO: 2618658 - DNA, 11 bp, Homo sapiens
caaaaatataa

SEQ ID NO: 2618659 - DNA, 19 bp, Homo sapiens
caaaaatgaaagcatgtct

SEQ ID NO: 2618660 - DNA, 17 bp, Homo sapiens
caaaaatgaactgaagt

SEQ ID NO: 2618661 - DNA, 21 bp, Homo sapiens
caaaacaaatgccacacatca

SEQ ID NO: 2618662 - DNA, 13 bp, Homo sapiens
caaaaccacagcc

SEQ ID NO: 2618663 - DNA, 16 bp, Homo sapiens
caaaaccacagccctg

SEQ ID NO: 2618664 - DNA, 21 bp, Homo sapiens
caaaaccacagccctgtcagt

SEQ ID NO: 2618665 - DNA, 23 bp, Homo sapiens
caaaacgcatggagtgtgtattg

SEQ ID NO: 2618666 - DNA, 20 bp, Homo sapiens
caaaactcaaatgcttggct

SEQ ID NO: 2618667 - DNA, 23 bp, Homo sapiens
caaaactctcctctgctgctggc

SEQ ID NO: 2618668 - DNA, 13 bp, Homo sapiens
caaaagacaattc

SEQ ID NO: 2618669 - DNA, 15 bp, Homo sapiens
caaaagacaattctt

SEQ ID NO: 2618670 - DNA, 19 bp, Homo sapiens
caaaagattgctgaaattt

SEQ ID NO: 2618671 - DNA, 20 bp, Homo sapiens
caaaagattgctgaaatttt

SEQ ID NO: 2618672 - DNA, 16 bp, Homo sapiens
caaaagcaagactgtt

SEQ ID NO: 2618673 - DNA, 14 bp, Homo sapiens
caaaagcacccttg

SEQ ID NO: 2618674 - DNA, 13 bp, Homo sapiens
caaaagcatgtga

SEQ ID NO: 2618675 - DNA, 19 bp, Homo sapiens
caaaagctgggcaggttgg

SEQ ID NO: 2618676 - DNA, 21 bp, Homo sapiens
caaaaggtattttaatcacca

SEQ ID NO: 2618677 - DNA, 13 bp, Homo sapiens
caaaagtattttc

SEQ ID NO: 2618678 - DNA, 14 bp, Homo sapiens
caaaagtattttcc

SEQ ID NO: 2618679 - DNA, 16 bp, Homo sapiens
caaaagtattttcctg

SEQ ID NO: 2618680 - DNA, 20 bp, Homo sapiens
caaaagtattttcctgtaaa

SEQ ID NO: 2618681 - DNA, 16 bp, Homo sapiens
caaaagtggcctcttt

SEQ ID NO: 2618682 - DNA, 22 bp, Homo sapiens
caaaataaaaagtgacacagca

SEQ ID NO: 2618683 - DNA, 17 bp, Homo sapiens
caaaataaaaatgaggt

SEQ ID NO: 2618684 - DNA, 14 bp, Homo sapiens
caaaataaatgttg

SEQ ID NO: 2618685 - DNA, 15 bp, Homo sapiens
caaaataagaaaaga

SEQ ID NO: 2618686 - DNA, 13 bp, Homo sapiens
caaaatagaagct

SEQ ID NO: 2618687 - DNA, 13 bp, Homo sapiens
caaaatagagaat

SEQ ID NO: 2618688 - DNA, 16 bp, Homo sapiens
caaaatagcatttgtt

SEQ ID NO: 2618689 - DNA, 19 bp, Homo sapiens
caaaatatgttgatgaaaa

SEQ ID NO: 2618690 - DNA, 23 bp, Homo sapiens
caaaatcatggaatggttataaa

SEQ ID NO: 2618691 - DNA, 15 bp, Homo sapiens
caaaattatttcaga

SEQ ID NO: 2618692 - DNA, 11 bp, Homo sapiens
caaaattccca

SEQ ID NO: 2618693 - DNA, 13 bp, Homo sapiens
caaaattcccagg

SEQ ID NO: 2618694 - DNA, 19 bp, Homo sapiens
caaaattgacattgcttta

SEQ ID NO: 2618695 - DNA, 23 bp, Homo sapiens
caaaattgggaaaggagtagaaa

SEQ ID NO: 2618696 - DNA, 17 bp, Homo sapiens
caaaatttagtttttgt

SEQ ID NO: 2618697 - DNA, 20 bp, Homo sapiens
caaaatttagtttttgttct

SEQ ID NO: 2618698 - DNA, 21 bp, Homo sapiens
caaaatttagtttttgttctt

SEQ ID NO: 2618699 - DNA, 14 bp, Homo sapiens
caaaattttattcc

SEQ ID NO: 2618700 - DNA, 13 bp, Homo sapiens
caaacaaagccag

SEQ ID NO: 2618701 - DNA, 14 bp, Homo sapiens
caaacaaagccaga

SEQ ID NO: 2618702 - DNA, 14 bp, Homo sapiens
caaacaaatatgca

SEQ ID NO: 2618703 - DNA, 17 bp, Homo sapiens
caaacaatggaaactga

SEQ ID NO: 2618704 - DNA, 12 bp, Homo sapiens
caaacaccttcc

SEQ ID NO: 2618705 - DNA, 21 bp, Homo sapiens
caaacaccttccagctcctgt

SEQ ID NO: 2618706 - DNA, 20 bp, Homo sapiens
caaacactgcaggcatcaca

SEQ ID NO: 2618707 - DNA, 19 bp, Homo sapiens
caaacagtaggttggcagt

SEQ ID NO: 2618708 - DNA, 16 bp, Homo sapiens
caaacagtctcaggaa

SEQ ID NO: 2618709 - DNA, 17 bp, Homo sapiens
caaacagtctcaggaaa

SEQ ID NO: 2618710 - DNA, 22 bp, Homo sapiens
caaacatgaagtgtgtttcctt

SEQ ID NO: 2618711 - DNA, 18 bp, Homo sapiens
caaacatgtggttaatgc

SEQ ID NO: 2618712 - DNA, 20 bp, Homo sapiens
caaacatgtggttaatgcca

SEQ ID NO: 2618713 - DNA, 14 bp, Homo sapiens
caaaccacactgga

SEQ ID NO: 2618714 - DNA, 15 bp, Homo sapiens
caaaccacactggac

SEQ ID NO: 2618715 - DNA, 13 bp, Homo sapiens
caaaccagaagca

SEQ ID NO: 2618716 - DNA, 18 bp, Homo sapiens
caaaccccctttgtgctg

SEQ ID NO: 2618717 - DNA, 18 bp, Homo sapiens
caaaccccgaccacctgc

SEQ ID NO: 2618718 - DNA, 21 bp, Homo sapiens
caaacctccaaaactcctgcc

SEQ ID NO: 2618719 - DNA, 11 bp, Homo sapiens
caaacctctgt

SEQ ID NO: 2618720 - DNA, 13 bp, Homo sapiens
caaacctctgttc

SEQ ID NO: 2618721 - DNA, 15 bp, Homo sapiens
caaacctctgttcag

SEQ ID NO: 2618722 - DNA, 19 bp, Homo sapiens
caaacctctgttcagtgta

SEQ ID NO: 2618723 - DNA, 15 bp, Homo sapiens
caaacctgcctgggt

SEQ ID NO: 2618724 - DNA, 16 bp, Homo sapiens
caaacctgcctgggtt

SEQ ID NO: 2618725 - DNA, 19 bp, Homo sapiens
caaacctgtttaaatattt

SEQ ID NO: 2618726 - DNA, 21 bp, Homo sapiens
caaacctgtttaaatatttca

SEQ ID NO: 2618727 - DNA, 13 bp, Homo sapiens
caaactagggcca

SEQ ID NO: 2618728 - DNA, 14 bp, Homo sapiens
caaactatttctta

SEQ ID NO: 2618729 - DNA, 18 bp, Homo sapiens
caaactatttcttatata

SEQ ID NO: 2618730 - DNA, 18 bp, Homo sapiens
caaactcactgctcaaga

SEQ ID NO: 2618731 - DNA, 14 bp, Homo sapiens
caaactcagcctca

SEQ ID NO: 2618732 - DNA, 19 bp, Homo sapiens
caaactcttgacctcaggt

SEQ ID NO: 2618733 - DNA, 21 bp, Homo sapiens
caaactcttgacctcaggtga

SEQ ID NO: 2618734 - DNA, 17 bp, Homo sapiens
caaactgcctaagccct

SEQ ID NO: 2618735 - DNA, 19 bp, Homo sapiens
caaactggcaaacttcaga

SEQ ID NO: 2618736 - DNA, 23 bp, Homo sapiens
caagtgtgcatattgtacacttt

SEQ ID NO: 2618737 - DNA, 19 bp, Homo sapiens
caagtgtgctttagcttga

SEQ ID NO: 2618738 - DNA, 11 bp, Homo sapiens
caagtgtgtgc

SEQ ID NO: 2618739 - DNA, 22 bp, Homo sapiens
caagtgtgtgcacatgtgtgcg

SEQ ID NO: 2618740 - DNA, 20 bp, Homo sapiens
caagtgtgtgcatgtgtgcg

SEQ ID NO: 2618741 - DNA, 18 bp, Homo sapiens
caagttaaagtgaataac

SEQ ID NO: 2618742 - DNA, 20 bp, Homo sapiens
caagttacagctgtgacaat

SEQ ID NO: 2618743 - DNA, 13 bp, Homo sapiens
caagttagctcag

SEQ ID NO: 2618744 - DNA, 16 bp, Homo sapiens
caagttagctcaggag

SEQ ID NO: 2618745 - DNA, 17 bp, Homo sapiens
caagttagctcaggagg

SEQ ID NO: 2618746 - DNA, 19 bp, Homo sapiens
caagttagctcaggaggct

SEQ ID NO: 2618747 - DNA, 18 bp, Homo sapiens
caagttccaagttgctaa

SEQ ID NO: 2618748 - DNA, 18 bp, Homo sapiens
caagttctagagaagagg

SEQ ID NO: 2618749 - DNA, 15 bp, Homo sapiens
caagttgctaataca

SEQ ID NO: 2618750 - DNA, 21 bp, Homo sapiens
caagttgtggtgctgacaaag

SEQ ID NO: 2618751 - DNA, 23 bp, Homo sapiens
caagttgtttgagaaattaagta

SEQ ID NO: 2618752 - DNA, 22 bp, Homo sapiens
caagttttaggacaaacagctc

SEQ ID NO: 2618753 - DNA, 13 bp, Homo sapiens
caagttttgtgta

SEQ ID NO: 2618754 - DNA, 16 bp, Homo sapiens
caataaaaatggctca

SEQ ID NO: 2618755 - DNA, 22 bp, Homo sapiens
caataaaaatggctcagatgcc

SEQ ID NO: 2618756 - DNA, 14 bp, Homo sapiens
caataaaacattaa

SEQ ID NO: 2618757 - DNA, 22 bp, Homo sapiens
caataaaagcaattccaacctt

SEQ ID NO: 2618758 - DNA, 13 bp, Homo sapiens
caataaaatagca

SEQ ID NO: 2618759 - DNA, 16 bp, Homo sapiens
caataaaatgtgattt

SEQ ID NO: 2618760 - DNA, 19 bp, Homo sapiens
caataaaattttttttcat

SEQ ID NO: 2618761 - DNA, 17 bp, Homo sapiens
caataaacctcttttct

SEQ ID NO: 2618762 - DNA, 16 bp, Homo sapiens
caataaacgatttaat

SEQ ID NO: 2618763 - DNA, 17 bp, Homo sapiens
caataaacgatttaatt

SEQ ID NO: 2618764 - DNA, 19 bp, Homo sapiens
caataaacgatttaattct

SEQ ID NO: 2618765 - DNA, 11 bp, Homo sapiens
caataaagtat

SEQ ID NO: 2618766 - DNA, 18 bp, Homo sapiens
caataaatggtatagcaa

SEQ ID NO: 2618767 - DNA, 23 bp, Homo sapiens
caataaatggtatagcaaatgtt

SEQ ID NO: 2618768 - DNA, 14 bp, Homo sapiens
caataaatgtctgt

SEQ ID NO: 2618769 - DNA, 13 bp, Homo sapiens
caataacactgtc

SEQ ID NO: 2618770 - DNA, 14 bp, Homo sapiens
caataactactgtg

SEQ ID NO: 2618771 - DNA, 16 bp, Homo sapiens
caataactactgtgtt

SEQ ID NO: 2618772 - DNA, 21 bp, Homo sapiens
caataactactgtgttcctgg

SEQ ID NO: 2618773 - DNA, 13 bp, Homo sapiens
caataatatattt

SEQ ID NO: 2618774 - DNA, 17 bp, Homo sapiens
caataatatattttctg

SEQ ID NO: 2618775 - DNA, 18 bp, Homo sapiens
caataatatattttctgt

SEQ ID NO: 2618776 - DNA, 19 bp, Homo sapiens
caataatggtcccatccag

SEQ ID NO: 2618777 - DNA, 22 bp, Homo sapiens
caataatttcaggttttgtaaa

SEQ ID NO: 2618778 - DNA, 18 bp, Homo sapiens
caatacagtacaggcagc

SEQ ID NO: 2618779 - DNA, 15 bp, Homo sapiens
caatacatgctgcta

SEQ ID NO: 2618780 - DNA, 19 bp, Homo sapiens
caatacccaaatcctctcc

SEQ ID NO: 2618781 - DNA, 17 bp, Homo sapiens
caatactcataatgtga

SEQ ID NO: 2618782 - DNA, 22 bp, Homo sapiens
caatactcataatgtgaagtgt

SEQ ID NO: 2618783 - DNA, 23 bp, Homo sapiens
caatagaaactcaccatgtaaaa

SEQ ID NO: 2618784 - DNA, 19 bp, Homo sapiens
caatagatatttacctttt

SEQ ID NO: 2618785 - DNA, 16 bp, Homo sapiens
caatagtgtgttctga

SEQ ID NO: 2618786 - DNA, 23 bp, Homo sapiens
caatataaaaggcaaatgtgtac

SEQ ID NO: 2618787 - DNA, 19 bp, Homo sapiens
caatatagaaacacgaact

SEQ ID NO: 2618788 - DNA, 22 bp, Homo sapiens
caatatatctaaattgaataat

SEQ ID NO: 2618789 - DNA, 15 bp, Homo sapiens
caatatgcagttctg

SEQ ID NO: 2618790 - DNA, 14 bp, Homo sapiens
caatatgtattgta

SEQ ID NO: 2618791 - DNA, 23 bp, Homo sapiens
caatatgtattgtaaacatgtgt

SEQ ID NO: 2618792 - DNA, 23 bp, Homo sapiens
caatattaaatacagacactaag

SEQ ID NO: 2618793 - DNA, 18 bp, Homo sapiens
caatattatactaagaaa

SEQ ID NO: 2618794 - DNA, 21 bp, Homo sapiens
caatattatactaagaaaaga

SEQ ID NO: 2618795 - DNA, 13 bp, Homo sapiens
caatattcctgaa

SEQ ID NO: 2618796 - DNA, 15 bp, Homo sapiens
caatattgaactttt

SEQ ID NO: 2618797 - DNA, 13 bp, Homo sapiens
caatatttattat

SEQ ID NO: 2618798 - DNA, 11 bp, Homo sapiens
caatattttcc

SEQ ID NO: 2618799 - DNA, 15 bp, Homo sapiens
caatattttccatga

SEQ ID NO: 2618800 - DNA, 16 bp, Homo sapiens
caatcagtataattct

SEQ ID NO: 2618801 - DNA, 19 bp, Homo sapiens
caatcagtataattctgta

SEQ ID NO: 2618802 - DNA, 17 bp, Homo sapiens
caatcagtcccctccca

SEQ ID NO: 2618803 - DNA, 20 bp, Homo sapiens
caatcagtcccctcccatct

SEQ ID NO: 2618804 - DNA, 17 bp, Homo sapiens
caatcatgaaatatgca

SEQ ID NO: 2618805 - DNA, 16 bp, Homo sapiens
caatcattgctgaaaa

SEQ ID NO: 2618806 - DNA, 15 bp, Homo sapiens
caatccatgtaaggt

SEQ ID NO: 2618807 - DNA, 17 bp, Homo sapiens
caatccatgtaaggtat

SEQ ID NO: 2618808 - DNA, 12 bp, Homo sapiens
caatcccctcct

SEQ ID NO: 2618809 - DNA, 20 bp, Homo sapiens
caatcccctccttgggcact

SEQ ID NO: 2618810 - DNA, 17 bp, Homo sapiens
caatcctaacacattat

SEQ ID NO: 2618811 - DNA, 20 bp, Homo sapiens
caatcctatgtttttgttca

SEQ ID NO: 2618812 - DNA, 14 bp, Homo sapiens
caatcctcactggg

SEQ ID NO: 2618813 - DNA, 16 bp, Homo sapiens
caatcctcactgggtg

SEQ ID NO: 2618814 - DNA, 18 bp, Homo sapiens
caatcctcactgggtggg

SEQ ID NO: 2618815 - DNA, 11 bp, Homo sapiens
caatcctgccc

SEQ ID NO: 2618816 - DNA, 12 bp, Homo sapiens
caatcctgcccc

SEQ ID NO: 2618817 - DNA, 11 bp, Homo sapiens
caatcctggac

SEQ ID NO: 2618818 - DNA, 20 bp, Homo sapiens
caatctaaccacatcaatat

SEQ ID NO: 2618819 - DNA, 21 bp, Homo sapiens
caatgaaatgaattaaagtgg

SEQ ID NO: 2618820 - DNA, 23 bp, Homo sapiens
caatgaaatgaattaaagtggac

SEQ ID NO: 2618821 - DNA, 22 bp, Homo sapiens
caatgaatgaatgaatggctaa

SEQ ID NO: 2618822 - DNA, 21 bp, Homo sapiens
caatgacacagtcttggctca

SEQ ID NO: 2618823 - DNA, 16 bp, Homo sapiens
caatgacatctcaggg

SEQ ID NO: 2618824 - DNA, 17 bp, Homo sapiens
caatgaggtctgaaatg

SEQ ID NO: 2618825 - DNA, 18 bp, Homo sapiens
caatgaggtctgaaatgg

SEQ ID NO: 2618826 - DNA, 19 bp, Homo sapiens
caatgaggtctgaaatgga

SEQ ID NO: 2618827 - DNA, 18 bp, Homo sapiens
caatgatagtaagaaaag

SEQ ID NO: 2618828 - DNA, 22 bp, Homo sapiens
caatgatctaggtttaactcag

SEQ ID NO: 2618829 - DNA, 24 bp, Homo sapiens
caatgatctaggtttaactcagat

SEQ ID NO: 2618830 - DNA, 14 bp, Homo sapiens
caatgatggtcacc

SEQ ID NO: 2618831 - DNA, 16 bp, Homo sapiens
caatgcacacaaaaca

SEQ ID NO: 2618832 - DNA, 14 bp, Homo sapiens
caatgcactttgtt

SEQ ID NO: 2618833 - DNA, 21 bp, Homo sapiens
caatgcactttgttctggctc

SEQ ID NO: 2618834 - DNA, 22 bp, Homo sapiens
caatgcactttgttctggctct

SEQ ID NO: 2618835 - DNA, 12 bp, Homo sapiens
caatgcattttg

SEQ ID NO: 2618836 - DNA, 13 bp, Homo sapiens
caatgcattttgg

SEQ ID NO: 2618837 - DNA, 21 bp, Homo sapiens
caatgcattttggaaagctcc

SEQ ID NO: 2618838 - DNA, 13 bp, Homo sapiens
caatgctgatgtc

SEQ ID NO: 2618839 - DNA, 20 bp, Homo sapiens
caatgctgatgtcctcacca

SEQ ID NO: 2618840 - DNA, 20 bp, Homo sapiens
caatgctggctgttggctgg

SEQ ID NO: 2618841 - DNA, 21 bp, Homo sapiens
caatgctggctgttggctggg

SEQ ID NO: 2618842 - DNA, 21 bp, Homo sapiens
caatgctttgcccctgagaca

SEQ ID NO: 2618843 - DNA, 16 bp, Homo sapiens
caatggaaactgaatg

SEQ ID NO: 2618844 - DNA, 14 bp, Homo sapiens
caatggaacctcct

SEQ ID NO: 2618845 - DNA, 17 bp, Homo sapiens
caatggatttgatgctg

SEQ ID NO: 2618846 - DNA, 13 bp, Homo sapiens
caatggcagcctt

SEQ ID NO: 2618847 - DNA, 14 bp, Homo sapiens
caatggcagccttg

SEQ ID NO: 2618848 - DNA, 20 bp, Homo sapiens
caatggcgcagtgcctctgg

SEQ ID NO: 2618849 - DNA, 18 bp, Homo sapiens
caatggcttactccagga

SEQ ID NO: 2618850 - DNA, 15 bp, Homo sapiens
caatggctttttaaa

SEQ ID NO: 2618851 - DNA, 15 bp, Homo sapiens
caatgggcaatgaca

SEQ ID NO: 2618852 - DNA, 17 bp, Homo sapiens
caatggtttgcaaggaa

SEQ ID NO: 2618853 - DNA, 20 bp, Homo sapiens
caatggtttgcaaggaagcc

SEQ ID NO: 2618854 - DNA, 20 bp, Homo sapiens
caatgtattgataagagggc

SEQ ID NO: 2618855 - DNA, 22 bp, Homo sapiens
caatgtatttatttaaaagatt

SEQ ID NO: 2618856 - DNA, 23 bp, Homo sapiens
caatgtatttatttaaaagattc

SEQ ID NO: 2618857 - DNA, 16 bp, Homo sapiens
caatgtcaggaacaga

SEQ ID NO: 2618858 - DNA, 13 bp, Homo sapiens
caatgtgcagtgt

SEQ ID NO: 2618859 - DNA, 23 bp, Homo sapiens
caatgtgctactgattgtttcat

SEQ ID NO: 2618860 - DNA, 13 bp, Homo sapiens
caatgtgctctcg

SEQ ID NO: 2618861 - DNA, 16 bp, Homo sapiens
caatgttaaggaaact

SEQ ID NO: 2618862 - DNA, 19 bp, Homo sapiens
caatgttaaggaaactctt

SEQ ID NO: 2618863 - DNA, 19 bp, Homo sapiens
caatgttactatctgcttt

SEQ ID NO: 2618864 - DNA, 13 bp, Homo sapiens
caatgttcattgt

SEQ ID NO: 2618865 - DNA, 18 bp, Homo sapiens
caatgtttcttttatcac

SEQ ID NO: 2618866 - DNA, 13 bp, Homo sapiens
caatgttttcctt

SEQ ID NO: 2618867 - DNA, 18 bp, Homo sapiens
caattaaacggattattt

SEQ ID NO: 2618868 - DNA, 19 bp, Homo sapiens
caattaaacggattatttt

SEQ ID NO: 2618869 - DNA, 13 bp, Homo sapiens
caattaaatgtag

SEQ ID NO: 2618870 - DNA, 22 bp, Homo sapiens
caattaaatgtaggtatgaata

SEQ ID NO: 2618871 - DNA, 13 bp, Homo sapiens
caattaaggattt

SEQ ID NO: 2618872 - DNA, 22 bp, Homo sapiens
caattaaggattttatgcttta

SEQ ID NO: 2618873 - DNA, 23 bp, Homo sapiens
caattaggaagtgtaacagctga

SEQ ID NO: 2618874 - DNA, 13 bp, Homo sapiens
caattcccctctg

SEQ ID NO: 2618875 - DNA, 13 bp, Homo sapiens
caattcctgggcc

SEQ ID NO: 2618876 - DNA, 16 bp, Homo sapiens
caattcgatatccgga

SEQ ID NO: 2618877 - DNA, 17 bp, Homo sapiens
caattcttacaaacatg

SEQ ID NO: 2618878 - DNA, 17 bp, Homo sapiens
caattcttccctatctt

SEQ ID NO: 2618879 - DNA, 19 bp, Homo sapiens
caattctttatacaacagt

SEQ ID NO: 2618880 - DNA, 14 bp, Homo sapiens
cacggtgggccttg

SEQ ID NO: 2618881 - DNA, 17 bp, Homo sapiens
cacgtcatgtttcttca

SEQ ID NO: 2618882 - DNA, 16 bp, Homo sapiens
cacgtccagaattttt

SEQ ID NO: 2618883 - DNA, 20 bp, Homo sapiens
cacgtggaggaatgctcccc

SEQ ID NO: 2618884 - DNA, 18 bp, Homo sapiens
cacgtggcatgtggcctg

SEQ ID NO: 2618885 - DNA, 22 bp, Homo sapiens
cacgtggcatgtggcctgtggc

SEQ ID NO: 2618886 - DNA, 16 bp, Homo sapiens
cacgtgggctcatatg

SEQ ID NO: 2618887 - DNA, 15 bp, Homo sapiens
cacgtgtcctgtagt

SEQ ID NO: 2618888 - DNA, 16 bp, Homo sapiens
cacgtgtcctgtagtt

SEQ ID NO: 2618889 - DNA, 11 bp, Homo sapiens
cacgtgtgtga

SEQ ID NO: 2618890 - DNA, 12 bp, Homo sapiens
cacgtgtgtgac

SEQ ID NO: 2618891 - DNA, 16 bp, Homo sapiens
cacgtgtgtgactcag

SEQ ID NO: 2618892 - DNA, 16 bp, Homo sapiens
cacgtgtttgtgctgt

SEQ ID NO: 2618893 - DNA, 19 bp, Homo sapiens
cacgttctcacacccaccg

SEQ ID NO: 2618894 - DNA, 22 bp, Homo sapiens
cacgttctcacacccaccgtcc

SEQ ID NO: 2618895 - DNA, 22 bp, Homo sapiens
cacgttcttactagtttccctt

SEQ ID NO: 2618896 - DNA, 12 bp, Homo sapiens
cacgtttctaaa

SEQ ID NO: 2618897 - DNA, 22 bp, Homo sapiens
cactaaactttacccaaaaact

SEQ ID NO: 2618898 - DNA, 12 bp, Homo sapiens
cactaaagcagt

SEQ ID NO: 2618899 - DNA, 22 bp, Homo sapiens
cactaaagtatgtaaagtatgt

SEQ ID NO: 2618900 - DNA, 20 bp, Homo sapiens
cactaacgttgagcccctgg

SEQ ID NO: 2618901 - DNA, 18 bp, Homo sapiens
cactaaggtgtgctctga

SEQ ID NO: 2618902 - DNA, 20 bp, Homo sapiens
cactacactccagcctgagc

SEQ ID NO: 2618903 - DNA, 15 bp, Homo sapiens
cactacatgcagccc

SEQ ID NO: 2618904 - DNA, 15 bp, Homo sapiens
cactactcctctgca

SEQ ID NO: 2618905 - DNA, 20 bp, Homo sapiens
cactactcctctgcagtgcc

SEQ ID NO: 2618906 - DNA, 12 bp, Homo sapiens
cactactgcagt

SEQ ID NO: 2618907 - DNA, 14 bp, Homo sapiens
cactagcctctcca

SEQ ID NO: 2618908 - DNA, 16 bp, Homo sapiens
cactagcctctccagg

SEQ ID NO: 2618909 - DNA, 17 bp, Homo sapiens
cactagcctctccagga

SEQ ID NO: 2618910 - DNA, 17 bp, Homo sapiens
cactaggactctgaggc

SEQ ID NO: 2618911 - DNA, 20 bp, Homo sapiens
cactagggcagggacaggat

SEQ ID NO: 2618912 - DNA, 18 bp, Homo sapiens
cactatctgggtgcatga

SEQ ID NO: 2618913 - DNA, 14 bp, Homo sapiens
cactatgaagatgt

SEQ ID NO: 2618914 - DNA, 15 bp, Homo sapiens
cactatggtgccaat

SEQ ID NO: 2618915 - DNA, 19 bp, Homo sapiens
cactatttatctgtgcaaa

SEQ ID NO: 2618916 - DNA, 18 bp, Homo sapiens
cactcaaaagctgggcag

SEQ ID NO: 2618917 - DNA, 14 bp, Homo sapiens
cactcaagaagcag

SEQ ID NO: 2618918 - DNA, 17 bp, Homo sapiens
cactcaagaagcaggct

SEQ ID NO: 2618919 - DNA, 19 bp, Homo sapiens
cactcaagaagcaggctac

SEQ ID NO: 2618920 - DNA, 23 bp, Homo sapiens
cactcaagaagcaggctacactg

SEQ ID NO: 2618921 - DNA, 16 bp, Homo sapiens
cactcaagccaagcag

SEQ ID NO: 2618922 - DNA, 16 bp, Homo sapiens
cactcacacagccagg

SEQ ID NO: 2618923 - DNA, 12 bp, Homo sapiens
cactcacacagg

SEQ ID NO: 2618924 - DNA, 13 bp, Homo sapiens
cactcacacagga

SEQ ID NO: 2618925 - DNA, 18 bp, Homo sapiens
cactcaccagtgtcccct

SEQ ID NO: 2618926 - DNA, 22 bp, Homo sapiens
cactcacccatgtgccaaggtg

SEQ ID NO: 2618927 - DNA, 17 bp, Homo sapiens
cactcactgcggagaac

SEQ ID NO: 2618928 - DNA, 22 bp, Homo sapiens
cactcagctcttggctccactg

SEQ ID NO: 2618929 - DNA, 19 bp, Homo sapiens
cactcagcttcctacccac

SEQ ID NO: 2618930 - DNA, 19 bp, Homo sapiens
cactcaggaggctgaggca

SEQ ID NO: 2618931 - DNA, 12 bp, Homo sapiens
cactcatgctga

SEQ ID NO: 2618932 - DNA, 14 bp, Homo sapiens
cactcatgctgaaa

SEQ ID NO: 2618933 - DNA, 20 bp, Homo sapiens
cactcattgacctgaggccc

SEQ ID NO: 2618934 - DNA, 22 bp, Homo sapiens
cactcattgacctgaggccctt

SEQ ID NO: 2618935 - DNA, 13 bp, Homo sapiens
cactccaattaag

SEQ ID NO: 2618936 - DNA, 21 bp, Homo sapiens
cactccaattaaggattttat

SEQ ID NO: 2618937 - DNA, 14 bp, Homo sapiens
cactccagcctgag

SEQ ID NO: 2618938 - DNA, 15 bp, Homo sapiens
cactccagcctgagc

SEQ ID NO: 2618939 - DNA, 23 bp, Homo sapiens
cactccagcctgagcgacagtga

SEQ ID NO: 2618940 - DNA, 13 bp, Homo sapiens
cactccagcctgg

SEQ ID NO: 2618941 - DNA, 15 bp, Homo sapiens
cactccagcctgggc

SEQ ID NO: 2618942 - DNA, 23 bp, Homo sapiens
cactccagcctgggcgacagagc

SEQ ID NO: 2618943 - DNA, 16 bp, Homo sapiens
cactccagtgagacag

SEQ ID NO: 2618944 - DNA, 21 bp, Homo sapiens
cactccagtgagacagctctg

SEQ ID NO: 2618945 - DNA, 12 bp, Homo sapiens
cactcccaagcc

SEQ ID NO: 2618946 - DNA, 15 bp, Homo sapiens
cactcccaggcagcc

SEQ ID NO: 2618947 - DNA, 14 bp, Homo sapiens
cactccccaccttc

SEQ ID NO: 2618948 - DNA, 13 bp, Homo sapiens
cactcccctgctg

SEQ ID NO: 2618949 - DNA, 15 bp, Homo sapiens
cactcccctgctggg

SEQ ID NO: 2618950 - DNA, 18 bp, Homo sapiens
cactcccttctacctgcc

SEQ ID NO: 2618951 - DNA, 19 bp, Homo sapiens
cactcccttctacctgcca

SEQ ID NO: 2618952 - DNA, 17 bp, Homo sapiens
cactccggtgtgcctgc

SEQ ID NO: 2618953 - DNA, 19 bp, Homo sapiens
cactccggtgtgcctgcag

SEQ ID NO: 2618954 - DNA, 21 bp, Homo sapiens
cactccggtgtgcctgcagcc

SEQ ID NO: 2618955 - DNA, 21 bp, Homo sapiens
cactcctagagaacgcagccc

SEQ ID NO: 2618956 - DNA, 22 bp, Homo sapiens
cactcctagagaacgcagccct

SEQ ID NO: 2618957 - DNA, 12 bp, Homo sapiens
cactcctctgac

SEQ ID NO: 2618958 - DNA, 10 bp, Homo sapiens
cactcctggg

SEQ ID NO: 2618959 - DNA, 11 bp, Homo sapiens
cactcctgggg

SEQ ID NO: 2618960 - DNA, 14 bp, Homo sapiens
cactccttcacaga

SEQ ID NO: 2618961 - DNA, 16 bp, Homo sapiens
cactcgcccgcccact

SEQ ID NO: 2618962 - DNA, 17 bp, Homo sapiens
cactcgcccgcccactg

SEQ ID NO: 2618963 - DNA, 23 bp, Homo sapiens
cactcgcccgcccactgtcctgg

SEQ ID NO: 2618964 - DNA, 22 bp, Homo sapiens
cactcggcatttcaaatgtgct

SEQ ID NO: 2618965 - DNA, 16 bp, Homo sapiens
cactctaccctcccac

SEQ ID NO: 2618966 - DNA, 17 bp, Homo sapiens
cactctaccctcccacc

SEQ ID NO: 2618967 - DNA, 18 bp, Homo sapiens
cactctaccctcccaccc

SEQ ID NO: 2618968 - DNA, 17 bp, Homo sapiens
cactctaggggtcaggc

SEQ ID NO: 2618969 - DNA, 19 bp, Homo sapiens
cactctaggggtcaggctc

SEQ ID NO: 2618970 - DNA, 22 bp, Homo sapiens
cactctaggggtcaggctccat

SEQ ID NO: 2618971 - DNA, 17 bp, Homo sapiens
cactctccttgctaccc

SEQ ID NO: 2618972 - DNA, 13 bp, Homo sapiens
cactctctgaaga

SEQ ID NO: 2618973 - DNA, 14 bp, Homo sapiens
cactctctgaagat

SEQ ID NO: 2618974 - DNA, 16 bp, Homo sapiens
cactctgcttgttatt

SEQ ID NO: 2618975 - DNA, 20 bp, Homo sapiens
cactctggcagctcagagag

SEQ ID NO: 2618976 - DNA, 14 bp, Homo sapiens
cactctgggctcca

SEQ ID NO: 2618977 - DNA, 15 bp, Homo sapiens
cactctgtcgcccag

SEQ ID NO: 2618978 - DNA, 16 bp, Homo sapiens
cactctgtcgcccagt

SEQ ID NO: 2618979 - DNA, 17 bp, Homo sapiens
cactcttattgcccacg

SEQ ID NO: 2618980 - DNA, 19 bp, Homo sapiens
cactcttattgcccacgct

SEQ ID NO: 2618981 - DNA, 20 bp, Homo sapiens
cactcttattgcccacgctg

SEQ ID NO: 2618982 - DNA, 22 bp, Homo sapiens
cactcttattgcccacgctgga

SEQ ID NO: 2618983 - DNA, 15 bp, Homo sapiens
cactctttgtaagag

SEQ ID NO: 2618984 - DNA, 16 bp, Homo sapiens
cactgaaaacatctgg

SEQ ID NO: 2618985 - DNA, 20 bp, Homo sapiens
cactgaaatatacacacagc

SEQ ID NO: 2618986 - DNA, 19 bp, Homo sapiens
cactgacacaaaaagtaga

SEQ ID NO: 2618987 - DNA, 17 bp, Homo sapiens
cactgacagcctcccac

SEQ ID NO: 2618988 - DNA, 16 bp, Homo sapiens
cactgaccatccactc

SEQ ID NO: 2618989 - DNA, 15 bp, Homo sapiens
cactgactactggct

SEQ ID NO: 2618990 - DNA, 19 bp, Homo sapiens
cactgactactggctctca

SEQ ID NO: 2618991 - DNA, 15 bp, Homo sapiens
cactgacttctaagt

SEQ ID NO: 2618992 - DNA, 21 bp, Homo sapiens
cactgacttctaagtaaaacc

SEQ ID NO: 2618993 - DNA, 19 bp, Homo sapiens
cactgagataccagcgagg

SEQ ID NO: 2618994 - DNA, 23 bp, Homo sapiens
cactgagataccagcgaggaggc

SEQ ID NO: 2618995 - DNA, 14 bp, Homo sapiens
cactgagcaaagca

SEQ ID NO: 2618996 - DNA, 14 bp, Homo sapiens
cactgagccccccc

SEQ ID NO: 2618997 - DNA, 14 bp, Homo sapiens
cactgaggcaggga

SEQ ID NO: 2618998 - DNA, 19 bp, Homo sapiens
cactgaggcagggaagtcc

SEQ ID NO: 2618999 - DNA, 10 bp, Homo sapiens
cactgagggc

SEQ ID NO: 2619000 - DNA, 22 bp, Homo sapiens
cactgatattttacctcttatt

SEQ ID NO: 2619001 - DNA, 19 bp, Homo sapiens
cactgatggacaaggaggt

SEQ ID NO: 2619002 - DNA, 13 bp, Homo sapiens
cactgatttcaca

SEQ ID NO: 2619003 - DNA, 19 bp, Homo sapiens
cactgatttcacaacagat

SEQ ID NO: 2619004 - DNA, 13 bp, Homo sapiens
cactgcaacctcc

SEQ ID NO: 2619005 - DNA, 14 bp, Homo sapiens
cactgcacagagct

SEQ ID NO: 2619006 - DNA, 16 bp, Homo sapiens
cactgcacagagctct

SEQ ID NO: 2619007 - DNA, 19 bp, Homo sapiens
cactgcacagagctctcca

SEQ ID NO: 2619008 - DNA, 22 bp, Homo sapiens
cactgcacagagctctccagct

SEQ ID NO: 2619009 - DNA, 18 bp, Homo sapiens
cactgcaccgggccacag

SEQ ID NO: 2619010 - DNA, 19 bp, Homo sapiens
cactgcaccgggccacaga

SEQ ID NO: 2619011 - DNA, 19 bp, Homo sapiens
cactgcactatagcctagg

SEQ ID NO: 2619012 - DNA, 16 bp, Homo sapiens
cactgcactccagcct

SEQ ID NO: 2619013 - DNA, 17 bp, Homo sapiens
cactgcactccagcctg

SEQ ID NO: 2619014 - DNA, 19 bp, Homo sapiens
cactgcactccagcctggg

SEQ ID NO: 2619015 - DNA, 13 bp, Homo sapiens
cactgcagcctca

SEQ ID NO: 2619016 - DNA, 21 bp, Homo sapiens
cactgcagcctcaacctcctg

SEQ ID NO: 2619017 - DNA, 22 bp, Homo sapiens
cactgcagcctcaacctcctgg

SEQ ID NO: 2619018 - DNA, 20 bp, Homo sapiens
cactgcaggcatcacagcta

SEQ ID NO: 2619019 - DNA, 18 bp, Homo sapiens
cactgcatgagcttttat

SEQ ID NO: 2619020 - DNA, 22 bp, Homo sapiens
cactgcatgagcttttatacta

SEQ ID NO: 2619021 - DNA, 21 bp, Homo sapiens
cactgcccaaagtgcttccaa

SEQ ID NO: 2619022 - DNA, 17 bp, Homo sapiens
cactgcccaccccctca

SEQ ID NO: 2619023 - DNA, 13 bp, Homo sapiens
cactgcctcaggt

SEQ ID NO: 2619024 - DNA, 17 bp, Homo sapiens
cactgcctcaggttcct

SEQ ID NO: 2619025 - DNA, 15 bp, Homo sapiens
cagcccggaccttgg

SEQ ID NO: 2619026 - DNA, 12 bp, Homo sapiens
cagcccggcctg

SEQ ID NO: 2619027 - DNA, 21 bp, Homo sapiens
cagcccggcctgctcccagca

SEQ ID NO: 2619028 - DNA, 16 bp, Homo sapiens
cagcccgggctctgcc

SEQ ID NO: 2619029 - DNA, 19 bp, Homo sapiens
cagcccgggctctgcctcc

SEQ ID NO: 2619030 - DNA, 17 bp, Homo sapiens
cagcccgtgtggcccct

SEQ ID NO: 2619031 - DNA, 19 bp, Homo sapiens
cagccctaaggatctctca

SEQ ID NO: 2619032 - DNA, 20 bp, Homo sapiens
cagccctaaggatctctcag

SEQ ID NO: 2619033 - DNA, 21 bp, Homo sapiens
cagccctaaggatctctcagg

SEQ ID NO: 2619034 - DNA, 23 bp, Homo sapiens
cagccctagagcctgcctggagc

SEQ ID NO: 2619035 - DNA, 14 bp, Homo sapiens
cagccctatggatg

SEQ ID NO: 2619036 - DNA, 22 bp, Homo sapiens
cagccctgaggtgaaagggagc

SEQ ID NO: 2619037 - DNA, 16 bp, Homo sapiens
cagccctgctggccgc

SEQ ID NO: 2619038 - DNA, 14 bp, Homo sapiens
cagccctggagtca

SEQ ID NO: 2619039 - DNA, 16 bp, Homo sapiens
cagccctggctgaagg

SEQ ID NO: 2619040 - DNA, 11 bp, Homo sapiens
cagccctgtgg

SEQ ID NO: 2619041 - DNA, 19 bp, Homo sapiens
cagccctttgggaggctga

SEQ ID NO: 2619042 - DNA, 23 bp, Homo sapiens
cagccctttgggaggctgaggcg

SEQ ID NO: 2619043 - DNA, 14 bp, Homo sapiens
cagccgagccgggc

SEQ ID NO: 2619044 - DNA, 23 bp, Homo sapiens
cagccgagctcgtgtatcctggg

SEQ ID NO: 2619045 - DNA, 17 bp, Homo sapiens
cagccgccattgccacc

SEQ ID NO: 2619046 - DNA, 19 bp, Homo sapiens
cagccgccattgccaccag

SEQ ID NO: 2619047 - DNA, 18 bp, Homo sapiens
cagccgctcctgtctgcc

SEQ ID NO: 2619048 - DNA, 20 bp, Homo sapiens
cagccgctgagcgaggagat

SEQ ID NO: 2619049 - DNA, 14 bp, Homo sapiens
cagccggcctctct

SEQ ID NO: 2619050 - DNA, 16 bp, Homo sapiens
cagccggcctctctgg

SEQ ID NO: 2619051 - DNA, 17 bp, Homo sapiens
cagccggcctctctggc

SEQ ID NO: 2619052 - DNA, 18 bp, Homo sapiens
cagccggcctctctggcc

SEQ ID NO: 2619053 - DNA, 13 bp, Homo sapiens
cagccgggccctg

SEQ ID NO: 2619054 - DNA, 19 bp, Homo sapiens
cagccggtacctgggaagg

SEQ ID NO: 2619055 - DNA, 18 bp, Homo sapiens
cagccgtcagccaaatgt

SEQ ID NO: 2619056 - DNA, 19 bp, Homo sapiens
cagccgtcagccaaatgta

SEQ ID NO: 2619057 - DNA, 18 bp, Homo sapiens
cagcctagccgacctcag

SEQ ID NO: 2619058 - DNA, 22 bp, Homo sapiens
cagcctagccgacctcagcctt

SEQ ID NO: 2619059 - DNA, 18 bp, Homo sapiens
cagcctcaacctcctggg

SEQ ID NO: 2619060 - DNA, 18 bp, Homo sapiens
cagcctcaataagccttg

SEQ ID NO: 2619061 - DNA, 21 bp, Homo sapiens
cagcctcaataagccttgtcg

SEQ ID NO: 2619062 - DNA, 14 bp, Homo sapiens
cagcctccaagctc

SEQ ID NO: 2619063 - DNA, 12 bp, Homo sapiens
cagcctccagcc

SEQ ID NO: 2619064 - DNA, 13 bp, Homo sapiens
cagcctccagcct

SEQ ID NO: 2619065 - DNA, 17 bp, Homo sapiens
cagcctccagcctctgt

SEQ ID NO: 2619066 - DNA, 17 bp, Homo sapiens
cagcctccatgctgcct

SEQ ID NO: 2619067 - DNA, 14 bp, Homo sapiens
cagcctcccacccc

SEQ ID NO: 2619068 - DNA, 18 bp, Homo sapiens
cagcctcccacccccatc

SEQ ID NO: 2619069 - DNA, 19 bp, Homo sapiens
cagcctcccctgccagggc

SEQ ID NO: 2619070 - DNA, 20 bp, Homo sapiens
cagcctcccctgccagggca

SEQ ID NO: 2619071 - DNA, 22 bp, Homo sapiens
cagcctcccctgccagggcagg

SEQ ID NO: 2619072 - DNA, 20 bp, Homo sapiens
cagcctcccgaatagctggg

SEQ ID NO: 2619073 - DNA, 22 bp, Homo sapiens
cagcctcccgaatagctgggac

SEQ ID NO: 2619074 - DNA, 22 bp, Homo sapiens
cagcctcccgagtagctgggac

SEQ ID NO: 2619075 - DNA, 21 bp, Homo sapiens
cagcctccctattttttttct

SEQ ID NO: 2619076 - DNA, 13 bp, Homo sapiens
cagcctccctctg

SEQ ID NO: 2619077 - DNA, 23 bp, Homo sapiens
cagcctccctctgacctgcaggc

SEQ ID NO: 2619078 - DNA, 18 bp, Homo sapiens
cagcctccgtatttcaga

SEQ ID NO: 2619079 - DNA, 16 bp, Homo sapiens
cagcctcctcatctgg

SEQ ID NO: 2619080 - DNA, 23 bp, Homo sapiens
cagcctcctcatctgggggagtg

SEQ ID NO: 2619081 - DNA, 14 bp, Homo sapiens
cagcctctagggac

SEQ ID NO: 2619082 - DNA, 21 bp, Homo sapiens
cagcctctagggacccctcct

SEQ ID NO: 2619083 - DNA, 17 bp, Homo sapiens
cagcctctcccctgatt

SEQ ID NO: 2619084 - DNA, 11 bp, Homo sapiens
cagcctcttaa

SEQ ID NO: 2619085 - DNA, 21 bp, Homo sapiens
cagcctcttaaagctgcctgt

SEQ ID NO: 2619086 - DNA, 18 bp, Homo sapiens
cagcctcttggccccaga

SEQ ID NO: 2619087 - DNA, 18 bp, Homo sapiens
cagcctgagcgacagtga

SEQ ID NO: 2619088 - DNA, 19 bp, Homo sapiens
cagcctgagcgacagtgag

SEQ ID NO: 2619089 - DNA, 15 bp, Homo sapiens
cagcctgaggctgag

SEQ ID NO: 2619090 - DNA, 15 bp, Homo sapiens
cagcctgagtctcct

SEQ ID NO: 2619091 - DNA, 16 bp, Homo sapiens
cagcctgagtctcctg

SEQ ID NO: 2619092 - DNA, 17 bp, Homo sapiens
cagcctgagtctcctgt

SEQ ID NO: 2619093 - DNA, 19 bp, Homo sapiens
cagcctgagtctcctgtgc

SEQ ID NO: 2619094 - DNA, 20 bp, Homo sapiens
cagcctgagtctcctgtgcc

SEQ ID NO: 2619095 - DNA, 17 bp, Homo sapiens
cagcctgccctcttcat

SEQ ID NO: 2619096 - DNA, 12 bp, Homo sapiens
cagcctgctcca

SEQ ID NO: 2619097 - DNA, 19 bp, Homo sapiens
cagcctggaccctgtggat

SEQ ID NO: 2619098 - DNA, 17 bp, Homo sapiens
cagcctggatctcctca

SEQ ID NO: 2619099 - DNA, 17 bp, Homo sapiens
cagcctggcttctggag

SEQ ID NO: 2619100 - DNA, 20 bp, Homo sapiens
cagcctgggcaacagagcaa

SEQ ID NO: 2619101 - DNA, 20 bp, Homo sapiens
cagcctgggcagcatagcaa

SEQ ID NO: 2619102 - DNA, 21 bp, Homo sapiens
cagcctgggcagccaggctgc

SEQ ID NO: 2619103 - DNA, 15 bp, Homo sapiens
cagcctgggcgacag

SEQ ID NO: 2619104 - DNA, 15 bp, Homo sapiens
cagcctggtgggcct

SEQ ID NO: 2619105 - DNA, 16 bp, Homo sapiens
cagcctggtgggcctc

SEQ ID NO: 2619106 - DNA, 22 bp, Homo sapiens
cagcctgtcccatggacactcc

SEQ ID NO: 2619107 - DNA, 17 bp, Homo sapiens
cagcctgtctcttccat

SEQ ID NO: 2619108 - DNA, 12 bp, Homo sapiens
cagcctgtggca

SEQ ID NO: 2619109 - DNA, 15 bp, Homo sapiens
cagcctgtggcatct

SEQ ID NO: 2619110 - DNA, 19 bp, Homo sapiens
cagcctgtggcatctttgc

SEQ ID NO: 2619111 - DNA, 14 bp, Homo sapiens
cagccttccccctc

SEQ ID NO: 2619112 - DNA, 20 bp, Homo sapiens
cagccttccccctcccaggg

SEQ ID NO: 2619113 - DNA, 20 bp, Homo sapiens
cagccttcctctgcagctga

SEQ ID NO: 2619114 - DNA, 21 bp, Homo sapiens
cagccttctttgcttgcctct

SEQ ID NO: 2619115 - DNA, 20 bp, Homo sapiens
cagccttgaccattctccac

SEQ ID NO: 2619116 - DNA, 21 bp, Homo sapiens
cagccttgaccattctccacc

SEQ ID NO: 2619117 - DNA, 23 bp, Homo sapiens
cagccttgaccattctccacctg

SEQ ID NO: 2619118 - DNA, 24 bp, Homo sapiens
cagccttgaccattctccacctgc

SEQ ID NO: 2619119 - DNA, 20 bp, Homo sapiens
cagcctttctcccaggccag

SEQ ID NO: 2619120 - DNA, 14 bp, Homo sapiens
cagcgaagggagtg

SEQ ID NO: 2619121 - DNA, 18 bp, Homo sapiens
cagcgagaggcagagaaa

SEQ ID NO: 2619122 - DNA, 20 bp, Homo sapiens
cagcgagaggcagagaaaga

SEQ ID NO: 2619123 - DNA, 17 bp, Homo sapiens
cagcgagccctggtggc

SEQ ID NO: 2619124 - DNA, 19 bp, Homo sapiens
cagcgagccctggtggcag

SEQ ID NO: 2619125 - DNA, 21 bp, Homo sapiens
cagcgagccctggtggcagtg

SEQ ID NO: 2619126 - DNA, 18 bp, Homo sapiens
cagcgaggaggctccaga

SEQ ID NO: 2619127 - DNA, 22 bp, Homo sapiens
cagcgagttgtggaaagcctct

SEQ ID NO: 2619128 - DNA, 17 bp, Homo sapiens
cagcgccaagcaacctg

SEQ ID NO: 2619129 - DNA, 23 bp, Homo sapiens
cagcgccaagcaacctgggtcca

SEQ ID NO: 2619130 - DNA, 14 bp, Homo sapiens
cagcgccagcctgt

SEQ ID NO: 2619131 - DNA, 20 bp, Homo sapiens
cagcgctggccgggaccccg

SEQ ID NO: 2619132 - DNA, 17 bp, Homo sapiens
cagcggcccctcccaca

SEQ ID NO: 2619133 - DNA, 19 bp, Homo sapiens
cagcggcccctcccacaca

SEQ ID NO: 2619134 - DNA, 14 bp, Homo sapiens
cagcggcccctgca

SEQ ID NO: 2619135 - DNA, 16 bp, Homo sapiens
cagcggcccctgcatc

SEQ ID NO: 2619136 - DNA, 17 bp, Homo sapiens
cagcggccccttgactc

SEQ ID NO: 2619137 - DNA, 16 bp, Homo sapiens
cagcgggaatggcagc

SEQ ID NO: 2619138 - DNA, 23 bp, Homo sapiens
cagcgggaatggcagctgccacg

SEQ ID NO: 2619139 - DNA, 14 bp, Homo sapiens
cagcggggacagct

SEQ ID NO: 2619140 - DNA, 15 bp, Homo sapiens
cagcggggacagctc

SEQ ID NO: 2619141 - DNA, 16 bp, Homo sapiens
cagcggggacagctcc

SEQ ID NO: 2619142 - DNA, 18 bp, Homo sapiens
cagcggggccccagggct

SEQ ID NO: 2619143 - DNA, 15 bp, Homo sapiens
cagcgtactcatcat

SEQ ID NO: 2619144 - DNA, 15 bp, Homo sapiens
cagcgtcctcctctg

SEQ ID NO: 2619145 - DNA, 16 bp, Homo sapiens
cagcgtcctcctctgt

SEQ ID NO: 2619146 - DNA, 18 bp, Homo sapiens
cagcgtcctcctctgtga

SEQ ID NO: 2619147 - DNA, 13 bp, Homo sapiens
cagcgttgcatgt

SEQ ID NO: 2619148 - DNA, 14 bp, Homo sapiens
cagcgtttctatga

SEQ ID NO: 2619149 - DNA, 19 bp, Homo sapiens
cagctaaagcaatatgcat

SEQ ID NO: 2619150 - DNA, 18 bp, Homo sapiens
cagctaaagcccaacctc

SEQ ID NO: 2619151 - DNA, 17 bp, Homo sapiens
cagctaacacacagctc

SEQ ID NO: 2619152 - DNA, 12 bp, Homo sapiens
cagctaatctgt

SEQ ID NO: 2619153 - DNA, 14 bp, Homo sapiens
cagctaatctgtag

SEQ ID NO: 2619154 - DNA, 16 bp, Homo sapiens
cagctaatctgtaggg

SEQ ID NO: 2619155 - DNA, 21 bp, Homo sapiens
cagctaatctgtagggctgga

SEQ ID NO: 2619156 - DNA, 16 bp, Homo sapiens
cagctaatgggacact

SEQ ID NO: 2619157 - DNA, 24 bp, Homo sapiens
cagctaccctttttctccagctgg

SEQ ID NO: 2619158 - DNA, 16 bp, Homo sapiens
cagctactcagaagcc

SEQ ID NO: 2619159 - DNA, 19 bp, Homo sapiens
cagctactcagaagcctga

SEQ ID NO: 2619160 - DNA, 20 bp, Homo sapiens
cagctactcagaagcctgag

SEQ ID NO: 2619161 - DNA, 21 bp, Homo sapiens
cagctactcagaagcctgagg

SEQ ID NO: 2619162 - DNA, 23 bp, Homo sapiens
cagctactcagaagcctgaggct

SEQ ID NO: 2619163 - DNA, 17 bp, Homo sapiens
cagctacttcctcctcc

SEQ ID NO: 2619164 - DNA, 16 bp, Homo sapiens
cagctacttgggaagc

SEQ ID NO: 2619165 - DNA, 17 bp, Homo sapiens
cagctatctctcagtga

SEQ ID NO: 2619166 - DNA, 18 bp, Homo sapiens
cagctatctctcagtgaa

SEQ ID NO: 2619167 - DNA, 17 bp, Homo sapiens
cagctatgggagcccca

SEQ ID NO: 2619168 - DNA, 19 bp, Homo sapiens
cagctcaaaggcacagtga

SEQ ID NO: 2619169 - DNA, 18 bp, Homo sapiens
caggtcttgaactcctgg

SEQ ID NO: 2619170 - DNA, 19 bp, Homo sapiens
caggtcttgaactcctggc

SEQ ID NO: 2619171 - DNA, 21 bp, Homo sapiens
caggtcttgaactcctggcct

SEQ ID NO: 2619172 - DNA, 22 bp, Homo sapiens
caggtcttgaactcctggcctc

SEQ ID NO: 2619173 - DNA, 21 bp, Homo sapiens
caggtcttggagctgagcctc

SEQ ID NO: 2619174 - DNA, 17 bp, Homo sapiens
caggtgacatgtgaaac

SEQ ID NO: 2619175 - DNA, 21 bp, Homo sapiens
caggtgacatgtgaaaccttt

SEQ ID NO: 2619176 - DNA, 23 bp, Homo sapiens
caggtgaccaaaatccccttctc

SEQ ID NO: 2619177 - DNA, 17 bp, Homo sapiens
caggtgaccttctggga

SEQ ID NO: 2619178 - DNA, 13 bp, Homo sapiens
caggtgagaagca

SEQ ID NO: 2619179 - DNA, 22 bp, Homo sapiens
caggtgatccacccacctcagc

SEQ ID NO: 2619180 - DNA, 20 bp, Homo sapiens
caggtgcacaagctccaagc

SEQ ID NO: 2619181 - DNA, 22 bp, Homo sapiens
caggtgcacaagctccaagctc

SEQ ID NO: 2619182 - DNA, 12 bp, Homo sapiens
caggtgcagtgg

SEQ ID NO: 2619183 - DNA, 20 bp, Homo sapiens
caggtgcccatccctggaag

SEQ ID NO: 2619184 - DNA, 15 bp, Homo sapiens
caggtgcctccaggt

SEQ ID NO: 2619185 - DNA, 12 bp, Homo sapiens
caggtgcctgga

SEQ ID NO: 2619186 - DNA, 21 bp, Homo sapiens
caggtgctacacccttttcca

SEQ ID NO: 2619187 - DNA, 19 bp, Homo sapiens
caggtgctcaataaatgat

SEQ ID NO: 2619188 - DNA, 14 bp, Homo sapiens
caggtgctgccatc

SEQ ID NO: 2619189 - DNA, 21 bp, Homo sapiens
caggtggaggtgtcaggctgc

SEQ ID NO: 2619190 - DNA, 21 bp, Homo sapiens
caggtggcaggaccaggacta

SEQ ID NO: 2619191 - DNA, 16 bp, Homo sapiens
caggtgggcttcccag

SEQ ID NO: 2619192 - DNA, 19 bp, Homo sapiens
caggtggggagactgggct

SEQ ID NO: 2619193 - DNA, 13 bp, Homo sapiens
caggtggggcagc

SEQ ID NO: 2619194 - DNA, 17 bp, Homo sapiens
caggtggggcagcttga

SEQ ID NO: 2619195 - DNA, 19 bp, Homo sapiens
caggtggggtcactctggc

SEQ ID NO: 2619196 - DNA, 20 bp, Homo sapiens
caggtggggtcactctggca

SEQ ID NO: 2619197 - DNA, 22 bp, Homo sapiens
caggtggggtcactctggcagc

SEQ ID NO: 2619198 - DNA, 16 bp, Homo sapiens
caggtggtcctgagac

SEQ ID NO: 2619199 - DNA, 19 bp, Homo sapiens
caggtggtggcactgagcc

SEQ ID NO: 2619200 - DNA, 20 bp, Homo sapiens
caggtggttatggagagggt

SEQ ID NO: 2619201 - DNA, 15 bp, Homo sapiens
caggtgtccctgcac

SEQ ID NO: 2619202 - DNA, 22 bp, Homo sapiens
caggtgtgaaccaccacaccca

SEQ ID NO: 2619203 - DNA, 16 bp, Homo sapiens
caggtgtgagtcacca

SEQ ID NO: 2619204 - DNA, 20 bp, Homo sapiens
caggtgtgagtcaccaagcc

SEQ ID NO: 2619205 - DNA, 13 bp, Homo sapiens
caggtgtgcacgt

SEQ ID NO: 2619206 - DNA, 12 bp, Homo sapiens
caggttacaaca

SEQ ID NO: 2619207 - DNA, 16 bp, Homo sapiens
caggttacaacagatt

SEQ ID NO: 2619208 - DNA, 23 bp, Homo sapiens
caggttagaacctagaagggcta

SEQ ID NO: 2619209 - DNA, 23 bp, Homo sapiens
caggttatcgaaataacaatgtt

SEQ ID NO: 2619210 - DNA, 13 bp, Homo sapiens
caggttcagcttg

SEQ ID NO: 2619211 - DNA, 15 bp, Homo sapiens
caggttctatttgga

SEQ ID NO: 2619212 - DNA, 20 bp, Homo sapiens
caggttcttcttcctgaagc

SEQ ID NO: 2619213 - DNA, 20 bp, Homo sapiens
caggttgaggggctcctgga

SEQ ID NO: 2619214 - DNA, 21 bp, Homo sapiens
caggttgaggggctcctggaa

SEQ ID NO: 2619215 - DNA, 19 bp, Homo sapiens
caggttgctggttgctgtg

SEQ ID NO: 2619216 - DNA, 21 bp, Homo sapiens
caggttgctggttgctgtgtg

SEQ ID NO: 2619217 - DNA, 15 bp, Homo sapiens
caggttgctttgccc

SEQ ID NO: 2619218 - DNA, 22 bp, Homo sapiens
caggttgggaatgaggcttgct

SEQ ID NO: 2619219 - DNA, 21 bp, Homo sapiens
caggttggtgggggcctcggt

SEQ ID NO: 2619220 - DNA, 14 bp, Homo sapiens
caggtttaagctgt

SEQ ID NO: 2619221 - DNA, 16 bp, Homo sapiens
caggtttaagctgtta

SEQ ID NO: 2619222 - DNA, 14 bp, Homo sapiens
caggtttgttacat

SEQ ID NO: 2619223 - DNA, 12 bp, Homo sapiens
caggtttttcaa

SEQ ID NO: 2619224 - DNA, 14 bp, Homo sapiens
caggtttttcaatt

SEQ ID NO: 2619225 - DNA, 16 bp, Homo sapiens
caggtttttcaattaa

SEQ ID NO: 2619226 - DNA, 18 bp, Homo sapiens
caggtttttcaattaaac

SEQ ID NO: 2619227 - DNA, 18 bp, Homo sapiens
cagtaaatgggggtgcat

SEQ ID NO: 2619228 - DNA, 18 bp, Homo sapiens
cagtaacgcaggggaaac

SEQ ID NO: 2619229 - DNA, 19 bp, Homo sapiens
cagtaactttatgtgtaaa

SEQ ID NO: 2619230 - DNA, 20 bp, Homo sapiens
cagtaactttatgtgtaaat

SEQ ID NO: 2619231 - DNA, 18 bp, Homo sapiens
cagtaagggaaatagaaa

SEQ ID NO: 2619232 - DNA, 21 bp, Homo sapiens
cagtaattggtccgatctttg

SEQ ID NO: 2619233 - DNA, 16 bp, Homo sapiens
cagtacaggcagcaca

SEQ ID NO: 2619234 - DNA, 19 bp, Homo sapiens
cagtacaggcagcacagag

SEQ ID NO: 2619235 - DNA, 20 bp, Homo sapiens
cagtacaggcagcacagaga

SEQ ID NO: 2619236 - DNA, 20 bp, Homo sapiens
cagtaccctctcagctccag

SEQ ID NO: 2619237 - DNA, 24 bp, Homo sapiens
cagtaccctctcagctccaggtgg

SEQ ID NO: 2619238 - DNA, 12 bp, Homo sapiens
cagtacctcctg

SEQ ID NO: 2619239 - DNA, 13 bp, Homo sapiens
cagtacctggagg

SEQ ID NO: 2619240 - DNA, 14 bp, Homo sapiens
cagtacctggagga

SEQ ID NO: 2619241 - DNA, 14 bp, Homo sapiens
cagtagattttctt

SEQ ID NO: 2619242 - DNA, 23 bp, Homo sapiens
cagtagattttctttaaaagaat

SEQ ID NO: 2619243 - DNA, 15 bp, Homo sapiens
cagtaggagcccagc

SEQ ID NO: 2619244 - DNA, 22 bp, Homo sapiens
cagtaggagcccagctctgaaa

SEQ ID NO: 2619245 - DNA, 16 bp, Homo sapiens
cagtagtctctgtgct

SEQ ID NO: 2619246 - DNA, 12 bp, Homo sapiens
cagtagtgatag

SEQ ID NO: 2619247 - DNA, 23 bp, Homo sapiens
cagtataattgagttttcagtgg

SEQ ID NO: 2619248 - DNA, 14 bp, Homo sapiens
cagtatacagtcct

SEQ ID NO: 2619249 - DNA, 16 bp, Homo sapiens
cagtatctatatatgt

SEQ ID NO: 2619250 - DNA, 19 bp, Homo sapiens
cagtatctatatatgtgta

SEQ ID NO: 2619251 - DNA, 21 bp, Homo sapiens
cagtatctatatatgtgtatg

SEQ ID NO: 2619252 - DNA, 13 bp, Homo sapiens
cagtatgaaaata

SEQ ID NO: 2619253 - DNA, 14 bp, Homo sapiens
cagtatgaaaataa

SEQ ID NO: 2619254 - DNA, 21 bp, Homo sapiens
cagtatgagtcaatgtgcagt

SEQ ID NO: 2619255 - DNA, 12 bp, Homo sapiens
cagtatggcagc

SEQ ID NO: 2619256 - DNA, 19 bp, Homo sapiens
cagtattcttgtcaaaaaa

SEQ ID NO: 2619257 - DNA, 15 bp, Homo sapiens
cagtatttgtgggga

SEQ ID NO: 2619258 - DNA, 18 bp, Homo sapiens
cagtattttggagaaatt

SEQ ID NO: 2619259 - DNA, 19 bp, Homo sapiens
cagtattttggagaaatta

SEQ ID NO: 2619260 - DNA, 20 bp, Homo sapiens
cagtattttggagaaattat

SEQ ID NO: 2619261 - DNA, 21 bp, Homo sapiens
cagtattttggagaaattatt

SEQ ID NO: 2619262 - DNA, 19 bp, Homo sapiens
cagtcaaaacagagatgtg

SEQ ID NO: 2619263 - DNA, 12 bp, Homo sapiens
cagtcaccccag

SEQ ID NO: 2619264 - DNA, 16 bp, Homo sapiens
cagtcaccccggccac

SEQ ID NO: 2619265 - DNA, 12 bp, Homo sapiens
cagtcagcctct

SEQ ID NO: 2619266 - DNA, 14 bp, Homo sapiens
cagtcagcctctct

SEQ ID NO: 2619267 - DNA, 21 bp, Homo sapiens
cagtcagcctctctcccagtc

SEQ ID NO: 2619268 - DNA, 18 bp, Homo sapiens
cagtcagtgcaaatgtca

SEQ ID NO: 2619269 - DNA, 18 bp, Homo sapiens
cagtcatcttgaccaagc

SEQ ID NO: 2619270 - DNA, 21 bp, Homo sapiens
cagtcatcttgaccaagcagg

SEQ ID NO: 2619271 - DNA, 14 bp, Homo sapiens
cagtcatgcataaa

SEQ ID NO: 2619272 - DNA, 20 bp, Homo sapiens
cagtcatgcataaatatgca

SEQ ID NO: 2619273 - DNA, 24 bp, Homo sapiens
cagtcatggcaccaaagccaccag

SEQ ID NO: 2619274 - DNA, 21 bp, Homo sapiens
cagtcatttttgtttctacct

SEQ ID NO: 2619275 - DNA, 17 bp, Homo sapiens
cagtccaaatgtcctcc

SEQ ID NO: 2619276 - DNA, 22 bp, Homo sapiens
cagtccaaatgtcctccagaag

SEQ ID NO: 2619277 - DNA, 23 bp, Homo sapiens
cagtccaaatgtcctccagaagc

SEQ ID NO: 2619278 - DNA, 19 bp, Homo sapiens
cagtccaaggaaaccacag

SEQ ID NO: 2619279 - DNA, 17 bp, Homo sapiens
cagtccagcctggagat

SEQ ID NO: 2619280 - DNA, 16 bp, Homo sapiens
cagtccatagcagaga

SEQ ID NO: 2619281 - DNA, 13 bp, Homo sapiens
cagtcccaggggc

SEQ ID NO: 2619282 - DNA, 14 bp, Homo sapiens
cagtcccctcccat

SEQ ID NO: 2619283 - DNA, 16 bp, Homo sapiens
cagtcccctcccatct

SEQ ID NO: 2619284 - DNA, 15 bp, Homo sapiens
cagtccctatgtatt

SEQ ID NO: 2619285 - DNA, 12 bp, Homo sapiens
cagtccctgcca

SEQ ID NO: 2619286 - DNA, 17 bp, Homo sapiens
cagtccctgccaatgga

SEQ ID NO: 2619287 - DNA, 17 bp, Homo sapiens
cagtcctagctgcacag

SEQ ID NO: 2619288 - DNA, 17 bp, Homo sapiens
cagtcctcccatctcac

SEQ ID NO: 2619289 - DNA, 14 bp, Homo sapiens
cagtcctgcctggc

SEQ ID NO: 2619290 - DNA, 13 bp, Homo sapiens
cagtcctgggaga

SEQ ID NO: 2619291 - DNA, 23 bp, Homo sapiens
cagtcctgggagaacctcaggct

SEQ ID NO: 2619292 - DNA, 15 bp, Homo sapiens
cagtccttaccagca

SEQ ID NO: 2619293 - DNA, 12 bp, Homo sapiens
cagtccttccac

SEQ ID NO: 2619294 - DNA, 15 bp, Homo sapiens
cagtcgatagagctg

SEQ ID NO: 2619295 - DNA, 16 bp, Homo sapiens
cagtcgatagagctgt

SEQ ID NO: 2619296 - DNA, 18 bp, Homo sapiens
cagtcgtcgcacagtctc

SEQ ID NO: 2619297 - DNA, 15 bp, Homo sapiens
cagtctacccagaga

SEQ ID NO: 2619298 - DNA, 19 bp, Homo sapiens
cagtctacccagagaagcc

SEQ ID NO: 2619299 - DNA, 16 bp, Homo sapiens
cagtctatccacagag

SEQ ID NO: 2619300 - DNA, 19 bp, Homo sapiens
cagtctcactgtgggaagg

SEQ ID NO: 2619301 - DNA, 14 bp, Homo sapiens
cagtctcaggagca

SEQ ID NO: 2619302 - DNA, 18 bp, Homo sapiens
cagtctcaggagcatggg

SEQ ID NO: 2619303 - DNA, 18 bp, Homo sapiens
cagtctcccttctcccat

SEQ ID NO: 2619304 - DNA, 22 bp, Homo sapiens
cagtctccctttcccttcttgg

SEQ ID NO: 2619305 - DNA, 12 bp, Homo sapiens
cagtctctgagc

SEQ ID NO: 2619306 - DNA, 15 bp, Homo sapiens
cagtctctgagggct

SEQ ID NO: 2619307 - DNA, 19 bp, Homo sapiens
cagtctctttaatcttcag

SEQ ID NO: 2619308 - DNA, 20 bp, Homo sapiens
cagtctgattcccaagctct

SEQ ID NO: 2619309 - DNA, 14 bp, Homo sapiens
cagtctgctgccct

SEQ ID NO: 2619310 - DNA, 20 bp, Homo sapiens
cagtctggctgagccctgct

SEQ ID NO: 2619311 - DNA, 24 bp, Homo sapiens
cagtctgtcatgaacatgttcctg

SEQ ID NO: 2619312 - DNA, 16 bp, Homo sapiens
cagtcttcctgacact

SEQ ID NO: 2619313 - DNA, 14 bp, Homo sapiens
cattacagcttaat

SEQ ID NO: 2619314 - DNA, 16 bp, Homo sapiens
cattacagcttaatca

SEQ ID NO: 2619315 - DNA, 21 bp, Homo sapiens
cattacagtgggtgcccccct

SEQ ID NO: 2619316 - DNA, 14 bp, Homo sapiens
cattaccactcagg

SEQ ID NO: 2619317 - DNA, 20 bp, Homo sapiens
cattaccagacggttcacca

SEQ ID NO: 2619318 - DNA, 23 bp, Homo sapiens
cattaccagacggttcaccagcc

SEQ ID NO: 2619319 - DNA, 17 bp, Homo sapiens
cattacgtgagccaggt

SEQ ID NO: 2619320 - DNA, 21 bp, Homo sapiens
cattactttaccacccccaca

SEQ ID NO: 2619321 - DNA, 11 bp, Homo sapiens
cattagagcag

SEQ ID NO: 2619322 - DNA, 12 bp, Homo sapiens
cattagagcagg

SEQ ID NO: 2619323 - DNA, 21 bp, Homo sapiens
cattaggaattaagttatctt

SEQ ID NO: 2619324 - DNA, 22 bp, Homo sapiens
cattaggtgtgactgaatttct

SEQ ID NO: 2619325 - DNA, 19 bp, Homo sapiens
cattatcactttaaagccc

SEQ ID NO: 2619326 - DNA, 12 bp, Homo sapiens
cattatcatgtg

SEQ ID NO: 2619327 - DNA, 13 bp, Homo sapiens
cattatcatgtgt

SEQ ID NO: 2619328 - DNA, 13 bp, Homo sapiens
cattatccctgaa

SEQ ID NO: 2619329 - DNA, 20 bp, Homo sapiens
cattatcgggagcagtgtct

SEQ ID NO: 2619330 - DNA, 21 bp, Homo sapiens
cattatcgggagcagtgtctt

SEQ ID NO: 2619331 - DNA, 17 bp, Homo sapiens
cattatctagatactgt

SEQ ID NO: 2619332 - DNA, 13 bp, Homo sapiens
cattatctcaaaa

SEQ ID NO: 2619333 - DNA, 17 bp, Homo sapiens
cattatgtaaaatgttt

SEQ ID NO: 2619334 - DNA, 19 bp, Homo sapiens
cattatgtccactgtgtat

SEQ ID NO: 2619335 - DNA, 21 bp, Homo sapiens
cattatgtccactgtgtatag

SEQ ID NO: 2619336 - DNA, 22 bp, Homo sapiens
cattatgtccactgtgtataga

SEQ ID NO: 2619337 - DNA, 19 bp, Homo sapiens
cattattagtactgctctt

SEQ ID NO: 2619338 - DNA, 17 bp, Homo sapiens
cattattggaattaacc

SEQ ID NO: 2619339 - DNA, 22 bp, Homo sapiens
cattatttattcagcttcattt

SEQ ID NO: 2619340 - DNA, 13 bp, Homo sapiens
cattatttgcatg

SEQ ID NO: 2619341 - DNA, 19 bp, Homo sapiens
cattatttgcatgttacct

SEQ ID NO: 2619342 - DNA, 18 bp, Homo sapiens
cattcaaaagttgaaatt

SEQ ID NO: 2619343 - DNA, 23 bp, Homo sapiens
cattcaaattaagggttaagaaa

SEQ ID NO: 2619344 - DNA, 17 bp, Homo sapiens
cattcaagtgtaaaata

SEQ ID NO: 2619345 - DNA, 20 bp, Homo sapiens
cattcaagtgtaaaatattt

SEQ ID NO: 2619346 - DNA, 13 bp, Homo sapiens
cattcacccagac

SEQ ID NO: 2619347 - DNA, 14 bp, Homo sapiens
cattcacccagaca

SEQ ID NO: 2619348 - DNA, 11 bp, Homo sapiens
cattcacttca

SEQ ID NO: 2619349 - DNA, 15 bp, Homo sapiens
cattcacttgcattt

SEQ ID NO: 2619350 - DNA, 17 bp, Homo sapiens
cattcaggaagatgaaa

SEQ ID NO: 2619351 - DNA, 16 bp, Homo sapiens
cattcatgcctggctt

SEQ ID NO: 2619352 - DNA, 23 bp, Homo sapiens
cattccaacagctcaagtcttcc

SEQ ID NO: 2619353 - DNA, 14 bp, Homo sapiens
cattccaagacagt

SEQ ID NO: 2619354 - DNA, 15 bp, Homo sapiens
cattccaagacagta

SEQ ID NO: 2619355 - DNA, 23 bp, Homo sapiens
cattccaagacagtatacagtcc

SEQ ID NO: 2619356 - DNA, 14 bp, Homo sapiens
cattccaagcctga

SEQ ID NO: 2619357 - DNA, 13 bp, Homo sapiens
cattccagaggaa

SEQ ID NO: 2619358 - DNA, 15 bp, Homo sapiens
cattccattctggaa

SEQ ID NO: 2619359 - DNA, 15 bp, Homo sapiens
cattccccaggaggc

SEQ ID NO: 2619360 - DNA, 13 bp, Homo sapiens
cattcctatttct

SEQ ID NO: 2619361 - DNA, 16 bp, Homo sapiens
cattcctgatgcttct

SEQ ID NO: 2619362 - DNA, 22 bp, Homo sapiens
cattcctgatgcttcttcagag

SEQ ID NO: 2619363 - DNA, 14 bp, Homo sapiens
cattcctgcctgtc

SEQ ID NO: 2619364 - DNA, 16 bp, Homo sapiens
cattcctgcctgtctc

SEQ ID NO: 2619365 - DNA, 17 bp, Homo sapiens
cattcctggtacccagc

SEQ ID NO: 2619366 - DNA, 23 bp, Homo sapiens
cattcctggtacccagccatctg

SEQ ID NO: 2619367 - DNA, 14 bp, Homo sapiens
cattctcaagccct

SEQ ID NO: 2619368 - DNA, 19 bp, Homo sapiens
cattctcatggagaagtta

SEQ ID NO: 2619369 - DNA, 16 bp, Homo sapiens
cattctccacctgcca

SEQ ID NO: 2619370 - DNA, 21 bp, Homo sapiens
cattctccacctgccagggac

SEQ ID NO: 2619371 - DNA, 15 bp, Homo sapiens
cattctcctgcctgt

SEQ ID NO: 2619372 - DNA, 23 bp, Homo sapiens
cattctcctgcctgtagcagtga

SEQ ID NO: 2619373 - DNA, 13 bp, Homo sapiens
cattctctgaaga

SEQ ID NO: 2619374 - DNA, 23 bp, Homo sapiens
cattctctgtctcatccatcatc

SEQ ID NO: 2619375 - DNA, 15 bp, Homo sapiens
cattctgactcatat

SEQ ID NO: 2619376 - DNA, 15 bp, Homo sapiens
cattctgcctgccca

SEQ ID NO: 2619377 - DNA, 12 bp, Homo sapiens
cattctggaagt

SEQ ID NO: 2619378 - DNA, 21 bp, Homo sapiens
cattctgtcgccttagcatgt

SEQ ID NO: 2619379 - DNA, 22 bp, Homo sapiens
cattctgtcgccttagcatgtt

SEQ ID NO: 2619380 - DNA, 17 bp, Homo sapiens
cattctgttaatcatta

SEQ ID NO: 2619381 - DNA, 16 bp, Homo sapiens
cattcttataaatatg

SEQ ID NO: 2619382 - DNA, 21 bp, Homo sapiens
cattcttcctagttttctcct

SEQ ID NO: 2619383 - DNA, 18 bp, Homo sapiens
cattcttctctagctggt

SEQ ID NO: 2619384 - DNA, 19 bp, Homo sapiens
cattgaaagagaaccagtt

SEQ ID NO: 2619385 - DNA, 18 bp, Homo sapiens
cattgaagtaatgaattt

SEQ ID NO: 2619386 - DNA, 19 bp, Homo sapiens
cattgaagtaatgaatttt

SEQ ID NO: 2619387 - DNA, 13 bp, Homo sapiens
cattgacctgagg

SEQ ID NO: 2619388 - DNA, 19 bp, Homo sapiens
cattgactatcaaactgaa

SEQ ID NO: 2619389 - DNA, 16 bp, Homo sapiens
cattgatggggaagga

SEQ ID NO: 2619390 - DNA, 17 bp, Homo sapiens
cattgcacagggagacg

SEQ ID NO: 2619391 - DNA, 16 bp, Homo sapiens
cattgcactccagcct

SEQ ID NO: 2619392 - DNA, 15 bp, Homo sapiens
cattgccaagggctt

SEQ ID NO: 2619393 - DNA, 13 bp, Homo sapiens
cattgccaccagg

SEQ ID NO: 2619394 - DNA, 16 bp, Homo sapiens
cattgccaccaggaga

SEQ ID NO: 2619395 - DNA, 17 bp, Homo sapiens
cattgccttaactggag

SEQ ID NO: 2619396 - DNA, 13 bp, Homo sapiens
cattgccttttct

SEQ ID NO: 2619397 - DNA, 15 bp, Homo sapiens
cattgctaagatgct

SEQ ID NO: 2619398 - DNA, 15 bp, Homo sapiens
cattggaagacccca

SEQ ID NO: 2619399 - DNA, 15 bp, Homo sapiens
cattggctgagagac

SEQ ID NO: 2619400 - DNA, 15 bp, Homo sapiens
cattgtaatgttact

SEQ ID NO: 2619401 - DNA, 16 bp, Homo sapiens
cattgtaatgttactg

SEQ ID NO: 2619402 - DNA, 18 bp, Homo sapiens
cattgtaatgttactgat

SEQ ID NO: 2619403 - DNA, 21 bp, Homo sapiens
cattgtagagcttctggcact

SEQ ID NO: 2619404 - DNA, 15 bp, Homo sapiens
cattgtataaaaata

SEQ ID NO: 2619405 - DNA, 22 bp, Homo sapiens
cattgtatagttggaatcatat

SEQ ID NO: 2619406 - DNA, 20 bp, Homo sapiens
cattgtatatatgtgtgttt

SEQ ID NO: 2619407 - DNA, 15 bp, Homo sapiens
cattgtatgatgtgt

SEQ ID NO: 2619408 - DNA, 17 bp, Homo sapiens
cattgtatgatgtgttg

SEQ ID NO: 2619409 - DNA, 18 bp, Homo sapiens
cattgtatgatgtgttgt

SEQ ID NO: 2619410 - DNA, 22 bp, Homo sapiens
cattgtatgatgtgttgtgata

SEQ ID NO: 2619411 - DNA, 21 bp, Homo sapiens
cattgtccaatcctatgtttt

SEQ ID NO: 2619412 - DNA, 13 bp, Homo sapiens
cattgtcttcgga

SEQ ID NO: 2619413 - DNA, 13 bp, Homo sapiens
cattgtggctcct

SEQ ID NO: 2619414 - DNA, 21 bp, Homo sapiens
cattgtggctgtcagcaggaa

SEQ ID NO: 2619415 - DNA, 18 bp, Homo sapiens
cattgttggccaaagcca

SEQ ID NO: 2619416 - DNA, 14 bp, Homo sapiens
cattgtttgaaaca

SEQ ID NO: 2619417 - DNA, 20 bp, Homo sapiens
cattgtttgaaacaaagaag

SEQ ID NO: 2619418 - DNA, 22 bp, Homo sapiens
cattgtttgtctgtcttcatag

SEQ ID NO: 2619419 - DNA, 13 bp, Homo sapiens
cattgttttaaaa

SEQ ID NO: 2619420 - DNA, 16 bp, Homo sapiens
cattgttttaaaaaga

SEQ ID NO: 2619421 - DNA, 13 bp, Homo sapiens
catttaaaacaga

SEQ ID NO: 2619422 - DNA, 21 bp, Homo sapiens
catttaaaagatacagttact

SEQ ID NO: 2619423 - DNA, 17 bp, Homo sapiens
catttaaatacagtctt

SEQ ID NO: 2619424 - DNA, 23 bp, Homo sapiens
catttaagagacagtcaccccag

SEQ ID NO: 2619425 - DNA, 12 bp, Homo sapiens
catttactgtgg

SEQ ID NO: 2619426 - DNA, 17 bp, Homo sapiens
catttactttgtgttca

SEQ ID NO: 2619427 - DNA, 23 bp, Homo sapiens
catttagagaactgtggccgtta

SEQ ID NO: 2619428 - DNA, 20 bp, Homo sapiens
catttagattgaaaactttt

SEQ ID NO: 2619429 - DNA, 22 bp, Homo sapiens
catttagccaccatctttgcag

SEQ ID NO: 2619430 - DNA, 23 bp, Homo sapiens
catttagtttgattattcagtgt

SEQ ID NO: 2619431 - DNA, 14 bp, Homo sapiens
catttataatgttt

SEQ ID NO: 2619432 - DNA, 13 bp, Homo sapiens
catttatatagat

SEQ ID NO: 2619433 - DNA, 18 bp, Homo sapiens
catttatcaatcagtata

SEQ ID NO: 2619434 - DNA, 20 bp, Homo sapiens
catttatcaatcagtataat

SEQ ID NO: 2619435 - DNA, 17 bp, Homo sapiens
catttatctttctacag

SEQ ID NO: 2619436 - DNA, 15 bp, Homo sapiens
catttatgatttaat

SEQ ID NO: 2619437 - DNA, 21 bp, Homo sapiens
catttatggtcaacacttaag

SEQ ID NO: 2619438 - DNA, 15 bp, Homo sapiens
catttattctgctca

SEQ ID NO: 2619439 - DNA, 13 bp, Homo sapiens
catttcaggaggg

SEQ ID NO: 2619440 - DNA, 12 bp, Homo sapiens
catttcattgta

SEQ ID NO: 2619441 - DNA, 18 bp, Homo sapiens
catttcattgtatgatgt

SEQ ID NO: 2619442 - DNA, 21 bp, Homo sapiens
catttccaaatgaatgacctt

SEQ ID NO: 2619443 - DNA, 18 bp, Homo sapiens
catttccaacaccacaga

SEQ ID NO: 2619444 - DNA, 19 bp, Homo sapiens
catttccaacaccacagac

SEQ ID NO: 2619445 - DNA, 22 bp, Homo sapiens
catttccaacaccacagacaca

SEQ ID NO: 2619446 - DNA, 18 bp, Homo sapiens
catttctatttatttact

SEQ ID NO: 2619447 - DNA, 23 bp, Homo sapiens
catttctatttatttactgagct

SEQ ID NO: 2619448 - DNA, 19 bp, Homo sapiens
catttctatttctcctcca

SEQ ID NO: 2619449 - DNA, 14 bp, Homo sapiens
catttctgaagtgg

SEQ ID NO: 2619450 - DNA, 15 bp, Homo sapiens
catttcttgggccct

SEQ ID NO: 2619451 - DNA, 18 bp, Homo sapiens
catttcttgggccctcct

SEQ ID NO: 2619452 - DNA, 17 bp, Homo sapiens
catttgaaaattttgat

SEQ ID NO: 2619453 - DNA, 19 bp, Homo sapiens
catttgaaaattttgatgt

SEQ ID NO: 2619454 - DNA, 18 bp, Homo sapiens
catttgaaagaaaggact

SEQ ID NO: 2619455 - DNA, 21 bp, Homo sapiens
catttgaataaagcctgcttt

SEQ ID NO: 2619456 - DNA, 23 bp, Homo sapiens
catttgactgaagatgcagctca

SEQ ID NO: 2619457 - DNA, 18 bp, Homo sapiens
catttgagaaatgcatat

SEQ ID NO: 2619458 - DNA, 14 bp, Homo sapiens
ccactgtgaagaga

SEQ ID NO: 2619459 - DNA, 19 bp, Homo sapiens
ccactgtgccatgtgccag

SEQ ID NO: 2619460 - DNA, 14 bp, Homo sapiens
ccactgttatcaaa

SEQ ID NO: 2619461 - DNA, 16 bp, Homo sapiens
ccacttaaaaaatgtc

SEQ ID NO: 2619462 - DNA, 19 bp, Homo sapiens
ccacttaaaaaatgtccat

SEQ ID NO: 2619463 - DNA, 18 bp, Homo sapiens
ccacttggcatcagctgg

SEQ ID NO: 2619464 - DNA, 21 bp, Homo sapiens
ccacttgtccgctgggtggta

SEQ ID NO: 2619465 - DNA, 14 bp, Homo sapiens
ccactttgttggaa

SEQ ID NO: 2619466 - DNA, 21 bp, Homo sapiens
ccacttttgttcttggtttgt

SEQ ID NO: 2619467 - DNA, 22 bp, Homo sapiens
ccacttttgttcttggtttgta

SEQ ID NO: 2619468 - DNA, 16 bp, Homo sapiens
ccagaaaaggacagaa

SEQ ID NO: 2619469 - DNA, 24 bp, Homo sapiens
ccagaaactgttcccacctgctgg

SEQ ID NO: 2619470 - DNA, 12 bp, Homo sapiens
ccagaaagaaaa

SEQ ID NO: 2619471 - DNA, 21 bp, Homo sapiens
ccagaaataaagttggtgaca

SEQ ID NO: 2619472 - DNA, 16 bp, Homo sapiens
ccagaaatcattttac

SEQ ID NO: 2619473 - DNA, 17 bp, Homo sapiens
ccagaaattagaaacct

SEQ ID NO: 2619474 - DNA, 22 bp, Homo sapiens
ccagaacaaggttccctctgag

SEQ ID NO: 2619475 - DNA, 14 bp, Homo sapiens
ccagaacctgtcct

SEQ ID NO: 2619476 - DNA, 15 bp, Homo sapiens
ccagaacctgtcctt

SEQ ID NO: 2619477 - DNA, 16 bp, Homo sapiens
ccagaagaatattcag

SEQ ID NO: 2619478 - DNA, 18 bp, Homo sapiens
ccagaagatcccctcagg

SEQ ID NO: 2619479 - DNA, 16 bp, Homo sapiens
ccagaagcctctggct

SEQ ID NO: 2619480 - DNA, 16 bp, Homo sapiens
ccagaagcttccatag

SEQ ID NO: 2619481 - DNA, 12 bp, Homo sapiens
ccagaagtgtga

SEQ ID NO: 2619482 - DNA, 23 bp, Homo sapiens
ccagaagtttgagatcagcctgg

SEQ ID NO: 2619483 - DNA, 18 bp, Homo sapiens
ccagacacagaagaggct

SEQ ID NO: 2619484 - DNA, 17 bp, Homo sapiens
ccagacacatgtccaag

SEQ ID NO: 2619485 - DNA, 17 bp, Homo sapiens
ccagacaccttgacagg

SEQ ID NO: 2619486 - DNA, 19 bp, Homo sapiens
ccagacaccttgacagggc

SEQ ID NO: 2619487 - DNA, 21 bp, Homo sapiens
ccagacaccttgacagggcac

SEQ ID NO: 2619488 - DNA, 22 bp, Homo sapiens
ccagacagacatctctgcaccc

SEQ ID NO: 2619489 - DNA, 21 bp, Homo sapiens
ccagacagcaacggggaggcc

SEQ ID NO: 2619490 - DNA, 20 bp, Homo sapiens
ccagacagctccctctgcct

SEQ ID NO: 2619491 - DNA, 22 bp, Homo sapiens
ccagacccctctggccaggatg

SEQ ID NO: 2619492 - DNA, 24 bp, Homo sapiens
ccagacccctctggccaggatgga

SEQ ID NO: 2619493 - DNA, 13 bp, Homo sapiens
ccagacgatgtct

SEQ ID NO: 2619494 - DNA, 13 bp, Homo sapiens
ccagactgtggag

SEQ ID NO: 2619495 - DNA, 17 bp, Homo sapiens
ccagactgtgtattcat

SEQ ID NO: 2619496 - DNA, 23 bp, Homo sapiens
ccagagaagcatcggagggaatt

SEQ ID NO: 2619497 - DNA, 16 bp, Homo sapiens
ccagagaattcttaga

SEQ ID NO: 2619498 - DNA, 15 bp, Homo sapiens
ccagagactcagagg

SEQ ID NO: 2619499 - DNA, 18 bp, Homo sapiens
ccagagagagaagtgccc

SEQ ID NO: 2619500 - DNA, 20 bp, Homo sapiens
ccagagagagaagtgcccct

SEQ ID NO: 2619501 - DNA, 23 bp, Homo sapiens
ccagagagagaagtgcccctgct

SEQ ID NO: 2619502 - DNA, 18 bp, Homo sapiens
ccagagagcaactctgag

SEQ ID NO: 2619503 - DNA, 20 bp, Homo sapiens
ccagagagcaactctgagat

SEQ ID NO: 2619504 - DNA, 21 bp, Homo sapiens
ccagagagggtggtgacctct

SEQ ID NO: 2619505 - DNA, 17 bp, Homo sapiens
ccagagagtcctctgga

SEQ ID NO: 2619506 - DNA, 18 bp, Homo sapiens
ccagagagtcctctggat

SEQ ID NO: 2619507 - DNA, 22 bp, Homo sapiens
ccagagcactgggttgcagggg

SEQ ID NO: 2619508 - DNA, 17 bp, Homo sapiens
ccagagcagatgcagag

SEQ ID NO: 2619509 - DNA, 20 bp, Homo sapiens
ccagagcagatgcagagagc

SEQ ID NO: 2619510 - DNA, 19 bp, Homo sapiens
ccagagcaggaggcccctg

SEQ ID NO: 2619511 - DNA, 21 bp, Homo sapiens
ccagagcaggaggcccctggc

SEQ ID NO: 2619512 - DNA, 22 bp, Homo sapiens
ccagagcattacgtgagccagg

SEQ ID NO: 2619513 - DNA, 22 bp, Homo sapiens
ccagagcatttccaacaccaca

SEQ ID NO: 2619514 - DNA, 23 bp, Homo sapiens
ccagagcatttccaacaccacag

SEQ ID NO: 2619515 - DNA, 14 bp, Homo sapiens
ccagagctgggagg

SEQ ID NO: 2619516 - DNA, 21 bp, Homo sapiens
ccagagctgggaggcatggcc

SEQ ID NO: 2619517 - DNA, 20 bp, Homo sapiens
ccagagctgtttatggcctc

SEQ ID NO: 2619518 - DNA, 21 bp, Homo sapiens
ccagagctgtttatggcctca

SEQ ID NO: 2619519 - DNA, 23 bp, Homo sapiens
ccagagctgtttatggcctcagc

SEQ ID NO: 2619520 - DNA, 24 bp, Homo sapiens
ccagagctgtttatggcctcagct

SEQ ID NO: 2619521 - DNA, 14 bp, Homo sapiens
ccagaggaactgtc

SEQ ID NO: 2619522 - DNA, 17 bp, Homo sapiens
ccagaggaaggggccag

SEQ ID NO: 2619523 - DNA, 22 bp, Homo sapiens
ccagaggaaggggccagaggct

SEQ ID NO: 2619524 - DNA, 21 bp, Homo sapiens
ccagaggattgctgccccatc

SEQ ID NO: 2619525 - DNA, 19 bp, Homo sapiens
ccagaggctattattttca

SEQ ID NO: 2619526 - DNA, 16 bp, Homo sapiens
ccagagggagtgacag

SEQ ID NO: 2619527 - DNA, 17 bp, Homo sapiens
ccagagggagtgacaga

SEQ ID NO: 2619528 - DNA, 20 bp, Homo sapiens
ccagagggagtgacagaggc

SEQ ID NO: 2619529 - DNA, 23 bp, Homo sapiens
ccagagggagtgacagaggcagc

SEQ ID NO: 2619530 - DNA, 17 bp, Homo sapiens
ccagagggcccaggcag

SEQ ID NO: 2619531 - DNA, 15 bp, Homo sapiens
ccagagggcctgcaa

SEQ ID NO: 2619532 - DNA, 18 bp, Homo sapiens
ccagaggtaacagaacag

SEQ ID NO: 2619533 - DNA, 19 bp, Homo sapiens
ccagaggtaacagaacagc

SEQ ID NO: 2619534 - DNA, 17 bp, Homo sapiens
ccagaggtgggcaggtg

SEQ ID NO: 2619535 - DNA, 16 bp, Homo sapiens
ccagagtcctttccaa

SEQ ID NO: 2619536 - DNA, 21 bp, Homo sapiens
ccagagtcctttccaaggctt

SEQ ID NO: 2619537 - DNA, 18 bp, Homo sapiens
ccagagtggcctggccag

SEQ ID NO: 2619538 - DNA, 13 bp, Homo sapiens
ccagataccagcc

SEQ ID NO: 2619539 - DNA, 18 bp, Homo sapiens
ccagatcaccagcccggc

SEQ ID NO: 2619540 - DNA, 14 bp, Homo sapiens
ccagatcctcacaa

SEQ ID NO: 2619541 - DNA, 14 bp, Homo sapiens
ccagatgcaccagc

SEQ ID NO: 2619542 - DNA, 18 bp, Homo sapiens
ccagatgcaccagccctt

SEQ ID NO: 2619543 - DNA, 20 bp, Homo sapiens
ccagattgcaacaggctggg

SEQ ID NO: 2619544 - DNA, 21 bp, Homo sapiens
ccagattgcaacaggctgggc

SEQ ID NO: 2619545 - DNA, 22 bp, Homo sapiens
ccagattgcaacaggctgggct

SEQ ID NO: 2619546 - DNA, 23 bp, Homo sapiens
ccagattgcaacaggctgggctt

SEQ ID NO: 2619547 - DNA, 21 bp, Homo sapiens
ccagatttgctaatttatcct

SEQ ID NO: 2619548 - DNA, 24 bp, Homo sapiens
ccagattttttacagctgcctgca

SEQ ID NO: 2619549 - DNA, 15 bp, Homo sapiens
ccagcaaaaggttgt

SEQ ID NO: 2619550 - DNA, 18 bp, Homo sapiens
ccagcaaccctcctatca

SEQ ID NO: 2619551 - DNA, 11 bp, Homo sapiens
ccagcaactga

SEQ ID NO: 2619552 - DNA, 18 bp, Homo sapiens
ccagcaacttgtcttttt

SEQ ID NO: 2619553 - DNA, 18 bp, Homo sapiens
ccagcaagtgagagctgg

SEQ ID NO: 2619554 - DNA, 22 bp, Homo sapiens
ccagcaagtgagagctgggtgt

SEQ ID NO: 2619555 - DNA, 17 bp, Homo sapiens
ccagcaatgatgtccag

SEQ ID NO: 2619556 - DNA, 18 bp, Homo sapiens
ccagcaatgatgtccaga

SEQ ID NO: 2619557 - DNA, 15 bp, Homo sapiens
ccagcactgtctcag

SEQ ID NO: 2619558 - DNA, 16 bp, Homo sapiens
ccagcagaaatgcctt

SEQ ID NO: 2619559 - DNA, 23 bp, Homo sapiens
ccagcagagcaccttagacagtc

SEQ ID NO: 2619560 - DNA, 17 bp, Homo sapiens
ccagcagatcccagctc

SEQ ID NO: 2619561 - DNA, 19 bp, Homo sapiens
ccagcagatcccagctcac

SEQ ID NO: 2619562 - DNA, 21 bp, Homo sapiens
ccagcagatcccagctcacgt

SEQ ID NO: 2619563 - DNA, 15 bp, Homo sapiens
ccagcagccagctct

SEQ ID NO: 2619564 - DNA, 13 bp, Homo sapiens
ccagcagcctgga

SEQ ID NO: 2619565 - DNA, 19 bp, Homo sapiens
ccagcagcctggaccctgt

SEQ ID NO: 2619566 - DNA, 21 bp, Homo sapiens
ccagcagggtcttttcatctg

SEQ ID NO: 2619567 - DNA, 21 bp, Homo sapiens
ccagcatccttttctgcagag

SEQ ID NO: 2619568 - DNA, 17 bp, Homo sapiens
ccagcattgctggttct

SEQ ID NO: 2619569 - DNA, 17 bp, Homo sapiens
ccagccaaaccctgtct

SEQ ID NO: 2619570 - DNA, 18 bp, Homo sapiens
ccagccaaagcctcctcc

SEQ ID NO: 2619571 - DNA, 19 bp, Homo sapiens
ccagccaacccctgtggag

SEQ ID NO: 2619572 - DNA, 19 bp, Homo sapiens
ccagccagatcctcttggt

SEQ ID NO: 2619573 - DNA, 21 bp, Homo sapiens
ccagccagatggactccagcc

SEQ ID NO: 2619574 - DNA, 15 bp, Homo sapiens
ccagccagcagccag

SEQ ID NO: 2619575 - DNA, 16 bp, Homo sapiens
ccagccagcagccagc

SEQ ID NO: 2619576 - DNA, 12 bp, Homo sapiens
ccagccaggcgg

SEQ ID NO: 2619577 - DNA, 18 bp, Homo sapiens
ccagccaggctctgtgct

SEQ ID NO: 2619578 - DNA, 20 bp, Homo sapiens
ccagccaggctctgtgctga

SEQ ID NO: 2619579 - DNA, 22 bp, Homo sapiens
ccagccatacttatctctctgt

SEQ ID NO: 2619580 - DNA, 16 bp, Homo sapiens
ccagccatctgcccag

SEQ ID NO: 2619581 - DNA, 19 bp, Homo sapiens
ccagccatctgcccagggg

SEQ ID NO: 2619582 - DNA, 18 bp, Homo sapiens
ccagcccaccctcctgtc

SEQ ID NO: 2619583 - DNA, 19 bp, Homo sapiens
ccagcccaccctcctgtct

SEQ ID NO: 2619584 - DNA, 14 bp, Homo sapiens
ccagcccagatgtt

SEQ ID NO: 2619585 - DNA, 12 bp, Homo sapiens
ccagcccagggt

SEQ ID NO: 2619586 - DNA, 18 bp, Homo sapiens
ccagcccagggttccccc

SEQ ID NO: 2619587 - DNA, 19 bp, Homo sapiens
ccagccccaaaactctcct

SEQ ID NO: 2619588 - DNA, 15 bp, Homo sapiens
ccagccccacccagg

SEQ ID NO: 2619589 - DNA, 17 bp, Homo sapiens
ccagccccacccaggag

SEQ ID NO: 2619590 - DNA, 13 bp, Homo sapiens
ccagccccagtgc

SEQ ID NO: 2619591 - DNA, 23 bp, Homo sapiens
ccagccccatcctctgtacagag

SEQ ID NO: 2619592 - DNA, 18 bp, Homo sapiens
ccagcccccacagtgctg

SEQ ID NO: 2619593 - DNA, 20 bp, Homo sapiens
ccagccccctttgggcccag

SEQ ID NO: 2619594 - DNA, 23 bp, Homo sapiens
ccagccccctttgggcccaggga

SEQ ID NO: 2619595 - DNA, 14 bp, Homo sapiens
ccagcccctcccac

SEQ ID NO: 2619596 - DNA, 16 bp, Homo sapiens
ccagcccctcccacca

SEQ ID NO: 2619597 - DNA, 20 bp, Homo sapiens
ccagcccctcccaccacagc

SEQ ID NO: 2619598 - DNA, 12 bp, Homo sapiens
ccagcccctgga

SEQ ID NO: 2619599 - DNA, 18 bp, Homo sapiens
ccagcccctggatgcagc

SEQ ID NO: 2619600 - DNA, 21 bp, Homo sapiens
cccacctggcctctgcactcc

SEQ ID NO: 2619601 - DNA, 12 bp, Homo sapiens
cccacctgtctt

SEQ ID NO: 2619602 - DNA, 17 bp, Homo sapiens
cccaccttgttggagcc

SEQ ID NO: 2619603 - DNA, 19 bp, Homo sapiens
cccaccttgttggagcctg

SEQ ID NO: 2619604 - DNA, 21 bp, Homo sapiens
cccacctttattaaaatctta

SEQ ID NO: 2619605 - DNA, 16 bp, Homo sapiens
cccacgagggtcagga

SEQ ID NO: 2619606 - DNA, 13 bp, Homo sapiens
cccacgcccccac

SEQ ID NO: 2619607 - DNA, 14 bp, Homo sapiens
cccacgcccccact

SEQ ID NO: 2619608 - DNA, 20 bp, Homo sapiens
cccacgctggagtgcagtga

SEQ ID NO: 2619609 - DNA, 21 bp, Homo sapiens
cccacgctggagtgcagtgag

SEQ ID NO: 2619610 - DNA, 16 bp, Homo sapiens
cccacggccgctccag

SEQ ID NO: 2619611 - DNA, 20 bp, Homo sapiens
cccacgttctcacacccacc

SEQ ID NO: 2619612 - DNA, 20 bp, Homo sapiens
cccactcaagccaagcagcc

SEQ ID NO: 2619613 - DNA, 23 bp, Homo sapiens
cccactcaagccaagcagccaag

SEQ ID NO: 2619614 - DNA, 12 bp, Homo sapiens
cccactccctgc

SEQ ID NO: 2619615 - DNA, 13 bp, Homo sapiens
cccactccctgca

SEQ ID NO: 2619616 - DNA, 20 bp, Homo sapiens
cccactccctggctctcaga

SEQ ID NO: 2619617 - DNA, 11 bp, Homo sapiens
cccactctccc

SEQ ID NO: 2619618 - DNA, 16 bp, Homo sapiens
cccactgacagcctcc

SEQ ID NO: 2619619 - DNA, 15 bp, Homo sapiens
cccactgcaatcctg

SEQ ID NO: 2619620 - DNA, 18 bp, Homo sapiens
cccactgcaatcctgtct

SEQ ID NO: 2619621 - DNA, 17 bp, Homo sapiens
cccactgcccaccccct

SEQ ID NO: 2619622 - DNA, 16 bp, Homo sapiens
cccactgtcctgggcg

SEQ ID NO: 2619623 - DNA, 17 bp, Homo sapiens
cccactgtcctgggcgc

SEQ ID NO: 2619624 - DNA, 15 bp, Homo sapiens
cccagaaaaggacag

SEQ ID NO: 2619625 - DNA, 14 bp, Homo sapiens
cccagaaaggagac

SEQ ID NO: 2619626 - DNA, 14 bp, Homo sapiens
cccagaacacactc

SEQ ID NO: 2619627 - DNA, 15 bp, Homo sapiens
cccagaacctgtcct

SEQ ID NO: 2619628 - DNA, 19 bp, Homo sapiens
cccagaactggactcagga

SEQ ID NO: 2619629 - DNA, 13 bp, Homo sapiens
cccagaaggcagg

SEQ ID NO: 2619630 - DNA, 23 bp, Homo sapiens
cccagaaggcagggaaaggctct

SEQ ID NO: 2619631 - DNA, 13 bp, Homo sapiens
cccagacagctcc

SEQ ID NO: 2619632 - DNA, 14 bp, Homo sapiens
cccagacagctccc

SEQ ID NO: 2619633 - DNA, 16 bp, Homo sapiens
cccagacagctccctc

SEQ ID NO: 2619634 - DNA, 20 bp, Homo sapiens
cccagacagctccctctgcc

SEQ ID NO: 2619635 - DNA, 18 bp, Homo sapiens
cccagacccctctggcca

SEQ ID NO: 2619636 - DNA, 17 bp, Homo sapiens
cccagacgatgtcttca

SEQ ID NO: 2619637 - DNA, 16 bp, Homo sapiens
cccagagcaggaagca

SEQ ID NO: 2619638 - DNA, 23 bp, Homo sapiens
cccagagcaggaggcccctggcc

SEQ ID NO: 2619639 - DNA, 22 bp, Homo sapiens
cccagagcattacgtgagccag

SEQ ID NO: 2619640 - DNA, 20 bp, Homo sapiens
cccagagctgtttatggcct

SEQ ID NO: 2619641 - DNA, 21 bp, Homo sapiens
cccagagctgtttatggcctc

SEQ ID NO: 2619642 - DNA, 22 bp, Homo sapiens
cccagagctgtttatggcctca

SEQ ID NO: 2619643 - DNA, 14 bp, Homo sapiens
cccagaggcctctc

SEQ ID NO: 2619644 - DNA, 16 bp, Homo sapiens
cccagagggcccaggc

SEQ ID NO: 2619645 - DNA, 23 bp, Homo sapiens
cccagagggcccaggcaggccac

SEQ ID NO: 2619646 - DNA, 14 bp, Homo sapiens
cccagagggcctgc

SEQ ID NO: 2619647 - DNA, 15 bp, Homo sapiens
cccagagggcctgca

SEQ ID NO: 2619648 - DNA, 18 bp, Homo sapiens
cccagagggcctgcaagg

SEQ ID NO: 2619649 - DNA, 14 bp, Homo sapiens
cccagataccagcc

SEQ ID NO: 2619650 - DNA, 18 bp, Homo sapiens
cccagatctggtcccttg

SEQ ID NO: 2619651 - DNA, 21 bp, Homo sapiens
cccagattgcaacaggctggg

SEQ ID NO: 2619652 - DNA, 20 bp, Homo sapiens
cccagcaacacaagctggaa

SEQ ID NO: 2619653 - DNA, 20 bp, Homo sapiens
cccagcaagtgagagctggg

SEQ ID NO: 2619654 - DNA, 22 bp, Homo sapiens
cccagcaagtgagagctgggtg

SEQ ID NO: 2619655 - DNA, 23 bp, Homo sapiens
cccagcaagtgagagctgggtgt

SEQ ID NO: 2619656 - DNA, 18 bp, Homo sapiens
cccagcacttgtgttgtc

SEQ ID NO: 2619657 - DNA, 15 bp, Homo sapiens
cccagcactttggga

SEQ ID NO: 2619658 - DNA, 17 bp, Homo sapiens
cccagcactttgggagg

SEQ ID NO: 2619659 - DNA, 20 bp, Homo sapiens
cccagcactttgggaggcct

SEQ ID NO: 2619660 - DNA, 21 bp, Homo sapiens
cccagcactttgggaggccta

SEQ ID NO: 2619661 - DNA, 15 bp, Homo sapiens
cccagcaggtgggga

SEQ ID NO: 2619662 - DNA, 19 bp, Homo sapiens
cccagcaggtggggagggg

SEQ ID NO: 2619663 - DNA, 15 bp, Homo sapiens
cccagcattgctggt

SEQ ID NO: 2619664 - DNA, 17 bp, Homo sapiens
cccagccagagttcctg

SEQ ID NO: 2619665 - DNA, 22 bp, Homo sapiens
cccagccagagttcctgcggag

SEQ ID NO: 2619666 - DNA, 15 bp, Homo sapiens
cccagccatctgccc

SEQ ID NO: 2619667 - DNA, 18 bp, Homo sapiens
cccagccattaccatgga

SEQ ID NO: 2619668 - DNA, 13 bp, Homo sapiens
cccagcccaccct

SEQ ID NO: 2619669 - DNA, 14 bp, Homo sapiens
cccagcccaccctc

SEQ ID NO: 2619670 - DNA, 15 bp, Homo sapiens
cccagcccaccctcc

SEQ ID NO: 2619671 - DNA, 11 bp, Homo sapiens
cccagccccat

SEQ ID NO: 2619672 - DNA, 19 bp, Homo sapiens
cccagccccatcctctgta

SEQ ID NO: 2619673 - DNA, 17 bp, Homo sapiens
cccagccctatggatgt

SEQ ID NO: 2619674 - DNA, 18 bp, Homo sapiens
cccagccctatggatgtg

SEQ ID NO: 2619675 - DNA, 15 bp, Homo sapiens
cccagccctcatccc

SEQ ID NO: 2619676 - DNA, 13 bp, Homo sapiens
cccagccctgctg

SEQ ID NO: 2619677 - DNA, 15 bp, Homo sapiens
cccagccctgctggc

SEQ ID NO: 2619678 - DNA, 12 bp, Homo sapiens
cccagccctggc

SEQ ID NO: 2619679 - DNA, 14 bp, Homo sapiens
cccagccctggtct

SEQ ID NO: 2619680 - DNA, 16 bp, Homo sapiens
cccagccctgtggaag

SEQ ID NO: 2619681 - DNA, 14 bp, Homo sapiens
cccagccggcctct

SEQ ID NO: 2619682 - DNA, 17 bp, Homo sapiens
cccagccggcctctctg

SEQ ID NO: 2619683 - DNA, 20 bp, Homo sapiens
cccagccggcctctctggcc

SEQ ID NO: 2619684 - DNA, 21 bp, Homo sapiens
cccagcctcttctagagccgt

SEQ ID NO: 2619685 - DNA, 18 bp, Homo sapiens
cccagcggcccctcccac

SEQ ID NO: 2619686 - DNA, 18 bp, Homo sapiens
cccagctaatctgtaggg

SEQ ID NO: 2619687 - DNA, 17 bp, Homo sapiens
cccagctactcagaagc

SEQ ID NO: 2619688 - DNA, 22 bp, Homo sapiens
cccagctactcagaagcctgag

SEQ ID NO: 2619689 - DNA, 15 bp, Homo sapiens
cccagctactcagga

SEQ ID NO: 2619690 - DNA, 12 bp, Homo sapiens
cccagctctgaa

SEQ ID NO: 2619691 - DNA, 13 bp, Homo sapiens
cccagctctggct

SEQ ID NO: 2619692 - DNA, 15 bp, Homo sapiens
cccagctctggtgag

SEQ ID NO: 2619693 - DNA, 15 bp, Homo sapiens
cccagctgacatgga

SEQ ID NO: 2619694 - DNA, 17 bp, Homo sapiens
cccagctgacatggaaa

SEQ ID NO: 2619695 - DNA, 17 bp, Homo sapiens
cccagctgggaggcaag

SEQ ID NO: 2619696 - DNA, 14 bp, Homo sapiens
cccagctgggctct

SEQ ID NO: 2619697 - DNA, 19 bp, Homo sapiens
cccagctgggctctgccac

SEQ ID NO: 2619698 - DNA, 20 bp, Homo sapiens
cccagctgggctctgccacc

SEQ ID NO: 2619699 - DNA, 21 bp, Homo sapiens
cccagctgtgctctggacagg

SEQ ID NO: 2619700 - DNA, 11 bp, Homo sapiens
cccagctgttt

SEQ ID NO: 2619701 - DNA, 22 bp, Homo sapiens
cccagcttaaaggggctagagt

SEQ ID NO: 2619702 - DNA, 20 bp, Homo sapiens
cccagcttgggcccagctgg

SEQ ID NO: 2619703 - DNA, 23 bp, Homo sapiens
cccagcttgggcccagctgggct

SEQ ID NO: 2619704 - DNA, 23 bp, Homo sapiens
cccaggaaaggctccaggagcag

SEQ ID NO: 2619705 - DNA, 15 bp, Homo sapiens
cccaggaactgggcc

SEQ ID NO: 2619706 - DNA, 12 bp, Homo sapiens
cccaggaagccg

SEQ ID NO: 2619707 - DNA, 22 bp, Homo sapiens
cccaggaatgccaaggagacat

SEQ ID NO: 2619708 - DNA, 16 bp, Homo sapiens
cccaggaccagctggg

SEQ ID NO: 2619709 - DNA, 22 bp, Homo sapiens
cccaggaccagctggggcgtgg

SEQ ID NO: 2619710 - DNA, 22 bp, Homo sapiens
cccaggagcatccacctccttc

SEQ ID NO: 2619711 - DNA, 13 bp, Homo sapiens
cccaggagccccg

SEQ ID NO: 2619712 - DNA, 18 bp, Homo sapiens
cccaggagccccgaggcc

SEQ ID NO: 2619713 - DNA, 24 bp, Homo sapiens
cccaggagttcgaggctgcagtca

SEQ ID NO: 2619714 - DNA, 23 bp, Homo sapiens
cccaggagtttgaggctgcagcg

SEQ ID NO: 2619715 - DNA, 11 bp, Homo sapiens
cccaggcaggt

SEQ ID NO: 2619716 - DNA, 13 bp, Homo sapiens
cccaggcaggtct

SEQ ID NO: 2619717 - DNA, 20 bp, Homo sapiens
cccaggcattccccaggagg

SEQ ID NO: 2619718 - DNA, 22 bp, Homo sapiens
cccaggccaggccaccaggatg

SEQ ID NO: 2619719 - DNA, 23 bp, Homo sapiens
cccaggccaggctccttcctgtc

SEQ ID NO: 2619720 - DNA, 17 bp, Homo sapiens
cccaggccccaggaagc

SEQ ID NO: 2619721 - DNA, 22 bp, Homo sapiens
cccaggccccgaggacccagac

SEQ ID NO: 2619722 - DNA, 13 bp, Homo sapiens
cccaggcctctgt

SEQ ID NO: 2619723 - DNA, 20 bp, Homo sapiens
cccaggctggagtgcaatga

SEQ ID NO: 2619724 - DNA, 20 bp, Homo sapiens
cccaggctggcgtgcagtgg

SEQ ID NO: 2619725 - DNA, 12 bp, Homo sapiens
cccaggctgggc

SEQ ID NO: 2619726 - DNA, 20 bp, Homo sapiens
cccaggcttagtcactgaga

SEQ ID NO: 2619727 - DNA, 22 bp, Homo sapiens
cccaggcttagtcactgagaca

SEQ ID NO: 2619728 - DNA, 15 bp, Homo sapiens
cccagggaagttttg

SEQ ID NO: 2619729 - DNA, 18 bp, Homo sapiens
cccagggacaccagccag

SEQ ID NO: 2619730 - DNA, 21 bp, Homo sapiens
cccagggacaccagccaggct

SEQ ID NO: 2619731 - DNA, 17 bp, Homo sapiens
cccagggaccgaaaagt

SEQ ID NO: 2619732 - DNA, 20 bp, Homo sapiens
cccagggcacttcacagagt

SEQ ID NO: 2619733 - DNA, 22 bp, Homo sapiens
cccagggcacttcacagagtgt

SEQ ID NO: 2619734 - DNA, 21 bp, Homo sapiens
cccagggctaccctcccccag

SEQ ID NO: 2619735 - DNA, 14 bp, Homo sapiens
cccagggctcagcc

SEQ ID NO: 2619736 - DNA, 16 bp, Homo sapiens
cccagggctcagcctg

SEQ ID NO: 2619737 - DNA, 17 bp, Homo sapiens
cccagggctcagcctgg

SEQ ID NO: 2619738 - DNA, 14 bp, Homo sapiens
cccaggggagccct

SEQ ID NO: 2619739 - DNA, 15 bp, Homo sapiens
cccaggggagccctc

SEQ ID NO: 2619740 - DNA, 22 bp, Homo sapiens
cccaggggcatgtattggcctg

SEQ ID NO: 2619741 - DNA, 23 bp, Homo sapiens
cccaggggcatgtattggcctgg

SEQ ID NO: 2619742 - DNA, 17 bp, Homo sapiens
cccaggggcccacaggg

SEQ ID NO: 2619743 - DNA, 16 bp, Homo sapiens
cccaggggtcccagcc

SEQ ID NO: 2619744 - DNA, 19 bp, Homo sapiens
ccctccccggccctaccag

SEQ ID NO: 2619745 - DNA, 15 bp, Homo sapiens
ccctcccctctcttg

SEQ ID NO: 2619746 - DNA, 13 bp, Homo sapiens
ccctcccctgccc

SEQ ID NO: 2619747 - DNA, 16 bp, Homo sapiens
ccctcccctgccctag

SEQ ID NO: 2619748 - DNA, 23 bp, Homo sapiens
ccctcccgccccttcccactcac

SEQ ID NO: 2619749 - DNA, 14 bp, Homo sapiens
ccctccctggagtg

SEQ ID NO: 2619750 - DNA, 12 bp, Homo sapiens
ccctccctgggt

SEQ ID NO: 2619751 - DNA, 12 bp, Homo sapiens
ccctcccttgga

SEQ ID NO: 2619752 - DNA, 18 bp, Homo sapiens
ccctccgccaggcgagat

SEQ ID NO: 2619753 - DNA, 14 bp, Homo sapiens
ccctccgccattct

SEQ ID NO: 2619754 - DNA, 22 bp, Homo sapiens
ccctccgccttcactccggtgt

SEQ ID NO: 2619755 - DNA, 23 bp, Homo sapiens
ccctccgtggcatcaccttaggc

SEQ ID NO: 2619756 - DNA, 20 bp, Homo sapiens
ccctcctatcacctcccctc

SEQ ID NO: 2619757 - DNA, 13 bp, Homo sapiens
ccctcctcacctc

SEQ ID NO: 2619758 - DNA, 17 bp, Homo sapiens
ccctcctcacctctgga

SEQ ID NO: 2619759 - DNA, 23 bp, Homo sapiens
ccctcctccctttttccttgtcc

SEQ ID NO: 2619760 - DNA, 14 bp, Homo sapiens
ccctcctctcccat

SEQ ID NO: 2619761 - DNA, 15 bp, Homo sapiens
ccctcctctcccatc

SEQ ID NO: 2619762 - DNA, 18 bp, Homo sapiens
ccctcctgccgactcctg

SEQ ID NO: 2619763 - DNA, 12 bp, Homo sapiens
ccctcctgtctt

SEQ ID NO: 2619764 - DNA, 19 bp, Homo sapiens
ccctcctgttgcacccagc

SEQ ID NO: 2619765 - DNA, 18 bp, Homo sapiens
ccctccttgcctcctgtg

SEQ ID NO: 2619766 - DNA, 18 bp, Homo sapiens
ccctccttgtccacccac

SEQ ID NO: 2619767 - DNA, 12 bp, Homo sapiens
ccctccttgtct

SEQ ID NO: 2619768 - DNA, 14 bp, Homo sapiens
ccctcctttcacca

SEQ ID NO: 2619769 - DNA, 23 bp, Homo sapiens
ccctcgcttggacggctgggcac

SEQ ID NO: 2619770 - DNA, 13 bp, Homo sapiens
ccctcggagaaga

SEQ ID NO: 2619771 - DNA, 16 bp, Homo sapiens
ccctcgggcccacctg

SEQ ID NO: 2619772 - DNA, 19 bp, Homo sapiens
ccctcgggcccacctggcc

SEQ ID NO: 2619773 - DNA, 15 bp, Homo sapiens
ccctcgggcccagcc

SEQ ID NO: 2619774 - DNA, 19 bp, Homo sapiens
ccctcgggtctcctcactc

SEQ ID NO: 2619775 - DNA, 13 bp, Homo sapiens
ccctcgtggccag

SEQ ID NO: 2619776 - DNA, 14 bp, Homo sapiens
ccctctcagctcca

SEQ ID NO: 2619777 - DNA, 12 bp, Homo sapiens
ccctctctctga

SEQ ID NO: 2619778 - DNA, 14 bp, Homo sapiens
ccctctctcttctg

SEQ ID NO: 2619779 - DNA, 18 bp, Homo sapiens
ccctctctgcatctgacc

SEQ ID NO: 2619780 - DNA, 20 bp, Homo sapiens
ccctctctgcatctgaccac

SEQ ID NO: 2619781 - DNA, 16 bp, Homo sapiens
ccctctctgctctgcg

SEQ ID NO: 2619782 - DNA, 13 bp, Homo sapiens
ccctctcttgcac

SEQ ID NO: 2619783 - DNA, 22 bp, Homo sapiens
ccctctgaatggtccagggttg

SEQ ID NO: 2619784 - DNA, 17 bp, Homo sapiens
ccctctgacctgcactg

SEQ ID NO: 2619785 - DNA, 12 bp, Homo sapiens
ccctctgcccag

SEQ ID NO: 2619786 - DNA, 15 bp, Homo sapiens
ccctctgcccagctt

SEQ ID NO: 2619787 - DNA, 18 bp, Homo sapiens
ccctctgcccagcttggg

SEQ ID NO: 2619788 - DNA, 21 bp, Homo sapiens
ccctctgcctgaaccttccat

SEQ ID NO: 2619789 - DNA, 14 bp, Homo sapiens
ccctctgcctgtcc

SEQ ID NO: 2619790 - DNA, 18 bp, Homo sapiens
ccctctggccaggatgga

SEQ ID NO: 2619791 - DNA, 22 bp, Homo sapiens
ccctctggccaggatggagggg

SEQ ID NO: 2619792 - DNA, 22 bp, Homo sapiens
ccctgaaaatgtttttctgcca

SEQ ID NO: 2619793 - DNA, 15 bp, Homo sapiens
ccctgaaacttattt

SEQ ID NO: 2619794 - DNA, 17 bp, Homo sapiens
ccctgaaacttattttt

SEQ ID NO: 2619795 - DNA, 23 bp, Homo sapiens
ccctgaaacttatttttttctga

SEQ ID NO: 2619796 - DNA, 23 bp, Homo sapiens
ccctgaaggaacattccttagtc

SEQ ID NO: 2619797 - DNA, 14 bp, Homo sapiens
ccctgaaggccccg

SEQ ID NO: 2619798 - DNA, 20 bp, Homo sapiens
ccctgaagtgagcacagcct

SEQ ID NO: 2619799 - DNA, 14 bp, Homo sapiens
ccctgacctcccag

SEQ ID NO: 2619800 - DNA, 21 bp, Homo sapiens
ccctgacctcccagccctatg

SEQ ID NO: 2619801 - DNA, 13 bp, Homo sapiens
ccctgactgggag

SEQ ID NO: 2619802 - DNA, 14 bp, Homo sapiens
ccctgactggtgct

SEQ ID NO: 2619803 - DNA, 20 bp, Homo sapiens
ccctgagacaaatggaggcc

SEQ ID NO: 2619804 - DNA, 16 bp, Homo sapiens
ccctgagctgaggcag

SEQ ID NO: 2619805 - DNA, 19 bp, Homo sapiens
ccctgaggagccaggccgg

SEQ ID NO: 2619806 - DNA, 14 bp, Homo sapiens
ccctgaggcccaga

SEQ ID NO: 2619807 - DNA, 19 bp, Homo sapiens
ccctgaggcccagagggcc

SEQ ID NO: 2619808 - DNA, 18 bp, Homo sapiens
ccctgaggctcagggaaa

SEQ ID NO: 2619809 - DNA, 22 bp, Homo sapiens
ccctgagtaatcgcttaaagat

SEQ ID NO: 2619810 - DNA, 19 bp, Homo sapiens
ccctgagtggatctccaag

SEQ ID NO: 2619811 - DNA, 23 bp, Homo sapiens
ccctgagtggatctccaaggacc

SEQ ID NO: 2619812 - DNA, 22 bp, Homo sapiens
ccctgcaacctgattgtgtctc

SEQ ID NO: 2619813 - DNA, 12 bp, Homo sapiens
ccctgcacttgc

SEQ ID NO: 2619814 - DNA, 17 bp, Homo sapiens
ccctgccaccctgggga

SEQ ID NO: 2619815 - DNA, 20 bp, Homo sapiens
ccctgccatcatgtttacag

SEQ ID NO: 2619816 - DNA, 16 bp, Homo sapiens
ccctgccccagcaaga

SEQ ID NO: 2619817 - DNA, 20 bp, Homo sapiens
ccctgcccccaaataagaag

SEQ ID NO: 2619818 - DNA, 16 bp, Homo sapiens
ccctgcccccacttcc

SEQ ID NO: 2619819 - DNA, 17 bp, Homo sapiens
ccctgcccccacttcct

SEQ ID NO: 2619820 - DNA, 20 bp, Homo sapiens
ccctgcccccacttcctgtt

SEQ ID NO: 2619821 - DNA, 19 bp, Homo sapiens
ccctgccccccagcctctg

SEQ ID NO: 2619822 - DNA, 15 bp, Homo sapiens
ccctgccccgtcacc

SEQ ID NO: 2619823 - DNA, 17 bp, Homo sapiens
ccctgcccctgccccgt

SEQ ID NO: 2619824 - DNA, 18 bp, Homo sapiens
ccctgcccctgccccgtc

SEQ ID NO: 2619825 - DNA, 17 bp, Homo sapiens
ccctgcccggctgcgga

SEQ ID NO: 2619826 - DNA, 17 bp, Homo sapiens
ccctgccctagctccac

SEQ ID NO: 2619827 - DNA, 10 bp, Homo sapiens
ccctgccctc

SEQ ID NO: 2619828 - DNA, 17 bp, Homo sapiens
ccctgccctcgtggcca

SEQ ID NO: 2619829 - DNA, 20 bp, Homo sapiens
ccctgccctcgtggccagcc

SEQ ID NO: 2619830 - DNA, 22 bp, Homo sapiens
ccctgccctcgtggccagcccg

SEQ ID NO: 2619831 - DNA, 11 bp, Homo sapiens
ccctgccctgc

SEQ ID NO: 2619832 - DNA, 13 bp, Homo sapiens
ccctgccctgctg

SEQ ID NO: 2619833 - DNA, 13 bp, Homo sapiens
ccctgccctgtgg

SEQ ID NO: 2619834 - DNA, 15 bp, Homo sapiens
ccctgccctgtgggc

SEQ ID NO: 2619835 - DNA, 13 bp, Homo sapiens
ccctgccggccgg

SEQ ID NO: 2619836 - DNA, 19 bp, Homo sapiens
ccctgcctccaccctctga

SEQ ID NO: 2619837 - DNA, 22 bp, Homo sapiens
ccctgcctctcatcaactgaat

SEQ ID NO: 2619838 - DNA, 13 bp, Homo sapiens
ccctgcctgaggg

SEQ ID NO: 2619839 - DNA, 22 bp, Homo sapiens
ccctgcctgagggcccctctgc

SEQ ID NO: 2619840 - DNA, 21 bp, Homo sapiens
ccctgcgaaggggccctggtc

SEQ ID NO: 2619841 - DNA, 21 bp, Homo sapiens
ccctgctccacgtctgcgccg

SEQ ID NO: 2619842 - DNA, 16 bp, Homo sapiens
ccctgctcctccctgg

SEQ ID NO: 2619843 - DNA, 20 bp, Homo sapiens
ccctgctcctccctggctgc

SEQ ID NO: 2619844 - DNA, 19 bp, Homo sapiens
ccctgctgccgcctcccag

SEQ ID NO: 2619845 - DNA, 11 bp, Homo sapiens
ccctgctgcct

SEQ ID NO: 2619846 - DNA, 14 bp, Homo sapiens
ccctgctgcctccc

SEQ ID NO: 2619847 - DNA, 17 bp, Homo sapiens
ccctgctgctgacccag

SEQ ID NO: 2619848 - DNA, 12 bp, Homo sapiens
ccctgctggccg

SEQ ID NO: 2619849 - DNA, 13 bp, Homo sapiens
ccctgctggctct

SEQ ID NO: 2619850 - DNA, 13 bp, Homo sapiens
ccctgctggttca

SEQ ID NO: 2619851 - DNA, 19 bp, Homo sapiens
ccctgctggttcagggttg

SEQ ID NO: 2619852 - DNA, 21 bp, Homo sapiens
ccctgcttcaatacccaaatc

SEQ ID NO: 2619853 - DNA, 22 bp, Homo sapiens
ccctggaagccggcggcccaag

SEQ ID NO: 2619854 - DNA, 19 bp, Homo sapiens
ccctggagccaactgctgc

SEQ ID NO: 2619855 - DNA, 20 bp, Homo sapiens
ccctggagccaactgctgct

SEQ ID NO: 2619856 - DNA, 21 bp, Homo sapiens
ccctggagccagactctggtc

SEQ ID NO: 2619857 - DNA, 19 bp, Homo sapiens
ccctggaggcactgaagtg

SEQ ID NO: 2619858 - DNA, 18 bp, Homo sapiens
ccctggagtcatgccaag

SEQ ID NO: 2619859 - DNA, 20 bp, Homo sapiens
ccctggcaggatgaccctgc

SEQ ID NO: 2619860 - DNA, 23 bp, Homo sapiens
ccctggccaccaccccccactct

SEQ ID NO: 2619861 - DNA, 15 bp, Homo sapiens
ccctggctgccctgg

SEQ ID NO: 2619862 - DNA, 17 bp, Homo sapiens
ccctgggctcggaggct

SEQ ID NO: 2619863 - DNA, 19 bp, Homo sapiens
ccctggggacagcaagggc

SEQ ID NO: 2619864 - DNA, 21 bp, Homo sapiens
ccctggggcctggacctgcct

SEQ ID NO: 2619865 - DNA, 23 bp, Homo sapiens
ccctgggtgggtggtggggaggg

SEQ ID NO: 2619866 - DNA, 16 bp, Homo sapiens
ccctggtccagggaag

SEQ ID NO: 2619867 - DNA, 18 bp, Homo sapiens
ccctggtccagggaagct

SEQ ID NO: 2619868 - DNA, 13 bp, Homo sapiens
ccctggtggcagt

SEQ ID NO: 2619869 - DNA, 14 bp, Homo sapiens
ccctggtggcagtg

SEQ ID NO: 2619870 - DNA, 18 bp, Homo sapiens
ccctgtactgttctgtgt

SEQ ID NO: 2619871 - DNA, 15 bp, Homo sapiens
ccctgtcccccagct

SEQ ID NO: 2619872 - DNA, 18 bp, Homo sapiens
ccctgtcccccagctctg

SEQ ID NO: 2619873 - DNA, 20 bp, Homo sapiens
ccctgtcctctctggctggg

SEQ ID NO: 2619874 - DNA, 20 bp, Homo sapiens
ccctgtcgagacacttgcct

SEQ ID NO: 2619875 - DNA, 14 bp, Homo sapiens
ccctgtctaaaaaa

SEQ ID NO: 2619876 - DNA, 21 bp, Homo sapiens
ccctgtctgtagagggccctg

SEQ ID NO: 2619877 - DNA, 22 bp, Homo sapiens
ccctgtctgtagagggccctgg

SEQ ID NO: 2619878 - DNA, 15 bp, Homo sapiens
ccctgtgatggggcc

SEQ ID NO: 2619879 - DNA, 22 bp, Homo sapiens
ccctgtgcagccgctgagcgag

SEQ ID NO: 2619880 - DNA, 21 bp, Homo sapiens
ccctgtgcctaacaccagcgt

SEQ ID NO: 2619881 - DNA, 22 bp, Homo sapiens
ccctgtgcctaacaccagcgtt

SEQ ID NO: 2619882 - DNA, 24 bp, Homo sapiens
ccctgtgccttggtgtgctgtatc

SEQ ID NO: 2619883 - DNA, 15 bp, Homo sapiens
ccctgtgctggtgtc

SEQ ID NO: 2619884 - DNA, 14 bp, Homo sapiens
ccctgtggaaggga

SEQ ID NO: 2619885 - DNA, 14 bp, Homo sapiens
ccctgtggggatct

SEQ ID NO: 2619886 - DNA, 20 bp, Homo sapiens
ccctgtggggatctcagggg

SEQ ID NO: 2619887 - DNA, 11 bp, Homo sapiens
ccctgtttaat

SEQ ID NO: 2619888 - DNA, 18 bp, Homo sapiens
ccctgtttaatatttaaa

SEQ ID NO: 2619889 - DNA, 15 bp, Homo sapiens
cctcccctgccctgg

SEQ ID NO: 2619890 - DNA, 12 bp, Homo sapiens
cctccccttggg

SEQ ID NO: 2619891 - DNA, 16 bp, Homo sapiens
cctccccttgggcggc

SEQ ID NO: 2619892 - DNA, 21 bp, Homo sapiens
cctcccgaatagctgggacta

SEQ ID NO: 2619893 - DNA, 20 bp, Homo sapiens
cctcccgagtagctgggact

SEQ ID NO: 2619894 - DNA, 21 bp, Homo sapiens
cctcccgagtagctgggacta

SEQ ID NO: 2619895 - DNA, 21 bp, Homo sapiens
cctcccgggccctcccttgga

SEQ ID NO: 2619896 - DNA, 15 bp, Homo sapiens
cctccctagccagca

SEQ ID NO: 2619897 - DNA, 21 bp, Homo sapiens
cctccctagccagcacttgta

SEQ ID NO: 2619898 - DNA, 16 bp, Homo sapiens
cctccctcagcccctc

SEQ ID NO: 2619899 - DNA, 19 bp, Homo sapiens
cctccctcccggcatggga

SEQ ID NO: 2619900 - DNA, 22 bp, Homo sapiens
cctccctctctcttctgctcca

SEQ ID NO: 2619901 - DNA, 18 bp, Homo sapiens
cctccctctgacctgcag

SEQ ID NO: 2619902 - DNA, 19 bp, Homo sapiens
cctccctctgacctgcagg

SEQ ID NO: 2619903 - DNA, 13 bp, Homo sapiens
cctccctggagtg

SEQ ID NO: 2619904 - DNA, 17 bp, Homo sapiens
cctccctggctgccctg

SEQ ID NO: 2619905 - DNA, 21 bp, Homo sapiens
cctccctggctgccctggccc

SEQ ID NO: 2619906 - DNA, 19 bp, Homo sapiens
cctcccttggaaacctgcc

SEQ ID NO: 2619907 - DNA, 18 bp, Homo sapiens
cctccctttttccttgtc

SEQ ID NO: 2619908 - DNA, 19 bp, Homo sapiens
cctccgatccttcctccca

SEQ ID NO: 2619909 - DNA, 14 bp, Homo sapiens
cctccgccaggcga

SEQ ID NO: 2619910 - DNA, 23 bp, Homo sapiens
cctccgccattctcaagccctgc

SEQ ID NO: 2619911 - DNA, 13 bp, Homo sapiens
cctccgcctcttg

SEQ ID NO: 2619912 - DNA, 16 bp, Homo sapiens
cctccggcctcccctc

SEQ ID NO: 2619913 - DNA, 20 bp, Homo sapiens
cctccggcgtcagcctccag

SEQ ID NO: 2619914 - DNA, 22 bp, Homo sapiens
cctccggcgtcagcctccagcc

SEQ ID NO: 2619915 - DNA, 23 bp, Homo sapiens
cctccggcgtcagcctccagcct

SEQ ID NO: 2619916 - DNA, 18 bp, Homo sapiens
cctccgtccaggagcctg

SEQ ID NO: 2619917 - DNA, 16 bp, Homo sapiens
cctcctaccctgcgcc

SEQ ID NO: 2619918 - DNA, 18 bp, Homo sapiens
cctcctatcacctcccct

SEQ ID NO: 2619919 - DNA, 12 bp, Homo sapiens
cctcctcacctc

SEQ ID NO: 2619920 - DNA, 23 bp, Homo sapiens
cctcctcatctgggggagtggaa

SEQ ID NO: 2619921 - DNA, 19 bp, Homo sapiens
cctcctccaaaggccccct

SEQ ID NO: 2619922 - DNA, 21 bp, Homo sapiens
cctcctccagccgccatgctc

SEQ ID NO: 2619923 - DNA, 18 bp, Homo sapiens
cctcctccctcctgccga

SEQ ID NO: 2619924 - DNA, 21 bp, Homo sapiens
cctcctccttcccaaaggact

SEQ ID NO: 2619925 - DNA, 13 bp, Homo sapiens
cctcctctcccat

SEQ ID NO: 2619926 - DNA, 15 bp, Homo sapiens
cctcctctcccatcc

SEQ ID NO: 2619927 - DNA, 18 bp, Homo sapiens
cctcctctgtccagggcc

SEQ ID NO: 2619928 - DNA, 16 bp, Homo sapiens
cctcctctgtctgccc

SEQ ID NO: 2619929 - DNA, 12 bp, Homo sapiens
cctcctctgtga

SEQ ID NO: 2619930 - DNA, 21 bp, Homo sapiens
cctcctgaaacttacacacaa

SEQ ID NO: 2619931 - DNA, 12 bp, Homo sapiens
cctcctgagaaa

SEQ ID NO: 2619932 - DNA, 14 bp, Homo sapiens
cctcctgcccacct

SEQ ID NO: 2619933 - DNA, 18 bp, Homo sapiens
cctcctgccgactcctgg

SEQ ID NO: 2619934 - DNA, 12 bp, Homo sapiens
cctcctgcctcc

SEQ ID NO: 2619935 - DNA, 23 bp, Homo sapiens
cctcctgcctcgaactggctgca

SEQ ID NO: 2619936 - DNA, 20 bp, Homo sapiens
cctcctgcgcgcatgtgcgc

SEQ ID NO: 2619937 - DNA, 15 bp, Homo sapiens
cctcctgctactctg

SEQ ID NO: 2619938 - DNA, 11 bp, Homo sapiens
cctcctgctca

SEQ ID NO: 2619939 - DNA, 21 bp, Homo sapiens
cctcctggacattttttcagt

SEQ ID NO: 2619940 - DNA, 21 bp, Homo sapiens
cctcctggtgggtccaggggc

SEQ ID NO: 2619941 - DNA, 16 bp, Homo sapiens
cctcctgtcttcccag

SEQ ID NO: 2619942 - DNA, 17 bp, Homo sapiens
cctcctgtcttcccagg

SEQ ID NO: 2619943 - DNA, 18 bp, Homo sapiens
cctcctgtcttcccaggg

SEQ ID NO: 2619944 - DNA, 17 bp, Homo sapiens
cctcctgttgcacccag

SEQ ID NO: 2619945 - DNA, 16 bp, Homo sapiens
cctccttccacctccc

SEQ ID NO: 2619946 - DNA, 15 bp, Homo sapiens
cctccttctcccttt

SEQ ID NO: 2619947 - DNA, 17 bp, Homo sapiens
cctccttctcccttttt

SEQ ID NO: 2619948 - DNA, 14 bp, Homo sapiens
cctccttctctgtc

SEQ ID NO: 2619949 - DNA, 17 bp, Homo sapiens
cctccttctctgtctca

SEQ ID NO: 2619950 - DNA, 14 bp, Homo sapiens
cctccttgcctcct

SEQ ID NO: 2619951 - DNA, 18 bp, Homo sapiens
cctccttgctctgcaggc

SEQ ID NO: 2619952 - DNA, 20 bp, Homo sapiens
cctccttgggcactttttaa

SEQ ID NO: 2619953 - DNA, 16 bp, Homo sapiens
cctcctttctcttctc

SEQ ID NO: 2619954 - DNA, 20 bp, Homo sapiens
cctcctttctcttctctgtt

SEQ ID NO: 2619955 - DNA, 16 bp, Homo sapiens
cctcgagcagatgatg

SEQ ID NO: 2619956 - DNA, 12 bp, Homo sapiens
cctcggagaaga

SEQ ID NO: 2619957 - DNA, 15 bp, Homo sapiens
cctcgggcccacctg

SEQ ID NO: 2619958 - DNA, 19 bp, Homo sapiens
cctcgggcccacctggcca

SEQ ID NO: 2619959 - DNA, 22 bp, Homo sapiens
cctcgggcccacctggccacct

SEQ ID NO: 2619960 - DNA, 13 bp, Homo sapiens
cctcgggcccagc

SEQ ID NO: 2619961 - DNA, 14 bp, Homo sapiens
cctcgggcccagcc

SEQ ID NO: 2619962 - DNA, 14 bp, Homo sapiens
cctcgggtctcctc

SEQ ID NO: 2619963 - DNA, 13 bp, Homo sapiens
cctcgtggccagc

SEQ ID NO: 2619964 - DNA, 18 bp, Homo sapiens
cctcgtggccttccccag

SEQ ID NO: 2619965 - DNA, 23 bp, Homo sapiens
cctcgtggccttccccagcctct

SEQ ID NO: 2619966 - DNA, 23 bp, Homo sapiens
cctctaaagcaataatggtccca

SEQ ID NO: 2619967 - DNA, 18 bp, Homo sapiens
cctctaaccccaggcccc

SEQ ID NO: 2619968 - DNA, 19 bp, Homo sapiens
cctctaagccactcttcca

SEQ ID NO: 2619969 - DNA, 21 bp, Homo sapiens
cctctacagagcttccctgac

SEQ ID NO: 2619970 - DNA, 17 bp, Homo sapiens
cctctagaaatttttca

SEQ ID NO: 2619971 - DNA, 14 bp, Homo sapiens
cctctagaggcaag

SEQ ID NO: 2619972 - DNA, 12 bp, Homo sapiens
cctctagggacc

SEQ ID NO: 2619973 - DNA, 19 bp, Homo sapiens
cctctatgaactatggacg

SEQ ID NO: 2619974 - DNA, 23 bp, Homo sapiens
cctctattgatgtacagtctgtc

SEQ ID NO: 2619975 - DNA, 16 bp, Homo sapiens
cctctatttagcatga

SEQ ID NO: 2619976 - DNA, 12 bp, Homo sapiens
cctctcactgtc

SEQ ID NO: 2619977 - DNA, 14 bp, Homo sapiens
cctctcactgtctg

SEQ ID NO: 2619978 - DNA, 14 bp, Homo sapiens
cctctcagagctac

SEQ ID NO: 2619979 - DNA, 23 bp, Homo sapiens
cctctcagagctacttgggccat

SEQ ID NO: 2619980 - DNA, 22 bp, Homo sapiens
cctctccaagggcttctgcacc

SEQ ID NO: 2619981 - DNA, 23 bp, Homo sapiens
cctctccaagggcttctgcaccc

SEQ ID NO: 2619982 - DNA, 11 bp, Homo sapiens
cctctccaggc

SEQ ID NO: 2619983 - DNA, 12 bp, Homo sapiens
cctctccaggca

SEQ ID NO: 2619984 - DNA, 14 bp, Homo sapiens
cctctcccaggacc

SEQ ID NO: 2619985 - DNA, 12 bp, Homo sapiens
cctctcccaggg

SEQ ID NO: 2619986 - DNA, 13 bp, Homo sapiens
cctctcccatccc

SEQ ID NO: 2619987 - DNA, 14 bp, Homo sapiens
cctctcccatcccc

SEQ ID NO: 2619988 - DNA, 17 bp, Homo sapiens
cctctcccatccccctg

SEQ ID NO: 2619989 - DNA, 20 bp, Homo sapiens
cctctcccatccccctgccc

SEQ ID NO: 2619990 - DNA, 22 bp, Homo sapiens
cctctcccgccagactgttaga

SEQ ID NO: 2619991 - DNA, 19 bp, Homo sapiens
cctctcccgtcagggccca

SEQ ID NO: 2619992 - DNA, 23 bp, Homo sapiens
cctctcccgtcagggcccaagtc

SEQ ID NO: 2619993 - DNA, 22 bp, Homo sapiens
cctctccctcaacaagggagag

SEQ ID NO: 2619994 - DNA, 18 bp, Homo sapiens
cctctcctcatgttctgc

SEQ ID NO: 2619995 - DNA, 21 bp, Homo sapiens
cctctccttgtggcctgggcc

SEQ ID NO: 2619996 - DNA, 18 bp, Homo sapiens
cctctcctttgtatatta

SEQ ID NO: 2619997 - DNA, 22 bp, Homo sapiens
cctctcctttgtatattatttc

SEQ ID NO: 2619998 - DNA, 17 bp, Homo sapiens
cctctcggaaggctggc

SEQ ID NO: 2619999 - DNA, 21 bp, Homo sapiens
cctctcggaaggctggctggg

SEQ ID NO: 2620000 - DNA, 14 bp, Homo sapiens
cctctctcccagtc

SEQ ID NO: 2620001 - DNA, 13 bp, Homo sapiens
cctctctctgact

SEQ ID NO: 2620002 - DNA, 14 bp, Homo sapiens
cctctctctgactc

SEQ ID NO: 2620003 - DNA, 16 bp, Homo sapiens
cctctctcttctgctc

SEQ ID NO: 2620004 - DNA, 18 bp, Homo sapiens
cctctctcttctgctcca

SEQ ID NO: 2620005 - DNA, 21 bp, Homo sapiens
cctctctcttctgctccaccc

SEQ ID NO: 2620006 - DNA, 22 bp, Homo sapiens
cctctctcttctgctccaccct

SEQ ID NO: 2620007 - DNA, 12 bp, Homo sapiens
cctctctgcacc

SEQ ID NO: 2620008 - DNA, 16 bp, Homo sapiens
cctctctgcatctgac

SEQ ID NO: 2620009 - DNA, 22 bp, Homo sapiens
cctctctgccgcaatacaggaa

SEQ ID NO: 2620010 - DNA, 15 bp, Homo sapiens
cctctctgctctgcg

SEQ ID NO: 2620011 - DNA, 17 bp, Homo sapiens
cctctctggcctcccac

SEQ ID NO: 2620012 - DNA, 22 bp, Homo sapiens
cctctctggcctcccacccgat

SEQ ID NO: 2620013 - DNA, 17 bp, Homo sapiens
cctctcttgcacccgcc

SEQ ID NO: 2620014 - DNA, 18 bp, Homo sapiens
cctctcttgcacccgcct

SEQ ID NO: 2620015 - DNA, 21 bp, Homo sapiens
cctctcttgcacccgcctctc

SEQ ID NO: 2620016 - DNA, 21 bp, Homo sapiens
cctctcttggtttccttcctt

SEQ ID NO: 2620017 - DNA, 23 bp, Homo sapiens
cctctgaaaaccaatgttctctc

SEQ ID NO: 2620018 - DNA, 14 bp, Homo sapiens
cctctgacacacag

SEQ ID NO: 2620019 - DNA, 15 bp, Homo sapiens
cctctgacacacagc

SEQ ID NO: 2620020 - DNA, 18 bp, Homo sapiens
cctctgacacacagctct

SEQ ID NO: 2620021 - DNA, 14 bp, Homo sapiens
cctctgacctgcac

SEQ ID NO: 2620022 - DNA, 17 bp, Homo sapiens
cctctgacctgcactgg

SEQ ID NO: 2620023 - DNA, 16 bp, Homo sapiens
cctctgacctgcaggc

SEQ ID NO: 2620024 - DNA, 17 bp, Homo sapiens
cctctgacctgcaggcc

SEQ ID NO: 2620025 - DNA, 11 bp, Homo sapiens
cctctgaggct

SEQ ID NO: 2620026 - DNA, 18 bp, Homo sapiens
cctctgaggctggatcct

SEQ ID NO: 2620027 - DNA, 22 bp, Homo sapiens
cctctgagggaaagcccagaaa

SEQ ID NO: 2620028 - DNA, 15 bp, Homo sapiens
cctctgcacaagctg

SEQ ID NO: 2620029 - DNA, 19 bp, Homo sapiens
cctctgcacaagctgcacc

SEQ ID NO: 2620030 - DNA, 14 bp, Homo sapiens
cctctgcactcccc

SEQ ID NO: 2620031 - DNA, 14 bp, Homo sapiens
cctctgcagcaata

SEQ ID NO: 2620032 - DNA, 12 bp, Homo sapiens
cctctgcagctg

SEQ ID NO: 2620033 - DNA, 16 bp, Homo sapiens
cctctgcagctgacct

SEQ ID NO: 2620034 - DNA, 20 bp, Homo sapiens
cctggtacccagccatctgc

SEQ ID NO: 2620035 - DNA, 22 bp, Homo sapiens
cctggtacccagccatctgccc

SEQ ID NO: 2620036 - DNA, 14 bp, Homo sapiens
cctggtaccctcct

SEQ ID NO: 2620037 - DNA, 18 bp, Homo sapiens
cctggtatatccaaaagc

SEQ ID NO: 2620038 - DNA, 20 bp, Homo sapiens
cctggtatatccaaaagctt

SEQ ID NO: 2620039 - DNA, 21 bp, Homo sapiens
cctggtccagggaagctggcc

SEQ ID NO: 2620040 - DNA, 14 bp, Homo sapiens
cctggtcctgaggg

SEQ ID NO: 2620041 - DNA, 15 bp, Homo sapiens
cctggtccttccagg

SEQ ID NO: 2620042 - DNA, 13 bp, Homo sapiens
cctggtctctggt

SEQ ID NO: 2620043 - DNA, 14 bp, Homo sapiens
cctggtctgtagaa

SEQ ID NO: 2620044 - DNA, 9 bp, Homo sapiens
cctggtgct

SEQ ID NO: 2620045 - DNA, 20 bp, Homo sapiens
cctggtgctgcctctacctg

SEQ ID NO: 2620046 - DNA, 12 bp, Homo sapiens
cctggtgctgct

SEQ ID NO: 2620047 - DNA, 14 bp, Homo sapiens
cctggtggacagtc

SEQ ID NO: 2620048 - DNA, 13 bp, Homo sapiens
cctggtggcagct

SEQ ID NO: 2620049 - DNA, 18 bp, Homo sapiens
cctggtggcagctcacct

SEQ ID NO: 2620050 - DNA, 16 bp, Homo sapiens
cctggtggcagctgcg

SEQ ID NO: 2620051 - DNA, 14 bp, Homo sapiens
cctggtggcagtgg

SEQ ID NO: 2620052 - DNA, 15 bp, Homo sapiens
cctggtggcagtggg

SEQ ID NO: 2620053 - DNA, 19 bp, Homo sapiens
cctggtggcagtgggagct

SEQ ID NO: 2620054 - DNA, 22 bp, Homo sapiens
cctggtgggtccaggggcccct

SEQ ID NO: 2620055 - DNA, 23 bp, Homo sapiens
cctggtgggtccaggggcccctc

SEQ ID NO: 2620056 - DNA, 23 bp, Homo sapiens
cctggtgtttctagcactggcct

SEQ ID NO: 2620057 - DNA, 22 bp, Homo sapiens
cctggttcccgtttctccacct

SEQ ID NO: 2620058 - DNA, 22 bp, Homo sapiens
cctggtttttaaatagagtttg

SEQ ID NO: 2620059 - DNA, 19 bp, Homo sapiens
cctgtaacatactggcctg

SEQ ID NO: 2620060 - DNA, 20 bp, Homo sapiens
cctgtaatcatataataaat

SEQ ID NO: 2620061 - DNA, 16 bp, Homo sapiens
cctgtaatcccagcac

SEQ ID NO: 2620062 - DNA, 21 bp, Homo sapiens
cctgtaatcccagcactttgg

SEQ ID NO: 2620063 - DNA, 18 bp, Homo sapiens
cctgtactgttctgtgtc

SEQ ID NO: 2620064 - DNA, 12 bp, Homo sapiens
cctgtacttttt

SEQ ID NO: 2620065 - DNA, 13 bp, Homo sapiens
cctgtagacctag

SEQ ID NO: 2620066 - DNA, 22 bp, Homo sapiens
cctgtagacctagggaggacct

SEQ ID NO: 2620067 - DNA, 16 bp, Homo sapiens
cctgtagagtgggagc

SEQ ID NO: 2620068 - DNA, 19 bp, Homo sapiens
cctgtagagtgggagctga

SEQ ID NO: 2620069 - DNA, 21 bp, Homo sapiens
cctgtagagtgggagctgagt

SEQ ID NO: 2620070 - DNA, 13 bp, Homo sapiens
cctgtagcagtga

SEQ ID NO: 2620071 - DNA, 21 bp, Homo sapiens
cctgtagcagtgagaaaaagc

SEQ ID NO: 2620072 - DNA, 14 bp, Homo sapiens
cctgtagttaggaa

SEQ ID NO: 2620073 - DNA, 19 bp, Homo sapiens
cctgtagttaggaaataaa

SEQ ID NO: 2620074 - DNA, 23 bp, Homo sapiens
cctgtagttaggaaataaaacct

SEQ ID NO: 2620075 - DNA, 23 bp, Homo sapiens
cctgtagttgcgtggactctgca

SEQ ID NO: 2620076 - DNA, 12 bp, Homo sapiens
cctgtatagtta

SEQ ID NO: 2620077 - DNA, 19 bp, Homo sapiens
cctgtatgcaacaggcact

SEQ ID NO: 2620078 - DNA, 13 bp, Homo sapiens
cctgtatgttgtc

SEQ ID NO: 2620079 - DNA, 17 bp, Homo sapiens
cctgtattttctttctc

SEQ ID NO: 2620080 - DNA, 19 bp, Homo sapiens
cctgtcaaacaaagccaga

SEQ ID NO: 2620081 - DNA, 20 bp, Homo sapiens
cctgtcaaacaaagccagaa

SEQ ID NO: 2620082 - DNA, 22 bp, Homo sapiens
cctgtcaaacaaagccagaagc

SEQ ID NO: 2620083 - DNA, 14 bp, Homo sapiens
cctgtcagtgcagc

SEQ ID NO: 2620084 - DNA, 16 bp, Homo sapiens
cctgtcagtgcagccc

SEQ ID NO: 2620085 - DNA, 19 bp, Homo sapiens
cctgtcagtgcagcccgtg

SEQ ID NO: 2620086 - DNA, 15 bp, Homo sapiens
cctgtcatgcccccc

SEQ ID NO: 2620087 - DNA, 19 bp, Homo sapiens
cctgtcatgcccccctcaa

SEQ ID NO: 2620088 - DNA, 17 bp, Homo sapiens
cctgtccaaactgccta

SEQ ID NO: 2620089 - DNA, 13 bp, Homo sapiens
cctgtccagagag

SEQ ID NO: 2620090 - DNA, 12 bp, Homo sapiens
cctgtccagcct

SEQ ID NO: 2620091 - DNA, 17 bp, Homo sapiens
cctgtcccacccccacc

SEQ ID NO: 2620092 - DNA, 16 bp, Homo sapiens
cctgtcccacctcttc

SEQ ID NO: 2620093 - DNA, 19 bp, Homo sapiens
cctgtcccatggacactcc

SEQ ID NO: 2620094 - DNA, 13 bp, Homo sapiens
cctgtccccctga

SEQ ID NO: 2620095 - DNA, 15 bp, Homo sapiens
cctgtccccctgaca

SEQ ID NO: 2620096 - DNA, 16 bp, Homo sapiens
cctgtccccctgacaa

SEQ ID NO: 2620097 - DNA, 22 bp, Homo sapiens
cctgtccctctcaggcatgcct

SEQ ID NO: 2620098 - DNA, 14 bp, Homo sapiens
cctgtcctcctggt

SEQ ID NO: 2620099 - DNA, 23 bp, Homo sapiens
cctgtcctgatggtcagctccct

SEQ ID NO: 2620100 - DNA, 12 bp, Homo sapiens
cctgtccttgca

SEQ ID NO: 2620101 - DNA, 17 bp, Homo sapiens
cctgtcgagacacttgc

SEQ ID NO: 2620102 - DNA, 20 bp, Homo sapiens
cctgtcgagacacttgcctt

SEQ ID NO: 2620103 - DNA, 18 bp, Homo sapiens
cctgtctcatccccaggg

SEQ ID NO: 2620104 - DNA, 20 bp, Homo sapiens
cctgtctcatccccaggggt

SEQ ID NO: 2620105 - DNA, 13 bp, Homo sapiens
cctgtctcctttc

SEQ ID NO: 2620106 - DNA, 21 bp, Homo sapiens
cctgtctctagccactttggt

SEQ ID NO: 2620107 - DNA, 14 bp, Homo sapiens
cctgtctcttccat

SEQ ID NO: 2620108 - DNA, 22 bp, Homo sapiens
cctgtctcttccatatgacctc

SEQ ID NO: 2620109 - DNA, 16 bp, Homo sapiens
cctgtctgccagccag

SEQ ID NO: 2620110 - DNA, 20 bp, Homo sapiens
cctgtctgtagagggccctg

SEQ ID NO: 2620111 - DNA, 21 bp, Homo sapiens
cctgtctgtagagggccctgg

SEQ ID NO: 2620112 - DNA, 22 bp, Homo sapiens
cctgtctgtagagggccctggt

SEQ ID NO: 2620113 - DNA, 21 bp, Homo sapiens
cctgtctgtctctccatctgt

SEQ ID NO: 2620114 - DNA, 17 bp, Homo sapiens
cctgtctgttacactgg

SEQ ID NO: 2620115 - DNA, 17 bp, Homo sapiens
cctgtctttaaggaaaa

SEQ ID NO: 2620116 - DNA, 19 bp, Homo sapiens
cctgtgaggtgcagagtgc

SEQ ID NO: 2620117 - DNA, 23 bp, Homo sapiens
cctgtgaggtgcagagtgcccag

SEQ ID NO: 2620118 - DNA, 19 bp, Homo sapiens
cctgtgatggggccctgcc

SEQ ID NO: 2620119 - DNA, 14 bp, Homo sapiens
cctgtgcatgtatg

SEQ ID NO: 2620120 - DNA, 19 bp, Homo sapiens
cctgtgccacccaccaggg

SEQ ID NO: 2620121 - DNA, 20 bp, Homo sapiens
cctgtgcctcctcaccccca

SEQ ID NO: 2620122 - DNA, 15 bp, Homo sapiens
cctgtgctactttgc

SEQ ID NO: 2620123 - DNA, 17 bp, Homo sapiens
cctgtgctactttgcct

SEQ ID NO: 2620124 - DNA, 19 bp, Homo sapiens
cctgtgctactttgccttt

SEQ ID NO: 2620125 - DNA, 18 bp, Homo sapiens
cctgtgctgacggaagcc

SEQ ID NO: 2620126 - DNA, 23 bp, Homo sapiens
cctgtgctgcccgtcttcagcct

SEQ ID NO: 2620127 - DNA, 17 bp, Homo sapiens
cctgtgctggtgtcctg

SEQ ID NO: 2620128 - DNA, 22 bp, Homo sapiens
cctgtgctggtgtcctgaccac

SEQ ID NO: 2620129 - DNA, 23 bp, Homo sapiens
cctgtgctggtgtcctgaccacc

SEQ ID NO: 2620130 - DNA, 24 bp, Homo sapiens
cctgtgctggtgtcctgaccaccc

SEQ ID NO: 2620131 - DNA, 19 bp, Homo sapiens
cctgtggaatctggagtga

SEQ ID NO: 2620132 - DNA, 22 bp, Homo sapiens
cctgtggcaggcagcgccaagc

SEQ ID NO: 2620133 - DNA, 13 bp, Homo sapiens
cctgtggcctgtg

SEQ ID NO: 2620134 - DNA, 21 bp, Homo sapiens
cctgtggcctgtgtcccatga

SEQ ID NO: 2620135 - DNA, 19 bp, Homo sapiens
cctgtggggatttctccca

SEQ ID NO: 2620136 - DNA, 21 bp, Homo sapiens
cctgtgtaatcatttcttggg

SEQ ID NO: 2620137 - DNA, 21 bp, Homo sapiens
cctgtgtcccatgacccaccc

SEQ ID NO: 2620138 - DNA, 21 bp, Homo sapiens
cctgttaaaagatgaaaatat

SEQ ID NO: 2620139 - DNA, 14 bp, Homo sapiens
cctgttacttacct

SEQ ID NO: 2620140 - DNA, 14 bp, Homo sapiens
cctgttcagctcca

SEQ ID NO: 2620141 - DNA, 15 bp, Homo sapiens
cctgttcagctccag

SEQ ID NO: 2620142 - DNA, 16 bp, Homo sapiens
cctgttcagctccagc

SEQ ID NO: 2620143 - DNA, 20 bp, Homo sapiens
cctgttcagctccagctcac

SEQ ID NO: 2620144 - DNA, 18 bp, Homo sapiens
cctgttcccctcactgga

SEQ ID NO: 2620145 - DNA, 20 bp, Homo sapiens
cctgttgacgaagtctcttt

SEQ ID NO: 2620146 - DNA, 15 bp, Homo sapiens
cctgttgcacccagc

SEQ ID NO: 2620147 - DNA, 16 bp, Homo sapiens
cctgttgcacccagcc

SEQ ID NO: 2620148 - DNA, 20 bp, Homo sapiens
cctgttgcacccagccctgg

SEQ ID NO: 2620149 - DNA, 21 bp, Homo sapiens
cctgttgcacccagccctggt

SEQ ID NO: 2620150 - DNA, 23 bp, Homo sapiens
cctgttgcacccagccctggtct

SEQ ID NO: 2620151 - DNA, 19 bp, Homo sapiens
cctgttggacccgctctgg

SEQ ID NO: 2620152 - DNA, 23 bp, Homo sapiens
cctgttggacccgctctggacca

SEQ ID NO: 2620153 - DNA, 17 bp, Homo sapiens
cctgttggatttgttta

SEQ ID NO: 2620154 - DNA, 17 bp, Homo sapiens
cctgttggttccaagcc

SEQ ID NO: 2620155 - DNA, 22 bp, Homo sapiens
cctgttggttccaagccctgga

SEQ ID NO: 2620156 - DNA, 14 bp, Homo sapiens
cctgtttaatattt

SEQ ID NO: 2620157 - DNA, 21 bp, Homo sapiens
cctgtttgggcccctctccca

SEQ ID NO: 2620158 - DNA, 14 bp, Homo sapiens
cctgtttgtttctg

SEQ ID NO: 2620159 - DNA, 15 bp, Homo sapiens
cctgttttctgagcc

SEQ ID NO: 2620160 - DNA, 17 bp, Homo sapiens
cctgtttttaagctgtt

SEQ ID NO: 2620161 - DNA, 19 bp, Homo sapiens
cctgtttttaagctgtttc

SEQ ID NO: 2620162 - DNA, 13 bp, Homo sapiens
cctgtttttcaca

SEQ ID NO: 2620163 - DNA, 16 bp, Homo sapiens
cctgtttttcacattt

SEQ ID NO: 2620164 - DNA, 15 bp, Homo sapiens
cctgtttttctgggt

SEQ ID NO: 2620165 - DNA, 23 bp, Homo sapiens
ccttaaacagggcatctccagga

SEQ ID NO: 2620166 - DNA, 22 bp, Homo sapiens
ccttaaagtcagtaacttaccc

SEQ ID NO: 2620167 - DNA, 20 bp, Homo sapiens
ccttaaggacaaaaatgaac

SEQ ID NO: 2620168 - DNA, 22 bp, Homo sapiens
ccttacacgtacctctcatcag

SEQ ID NO: 2620169 - DNA, 13 bp, Homo sapiens
ccttacacttact

SEQ ID NO: 2620170 - DNA, 16 bp, Homo sapiens
ccttacacttactgtt

SEQ ID NO: 2620171 - DNA, 21 bp, Homo sapiens
ccttacagtaggagcccagct

SEQ ID NO: 2620172 - DNA, 18 bp, Homo sapiens
ccttaccaactttctgta

SEQ ID NO: 2620173 - DNA, 19 bp, Homo sapiens
ccttaccaactttctgtaa

SEQ ID NO: 2620174 - DNA, 14 bp, Homo sapiens
ccttaccagcagag

SEQ ID NO: 2620175 - DNA, 17 bp, Homo sapiens
ccttaccagcagagcac

SEQ ID NO: 2620176 - DNA, 20 bp, Homo sapiens
ccttaccagcagagcacctt

SEQ ID NO: 2620177 - DNA, 21 bp, Homo sapiens
cgtaatgcttagagaatgttc

SEQ ID NO: 2620178 - DNA, 17 bp, Homo sapiens
cgtacattcaatgttta

SEQ ID NO: 2620179 - DNA, 13 bp, Homo sapiens
cgtaccccaccct

SEQ ID NO: 2620180 - DNA, 18 bp, Homo sapiens
cgtagatcaccagaataa

SEQ ID NO: 2620181 - DNA, 21 bp, Homo sapiens
cgtagattcccatcatacact

SEQ ID NO: 2620182 - DNA, 15 bp, Homo sapiens
cgtatgtaaatgtat

SEQ ID NO: 2620183 - DNA, 20 bp, Homo sapiens
cgtcaccatctcaggccacc

SEQ ID NO: 2620184 - DNA, 20 bp, Homo sapiens
cgtcatggcttaatgtttat

SEQ ID NO: 2620185 - DNA, 19 bp, Homo sapiens
cgtccaggagcctgtgcct

SEQ ID NO: 2620186 - DNA, 12 bp, Homo sapiens
cgtccgccctgc

SEQ ID NO: 2620187 - DNA, 19 bp, Homo sapiens
cgtccgccctgctcctccc

SEQ ID NO: 2620188 - DNA, 20 bp, Homo sapiens
cgtccggcagttctgggtgc

SEQ ID NO: 2620189 - DNA, 16 bp, Homo sapiens
cgtcctcccgggccct

SEQ ID NO: 2620190 - DNA, 17 bp, Homo sapiens
cgtcctcccgggccctc

SEQ ID NO: 2620191 - DNA, 16 bp, Homo sapiens
cgtcgaggggctctca

SEQ ID NO: 2620192 - DNA, 14 bp, Homo sapiens
cgtctacctgaggg

SEQ ID NO: 2620193 - DNA, 17 bp, Homo sapiens
cgtctcaacccctcaca

SEQ ID NO: 2620194 - DNA, 11 bp, Homo sapiens
cgtctcagtgt

SEQ ID NO: 2620195 - DNA, 13 bp, Homo sapiens
cgtctctctccca

SEQ ID NO: 2620196 - DNA, 14 bp, Homo sapiens
cgtctctctcccat

SEQ ID NO: 2620197 - DNA, 23 bp, Homo sapiens
cgtctctctcccatggagcccca

SEQ ID NO: 2620198 - DNA, 21 bp, Homo sapiens
cgtctgacaggcaatgctggc

SEQ ID NO: 2620199 - DNA, 22 bp, Homo sapiens
cgtctgacaggcaatgctggct

SEQ ID NO: 2620200 - DNA, 14 bp, Homo sapiens
cgtctgggagaaat

SEQ ID NO: 2620201 - DNA, 22 bp, Homo sapiens
cgtctgggagaaattgacagat

SEQ ID NO: 2620202 - DNA, 20 bp, Homo sapiens
cgtcttagcaagaagtaaaa

SEQ ID NO: 2620203 - DNA, 13 bp, Homo sapiens
cgtcttcagccta

SEQ ID NO: 2620204 - DNA, 12 bp, Homo sapiens
cgtcttcattaa

SEQ ID NO: 2620205 - DNA, 14 bp, Homo sapiens
cgtcttgcttggga

SEQ ID NO: 2620206 - DNA, 15 bp, Homo sapiens
cgtgaaacacaccag

SEQ ID NO: 2620207 - DNA, 20 bp, Homo sapiens
cgtgaaacacaccaggctgt

SEQ ID NO: 2620208 - DNA, 19 bp, Homo sapiens
cgtgaaggccgagaagcaa

SEQ ID NO: 2620209 - DNA, 12 bp, Homo sapiens
cgtgacaacact

SEQ ID NO: 2620210 - DNA, 15 bp, Homo sapiens
cgtgacagactcctg

SEQ ID NO: 2620211 - DNA, 16 bp, Homo sapiens
cgtgacagactcctga

SEQ ID NO: 2620212 - DNA, 17 bp, Homo sapiens
cgtgacagtgcctggga

SEQ ID NO: 2620213 - DNA, 16 bp, Homo sapiens
cgtgacgctgaataaa

SEQ ID NO: 2620214 - DNA, 20 bp, Homo sapiens
cgtgacgctgaataaatgtc

SEQ ID NO: 2620215 - DNA, 14 bp, Homo sapiens
cgtgagccaccgcg

SEQ ID NO: 2620216 - DNA, 15 bp, Homo sapiens
cgtgagccactgcac

SEQ ID NO: 2620217 - DNA, 20 bp, Homo sapiens
cgtgagccactgcaccgggc

SEQ ID NO: 2620218 - DNA, 14 bp, Homo sapiens
cgtgagttctcagg

SEQ ID NO: 2620219 - DNA, 15 bp, Homo sapiens
cgtgagttctcaggg

SEQ ID NO: 2620220 - DNA, 22 bp, Homo sapiens
cgtgatctcggctcactgcaac

SEQ ID NO: 2620221 - DNA, 13 bp, Homo sapiens
cgtgatcttggct

SEQ ID NO: 2620222 - DNA, 14 bp, Homo sapiens
cgtgcacacaccag

SEQ ID NO: 2620223 - DNA, 19 bp, Homo sapiens
cgtgcacacaccagagccc

SEQ ID NO: 2620224 - DNA, 20 bp, Homo sapiens
cgtgcacacaccagagccca

SEQ ID NO: 2620225 - DNA, 22 bp, Homo sapiens
cgtgcacacaccagagcccacc

SEQ ID NO: 2620226 - DNA, 17 bp, Homo sapiens
cgtgcacgtggagagct

SEQ ID NO: 2620227 - DNA, 20 bp, Homo sapiens
cgtgcacgtggagagctggt

SEQ ID NO: 2620228 - DNA, 18 bp, Homo sapiens
cgtgcataccacttttgt

SEQ ID NO: 2620229 - DNA, 19 bp, Homo sapiens
cgtgcataccacttttgtt

SEQ ID NO: 2620230 - DNA, 13 bp, Homo sapiens
cgtgcatgtgcac

SEQ ID NO: 2620231 - DNA, 13 bp, Homo sapiens
cgtgcctccacca

SEQ ID NO: 2620232 - DNA, 18 bp, Homo sapiens
cgtgcctccaccaccact

SEQ ID NO: 2620233 - DNA, 20 bp, Homo sapiens
cgtgcctccttccacctccc

SEQ ID NO: 2620234 - DNA, 20 bp, Homo sapiens
cgtgccttttgcacccctcc

SEQ ID NO: 2620235 - DNA, 21 bp, Homo sapiens
cgtgccttttgcacccctccc

SEQ ID NO: 2620236 - DNA, 18 bp, Homo sapiens
cgtgcttagcctcctgac

SEQ ID NO: 2620237 - DNA, 15 bp, Homo sapiens
cgtggaaagggtgct

SEQ ID NO: 2620238 - DNA, 14 bp, Homo sapiens
cgtggaccttcctg

SEQ ID NO: 2620239 - DNA, 16 bp, Homo sapiens
cgtggactctgcacat

SEQ ID NO: 2620240 - DNA, 15 bp, Homo sapiens
cgtggagatgtcttc

SEQ ID NO: 2620241 - DNA, 17 bp, Homo sapiens
cgtggagcagaatcagt

SEQ ID NO: 2620242 - DNA, 16 bp, Homo sapiens
cgtggaggagcagtgc

SEQ ID NO: 2620243 - DNA, 22 bp, Homo sapiens
cgtggaggagcagtgcaggcac

SEQ ID NO: 2620244 - DNA, 20 bp, Homo sapiens
cgtggcagataatcagcctc

SEQ ID NO: 2620245 - DNA, 20 bp, Homo sapiens
cgtggcatgtggcctgtggc

SEQ ID NO: 2620246 - DNA, 13 bp, Homo sapiens
cgtggccagcccg

SEQ ID NO: 2620247 - DNA, 15 bp, Homo sapiens
cgtggccagcccggc

SEQ ID NO: 2620248 - DNA, 15 bp, Homo sapiens
cgtggcccagagaag

SEQ ID NO: 2620249 - DNA, 20 bp, Homo sapiens
cgtggccttccccagcctct

SEQ ID NO: 2620250 - DNA, 22 bp, Homo sapiens
cgtgggaacccccctcccaccc

SEQ ID NO: 2620251 - DNA, 17 bp, Homo sapiens
cgtgggagagagacgtg

SEQ ID NO: 2620252 - DNA, 20 bp, Homo sapiens
cgtgggaggcgggagtggag

SEQ ID NO: 2620253 - DNA, 18 bp, Homo sapiens
cgtgggtctgttttcctt

SEQ ID NO: 2620254 - DNA, 23 bp, Homo sapiens
cgtgggtgtgtgtagccaaggtc

SEQ ID NO: 2620255 - DNA, 21 bp, Homo sapiens
cgtggtgatcaattaaatgta

SEQ ID NO: 2620256 - DNA, 21 bp, Homo sapiens
cgtggtggaagaggggacagg

SEQ ID NO: 2620257 - DNA, 15 bp, Homo sapiens
cgtgtaaaccaaagc

SEQ ID NO: 2620258 - DNA, 15 bp, Homo sapiens
cgtgtcgtgggtgtg

SEQ ID NO: 2620259 - DNA, 18 bp, Homo sapiens
cgtgtgcacacacaccac

SEQ ID NO: 2620260 - DNA, 16 bp, Homo sapiens
cgtgtgcgtgcatgtg

SEQ ID NO: 2620261 - DNA, 19 bp, Homo sapiens
cgtgtgtacacgggactga

SEQ ID NO: 2620262 - DNA, 16 bp, Homo sapiens
cgtgttctccttttcc

SEQ ID NO: 2620263 - DNA, 15 bp, Homo sapiens
cgtgttgccttgaac

SEQ ID NO: 2620264 - DNA, 15 bp, Homo sapiens
cgtgtttctgactct

SEQ ID NO: 2620265 - DNA, 20 bp, Homo sapiens
cgtgtttctgactctgagct

SEQ ID NO: 2620266 - DNA, 13 bp, Homo sapiens
cgttaaaatacca

SEQ ID NO: 2620267 - DNA, 21 bp, Homo sapiens
cgttccagccggcatggctgg

SEQ ID NO: 2620268 - DNA, 20 bp, Homo sapiens
cgttccatgatgctgggatt

SEQ ID NO: 2620269 - DNA, 15 bp, Homo sapiens
cgttctcacacccac

SEQ ID NO: 2620270 - DNA, 17 bp, Homo sapiens
cgttctgctggcctgga

SEQ ID NO: 2620271 - DNA, 18 bp, Homo sapiens
cgttgaagaggaagggca

SEQ ID NO: 2620272 - DNA, 16 bp, Homo sapiens
cgttgaggatgaggcc

SEQ ID NO: 2620273 - DNA, 11 bp, Homo sapiens
cgttgtgaggg

SEQ ID NO: 2620274 - DNA, 22 bp, Homo sapiens
cgtttaagactgtaatgaatct

SEQ ID NO: 2620275 - DNA, 14 bp, Homo sapiens
cgtttattttcaag

SEQ ID NO: 2620276 - DNA, 15 bp, Homo sapiens
cgtttcaaaaacaca

SEQ ID NO: 2620277 - DNA, 18 bp, Homo sapiens
cgtttctccacctagact

SEQ ID NO: 2620278 - DNA, 13 bp, Homo sapiens
cgtttcttccctg

SEQ ID NO: 2620279 - DNA, 23 bp, Homo sapiens
cgttttgtgtggtggcacctcct

SEQ ID NO: 2620280 - DNA, 16 bp, Homo sapiens
cgtttttggtggagtc

SEQ ID NO: 2620281 - DNA, 17 bp, Homo sapiens
ctaaaaaacagaggcca

SEQ ID NO: 2620282 - DNA, 22 bp, Homo sapiens
ctaaaaaacataaatttcttta

SEQ ID NO: 2620283 - DNA, 13 bp, Homo sapiens
ctaaaaatgcaac

SEQ ID NO: 2620284 - DNA, 20 bp, Homo sapiens
ctaaaacaaaagctcatcca

SEQ ID NO: 2620285 - DNA, 18 bp, Homo sapiens
ctaaaagagatttcaaga

SEQ ID NO: 2620286 - DNA, 16 bp, Homo sapiens
ctaaaaggttcaggga

SEQ ID NO: 2620287 - DNA, 22 bp, Homo sapiens
ctaaaataagggcagagtcaca

SEQ ID NO: 2620288 - DNA, 19 bp, Homo sapiens
ctaaaatagccacttacct

SEQ ID NO: 2620289 - DNA, 23 bp, Homo sapiens
ctaaaatatttattttttttaag

SEQ ID NO: 2620290 - DNA, 17 bp, Homo sapiens
ctaaaatttttaaggac

SEQ ID NO: 2620291 - DNA, 21 bp, Homo sapiens
ctaaacaagaatcagtctatc

SEQ ID NO: 2620292 - DNA, 17 bp, Homo sapiens
ctaaacagatataaatg

SEQ ID NO: 2620293 - DNA, 14 bp, Homo sapiens
ctaaactatctttt

SEQ ID NO: 2620294 - DNA, 13 bp, Homo sapiens
ctaaactttcaca

SEQ ID NO: 2620295 - DNA, 18 bp, Homo sapiens
ctaaagaaaaagtcatcc

SEQ ID NO: 2620296 - DNA, 19 bp, Homo sapiens
ctaaagaaaaagtcatcca

SEQ ID NO: 2620297 - DNA, 18 bp, Homo sapiens
ctaaagagagaatgtaga

SEQ ID NO: 2620298 - DNA, 20 bp, Homo sapiens
ctaaagcaataatggtccca

SEQ ID NO: 2620299 - DNA, 17 bp, Homo sapiens
ctaaaggctacctttgt

SEQ ID NO: 2620300 - DNA, 19 bp, Homo sapiens
ctaaagtgtatttttttac

SEQ ID NO: 2620301 - DNA, 19 bp, Homo sapiens
ctaaagtgtgttgttgctt

SEQ ID NO: 2620302 - DNA, 15 bp, Homo sapiens
ctaaataaaatttgt

SEQ ID NO: 2620303 - DNA, 15 bp, Homo sapiens
ctaaatatttcctta

SEQ ID NO: 2620304 - DNA, 21 bp, Homo sapiens
ctaaatcctttactgttagtc

SEQ ID NO: 2620305 - DNA, 15 bp, Homo sapiens
ctaaatctctaatat

SEQ ID NO: 2620306 - DNA, 13 bp, Homo sapiens
ctaaatgaagtgc

SEQ ID NO: 2620307 - DNA, 15 bp, Homo sapiens
ctaaatgaatgttta

SEQ ID NO: 2620308 - DNA, 16 bp, Homo sapiens
ctaaatgaatgtttac

SEQ ID NO: 2620309 - DNA, 21 bp, Homo sapiens
ctaaatgcatatcctgagcca

SEQ ID NO: 2620310 - DNA, 15 bp, Homo sapiens
ctaaatggaaccact

SEQ ID NO: 2620311 - DNA, 16 bp, Homo sapiens
ctaaatggaaccactc

SEQ ID NO: 2620312 - DNA, 18 bp, Homo sapiens
ctaaatggaaccactcta

SEQ ID NO: 2620313 - DNA, 19 bp, Homo sapiens
ctaaatgtaacagtctgat

SEQ ID NO: 2620314 - DNA, 14 bp, Homo sapiens
ctaaattccacact

SEQ ID NO: 2620315 - DNA, 14 bp, Homo sapiens
ctaaattgtaaact

SEQ ID NO: 2620316 - DNA, 18 bp, Homo sapiens
ctaaattgtaaactcctg

SEQ ID NO: 2620317 - DNA, 13 bp, Homo sapiens
ctaacaatgacat

SEQ ID NO: 2620318 - DNA, 16 bp, Homo sapiens
ctaacacacagctccc

SEQ ID NO: 2620319 - DNA, 17 bp, Homo sapiens
ctaacacagcatgtgta

SEQ ID NO: 2620320 - DNA, 13 bp, Homo sapiens
ctaacactggccc

SEQ ID NO: 2620321 - DNA, 14 bp, Homo sapiens
ctaacactggcccc

SEQ ID NO: 2620322 - DNA, 12 bp, Homo sapiens
ctccaccaccac

SEQ ID NO: 2620323 - DNA, 23 bp, Homo sapiens
ctccacccatcctatcagcctgt

SEQ ID NO: 2620324 - DNA, 22 bp, Homo sapiens
ctccacccccagctgcttgtgt

SEQ ID NO: 2620325 - DNA, 22 bp, Homo sapiens
ctccaccccccagaacctgtcc

SEQ ID NO: 2620326 - DNA, 14 bp, Homo sapiens
ctccaccctctgag

SEQ ID NO: 2620327 - DNA, 19 bp, Homo sapiens
ctccaccctctgagctttg

SEQ ID NO: 2620328 - DNA, 13 bp, Homo sapiens
ctccaccctgctc

SEQ ID NO: 2620329 - DNA, 15 bp, Homo sapiens
ctccaccctgtcccc

SEQ ID NO: 2620330 - DNA, 14 bp, Homo sapiens
ctccacccttggcc

SEQ ID NO: 2620331 - DNA, 12 bp, Homo sapiens
ctccacctgcca

SEQ ID NO: 2620332 - DNA, 13 bp, Homo sapiens
ctccacctgccag

SEQ ID NO: 2620333 - DNA, 20 bp, Homo sapiens
ctccacgttctgctcatcat

SEQ ID NO: 2620334 - DNA, 19 bp, Homo sapiens
ctccactctgactggcaca

SEQ ID NO: 2620335 - DNA, 13 bp, Homo sapiens
ctccactgtcaca

SEQ ID NO: 2620336 - DNA, 17 bp, Homo sapiens
ctccagaagcctctggc

SEQ ID NO: 2620337 - DNA, 19 bp, Homo sapiens
ctccagaagcctctggcta

SEQ ID NO: 2620338 - DNA, 21 bp, Homo sapiens
ctccagaagcctctggctaga

SEQ ID NO: 2620339 - DNA, 11 bp, Homo sapiens
ctccagacaca

SEQ ID NO: 2620340 - DNA, 18 bp, Homo sapiens
ctccagacccccacccct

SEQ ID NO: 2620341 - DNA, 14 bp, Homo sapiens
ctccagacccccag

SEQ ID NO: 2620342 - DNA, 14 bp, Homo sapiens
ctccagactctctg

SEQ ID NO: 2620343 - DNA, 14 bp, Homo sapiens
ctccagccaacccc

SEQ ID NO: 2620344 - DNA, 17 bp, Homo sapiens
ctccagccaacccctgt

SEQ ID NO: 2620345 - DNA, 12 bp, Homo sapiens
ctccagccagca

SEQ ID NO: 2620346 - DNA, 14 bp, Homo sapiens
ctccagcccctgga

SEQ ID NO: 2620347 - DNA, 11 bp, Homo sapiens
ctccagcctct

SEQ ID NO: 2620348 - DNA, 13 bp, Homo sapiens
ctccagcctctgt

SEQ ID NO: 2620349 - DNA, 17 bp, Homo sapiens
ctccagcctctgttccc

SEQ ID NO: 2620350 - DNA, 12 bp, Homo sapiens
ctccagcctggc

SEQ ID NO: 2620351 - DNA, 14 bp, Homo sapiens
ctccagcctggctc

SEQ ID NO: 2620352 - DNA, 13 bp, Homo sapiens
ctccagcctgggc

SEQ ID NO: 2620353 - DNA, 15 bp, Homo sapiens
ctccagctcaccagc

SEQ ID NO: 2620354 - DNA, 18 bp, Homo sapiens
ctccagctcaccagcccc

SEQ ID NO: 2620355 - DNA, 20 bp, Homo sapiens
ctccagctcaccagccccag

SEQ ID NO: 2620356 - DNA, 19 bp, Homo sapiens
ctccagctgggctctgcaa

SEQ ID NO: 2620357 - DNA, 20 bp, Homo sapiens
ctccagctgggctctgcaat

SEQ ID NO: 2620358 - DNA, 12 bp, Homo sapiens
ctccagcttgtg

SEQ ID NO: 2620359 - DNA, 18 bp, Homo sapiens
ctccagcttgtggagccc

SEQ ID NO: 2620360 - DNA, 13 bp, Homo sapiens
ctccaggagagga

SEQ ID NO: 2620361 - DNA, 22 bp, Homo sapiens
ctccaggagaggagcgggacct

SEQ ID NO: 2620362 - DNA, 17 bp, Homo sapiens
ctccaggagcagccaca

SEQ ID NO: 2620363 - DNA, 11 bp, Homo sapiens
ctccaggctcc

SEQ ID NO: 2620364 - DNA, 22 bp, Homo sapiens
ctccaggctgtatcccatgagc

SEQ ID NO: 2620365 - DNA, 23 bp, Homo sapiens
ctccaggctgtatcccatgagcc

SEQ ID NO: 2620366 - DNA, 14 bp, Homo sapiens
ctccagggagtccc

SEQ ID NO: 2620367 - DNA, 18 bp, Homo sapiens
ctccagggagtcccctcc

SEQ ID NO: 2620368 - DNA, 11 bp, Homo sapiens
ctccaggtgca

SEQ ID NO: 2620369 - DNA, 22 bp, Homo sapiens
ctccaggtgcacaagctccaag

SEQ ID NO: 2620370 - DNA, 12 bp, Homo sapiens
ctccaggttttt

SEQ ID NO: 2620371 - DNA, 14 bp, Homo sapiens
ctccaggtttttca

SEQ ID NO: 2620372 - DNA, 22 bp, Homo sapiens
ctccaggtttttcaattaaacg

SEQ ID NO: 2620373 - DNA, 16 bp, Homo sapiens
ctccagtcaggaggca

SEQ ID NO: 2620374 - DNA, 15 bp, Homo sapiens
ctccagtggttgctg

SEQ ID NO: 2620375 - DNA, 16 bp, Homo sapiens
ctccagtggttgctgt

SEQ ID NO: 2620376 - DNA, 19 bp, Homo sapiens
ctccatcagttagagctga

SEQ ID NO: 2620377 - DNA, 20 bp, Homo sapiens
ctccatccacatgggagccg

SEQ ID NO: 2620378 - DNA, 17 bp, Homo sapiens
ctccatctctctggccc

SEQ ID NO: 2620379 - DNA, 18 bp, Homo sapiens
ctccatctctctggccct

SEQ ID NO: 2620380 - DNA, 12 bp, Homo sapiens
ctccatcttatt

SEQ ID NO: 2620381 - DNA, 17 bp, Homo sapiens
ctccatgagttttttct

SEQ ID NO: 2620382 - DNA, 15 bp, Homo sapiens
ctccatggcttcctc

SEQ ID NO: 2620383 - DNA, 17 bp, Homo sapiens
ctccatggcttcctcct

SEQ ID NO: 2620384 - DNA, 18 bp, Homo sapiens
ctccatggcttcctcctc

SEQ ID NO: 2620385 - DNA, 13 bp, Homo sapiens
ctccatgtgggct

SEQ ID NO: 2620386 - DNA, 14 bp, Homo sapiens
ctccatgtgggcta

SEQ ID NO: 2620387 - DNA, 16 bp, Homo sapiens
ctcccaaagtgctggg

SEQ ID NO: 2620388 - DNA, 18 bp, Homo sapiens
ctcccaaagtgctgggat

SEQ ID NO: 2620389 - DNA, 22 bp, Homo sapiens
ctcccaaagtgctgggattaca

SEQ ID NO: 2620390 - DNA, 17 bp, Homo sapiens
ctcccaactcaccccag

SEQ ID NO: 2620391 - DNA, 20 bp, Homo sapiens
ctcccaagttttaggacaaa

SEQ ID NO: 2620392 - DNA, 15 bp, Homo sapiens
ctcccacaaaggaga

SEQ ID NO: 2620393 - DNA, 15 bp, Homo sapiens
ctcccacactgctag

SEQ ID NO: 2620394 - DNA, 14 bp, Homo sapiens
ctcccacaggcagc

SEQ ID NO: 2620395 - DNA, 17 bp, Homo sapiens
ctcccacaggcagcttt

SEQ ID NO: 2620396 - DNA, 13 bp, Homo sapiens
ctcccaccacagc

SEQ ID NO: 2620397 - DNA, 14 bp, Homo sapiens
ctcccaccacagca

SEQ ID NO: 2620398 - DNA, 19 bp, Homo sapiens
ctcccaccacagcaggtgt

SEQ ID NO: 2620399 - DNA, 14 bp, Homo sapiens
ctcccacccaccgc

SEQ ID NO: 2620400 - DNA, 17 bp, Homo sapiens
ctcccacccaccgccac

SEQ ID NO: 2620401 - DNA, 15 bp, Homo sapiens
ctcccacccccatct

SEQ ID NO: 2620402 - DNA, 22 bp, Homo sapiens
ctcccacccccatctctccctc

SEQ ID NO: 2620403 - DNA, 18 bp, Homo sapiens
ctcccacccccttctctg

SEQ ID NO: 2620404 - DNA, 22 bp, Homo sapiens
ctcccacccccttctctgctcc

SEQ ID NO: 2620405 - DNA, 23 bp, Homo sapiens
ctcccacccccttctctgctcca

SEQ ID NO: 2620406 - DNA, 17 bp, Homo sapiens
ctcccacccgatgctgc

SEQ ID NO: 2620407 - DNA, 18 bp, Homo sapiens
ctcccacccgatgctgct

SEQ ID NO: 2620408 - DNA, 13 bp, Homo sapiens
ctcccacctcagc

SEQ ID NO: 2620409 - DNA, 16 bp, Homo sapiens
ctcccacctcagcctc

SEQ ID NO: 2620410 - DNA, 14 bp, Homo sapiens
ctcccactgagttt

SEQ ID NO: 2620411 - DNA, 24 bp, Homo sapiens
ctcccagaacacactccatcagct

SEQ ID NO: 2620412 - DNA, 21 bp, Homo sapiens
ctcccagcaacacaagctgga

SEQ ID NO: 2620413 - DNA, 19 bp, Homo sapiens
ctcccagccctatggatgt

SEQ ID NO: 2620414 - DNA, 16 bp, Homo sapiens
ctcccaggagacagtt

SEQ ID NO: 2620415 - DNA, 22 bp, Homo sapiens
ctcccaggcattccccaggagg

SEQ ID NO: 2620416 - DNA, 23 bp, Homo sapiens
ctcccagggccagggccctgcag

SEQ ID NO: 2620417 - DNA, 22 bp, Homo sapiens
ctcccagtcaccttgtggcaag

SEQ ID NO: 2620418 - DNA, 17 bp, Homo sapiens
ctcccagtcatttaata

SEQ ID NO: 2620419 - DNA, 17 bp, Homo sapiens
ctcccataaccgctgat

SEQ ID NO: 2620420 - DNA, 16 bp, Homo sapiens
ctcccatcacttccct

SEQ ID NO: 2620421 - DNA, 15 bp, Homo sapiens
ctcccatctgggagt

SEQ ID NO: 2620422 - DNA, 22 bp, Homo sapiens
ctcccatctgggagtccccttt

SEQ ID NO: 2620423 - DNA, 23 bp, Homo sapiens
ctcccatctgtgaaaggaaagag

SEQ ID NO: 2620424 - DNA, 16 bp, Homo sapiens
ctcccatgaccatact

SEQ ID NO: 2620425 - DNA, 14 bp, Homo sapiens
ctcccatggagccc

SEQ ID NO: 2620426 - DNA, 15 bp, Homo sapiens
ctcccatggagcccc

SEQ ID NO: 2620427 - DNA, 17 bp, Homo sapiens
ctcccatggagccccag

SEQ ID NO: 2620428 - DNA, 21 bp, Homo sapiens
ctcccatggcttaatgcttct

SEQ ID NO: 2620429 - DNA, 19 bp, Homo sapiens
ctcccattaggacaatcag

SEQ ID NO: 2620430 - DNA, 14 bp, Homo sapiens
ctcccatttcctga

SEQ ID NO: 2620431 - DNA, 14 bp, Homo sapiens
ctcccatttctact

SEQ ID NO: 2620432 - DNA, 14 bp, Homo sapiens
ctccccaaccctgc

SEQ ID NO: 2620433 - DNA, 17 bp, Homo sapiens
ctccccaaccctgcccc

SEQ ID NO: 2620434 - DNA, 19 bp, Homo sapiens
ctccccaaccctgcccctg

SEQ ID NO: 2620435 - DNA, 21 bp, Homo sapiens
ctccccacactaacctgggtt

SEQ ID NO: 2620436 - DNA, 18 bp, Homo sapiens
ctccccacaggagccctg

SEQ ID NO: 2620437 - DNA, 23 bp, Homo sapiens
ctccccaccttcaattcctgggc

SEQ ID NO: 2620438 - DNA, 17 bp, Homo sapiens
ctccccagagcactggg

SEQ ID NO: 2620439 - DNA, 19 bp, Homo sapiens
ctccccagcaggtggggag

SEQ ID NO: 2620440 - DNA, 21 bp, Homo sapiens
ctccccagggttcagtcctca

SEQ ID NO: 2620441 - DNA, 15 bp, Homo sapiens
ctccccatcccatgt

SEQ ID NO: 2620442 - DNA, 15 bp, Homo sapiens
ctcccccgccactcc

SEQ ID NO: 2620443 - DNA, 17 bp, Homo sapiens
ctccccctcccccttct

SEQ ID NO: 2620444 - DNA, 11 bp, Homo sapiens
ctccccctggg

SEQ ID NO: 2620445 - DNA, 14 bp, Homo sapiens
ctccccgcttctgc

SEQ ID NO: 2620446 - DNA, 14 bp, Homo sapiens
ctccccggccctac

SEQ ID NO: 2620447 - DNA, 18 bp, Homo sapiens
ctcccctcaaagtctgca

SEQ ID NO: 2620448 - DNA, 16 bp, Homo sapiens
ctcccctcagagtgca

SEQ ID NO: 2620449 - DNA, 22 bp, Homo sapiens
ctcccctgattacaccagcctc

SEQ ID NO: 2620450 - DNA, 15 bp, Homo sapiens
ctcccctgcactgga

SEQ ID NO: 2620451 - DNA, 14 bp, Homo sapiens
ctcccctgccattt

SEQ ID NO: 2620452 - DNA, 15 bp, Homo sapiens
ctcccctgccctgct

SEQ ID NO: 2620453 - DNA, 16 bp, Homo sapiens
ctcccctgccctgctg

SEQ ID NO: 2620454 - DNA, 16 bp, Homo sapiens
ctcccctgctgaaggt

SEQ ID NO: 2620455 - DNA, 23 bp, Homo sapiens
ctcccctggggacagcaagggct

SEQ ID NO: 2620456 - DNA, 16 bp, Homo sapiens
ctcccgaatagctggg

SEQ ID NO: 2620457 - DNA, 23 bp, Homo sapiens
ctcccgaatagctgggactacag

SEQ ID NO: 2620458 - DNA, 15 bp, Homo sapiens
ctcccgagtagctgg

SEQ ID NO: 2620459 - DNA, 20 bp, Homo sapiens
ctcccgagtagctgggacta

SEQ ID NO: 2620460 - DNA, 21 bp, Homo sapiens
ctcccgccagactgttagaaa

SEQ ID NO: 2620461 - DNA, 16 bp, Homo sapiens
ctcccgccccttccca

SEQ ID NO: 2620462 - DNA, 13 bp, Homo sapiens
ctcccgctgctgc

SEQ ID NO: 2620463 - DNA, 17 bp, Homo sapiens
ctcccgctgctgctgct

SEQ ID NO: 2620464 - DNA, 17 bp, Homo sapiens
ctcccggcatgggaaag

SEQ ID NO: 2620465 - DNA, 16 bp, Homo sapiens
ctcccggcgtggtgga

SEQ ID NO: 2620466 - DNA, 16 bp, Homo sapiens
ctcccgggccctccct

SEQ ID NO: 2620467 - DNA, 20 bp, Homo sapiens
ctcccgggccctcccttgga

SEQ ID NO: 2620468 - DNA, 13 bp, Homo sapiens
ctctgtacagagc

SEQ ID NO: 2620469 - DNA, 14 bp, Homo sapiens
ctctgtacagagcc

SEQ ID NO: 2620470 - DNA, 15 bp, Homo sapiens
ctctgtacagagccc

SEQ ID NO: 2620471 - DNA, 17 bp, Homo sapiens
ctctgtacagagcccac

SEQ ID NO: 2620472 - DNA, 21 bp, Homo sapiens
ctctgtacagagcccacgccc

SEQ ID NO: 2620473 - DNA, 13 bp, Homo sapiens
ctctgtcagatgg

SEQ ID NO: 2620474 - DNA, 22 bp, Homo sapiens
ctctgtcctgggagtgagctgg

SEQ ID NO: 2620475 - DNA, 19 bp, Homo sapiens
ctctgtcgcccagtctgga

SEQ ID NO: 2620476 - DNA, 14 bp, Homo sapiens
ctctgtctcatcca

SEQ ID NO: 2620477 - DNA, 23 bp, Homo sapiens
ctctgtctcatgtgtgctcttct

SEQ ID NO: 2620478 - DNA, 23 bp, Homo sapiens
ctctgtcttctttgcccacaatg

SEQ ID NO: 2620479 - DNA, 18 bp, Homo sapiens
ctctgtgaaccctatgag

SEQ ID NO: 2620480 - DNA, 18 bp, Homo sapiens
ctctgtgaacgatttaga

SEQ ID NO: 2620481 - DNA, 23 bp, Homo sapiens
ctctgtgaacgatttagaaagaa

SEQ ID NO: 2620482 - DNA, 18 bp, Homo sapiens
ctctgtgaagcattcgag

SEQ ID NO: 2620483 - DNA, 14 bp, Homo sapiens
ctctgtgaccaatg

SEQ ID NO: 2620484 - DNA, 15 bp, Homo sapiens
ctctgtgaccaatgt

SEQ ID NO: 2620485 - DNA, 17 bp, Homo sapiens
ctctgtgaccaatgtct

SEQ ID NO: 2620486 - DNA, 15 bp, Homo sapiens
ctctgtgctgaccct

SEQ ID NO: 2620487 - DNA, 18 bp, Homo sapiens
ctctgtgctgtggaagca

SEQ ID NO: 2620488 - DNA, 18 bp, Homo sapiens
ctctgtgctttgactcac

SEQ ID NO: 2620489 - DNA, 23 bp, Homo sapiens
ctctgtgctttgactcacctgtt

SEQ ID NO: 2620490 - DNA, 23 bp, Homo sapiens
ctctgtgtcaggtggggcagctt

SEQ ID NO: 2620491 - DNA, 15 bp, Homo sapiens
ctctgtgtgcacaaa

SEQ ID NO: 2620492 - DNA, 13 bp, Homo sapiens
ctctgtgtgctcc

SEQ ID NO: 2620493 - DNA, 18 bp, Homo sapiens
ctctgttcagtgtaaata

SEQ ID NO: 2620494 - DNA, 14 bp, Homo sapiens
ctctgttcccctag

SEQ ID NO: 2620495 - DNA, 22 bp, Homo sapiens
ctctgttgcccaggctggagtg

SEQ ID NO: 2620496 - DNA, 17 bp, Homo sapiens
ctctgttgtcctcccct

SEQ ID NO: 2620497 - DNA, 19 bp, Homo sapiens
ctcttaaaaaataaaaact

SEQ ID NO: 2620498 - DNA, 20 bp, Homo sapiens
ctcttaagccatcttggtaa

SEQ ID NO: 2620499 - DNA, 22 bp, Homo sapiens
ctcttaagtttctcagctccca

SEQ ID NO: 2620500 - DNA, 20 bp, Homo sapiens
ctcttatagaatatttatta

SEQ ID NO: 2620501 - DNA, 15 bp, Homo sapiens
ctcttatgggctggg

SEQ ID NO: 2620502 - DNA, 16 bp, Homo sapiens
ctcttcaccccccact

SEQ ID NO: 2620503 - DNA, 17 bp, Homo sapiens
ctcttcaccccccactc

SEQ ID NO: 2620504 - DNA, 14 bp, Homo sapiens
ctcttcaggttctt

SEQ ID NO: 2620505 - DNA, 13 bp, Homo sapiens
ctcttcatacttt

SEQ ID NO: 2620506 - DNA, 19 bp, Homo sapiens
ctcttcatactttttttca

SEQ ID NO: 2620507 - DNA, 22 bp, Homo sapiens
ctcttccaggctgggagagcct

SEQ ID NO: 2620508 - DNA, 19 bp, Homo sapiens
ctcttccagtcttcctgac

SEQ ID NO: 2620509 - DNA, 22 bp, Homo sapiens
ctcttccagtcttcctgacact

SEQ ID NO: 2620510 - DNA, 15 bp, Homo sapiens
ctcttccccttgccc

SEQ ID NO: 2620511 - DNA, 18 bp, Homo sapiens
ctcttccccttgcccttg

SEQ ID NO: 2620512 - DNA, 19 bp, Homo sapiens
ctcttccggagatgtagca

SEQ ID NO: 2620513 - DNA, 22 bp, Homo sapiens
ctcttccggagatgtagcaaaa

SEQ ID NO: 2620514 - DNA, 20 bp, Homo sapiens
ctcttccgtgacgtcactgg

SEQ ID NO: 2620515 - DNA, 15 bp, Homo sapiens
ctcttcctacccaac

SEQ ID NO: 2620516 - DNA, 11 bp, Homo sapiens
ctcttcctctg

SEQ ID NO: 2620517 - DNA, 13 bp, Homo sapiens
ctcttcctctgag

SEQ ID NO: 2620518 - DNA, 22 bp, Homo sapiens
ctcttcctctgaggctggatcc

SEQ ID NO: 2620519 - DNA, 10 bp, Homo sapiens
ctcttcctgt

SEQ ID NO: 2620520 - DNA, 16 bp, Homo sapiens
ctcttccttttatcag

SEQ ID NO: 2620521 - DNA, 15 bp, Homo sapiens
ctcttctagagccgt

SEQ ID NO: 2620522 - DNA, 17 bp, Homo sapiens
ctcttctattttgtaaa

SEQ ID NO: 2620523 - DNA, 14 bp, Homo sapiens
ctcttctcaagtgc

SEQ ID NO: 2620524 - DNA, 12 bp, Homo sapiens
ctcttctccagg

SEQ ID NO: 2620525 - DNA, 14 bp, Homo sapiens
ctcttctccccaga

SEQ ID NO: 2620526 - DNA, 16 bp, Homo sapiens
ctcttctccccagagt

SEQ ID NO: 2620527 - DNA, 15 bp, Homo sapiens
ctcttctcttcctgt

SEQ ID NO: 2620528 - DNA, 16 bp, Homo sapiens
ctcttctgacgtgcct

SEQ ID NO: 2620529 - DNA, 15 bp, Homo sapiens
ctcttctgagctatt

SEQ ID NO: 2620530 - DNA, 20 bp, Homo sapiens
ctcttctgccggccctgggg

SEQ ID NO: 2620531 - DNA, 13 bp, Homo sapiens
ctcttctgctcca

SEQ ID NO: 2620532 - DNA, 15 bp, Homo sapiens
ctcttctgctccacc

SEQ ID NO: 2620533 - DNA, 18 bp, Homo sapiens
ctcttctgctccaccctt

SEQ ID NO: 2620534 - DNA, 19 bp, Homo sapiens
ctcttctgctccacccttg

SEQ ID NO: 2620535 - DNA, 23 bp, Homo sapiens
ctcttctgtgggtgacccaggtc

SEQ ID NO: 2620536 - DNA, 15 bp, Homo sapiens
ctcttcttcttcaga

SEQ ID NO: 2620537 - DNA, 14 bp, Homo sapiens
ctcttcttctttct

SEQ ID NO: 2620538 - DNA, 20 bp, Homo sapiens
ctcttgaagacactgaaata

SEQ ID NO: 2620539 - DNA, 21 bp, Homo sapiens
ctcttgaagacactgaaatat

SEQ ID NO: 2620540 - DNA, 16 bp, Homo sapiens
ctcttgagcctgggag

SEQ ID NO: 2620541 - DNA, 16 bp, Homo sapiens
ctcttgagccttgaac

SEQ ID NO: 2620542 - DNA, 23 bp, Homo sapiens
ctcttgagccttgaactttgacc

SEQ ID NO: 2620543 - DNA, 19 bp, Homo sapiens
ctcttgatacccccctctg

SEQ ID NO: 2620544 - DNA, 23 bp, Homo sapiens
ctcttgcaatccacaatctgaca

SEQ ID NO: 2620545 - DNA, 14 bp, Homo sapiens
ctcttgcacccgcc

SEQ ID NO: 2620546 - DNA, 21 bp, Homo sapiens
ctcttgcacccgcctctcccg

SEQ ID NO: 2620547 - DNA, 18 bp, Homo sapiens
ctcttgcaggtctcaacc

SEQ ID NO: 2620548 - DNA, 18 bp, Homo sapiens
ctcttgccactgcctctt

SEQ ID NO: 2620549 - DNA, 16 bp, Homo sapiens
ctcttgccccccaccc

SEQ ID NO: 2620550 - DNA, 19 bp, Homo sapiens
ctcttgccccccaccccag

SEQ ID NO: 2620551 - DNA, 16 bp, Homo sapiens
ctcttgcccttccctg

SEQ ID NO: 2620552 - DNA, 20 bp, Homo sapiens
ctcttgcccttccctgtccc

SEQ ID NO: 2620553 - DNA, 14 bp, Homo sapiens
ctcttgcctcctgg

SEQ ID NO: 2620554 - DNA, 21 bp, Homo sapiens
ctcttgctaatcagtgtctca

SEQ ID NO: 2620555 - DNA, 14 bp, Homo sapiens
ctcttgctctttct

SEQ ID NO: 2620556 - DNA, 15 bp, Homo sapiens
ctcttgctctttcta

SEQ ID NO: 2620557 - DNA, 12 bp, Homo sapiens
ctcttggacctc

SEQ ID NO: 2620558 - DNA, 19 bp, Homo sapiens
ctcttggacctctgctctg

SEQ ID NO: 2620559 - DNA, 20 bp, Homo sapiens
ctcttggacctctgctctga

SEQ ID NO: 2620560 - DNA, 14 bp, Homo sapiens
ctcttggctccact

SEQ ID NO: 2620561 - DNA, 17 bp, Homo sapiens
ctcttgggctgagactg

SEQ ID NO: 2620562 - DNA, 21 bp, Homo sapiens
ctcttgggttcaagcgattct

SEQ ID NO: 2620563 - DNA, 18 bp, Homo sapiens
ctcttggtcctgctgcag

SEQ ID NO: 2620564 - DNA, 16 bp, Homo sapiens
ctcttggtcttcccag

SEQ ID NO: 2620565 - DNA, 21 bp, Homo sapiens
ctcttgtaatccgaatctctt

SEQ ID NO: 2620566 - DNA, 23 bp, Homo sapiens
ctcttgtaatgatatagccagaa

SEQ ID NO: 2620567 - DNA, 13 bp, Homo sapiens
ctcttgtggatgt

SEQ ID NO: 2620568 - DNA, 12 bp, Homo sapiens
ctctttcaaaac

SEQ ID NO: 2620569 - DNA, 22 bp, Homo sapiens
ctctttcctgttgttgttaatg

SEQ ID NO: 2620570 - DNA, 13 bp, Homo sapiens
ctctttccttgct

SEQ ID NO: 2620571 - DNA, 19 bp, Homo sapiens
ctctttctctcctttcttt

SEQ ID NO: 2620572 - DNA, 22 bp, Homo sapiens
ctctttgaaatagtctgtgtga

SEQ ID NO: 2620573 - DNA, 14 bp, Homo sapiens
ctctttgaatgaca

SEQ ID NO: 2620574 - DNA, 12 bp, Homo sapiens
ctctttgaattt

SEQ ID NO: 2620575 - DNA, 23 bp, Homo sapiens
ctctttgagatagaagaactgca

SEQ ID NO: 2620576 - DNA, 17 bp, Homo sapiens
ctctttggggtcagcca

SEQ ID NO: 2620577 - DNA, 22 bp, Homo sapiens
ctctttggtctacactgtgctg

SEQ ID NO: 2620578 - DNA, 16 bp, Homo sapiens
ctctttgtctaaaaca

SEQ ID NO: 2620579 - DNA, 20 bp, Homo sapiens
ctctttgttctaaagatgga

SEQ ID NO: 2620580 - DNA, 20 bp, Homo sapiens
ctgaaaaaaagtttacaagt

SEQ ID NO: 2620581 - DNA, 22 bp, Homo sapiens
ctgaaaaaacacctagctttat

SEQ ID NO: 2620582 - DNA, 15 bp, Homo sapiens
ctgaaaaattccttt

SEQ ID NO: 2620583 - DNA, 15 bp, Homo sapiens
ctgaaaacctctcct

SEQ ID NO: 2620584 - DNA, 20 bp, Homo sapiens
ctgaaaacctctcctcatgt

SEQ ID NO: 2620585 - DNA, 16 bp, Homo sapiens
ctgaaaacggccctct

SEQ ID NO: 2620586 - DNA, 17 bp, Homo sapiens
ctgaaaacggccctctt

SEQ ID NO: 2620587 - DNA, 12 bp, Homo sapiens
ctgaaaatgtgc

SEQ ID NO: 2620588 - DNA, 15 bp, Homo sapiens
ctgaaacaacaaata

SEQ ID NO: 2620589 - DNA, 22 bp, Homo sapiens
ctgaaacttatttttttctgat

SEQ ID NO: 2620590 - DNA, 23 bp, Homo sapiens
ctgaaacttatttttttctgatt

SEQ ID NO: 2620591 - DNA, 20 bp, Homo sapiens
ctgaaagaaacagttaactt

SEQ ID NO: 2620592 - DNA, 19 bp, Homo sapiens
ctgaaagaacatggacttg

SEQ ID NO: 2620593 - DNA, 13 bp, Homo sapiens
ctgaaagaggaat

SEQ ID NO: 2620594 - DNA, 17 bp, Homo sapiens
ctgaaagaggaatgaag

SEQ ID NO: 2620595 - DNA, 15 bp, Homo sapiens
ctgaaagccctgagc

SEQ ID NO: 2620596 - DNA, 16 bp, Homo sapiens
ctgaaagccctgagct

SEQ ID NO: 2620597 - DNA, 17 bp, Homo sapiens
ctgaaagccctgagctt

SEQ ID NO: 2620598 - DNA, 19 bp, Homo sapiens
ctgaaagccctgagctttc

SEQ ID NO: 2620599 - DNA, 23 bp, Homo sapiens
ctgaaagggacgctacccgggaa

SEQ ID NO: 2620600 - DNA, 14 bp, Homo sapiens
ctgaaatttcacca

SEQ ID NO: 2620601 - DNA, 16 bp, Homo sapiens
ctgaacaattctctct

SEQ ID NO: 2620602 - DNA, 14 bp, Homo sapiens
ctgaaccatccctg

SEQ ID NO: 2620603 - DNA, 17 bp, Homo sapiens
ctgaaccctgtgctggt

SEQ ID NO: 2620604 - DNA, 20 bp, Homo sapiens
ctgaaccggctttaccaaac

SEQ ID NO: 2620605 - DNA, 17 bp, Homo sapiens
ctgaacctgatgctgac

SEQ ID NO: 2620606 - DNA, 18 bp, Homo sapiens
ctgaactcaaactgagga

SEQ ID NO: 2620607 - DNA, 19 bp, Homo sapiens
ctgaactgatgggtttctc

SEQ ID NO: 2620608 - DNA, 12 bp, Homo sapiens
ctgaactttgct

SEQ ID NO: 2620609 - DNA, 13 bp, Homo sapiens
ctgaagaacagta

SEQ ID NO: 2620610 - DNA, 16 bp, Homo sapiens
ctgaagacctcgagca

SEQ ID NO: 2620611 - DNA, 21 bp, Homo sapiens
ctgaagagaagggcagggctg

SEQ ID NO: 2620612 - DNA, 15 bp, Homo sapiens
ctgaagaggcgggcc

SEQ ID NO: 2620613 - DNA, 20 bp, Homo sapiens
cttcattaccttttttgata

SEQ ID NO: 2620614 - DNA, 15 bp, Homo sapiens
cttcattagagcagg

SEQ ID NO: 2620615 - DNA, 20 bp, Homo sapiens
cttcattcttgaaagctgtg

SEQ ID NO: 2620616 - DNA, 21 bp, Homo sapiens
cttcattgagagttttgtctt

SEQ ID NO: 2620617 - DNA, 14 bp, Homo sapiens
cttcatttcattgt

SEQ ID NO: 2620618 - DNA, 18 bp, Homo sapiens
cttcatttcattgtatga

SEQ ID NO: 2620619 - DNA, 18 bp, Homo sapiens
cttcatttgtgtcaatgg

SEQ ID NO: 2620620 - DNA, 16 bp, Homo sapiens
cttccaaatcccctaa

SEQ ID NO: 2620621 - DNA, 16 bp, Homo sapiens
cttccaagcaaaggtg

SEQ ID NO: 2620622 - DNA, 12 bp, Homo sapiens
cttccaccagcc

SEQ ID NO: 2620623 - DNA, 14 bp, Homo sapiens
cttccaccagcctg

SEQ ID NO: 2620624 - DNA, 13 bp, Homo sapiens
cttccacctccct

SEQ ID NO: 2620625 - DNA, 17 bp, Homo sapiens
cttccacgctgtctcca

SEQ ID NO: 2620626 - DNA, 18 bp, Homo sapiens
cttccacgctgtctccag

SEQ ID NO: 2620627 - DNA, 22 bp, Homo sapiens
cttccacgctgtctccagaccc

SEQ ID NO: 2620628 - DNA, 16 bp, Homo sapiens
cttccagaagtgtgat

SEQ ID NO: 2620629 - DNA, 15 bp, Homo sapiens
cttccagcaccctgc

SEQ ID NO: 2620630 - DNA, 14 bp, Homo sapiens
cttccaggctggga

SEQ ID NO: 2620631 - DNA, 16 bp, Homo sapiens
cttccaggctgggaga

SEQ ID NO: 2620632 - DNA, 15 bp, Homo sapiens
cttccaggggtggga

SEQ ID NO: 2620633 - DNA, 18 bp, Homo sapiens
cttccaggtatctccagg

SEQ ID NO: 2620634 - DNA, 20 bp, Homo sapiens
cttccaggtatctccaggat

SEQ ID NO: 2620635 - DNA, 17 bp, Homo sapiens
cttccagtccaatctca

SEQ ID NO: 2620636 - DNA, 20 bp, Homo sapiens
cttccagtccaatctcatgg

SEQ ID NO: 2620637 - DNA, 14 bp, Homo sapiens
cttccagtgaggct

SEQ ID NO: 2620638 - DNA, 19 bp, Homo sapiens
cttccagtgaggctctgcc

SEQ ID NO: 2620639 - DNA, 21 bp, Homo sapiens
cttccagtgaggctctgccct

SEQ ID NO: 2620640 - DNA, 22 bp, Homo sapiens
cttccagtgaggctctgccctt

SEQ ID NO: 2620641 - DNA, 11 bp, Homo sapiens
cttccataatg

SEQ ID NO: 2620642 - DNA, 18 bp, Homo sapiens
cttccataatgctactgt

SEQ ID NO: 2620643 - DNA, 23 bp, Homo sapiens
cttccataatgtataaagaacaa

SEQ ID NO: 2620644 - DNA, 16 bp, Homo sapiens
cttccatacagctcta

SEQ ID NO: 2620645 - DNA, 14 bp, Homo sapiens
cttccatcatgtcc

SEQ ID NO: 2620646 - DNA, 17 bp, Homo sapiens
cttccatcatgtcccca

SEQ ID NO: 2620647 - DNA, 16 bp, Homo sapiens
cttccatggccctcat

SEQ ID NO: 2620648 - DNA, 14 bp, Homo sapiens
cttccatgtggaga

SEQ ID NO: 2620649 - DNA, 18 bp, Homo sapiens
cttccatgtggagaaagg

SEQ ID NO: 2620650 - DNA, 16 bp, Homo sapiens
cttccatttgtgtgtg

SEQ ID NO: 2620651 - DNA, 19 bp, Homo sapiens
cttcccaaaggactccacc

SEQ ID NO: 2620652 - DNA, 21 bp, Homo sapiens
cttcccaaaggactccaccca

SEQ ID NO: 2620653 - DNA, 19 bp, Homo sapiens
cttcccaggagtggaggag

SEQ ID NO: 2620654 - DNA, 22 bp, Homo sapiens
cttcccaggctggggctgacct

SEQ ID NO: 2620655 - DNA, 11 bp, Homo sapiens
cttcccagggt

SEQ ID NO: 2620656 - DNA, 21 bp, Homo sapiens
cttcccagggtagcccgcctg

SEQ ID NO: 2620657 - DNA, 16 bp, Homo sapiens
cttcccatcctaccct

SEQ ID NO: 2620658 - DNA, 16 bp, Homo sapiens
cttccccactgcctgc

SEQ ID NO: 2620659 - DNA, 13 bp, Homo sapiens
cttccccagcctc

SEQ ID NO: 2620660 - DNA, 12 bp, Homo sapiens
cttccccatggg

SEQ ID NO: 2620661 - DNA, 18 bp, Homo sapiens
cttcccctccctggctcc

SEQ ID NO: 2620662 - DNA, 20 bp, Homo sapiens
cttcccctctctcctcctgc

SEQ ID NO: 2620663 - DNA, 14 bp, Homo sapiens
cttcccctgggccc

SEQ ID NO: 2620664 - DNA, 13 bp, Homo sapiens
cttccccttgccc

SEQ ID NO: 2620665 - DNA, 16 bp, Homo sapiens
cttccctaaaatcagg

SEQ ID NO: 2620666 - DNA, 17 bp, Homo sapiens
cttccctacagttgaaa

SEQ ID NO: 2620667 - DNA, 20 bp, Homo sapiens
cttccctagagggttcctgt

SEQ ID NO: 2620668 - DNA, 16 bp, Homo sapiens
cttccctatctttgcc

SEQ ID NO: 2620669 - DNA, 16 bp, Homo sapiens
cttccctcatctctcc

SEQ ID NO: 2620670 - DNA, 13 bp, Homo sapiens
cttccctctgcct

SEQ ID NO: 2620671 - DNA, 18 bp, Homo sapiens
cttccctctgcctgtccc

SEQ ID NO: 2620672 - DNA, 13 bp, Homo sapiens
cttccctgtccct

SEQ ID NO: 2620673 - DNA, 20 bp, Homo sapiens
cttccgaaaaatcctcttcc

SEQ ID NO: 2620674 - DNA, 18 bp, Homo sapiens
cttcctacaagagcagcc

SEQ ID NO: 2620675 - DNA, 19 bp, Homo sapiens
cttcctacccacacctctg

SEQ ID NO: 2620676 - DNA, 21 bp, Homo sapiens
cttcctagaagttactgaatg

SEQ ID NO: 2620677 - DNA, 22 bp, Homo sapiens
cttcctagttttctcctcccag

SEQ ID NO: 2620678 - DNA, 23 bp, Homo sapiens
cttcctagttttctcctcccagg

SEQ ID NO: 2620679 - DNA, 18 bp, Homo sapiens
cttcctatatgcacttat

SEQ ID NO: 2620680 - DNA, 12 bp, Homo sapiens
cttcctcccaag

SEQ ID NO: 2620681 - DNA, 20 bp, Homo sapiens
cttcctcccaagtggtgcct

SEQ ID NO: 2620682 - DNA, 21 bp, Homo sapiens
cttcctccgaggccagtacct

SEQ ID NO: 2620683 - DNA, 15 bp, Homo sapiens
cttcctcctgggccc

SEQ ID NO: 2620684 - DNA, 16 bp, Homo sapiens
cttcctcgcagagagg

SEQ ID NO: 2620685 - DNA, 19 bp, Homo sapiens
cttcctcgcagagaggcca

SEQ ID NO: 2620686 - DNA, 19 bp, Homo sapiens
cttcctctgaggctggatc

SEQ ID NO: 2620687 - DNA, 14 bp, Homo sapiens
cttcctctgcagct

SEQ ID NO: 2620688 - DNA, 22 bp, Homo sapiens
cttcctctgcagctgacctctg

SEQ ID NO: 2620689 - DNA, 13 bp, Homo sapiens
cttcctgaagctg

SEQ ID NO: 2620690 - DNA, 18 bp, Homo sapiens
cttcctgacactttaatt

SEQ ID NO: 2620691 - DNA, 14 bp, Homo sapiens
cttcctgagttcag

SEQ ID NO: 2620692 - DNA, 22 bp, Homo sapiens
cttcctgcattcacccagacag

SEQ ID NO: 2620693 - DNA, 15 bp, Homo sapiens
cttcctgccaccagt

SEQ ID NO: 2620694 - DNA, 16 bp, Homo sapiens
cttcctgccaccagtc

SEQ ID NO: 2620695 - DNA, 18 bp, Homo sapiens
cttcctgccaccagtcac

SEQ ID NO: 2620696 - DNA, 21 bp, Homo sapiens
cttcctgccaccagtcactgt

SEQ ID NO: 2620697 - DNA, 19 bp, Homo sapiens
cttcctgccctacagaggt

SEQ ID NO: 2620698 - DNA, 14 bp, Homo sapiens
cttcctggagactg

SEQ ID NO: 2620699 - DNA, 20 bp, Homo sapiens
cttcctggggcatctggcga

SEQ ID NO: 2620700 - DNA, 15 bp, Homo sapiens
cttcctgtccagaga

SEQ ID NO: 2620701 - DNA, 20 bp, Homo sapiens
cttcctgtcttcctgcattc

SEQ ID NO: 2620702 - DNA, 23 bp, Homo sapiens
cttcctgtttttcacattttcct

SEQ ID NO: 2620703 - DNA, 19 bp, Homo sapiens
cttccttgctaatgcacca

SEQ ID NO: 2620704 - DNA, 14 bp, Homo sapiens
cttccttgctctcc

SEQ ID NO: 2620705 - DNA, 15 bp, Homo sapiens
cttccttgctctgca

SEQ ID NO: 2620706 - DNA, 17 bp, Homo sapiens
cttccttgctgtcctag

SEQ ID NO: 2620707 - DNA, 19 bp, Homo sapiens
cttccttggactcatttta

SEQ ID NO: 2620708 - DNA, 20 bp, Homo sapiens
cttcgaaagcatcattattt

SEQ ID NO: 2620709 - DNA, 14 bp, Homo sapiens
cttcgactcaggat

SEQ ID NO: 2620710 - DNA, 18 bp, Homo sapiens
cttcgactcaggatccag

SEQ ID NO: 2620711 - DNA, 16 bp, Homo sapiens
cttcgcatcaaaagac

SEQ ID NO: 2620712 - DNA, 17 bp, Homo sapiens
cttcgcatcaaaagaca

SEQ ID NO: 2620713 - DNA, 19 bp, Homo sapiens
cttcgcatcaaaagacaat

SEQ ID NO: 2620714 - DNA, 20 bp, Homo sapiens
cttcgcatcaaaagacaatt

SEQ ID NO: 2620715 - DNA, 22 bp, Homo sapiens
cttcgcatcaaaagacaattct

SEQ ID NO: 2620716 - DNA, 17 bp, Homo sapiens
cttcgctcctgtgtctt

SEQ ID NO: 2620717 - DNA, 17 bp, Homo sapiens
cttcgggaagagaggag

SEQ ID NO: 2620718 - DNA, 21 bp, Homo sapiens
cttcgtgggatctgcccctcc

SEQ ID NO: 2620719 - DNA, 16 bp, Homo sapiens
cttcgtttattttcaa

SEQ ID NO: 2620720 - DNA, 18 bp, Homo sapiens
cttcgtttattttcaaga

SEQ ID NO: 2620721 - DNA, 17 bp, Homo sapiens
cttctaagtaaaaccac

SEQ ID NO: 2620722 - DNA, 11 bp, Homo sapiens
cttctaatata

SEQ ID NO: 2620723 - DNA, 15 bp, Homo sapiens
cttctaatatatttt

SEQ ID NO: 2620724 - DNA, 16 bp, Homo sapiens
cttctacctgccactc

SEQ ID NO: 2620725 - DNA, 21 bp, Homo sapiens
cttctacttttaagttgctga

SEQ ID NO: 2620726 - DNA, 17 bp, Homo sapiens
cttctagaaccaggcaa

SEQ ID NO: 2620727 - DNA, 13 bp, Homo sapiens
cttctaggaagct

SEQ ID NO: 2620728 - DNA, 22 bp, Homo sapiens
cttctaggtggcaaggctgtgc

SEQ ID NO: 2620729 - DNA, 13 bp, Homo sapiens
cttctattttatt

SEQ ID NO: 2620730 - DNA, 14 bp, Homo sapiens
cttctattttgtaa

SEQ ID NO: 2620731 - DNA, 16 bp, Homo sapiens
cttctcaaaccttgat

SEQ ID NO: 2620732 - DNA, 12 bp, Homo sapiens
cttctcaagtgc

SEQ ID NO: 2620733 - DNA, 14 bp, Homo sapiens
cttctcaagtgcct

SEQ ID NO: 2620734 - DNA, 15 bp, Homo sapiens
cttctcaagtgcctt

SEQ ID NO: 2620735 - DNA, 21 bp, Homo sapiens
cttctcactgccatgccagct

SEQ ID NO: 2620736 - DNA, 14 bp, Homo sapiens
cttctcagctccca

SEQ ID NO: 2620737 - DNA, 15 bp, Homo sapiens
cttctcatagcatta

SEQ ID NO: 2620738 - DNA, 20 bp, Homo sapiens
cttctcattccaacagtgag

SEQ ID NO: 2620739 - DNA, 16 bp, Homo sapiens
cttctccaccctgctc

SEQ ID NO: 2620740 - DNA, 18 bp, Homo sapiens
cttctccaccctgctctc

SEQ ID NO: 2620741 - DNA, 23 bp, Homo sapiens
cttctccagacaaaccagaagca

SEQ ID NO: 2620742 - DNA, 15 bp, Homo sapiens
cttctccagcctaga

SEQ ID NO: 2620743 - DNA, 17 bp, Homo sapiens
cttctccaggctgtatc

SEQ ID NO: 2620744 - DNA, 11 bp, Homo sapiens
cttctccatct

SEQ ID NO: 2620745 - DNA, 18 bp, Homo sapiens
cttctccatctctctggc

SEQ ID NO: 2620746 - DNA, 19 bp, Homo sapiens
cttctccatctctctggcc

SEQ ID NO: 2620747 - DNA, 21 bp, Homo sapiens
cttctccatctctctggccct

SEQ ID NO: 2620748 - DNA, 16 bp, Homo sapiens
cttctccccagagttc

SEQ ID NO: 2620749 - DNA, 22 bp, Homo sapiens
cttctccctcatttcaggagca

SEQ ID NO: 2620750 - DNA, 11 bp, Homo sapiens
cttctctacag

SEQ ID NO: 2620751 - DNA, 13 bp, Homo sapiens
cttctctacagac

SEQ ID NO: 2620752 - DNA, 16 bp, Homo sapiens
cttctctctgtgggat

SEQ ID NO: 2620753 - DNA, 16 bp, Homo sapiens
cttctctgaagggagg

SEQ ID NO: 2620754 - DNA, 16 bp, Homo sapiens
cttctctgctccacca

SEQ ID NO: 2620755 - DNA, 22 bp, Homo sapiens
cttctctgtgaacgatttagaa

SEQ ID NO: 2620756 - DNA, 21 bp, Homo sapiens
cttctctgttccattgaatct

SEQ ID NO: 2620757 - DNA, 14 bp, Homo sapiens
cttctcttaattta

SEQ ID NO: 2620758 - DNA, 22 bp, Homo sapiens
ctttgggaaaggagaagttaag

SEQ ID NO: 2620759 - DNA, 18 bp, Homo sapiens
ctttgggaggctgaggcg

SEQ ID NO: 2620760 - DNA, 23 bp, Homo sapiens
ctttgggcccagggacaccagcc

SEQ ID NO: 2620761 - DNA, 17 bp, Homo sapiens
ctttggggtcagccagg

SEQ ID NO: 2620762 - DNA, 21 bp, Homo sapiens
ctttggggtcagccagggcca

SEQ ID NO: 2620763 - DNA, 16 bp, Homo sapiens
ctttggtctacactgt

SEQ ID NO: 2620764 - DNA, 17 bp, Homo sapiens
ctttggtggagataaag

SEQ ID NO: 2620765 - DNA, 17 bp, Homo sapiens
ctttgtaagagtgtaga

SEQ ID NO: 2620766 - DNA, 10 bp, Homo sapiens
ctttgtatat

SEQ ID NO: 2620767 - DNA, 18 bp, Homo sapiens
ctttgtccccaccgcaga

SEQ ID NO: 2620768 - DNA, 19 bp, Homo sapiens
ctttgtctaaaacaataaa

SEQ ID NO: 2620769 - DNA, 22 bp, Homo sapiens
ctttgtgaatagaactctgaaa

SEQ ID NO: 2620770 - DNA, 19 bp, Homo sapiens
ctttgtgaggaagccgctg

SEQ ID NO: 2620771 - DNA, 17 bp, Homo sapiens
ctttgtgattatttcac

SEQ ID NO: 2620772 - DNA, 16 bp, Homo sapiens
ctttgtggatgtcttc

SEQ ID NO: 2620773 - DNA, 20 bp, Homo sapiens
ctttgtggatgtcttccttg

SEQ ID NO: 2620774 - DNA, 18 bp, Homo sapiens
ctttgtgtagctttgctc

SEQ ID NO: 2620775 - DNA, 15 bp, Homo sapiens
ctttgttacaggcac

SEQ ID NO: 2620776 - DNA, 14 bp, Homo sapiens
ctttgttctggctc

SEQ ID NO: 2620777 - DNA, 21 bp, Homo sapiens
ctttgttctggctcttccagg

SEQ ID NO: 2620778 - DNA, 20 bp, Homo sapiens
ctttgttctttaggagattt

SEQ ID NO: 2620779 - DNA, 17 bp, Homo sapiens
ctttgtttcaaccaagt

SEQ ID NO: 2620780 - DNA, 18 bp, Homo sapiens
ctttgtttgttgtcagct

SEQ ID NO: 2620781 - DNA, 19 bp, Homo sapiens
ctttgttttgatgtttgtg

SEQ ID NO: 2620782 - DNA, 19 bp, Homo sapiens
ctttgttttgcacactttg

SEQ ID NO: 2620783 - DNA, 23 bp, Homo sapiens
ctttgttttgcacactttgccat

SEQ ID NO: 2620784 - DNA, 13 bp, Homo sapiens
cttttaaactgtg

SEQ ID NO: 2620785 - DNA, 23 bp, Homo sapiens
cttttaacacctgatgtgtacat

SEQ ID NO: 2620786 - DNA, 19 bp, Homo sapiens
cttttaatgctccaaatgc

SEQ ID NO: 2620787 - DNA, 14 bp, Homo sapiens
cttttaattaaatg

SEQ ID NO: 2620788 - DNA, 15 bp, Homo sapiens
cttttaattaaatgc

SEQ ID NO: 2620789 - DNA, 14 bp, Homo sapiens
cttttacatactgc

SEQ ID NO: 2620790 - DNA, 16 bp, Homo sapiens
cttttaggccaaaaaa

SEQ ID NO: 2620791 - DNA, 18 bp, Homo sapiens
cttttaggccaaaaaaat

SEQ ID NO: 2620792 - DNA, 21 bp, Homo sapiens
cttttagggagagtcatattt

SEQ ID NO: 2620793 - DNA, 18 bp, Homo sapiens
cttttagttgtatctctt

SEQ ID NO: 2620794 - DNA, 19 bp, Homo sapiens
cttttataaactttacctt

SEQ ID NO: 2620795 - DNA, 21 bp, Homo sapiens
cttttataaactttacctttt

SEQ ID NO: 2620796 - DNA, 21 bp, Homo sapiens
cttttataataaaaggaaaag

SEQ ID NO: 2620797 - DNA, 18 bp, Homo sapiens
cttttatagctattactg

SEQ ID NO: 2620798 - DNA, 19 bp, Homo sapiens
cttttatagctattactgt

SEQ ID NO: 2620799 - DNA, 17 bp, Homo sapiens
cttttatccacttacct

SEQ ID NO: 2620800 - DNA, 18 bp, Homo sapiens
cttttatgatgtatattt

SEQ ID NO: 2620801 - DNA, 20 bp, Homo sapiens
cttttatgttatttatatat

SEQ ID NO: 2620802 - DNA, 13 bp, Homo sapiens
cttttattgtata

SEQ ID NO: 2620803 - DNA, 13 bp, Homo sapiens
cttttattgtcag

SEQ ID NO: 2620804 - DNA, 13 bp, Homo sapiens
cttttcacaaata

SEQ ID NO: 2620805 - DNA, 13 bp, Homo sapiens
cttttcacattct

SEQ ID NO: 2620806 - DNA, 20 bp, Homo sapiens
cttttcacattcttataaat

SEQ ID NO: 2620807 - DNA, 13 bp, Homo sapiens
cttttcatctggg

SEQ ID NO: 2620808 - DNA, 16 bp, Homo sapiens
cttttcctatttgttt

SEQ ID NO: 2620809 - DNA, 13 bp, Homo sapiens
cttttcctccctt

SEQ ID NO: 2620810 - DNA, 18 bp, Homo sapiens
cttttcctctctcccgga

SEQ ID NO: 2620811 - DNA, 13 bp, Homo sapiens
cttttccttgggg

SEQ ID NO: 2620812 - DNA, 16 bp, Homo sapiens
cttttctaccctagcc

SEQ ID NO: 2620813 - DNA, 18 bp, Homo sapiens
cttttctaccctagccat

SEQ ID NO: 2620814 - DNA, 17 bp, Homo sapiens
cttttcttttctaccct

SEQ ID NO: 2620815 - DNA, 17 bp, Homo sapiens
cttttgacaaaggcaag

SEQ ID NO: 2620816 - DNA, 13 bp, Homo sapiens
cttttgacatgtg

SEQ ID NO: 2620817 - DNA, 14 bp, Homo sapiens
cttttgacatgtgg

SEQ ID NO: 2620818 - DNA, 23 bp, Homo sapiens
cttttgataatcaactgggctga

SEQ ID NO: 2620819 - DNA, 16 bp, Homo sapiens
cttttgcacccctccc

SEQ ID NO: 2620820 - DNA, 15 bp, Homo sapiens
cttttgcatcattgt

SEQ ID NO: 2620821 - DNA, 15 bp, Homo sapiens
cttttggcactgaga

SEQ ID NO: 2620822 - DNA, 13 bp, Homo sapiens
cttttggcccccg

SEQ ID NO: 2620823 - DNA, 14 bp, Homo sapiens
cttttggcttccat

SEQ ID NO: 2620824 - DNA, 21 bp, Homo sapiens
cttttggtaaagactggcttt

SEQ ID NO: 2620825 - DNA, 13 bp, Homo sapiens
cttttggttaagt

SEQ ID NO: 2620826 - DNA, 16 bp, Homo sapiens
cttttggttaagtctg

SEQ ID NO: 2620827 - DNA, 12 bp, Homo sapiens
cttttgtgcatt

SEQ ID NO: 2620828 - DNA, 14 bp, Homo sapiens
cttttgtgcattat

SEQ ID NO: 2620829 - DNA, 14 bp, Homo sapiens
cttttgtgtacagt

SEQ ID NO: 2620830 - DNA, 22 bp, Homo sapiens
cttttgttcagggctgtgatcg

SEQ ID NO: 2620831 - DNA, 20 bp, Homo sapiens
cttttgttcttggtttgtaa

SEQ ID NO: 2620832 - DNA, 23 bp, Homo sapiens
ctttttaaagtgtttctgttatt

SEQ ID NO: 2620833 - DNA, 20 bp, Homo sapiens
ctttttaataaaaaggcacc

SEQ ID NO: 2620834 - DNA, 17 bp, Homo sapiens
ctttttaattcaccaaa

SEQ ID NO: 2620835 - DNA, 22 bp, Homo sapiens
ctttttaattgttgtttctttc

SEQ ID NO: 2620836 - DNA, 17 bp, Homo sapiens
ctttttattgaatctat

SEQ ID NO: 2620837 - DNA, 19 bp, Homo sapiens
ctttttattgaatctattt

SEQ ID NO: 2620838 - DNA, 15 bp, Homo sapiens
ctttttatttgcatg

SEQ ID NO: 2620839 - DNA, 13 bp, Homo sapiens
ctttttcatttgc

SEQ ID NO: 2620840 - DNA, 15 bp, Homo sapiens
ctttttcatttgcct

SEQ ID NO: 2620841 - DNA, 13 bp, Homo sapiens
ctttttccagagg

SEQ ID NO: 2620842 - DNA, 15 bp, Homo sapiens
ctttttgaaatcagc

SEQ ID NO: 2620843 - DNA, 18 bp, Homo sapiens
ctttttgaggtggcactt

SEQ ID NO: 2620844 - DNA, 15 bp, Homo sapiens
ctttttggaggtgct

SEQ ID NO: 2620845 - DNA, 17 bp, Homo sapiens
ctttttggtttgcagat

SEQ ID NO: 2620846 - DNA, 23 bp, Homo sapiens
cttttttatgtgccgtgttattg

SEQ ID NO: 2620847 - DNA, 12 bp, Homo sapiens
cttttttcaaaa

SEQ ID NO: 2620848 - DNA, 15 bp, Homo sapiens
cttttttcacaaatt

SEQ ID NO: 2620849 - DNA, 16 bp, Homo sapiens
cttttttcttatttaa

SEQ ID NO: 2620850 - DNA, 16 bp, Homo sapiens
cttttttctttaagat

SEQ ID NO: 2620851 - DNA, 18 bp, Homo sapiens
cttttttgataaagtttc

SEQ ID NO: 2620852 - DNA, 20 bp, Homo sapiens
cttttttggctgctgaaggc

SEQ ID NO: 2620853 - DNA, 14 bp, Homo sapiens
cttttttttaagtt

SEQ ID NO: 2620854 - DNA, 17 bp, Homo sapiens
cttttttttaatgtgct

SEQ ID NO: 2620855 - DNA, 18 bp, Homo sapiens
cttttttttaatgtgctg

SEQ ID NO: 2620856 - DNA, 21 bp, Homo sapiens
cttttttttcccccctagaaa

SEQ ID NO: 2620857 - DNA, 15 bp, Homo sapiens
cttttttttgtatgt

SEQ ID NO: 2620858 - DNA, 15 bp, Homo sapiens
ctttttttttccaaa

SEQ ID NO: 2620859 - DNA, 22 bp, Homo sapiens
ctttttttttctctttctctcc

SEQ ID NO: 2620860 - DNA, 18 bp, Homo sapiens
gaaaaaaaaaatgctgaa

SEQ ID NO: 2620861 - DNA, 19 bp, Homo sapiens
gaaaaaaaaaatgctgaac

SEQ ID NO: 2620862 - DNA, 18 bp, Homo sapiens
gaaaaaaaaagaaaaaag

SEQ ID NO: 2620863 - DNA, 13 bp, Homo sapiens
gaaaaaaatgact

SEQ ID NO: 2620864 - DNA, 17 bp, Homo sapiens
gaaaaaagagaaaagaa

SEQ ID NO: 2620865 - DNA, 14 bp, Homo sapiens
gaaaaaatacattt

SEQ ID NO: 2620866 - DNA, 19 bp, Homo sapiens
gaaaaaatattttcctgcc

SEQ ID NO: 2620867 - DNA, 19 bp, Homo sapiens
gaaaaaatgatgttcattt

SEQ ID NO: 2620868 - DNA, 19 bp, Homo sapiens
gaaaaacaaattcatcaaa

SEQ ID NO: 2620869 - DNA, 16 bp, Homo sapiens
gaaaaagaaaaaatat

SEQ ID NO: 2620870 - DNA, 21 bp, Homo sapiens
gaaaaagctcctgtcctccca

SEQ ID NO: 2620871 - DNA, 10 bp, Homo sapiens
gaaaaatatg

SEQ ID NO: 2620872 - DNA, 14 bp, Homo sapiens
gaaaaatatttaag

SEQ ID NO: 2620873 - DNA, 18 bp, Homo sapiens
gaaaaatccagaaagaaa

SEQ ID NO: 2620874 - DNA, 13 bp, Homo sapiens
gaaaaatcctctt

SEQ ID NO: 2620875 - DNA, 20 bp, Homo sapiens
gaaaaatcctcttcctctga

SEQ ID NO: 2620876 - DNA, 18 bp, Homo sapiens
gaaaaatgagagaaggga

SEQ ID NO: 2620877 - DNA, 20 bp, Homo sapiens
gaaaaatgcccttaaatcat

SEQ ID NO: 2620878 - DNA, 17 bp, Homo sapiens
gaaaaatttaagcattg

SEQ ID NO: 2620879 - DNA, 18 bp, Homo sapiens
gaaaaatttaagcattgt

SEQ ID NO: 2620880 - DNA, 15 bp, Homo sapiens
gaaaacaagtgctgg

SEQ ID NO: 2620881 - DNA, 18 bp, Homo sapiens
gaaaacacatttttctta

SEQ ID NO: 2620882 - DNA, 19 bp, Homo sapiens
gaaaacacatttttcttag

SEQ ID NO: 2620883 - DNA, 14 bp, Homo sapiens
gaaaacactgtgca

SEQ ID NO: 2620884 - DNA, 20 bp, Homo sapiens
gaaaacactgttctctgccc

SEQ ID NO: 2620885 - DNA, 21 bp, Homo sapiens
gaaaacagaacatcattagaa

SEQ ID NO: 2620886 - DNA, 19 bp, Homo sapiens
gaaaacatcactgaaatgc

SEQ ID NO: 2620887 - DNA, 12 bp, Homo sapiens
gaaaacatgcta

SEQ ID NO: 2620888 - DNA, 14 bp, Homo sapiens
gaaaacatgctaca

SEQ ID NO: 2620889 - DNA, 19 bp, Homo sapiens
gaaaacatgctacacactg

SEQ ID NO: 2620890 - DNA, 17 bp, Homo sapiens
gaaaacattccatcctt

SEQ ID NO: 2620891 - DNA, 16 bp, Homo sapiens
gaaaaccatcacatga

SEQ ID NO: 2620892 - DNA, 18 bp, Homo sapiens
gaaaacgttttattgtgt

SEQ ID NO: 2620893 - DNA, 20 bp, Homo sapiens
gaaaacgttttattgtgttt

SEQ ID NO: 2620894 - DNA, 15 bp, Homo sapiens
gaaaacttttctcag

SEQ ID NO: 2620895 - DNA, 16 bp, Homo sapiens
gaaaacttttctcaga

SEQ ID NO: 2620896 - DNA, 17 bp, Homo sapiens
gaaaacttttctcagat

SEQ ID NO: 2620897 - DNA, 12 bp, Homo sapiens
gaaaagaaaaaa

SEQ ID NO: 2620898 - DNA, 20 bp, Homo sapiens
gaaaagaaaaaaaaagaaaa

SEQ ID NO: 2620899 - DNA, 18 bp, Homo sapiens
gaaaagaaaaatgagcct

SEQ ID NO: 2620900 - DNA, 23 bp, Homo sapiens
gaaaagaaaaatgagcctggcaa

SEQ ID NO: 2620901 - DNA, 19 bp, Homo sapiens
gaaaagaatacagaaagat

SEQ ID NO: 2620902 - DNA, 17 bp, Homo sapiens
gaaaagactccaaagaa

SEQ ID NO: 2620903 - DNA, 21 bp, Homo sapiens
gaagtaatatgcacacatttt

SEQ ID NO: 2620904 - DNA, 23 bp, Homo sapiens
gaagtaggaagtgaaaataggta

SEQ ID NO: 2620905 - DNA, 19 bp, Homo sapiens
gaagtagtttgtataactt

SEQ ID NO: 2620906 - DNA, 14 bp, Homo sapiens
gaagtatccttcag

SEQ ID NO: 2620907 - DNA, 16 bp, Homo sapiens
gaagtcaaagcaagga

SEQ ID NO: 2620908 - DNA, 18 bp, Homo sapiens
gaagtcttagatgtatat

SEQ ID NO: 2620909 - DNA, 14 bp, Homo sapiens
gaagtgaacatttc

SEQ ID NO: 2620910 - DNA, 21 bp, Homo sapiens
gaagtgacaaggccccagaga

SEQ ID NO: 2620911 - DNA, 12 bp, Homo sapiens
gaagtgacaggg

SEQ ID NO: 2620912 - DNA, 21 bp, Homo sapiens
gaagtgacagggaagctacag

SEQ ID NO: 2620913 - DNA, 16 bp, Homo sapiens
gaagtgaggaagccag

SEQ ID NO: 2620914 - DNA, 14 bp, Homo sapiens
gaagtgaggcattg

SEQ ID NO: 2620915 - DNA, 18 bp, Homo sapiens
gaagtgcaaatttgatac

SEQ ID NO: 2620916 - DNA, 14 bp, Homo sapiens
gaagtgcccctgct

SEQ ID NO: 2620917 - DNA, 11 bp, Homo sapiens
gaagtgtgatt

SEQ ID NO: 2620918 - DNA, 20 bp, Homo sapiens
gaagtgtgattgggaataaa

SEQ ID NO: 2620919 - DNA, 23 bp, Homo sapiens
gaagtgtgattgggaataaatat

SEQ ID NO: 2620920 - DNA, 21 bp, Homo sapiens
gaagtgtgggtctgtgtgtgt

SEQ ID NO: 2620921 - DNA, 22 bp, Homo sapiens
gaagtgttgcatggatgtttta

SEQ ID NO: 2620922 - DNA, 14 bp, Homo sapiens
gaagttactgaatg

SEQ ID NO: 2620923 - DNA, 20 bp, Homo sapiens
gaagttcaccattaaaaggg

SEQ ID NO: 2620924 - DNA, 14 bp, Homo sapiens
gaagtttcacatga

SEQ ID NO: 2620925 - DNA, 23 bp, Homo sapiens
gaagttttcaggacttggtctga

SEQ ID NO: 2620926 - DNA, 15 bp, Homo sapiens
gaagttttgtacaga

SEQ ID NO: 2620927 - DNA, 14 bp, Homo sapiens
gaagtttttgtact

SEQ ID NO: 2620928 - DNA, 18 bp, Homo sapiens
gaagtttttgtactgtaa

SEQ ID NO: 2620929 - DNA, 17 bp, Homo sapiens
gaataaaattattttgg

SEQ ID NO: 2620930 - DNA, 14 bp, Homo sapiens
gaataaagttctga

SEQ ID NO: 2620931 - DNA, 19 bp, Homo sapiens
gaataacatgtaattaagt

SEQ ID NO: 2620932 - DNA, 23 bp, Homo sapiens
gaataaccacttaaaaaatgtcc

SEQ ID NO: 2620933 - DNA, 20 bp, Homo sapiens
gaataagccattctgactca

SEQ ID NO: 2620934 - DNA, 22 bp, Homo sapiens
gaataagccattctgactcata

SEQ ID NO: 2620935 - DNA, 20 bp, Homo sapiens
gaataagtgccaggatggaa

SEQ ID NO: 2620936 - DNA, 18 bp, Homo sapiens
gaataagttattgcagtt

SEQ ID NO: 2620937 - DNA, 22 bp, Homo sapiens
gaataataattatccagagttt

SEQ ID NO: 2620938 - DNA, 19 bp, Homo sapiens
gaataatatgctgccaaat

SEQ ID NO: 2620939 - DNA, 20 bp, Homo sapiens
gaataatcacgctttcctga

SEQ ID NO: 2620940 - DNA, 15 bp, Homo sapiens
gaataatctttgggt

SEQ ID NO: 2620941 - DNA, 13 bp, Homo sapiens
gaataattattta

SEQ ID NO: 2620942 - DNA, 20 bp, Homo sapiens
gaataattatttatttaata

SEQ ID NO: 2620943 - DNA, 14 bp, Homo sapiens
gaataatttcccaa

SEQ ID NO: 2620944 - DNA, 21 bp, Homo sapiens
gaataatttcccaattaggaa

SEQ ID NO: 2620945 - DNA, 21 bp, Homo sapiens
gaatacagaggcaactgcatt

SEQ ID NO: 2620946 - DNA, 13 bp, Homo sapiens
gaatacctgtccc

SEQ ID NO: 2620947 - DNA, 14 bp, Homo sapiens
gaatagctgggact

SEQ ID NO: 2620948 - DNA, 16 bp, Homo sapiens
gaatataatactgtat

SEQ ID NO: 2620949 - DNA, 20 bp, Homo sapiens
gaatataatatatttgtgta

SEQ ID NO: 2620950 - DNA, 12 bp, Homo sapiens
gaatataattat

SEQ ID NO: 2620951 - DNA, 21 bp, Homo sapiens
gaatataccccttagtgtttg

SEQ ID NO: 2620952 - DNA, 14 bp, Homo sapiens
gaatatctgggatt

SEQ ID NO: 2620953 - DNA, 22 bp, Homo sapiens
gaatatgaacggtgagcattgt

SEQ ID NO: 2620954 - DNA, 17 bp, Homo sapiens
gaatatgacggaagaac

SEQ ID NO: 2620955 - DNA, 19 bp, Homo sapiens
gaatatgagctttatgtaa

SEQ ID NO: 2620956 - DNA, 18 bp, Homo sapiens
gaatatgattagtaaaga

SEQ ID NO: 2620957 - DNA, 13 bp, Homo sapiens
gaatattgtccat

SEQ ID NO: 2620958 - DNA, 10 bp, Homo sapiens
gaatatttat

SEQ ID NO: 2620959 - DNA, 12 bp, Homo sapiens
gaatatttatta

SEQ ID NO: 2620960 - DNA, 13 bp, Homo sapiens
gaatatttattac

SEQ ID NO: 2620961 - DNA, 15 bp, Homo sapiens
gaatatttattacct

SEQ ID NO: 2620962 - DNA, 18 bp, Homo sapiens
gaatatttattacctctg

SEQ ID NO: 2620963 - DNA, 14 bp, Homo sapiens
gaatcaaaactctc

SEQ ID NO: 2620964 - DNA, 17 bp, Homo sapiens
gaatcaaagcaatgcat

SEQ ID NO: 2620965 - DNA, 17 bp, Homo sapiens
gaatcaacatttctcaa

SEQ ID NO: 2620966 - DNA, 14 bp, Homo sapiens
gaatcaagagctgc

SEQ ID NO: 2620967 - DNA, 21 bp, Homo sapiens
gaatcaagatgtcagactggc

SEQ ID NO: 2620968 - DNA, 11 bp, Homo sapiens
gaatcaataat

SEQ ID NO: 2620969 - DNA, 19 bp, Homo sapiens
gaatcagatcatttcaaaa

SEQ ID NO: 2620970 - DNA, 11 bp, Homo sapiens
gaatcatgtag

SEQ ID NO: 2620971 - DNA, 21 bp, Homo sapiens
gaatcatgtcaggcctgtgtg

SEQ ID NO: 2620972 - DNA, 22 bp, Homo sapiens
gaatcatttctatttctcctcc

SEQ ID NO: 2620973 - DNA, 14 bp, Homo sapiens
gaatccatgcttgg

SEQ ID NO: 2620974 - DNA, 17 bp, Homo sapiens
gaatcccccttgccacc

SEQ ID NO: 2620975 - DNA, 17 bp, Homo sapiens
gaatcccctccctgtca

SEQ ID NO: 2620976 - DNA, 20 bp, Homo sapiens
gaatcctaggctccacccca

SEQ ID NO: 2620977 - DNA, 18 bp, Homo sapiens
gaatcgaggaaccagagc

SEQ ID NO: 2620978 - DNA, 17 bp, Homo sapiens
gaatctatatttaacaa

SEQ ID NO: 2620979 - DNA, 18 bp, Homo sapiens
gaatctctttttgctttc

SEQ ID NO: 2620980 - DNA, 23 bp, Homo sapiens
gaatctggaccccatctgtgaat

SEQ ID NO: 2620981 - DNA, 19 bp, Homo sapiens
gaatgaaaaatttaagcat

SEQ ID NO: 2620982 - DNA, 16 bp, Homo sapiens
gaatgaaacccccaca

SEQ ID NO: 2620983 - DNA, 19 bp, Homo sapiens
gaatgaaacccccacacac

SEQ ID NO: 2620984 - DNA, 21 bp, Homo sapiens
gaatgaaacccccacacacac

SEQ ID NO: 2620985 - DNA, 14 bp, Homo sapiens
gaatgaaagagtaa

SEQ ID NO: 2620986 - DNA, 22 bp, Homo sapiens
gaatgaaagagtaaaggaaatg

SEQ ID NO: 2620987 - DNA, 19 bp, Homo sapiens
gaatgaaagggcccagaga

SEQ ID NO: 2620988 - DNA, 19 bp, Homo sapiens
gaatgaaatactgtttgag

SEQ ID NO: 2620989 - DNA, 13 bp, Homo sapiens
gaatgaacaaatt

SEQ ID NO: 2620990 - DNA, 20 bp, Homo sapiens
gaatgaagcttgtgtatcca

SEQ ID NO: 2620991 - DNA, 16 bp, Homo sapiens
gaatgaattaaataaa

SEQ ID NO: 2620992 - DNA, 20 bp, Homo sapiens
gaatgagcctacgctgaaga

SEQ ID NO: 2620993 - DNA, 23 bp, Homo sapiens
gaatgaggaataataagttaaac

SEQ ID NO: 2620994 - DNA, 17 bp, Homo sapiens
gaatgaggcttgctgag

SEQ ID NO: 2620995 - DNA, 14 bp, Homo sapiens
gaatgaggtcccag

SEQ ID NO: 2620996 - DNA, 13 bp, Homo sapiens
gaatgatgaagct

SEQ ID NO: 2620997 - DNA, 14 bp, Homo sapiens
gaatgcataaaatg

SEQ ID NO: 2620998 - DNA, 18 bp, Homo sapiens
gaatgcctgagtgcctgg

SEQ ID NO: 2620999 - DNA, 13 bp, Homo sapiens
gaatgctccccca

SEQ ID NO: 2621000 - DNA, 20 bp, Homo sapiens
gaatgctcccccatcctccc

SEQ ID NO: 2621001 - DNA, 21 bp, Homo sapiens
gaatgctcccccatcctcccc

SEQ ID NO: 2621002 - DNA, 18 bp, Homo sapiens
gaatgctggttttcctaa

SEQ ID NO: 2621003 - DNA, 22 bp, Homo sapiens
gaatgctggttttcctaaatgc

SEQ ID NO: 2621004 - DNA, 15 bp, Homo sapiens
gaatgcttcttctca

SEQ ID NO: 2621005 - DNA, 13 bp, Homo sapiens
gaatgcttgaaaa

SEQ ID NO: 2621006 - DNA, 22 bp, Homo sapiens
gaatggaagggttctggctgcc

SEQ ID NO: 2621007 - DNA, 17 bp, Homo sapiens
gaatggcacagcccaaa

SEQ ID NO: 2621008 - DNA, 22 bp, Homo sapiens
gaatggcacagcccaaagaagg

SEQ ID NO: 2621009 - DNA, 21 bp, Homo sapiens
gaatgggcaaaactgaattat

SEQ ID NO: 2621010 - DNA, 23 bp, Homo sapiens
gaatggtcagcgttgcatgtcgt

SEQ ID NO: 2621011 - DNA, 13 bp, Homo sapiens
gaatggtccaggg

SEQ ID NO: 2621012 - DNA, 16 bp, Homo sapiens
gaatggttccatgcct

SEQ ID NO: 2621013 - DNA, 19 bp, Homo sapiens
gaatggttccatgcctgag

SEQ ID NO: 2621014 - DNA, 22 bp, Homo sapiens
gaatggttccatgcctgagggt

SEQ ID NO: 2621015 - DNA, 18 bp, Homo sapiens
gaatgtaatcaatgtttc

SEQ ID NO: 2621016 - DNA, 16 bp, Homo sapiens
gaatgtatcaggaaat

SEQ ID NO: 2621017 - DNA, 21 bp, Homo sapiens
gaatgtattattctgcagcat

SEQ ID NO: 2621018 - DNA, 13 bp, Homo sapiens
gaatgtattgtac

SEQ ID NO: 2621019 - DNA, 15 bp, Homo sapiens
gaatgtattgtacct

SEQ ID NO: 2621020 - DNA, 16 bp, Homo sapiens
gaatgtcttttgaata

SEQ ID NO: 2621021 - DNA, 14 bp, Homo sapiens
gaatgtgaaagcac

SEQ ID NO: 2621022 - DNA, 17 bp, Homo sapiens
gaatgttacattgtttg

SEQ ID NO: 2621023 - DNA, 23 bp, Homo sapiens
gaatgttgggactgctaaataaa

SEQ ID NO: 2621024 - DNA, 17 bp, Homo sapiens
gaatgtttgcctctgcc

SEQ ID NO: 2621025 - DNA, 16 bp, Homo sapiens
gaattagtccttgctt

SEQ ID NO: 2621026 - DNA, 20 bp, Homo sapiens
gaattatcttggttgaaaat

SEQ ID NO: 2621027 - DNA, 16 bp, Homo sapiens
gaattcagattttaaa

SEQ ID NO: 2621028 - DNA, 12 bp, Homo sapiens
gaattccaagga

SEQ ID NO: 2621029 - DNA, 19 bp, Homo sapiens
gaattcttggttgaggaaa

SEQ ID NO: 2621030 - DNA, 20 bp, Homo sapiens
gaattcttggttgaggaaac

SEQ ID NO: 2621031 - DNA, 16 bp, Homo sapiens
gaattgacccacaaga

SEQ ID NO: 2621032 - DNA, 18 bp, Homo sapiens
gaattgacttcgactgtg

SEQ ID NO: 2621033 - DNA, 20 bp, Homo sapiens
gaattgcctgcagagagaag

SEQ ID NO: 2621034 - DNA, 22 bp, Homo sapiens
gaattgcctgcagagagaagcc

SEQ ID NO: 2621035 - DNA, 22 bp, Homo sapiens
gaattggaccatcctatttaac

SEQ ID NO: 2621036 - DNA, 17 bp, Homo sapiens
gaattgggagcttggga

SEQ ID NO: 2621037 - DNA, 16 bp, Homo sapiens
gaattgtaactgttct

SEQ ID NO: 2621038 - DNA, 14 bp, Homo sapiens
gaattgtatcattt

SEQ ID NO: 2621039 - DNA, 18 bp, Homo sapiens
gaattgtgaccaagttat

SEQ ID NO: 2621040 - DNA, 16 bp, Homo sapiens
gaattgtgtgatgttt

SEQ ID NO: 2621041 - DNA, 14 bp, Homo sapiens
gaatttaaatataa

SEQ ID NO: 2621042 - DNA, 17 bp, Homo sapiens
gaatttaaatataattc

SEQ ID NO: 2621043 - DNA, 23 bp, Homo sapiens
gaatttaaatataattctgtaaa

SEQ ID NO: 2621044 - DNA, 20 bp, Homo sapiens
gaatttatcacacttctgtg

SEQ ID NO: 2621045 - DNA, 22 bp, Homo sapiens
gaatttatcacacttctgtgag

SEQ ID NO: 2621046 - DNA, 23 bp, Homo sapiens
gaatttattcaattcctctggga

SEQ ID NO: 2621047 - DNA, 17 bp, Homo sapiens
gactgaaaacctctcct

SEQ ID NO: 2621048 - DNA, 18 bp, Homo sapiens
gactgaagatgcagctca

SEQ ID NO: 2621049 - DNA, 16 bp, Homo sapiens
gactgaatttcttttg

SEQ ID NO: 2621050 - DNA, 12 bp, Homo sapiens
gactgagccagt

SEQ ID NO: 2621051 - DNA, 14 bp, Homo sapiens
gactgagccagtcc

SEQ ID NO: 2621052 - DNA, 15 bp, Homo sapiens
gactgagggactctg

SEQ ID NO: 2621053 - DNA, 22 bp, Homo sapiens
gactgagtacgttgtgcatttg

SEQ ID NO: 2621054 - DNA, 21 bp, Homo sapiens
gactgcatgtaccatttgcat

SEQ ID NO: 2621055 - DNA, 23 bp, Homo sapiens
gactgcatgtaccatttgcatgg

SEQ ID NO: 2621056 - DNA, 23 bp, Homo sapiens
gactgccgaccgaggctggagct

SEQ ID NO: 2621057 - DNA, 21 bp, Homo sapiens
gactgcgggatggtcctgggg

SEQ ID NO: 2621058 - DNA, 22 bp, Homo sapiens
gactgcgggatggtcctggggc

SEQ ID NO: 2621059 - DNA, 12 bp, Homo sapiens
gactgctaaata

SEQ ID NO: 2621060 - DNA, 18 bp, Homo sapiens
gactgctaaataaaattt

SEQ ID NO: 2621061 - DNA, 15 bp, Homo sapiens
gactgctagggagtg

SEQ ID NO: 2621062 - DNA, 19 bp, Homo sapiens
gactgctccccagccctgg

SEQ ID NO: 2621063 - DNA, 20 bp, Homo sapiens
gactgctccccagccctggc

SEQ ID NO: 2621064 - DNA, 21 bp, Homo sapiens
gactgctccccagccctggct

SEQ ID NO: 2621065 - DNA, 14 bp, Homo sapiens
gactgctgggactg

SEQ ID NO: 2621066 - DNA, 19 bp, Homo sapiens
gactgctgggactggccag

SEQ ID NO: 2621067 - DNA, 17 bp, Homo sapiens
gactgcttcccatccta

SEQ ID NO: 2621068 - DNA, 20 bp, Homo sapiens
gactgcttcccatcctaccc

SEQ ID NO: 2621069 - DNA, 15 bp, Homo sapiens
gactggaagcacagc

SEQ ID NO: 2621070 - DNA, 14 bp, Homo sapiens
gactggagcatctg

SEQ ID NO: 2621071 - DNA, 17 bp, Homo sapiens
gactggctagagtcctc

SEQ ID NO: 2621072 - DNA, 21 bp, Homo sapiens
gactggctagagtcctcactc

SEQ ID NO: 2621073 - DNA, 22 bp, Homo sapiens
gactggcttttattaatgcact

SEQ ID NO: 2621074 - DNA, 23 bp, Homo sapiens
gactggcttttattaatgcactt

SEQ ID NO: 2621075 - DNA, 13 bp, Homo sapiens
gactgggaggtag

SEQ ID NO: 2621076 - DNA, 20 bp, Homo sapiens
gactggggatgtgggaggga

SEQ ID NO: 2621077 - DNA, 23 bp, Homo sapiens
gactggggatgtgggagggagca

SEQ ID NO: 2621078 - DNA, 23 bp, Homo sapiens
gactgtatttgtgactaattgta

SEQ ID NO: 2621079 - DNA, 15 bp, Homo sapiens
gactgtcatagaaat

SEQ ID NO: 2621080 - DNA, 13 bp, Homo sapiens
gactgtgatgcca

SEQ ID NO: 2621081 - DNA, 15 bp, Homo sapiens
gactgtggctgctag

SEQ ID NO: 2621082 - DNA, 22 bp, Homo sapiens
gactgttagaaaatggacactg

SEQ ID NO: 2621083 - DNA, 18 bp, Homo sapiens
gactgttcaagagcacac

SEQ ID NO: 2621084 - DNA, 14 bp, Homo sapiens
gactgttcctgtct

SEQ ID NO: 2621085 - DNA, 21 bp, Homo sapiens
gactgttttctctcggctccc

SEQ ID NO: 2621086 - DNA, 13 bp, Homo sapiens
gactgtttttacc

SEQ ID NO: 2621087 - DNA, 18 bp, Homo sapiens
gactgtttttacccatat

SEQ ID NO: 2621088 - DNA, 19 bp, Homo sapiens
gactgttttttcctgagct

SEQ ID NO: 2621089 - DNA, 13 bp, Homo sapiens
gacttaaagcaga

SEQ ID NO: 2621090 - DNA, 16 bp, Homo sapiens
gacttaatagaaacat

SEQ ID NO: 2621091 - DNA, 15 bp, Homo sapiens
gacttactgtacatg

SEQ ID NO: 2621092 - DNA, 23 bp, Homo sapiens
gacttactgtacatgaaaacaca

SEQ ID NO: 2621093 - DNA, 16 bp, Homo sapiens
gacttatttatataaa

SEQ ID NO: 2621094 - DNA, 14 bp, Homo sapiens
gacttcagggcagg

SEQ ID NO: 2621095 - DNA, 18 bp, Homo sapiens
gacttcagggcagggctc

SEQ ID NO: 2621096 - DNA, 15 bp, Homo sapiens
gacttcattaataat

SEQ ID NO: 2621097 - DNA, 14 bp, Homo sapiens
gacttccttactaa

SEQ ID NO: 2621098 - DNA, 16 bp, Homo sapiens
gacttcgactcaggat

SEQ ID NO: 2621099 - DNA, 19 bp, Homo sapiens
gacttctaagtaaaaccac

SEQ ID NO: 2621100 - DNA, 14 bp, Homo sapiens
gacttctccaggtc

SEQ ID NO: 2621101 - DNA, 17 bp, Homo sapiens
gacttctgctttccaca

SEQ ID NO: 2621102 - DNA, 12 bp, Homo sapiens
gacttcttttca

SEQ ID NO: 2621103 - DNA, 19 bp, Homo sapiens
gacttgaaagcatccatgt

SEQ ID NO: 2621104 - DNA, 21 bp, Homo sapiens
gacttgaaagcatccatgtgt

SEQ ID NO: 2621105 - DNA, 19 bp, Homo sapiens
gacttgagaaacaaataat

SEQ ID NO: 2621106 - DNA, 23 bp, Homo sapiens
gacttgagaaacaaataatttgt

SEQ ID NO: 2621107 - DNA, 15 bp, Homo sapiens
gacttggaagctccg

SEQ ID NO: 2621108 - DNA, 18 bp, Homo sapiens
gacttgttttatgctcag

SEQ ID NO: 2621109 - DNA, 12 bp, Homo sapiens
gactttcaggta

SEQ ID NO: 2621110 - DNA, 13 bp, Homo sapiens
gactttccacccc

SEQ ID NO: 2621111 - DNA, 17 bp, Homo sapiens
gactttccaccccctcc

SEQ ID NO: 2621112 - DNA, 18 bp, Homo sapiens
gactttccaccccctccc

SEQ ID NO: 2621113 - DNA, 19 bp, Homo sapiens
gactttccaccccctccct

SEQ ID NO: 2621114 - DNA, 11 bp, Homo sapiens
gactttcctct

SEQ ID NO: 2621115 - DNA, 19 bp, Homo sapiens
gactttcggagttgggggt

SEQ ID NO: 2621116 - DNA, 11 bp, Homo sapiens
gactttctgtt

SEQ ID NO: 2621117 - DNA, 14 bp, Homo sapiens
gactttggaaagac

SEQ ID NO: 2621118 - DNA, 22 bp, Homo sapiens
gacttttcgaccaattcaaccc

SEQ ID NO: 2621119 - DNA, 21 bp, Homo sapiens
gacttttctgtccgagctttg

SEQ ID NO: 2621120 - DNA, 23 bp, Homo sapiens
gacttttctgtccgagctttgaa

SEQ ID NO: 2621121 - DNA, 13 bp, Homo sapiens
gagaaaagaaaaa

SEQ ID NO: 2621122 - DNA, 14 bp, Homo sapiens
gagaaaagaaaaaa

SEQ ID NO: 2621123 - DNA, 15 bp, Homo sapiens
gagaaaagaaaaaaa

SEQ ID NO: 2621124 - DNA, 11 bp, Homo sapiens
gagaaaataaa

SEQ ID NO: 2621125 - DNA, 16 bp, Homo sapiens
gagaaaataaaaagtt

SEQ ID NO: 2621126 - DNA, 19 bp, Homo sapiens
gagaaaataaaaagttaaa

SEQ ID NO: 2621127 - DNA, 13 bp, Homo sapiens
gagaaagactatt

SEQ ID NO: 2621128 - DNA, 16 bp, Homo sapiens
gagaaagaggaagctt

SEQ ID NO: 2621129 - DNA, 22 bp, Homo sapiens
gagaaagtacttctccaccctg

SEQ ID NO: 2621130 - DNA, 18 bp, Homo sapiens
gagaaagtgtgagcaaac

SEQ ID NO: 2621131 - DNA, 13 bp, Homo sapiens
gagaacgcagccc

SEQ ID NO: 2621132 - DNA, 16 bp, Homo sapiens
gagaacgcagccctag

SEQ ID NO: 2621133 - DNA, 16 bp, Homo sapiens
gagaagagggcctgtg

SEQ ID NO: 2621134 - DNA, 18 bp, Homo sapiens
gagaagccaaaagattgg

SEQ ID NO: 2621135 - DNA, 15 bp, Homo sapiens
gagaagccccttccc

SEQ ID NO: 2621136 - DNA, 13 bp, Homo sapiens
gagaagcggctgg

SEQ ID NO: 2621137 - DNA, 17 bp, Homo sapiens
gagaagcggctggcagc

SEQ ID NO: 2621138 - DNA, 19 bp, Homo sapiens
gagaagctaaaacctgagc

SEQ ID NO: 2621139 - DNA, 20 bp, Homo sapiens
gagaagctaaaacctgagct

SEQ ID NO: 2621140 - DNA, 16 bp, Homo sapiens
gagaaggcagccacca

SEQ ID NO: 2621141 - DNA, 15 bp, Homo sapiens
gagaagtgcccctgc

SEQ ID NO: 2621142 - DNA, 16 bp, Homo sapiens
gagaagtgcccctgct

SEQ ID NO: 2621143 - DNA, 17 bp, Homo sapiens
gagaagtgcccctgctg

SEQ ID NO: 2621144 - DNA, 22 bp, Homo sapiens
gagaagtgcccctgctgcctcc

SEQ ID NO: 2621145 - DNA, 16 bp, Homo sapiens
gagaagtttctggccc

SEQ ID NO: 2621146 - DNA, 17 bp, Homo sapiens
gagaagttttgtacaga

SEQ ID NO: 2621147 - DNA, 19 bp, Homo sapiens
gagaagttttgtacagaga

SEQ ID NO: 2621148 - DNA, 22 bp, Homo sapiens
gagaataagagaaagaaaatga

SEQ ID NO: 2621149 - DNA, 20 bp, Homo sapiens
gagaataagagagtcataaa

SEQ ID NO: 2621150 - DNA, 12 bp, Homo sapiens
gagaatatatac

SEQ ID NO: 2621151 - DNA, 20 bp, Homo sapiens
gagaatcagatcatttcaaa

SEQ ID NO: 2621152 - DNA, 21 bp, Homo sapiens
gagaatcatacttagcaaagt

SEQ ID NO: 2621153 - DNA, 20 bp, Homo sapiens
gagaatggcgtgaacccggg

SEQ ID NO: 2621154 - DNA, 18 bp, Homo sapiens
gagaattgcttgaaccca

SEQ ID NO: 2621155 - DNA, 15 bp, Homo sapiens
gagaattgtatcatt

SEQ ID NO: 2621156 - DNA, 15 bp, Homo sapiens
gagaattttaaatta

SEQ ID NO: 2621157 - DNA, 15 bp, Homo sapiens
gagacactggcccct

SEQ ID NO: 2621158 - DNA, 17 bp, Homo sapiens
gagacagcccgggctct

SEQ ID NO: 2621159 - DNA, 22 bp, Homo sapiens
gagacagcccgggctctgcctc

SEQ ID NO: 2621160 - DNA, 15 bp, Homo sapiens
gagacaggagggcaa

SEQ ID NO: 2621161 - DNA, 17 bp, Homo sapiens
gagacagtccagcctgg

SEQ ID NO: 2621162 - DNA, 16 bp, Homo sapiens
gagacagttcaagaaa

SEQ ID NO: 2621163 - DNA, 22 bp, Homo sapiens
gagaccaagactctgaaatctc

SEQ ID NO: 2621164 - DNA, 12 bp, Homo sapiens
gagaccatccct

SEQ ID NO: 2621165 - DNA, 17 bp, Homo sapiens
gagaccatgcagagcgc

SEQ ID NO: 2621166 - DNA, 23 bp, Homo sapiens
gagacccccacacctcagttccc

SEQ ID NO: 2621167 - DNA, 13 bp, Homo sapiens
gagacccctggcc

SEQ ID NO: 2621168 - DNA, 17 bp, Homo sapiens
gagaccctacaggagag

SEQ ID NO: 2621169 - DNA, 16 bp, Homo sapiens
gagaccgagcctctgt

SEQ ID NO: 2621170 - DNA, 16 bp, Homo sapiens
gagacctacctcaggt

SEQ ID NO: 2621171 - DNA, 21 bp, Homo sapiens
gagacctcatcaggatgaacc

SEQ ID NO: 2621172 - DNA, 18 bp, Homo sapiens
gagacctgacaagcactg

SEQ ID NO: 2621173 - DNA, 16 bp, Homo sapiens
gagacggagtcccacc

SEQ ID NO: 2621174 - DNA, 13 bp, Homo sapiens
gagactcctgcag

SEQ ID NO: 2621175 - DNA, 21 bp, Homo sapiens
gagactcctgcaggcagccag

SEQ ID NO: 2621176 - DNA, 19 bp, Homo sapiens
gagactctcttaggagcag

SEQ ID NO: 2621177 - DNA, 12 bp, Homo sapiens
gagactctggcc

SEQ ID NO: 2621178 - DNA, 12 bp, Homo sapiens
gagactctgtgg

SEQ ID NO: 2621179 - DNA, 22 bp, Homo sapiens
gagactgcgggatggtcctggg

SEQ ID NO: 2621180 - DNA, 17 bp, Homo sapiens
gagactgcttcccatcc

SEQ ID NO: 2621181 - DNA, 22 bp, Homo sapiens
gagactgcttcccatcctaccc

SEQ ID NO: 2621182 - DNA, 16 bp, Homo sapiens
gagactggagcatctg

SEQ ID NO: 2621183 - DNA, 20 bp, Homo sapiens
gagactggagcatctgactc

SEQ ID NO: 2621184 - DNA, 13 bp, Homo sapiens
gagactgggctga

SEQ ID NO: 2621185 - DNA, 15 bp, Homo sapiens
gagactgggctgagg

SEQ ID NO: 2621186 - DNA, 17 bp, Homo sapiens
gagactgggctgaggga

SEQ ID NO: 2621187 - DNA, 20 bp, Homo sapiens
gagacttccaaacctgacag

SEQ ID NO: 2621188 - DNA, 11 bp, Homo sapiens
gagagaaaata

SEQ ID NO: 2621189 - DNA, 18 bp, Homo sapiens
gagagaaaataaaaagtt

SEQ ID NO: 2621190 - DNA, 20 bp, Homo sapiens
gagagaaaataaaaagttaa

SEQ ID NO: 2621191 - DNA, 16 bp, Homo sapiens
gagagacgtgtacata

SEQ ID NO: 2621192 - DNA, 17 bp, Homo sapiens
gaggtgggatcctccag

SEQ ID NO: 2621193 - DNA, 18 bp, Homo sapiens
gaggtgggatcctccagg

SEQ ID NO: 2621194 - DNA, 22 bp, Homo sapiens
gaggtgggatcctccaggtgca

SEQ ID NO: 2621195 - DNA, 12 bp, Homo sapiens
gaggtgggccca

SEQ ID NO: 2621196 - DNA, 15 bp, Homo sapiens
gaggtggggttggga

SEQ ID NO: 2621197 - DNA, 20 bp, Homo sapiens
gaggtggtctgaatgttctg

SEQ ID NO: 2621198 - DNA, 18 bp, Homo sapiens
gaggtgtcaggctgctgg

SEQ ID NO: 2621199 - DNA, 16 bp, Homo sapiens
gaggtgtgggggctgc

SEQ ID NO: 2621200 - DNA, 14 bp, Homo sapiens
gaggtgtttaaaga

SEQ ID NO: 2621201 - DNA, 19 bp, Homo sapiens
gaggtgtttaaagagaggt

SEQ ID NO: 2621202 - DNA, 13 bp, Homo sapiens
gaggttataggtc

SEQ ID NO: 2621203 - DNA, 19 bp, Homo sapiens
gaggttataggtcactcct

SEQ ID NO: 2621204 - DNA, 19 bp, Homo sapiens
gaggtttaggtcaagaaga

SEQ ID NO: 2621205 - DNA, 13 bp, Homo sapiens
gagtaatctgtgt

SEQ ID NO: 2621206 - DNA, 14 bp, Homo sapiens
gagtaatttattgt

SEQ ID NO: 2621207 - DNA, 16 bp, Homo sapiens
gagtaatttattgttt

SEQ ID NO: 2621208 - DNA, 16 bp, Homo sapiens
gagtacaggtgaagca

SEQ ID NO: 2621209 - DNA, 16 bp, Homo sapiens
gagtacgttgtgcatt

SEQ ID NO: 2621210 - DNA, 17 bp, Homo sapiens
gagtacgttgtgcattt

SEQ ID NO: 2621211 - DNA, 18 bp, Homo sapiens
gagtacgttgtgcatttg

SEQ ID NO: 2621212 - DNA, 23 bp, Homo sapiens
gagtactacagtcctcccatctc

SEQ ID NO: 2621213 - DNA, 12 bp, Homo sapiens
gagtagctggga

SEQ ID NO: 2621214 - DNA, 12 bp, Homo sapiens
gagtaggaagac

SEQ ID NO: 2621215 - DNA, 18 bp, Homo sapiens
gagtaggaagactttgga

SEQ ID NO: 2621216 - DNA, 21 bp, Homo sapiens
gagtagttgatgttgcatttt

SEQ ID NO: 2621217 - DNA, 19 bp, Homo sapiens
gagtatgtgtttgtgtgtg

SEQ ID NO: 2621218 - DNA, 15 bp, Homo sapiens
gagtcaatgtgcagt

SEQ ID NO: 2621219 - DNA, 14 bp, Homo sapiens
gagtcaccaagccc

SEQ ID NO: 2621220 - DNA, 16 bp, Homo sapiens
gagtcaccaagcccag

SEQ ID NO: 2621221 - DNA, 21 bp, Homo sapiens
gagtcactgcctctccctggc

SEQ ID NO: 2621222 - DNA, 11 bp, Homo sapiens
gagtccactcc

SEQ ID NO: 2621223 - DNA, 13 bp, Homo sapiens
gagtccaggcccc

SEQ ID NO: 2621224 - DNA, 12 bp, Homo sapiens
gagtccagggaa

SEQ ID NO: 2621225 - DNA, 14 bp, Homo sapiens
gagtcccactgcct

SEQ ID NO: 2621226 - DNA, 18 bp, Homo sapiens
gagtcccagagcaggagg

SEQ ID NO: 2621227 - DNA, 19 bp, Homo sapiens
gagtcccagagcaggaggc

SEQ ID NO: 2621228 - DNA, 23 bp, Homo sapiens
gagtcccagagcaggaggcccct

SEQ ID NO: 2621229 - DNA, 17 bp, Homo sapiens
gagtcccctcacctcct

SEQ ID NO: 2621230 - DNA, 19 bp, Homo sapiens
gagtcccctcacctcctct

SEQ ID NO: 2621231 - DNA, 18 bp, Homo sapiens
gagtcccctccccggccc

SEQ ID NO: 2621232 - DNA, 19 bp, Homo sapiens
gagtccgaaagggacttgg

SEQ ID NO: 2621233 - DNA, 12 bp, Homo sapiens
gagtcctctgga

SEQ ID NO: 2621234 - DNA, 18 bp, Homo sapiens
gagtccttaaacagggca

SEQ ID NO: 2621235 - DNA, 16 bp, Homo sapiens
gagtcgaggacaggga

SEQ ID NO: 2621236 - DNA, 17 bp, Homo sapiens
gagtcgaggacagggag

SEQ ID NO: 2621237 - DNA, 13 bp, Homo sapiens
gagtcggaagggc

SEQ ID NO: 2621238 - DNA, 19 bp, Homo sapiens
gagtctcactgttgcccag

SEQ ID NO: 2621239 - DNA, 21 bp, Homo sapiens
gagtctcactgttgcccaggc

SEQ ID NO: 2621240 - DNA, 22 bp, Homo sapiens
gagtctcactgttgcccaggct

SEQ ID NO: 2621241 - DNA, 15 bp, Homo sapiens
gagtctgaagcagat

SEQ ID NO: 2621242 - DNA, 23 bp, Homo sapiens
gagtctgaagcagatgcaaagag

SEQ ID NO: 2621243 - DNA, 14 bp, Homo sapiens
gagtctgaaggctg

SEQ ID NO: 2621244 - DNA, 21 bp, Homo sapiens
gagtctgaaggctgggttctg

SEQ ID NO: 2621245 - DNA, 23 bp, Homo sapiens
gagtctggtgaagctcacttctg

SEQ ID NO: 2621246 - DNA, 20 bp, Homo sapiens
gagtcttggcggcagcagcc

SEQ ID NO: 2621247 - DNA, 20 bp, Homo sapiens
gagtgaaacctttagggcag

SEQ ID NO: 2621248 - DNA, 23 bp, Homo sapiens
gagtgaaacctttagggcagctt

SEQ ID NO: 2621249 - DNA, 15 bp, Homo sapiens
gagtgaaccatcatt

SEQ ID NO: 2621250 - DNA, 15 bp, Homo sapiens
gagtgaagaggggca

SEQ ID NO: 2621251 - DNA, 17 bp, Homo sapiens
gagtgaagaggggcagc

SEQ ID NO: 2621252 - DNA, 14 bp, Homo sapiens
gagtgacagaggca

SEQ ID NO: 2621253 - DNA, 14 bp, Homo sapiens
gagtgagactctgt

SEQ ID NO: 2621254 - DNA, 18 bp, Homo sapiens
gagtgagactctgtctca

SEQ ID NO: 2621255 - DNA, 24 bp, Homo sapiens
gagtgagcactaaggtgtgctctg

SEQ ID NO: 2621256 - DNA, 19 bp, Homo sapiens
gagtgcaggcctgctcagg

SEQ ID NO: 2621257 - DNA, 13 bp, Homo sapiens
gagtgccaggact

SEQ ID NO: 2621258 - DNA, 14 bp, Homo sapiens
gagtgccaggactc

SEQ ID NO: 2621259 - DNA, 22 bp, Homo sapiens
gagtgccaggactccccaggcc

SEQ ID NO: 2621260 - DNA, 20 bp, Homo sapiens
gagtggaatagtatcctcca

SEQ ID NO: 2621261 - DNA, 23 bp, Homo sapiens
gagtggaatagtatcctccaggt

SEQ ID NO: 2621262 - DNA, 19 bp, Homo sapiens
gagtggaggttaaggctga

SEQ ID NO: 2621263 - DNA, 19 bp, Homo sapiens
gagtggatctccaaggacc

SEQ ID NO: 2621264 - DNA, 18 bp, Homo sapiens
gagtgggacagagtctgg

SEQ ID NO: 2621265 - DNA, 12 bp, Homo sapiens
gagtgggcccaa

SEQ ID NO: 2621266 - DNA, 19 bp, Homo sapiens
gagtgggggagagcaggct

SEQ ID NO: 2621267 - DNA, 13 bp, Homo sapiens
gagtgggtgaata

SEQ ID NO: 2621268 - DNA, 21 bp, Homo sapiens
gagtggtctttctggagaggt

SEQ ID NO: 2621269 - DNA, 17 bp, Homo sapiens
gagtgtaagtgtgagta

SEQ ID NO: 2621270 - DNA, 13 bp, Homo sapiens
gagtgtagaagca

SEQ ID NO: 2621271 - DNA, 20 bp, Homo sapiens
gagtgtagaagcattccttc

SEQ ID NO: 2621272 - DNA, 11 bp, Homo sapiens
gagtgtagtga

SEQ ID NO: 2621273 - DNA, 19 bp, Homo sapiens
gagtgtcttaattaaaaga

SEQ ID NO: 2621274 - DNA, 13 bp, Homo sapiens
gagtgtctttcca

SEQ ID NO: 2621275 - DNA, 15 bp, Homo sapiens
gagtgtctttccacg

SEQ ID NO: 2621276 - DNA, 19 bp, Homo sapiens
gagtgtctttccacggagc

SEQ ID NO: 2621277 - DNA, 21 bp, Homo sapiens
gagtgtctttccacggagcca

SEQ ID NO: 2621278 - DNA, 15 bp, Homo sapiens
gagtgtgctggagga

SEQ ID NO: 2621279 - DNA, 17 bp, Homo sapiens
gagtgtggaagccggag

SEQ ID NO: 2621280 - DNA, 17 bp, Homo sapiens
gagttaaaaagggcagg

SEQ ID NO: 2621281 - DNA, 18 bp, Homo sapiens
gagttaacgggtgaataa

SEQ ID NO: 2621282 - DNA, 13 bp, Homo sapiens
gagttaagaagct

SEQ ID NO: 2621283 - DNA, 14 bp, Homo sapiens
gagttaagaagctg

SEQ ID NO: 2621284 - DNA, 16 bp, Homo sapiens
gagttaagaagctgtt

SEQ ID NO: 2621285 - DNA, 14 bp, Homo sapiens
gagttagaggccag

SEQ ID NO: 2621286 - DNA, 20 bp, Homo sapiens
gagttagaggccagcctggc

SEQ ID NO: 2621287 - DNA, 23 bp, Homo sapiens
gagttattttaattatcttttct

SEQ ID NO: 2621288 - DNA, 14 bp, Homo sapiens
gagttcaatgatct

SEQ ID NO: 2621289 - DNA, 19 bp, Homo sapiens
gagttcgagaccagcctgg

SEQ ID NO: 2621290 - DNA, 20 bp, Homo sapiens
gagttcgagaccagcctggc

SEQ ID NO: 2621291 - DNA, 19 bp, Homo sapiens
gagttctcagggctcctgc

SEQ ID NO: 2621292 - DNA, 21 bp, Homo sapiens
gagttctcagggctcctgcct

SEQ ID NO: 2621293 - DNA, 19 bp, Homo sapiens
gagttgatactacagtttg

SEQ ID NO: 2621294 - DNA, 15 bp, Homo sapiens
gagttgattcagctc

SEQ ID NO: 2621295 - DNA, 16 bp, Homo sapiens
gagttgattcagctct

SEQ ID NO: 2621296 - DNA, 13 bp, Homo sapiens
gagttggctggga

SEQ ID NO: 2621297 - DNA, 20 bp, Homo sapiens
gagttgttacatttttaagt

SEQ ID NO: 2621298 - DNA, 19 bp, Homo sapiens
gagtttcattctcctgcct

SEQ ID NO: 2621299 - DNA, 15 bp, Homo sapiens
gagtttcgaggtaga

SEQ ID NO: 2621300 - DNA, 18 bp, Homo sapiens
gagtttgctattagagca

SEQ ID NO: 2621301 - DNA, 19 bp, Homo sapiens
gagttttgttttaaaatta

SEQ ID NO: 2621302 - DNA, 13 bp, Homo sapiens
gataaagatgatc

SEQ ID NO: 2621303 - DNA, 22 bp, Homo sapiens
gataaagatgcaaggaccagga

SEQ ID NO: 2621304 - DNA, 13 bp, Homo sapiens
gataaagatttct

SEQ ID NO: 2621305 - DNA, 16 bp, Homo sapiens
gataaagatttcttga

SEQ ID NO: 2621306 - DNA, 17 bp, Homo sapiens
gataaagccactgaaaa

SEQ ID NO: 2621307 - DNA, 17 bp, Homo sapiens
gataaagtagtaaaaat

SEQ ID NO: 2621308 - DNA, 22 bp, Homo sapiens
gataaatagtttatgattccac

SEQ ID NO: 2621309 - DNA, 18 bp, Homo sapiens
gataaatcagtggttatt

SEQ ID NO: 2621310 - DNA, 16 bp, Homo sapiens
gataaattccactgga

SEQ ID NO: 2621311 - DNA, 15 bp, Homo sapiens
gataacaagatcttt

SEQ ID NO: 2621312 - DNA, 18 bp, Homo sapiens
gataactgttatttataa

SEQ ID NO: 2621313 - DNA, 17 bp, Homo sapiens
gataagaccaccacctc

SEQ ID NO: 2621314 - DNA, 23 bp, Homo sapiens
gataaggtacctttcacatagag

SEQ ID NO: 2621315 - DNA, 18 bp, Homo sapiens
gataatacaccactacat

SEQ ID NO: 2621316 - DNA, 14 bp, Homo sapiens
gataatcagcctct

SEQ ID NO: 2621317 - DNA, 15 bp, Homo sapiens
gataatcagcctctt

SEQ ID NO: 2621318 - DNA, 14 bp, Homo sapiens
gataatgttaaatt

SEQ ID NO: 2621319 - DNA, 13 bp, Homo sapiens
gataattccagtg

SEQ ID NO: 2621320 - DNA, 17 bp, Homo sapiens
gataattccagtggtcc

SEQ ID NO: 2621321 - DNA, 18 bp, Homo sapiens
gataattgcattcatctt

SEQ ID NO: 2621322 - DNA, 13 bp, Homo sapiens
gatacaatgctgt

SEQ ID NO: 2621323 - DNA, 22 bp, Homo sapiens
gatacaatgtatttatttaaaa

SEQ ID NO: 2621324 - DNA, 22 bp, Homo sapiens
gatacactgaagttaacagaga

SEQ ID NO: 2621325 - DNA, 18 bp, Homo sapiens
gatacagtccctaaagaa

SEQ ID NO: 2621326 - DNA, 19 bp, Homo sapiens
gatacagtccctaaagaaa

SEQ ID NO: 2621327 - DNA, 20 bp, Homo sapiens
gatacccatagcttccatga

SEQ ID NO: 2621328 - DNA, 13 bp, Homo sapiens
gatacccccctct

SEQ ID NO: 2621329 - DNA, 13 bp, Homo sapiens
gatacgactttat

SEQ ID NO: 2621330 - DNA, 13 bp, Homo sapiens
gatactctgtcag

SEQ ID NO: 2621331 - DNA, 14 bp, Homo sapiens
gatactggaagttt

SEQ ID NO: 2621332 - DNA, 16 bp, Homo sapiens
gatactggaagttttg

SEQ ID NO: 2621333 - DNA, 16 bp, Homo sapiens
gatagaaataaatagc

SEQ ID NO: 2621334 - DNA, 20 bp, Homo sapiens
gatagaaataaatagctata

SEQ ID NO: 2621335 - DNA, 14 bp, Homo sapiens
gatagaagaactgc

SEQ ID NO: 2621336 - DNA, 17 bp, Homo sapiens
gatagcacagaccctgc

SEQ ID NO: 2621337 - DNA, 20 bp, Homo sapiens
gcaccctggggcctggacct

SEQ ID NO: 2621338 - DNA, 16 bp, Homo sapiens
gcacccttctttcctc

SEQ ID NO: 2621339 - DNA, 18 bp, Homo sapiens
gcacccttctttcctctt

SEQ ID NO: 2621340 - DNA, 21 bp, Homo sapiens
gcacccttctttcctcttccc

SEQ ID NO: 2621341 - DNA, 14 bp, Homo sapiens
gcaccgggccacag

SEQ ID NO: 2621342 - DNA, 17 bp, Homo sapiens
gcaccgtcatggcttaa

SEQ ID NO: 2621343 - DNA, 19 bp, Homo sapiens
gcacctacagtgtacagtc

SEQ ID NO: 2621344 - DNA, 15 bp, Homo sapiens
gcacctaccatcagg

SEQ ID NO: 2621345 - DNA, 17 bp, Homo sapiens
gcacctaccatcaggga

SEQ ID NO: 2621346 - DNA, 18 bp, Homo sapiens
gcacctatagtcccagct

SEQ ID NO: 2621347 - DNA, 21 bp, Homo sapiens
gcacctatagtcccagctact

SEQ ID NO: 2621348 - DNA, 18 bp, Homo sapiens
gcacctccacatcctcca

SEQ ID NO: 2621349 - DNA, 14 bp, Homo sapiens
gcacctcctgcctc

SEQ ID NO: 2621350 - DNA, 15 bp, Homo sapiens
gcacctcctgcctcg

SEQ ID NO: 2621351 - DNA, 21 bp, Homo sapiens
gcacctgatggaaaagatata

SEQ ID NO: 2621352 - DNA, 17 bp, Homo sapiens
gcacctgccccctggtg

SEQ ID NO: 2621353 - DNA, 18 bp, Homo sapiens
gcacctgccccctggtgg

SEQ ID NO: 2621354 - DNA, 20 bp, Homo sapiens
gcacctgcttcatgctcagc

SEQ ID NO: 2621355 - DNA, 22 bp, Homo sapiens
gcacctggaatatataaccagt

SEQ ID NO: 2621356 - DNA, 15 bp, Homo sapiens
gcacctggggagtgg

SEQ ID NO: 2621357 - DNA, 21 bp, Homo sapiens
gcacctgtaatcccagctact

SEQ ID NO: 2621358 - DNA, 21 bp, Homo sapiens
gcaccttaccaactttctgta

SEQ ID NO: 2621359 - DNA, 21 bp, Homo sapiens
gcaccttagacagtccctgcc

SEQ ID NO: 2621360 - DNA, 14 bp, Homo sapiens
gcaccttcagactt

SEQ ID NO: 2621361 - DNA, 20 bp, Homo sapiens
gcaccttgtgtctgtacacg

SEQ ID NO: 2621362 - DNA, 22 bp, Homo sapiens
gcaccttgtgtctgtacacgtg

SEQ ID NO: 2621363 - DNA, 15 bp, Homo sapiens
gcacgaaatgttatt

SEQ ID NO: 2621364 - DNA, 11 bp, Homo sapiens
gcacgcacaca

SEQ ID NO: 2621365 - DNA, 16 bp, Homo sapiens
gcacgcacacacacaa

SEQ ID NO: 2621366 - DNA, 12 bp, Homo sapiens
gcacgcagtggc

SEQ ID NO: 2621367 - DNA, 15 bp, Homo sapiens
gcacgcccatgtgtg

SEQ ID NO: 2621368 - DNA, 21 bp, Homo sapiens
gcacgcttgcgtatgtctgtt

SEQ ID NO: 2621369 - DNA, 16 bp, Homo sapiens
gcacggtgggccttgc

SEQ ID NO: 2621370 - DNA, 19 bp, Homo sapiens
gcacggtgggccttgctgg

SEQ ID NO: 2621371 - DNA, 20 bp, Homo sapiens
gcacggtgggccttgctggg

SEQ ID NO: 2621372 - DNA, 22 bp, Homo sapiens
gcacgtagctgaggccggatgc

SEQ ID NO: 2621373 - DNA, 20 bp, Homo sapiens
gcacgtggagagctggtgcc

SEQ ID NO: 2621374 - DNA, 18 bp, Homo sapiens
gcacgtggcatgtggcct

SEQ ID NO: 2621375 - DNA, 22 bp, Homo sapiens
gcactaaagtatgtaaagtatg

SEQ ID NO: 2621376 - DNA, 18 bp, Homo sapiens
gcactaaggtgtgctctg

SEQ ID NO: 2621377 - DNA, 21 bp, Homo sapiens
gcactacatgtggtttataga

SEQ ID NO: 2621378 - DNA, 16 bp, Homo sapiens
gcactactcctctgca

SEQ ID NO: 2621379 - DNA, 14 bp, Homo sapiens
gcactataatgtaa

SEQ ID NO: 2621380 - DNA, 22 bp, Homo sapiens
gcactatagcctaggtgacaga

SEQ ID NO: 2621381 - DNA, 23 bp, Homo sapiens
gcactcacacaggacccccttcc

SEQ ID NO: 2621382 - DNA, 20 bp, Homo sapiens
gcactcacagacctggagcc

SEQ ID NO: 2621383 - DNA, 19 bp, Homo sapiens
gcactcacccatgtgccaa

SEQ ID NO: 2621384 - DNA, 20 bp, Homo sapiens
gcactcacccatgtgccaag

SEQ ID NO: 2621385 - DNA, 17 bp, Homo sapiens
gcactcagaagacactg

SEQ ID NO: 2621386 - DNA, 17 bp, Homo sapiens
gcactccagcctgggca

SEQ ID NO: 2621387 - DNA, 17 bp, Homo sapiens
gcactccagcctgggtg

SEQ ID NO: 2621388 - DNA, 16 bp, Homo sapiens
gcactccatgagcacc

SEQ ID NO: 2621389 - DNA, 14 bp, Homo sapiens
gcactcccctgctg

SEQ ID NO: 2621390 - DNA, 14 bp, Homo sapiens
gcactctgttattt

SEQ ID NO: 2621391 - DNA, 15 bp, Homo sapiens
gcactgagatattta

SEQ ID NO: 2621392 - DNA, 12 bp, Homo sapiens
gcactgagcccc

SEQ ID NO: 2621393 - DNA, 13 bp, Homo sapiens
gcactgagccccc

SEQ ID NO: 2621394 - DNA, 11 bp, Homo sapiens
gcactgagggc

SEQ ID NO: 2621395 - DNA, 16 bp, Homo sapiens
gcactgagggccacac

SEQ ID NO: 2621396 - DNA, 15 bp, Homo sapiens
gcactgccatgcagg

SEQ ID NO: 2621397 - DNA, 11 bp, Homo sapiens
gcactgcctga

SEQ ID NO: 2621398 - DNA, 15 bp, Homo sapiens
gcactgctgcccagc

SEQ ID NO: 2621399 - DNA, 13 bp, Homo sapiens
gcactgcttccag

SEQ ID NO: 2621400 - DNA, 16 bp, Homo sapiens
gcactgcttccagtga

SEQ ID NO: 2621401 - DNA, 23 bp, Homo sapiens
gcactgcttccagtgaggctctg

SEQ ID NO: 2621402 - DNA, 16 bp, Homo sapiens
gcactgcttgaggaaa

SEQ ID NO: 2621403 - DNA, 14 bp, Homo sapiens
gcactggagtccag

SEQ ID NO: 2621404 - DNA, 16 bp, Homo sapiens
gcactggctctctcca

SEQ ID NO: 2621405 - DNA, 18 bp, Homo sapiens
gcactggctctctccagg

SEQ ID NO: 2621406 - DNA, 15 bp, Homo sapiens
gcactggggagcccg

SEQ ID NO: 2621407 - DNA, 19 bp, Homo sapiens
gcactggggagcccgtctc

SEQ ID NO: 2621408 - DNA, 18 bp, Homo sapiens
gcactgggttgactttca

SEQ ID NO: 2621409 - DNA, 21 bp, Homo sapiens
gcactgtcactttgctctggg

SEQ ID NO: 2621410 - DNA, 18 bp, Homo sapiens
gcactgtgctcagggcta

SEQ ID NO: 2621411 - DNA, 21 bp, Homo sapiens
gcactgttccagcctgccctc

SEQ ID NO: 2621412 - DNA, 22 bp, Homo sapiens
gcacttaacaagctcccaggcc

SEQ ID NO: 2621413 - DNA, 19 bp, Homo sapiens
gcacttaaggcactctgtt

SEQ ID NO: 2621414 - DNA, 21 bp, Homo sapiens
gcacttgcacgcccatgtgtg

SEQ ID NO: 2621415 - DNA, 14 bp, Homo sapiens
gcacttgcagactc

SEQ ID NO: 2621416 - DNA, 18 bp, Homo sapiens
gcacttggactcttgctc

SEQ ID NO: 2621417 - DNA, 19 bp, Homo sapiens
gcactttgttctggctctt

SEQ ID NO: 2621418 - DNA, 14 bp, Homo sapiens
gcactttttcattt

SEQ ID NO: 2621419 - DNA, 14 bp, Homo sapiens
gcagaaaattgcac

SEQ ID NO: 2621420 - DNA, 22 bp, Homo sapiens
gcagaacagtgattaccaggga

SEQ ID NO: 2621421 - DNA, 18 bp, Homo sapiens
gcagaactgagctcctct

SEQ ID NO: 2621422 - DNA, 15 bp, Homo sapiens
gcagaagacaccaga

SEQ ID NO: 2621423 - DNA, 16 bp, Homo sapiens
gcagaagacaccagag

SEQ ID NO: 2621424 - DNA, 18 bp, Homo sapiens
gcagaagacaccagagca

SEQ ID NO: 2621425 - DNA, 15 bp, Homo sapiens
gcagaagggagaagg

SEQ ID NO: 2621426 - DNA, 17 bp, Homo sapiens
gcagaatagcaaggtgc

SEQ ID NO: 2621427 - DNA, 13 bp, Homo sapiens
gcagaatgttttt

SEQ ID NO: 2621428 - DNA, 14 bp, Homo sapiens
gcagacagcagctc

SEQ ID NO: 2621429 - DNA, 16 bp, Homo sapiens
gcagacagcagctcag

SEQ ID NO: 2621430 - DNA, 20 bp, Homo sapiens
gcagacagcagctcaggcac

SEQ ID NO: 2621431 - DNA, 15 bp, Homo sapiens
gcagacaggaccagg

SEQ ID NO: 2621432 - DNA, 18 bp, Homo sapiens
gcagacaggaccagggat

SEQ ID NO: 2621433 - DNA, 13 bp, Homo sapiens
gcagacaggcaag

SEQ ID NO: 2621434 - DNA, 14 bp, Homo sapiens
gcagacaggcaagc

SEQ ID NO: 2621435 - DNA, 19 bp, Homo sapiens
gcagacatgtgcacttgaa

SEQ ID NO: 2621436 - DNA, 19 bp, Homo sapiens
gcagacctgtcctcctggt

SEQ ID NO: 2621437 - DNA, 20 bp, Homo sapiens
gcagactcaataaaatcatg

SEQ ID NO: 2621438 - DNA, 15 bp, Homo sapiens
gcagagaaagaagag

SEQ ID NO: 2621439 - DNA, 20 bp, Homo sapiens
gcagagaatcatacttagca

SEQ ID NO: 2621440 - DNA, 21 bp, Homo sapiens
gcagagaatgaaagggcccag

SEQ ID NO: 2621441 - DNA, 22 bp, Homo sapiens
gcagagaatgaaagggcccaga

SEQ ID NO: 2621442 - DNA, 23 bp, Homo sapiens
gcagagaatgaaagggcccagag

SEQ ID NO: 2621443 - DNA, 13 bp, Homo sapiens
gcagagacactaa

SEQ ID NO: 2621444 - DNA, 14 bp, Homo sapiens
gcagagaccatccc

SEQ ID NO: 2621445 - DNA, 21 bp, Homo sapiens
gcagagagccattttgtgaat

SEQ ID NO: 2621446 - DNA, 14 bp, Homo sapiens
gcagagcagagacc

SEQ ID NO: 2621447 - DNA, 20 bp, Homo sapiens
gcagagcgccgtgagttctc

SEQ ID NO: 2621448 - DNA, 18 bp, Homo sapiens
gcagaggggctttctgga

SEQ ID NO: 2621449 - DNA, 20 bp, Homo sapiens
gcagaggggctttctggaga

SEQ ID NO: 2621450 - DNA, 19 bp, Homo sapiens
gcagaggggtaggcagagc

SEQ ID NO: 2621451 - DNA, 23 bp, Homo sapiens
gcagaggtaaaagtgtgagcagt

SEQ ID NO: 2621452 - DNA, 14 bp, Homo sapiens
gcagaggtggccag

SEQ ID NO: 2621453 - DNA, 13 bp, Homo sapiens
gcagagtcacacg

SEQ ID NO: 2621454 - DNA, 14 bp, Homo sapiens
gcagagtcacacgg

SEQ ID NO: 2621455 - DNA, 18 bp, Homo sapiens
gcagagtttccaaaacca

SEQ ID NO: 2621456 - DNA, 15 bp, Homo sapiens
gcagatcccagctca

SEQ ID NO: 2621457 - DNA, 19 bp, Homo sapiens
gcagatgaggttgctagag

SEQ ID NO: 2621458 - DNA, 19 bp, Homo sapiens
gcagatgcaaagaggcaag

SEQ ID NO: 2621459 - DNA, 13 bp, Homo sapiens
gcagatgcaatga

SEQ ID NO: 2621460 - DNA, 17 bp, Homo sapiens
gcagatgcagagagcca

SEQ ID NO: 2621461 - DNA, 18 bp, Homo sapiens
gcagatgtccttgatgct

SEQ ID NO: 2621462 - DNA, 20 bp, Homo sapiens
gcagattcatttttctttct

SEQ ID NO: 2621463 - DNA, 12 bp, Homo sapiens
gcagcaataaag

SEQ ID NO: 2621464 - DNA, 23 bp, Homo sapiens
gcagcaataaagcagcgtttcta

SEQ ID NO: 2621465 - DNA, 18 bp, Homo sapiens
gcagcactcacacaggac

SEQ ID NO: 2621466 - DNA, 19 bp, Homo sapiens
gcagcactcacacaggacc

SEQ ID NO: 2621467 - DNA, 17 bp, Homo sapiens
gcagcagggctaccctg

SEQ ID NO: 2621468 - DNA, 17 bp, Homo sapiens
gcagcagtgagtctctt

SEQ ID NO: 2621469 - DNA, 20 bp, Homo sapiens
gcagcagtgtgaggccaggg

SEQ ID NO: 2621470 - DNA, 22 bp, Homo sapiens
gcagcagtgtgaggccagggca

SEQ ID NO: 2621471 - DNA, 14 bp, Homo sapiens
gcagcatatgagga

SEQ ID NO: 2621472 - DNA, 18 bp, Homo sapiens
gcagcatattcaggaagc

SEQ ID NO: 2621473 - DNA, 20 bp, Homo sapiens
gcagcatgttgctgaggagt

SEQ ID NO: 2621474 - DNA, 17 bp, Homo sapiens
gcagccaagctccttgg

SEQ ID NO: 2621475 - DNA, 21 bp, Homo sapiens
gcagccaaggccgaagctctg

SEQ ID NO: 2621476 - DNA, 16 bp, Homo sapiens
gcagccagctctcagc

SEQ ID NO: 2621477 - DNA, 17 bp, Homo sapiens
gcagccagctctcagcc

SEQ ID NO: 2621478 - DNA, 14 bp, Homo sapiens
gcagccaggctgcc

SEQ ID NO: 2621479 - DNA, 18 bp, Homo sapiens
gcagcccacccctcaaca

SEQ ID NO: 2621480 - DNA, 24 bp, Homo sapiens
gcagccccattctgcctgcccagg

SEQ ID NO: 2621481 - DNA, 22 bp, Homo sapiens
gcccagtctggaatgcagtggt

SEQ ID NO: 2621482 - DNA, 15 bp, Homo sapiens
gcccagttgggtgga

SEQ ID NO: 2621483 - DNA, 19 bp, Homo sapiens
gcccagttgggtggatgcc

SEQ ID NO: 2621484 - DNA, 16 bp, Homo sapiens
gcccagtttcagggct

SEQ ID NO: 2621485 - DNA, 17 bp, Homo sapiens
gcccagtttcagggcta

SEQ ID NO: 2621486 - DNA, 22 bp, Homo sapiens
gcccatctatgtcccttgctgt

SEQ ID NO: 2621487 - DNA, 16 bp, Homo sapiens
gcccatgccaccgctt

SEQ ID NO: 2621488 - DNA, 13 bp, Homo sapiens
gcccatgcccacc

SEQ ID NO: 2621489 - DNA, 14 bp, Homo sapiens
gcccatgcccacct

SEQ ID NO: 2621490 - DNA, 22 bp, Homo sapiens
gcccatggccctcccagtacct

SEQ ID NO: 2621491 - DNA, 21 bp, Homo sapiens
gcccatggttgagaaatgaat

SEQ ID NO: 2621492 - DNA, 19 bp, Homo sapiens
gcccatgtcgcgctcagca

SEQ ID NO: 2621493 - DNA, 14 bp, Homo sapiens
gcccatgtgtgagt

SEQ ID NO: 2621494 - DNA, 15 bp, Homo sapiens
gcccatgtgtgagtg

SEQ ID NO: 2621495 - DNA, 16 bp, Homo sapiens
gcccattcattccatt

SEQ ID NO: 2621496 - DNA, 19 bp, Homo sapiens
gcccattcattccattctg

SEQ ID NO: 2621497 - DNA, 20 bp, Homo sapiens
gcccatttcaattctcaaaa

SEQ ID NO: 2621498 - DNA, 21 bp, Homo sapiens
gccccaaaaccacagccctgt

SEQ ID NO: 2621499 - DNA, 22 bp, Homo sapiens
gccccaaaaccacagccctgtc

SEQ ID NO: 2621500 - DNA, 11 bp, Homo sapiens
gccccaaaagg

SEQ ID NO: 2621501 - DNA, 20 bp, Homo sapiens
gccccaaacgggctgccctg

SEQ ID NO: 2621502 - DNA, 15 bp, Homo sapiens
gccccaagtcctgaa

SEQ ID NO: 2621503 - DNA, 20 bp, Homo sapiens
gccccaagtcctgaagaggc

SEQ ID NO: 2621504 - DNA, 15 bp, Homo sapiens
gccccacccaggagg

SEQ ID NO: 2621505 - DNA, 15 bp, Homo sapiens
gccccacctttatta

SEQ ID NO: 2621506 - DNA, 15 bp, Homo sapiens
gccccagaaggcagg

SEQ ID NO: 2621507 - DNA, 18 bp, Homo sapiens
gccccagatcaccagccc

SEQ ID NO: 2621508 - DNA, 20 bp, Homo sapiens
gccccagatcaccagcccgg

SEQ ID NO: 2621509 - DNA, 19 bp, Homo sapiens
gccccagcactaaagcagt

SEQ ID NO: 2621510 - DNA, 23 bp, Homo sapiens
gccccagcactaaagcagtggac

SEQ ID NO: 2621511 - DNA, 19 bp, Homo sapiens
gccccagcactaacgtaaa

SEQ ID NO: 2621512 - DNA, 10 bp, Homo sapiens
gccccagcca

SEQ ID NO: 2621513 - DNA, 14 bp, Homo sapiens
gccccagccagagt

SEQ ID NO: 2621514 - DNA, 18 bp, Homo sapiens
gccccagcccaccctcct

SEQ ID NO: 2621515 - DNA, 20 bp, Homo sapiens
gccccagcccaccctcctgt

SEQ ID NO: 2621516 - DNA, 17 bp, Homo sapiens
gccccagccccctttgg

SEQ ID NO: 2621517 - DNA, 17 bp, Homo sapiens
gccccagctgacatgga

SEQ ID NO: 2621518 - DNA, 18 bp, Homo sapiens
gccccagggctaccctcc

SEQ ID NO: 2621519 - DNA, 17 bp, Homo sapiens
gccccagggtcttccct

SEQ ID NO: 2621520 - DNA, 13 bp, Homo sapiens
gccccagtcagcc

SEQ ID NO: 2621521 - DNA, 14 bp, Homo sapiens
gccccagtcagcct

SEQ ID NO: 2621522 - DNA, 18 bp, Homo sapiens
gccccagtcagcctctct

SEQ ID NO: 2621523 - DNA, 12 bp, Homo sapiens
gccccagtgccc

SEQ ID NO: 2621524 - DNA, 21 bp, Homo sapiens
gccccataattttttttttcc

SEQ ID NO: 2621525 - DNA, 19 bp, Homo sapiens
gccccatcaggactcttgt

SEQ ID NO: 2621526 - DNA, 13 bp, Homo sapiens
gccccatcctctg

SEQ ID NO: 2621527 - DNA, 14 bp, Homo sapiens
gccccatcctctgt

SEQ ID NO: 2621528 - DNA, 23 bp, Homo sapiens
gccccatcctctgtacagagccc

SEQ ID NO: 2621529 - DNA, 16 bp, Homo sapiens
gccccatgcctgtcca

SEQ ID NO: 2621530 - DNA, 12 bp, Homo sapiens
gccccattcctg

SEQ ID NO: 2621531 - DNA, 15 bp, Homo sapiens
gccccattctgcctg

SEQ ID NO: 2621532 - DNA, 18 bp, Homo sapiens
gccccattctgcctgccc

SEQ ID NO: 2621533 - DNA, 20 bp, Homo sapiens
gccccattctgcctgcccag

SEQ ID NO: 2621534 - DNA, 23 bp, Homo sapiens
gccccattctgcctgcccaggcc

SEQ ID NO: 2621535 - DNA, 15 bp, Homo sapiens
gcccccacagtgctg

SEQ ID NO: 2621536 - DNA, 22 bp, Homo sapiens
gcccccaccacggccactggcc

SEQ ID NO: 2621537 - DNA, 16 bp, Homo sapiens
gcccccacctccaccc

SEQ ID NO: 2621538 - DNA, 15 bp, Homo sapiens
gcccccagctggccc

SEQ ID NO: 2621539 - DNA, 16 bp, Homo sapiens
gcccccaggctgctgg

SEQ ID NO: 2621540 - DNA, 19 bp, Homo sapiens
gcccccccaacactgtgcc

SEQ ID NO: 2621541 - DNA, 22 bp, Homo sapiens
gcccccccaacactgtgccctg

SEQ ID NO: 2621542 - DNA, 14 bp, Homo sapiens
gcccccccttccac

SEQ ID NO: 2621543 - DNA, 11 bp, Homo sapiens
gcccccctcaa

SEQ ID NO: 2621544 - DNA, 14 bp, Homo sapiens
gcccccgagctggg

SEQ ID NO: 2621545 - DNA, 11 bp, Homo sapiens
gcccccgcccc

SEQ ID NO: 2621546 - DNA, 16 bp, Homo sapiens
gcccccgccccgcccc

SEQ ID NO: 2621547 - DNA, 19 bp, Homo sapiens
gccccctcctctagctgtg

SEQ ID NO: 2621548 - DNA, 18 bp, Homo sapiens
gccccctgccccccagcc

SEQ ID NO: 2621549 - DNA, 14 bp, Homo sapiens
gccccctgccctcc

SEQ ID NO: 2621550 - DNA, 19 bp, Homo sapiens
gccccctgccctcccctct

SEQ ID NO: 2621551 - DNA, 13 bp, Homo sapiens
gccccctggtctc

SEQ ID NO: 2621552 - DNA, 22 bp, Homo sapiens
gccccctggtggacagtcctgg

SEQ ID NO: 2621553 - DNA, 19 bp, Homo sapiens
gcccccttctcccacactg

SEQ ID NO: 2621554 - DNA, 22 bp, Homo sapiens
gcccccttctcccacactgcta

SEQ ID NO: 2621555 - DNA, 16 bp, Homo sapiens
gccccctttcagatgt

SEQ ID NO: 2621556 - DNA, 19 bp, Homo sapiens
gccccctttgggcccaggg

SEQ ID NO: 2621557 - DNA, 14 bp, Homo sapiens
gccccgcccaggct

SEQ ID NO: 2621558 - DNA, 13 bp, Homo sapiens
gccccgccccaca

SEQ ID NO: 2621559 - DNA, 18 bp, Homo sapiens
gccccggccccagccaga

SEQ ID NO: 2621560 - DNA, 14 bp, Homo sapiens
gccccggccctggg

SEQ ID NO: 2621561 - DNA, 18 bp, Homo sapiens
gccccgtcaccatctcag

SEQ ID NO: 2621562 - DNA, 21 bp, Homo sapiens
gccccgtcaccatctcaggcc

SEQ ID NO: 2621563 - DNA, 20 bp, Homo sapiens
gcccctagaatcagcctagg

SEQ ID NO: 2621564 - DNA, 17 bp, Homo sapiens
gcccctcacctgggcac

SEQ ID NO: 2621565 - DNA, 16 bp, Homo sapiens
gcccctcagggtccct

SEQ ID NO: 2621566 - DNA, 21 bp, Homo sapiens
gcccctcagggtccctggtgg

SEQ ID NO: 2621567 - DNA, 14 bp, Homo sapiens
gcccctccagcttg

SEQ ID NO: 2621568 - DNA, 16 bp, Homo sapiens
gcccctcccaccacag

SEQ ID NO: 2621569 - DNA, 14 bp, Homo sapiens
gcccctctgcccag

SEQ ID NO: 2621570 - DNA, 18 bp, Homo sapiens
gcccctctgcccagcttg

SEQ ID NO: 2621571 - DNA, 19 bp, Homo sapiens
gcccctcttgccccccacc

SEQ ID NO: 2621572 - DNA, 21 bp, Homo sapiens
gcccctcttgccccccacccc

SEQ ID NO: 2621573 - DNA, 13 bp, Homo sapiens
gcccctgcacaaa

SEQ ID NO: 2621574 - DNA, 19 bp, Homo sapiens
gcccctgcactccagcctg

SEQ ID NO: 2621575 - DNA, 23 bp, Homo sapiens
gcccctgcatccccttggctgtg

SEQ ID NO: 2621576 - DNA, 18 bp, Homo sapiens
gcccctgccacctccctg

SEQ ID NO: 2621577 - DNA, 12 bp, Homo sapiens
gcccctgccccg

SEQ ID NO: 2621578 - DNA, 20 bp, Homo sapiens
gcccctgccccgtcaccatc

SEQ ID NO: 2621579 - DNA, 14 bp, Homo sapiens
gcccctgcccggct

SEQ ID NO: 2621580 - DNA, 17 bp, Homo sapiens
gcccctgctgcctcccc

SEQ ID NO: 2621581 - DNA, 20 bp, Homo sapiens
gcccctgctgcctccccaac

SEQ ID NO: 2621582 - DNA, 12 bp, Homo sapiens
gcccctgctggt

SEQ ID NO: 2621583 - DNA, 16 bp, Homo sapiens
gcccctgctggttcag

SEQ ID NO: 2621584 - DNA, 16 bp, Homo sapiens
gcccctggatgcagcc

SEQ ID NO: 2621585 - DNA, 22 bp, Homo sapiens
gcccctggatgcagcctcacag

SEQ ID NO: 2621586 - DNA, 19 bp, Homo sapiens
gcccctggcccagcggccc

SEQ ID NO: 2621587 - DNA, 22 bp, Homo sapiens
gcccctggcccagcggcccctc

SEQ ID NO: 2621588 - DNA, 20 bp, Homo sapiens
gcccctgggtgggtggtggg

SEQ ID NO: 2621589 - DNA, 16 bp, Homo sapiens
gcccctggtcctgagg

SEQ ID NO: 2621590 - DNA, 13 bp, Homo sapiens
gcccctgttctct

SEQ ID NO: 2621591 - DNA, 20 bp, Homo sapiens
gccccttcacttctgaccac

SEQ ID NO: 2621592 - DNA, 21 bp, Homo sapiens
gccccttcacttctgaccaca

SEQ ID NO: 2621593 - DNA, 19 bp, Homo sapiens
gccccttcccactcacccc

SEQ ID NO: 2621594 - DNA, 23 bp, Homo sapiens
gccccttctaggtggcaaggctg

SEQ ID NO: 2621595 - DNA, 15 bp, Homo sapiens
gcccctttacggaca

SEQ ID NO: 2621596 - DNA, 19 bp, Homo sapiens
gcccctttttactcccctt

SEQ ID NO: 2621597 - DNA, 21 bp, Homo sapiens
gcccgaatacaaacacctgga

SEQ ID NO: 2621598 - DNA, 18 bp, Homo sapiens
gcccgacttgctgttttg

SEQ ID NO: 2621599 - DNA, 14 bp, Homo sapiens
gcccgagctggtgc

SEQ ID NO: 2621600 - DNA, 16 bp, Homo sapiens
gcccgcacccccaccc

SEQ ID NO: 2621601 - DNA, 13 bp, Homo sapiens
gcccgcctgccag

SEQ ID NO: 2621602 - DNA, 17 bp, Homo sapiens
gcccgcctgccagtcct

SEQ ID NO: 2621603 - DNA, 22 bp, Homo sapiens
gcccgcctgccagtcctagctg

SEQ ID NO: 2621604 - DNA, 15 bp, Homo sapiens
gcccgctctgcagac

SEQ ID NO: 2621605 - DNA, 16 bp, Homo sapiens
gcccgctgggctgagc

SEQ ID NO: 2621606 - DNA, 13 bp, Homo sapiens
gcccggctccagg

SEQ ID NO: 2621607 - DNA, 14 bp, Homo sapiens
gcccggctccaggc

SEQ ID NO: 2621608 - DNA, 18 bp, Homo sapiens
gcccgggaaggtcaccag

SEQ ID NO: 2621609 - DNA, 23 bp, Homo sapiens
gcccgggaaggtcaccagcacca

SEQ ID NO: 2621610 - DNA, 19 bp, Homo sapiens
gcccgggagctgctgccct

SEQ ID NO: 2621611 - DNA, 19 bp, Homo sapiens
gcccgggcgcggccagccc

SEQ ID NO: 2621612 - DNA, 17 bp, Homo sapiens
gcccggggcagctgcca

SEQ ID NO: 2621613 - DNA, 14 bp, Homo sapiens
gcccgtcttcagcc

SEQ ID NO: 2621614 - DNA, 17 bp, Homo sapiens
gcccgtcttcagcctag

SEQ ID NO: 2621615 - DNA, 13 bp, Homo sapiens
gcccgtgacagac

SEQ ID NO: 2621616 - DNA, 19 bp, Homo sapiens
gcccgtgacagactcctga

SEQ ID NO: 2621617 - DNA, 20 bp, Homo sapiens
gcccgtgacatccccaccct

SEQ ID NO: 2621618 - DNA, 15 bp, Homo sapiens
gccctaaaagcacac

SEQ ID NO: 2621619 - DNA, 20 bp, Homo sapiens
gccctaccagcgcccgctgg

SEQ ID NO: 2621620 - DNA, 22 bp, Homo sapiens
gccctaccagcgcccgctgggc

SEQ ID NO: 2621621 - DNA, 23 bp, Homo sapiens
gccctaccagcgcccgctgggct

SEQ ID NO: 2621622 - DNA, 21 bp, Homo sapiens
gccctacttctttgctttgcc

SEQ ID NO: 2621623 - DNA, 21 bp, Homo sapiens
gccctagagcacactgtagca

SEQ ID NO: 2621624 - DNA, 19 bp, Homo sapiens
gccctagagcctgcctgga

SEQ ID NO: 2621625 - DNA, 20 bp, Homo sapiens
gcgcacaatagtaacctggg

SEQ ID NO: 2621626 - DNA, 12 bp, Homo sapiens
gcgcacctgccc

SEQ ID NO: 2621627 - DNA, 18 bp, Homo sapiens
gcgcacctgccccctggt

SEQ ID NO: 2621628 - DNA, 21 bp, Homo sapiens
gcgcactttcctcctggcaga

SEQ ID NO: 2621629 - DNA, 14 bp, Homo sapiens
gcgcagtgcctctg

SEQ ID NO: 2621630 - DNA, 22 bp, Homo sapiens
gcgcagtgcttctctacagact

SEQ ID NO: 2621631 - DNA, 21 bp, Homo sapiens
gcgccagcacagaaacagagg

SEQ ID NO: 2621632 - DNA, 13 bp, Homo sapiens
gcgcccgcgcccg

SEQ ID NO: 2621633 - DNA, 13 bp, Homo sapiens
gcgcccgctgggc

SEQ ID NO: 2621634 - DNA, 20 bp, Homo sapiens
gcgccgagtctgtctctgtc

SEQ ID NO: 2621635 - DNA, 17 bp, Homo sapiens
gcgccgcaaaccacact

SEQ ID NO: 2621636 - DNA, 15 bp, Homo sapiens
gcgcggccagccccg

SEQ ID NO: 2621637 - DNA, 23 bp, Homo sapiens
gcgctgacaaccaccgctcccca

SEQ ID NO: 2621638 - DNA, 22 bp, Homo sapiens
gcgctttctggaaaagaggagt

SEQ ID NO: 2621639 - DNA, 11 bp, Homo sapiens
gcggacagcca

SEQ ID NO: 2621640 - DNA, 19 bp, Homo sapiens
gcggacagccacggccagg

SEQ ID NO: 2621641 - DNA, 22 bp, Homo sapiens
gcggagagaggccttgtcccag

SEQ ID NO: 2621642 - DNA, 12 bp, Homo sapiens
gcggagctggcc

SEQ ID NO: 2621643 - DNA, 14 bp, Homo sapiens
gcggagctggcccc

SEQ ID NO: 2621644 - DNA, 17 bp, Homo sapiens
gcggagctggccccgcc

SEQ ID NO: 2621645 - DNA, 14 bp, Homo sapiens
gcggagtgaagagg

SEQ ID NO: 2621646 - DNA, 20 bp, Homo sapiens
gcggagtgaagaggggcagc

SEQ ID NO: 2621647 - DNA, 21 bp, Homo sapiens
gcggagtgaagaggggcagcc

SEQ ID NO: 2621648 - DNA, 22 bp, Homo sapiens
gcggagtgaagaggggcagccc

SEQ ID NO: 2621649 - DNA, 12 bp, Homo sapiens
gcggcacagcct

SEQ ID NO: 2621650 - DNA, 21 bp, Homo sapiens
gcggccagccccggccctggg

SEQ ID NO: 2621651 - DNA, 16 bp, Homo sapiens
gcggcccctcccgccc

SEQ ID NO: 2621652 - DNA, 18 bp, Homo sapiens
gcggcggagctggccccg

SEQ ID NO: 2621653 - DNA, 17 bp, Homo sapiens
gcggctgctgtgtgcct

SEQ ID NO: 2621654 - DNA, 17 bp, Homo sapiens
gcgggaaagccagtgac

SEQ ID NO: 2621655 - DNA, 14 bp, Homo sapiens
gcgggaaggagggt

SEQ ID NO: 2621656 - DNA, 15 bp, Homo sapiens
gcgggatggtcctgg

SEQ ID NO: 2621657 - DNA, 15 bp, Homo sapiens
gcgggccaaggactg

SEQ ID NO: 2621658 - DNA, 20 bp, Homo sapiens
gcgggccaaggactgccgac

SEQ ID NO: 2621659 - DNA, 13 bp, Homo sapiens
gcggggacagctc

SEQ ID NO: 2621660 - DNA, 17 bp, Homo sapiens
gcggggacagctccttc

SEQ ID NO: 2621661 - DNA, 14 bp, Homo sapiens
gcgggtgggggtgg

SEQ ID NO: 2621662 - DNA, 19 bp, Homo sapiens
gcggtgctatctcccccag

SEQ ID NO: 2621663 - DNA, 14 bp, Homo sapiens
gcggtggaaggccc

SEQ ID NO: 2621664 - DNA, 13 bp, Homo sapiens
gcgtatgtctgtt

SEQ ID NO: 2621665 - DNA, 21 bp, Homo sapiens
gcgtatgtctgttaccatgtc

SEQ ID NO: 2621666 - DNA, 16 bp, Homo sapiens
gcgtcagcctccagcc

SEQ ID NO: 2621667 - DNA, 18 bp, Homo sapiens
gcgtcagcctccagcctc

SEQ ID NO: 2621668 - DNA, 21 bp, Homo sapiens
gcgtcagcctccagcctctgt

SEQ ID NO: 2621669 - DNA, 20 bp, Homo sapiens
gcgtccgcgcgccagcacag

SEQ ID NO: 2621670 - DNA, 14 bp, Homo sapiens
gcgtcctcctctgt

SEQ ID NO: 2621671 - DNA, 13 bp, Homo sapiens
gcgtcctgtccac

SEQ ID NO: 2621672 - DNA, 19 bp, Homo sapiens
gcgtcctgtccacacccag

SEQ ID NO: 2621673 - DNA, 20 bp, Homo sapiens
gcgtctcctgtttttctggg

SEQ ID NO: 2621674 - DNA, 12 bp, Homo sapiens
gcgtgaaacaca

SEQ ID NO: 2621675 - DNA, 20 bp, Homo sapiens
gcgtgaaacacaccaggctg

SEQ ID NO: 2621676 - DNA, 15 bp, Homo sapiens
gcgtgaaggccgaga

SEQ ID NO: 2621677 - DNA, 23 bp, Homo sapiens
gcgtgagccactgcaccgggcca

SEQ ID NO: 2621678 - DNA, 19 bp, Homo sapiens
gcgtgatcaaagccacact

SEQ ID NO: 2621679 - DNA, 23 bp, Homo sapiens
gcgtgcacacaccagagcccacc

SEQ ID NO: 2621680 - DNA, 14 bp, Homo sapiens
gcgtgccctcgctg

SEQ ID NO: 2621681 - DNA, 21 bp, Homo sapiens
gcgtgctcagttcagaatcac

SEQ ID NO: 2621682 - DNA, 14 bp, Homo sapiens
gcgtggacaggtgt

SEQ ID NO: 2621683 - DNA, 13 bp, Homo sapiens
gcgtggactctgc

SEQ ID NO: 2621684 - DNA, 14 bp, Homo sapiens
gcgtggactctgca

SEQ ID NO: 2621685 - DNA, 19 bp, Homo sapiens
gcgtggagggcgtggaggg

SEQ ID NO: 2621686 - DNA, 18 bp, Homo sapiens
gcgtggtcactgctgtca

SEQ ID NO: 2621687 - DNA, 13 bp, Homo sapiens
gcgtgtggctcac

SEQ ID NO: 2621688 - DNA, 21 bp, Homo sapiens
gcgtgtggctcacgtgtgtga

SEQ ID NO: 2621689 - DNA, 20 bp, Homo sapiens
gcgtgtgtagagttaagaag

SEQ ID NO: 2621690 - DNA, 16 bp, Homo sapiens
gcgttactaattggcc

SEQ ID NO: 2621691 - DNA, 17 bp, Homo sapiens
gcgttccatgatgctgg

SEQ ID NO: 2621692 - DNA, 18 bp, Homo sapiens
gcgtttctatgacacatg

SEQ ID NO: 2621693 - DNA, 16 bp, Homo sapiens
gctaaaacctgagcta

SEQ ID NO: 2621694 - DNA, 17 bp, Homo sapiens
gctaaagcaatatgcat

SEQ ID NO: 2621695 - DNA, 19 bp, Homo sapiens
gctaaagcaatatgcattt

SEQ ID NO: 2621696 - DNA, 23 bp, Homo sapiens
gctaaatggtcgcccaggagaca

SEQ ID NO: 2621697 - DNA, 17 bp, Homo sapiens
gctaaatgtaacagtct

SEQ ID NO: 2621698 - DNA, 16 bp, Homo sapiens
gctaacactggcccct

SEQ ID NO: 2621699 - DNA, 17 bp, Homo sapiens
gctaacactggccccta

SEQ ID NO: 2621700 - DNA, 17 bp, Homo sapiens
gctaacattttaaataa

SEQ ID NO: 2621701 - DNA, 23 bp, Homo sapiens
gctaacattttaaataaaagaaa

SEQ ID NO: 2621702 - DNA, 21 bp, Homo sapiens
gctaacccccttctactgagc

SEQ ID NO: 2621703 - DNA, 22 bp, Homo sapiens
gctaacccccttctactgagcc

SEQ ID NO: 2621704 - DNA, 20 bp, Homo sapiens
gctaacttggagccccagtg

SEQ ID NO: 2621705 - DNA, 20 bp, Homo sapiens
gctaagagggagggagggct

SEQ ID NO: 2621706 - DNA, 22 bp, Homo sapiens
gctaagagggagggagggctcc

SEQ ID NO: 2621707 - DNA, 16 bp, Homo sapiens
gctaaggcgtggagct

SEQ ID NO: 2621708 - DNA, 17 bp, Homo sapiens
gctaaggcgtggagctg

SEQ ID NO: 2621709 - DNA, 22 bp, Homo sapiens
gctaaggcgtggagctgcctga

SEQ ID NO: 2621710 - DNA, 17 bp, Homo sapiens
gctaatctgtagggctg

SEQ ID NO: 2621711 - DNA, 15 bp, Homo sapiens
gctaatgggacacta

SEQ ID NO: 2621712 - DNA, 19 bp, Homo sapiens
gctacaaagaagacatgtt

SEQ ID NO: 2621713 - DNA, 22 bp, Homo sapiens
gctacaattttctcccaggaag

SEQ ID NO: 2621714 - DNA, 14 bp, Homo sapiens
gctacacagggatg

SEQ ID NO: 2621715 - DNA, 14 bp, Homo sapiens
gctacaggttacaa

SEQ ID NO: 2621716 - DNA, 15 bp, Homo sapiens
gctacaggttacaac

SEQ ID NO: 2621717 - DNA, 20 bp, Homo sapiens
gctacaggttacaacagatt

SEQ ID NO: 2621718 - DNA, 17 bp, Homo sapiens
gctacccacttctaaat

SEQ ID NO: 2621719 - DNA, 16 bp, Homo sapiens
gctacccgcagagttc

SEQ ID NO: 2621720 - DNA, 22 bp, Homo sapiens
gctacccgcagagttctcagaa

SEQ ID NO: 2621721 - DNA, 14 bp, Homo sapiens
gctacccgggaagg

SEQ ID NO: 2621722 - DNA, 15 bp, Homo sapiens
gctacccgggaaggg

SEQ ID NO: 2621723 - DNA, 12 bp, Homo sapiens
gctaccctgagc

SEQ ID NO: 2621724 - DNA, 14 bp, Homo sapiens
gctacctcactggg

SEQ ID NO: 2621725 - DNA, 19 bp, Homo sapiens
gctacgttcctattgtcat

SEQ ID NO: 2621726 - DNA, 15 bp, Homo sapiens
gctactcagaagcct

SEQ ID NO: 2621727 - DNA, 21 bp, Homo sapiens
gctactcagaagcctgaggct

SEQ ID NO: 2621728 - DNA, 17 bp, Homo sapiens
gctactgatttcctttg

SEQ ID NO: 2621729 - DNA, 19 bp, Homo sapiens
gctactgcagctttacatg

SEQ ID NO: 2621730 - DNA, 20 bp, Homo sapiens
gctactgtcctacccaccct

SEQ ID NO: 2621731 - DNA, 18 bp, Homo sapiens
gctacttcctcctcccca

SEQ ID NO: 2621732 - DNA, 13 bp, Homo sapiens
gctacttgggagg

SEQ ID NO: 2621733 - DNA, 17 bp, Homo sapiens
gctacttgggaggctga

SEQ ID NO: 2621734 - DNA, 19 bp, Homo sapiens
gctagaaccaagaagggct

SEQ ID NO: 2621735 - DNA, 18 bp, Homo sapiens
gctagaacctagaagggc

SEQ ID NO: 2621736 - DNA, 19 bp, Homo sapiens
gctagaacctagaagggct

SEQ ID NO: 2621737 - DNA, 20 bp, Homo sapiens
gctagaacctggaagggcta

SEQ ID NO: 2621738 - DNA, 15 bp, Homo sapiens
gctagaacctggaga

SEQ ID NO: 2621739 - DNA, 19 bp, Homo sapiens
gctagaacctggagggctg

SEQ ID NO: 2621740 - DNA, 15 bp, Homo sapiens
gctagaaggccacat

SEQ ID NO: 2621741 - DNA, 17 bp, Homo sapiens
gctagaatatcctactt

SEQ ID NO: 2621742 - DNA, 20 bp, Homo sapiens
gctagaggaaccaaccccca

SEQ ID NO: 2621743 - DNA, 19 bp, Homo sapiens
gctagatgggcatggggtg

SEQ ID NO: 2621744 - DNA, 17 bp, Homo sapiens
gctagcacttggagcca

SEQ ID NO: 2621745 - DNA, 21 bp, Homo sapiens
gctagctcccctcctctcccc

SEQ ID NO: 2621746 - DNA, 16 bp, Homo sapiens
gctagctgcagagcca

SEQ ID NO: 2621747 - DNA, 15 bp, Homo sapiens
gctaggaacactcct

SEQ ID NO: 2621748 - DNA, 21 bp, Homo sapiens
gctaggaacactccttcacag

SEQ ID NO: 2621749 - DNA, 18 bp, Homo sapiens
gctaggaatgaaatcctg

SEQ ID NO: 2621750 - DNA, 16 bp, Homo sapiens
gctagtcttaagaact

SEQ ID NO: 2621751 - DNA, 21 bp, Homo sapiens
gctagtgtggtgtttcctggc

SEQ ID NO: 2621752 - DNA, 16 bp, Homo sapiens
gctagttgggcttcct

SEQ ID NO: 2621753 - DNA, 17 bp, Homo sapiens
gctataaacaattacat

SEQ ID NO: 2621754 - DNA, 16 bp, Homo sapiens
gctatagctcaggacc

SEQ ID NO: 2621755 - DNA, 13 bp, Homo sapiens
gctataggtgcta

SEQ ID NO: 2621756 - DNA, 19 bp, Homo sapiens
gctataggtgctacaaaaa

SEQ ID NO: 2621757 - DNA, 14 bp, Homo sapiens
gctatatccatgta

SEQ ID NO: 2621758 - DNA, 18 bp, Homo sapiens
gctatatccatgtactgt

SEQ ID NO: 2621759 - DNA, 19 bp, Homo sapiens
gctatatccatgtactgta

SEQ ID NO: 2621760 - DNA, 21 bp, Homo sapiens
gctatatccatgtactgtagt

SEQ ID NO: 2621761 - DNA, 19 bp, Homo sapiens
gctatccagctatttttat

SEQ ID NO: 2621762 - DNA, 15 bp, Homo sapiens
gctatcctggctctt

SEQ ID NO: 2621763 - DNA, 15 bp, Homo sapiens
gctatctcccccagc

SEQ ID NO: 2621764 - DNA, 18 bp, Homo sapiens
gctatctcccccagcccc

SEQ ID NO: 2621765 - DNA, 19 bp, Homo sapiens
gctatctcccccagcccca

SEQ ID NO: 2621766 - DNA, 20 bp, Homo sapiens
gctatctcccccagccccat

SEQ ID NO: 2621767 - DNA, 23 bp, Homo sapiens
gctatctctcagtgaactgtgag

SEQ ID NO: 2621768 - DNA, 12 bp, Homo sapiens
gctatcttaatt

SEQ ID NO: 2621769 - DNA, 23 bp, Homo sapiens
ggaacatcatcaaggcactgcct

SEQ ID NO: 2621770 - DNA, 17 bp, Homo sapiens
ggaaccagggagaccga

SEQ ID NO: 2621771 - DNA, 15 bp, Homo sapiens
ggaacccccctccca

SEQ ID NO: 2621772 - DNA, 21 bp, Homo sapiens
ggaacccccctcccacccacc

SEQ ID NO: 2621773 - DNA, 22 bp, Homo sapiens
ggaacccccctcccacccaccg

SEQ ID NO: 2621774 - DNA, 15 bp, Homo sapiens
ggaaccgcaggaagc

SEQ ID NO: 2621775 - DNA, 14 bp, Homo sapiens
ggaacgactgggca

SEQ ID NO: 2621776 - DNA, 22 bp, Homo sapiens
ggaactcattcctgcctgtctc

SEQ ID NO: 2621777 - DNA, 17 bp, Homo sapiens
ggaactgaacattccag

SEQ ID NO: 2621778 - DNA, 14 bp, Homo sapiens
ggaactgcagacct

SEQ ID NO: 2621779 - DNA, 15 bp, Homo sapiens
ggaactgcagacctg

SEQ ID NO: 2621780 - DNA, 17 bp, Homo sapiens
ggaactgcagacctgtc

SEQ ID NO: 2621781 - DNA, 14 bp, Homo sapiens
ggaactgctgggct

SEQ ID NO: 2621782 - DNA, 17 bp, Homo sapiens
ggaactgtccagagagc

SEQ ID NO: 2621783 - DNA, 18 bp, Homo sapiens
ggaactgtccagagagca

SEQ ID NO: 2621784 - DNA, 16 bp, Homo sapiens
ggaagaaagagaagga

SEQ ID NO: 2621785 - DNA, 18 bp, Homo sapiens
ggaagaaattcctgtagc

SEQ ID NO: 2621786 - DNA, 23 bp, Homo sapiens
ggaagaaattcctgtagcatctt

SEQ ID NO: 2621787 - DNA, 22 bp, Homo sapiens
ggaagacatggggaggaaggac

SEQ ID NO: 2621788 - DNA, 21 bp, Homo sapiens
ggaagaccagctttgcagtga

SEQ ID NO: 2621789 - DNA, 15 bp, Homo sapiens
ggaagaccccaccca

SEQ ID NO: 2621790 - DNA, 14 bp, Homo sapiens
ggaagacctggcaa

SEQ ID NO: 2621791 - DNA, 13 bp, Homo sapiens
ggaagagaaaaaa

SEQ ID NO: 2621792 - DNA, 19 bp, Homo sapiens
ggaagagcagaacggagcc

SEQ ID NO: 2621793 - DNA, 14 bp, Homo sapiens
ggaagagcaggcac

SEQ ID NO: 2621794 - DNA, 19 bp, Homo sapiens
ggaagagtgtactgggggt

SEQ ID NO: 2621795 - DNA, 17 bp, Homo sapiens
ggaagataggctctgca

SEQ ID NO: 2621796 - DNA, 22 bp, Homo sapiens
ggaagatcttaaattttgtgat

SEQ ID NO: 2621797 - DNA, 11 bp, Homo sapiens
ggaagcagtgc

SEQ ID NO: 2621798 - DNA, 12 bp, Homo sapiens
ggaagcagtgcc

SEQ ID NO: 2621799 - DNA, 20 bp, Homo sapiens
ggaagcatattgttattata

SEQ ID NO: 2621800 - DNA, 16 bp, Homo sapiens
ggaagcattcagagag

SEQ ID NO: 2621801 - DNA, 18 bp, Homo sapiens
ggaagccaacttggcttt

SEQ ID NO: 2621802 - DNA, 20 bp, Homo sapiens
ggaagccggagggtgtttat

SEQ ID NO: 2621803 - DNA, 19 bp, Homo sapiens
ggaagctagctcccctcct

SEQ ID NO: 2621804 - DNA, 20 bp, Homo sapiens
ggaagctagctcccctcctc

SEQ ID NO: 2621805 - DNA, 14 bp, Homo sapiens
ggaagctccactgt

SEQ ID NO: 2621806 - DNA, 11 bp, Homo sapiens
ggaagctccgc

SEQ ID NO: 2621807 - DNA, 18 bp, Homo sapiens
ggaagctggccgagggtc

SEQ ID NO: 2621808 - DNA, 20 bp, Homo sapiens
ggaagcttccagtccaatct

SEQ ID NO: 2621809 - DNA, 20 bp, Homo sapiens
ggaaggaaacccagctctgg

SEQ ID NO: 2621810 - DNA, 19 bp, Homo sapiens
ggaaggaaagaaagaagga

SEQ ID NO: 2621811 - DNA, 18 bp, Homo sapiens
ggaaggaactctggcttc

SEQ ID NO: 2621812 - DNA, 14 bp, Homo sapiens
ggaaggagagcctg

SEQ ID NO: 2621813 - DNA, 20 bp, Homo sapiens
ggaagggaccaaggcaaggc

SEQ ID NO: 2621814 - DNA, 22 bp, Homo sapiens
ggaagggaccaaggcaaggcag

SEQ ID NO: 2621815 - DNA, 16 bp, Homo sapiens
ggaaggggacccccgc

SEQ ID NO: 2621816 - DNA, 15 bp, Homo sapiens
ggaaggggccagagg

SEQ ID NO: 2621817 - DNA, 13 bp, Homo sapiens
ggaagggtggtgg

SEQ ID NO: 2621818 - DNA, 11 bp, Homo sapiens
ggaaggtgggg

SEQ ID NO: 2621819 - DNA, 16 bp, Homo sapiens
ggaaggtggggacagg

SEQ ID NO: 2621820 - DNA, 18 bp, Homo sapiens
ggaaggtttgtatattgt

SEQ ID NO: 2621821 - DNA, 18 bp, Homo sapiens
ggaagtcatcctgccaac

SEQ ID NO: 2621822 - DNA, 21 bp, Homo sapiens
ggaagtgagggtcagagagga

SEQ ID NO: 2621823 - DNA, 17 bp, Homo sapiens
ggaagtgtaacagctga

SEQ ID NO: 2621824 - DNA, 19 bp, Homo sapiens
ggaagtgtaacagctgagg

SEQ ID NO: 2621825 - DNA, 21 bp, Homo sapiens
ggaagtgtaacagctgaggtc

SEQ ID NO: 2621826 - DNA, 19 bp, Homo sapiens
ggaataaaatactattttt

SEQ ID NO: 2621827 - DNA, 23 bp, Homo sapiens
ggaataaatatgcctctcctttg

SEQ ID NO: 2621828 - DNA, 20 bp, Homo sapiens
ggaataaggccttaatatgt

SEQ ID NO: 2621829 - DNA, 22 bp, Homo sapiens
ggaataatgggcttagagcagt

SEQ ID NO: 2621830 - DNA, 19 bp, Homo sapiens
ggaatagtatcctccaggt

SEQ ID NO: 2621831 - DNA, 21 bp, Homo sapiens
ggaatagtatcctccaggttt

SEQ ID NO: 2621832 - DNA, 22 bp, Homo sapiens
ggaatagtatcctccaggtttt

SEQ ID NO: 2621833 - DNA, 23 bp, Homo sapiens
ggaatataaggaaagcaataaat

SEQ ID NO: 2621834 - DNA, 16 bp, Homo sapiens
ggaatatataaccagt

SEQ ID NO: 2621835 - DNA, 17 bp, Homo sapiens
ggaatcaagagctgccc

SEQ ID NO: 2621836 - DNA, 18 bp, Homo sapiens
ggaatcactcttgtggat

SEQ ID NO: 2621837 - DNA, 20 bp, Homo sapiens
ggaatcactcttgtggatgt

SEQ ID NO: 2621838 - DNA, 18 bp, Homo sapiens
ggaatcatgtcaggcctg

SEQ ID NO: 2621839 - DNA, 14 bp, Homo sapiens
ggaatccactccca

SEQ ID NO: 2621840 - DNA, 20 bp, Homo sapiens
ggaatccactcccaggcagc

SEQ ID NO: 2621841 - DNA, 16 bp, Homo sapiens
ggaatgaagcttgtgt

SEQ ID NO: 2621842 - DNA, 12 bp, Homo sapiens
ggaatgcagtgg

SEQ ID NO: 2621843 - DNA, 19 bp, Homo sapiens
ggaatgcctgagtgcctgg

SEQ ID NO: 2621844 - DNA, 23 bp, Homo sapiens
ggaatgcctgagtgcctggccaa

SEQ ID NO: 2621845 - DNA, 21 bp, Homo sapiens
ggaatggaaaaagcagaaggc

SEQ ID NO: 2621846 - DNA, 12 bp, Homo sapiens
ggaatgggctgt

SEQ ID NO: 2621847 - DNA, 16 bp, Homo sapiens
ggaattaacctggtgc

SEQ ID NO: 2621848 - DNA, 20 bp, Homo sapiens
ggaattaacctggtgctgga

SEQ ID NO: 2621849 - DNA, 20 bp, Homo sapiens
ggaattgacttcgactgtga

SEQ ID NO: 2621850 - DNA, 15 bp, Homo sapiens
ggacaaaacccacct

SEQ ID NO: 2621851 - DNA, 16 bp, Homo sapiens
ggacaacgaggaagcc

SEQ ID NO: 2621852 - DNA, 17 bp, Homo sapiens
ggacaacgaggaagccc

SEQ ID NO: 2621853 - DNA, 20 bp, Homo sapiens
ggacaaggaggtctgtgcca

SEQ ID NO: 2621854 - DNA, 22 bp, Homo sapiens
ggacaaggctagatcatgaaga

SEQ ID NO: 2621855 - DNA, 18 bp, Homo sapiens
ggacaatacagaacccat

SEQ ID NO: 2621856 - DNA, 17 bp, Homo sapiens
ggacaatcagtcccctc

SEQ ID NO: 2621857 - DNA, 16 bp, Homo sapiens
ggacaattcatgaact

SEQ ID NO: 2621858 - DNA, 22 bp, Homo sapiens
ggacacattcaaccctggagag

SEQ ID NO: 2621859 - DNA, 14 bp, Homo sapiens
ggacaccagccagg

SEQ ID NO: 2621860 - DNA, 13 bp, Homo sapiens
ggacaccaggagt

SEQ ID NO: 2621861 - DNA, 22 bp, Homo sapiens
ggacactaaccacgctggacct

SEQ ID NO: 2621862 - DNA, 17 bp, Homo sapiens
ggacactcaaaagctgg

SEQ ID NO: 2621863 - DNA, 15 bp, Homo sapiens
ggacactccagtgcc

SEQ ID NO: 2621864 - DNA, 14 bp, Homo sapiens
ggacagaagaaggc

SEQ ID NO: 2621865 - DNA, 15 bp, Homo sapiens
ggacagaagcagctc

SEQ ID NO: 2621866 - DNA, 16 bp, Homo sapiens
ggacagaagcagctct

SEQ ID NO: 2621867 - DNA, 14 bp, Homo sapiens
ggacagagccatgc

SEQ ID NO: 2621868 - DNA, 20 bp, Homo sapiens
ggacagagggggtggcctcc

SEQ ID NO: 2621869 - DNA, 16 bp, Homo sapiens
ggacagagtatgaaca

SEQ ID NO: 2621870 - DNA, 23 bp, Homo sapiens
ggacagatcaatggcgcagtgcc

SEQ ID NO: 2621871 - DNA, 22 bp, Homo sapiens
ggacagccacggccaggccaga

SEQ ID NO: 2621872 - DNA, 17 bp, Homo sapiens
ggacagctccttctgtc

SEQ ID NO: 2621873 - DNA, 11 bp, Homo sapiens
ggacagctgtc

SEQ ID NO: 2621874 - DNA, 13 bp, Homo sapiens
ggacagctgtcct

SEQ ID NO: 2621875 - DNA, 17 bp, Homo sapiens
ggacagggaggtgaccc

SEQ ID NO: 2621876 - DNA, 20 bp, Homo sapiens
ggacagggctggcccagccc

SEQ ID NO: 2621877 - DNA, 21 bp, Homo sapiens
ggacagggctggcccagccct

SEQ ID NO: 2621878 - DNA, 14 bp, Homo sapiens
ggacagggtccctg

SEQ ID NO: 2621879 - DNA, 16 bp, Homo sapiens
ggacagtgcttcagcc

SEQ ID NO: 2621880 - DNA, 22 bp, Homo sapiens
ggacagtgcttcagcctgaggc

SEQ ID NO: 2621881 - DNA, 20 bp, Homo sapiens
ggacatagagagggagaaga

SEQ ID NO: 2621882 - DNA, 14 bp, Homo sapiens
ggacatattcattt

SEQ ID NO: 2621883 - DNA, 14 bp, Homo sapiens
ggacatcagctggt

SEQ ID NO: 2621884 - DNA, 13 bp, Homo sapiens
ggacatggacaag

SEQ ID NO: 2621885 - DNA, 14 bp, Homo sapiens
ggacatggacaagg

SEQ ID NO: 2621886 - DNA, 18 bp, Homo sapiens
ggacatggcccctgtgag

SEQ ID NO: 2621887 - DNA, 16 bp, Homo sapiens
ggacatgttttgataa

SEQ ID NO: 2621888 - DNA, 21 bp, Homo sapiens
ggacatgtttttgttttcttt

SEQ ID NO: 2621889 - DNA, 18 bp, Homo sapiens
ggaccaaccctgtttcct

SEQ ID NO: 2621890 - DNA, 15 bp, Homo sapiens
ggaccaaggcaaggc

SEQ ID NO: 2621891 - DNA, 19 bp, Homo sapiens
ggaccaaggcaaggcaggt

SEQ ID NO: 2621892 - DNA, 20 bp, Homo sapiens
ggaccaaggcaaggcaggtg

SEQ ID NO: 2621893 - DNA, 13 bp, Homo sapiens
ggaccacatttta

SEQ ID NO: 2621894 - DNA, 21 bp, Homo sapiens
ggaccactgcatgagctttta

SEQ ID NO: 2621895 - DNA, 19 bp, Homo sapiens
ggaccagctggggcgtggg

SEQ ID NO: 2621896 - DNA, 23 bp, Homo sapiens
ggaccaggcaatgtgactttgca

SEQ ID NO: 2621897 - DNA, 16 bp, Homo sapiens
ggacccagacccagtg

SEQ ID NO: 2621898 - DNA, 21 bp, Homo sapiens
ggacccagaggaaggggccag

SEQ ID NO: 2621899 - DNA, 18 bp, Homo sapiens
ggaccccagctgggaggc

SEQ ID NO: 2621900 - DNA, 14 bp, Homo sapiens
ggaccccatctgtg

SEQ ID NO: 2621901 - DNA, 14 bp, Homo sapiens
ggacccccgccccc

SEQ ID NO: 2621902 - DNA, 12 bp, Homo sapiens
ggacccccttcc

SEQ ID NO: 2621903 - DNA, 13 bp, Homo sapiens
ggacccctcacct

SEQ ID NO: 2621904 - DNA, 13 bp, Homo sapiens
ggacccctgccct

SEQ ID NO: 2621905 - DNA, 13 bp, Homo sapiens
ggaccctgaggcc

SEQ ID NO: 2621906 - DNA, 19 bp, Homo sapiens
ggaccctgaggcccagagg

SEQ ID NO: 2621907 - DNA, 23 bp, Homo sapiens
ggacccttgagagtatcaggtct

SEQ ID NO: 2621908 - DNA, 15 bp, Homo sapiens
ggaccgccagatggg

SEQ ID NO: 2621909 - DNA, 23 bp, Homo sapiens
ggaccgccagatggggcctctgt

SEQ ID NO: 2621910 - DNA, 17 bp, Homo sapiens
ggacctcccctgaggct

SEQ ID NO: 2621911 - DNA, 12 bp, Homo sapiens
ggacctctgctc

SEQ ID NO: 2621912 - DNA, 13 bp, Homo sapiens
ggacctctgctct

SEQ ID NO: 2621913 - DNA, 21 bp, Homo sapiens
ggcatctagagcttgatgcca

SEQ ID NO: 2621914 - DNA, 14 bp, Homo sapiens
ggcatctgcccctc

SEQ ID NO: 2621915 - DNA, 17 bp, Homo sapiens
ggcatctttgccttggg

SEQ ID NO: 2621916 - DNA, 14 bp, Homo sapiens
ggcatgagggatca

SEQ ID NO: 2621917 - DNA, 14 bp, Homo sapiens
ggcatgcctgtgtg

SEQ ID NO: 2621918 - DNA, 16 bp, Homo sapiens
ggcatgcctgtgtgac

SEQ ID NO: 2621919 - DNA, 16 bp, Homo sapiens
ggcatggctccagtct

SEQ ID NO: 2621920 - DNA, 21 bp, Homo sapiens
ggcatggggtgggcctctggt

SEQ ID NO: 2621921 - DNA, 15 bp, Homo sapiens
ggcatgtattggcct

SEQ ID NO: 2621922 - DNA, 16 bp, Homo sapiens
ggcatgtattggcctg

SEQ ID NO: 2621923 - DNA, 19 bp, Homo sapiens
ggcatgtattggcctggag

SEQ ID NO: 2621924 - DNA, 20 bp, Homo sapiens
ggcatgtattggcctggagg

SEQ ID NO: 2621925 - DNA, 19 bp, Homo sapiens
ggcatgtggcctgtggcct

SEQ ID NO: 2621926 - DNA, 20 bp, Homo sapiens
ggcattagaattatttaaac

SEQ ID NO: 2621927 - DNA, 20 bp, Homo sapiens
ggcattatgtccactgtgta

SEQ ID NO: 2621928 - DNA, 19 bp, Homo sapiens
ggcattccccaggaggcca

SEQ ID NO: 2621929 - DNA, 13 bp, Homo sapiens
ggcattcctgctt

SEQ ID NO: 2621930 - DNA, 12 bp, Homo sapiens
ggcattccttct

SEQ ID NO: 2621931 - DNA, 23 bp, Homo sapiens
ggcattgatggggaaggaggctg

SEQ ID NO: 2621932 - DNA, 13 bp, Homo sapiens
ggcattgctttcc

SEQ ID NO: 2621933 - DNA, 12 bp, Homo sapiens
ggccaaacctct

SEQ ID NO: 2621934 - DNA, 15 bp, Homo sapiens
ggccaaagccaaagc

SEQ ID NO: 2621935 - DNA, 13 bp, Homo sapiens
ggccaaagtgtta

SEQ ID NO: 2621936 - DNA, 12 bp, Homo sapiens
ggccaacaaagc

SEQ ID NO: 2621937 - DNA, 23 bp, Homo sapiens
ggccaacttgagggcccagagca

SEQ ID NO: 2621938 - DNA, 17 bp, Homo sapiens
ggccaaggactgccgac

SEQ ID NO: 2621939 - DNA, 16 bp, Homo sapiens
ggccaaggagggtgag

SEQ ID NO: 2621940 - DNA, 16 bp, Homo sapiens
ggccaaggccttctcc

SEQ ID NO: 2621941 - DNA, 13 bp, Homo sapiens
ggccaaggtggga

SEQ ID NO: 2621942 - DNA, 20 bp, Homo sapiens
ggccacagggcgagactccg

SEQ ID NO: 2621943 - DNA, 18 bp, Homo sapiens
ggccaccaccccccactc

SEQ ID NO: 2621944 - DNA, 14 bp, Homo sapiens
ggccaccaggatgg

SEQ ID NO: 2621945 - DNA, 13 bp, Homo sapiens
ggccaccaggctg

SEQ ID NO: 2621946 - DNA, 16 bp, Homo sapiens
ggccaccaggctggcg

SEQ ID NO: 2621947 - DNA, 21 bp, Homo sapiens
ggccaccaggctggcgcagcc

SEQ ID NO: 2621948 - DNA, 15 bp, Homo sapiens
ggccacctctccaag

SEQ ID NO: 2621949 - DNA, 20 bp, Homo sapiens
ggccacctctccaagggctt

SEQ ID NO: 2621950 - DNA, 16 bp, Homo sapiens
ggccacctgaggtggg

SEQ ID NO: 2621951 - DNA, 17 bp, Homo sapiens
ggccacctgaggtgggc

SEQ ID NO: 2621952 - DNA, 19 bp, Homo sapiens
ggccacctgaggtgggccc

SEQ ID NO: 2621953 - DNA, 23 bp, Homo sapiens
ggccacctgaggtgggcccagga

SEQ ID NO: 2621954 - DNA, 14 bp, Homo sapiens
ggccaccttttcag

SEQ ID NO: 2621955 - DNA, 21 bp, Homo sapiens
ggccactctgcctctgcctgc

SEQ ID NO: 2621956 - DNA, 22 bp, Homo sapiens
ggccactctgcctctgcctgca

SEQ ID NO: 2621957 - DNA, 15 bp, Homo sapiens
ggccactgcacagag

SEQ ID NO: 2621958 - DNA, 18 bp, Homo sapiens
ggccactgcacagagctc

SEQ ID NO: 2621959 - DNA, 18 bp, Homo sapiens
ggccactggccatctcca

SEQ ID NO: 2621960 - DNA, 11 bp, Homo sapiens
ggccactgtga

SEQ ID NO: 2621961 - DNA, 15 bp, Homo sapiens
ggccacttttgacta

SEQ ID NO: 2621962 - DNA, 18 bp, Homo sapiens
ggccagagagcctggtgc

SEQ ID NO: 2621963 - DNA, 11 bp, Homo sapiens
ggccagaggct

SEQ ID NO: 2621964 - DNA, 23 bp, Homo sapiens
ggccagagggagtgacagaggca

SEQ ID NO: 2621965 - DNA, 16 bp, Homo sapiens
ggccagagtggcctgg

SEQ ID NO: 2621966 - DNA, 18 bp, Homo sapiens
ggccagagtggcctggcc

SEQ ID NO: 2621967 - DNA, 16 bp, Homo sapiens
ggccagatgcaccagc

SEQ ID NO: 2621968 - DNA, 19 bp, Homo sapiens
ggccagatgcaccagccct

SEQ ID NO: 2621969 - DNA, 11 bp, Homo sapiens
ggccagccagg

SEQ ID NO: 2621970 - DNA, 14 bp, Homo sapiens
ggccagccaggcgg

SEQ ID NO: 2621971 - DNA, 11 bp, Homo sapiens
ggccagccccg

SEQ ID NO: 2621972 - DNA, 20 bp, Homo sapiens
ggccagccccggccctgggc

SEQ ID NO: 2621973 - DNA, 16 bp, Homo sapiens
ggccagcccggctggt

SEQ ID NO: 2621974 - DNA, 20 bp, Homo sapiens
ggccagctgccccagccaga

SEQ ID NO: 2621975 - DNA, 13 bp, Homo sapiens
ggccaggagctct

SEQ ID NO: 2621976 - DNA, 15 bp, Homo sapiens
ggccaggagctcttc

SEQ ID NO: 2621977 - DNA, 20 bp, Homo sapiens
ggccaggagtttgagaccag

SEQ ID NO: 2621978 - DNA, 16 bp, Homo sapiens
ggccaggatggagggg

SEQ ID NO: 2621979 - DNA, 15 bp, Homo sapiens
ggccaggccaccagg

SEQ ID NO: 2621980 - DNA, 15 bp, Homo sapiens
ggccaggccagctgc

SEQ ID NO: 2621981 - DNA, 16 bp, Homo sapiens
ggccaggctggtctca

SEQ ID NO: 2621982 - DNA, 13 bp, Homo sapiens
ggccagggcagag

SEQ ID NO: 2621983 - DNA, 13 bp, Homo sapiens
ggccagggccctg

SEQ ID NO: 2621984 - DNA, 17 bp, Homo sapiens
ggccagggccctgcaga

SEQ ID NO: 2621985 - DNA, 20 bp, Homo sapiens
ggccagggctatagctcagg

SEQ ID NO: 2621986 - DNA, 23 bp, Homo sapiens
ggccagggtcactgaaggcctgg

SEQ ID NO: 2621987 - DNA, 14 bp, Homo sapiens
ggccaggtgcagtg

SEQ ID NO: 2621988 - DNA, 18 bp, Homo sapiens
ggccagtacctttccatt

SEQ ID NO: 2621989 - DNA, 21 bp, Homo sapiens
ggccagtatctatatatgtgt

SEQ ID NO: 2621990 - DNA, 20 bp, Homo sapiens
ggccagtcctgcctggccag

SEQ ID NO: 2621991 - DNA, 16 bp, Homo sapiens
ggccagtctgggctgc

SEQ ID NO: 2621992 - DNA, 20 bp, Homo sapiens
ggccagtgtgacaaggattg

SEQ ID NO: 2621993 - DNA, 19 bp, Homo sapiens
ggccagtgtgatcccaagt

SEQ ID NO: 2621994 - DNA, 17 bp, Homo sapiens
ggccagttggtccccct

SEQ ID NO: 2621995 - DNA, 17 bp, Homo sapiens
ggccatagctcctgctc

SEQ ID NO: 2621996 - DNA, 22 bp, Homo sapiens
ggccatccggcccccagagcgc

SEQ ID NO: 2621997 - DNA, 18 bp, Homo sapiens
ggccatctccacccccag

SEQ ID NO: 2621998 - DNA, 22 bp, Homo sapiens
ggccatgagctccagaccccca

SEQ ID NO: 2621999 - DNA, 21 bp, Homo sapiens
ggccatgaggcctcagtggac

SEQ ID NO: 2622000 - DNA, 21 bp, Homo sapiens
ggccatgattcgcccaaagcc

SEQ ID NO: 2622001 - DNA, 14 bp, Homo sapiens
ggccatgcctgccc

SEQ ID NO: 2622002 - DNA, 14 bp, Homo sapiens
ggccatggagagct

SEQ ID NO: 2622003 - DNA, 16 bp, Homo sapiens
ggccatgggcctcctg

SEQ ID NO: 2622004 - DNA, 16 bp, Homo sapiens
ggcccaaccctgtctg

SEQ ID NO: 2622005 - DNA, 17 bp, Homo sapiens
ggcccaaccctgtctgt

SEQ ID NO: 2622006 - DNA, 19 bp, Homo sapiens
ggcccaagagatgaagagt

SEQ ID NO: 2622007 - DNA, 17 bp, Homo sapiens
ggcccaaggcggcccct

SEQ ID NO: 2622008 - DNA, 14 bp, Homo sapiens
ggcccaagtccctg

SEQ ID NO: 2622009 - DNA, 16 bp, Homo sapiens
ggcccacctggccacc

SEQ ID NO: 2622010 - DNA, 11 bp, Homo sapiens
ggcccagagag

SEQ ID NO: 2622011 - DNA, 12 bp, Homo sapiens
ggcccagagagg

SEQ ID NO: 2622012 - DNA, 22 bp, Homo sapiens
ggcccagatctggtcccttgca

SEQ ID NO: 2622013 - DNA, 21 bp, Homo sapiens
ggcccagcccccacagtgctg

SEQ ID NO: 2622014 - DNA, 12 bp, Homo sapiens
ggcccagcccgg

SEQ ID NO: 2622015 - DNA, 15 bp, Homo sapiens
ggcccagcccggctc

SEQ ID NO: 2622016 - DNA, 16 bp, Homo sapiens
ggcccagcccggctcc

SEQ ID NO: 2622017 - DNA, 15 bp, Homo sapiens
ggcccagccctgctg

SEQ ID NO: 2622018 - DNA, 12 bp, Homo sapiens
ggcccagccggc

SEQ ID NO: 2622019 - DNA, 17 bp, Homo sapiens
ggcccagccggcctctc

SEQ ID NO: 2622020 - DNA, 19 bp, Homo sapiens
ggcccagccggcctctctg

SEQ ID NO: 2622021 - DNA, 15 bp, Homo sapiens
ggcccagctgggctc

SEQ ID NO: 2622022 - DNA, 21 bp, Homo sapiens
ggcccagctgggctctgccac

SEQ ID NO: 2622023 - DNA, 17 bp, Homo sapiens
ggcccaggaccagctgg

SEQ ID NO: 2622024 - DNA, 22 bp, Homo sapiens
ggcccagtgtcaagttgtgctt

SEQ ID NO: 2622025 - DNA, 23 bp, Homo sapiens
ggcccagtgtcaagttgtgcttg

SEQ ID NO: 2622026 - DNA, 23 bp, Homo sapiens
ggccccagagactcagagggagg

SEQ ID NO: 2622027 - DNA, 13 bp, Homo sapiens
ggccccagcacta

SEQ ID NO: 2622028 - DNA, 16 bp, Homo sapiens
ggccccagcactaaag

SEQ ID NO: 2622029 - DNA, 19 bp, Homo sapiens
ggccccagcccaccctcct

SEQ ID NO: 2622030 - DNA, 17 bp, Homo sapiens
ggccccagggctaccct

SEQ ID NO: 2622031 - DNA, 18 bp, Homo sapiens
ggccccagggctaccctc

SEQ ID NO: 2622032 - DNA, 17 bp, Homo sapiens
ggccccagtcagcctct

SEQ ID NO: 2622033 - DNA, 23 bp, Homo sapiens
ggccccagtcagcctctctccca

SEQ ID NO: 2622034 - DNA, 17 bp, Homo sapiens
ggcccccctccttgctc

SEQ ID NO: 2622035 - DNA, 20 bp, Homo sapiens
ggcccccctccttgctctgc

SEQ ID NO: 2622036 - DNA, 17 bp, Homo sapiens
ggccccctggtctctgg

SEQ ID NO: 2622037 - DNA, 17 bp, Homo sapiens
ggccccgaggacccaga

SEQ ID NO: 2622038 - DNA, 21 bp, Homo sapiens
ggcccctcagggtccctggtg

SEQ ID NO: 2622039 - DNA, 12 bp, Homo sapiens
ggcccctccagc

SEQ ID NO: 2622040 - DNA, 22 bp, Homo sapiens
ggcccctcccacacacacccac

SEQ ID NO: 2622041 - DNA, 14 bp, Homo sapiens
ggcccctctgacct

SEQ ID NO: 2622042 - DNA, 16 bp, Homo sapiens
ggcccctctgcccagc

SEQ ID NO: 2622043 - DNA, 17 bp, Homo sapiens
ggcccctgcatcccctt

SEQ ID NO: 2622044 - DNA, 17 bp, Homo sapiens
ggcccctgcccggctgc

SEQ ID NO: 2622045 - DNA, 20 bp, Homo sapiens
ggcccctgcccggctgcgga

SEQ ID NO: 2622046 - DNA, 23 bp, Homo sapiens
ggcccctgctggttcagggttgg

SEQ ID NO: 2622047 - DNA, 13 bp, Homo sapiens
ggcccctggccca

SEQ ID NO: 2622048 - DNA, 13 bp, Homo sapiens
ggcccggctccag

SEQ ID NO: 2622049 - DNA, 15 bp, Homo sapiens
ggcccgtcatgttcc

SEQ ID NO: 2622050 - DNA, 13 bp, Homo sapiens
ggcccgtgacaga

SEQ ID NO: 2622051 - DNA, 20 bp, Homo sapiens
ggcccgttgaggatgaggcc

SEQ ID NO: 2622052 - DNA, 18 bp, Homo sapiens
ggccctcacccctgccct

SEQ ID NO: 2622053 - DNA, 20 bp, Homo sapiens
ggccctcacccctgccctgg

SEQ ID NO: 2622054 - DNA, 17 bp, Homo sapiens
ggccctcctaccctgcg

SEQ ID NO: 2622055 - DNA, 20 bp, Homo sapiens
ggccctcctaccctgcgccc

SEQ ID NO: 2622056 - DNA, 21 bp, Homo sapiens
ggccctcctaccctgcgccca

SEQ ID NO: 2622057 - DNA, 19 bp, Homo sapiens
ggccctcgggcccagcccc

SEQ ID NO: 2622058 - DNA, 14 bp, Homo sapiens
gggcatgctggggc

SEQ ID NO: 2622059 - DNA, 22 bp, Homo sapiens
gggcatggacgttcggggcatg

SEQ ID NO: 2622060 - DNA, 15 bp, Homo sapiens
gggcatggggtgggc

SEQ ID NO: 2622061 - DNA, 17 bp, Homo sapiens
gggcatggggtgggcct

SEQ ID NO: 2622062 - DNA, 20 bp, Homo sapiens
gggcatgtattggcctggag

SEQ ID NO: 2622063 - DNA, 23 bp, Homo sapiens
gggccaacttgagggcccagagc

SEQ ID NO: 2622064 - DNA, 23 bp, Homo sapiens
gggccacagagaaagtacttctc

SEQ ID NO: 2622065 - DNA, 20 bp, Homo sapiens
gggccagagtattggtctcc

SEQ ID NO: 2622066 - DNA, 12 bp, Homo sapiens
gggccagccagg

SEQ ID NO: 2622067 - DNA, 14 bp, Homo sapiens
gggccagccaggcg

SEQ ID NO: 2622068 - DNA, 15 bp, Homo sapiens
gggccagccaggcgg

SEQ ID NO: 2622069 - DNA, 16 bp, Homo sapiens
gggccagccaggcggg

SEQ ID NO: 2622070 - DNA, 18 bp, Homo sapiens
gggccagccaggcgggct

SEQ ID NO: 2622071 - DNA, 12 bp, Homo sapiens
gggccagcccct

SEQ ID NO: 2622072 - DNA, 17 bp, Homo sapiens
gggccagcccctcccac

SEQ ID NO: 2622073 - DNA, 13 bp, Homo sapiens
gggccagggccct

SEQ ID NO: 2622074 - DNA, 18 bp, Homo sapiens
gggccagtcctgcctggc

SEQ ID NO: 2622075 - DNA, 20 bp, Homo sapiens
gggccagtctgggctgccgg

SEQ ID NO: 2622076 - DNA, 18 bp, Homo sapiens
gggccagttggtccccct

SEQ ID NO: 2622077 - DNA, 14 bp, Homo sapiens
gggccatgctgaag

SEQ ID NO: 2622078 - DNA, 14 bp, Homo sapiens
gggcccaaccctgt

SEQ ID NO: 2622079 - DNA, 16 bp, Homo sapiens
gggcccaaccctgtct

SEQ ID NO: 2622080 - DNA, 19 bp, Homo sapiens
gggcccaagacagatgccc

SEQ ID NO: 2622081 - DNA, 23 bp, Homo sapiens
gggcccaagacagatgccccaga

SEQ ID NO: 2622082 - DNA, 22 bp, Homo sapiens
gggcccacctggccacctgagg

SEQ ID NO: 2622083 - DNA, 12 bp, Homo sapiens
gggcccagctgg

SEQ ID NO: 2622084 - DNA, 21 bp, Homo sapiens
gggcccagctgggctctgcca

SEQ ID NO: 2622085 - DNA, 16 bp, Homo sapiens
gggcccaggaccagct

SEQ ID NO: 2622086 - DNA, 22 bp, Homo sapiens
gggcccagggacaccagccagg

SEQ ID NO: 2622087 - DNA, 17 bp, Homo sapiens
gggccccagcccaccct

SEQ ID NO: 2622088 - DNA, 18 bp, Homo sapiens
gggccccagtcagcctct

SEQ ID NO: 2622089 - DNA, 23 bp, Homo sapiens
gggcccccagcgagagtccctgc

SEQ ID NO: 2622090 - DNA, 15 bp, Homo sapiens
gggcccctctgccca

SEQ ID NO: 2622091 - DNA, 16 bp, Homo sapiens
gggcccgcctggcaga

SEQ ID NO: 2622092 - DNA, 20 bp, Homo sapiens
gggcccgcctggcagaactg

SEQ ID NO: 2622093 - DNA, 20 bp, Homo sapiens
gggcccggccatgtccttag

SEQ ID NO: 2622094 - DNA, 16 bp, Homo sapiens
gggccctccgacagcc

SEQ ID NO: 2622095 - DNA, 19 bp, Homo sapiens
gggccctccgacagccccc

SEQ ID NO: 2622096 - DNA, 23 bp, Homo sapiens
gggccctcctgaaacttacacac

SEQ ID NO: 2622097 - DNA, 16 bp, Homo sapiens
gggccctctctgctct

SEQ ID NO: 2622098 - DNA, 15 bp, Homo sapiens
gggccctgcagaggg

SEQ ID NO: 2622099 - DNA, 13 bp, Homo sapiens
gggccctgcctcc

SEQ ID NO: 2622100 - DNA, 22 bp, Homo sapiens
gggccgtaccccaccctcagca

SEQ ID NO: 2622101 - DNA, 17 bp, Homo sapiens
gggccgtgcccaggggc

SEQ ID NO: 2622102 - DNA, 23 bp, Homo sapiens
gggcctagatccacacacagagg

SEQ ID NO: 2622103 - DNA, 14 bp, Homo sapiens
gggcctcagtgcca

SEQ ID NO: 2622104 - DNA, 21 bp, Homo sapiens
gggcctcctctgtccagggcc

SEQ ID NO: 2622105 - DNA, 15 bp, Homo sapiens
gggcctcctgtgtgt

SEQ ID NO: 2622106 - DNA, 15 bp, Homo sapiens
gggcctcggagcctc

SEQ ID NO: 2622107 - DNA, 19 bp, Homo sapiens
gggcctcttatgggctggg

SEQ ID NO: 2622108 - DNA, 20 bp, Homo sapiens
gggcctcttatgggctgggt

SEQ ID NO: 2622109 - DNA, 12 bp, Homo sapiens
gggcctggctca

SEQ ID NO: 2622110 - DNA, 18 bp, Homo sapiens
gggcctggtcgttttcaa

SEQ ID NO: 2622111 - DNA, 12 bp, Homo sapiens
gggcgaggcaga

SEQ ID NO: 2622112 - DNA, 22 bp, Homo sapiens
gggcgatcgcggcggagctggc

SEQ ID NO: 2622113 - DNA, 22 bp, Homo sapiens
gggcgccgcaaaccacactgga

SEQ ID NO: 2622114 - DNA, 12 bp, Homo sapiens
gggcgctggccc

SEQ ID NO: 2622115 - DNA, 15 bp, Homo sapiens
gggcgctggcccagc

SEQ ID NO: 2622116 - DNA, 17 bp, Homo sapiens
gggcgctggcccagccg

SEQ ID NO: 2622117 - DNA, 19 bp, Homo sapiens
gggcgctggcccagccggc

SEQ ID NO: 2622118 - DNA, 14 bp, Homo sapiens
gggcggcacagcct

SEQ ID NO: 2622119 - DNA, 17 bp, Homo sapiens
gggcgggacccaggcac

SEQ ID NO: 2622120 - DNA, 15 bp, Homo sapiens
gggcgggaggatgtt

SEQ ID NO: 2622121 - DNA, 14 bp, Homo sapiens
gggcggggccttgc

SEQ ID NO: 2622122 - DNA, 14 bp, Homo sapiens
gggcgtgttgtttt

SEQ ID NO: 2622123 - DNA, 15 bp, Homo sapiens
gggctacaaggaccc

SEQ ID NO: 2622124 - DNA, 20 bp, Homo sapiens
gggctaccctgagctgaggc

SEQ ID NO: 2622125 - DNA, 22 bp, Homo sapiens
gggctaccctgagctgaggcag

SEQ ID NO: 2622126 - DNA, 12 bp, Homo sapiens
gggctagaatct

SEQ ID NO: 2622127 - DNA, 18 bp, Homo sapiens
gggctagttgggcttcct

SEQ ID NO: 2622128 - DNA, 13 bp, Homo sapiens
gggctcagcctgg

SEQ ID NO: 2622129 - DNA, 21 bp, Homo sapiens
gggctcagcggggacagctcc

SEQ ID NO: 2622130 - DNA, 13 bp, Homo sapiens
gggctcaggaaaa

SEQ ID NO: 2622131 - DNA, 14 bp, Homo sapiens
gggctccctgactg

SEQ ID NO: 2622132 - DNA, 13 bp, Homo sapiens
gggctcccttccc

SEQ ID NO: 2622133 - DNA, 17 bp, Homo sapiens
gggctcctgccttctgt

SEQ ID NO: 2622134 - DNA, 18 bp, Homo sapiens
gggctcctgccttctgtc

SEQ ID NO: 2622135 - DNA, 21 bp, Homo sapiens
gggctcctgccttctgtcctg

SEQ ID NO: 2622136 - DNA, 21 bp, Homo sapiens
gggctctgcaattcccctctg

SEQ ID NO: 2622137 - DNA, 19 bp, Homo sapiens
gggctctgccccagctctg

SEQ ID NO: 2622138 - DNA, 15 bp, Homo sapiens
gggctctgcctccca

SEQ ID NO: 2622139 - DNA, 16 bp, Homo sapiens
gggctctgcctcccat

SEQ ID NO: 2622140 - DNA, 19 bp, Homo sapiens
gggctgaaggttgaagagg

SEQ ID NO: 2622141 - DNA, 16 bp, Homo sapiens
gggctgaccttcctcg

SEQ ID NO: 2622142 - DNA, 23 bp, Homo sapiens
gggctgaccttcctcgcagagag

SEQ ID NO: 2622143 - DNA, 20 bp, Homo sapiens
gggctgactagaagggccag

SEQ ID NO: 2622144 - DNA, 13 bp, Homo sapiens
gggctgagggagc

SEQ ID NO: 2622145 - DNA, 18 bp, Homo sapiens
gggctgccatgtgaagag

SEQ ID NO: 2622146 - DNA, 13 bp, Homo sapiens
gggctgcctgggc

SEQ ID NO: 2622147 - DNA, 23 bp, Homo sapiens
gggctggaacagattcacactgt

SEQ ID NO: 2622148 - DNA, 16 bp, Homo sapiens
gggctggcccagccct

SEQ ID NO: 2622149 - DNA, 17 bp, Homo sapiens
gggctggcccagccctg

SEQ ID NO: 2622150 - DNA, 15 bp, Homo sapiens
gggctggcctaggag

SEQ ID NO: 2622151 - DNA, 15 bp, Homo sapiens
gggctggctccctct

SEQ ID NO: 2622152 - DNA, 14 bp, Homo sapiens
gggcttagagcagt

SEQ ID NO: 2622153 - DNA, 17 bp, Homo sapiens
gggcttcagtggcagct

SEQ ID NO: 2622154 - DNA, 18 bp, Homo sapiens
gggcttcagtggcagctg

SEQ ID NO: 2622155 - DNA, 15 bp, Homo sapiens
gggcttctgcaccct

SEQ ID NO: 2622156 - DNA, 13 bp, Homo sapiens
gggcttgactttt

SEQ ID NO: 2622157 - DNA, 15 bp, Homo sapiens
gggctttctggagag

SEQ ID NO: 2622158 - DNA, 21 bp, Homo sapiens
ggggaaaatcagcctgctcca

SEQ ID NO: 2622159 - DNA, 24 bp, Homo sapiens
ggggaaaatcagcctgctccagct

SEQ ID NO: 2622160 - DNA, 22 bp, Homo sapiens
ggggaagggccagtctgggctg

SEQ ID NO: 2622161 - DNA, 16 bp, Homo sapiens
ggggaagtcctctggg

SEQ ID NO: 2622162 - DNA, 22 bp, Homo sapiens
ggggaatgtttgcctctgcctc

SEQ ID NO: 2622163 - DNA, 12 bp, Homo sapiens
ggggacagctcc

SEQ ID NO: 2622164 - DNA, 14 bp, Homo sapiens
ggggacagctcctt

SEQ ID NO: 2622165 - DNA, 15 bp, Homo sapiens
ggggacccccgcccc

SEQ ID NO: 2622166 - DNA, 13 bp, Homo sapiens
ggggactcagccc

SEQ ID NO: 2622167 - DNA, 14 bp, Homo sapiens
ggggactcagccct

SEQ ID NO: 2622168 - DNA, 16 bp, Homo sapiens
ggggactcagccctga

SEQ ID NO: 2622169 - DNA, 14 bp, Homo sapiens
ggggactgtctttc

SEQ ID NO: 2622170 - DNA, 11 bp, Homo sapiens
ggggagccctc

SEQ ID NO: 2622171 - DNA, 16 bp, Homo sapiens
ggggagtctgaagcag

SEQ ID NO: 2622172 - DNA, 11 bp, Homo sapiens
ggggagtggaa

SEQ ID NO: 2622173 - DNA, 20 bp, Homo sapiens
ggggagtttctttcctgcct

SEQ ID NO: 2622174 - DNA, 13 bp, Homo sapiens
ggggatagatgtg

SEQ ID NO: 2622175 - DNA, 13 bp, Homo sapiens
ggggatatgctta

SEQ ID NO: 2622176 - DNA, 13 bp, Homo sapiens
ggggatctcaggg

SEQ ID NO: 2622177 - DNA, 14 bp, Homo sapiens
ggggatgtgggagg

SEQ ID NO: 2622178 - DNA, 20 bp, Homo sapiens
ggggcagcgggggccaggga

SEQ ID NO: 2622179 - DNA, 20 bp, Homo sapiens
ggggcagctgatacaaattg

SEQ ID NO: 2622180 - DNA, 16 bp, Homo sapiens
ggggcaggagggccct

SEQ ID NO: 2622181 - DNA, 10 bp, Homo sapiens
ggggcaggca

SEQ ID NO: 2622182 - DNA, 12 bp, Homo sapiens
ggggcaggcagt

SEQ ID NO: 2622183 - DNA, 21 bp, Homo sapiens
ggggcagggaaggggaggcag

SEQ ID NO: 2622184 - DNA, 20 bp, Homo sapiens
ggggcatctgcccctccccc

SEQ ID NO: 2622185 - DNA, 19 bp, Homo sapiens
ggggcatgtattggcctgg

SEQ ID NO: 2622186 - DNA, 14 bp, Homo sapiens
ggggccatgaggcc

SEQ ID NO: 2622187 - DNA, 17 bp, Homo sapiens
ggggcccatgaaagagg

SEQ ID NO: 2622188 - DNA, 10 bp, Homo sapiens
ggggcccctt

SEQ ID NO: 2622189 - DNA, 22 bp, Homo sapiens
ggggcccctttttactcccctt

SEQ ID NO: 2622190 - DNA, 23 bp, Homo sapiens
ggggcccgcctggcagaactgag

SEQ ID NO: 2622191 - DNA, 12 bp, Homo sapiens
ggggccctggtc

SEQ ID NO: 2622192 - DNA, 21 bp, Homo sapiens
ggggccctggtccttccaggc

SEQ ID NO: 2622193 - DNA, 12 bp, Homo sapiens
ggggcctcaggt

SEQ ID NO: 2622194 - DNA, 16 bp, Homo sapiens
ggggcctggacctgcc

SEQ ID NO: 2622195 - DNA, 21 bp, Homo sapiens
ggggccttgcggtatccgccc

SEQ ID NO: 2622196 - DNA, 15 bp, Homo sapiens
ggggcgctggcccag

SEQ ID NO: 2622197 - DNA, 18 bp, Homo sapiens
ggggcgctggcccagccg

SEQ ID NO: 2622198 - DNA, 23 bp, Homo sapiens
ggggcgctggcccagccggcctc

SEQ ID NO: 2622199 - DNA, 14 bp, Homo sapiens
ggggctagaaccta

SEQ ID NO: 2622200 - DNA, 13 bp, Homo sapiens
ggggctcccgccc

SEQ ID NO: 2622201 - DNA, 12 bp, Homo sapiens
ggggctgcaccg

SEQ ID NO: 2622202 - DNA, 16 bp, Homo sapiens
ggggctggccttcctg

SEQ ID NO: 2622203 - DNA, 13 bp, Homo sapiens
ggggctgggacat

SEQ ID NO: 2622204 - DNA, 21 bp, Homo sapiens
gtaattaagtactatgtatca

SEQ ID NO: 2622205 - DNA, 22 bp, Homo sapiens
gtaattctaaatgaatgtttac

SEQ ID NO: 2622206 - DNA, 17 bp, Homo sapiens
gtaattgcttacatttt

SEQ ID NO: 2622207 - DNA, 23 bp, Homo sapiens
gtaattgcttacatttttacaat

SEQ ID NO: 2622208 - DNA, 13 bp, Homo sapiens
gtaattgtgaaaa

SEQ ID NO: 2622209 - DNA, 19 bp, Homo sapiens
gtaattgttgtttgtatgt

SEQ ID NO: 2622210 - DNA, 20 bp, Homo sapiens
gtaatttaaacaggcccagc

SEQ ID NO: 2622211 - DNA, 17 bp, Homo sapiens
gtaatttagttattgat

SEQ ID NO: 2622212 - DNA, 20 bp, Homo sapiens
gtaatttgtgatacaatgct

SEQ ID NO: 2622213 - DNA, 20 bp, Homo sapiens
gtacaaataaagtcccaggt

SEQ ID NO: 2622214 - DNA, 18 bp, Homo sapiens
gtacaatatttaaaattt

SEQ ID NO: 2622215 - DNA, 14 bp, Homo sapiens
gtacaatctcaaat

SEQ ID NO: 2622216 - DNA, 14 bp, Homo sapiens
gtacacgtgtcctg

SEQ ID NO: 2622217 - DNA, 20 bp, Homo sapiens
gtacactgtttcaaacttta

SEQ ID NO: 2622218 - DNA, 20 bp, Homo sapiens
gtacagaattctgctacctc

SEQ ID NO: 2622219 - DNA, 18 bp, Homo sapiens
gtacagctgtttaagatg

SEQ ID NO: 2622220 - DNA, 15 bp, Homo sapiens
gtacaggcagcacag

SEQ ID NO: 2622221 - DNA, 15 bp, Homo sapiens
gtacaggtaaggtga

SEQ ID NO: 2622222 - DNA, 19 bp, Homo sapiens
gtacagtcttgcagcagga

SEQ ID NO: 2622223 - DNA, 14 bp, Homo sapiens
gtacagtcttgtat

SEQ ID NO: 2622224 - DNA, 16 bp, Homo sapiens
gtacagttcttcggga

SEQ ID NO: 2622225 - DNA, 23 bp, Homo sapiens
gtacataaaggtggtatgtgtgt

SEQ ID NO: 2622226 - DNA, 19 bp, Homo sapiens
gtacataccctggccgccc

SEQ ID NO: 2622227 - DNA, 22 bp, Homo sapiens
gtacataccctggccgccccct

SEQ ID NO: 2622228 - DNA, 14 bp, Homo sapiens
gtacatagcctata

SEQ ID NO: 2622229 - DNA, 15 bp, Homo sapiens
gtacatagcctatat

SEQ ID NO: 2622230 - DNA, 17 bp, Homo sapiens
gtacatagttatttatt

SEQ ID NO: 2622231 - DNA, 21 bp, Homo sapiens
gtacatcccatgtaacagaaa

SEQ ID NO: 2622232 - DNA, 22 bp, Homo sapiens
gtacatcccatgtaacagaaag

SEQ ID NO: 2622233 - DNA, 16 bp, Homo sapiens
gtacatgaaaacacat

SEQ ID NO: 2622234 - DNA, 18 bp, Homo sapiens
gtacatgaaaacacattt

SEQ ID NO: 2622235 - DNA, 19 bp, Homo sapiens
gtacatgaaaacacatttt

SEQ ID NO: 2622236 - DNA, 13 bp, Homo sapiens
gtacatgtgaggc

SEQ ID NO: 2622237 - DNA, 17 bp, Homo sapiens
gtacattcaatgtttat

SEQ ID NO: 2622238 - DNA, 18 bp, Homo sapiens
gtacattcaatgtttatg

SEQ ID NO: 2622239 - DNA, 14 bp, Homo sapiens
gtacatttatgatt

SEQ ID NO: 2622240 - DNA, 13 bp, Homo sapiens
gtacatttctgaa

SEQ ID NO: 2622241 - DNA, 15 bp, Homo sapiens
gtaccaatcatttta

SEQ ID NO: 2622242 - DNA, 16 bp, Homo sapiens
gtaccagcccagatgt

SEQ ID NO: 2622243 - DNA, 20 bp, Homo sapiens
gtaccatgaaacaaagctgc

SEQ ID NO: 2622244 - DNA, 12 bp, Homo sapiens
gtacccactgct

SEQ ID NO: 2622245 - DNA, 13 bp, Homo sapiens
gtacccactgctc

SEQ ID NO: 2622246 - DNA, 15 bp, Homo sapiens
gtacccactgctctg

SEQ ID NO: 2622247 - DNA, 15 bp, Homo sapiens
gtacccagccatctg

SEQ ID NO: 2622248 - DNA, 18 bp, Homo sapiens
gtacccagccatctgccc

SEQ ID NO: 2622249 - DNA, 12 bp, Homo sapiens
gtaccccaccct

SEQ ID NO: 2622250 - DNA, 14 bp, Homo sapiens
gtaccccaccctca

SEQ ID NO: 2622251 - DNA, 13 bp, Homo sapiens
gtacctcttgagc

SEQ ID NO: 2622252 - DNA, 18 bp, Homo sapiens
gtacctgaaaagtaactt

SEQ ID NO: 2622253 - DNA, 19 bp, Homo sapiens
gtacctgttccttagacct

SEQ ID NO: 2622254 - DNA, 13 bp, Homo sapiens
gtaccttttaaca

SEQ ID NO: 2622255 - DNA, 19 bp, Homo sapiens
gtaccttttaacacctgat

SEQ ID NO: 2622256 - DNA, 21 bp, Homo sapiens
gtacgttattgttgacttatt

SEQ ID NO: 2622257 - DNA, 14 bp, Homo sapiens
gtacgtttgtatgt

SEQ ID NO: 2622258 - DNA, 22 bp, Homo sapiens
gtactaactcctaggaaaatac

SEQ ID NO: 2622259 - DNA, 15 bp, Homo sapiens
gtactaaggaatctt

SEQ ID NO: 2622260 - DNA, 19 bp, Homo sapiens
gtactacagtcctcccatc

SEQ ID NO: 2622261 - DNA, 20 bp, Homo sapiens
gtactactagatgtctttag

SEQ ID NO: 2622262 - DNA, 16 bp, Homo sapiens
gtactagttacacatc

SEQ ID NO: 2622263 - DNA, 17 bp, Homo sapiens
gtactagttacacatct

SEQ ID NO: 2622264 - DNA, 23 bp, Homo sapiens
gtactcaggaggctgaggggagg

SEQ ID NO: 2622265 - DNA, 15 bp, Homo sapiens
gtactcctgcaaaat

SEQ ID NO: 2622266 - DNA, 16 bp, Homo sapiens
gtactctgcacatacg

SEQ ID NO: 2622267 - DNA, 16 bp, Homo sapiens
gtactgagccttgtaa

SEQ ID NO: 2622268 - DNA, 14 bp, Homo sapiens
gtactggcatggta

SEQ ID NO: 2622269 - DNA, 19 bp, Homo sapiens
gtactggctgatggagtaa

SEQ ID NO: 2622270 - DNA, 12 bp, Homo sapiens
gtactgggggtt

SEQ ID NO: 2622271 - DNA, 21 bp, Homo sapiens
gtactgggggttgcgggggga

SEQ ID NO: 2622272 - DNA, 23 bp, Homo sapiens
gtactgtgtacagaattctgcta

SEQ ID NO: 2622273 - DNA, 17 bp, Homo sapiens
gtactgttctgtgtctt

SEQ ID NO: 2622274 - DNA, 15 bp, Homo sapiens
gtacttaataaattc

SEQ ID NO: 2622275 - DNA, 19 bp, Homo sapiens
gtacttagcagctatctct

SEQ ID NO: 2622276 - DNA, 18 bp, Homo sapiens
gtacttcaggggcacttc

SEQ ID NO: 2622277 - DNA, 17 bp, Homo sapiens
gtacttctccaccctgc

SEQ ID NO: 2622278 - DNA, 18 bp, Homo sapiens
gtacttctccaccctgct

SEQ ID NO: 2622279 - DNA, 22 bp, Homo sapiens
gtacttgaaatctaggattatt

SEQ ID NO: 2622280 - DNA, 22 bp, Homo sapiens
gtacttgccttattagagtgtc

SEQ ID NO: 2622281 - DNA, 21 bp, Homo sapiens
gtacttggagtattggggtct

SEQ ID NO: 2622282 - DNA, 15 bp, Homo sapiens
gtacttgtcaaagaa

SEQ ID NO: 2622283 - DNA, 17 bp, Homo sapiens
gtacttgtcaaagaagg

SEQ ID NO: 2622284 - DNA, 20 bp, Homo sapiens
gtacttgtggacacagctct

SEQ ID NO: 2622285 - DNA, 20 bp, Homo sapiens
gtacttttatgatgtatatt

SEQ ID NO: 2622286 - DNA, 15 bp, Homo sapiens
gtagaaactgcaggg

SEQ ID NO: 2622287 - DNA, 17 bp, Homo sapiens
gtagaaataatatgcat

SEQ ID NO: 2622288 - DNA, 14 bp, Homo sapiens
gtagaaatgatgat

SEQ ID NO: 2622289 - DNA, 19 bp, Homo sapiens
gtagaacgtaaccacggaa

SEQ ID NO: 2622290 - DNA, 12 bp, Homo sapiens
gtagaagatggc

SEQ ID NO: 2622291 - DNA, 17 bp, Homo sapiens
gtagaagggttatattt

SEQ ID NO: 2622292 - DNA, 19 bp, Homo sapiens
gtagaagggttatatttta

SEQ ID NO: 2622293 - DNA, 14 bp, Homo sapiens
gtagaatgtattgt

SEQ ID NO: 2622294 - DNA, 19 bp, Homo sapiens
gtagaatgtattgtacctt

SEQ ID NO: 2622295 - DNA, 18 bp, Homo sapiens
gtagacacgctcttctat

SEQ ID NO: 2622296 - DNA, 15 bp, Homo sapiens
gtagaccaaaataaa

SEQ ID NO: 2622297 - DNA, 17 bp, Homo sapiens
gtagacctagggaggac

SEQ ID NO: 2622298 - DNA, 20 bp, Homo sapiens
gtagacctagggaggacctt

SEQ ID NO: 2622299 - DNA, 15 bp, Homo sapiens
gtagagccagaggtc

SEQ ID NO: 2622300 - DNA, 15 bp, Homo sapiens
gtagagccagggtct

SEQ ID NO: 2622301 - DNA, 18 bp, Homo sapiens
gtagagccagggtctcac

SEQ ID NO: 2622302 - DNA, 15 bp, Homo sapiens
gtagaggagaaactg

SEQ ID NO: 2622303 - DNA, 14 bp, Homo sapiens
gtagaggttttgtt

SEQ ID NO: 2622304 - DNA, 15 bp, Homo sapiens
gtagagttaagaagc

SEQ ID NO: 2622305 - DNA, 17 bp, Homo sapiens
gtagatcaccagaataa

SEQ ID NO: 2622306 - DNA, 17 bp, Homo sapiens
gtagatcagtggtctcc

SEQ ID NO: 2622307 - DNA, 21 bp, Homo sapiens
gtagatgtgcatttttgtgaa

SEQ ID NO: 2622308 - DNA, 16 bp, Homo sapiens
gtagattctgtggaac

SEQ ID NO: 2622309 - DNA, 12 bp, Homo sapiens
gtagatttattt

SEQ ID NO: 2622310 - DNA, 21 bp, Homo sapiens
gtagatttatttcatcatatt

SEQ ID NO: 2622311 - DNA, 20 bp, Homo sapiens
gtagcaagttctagagaaga

SEQ ID NO: 2622312 - DNA, 13 bp, Homo sapiens
gtagcatacattt

SEQ ID NO: 2622313 - DNA, 12 bp, Homo sapiens
gtagcatgagag

SEQ ID NO: 2622314 - DNA, 21 bp, Homo sapiens
gtagcatgttgagccaggcct

SEQ ID NO: 2622315 - DNA, 13 bp, Homo sapiens
gtagcatttcatt

SEQ ID NO: 2622316 - DNA, 17 bp, Homo sapiens
gtagcatttcattcttc

SEQ ID NO: 2622317 - DNA, 18 bp, Homo sapiens
gtagccaaggtgggctga

SEQ ID NO: 2622318 - DNA, 19 bp, Homo sapiens
gtagccaaggtgggctgag

SEQ ID NO: 2622319 - DNA, 14 bp, Homo sapiens
gtagccctttctgt

SEQ ID NO: 2622320 - DNA, 12 bp, Homo sapiens
gtagcctgtgca

SEQ ID NO: 2622321 - DNA, 15 bp, Homo sapiens
gtagccttgcccgga

SEQ ID NO: 2622322 - DNA, 15 bp, Homo sapiens
gtagctagaggaacc

SEQ ID NO: 2622323 - DNA, 16 bp, Homo sapiens
gtagctatatctatat

SEQ ID NO: 2622324 - DNA, 12 bp, Homo sapiens
gtagctcaggtg

SEQ ID NO: 2622325 - DNA, 23 bp, Homo sapiens
gtagctcctcaactcacctaatg

SEQ ID NO: 2622326 - DNA, 12 bp, Homo sapiens
gtagctgcccct

SEQ ID NO: 2622327 - DNA, 12 bp, Homo sapiens
gtagctgggact

SEQ ID NO: 2622328 - DNA, 12 bp, Homo sapiens
gtagctttgctc

SEQ ID NO: 2622329 - DNA, 21 bp, Homo sapiens
gtaggaacggtaaatttctgt

SEQ ID NO: 2622330 - DNA, 15 bp, Homo sapiens
gtaggaagtaggaag

SEQ ID NO: 2622331 - DNA, 18 bp, Homo sapiens
gtaggagcccagctctga

SEQ ID NO: 2622332 - DNA, 17 bp, Homo sapiens
gtaggaggatgggctcg

SEQ ID NO: 2622333 - DNA, 20 bp, Homo sapiens
gtaggcatgagggatcacag

SEQ ID NO: 2622334 - DNA, 23 bp, Homo sapiens
gtaggcatgagggatcacagggc

SEQ ID NO: 2622335 - DNA, 21 bp, Homo sapiens
gtagtactcctgcaaaatttt

SEQ ID NO: 2622336 - DNA, 22 bp, Homo sapiens
gtagtagtctcattacttttga

SEQ ID NO: 2622337 - DNA, 16 bp, Homo sapiens
gtagtataaagaaaag

SEQ ID NO: 2622338 - DNA, 18 bp, Homo sapiens
gtagtctcattacttttg

SEQ ID NO: 2622339 - DNA, 15 bp, Homo sapiens
gtagttaggaaataa

SEQ ID NO: 2622340 - DNA, 15 bp, Homo sapiens
gtagttcctgctaca

SEQ ID NO: 2622341 - DNA, 18 bp, Homo sapiens
gtagttgcaatagaacag

SEQ ID NO: 2622342 - DNA, 21 bp, Homo sapiens
gtagttttatcacatgtatgt

SEQ ID NO: 2622343 - DNA, 14 bp, Homo sapiens
gtataaagaaaagt

SEQ ID NO: 2622344 - DNA, 18 bp, Homo sapiens
gtataaataggagaggat

SEQ ID NO: 2622345 - DNA, 17 bp, Homo sapiens
gtataaatggttgtctg

SEQ ID NO: 2622346 - DNA, 15 bp, Homo sapiens
gtataacaggttatt

SEQ ID NO: 2622347 - DNA, 19 bp, Homo sapiens
gtatacaaccctggcatta

SEQ ID NO: 2622348 - DNA, 16 bp, Homo sapiens
gtatagactcctgaaa

SEQ ID NO: 2622349 - DNA, 15 bp, Homo sapiens
gtctgccagccagca

SEQ ID NO: 2622350 - DNA, 16 bp, Homo sapiens
gtctgccagccagcag

SEQ ID NO: 2622351 - DNA, 17 bp, Homo sapiens
gtctgccagccagcagc

SEQ ID NO: 2622352 - DNA, 18 bp, Homo sapiens
gtctgccagccagcagcc

SEQ ID NO: 2622353 - DNA, 10 bp, Homo sapiens
gtctgccctt

SEQ ID NO: 2622354 - DNA, 17 bp, Homo sapiens
gtctgctgaataataaa

SEQ ID NO: 2622355 - DNA, 19 bp, Homo sapiens
gtctgctgaataataaact

SEQ ID NO: 2622356 - DNA, 19 bp, Homo sapiens
gtctgctgccctccatccc

SEQ ID NO: 2622357 - DNA, 23 bp, Homo sapiens
gtctggagaagctcccaggaaca

SEQ ID NO: 2622358 - DNA, 18 bp, Homo sapiens
gtctgggacttccttgct

SEQ ID NO: 2622359 - DNA, 18 bp, Homo sapiens
gtctggttttaacaattt

SEQ ID NO: 2622360 - DNA, 14 bp, Homo sapiens
gtctgtaagctgaa

SEQ ID NO: 2622361 - DNA, 18 bp, Homo sapiens
gtctgtagagggccctgg

SEQ ID NO: 2622362 - DNA, 23 bp, Homo sapiens
gtctgtatttatgtgtgaggagc

SEQ ID NO: 2622363 - DNA, 15 bp, Homo sapiens
gtctgtcccaccagc

SEQ ID NO: 2622364 - DNA, 19 bp, Homo sapiens
gtctgtcccggggtcctgt

SEQ ID NO: 2622365 - DNA, 20 bp, Homo sapiens
gtctgtcccggggtcctgtg

SEQ ID NO: 2622366 - DNA, 14 bp, Homo sapiens
gtctgttacactgg

SEQ ID NO: 2622367 - DNA, 20 bp, Homo sapiens
gtctgttaccatgtcactgt

SEQ ID NO: 2622368 - DNA, 21 bp, Homo sapiens
gtctgttccccatggccactt

SEQ ID NO: 2622369 - DNA, 22 bp, Homo sapiens
gtcttaattaaaagaatatttt

SEQ ID NO: 2622370 - DNA, 24 bp, Homo sapiens
gtcttagacttgaaatactactta

SEQ ID NO: 2622371 - DNA, 15 bp, Homo sapiens
gtcttagatgtatat

SEQ ID NO: 2622372 - DNA, 14 bp, Homo sapiens
gtcttatttcctca

SEQ ID NO: 2622373 - DNA, 16 bp, Homo sapiens
gtcttcaacagctccc

SEQ ID NO: 2622374 - DNA, 14 bp, Homo sapiens
gtcttcaagggctt

SEQ ID NO: 2622375 - DNA, 20 bp, Homo sapiens
gtcttcacctgattcaacta

SEQ ID NO: 2622376 - DNA, 12 bp, Homo sapiens
gtcttcagccta

SEQ ID NO: 2622377 - DNA, 15 bp, Homo sapiens
gtcttcagcctagcc

SEQ ID NO: 2622378 - DNA, 21 bp, Homo sapiens
gtcttccctacctcaggcagg

SEQ ID NO: 2622379 - DNA, 14 bp, Homo sapiens
gtcttcctcccaag

SEQ ID NO: 2622380 - DNA, 23 bp, Homo sapiens
gtcttcctcccaagtggtgccta

SEQ ID NO: 2622381 - DNA, 15 bp, Homo sapiens
gtcttcggaaacctt

SEQ ID NO: 2622382 - DNA, 16 bp, Homo sapiens
gtcttcgtacagttct

SEQ ID NO: 2622383 - DNA, 15 bp, Homo sapiens
gtcttctaatttcaa

SEQ ID NO: 2622384 - DNA, 23 bp, Homo sapiens
gtcttctaatttcaaaaatataa

SEQ ID NO: 2622385 - DNA, 18 bp, Homo sapiens
gtcttctcaggctctgcc

SEQ ID NO: 2622386 - DNA, 17 bp, Homo sapiens
gtcttctcatagcatta

SEQ ID NO: 2622387 - DNA, 23 bp, Homo sapiens
gtcttctcatagcattaactaat

SEQ ID NO: 2622388 - DNA, 12 bp, Homo sapiens
gtcttctcccca

SEQ ID NO: 2622389 - DNA, 13 bp, Homo sapiens
gtcttctccccag

SEQ ID NO: 2622390 - DNA, 20 bp, Homo sapiens
gtcttctttgcccacaatgc

SEQ ID NO: 2622391 - DNA, 21 bp, Homo sapiens
gtcttgaactcctggcctcaa

SEQ ID NO: 2622392 - DNA, 19 bp, Homo sapiens
gtcttgaatgtcttttgaa

SEQ ID NO: 2622393 - DNA, 17 bp, Homo sapiens
gtcttgcaatggcagcc

SEQ ID NO: 2622394 - DNA, 18 bp, Homo sapiens
gtcttggagctgagcctc

SEQ ID NO: 2622395 - DNA, 18 bp, Homo sapiens
gtcttggcggcagcagcc

SEQ ID NO: 2622396 - DNA, 16 bp, Homo sapiens
gtcttggctttcatgt

SEQ ID NO: 2622397 - DNA, 16 bp, Homo sapiens
gtcttgggaaatatga

SEQ ID NO: 2622398 - DNA, 21 bp, Homo sapiens
gtctttcaggaccttttgaag

SEQ ID NO: 2622399 - DNA, 18 bp, Homo sapiens
gtctttccacggagccac

SEQ ID NO: 2622400 - DNA, 20 bp, Homo sapiens
gtctttccattggatctcat

SEQ ID NO: 2622401 - DNA, 16 bp, Homo sapiens
gtctttcctggcacta

SEQ ID NO: 2622402 - DNA, 17 bp, Homo sapiens
gtctttggaccctgagg

SEQ ID NO: 2622403 - DNA, 14 bp, Homo sapiens
gtctttgtaagagt

SEQ ID NO: 2622404 - DNA, 15 bp, Homo sapiens
gtctttgtaagagtg

SEQ ID NO: 2622405 - DNA, 21 bp, Homo sapiens
gtctttgtaagagtgtagaag

SEQ ID NO: 2622406 - DNA, 22 bp, Homo sapiens
gtctttgtaagagtgtagaagc

SEQ ID NO: 2622407 - DNA, 19 bp, Homo sapiens
gtcttttgaatattcccaa

SEQ ID NO: 2622408 - DNA, 15 bp, Homo sapiens
gtctttttaagctta

SEQ ID NO: 2622409 - DNA, 16 bp, Homo sapiens
gtcttttttcactaca

SEQ ID NO: 2622410 - DNA, 21 bp, Homo sapiens
gtctttttttgtattataaaa

SEQ ID NO: 2622411 - DNA, 17 bp, Homo sapiens
gtcttttttttaatgtg

SEQ ID NO: 2622412 - DNA, 14 bp, Homo sapiens
gtgaaaaaaaaaat

SEQ ID NO: 2622413 - DNA, 15 bp, Homo sapiens
gtgaaaacaagtgct

SEQ ID NO: 2622414 - DNA, 21 bp, Homo sapiens
gtgaaaataggtatacagtgg

SEQ ID NO: 2622415 - DNA, 17 bp, Homo sapiens
gtgaaaatggtccagga

SEQ ID NO: 2622416 - DNA, 14 bp, Homo sapiens
gtgaaaatgtactg

SEQ ID NO: 2622417 - DNA, 16 bp, Homo sapiens
gtgaaaccctgtctct

SEQ ID NO: 2622418 - DNA, 18 bp, Homo sapiens
gtgaaacctttagggcag

SEQ ID NO: 2622419 - DNA, 20 bp, Homo sapiens
gtgaaacctttagggcagct

SEQ ID NO: 2622420 - DNA, 23 bp, Homo sapiens
gtgaaacctttagggcagcttgc

SEQ ID NO: 2622421 - DNA, 17 bp, Homo sapiens
gtgaaaccttttttaag

SEQ ID NO: 2622422 - DNA, 20 bp, Homo sapiens
gtgaaactgcttgtttccta

SEQ ID NO: 2622423 - DNA, 19 bp, Homo sapiens
gtgaaaggaaagagggagg

SEQ ID NO: 2622424 - DNA, 21 bp, Homo sapiens
gtgaaagggagctatcaggaa

SEQ ID NO: 2622425 - DNA, 17 bp, Homo sapiens
gtgaaataccagtgtgg

SEQ ID NO: 2622426 - DNA, 17 bp, Homo sapiens
gtgaaatcaaaggtgct

SEQ ID NO: 2622427 - DNA, 23 bp, Homo sapiens
gtgaaccaccacacccagcccac

SEQ ID NO: 2622428 - DNA, 15 bp, Homo sapiens
gtgaacgtggactcc

SEQ ID NO: 2622429 - DNA, 16 bp, Homo sapiens
gtgaactcagccaagc

SEQ ID NO: 2622430 - DNA, 16 bp, Homo sapiens
gtgaactgacaggcag

SEQ ID NO: 2622431 - DNA, 17 bp, Homo sapiens
gtgaacttgggccactg

SEQ ID NO: 2622432 - DNA, 12 bp, Homo sapiens
gtgaagaggggc

SEQ ID NO: 2622433 - DNA, 17 bp, Homo sapiens
gtgaagaggggcagccc

SEQ ID NO: 2622434 - DNA, 17 bp, Homo sapiens
gtgaagttagaattcct

SEQ ID NO: 2622435 - DNA, 15 bp, Homo sapiens
gtgaataataaaagt

SEQ ID NO: 2622436 - DNA, 18 bp, Homo sapiens
gtgaatcacgtaaagcta

SEQ ID NO: 2622437 - DNA, 21 bp, Homo sapiens
gtgaatgatgatcctaggcat

SEQ ID NO: 2622438 - DNA, 14 bp, Homo sapiens
gtgaatttgaatga

SEQ ID NO: 2622439 - DNA, 16 bp, Homo sapiens
gtgaatttttctctaa

SEQ ID NO: 2622440 - DNA, 21 bp, Homo sapiens
gtgacacttcagagagctggt

SEQ ID NO: 2622441 - DNA, 22 bp, Homo sapiens
gtgacacttcagagagctggta

SEQ ID NO: 2622442 - DNA, 15 bp, Homo sapiens
gtgacagactcctga

SEQ ID NO: 2622443 - DNA, 16 bp, Homo sapiens
gtgacagactcctgag

SEQ ID NO: 2622444 - DNA, 20 bp, Homo sapiens
gtgacagactcctgaggaca

SEQ ID NO: 2622445 - DNA, 12 bp, Homo sapiens
gtgacagaggca

SEQ ID NO: 2622446 - DNA, 19 bp, Homo sapiens
gtgacagaggcagccccat

SEQ ID NO: 2622447 - DNA, 23 bp, Homo sapiens
gtgacagaggcagccccattctg

SEQ ID NO: 2622448 - DNA, 17 bp, Homo sapiens
gtgacagagttcactat

SEQ ID NO: 2622449 - DNA, 14 bp, Homo sapiens
gtgacaggcagcag

SEQ ID NO: 2622450 - DNA, 15 bp, Homo sapiens
gtgacaggcagcaga

SEQ ID NO: 2622451 - DNA, 13 bp, Homo sapiens
gtgacagggaagc

SEQ ID NO: 2622452 - DNA, 17 bp, Homo sapiens
gtgacagggaagctaca

SEQ ID NO: 2622453 - DNA, 20 bp, Homo sapiens
gtgacagggaagctacaggt

SEQ ID NO: 2622454 - DNA, 14 bp, Homo sapiens
gtgacatctcttac

SEQ ID NO: 2622455 - DNA, 15 bp, Homo sapiens
gtgacatgtgaaacc

SEQ ID NO: 2622456 - DNA, 18 bp, Homo sapiens
gtgacatgtgaaaccttt

SEQ ID NO: 2622457 - DNA, 21 bp, Homo sapiens
gtgacatttatttttctcatg

SEQ ID NO: 2622458 - DNA, 19 bp, Homo sapiens
gtgaccaactagacattct

SEQ ID NO: 2622459 - DNA, 16 bp, Homo sapiens
gtgaccaatgtcttga

SEQ ID NO: 2622460 - DNA, 18 bp, Homo sapiens
gtgaccatgttttgttta

SEQ ID NO: 2622461 - DNA, 14 bp, Homo sapiens
gtgacccaggtcct

SEQ ID NO: 2622462 - DNA, 15 bp, Homo sapiens
gtgacccagtcagag

SEQ ID NO: 2622463 - DNA, 12 bp, Homo sapiens
gtgaccccaggt

SEQ ID NO: 2622464 - DNA, 18 bp, Homo sapiens
gtgacccggaggccacat

SEQ ID NO: 2622465 - DNA, 18 bp, Homo sapiens
gtgacctccacagctacc

SEQ ID NO: 2622466 - DNA, 15 bp, Homo sapiens
gtgacctctgcctga

SEQ ID NO: 2622467 - DNA, 16 bp, Homo sapiens
gtgacctgaggaagcg

SEQ ID NO: 2622468 - DNA, 23 bp, Homo sapiens
gtgacctgaggatttaagggatg

SEQ ID NO: 2622469 - DNA, 23 bp, Homo sapiens
gtgacctgtggggatttctccca

SEQ ID NO: 2622470 - DNA, 15 bp, Homo sapiens
gtgacgctgaataaa

SEQ ID NO: 2622471 - DNA, 17 bp, Homo sapiens
gtgacgctgaataaatg

SEQ ID NO: 2622472 - DNA, 13 bp, Homo sapiens
gtgacggtcccac

SEQ ID NO: 2622473 - DNA, 15 bp, Homo sapiens
gtgacggtcccacac

SEQ ID NO: 2622474 - DNA, 15 bp, Homo sapiens
gtgactaattgtata

SEQ ID NO: 2622475 - DNA, 17 bp, Homo sapiens
gtgactaattgtataac

SEQ ID NO: 2622476 - DNA, 18 bp, Homo sapiens
gtgactaattgtataaca

SEQ ID NO: 2622477 - DNA, 20 bp, Homo sapiens
gtgactaattgtataacagg

SEQ ID NO: 2622478 - DNA, 22 bp, Homo sapiens
gtgactaattgtataacaggtt

SEQ ID NO: 2622479 - DNA, 15 bp, Homo sapiens
gtgactatatagaga

SEQ ID NO: 2622480 - DNA, 17 bp, Homo sapiens
gtgactatatagagatg

SEQ ID NO: 2622481 - DNA, 14 bp, Homo sapiens
gtgactccaggaga

SEQ ID NO: 2622482 - DNA, 15 bp, Homo sapiens
gtgactgaatttctt

SEQ ID NO: 2622483 - DNA, 18 bp, Homo sapiens
gtgactgaatttcttttg

SEQ ID NO: 2622484 - DNA, 21 bp, Homo sapiens
gtgactgatgttacatcacag

SEQ ID NO: 2622485 - DNA, 18 bp, Homo sapiens
gtgactgtggcacacgcc

SEQ ID NO: 2622486 - DNA, 21 bp, Homo sapiens
gtgacttgcatcgtggagaca

SEQ ID NO: 2622487 - DNA, 20 bp, Homo sapiens
gtgactttggctgcatgcga

SEQ ID NO: 2622488 - DNA, 22 bp, Homo sapiens
gtgagaaaaagctcctgtcctc

SEQ ID NO: 2622489 - DNA, 18 bp, Homo sapiens
gtgagaatccctggcaaa

SEQ ID NO: 2622490 - DNA, 19 bp, Homo sapiens
gtgagacagtccagcctgg

SEQ ID NO: 2622491 - DNA, 20 bp, Homo sapiens
gtgagacccagccctcatcc

SEQ ID NO: 2622492 - DNA, 16 bp, Homo sapiens
gtgagacccccacacc

SEQ ID NO: 2622493 - DNA, 17 bp, Homo sapiens
gtgttatttaaagaaga

SEQ ID NO: 2622494 - DNA, 17 bp, Homo sapiens
gtgttcatacatttgag

SEQ ID NO: 2622495 - DNA, 15 bp, Homo sapiens
gtgttccaacaacca

SEQ ID NO: 2622496 - DNA, 17 bp, Homo sapiens
gtgttcccatttcagct

SEQ ID NO: 2622497 - DNA, 21 bp, Homo sapiens
gtgttcccatttcagctgatc

SEQ ID NO: 2622498 - DNA, 19 bp, Homo sapiens
gtgttccccatctgggtcc

SEQ ID NO: 2622499 - DNA, 18 bp, Homo sapiens
gtgttccccttccactga

SEQ ID NO: 2622500 - DNA, 18 bp, Homo sapiens
gtgttcctggcaatagtg

SEQ ID NO: 2622501 - DNA, 18 bp, Homo sapiens
gtgttctggtgaggcctt

SEQ ID NO: 2622502 - DNA, 19 bp, Homo sapiens
gtgttgagccttttccctc

SEQ ID NO: 2622503 - DNA, 13 bp, Homo sapiens
gtgttgcagaagg

SEQ ID NO: 2622504 - DNA, 17 bp, Homo sapiens
gtgttggcccaagctct

SEQ ID NO: 2622505 - DNA, 18 bp, Homo sapiens
gtgttgtcttgaaagatt

SEQ ID NO: 2622506 - DNA, 18 bp, Homo sapiens
gtgtttaaagagaggtta

SEQ ID NO: 2622507 - DNA, 12 bp, Homo sapiens
gtgtttatgtgt

SEQ ID NO: 2622508 - DNA, 16 bp, Homo sapiens
gtgtttatgtgtgtgt

SEQ ID NO: 2622509 - DNA, 20 bp, Homo sapiens
gtgtttatttttcatattgt

SEQ ID NO: 2622510 - DNA, 18 bp, Homo sapiens
gtgtttcacttttaggga

SEQ ID NO: 2622511 - DNA, 12 bp, Homo sapiens
gtgtttcccata

SEQ ID NO: 2622512 - DNA, 15 bp, Homo sapiens
gtgtttctgttatta

SEQ ID NO: 2622513 - DNA, 13 bp, Homo sapiens
gtgtttctttagt

SEQ ID NO: 2622514 - DNA, 15 bp, Homo sapiens
gtgttttaattccaa

SEQ ID NO: 2622515 - DNA, 15 bp, Homo sapiens
gtgttttcataataa

SEQ ID NO: 2622516 - DNA, 18 bp, Homo sapiens
gtgttttctgaataacat

SEQ ID NO: 2622517 - DNA, 14 bp, Homo sapiens
gtgtttttgtaaag

SEQ ID NO: 2622518 - DNA, 21 bp, Homo sapiens
gtgtttttgtaaagtgtggtc

SEQ ID NO: 2622519 - DNA, 21 bp, Homo sapiens
gttaaaagaggtttttcttaa

SEQ ID NO: 2622520 - DNA, 22 bp, Homo sapiens
gttaaaataccagccagtaaat

SEQ ID NO: 2622521 - DNA, 21 bp, Homo sapiens
gttaaaccatccatgtatttt

SEQ ID NO: 2622522 - DNA, 13 bp, Homo sapiens
gttaaatatttac

SEQ ID NO: 2622523 - DNA, 15 bp, Homo sapiens
gttaaatgaaattgt

SEQ ID NO: 2622524 - DNA, 17 bp, Homo sapiens
gttaaattgctgtgtat

SEQ ID NO: 2622525 - DNA, 13 bp, Homo sapiens
gttaaatttgtaa

SEQ ID NO: 2622526 - DNA, 18 bp, Homo sapiens
gttaaatttgtaagtttc

SEQ ID NO: 2622527 - DNA, 19 bp, Homo sapiens
gttaaatttgtaagtttca

SEQ ID NO: 2622528 - DNA, 23 bp, Homo sapiens
gttaaatttgtaagtttcaggtg

SEQ ID NO: 2622529 - DNA, 16 bp, Homo sapiens
gttaacacattttgta

SEQ ID NO: 2622530 - DNA, 12 bp, Homo sapiens
gttaacagattt

SEQ ID NO: 2622531 - DNA, 23 bp, Homo sapiens
gttaactttaagactgagcacct

SEQ ID NO: 2622532 - DNA, 17 bp, Homo sapiens
gttaagaagctgttgta

SEQ ID NO: 2622533 - DNA, 20 bp, Homo sapiens
gttaagaagctgttgtacat

SEQ ID NO: 2622534 - DNA, 22 bp, Homo sapiens
gttaagagtgggggagagcagg

SEQ ID NO: 2622535 - DNA, 16 bp, Homo sapiens
gttaagcattaccact

SEQ ID NO: 2622536 - DNA, 12 bp, Homo sapiens
gttaaggaaact

SEQ ID NO: 2622537 - DNA, 14 bp, Homo sapiens
gttaaggaaactct

SEQ ID NO: 2622538 - DNA, 22 bp, Homo sapiens
gttaagtctaaatatttcctta

SEQ ID NO: 2622539 - DNA, 13 bp, Homo sapiens
gttaagtctgttt

SEQ ID NO: 2622540 - DNA, 21 bp, Homo sapiens
gttaatatatcccagaaatta

SEQ ID NO: 2622541 - DNA, 17 bp, Homo sapiens
gttaatcaatttaaacc

SEQ ID NO: 2622542 - DNA, 21 bp, Homo sapiens
gttaatcaatttaaacccatt

SEQ ID NO: 2622543 - DNA, 22 bp, Homo sapiens
gttaatcaatttaaacccattt

SEQ ID NO: 2622544 - DNA, 17 bp, Homo sapiens
gttaatgaaaatgtcag

SEQ ID NO: 2622545 - DNA, 23 bp, Homo sapiens
gttaatgatggttgatgggttct

SEQ ID NO: 2622546 - DNA, 13 bp, Homo sapiens
gttacaacagatt

SEQ ID NO: 2622547 - DNA, 18 bp, Homo sapiens
gttacaacagatttgtga

SEQ ID NO: 2622548 - DNA, 20 bp, Homo sapiens
gttacaacagatttgtgaac

SEQ ID NO: 2622549 - DNA, 17 bp, Homo sapiens
gttacacatttttcaga

SEQ ID NO: 2622550 - DNA, 23 bp, Homo sapiens
gttacactggaggagagaagaat

SEQ ID NO: 2622551 - DNA, 13 bp, Homo sapiens
gttacagaaagtg

SEQ ID NO: 2622552 - DNA, 19 bp, Homo sapiens
gttacagaaagtggtgctc

SEQ ID NO: 2622553 - DNA, 19 bp, Homo sapiens
gttacagcgagaggcagag

SEQ ID NO: 2622554 - DNA, 21 bp, Homo sapiens
gttacagcgagaggcagagaa

SEQ ID NO: 2622555 - DNA, 22 bp, Homo sapiens
gttacaggcaccgagaatgttg

SEQ ID NO: 2622556 - DNA, 18 bp, Homo sapiens
gttacataagataaatgt

SEQ ID NO: 2622557 - DNA, 13 bp, Homo sapiens
gttacattaatgt

SEQ ID NO: 2622558 - DNA, 14 bp, Homo sapiens
gttacattaatgtt

SEQ ID NO: 2622559 - DNA, 16 bp, Homo sapiens
gttacctactttgact

SEQ ID NO: 2622560 - DNA, 22 bp, Homo sapiens
gttactaagtttttatggcttt

SEQ ID NO: 2622561 - DNA, 13 bp, Homo sapiens
gttactatatgcc

SEQ ID NO: 2622562 - DNA, 15 bp, Homo sapiens
gttactcagaattct

SEQ ID NO: 2622563 - DNA, 14 bp, Homo sapiens
gttactctggttct

SEQ ID NO: 2622564 - DNA, 14 bp, Homo sapiens
gttactgttgtgac

SEQ ID NO: 2622565 - DNA, 23 bp, Homo sapiens
gttactgttgtgacctgaagttc

SEQ ID NO: 2622566 - DNA, 19 bp, Homo sapiens
gttacttgaaataccagtg

SEQ ID NO: 2622567 - DNA, 12 bp, Homo sapiens
gttagaattcct

SEQ ID NO: 2622568 - DNA, 20 bp, Homo sapiens
gttagaattccttcagggtg

SEQ ID NO: 2622569 - DNA, 15 bp, Homo sapiens
gttagcaaactttgt

SEQ ID NO: 2622570 - DNA, 17 bp, Homo sapiens
gttaggaaataaaacct

SEQ ID NO: 2622571 - DNA, 19 bp, Homo sapiens
gttaggaaataaaaccttt

SEQ ID NO: 2622572 - DNA, 23 bp, Homo sapiens
gttaggaaataaaacctttcaaa

SEQ ID NO: 2622573 - DNA, 15 bp, Homo sapiens
gttaggagttcgaga

SEQ ID NO: 2622574 - DNA, 20 bp, Homo sapiens
gttaggcattgtgggaaggg

SEQ ID NO: 2622575 - DNA, 20 bp, Homo sapiens
gttagggaaaacattccatc

SEQ ID NO: 2622576 - DNA, 11 bp, Homo sapiens
gttagggaggg

SEQ ID NO: 2622577 - DNA, 21 bp, Homo sapiens
gttagtagcatgttgagccag

SEQ ID NO: 2622578 - DNA, 17 bp, Homo sapiens
gttagtatgaggcattt

SEQ ID NO: 2622579 - DNA, 20 bp, Homo sapiens
gttagtatgaggcatttgtt

SEQ ID NO: 2622580 - DNA, 16 bp, Homo sapiens
gttagtttctccaagc

SEQ ID NO: 2622581 - DNA, 16 bp, Homo sapiens
gttagtttctttggga

SEQ ID NO: 2622582 - DNA, 12 bp, Homo sapiens
gttataaaagtg

SEQ ID NO: 2622583 - DNA, 14 bp, Homo sapiens
gttataaaagtgat

SEQ ID NO: 2622584 - DNA, 22 bp, Homo sapiens
gttataaaagtgattgttggca

SEQ ID NO: 2622585 - DNA, 17 bp, Homo sapiens
gttataggtcactcctg

SEQ ID NO: 2622586 - DNA, 12 bp, Homo sapiens
gttatataaatg

SEQ ID NO: 2622587 - DNA, 13 bp, Homo sapiens
gttatataggttt

SEQ ID NO: 2622588 - DNA, 17 bp, Homo sapiens
gttatatattttttgta

SEQ ID NO: 2622589 - DNA, 14 bp, Homo sapiens
gttatatcaacaga

SEQ ID NO: 2622590 - DNA, 19 bp, Homo sapiens
gttatattgaaaaaataga

SEQ ID NO: 2622591 - DNA, 14 bp, Homo sapiens
gttatcgaaataac

SEQ ID NO: 2622592 - DNA, 18 bp, Homo sapiens
gttatcgaaataacaatg

SEQ ID NO: 2622593 - DNA, 23 bp, Homo sapiens
gttatcgaaataacaatgttaag

SEQ ID NO: 2622594 - DNA, 13 bp, Homo sapiens
gttatctctgtgt

SEQ ID NO: 2622595 - DNA, 15 bp, Homo sapiens
gttatgaaataaaga

SEQ ID NO: 2622596 - DNA, 19 bp, Homo sapiens
gttatgcggtctagggaat

SEQ ID NO: 2622597 - DNA, 13 bp, Homo sapiens
gttatgctgtgac

SEQ ID NO: 2622598 - DNA, 21 bp, Homo sapiens
gttatgtaaaaggccaaacct

SEQ ID NO: 2622599 - DNA, 22 bp, Homo sapiens
gttattaaacgtatgcatgtga

SEQ ID NO: 2622600 - DNA, 18 bp, Homo sapiens
gttattataattgtatca

SEQ ID NO: 2622601 - DNA, 17 bp, Homo sapiens
gttattgtacagctgtt

SEQ ID NO: 2622602 - DNA, 13 bp, Homo sapiens
gttatttaaagaa

SEQ ID NO: 2622603 - DNA, 15 bp, Homo sapiens
gttatttaaagaaga

SEQ ID NO: 2622604 - DNA, 13 bp, Homo sapiens
gttatttaaatga

SEQ ID NO: 2622605 - DNA, 20 bp, Homo sapiens
gttatttataatcacttttt

SEQ ID NO: 2622606 - DNA, 19 bp, Homo sapiens
gttattttagtttctgttc

SEQ ID NO: 2622607 - DNA, 20 bp, Homo sapiens
gttatttttacattctgaat

SEQ ID NO: 2622608 - DNA, 16 bp, Homo sapiens
gttatttttatatcag

SEQ ID NO: 2622609 - DNA, 23 bp, Homo sapiens
gttatttttatatcagcctgagt

SEQ ID NO: 2622610 - DNA, 23 bp, Homo sapiens
gttatttttatttatttaaattt

SEQ ID NO: 2622611 - DNA, 21 bp, Homo sapiens
gttattttttaattattattt

SEQ ID NO: 2622612 - DNA, 20 bp, Homo sapiens
gttcaagtaattctgctgtc

SEQ ID NO: 2622613 - DNA, 14 bp, Homo sapiens
gttcaatgatctag

SEQ ID NO: 2622614 - DNA, 19 bp, Homo sapiens
gttcaatgatctaggttta

SEQ ID NO: 2622615 - DNA, 20 bp, Homo sapiens
gttcaatgatctaggtttaa

SEQ ID NO: 2622616 - DNA, 16 bp, Homo sapiens
gttcaattctcatttg

SEQ ID NO: 2622617 - DNA, 21 bp, Homo sapiens
gttcacttcatcttctcagct

SEQ ID NO: 2622618 - DNA, 17 bp, Homo sapiens
gttcagaaatgctgcct

SEQ ID NO: 2622619 - DNA, 22 bp, Homo sapiens
gttcagagactcagggccccag

SEQ ID NO: 2622620 - DNA, 17 bp, Homo sapiens
gttcagcaccaccctag

SEQ ID NO: 2622621 - DNA, 19 bp, Homo sapiens
gttcagctaagctaggaat

SEQ ID NO: 2622622 - DNA, 20 bp, Homo sapiens
gttcaggagtcccaaggaaa

SEQ ID NO: 2622623 - DNA, 21 bp, Homo sapiens
gttcaggagtcccaaggaaag

SEQ ID NO: 2622624 - DNA, 17 bp, Homo sapiens
gttcagggttggcccct

SEQ ID NO: 2622625 - DNA, 18 bp, Homo sapiens
gttcagggttggcccctg

SEQ ID NO: 2622626 - DNA, 13 bp, Homo sapiens
gttcagtacctgg

SEQ ID NO: 2622627 - DNA, 18 bp, Homo sapiens
gttcagtggcagggctca

SEQ ID NO: 2622628 - DNA, 16 bp, Homo sapiens
gttcagtgtaaatagt

SEQ ID NO: 2622629 - DNA, 12 bp, Homo sapiens
gttcagtgtaat

SEQ ID NO: 2622630 - DNA, 16 bp, Homo sapiens
gttcagttacagaaag

SEQ ID NO: 2622631 - DNA, 17 bp, Homo sapiens
gttcatagggtctcttc

SEQ ID NO: 2622632 - DNA, 22 bp, Homo sapiens
gttcatatgtaccatgtacatg

SEQ ID NO: 2622633 - DNA, 19 bp, Homo sapiens
gttcatattccatatttat

SEQ ID NO: 2622634 - DNA, 19 bp, Homo sapiens
gttcatccaatcctcactg

SEQ ID NO: 2622635 - DNA, 22 bp, Homo sapiens
gttcatccaatcctcactgggt

SEQ ID NO: 2622636 - DNA, 12 bp, Homo sapiens
gttcatgagaat

SEQ ID NO: 2622637 - DNA, 19 bp, Homo sapiens
taaacccagtagtggtgac

SEQ ID NO: 2622638 - DNA, 14 bp, Homo sapiens
taaacccattttag

SEQ ID NO: 2622639 - DNA, 23 bp, Homo sapiens
taaacccattttagtcacttttt

SEQ ID NO: 2622640 - DNA, 16 bp, Homo sapiens
taaaccgccaaggctg

SEQ ID NO: 2622641 - DNA, 14 bp, Homo sapiens
taaacggattattt

SEQ ID NO: 2622642 - DNA, 19 bp, Homo sapiens
taaacggattattttttca

SEQ ID NO: 2622643 - DNA, 23 bp, Homo sapiens
taaacggattattttttcagacc

SEQ ID NO: 2622644 - DNA, 20 bp, Homo sapiens
taaactatcttggtgaattt

SEQ ID NO: 2622645 - DNA, 22 bp, Homo sapiens
taaactatcttggtgaattttt

SEQ ID NO: 2622646 - DNA, 15 bp, Homo sapiens
taaactatttgtctt

SEQ ID NO: 2622647 - DNA, 22 bp, Homo sapiens
taaactcaaaatatttgtacat

SEQ ID NO: 2622648 - DNA, 19 bp, Homo sapiens
taaactcagggacagagcc

SEQ ID NO: 2622649 - DNA, 20 bp, Homo sapiens
taaactcagggacagagcca

SEQ ID NO: 2622650 - DNA, 14 bp, Homo sapiens
taaactcctgtcct

SEQ ID NO: 2622651 - DNA, 12 bp, Homo sapiens
taaactgtgcac

SEQ ID NO: 2622652 - DNA, 15 bp, Homo sapiens
taaactgtgtacata

SEQ ID NO: 2622653 - DNA, 22 bp, Homo sapiens
taaactgtgtggactgtgatgc

SEQ ID NO: 2622654 - DNA, 13 bp, Homo sapiens
taaacttaatcta

SEQ ID NO: 2622655 - DNA, 19 bp, Homo sapiens
taaacttaatctaaatgga

SEQ ID NO: 2622656 - DNA, 17 bp, Homo sapiens
taaacttctctgaaggg

SEQ ID NO: 2622657 - DNA, 20 bp, Homo sapiens
taaacttctctgaagggagg

SEQ ID NO: 2622658 - DNA, 16 bp, Homo sapiens
taaactttaccttttt

SEQ ID NO: 2622659 - DNA, 13 bp, Homo sapiens
taaactttcacac

SEQ ID NO: 2622660 - DNA, 12 bp, Homo sapiens
taaagaaagaga

SEQ ID NO: 2622661 - DNA, 13 bp, Homo sapiens
taaagaaagagag

SEQ ID NO: 2622662 - DNA, 14 bp, Homo sapiens
taaagaaagagaga

SEQ ID NO: 2622663 - DNA, 17 bp, Homo sapiens
taaagaaagagagaaaa

SEQ ID NO: 2622664 - DNA, 17 bp, Homo sapiens
taaagaaagtcgaatta

SEQ ID NO: 2622665 - DNA, 17 bp, Homo sapiens
taaagaaattgcaataa

SEQ ID NO: 2622666 - DNA, 19 bp, Homo sapiens
taaagaacaccctatattt

SEQ ID NO: 2622667 - DNA, 11 bp, Homo sapiens
taaagacaaag

SEQ ID NO: 2622668 - DNA, 15 bp, Homo sapiens
taaagacaaagacaa

SEQ ID NO: 2622669 - DNA, 19 bp, Homo sapiens
taaagacagggtttcacca

SEQ ID NO: 2622670 - DNA, 22 bp, Homo sapiens
taaagagacctacctcaggttg

SEQ ID NO: 2622671 - DNA, 12 bp, Homo sapiens
taaagagttctt

SEQ ID NO: 2622672 - DNA, 23 bp, Homo sapiens
taaagatacagaactctttcaaa

SEQ ID NO: 2622673 - DNA, 13 bp, Homo sapiens
taaagatgatcta

SEQ ID NO: 2622674 - DNA, 15 bp, Homo sapiens
taaagatgttaaaaa

SEQ ID NO: 2622675 - DNA, 15 bp, Homo sapiens
taaagatttatcaaa

SEQ ID NO: 2622676 - DNA, 14 bp, Homo sapiens
taaagatttcttga

SEQ ID NO: 2622677 - DNA, 22 bp, Homo sapiens
taaagcaactgttatgaaataa

SEQ ID NO: 2622678 - DNA, 17 bp, Homo sapiens
taaagcaatatgcattt

SEQ ID NO: 2622679 - DNA, 19 bp, Homo sapiens
taaagcagcgtttctatga

SEQ ID NO: 2622680 - DNA, 22 bp, Homo sapiens
taaagcatgaatggtatggaac

SEQ ID NO: 2622681 - DNA, 13 bp, Homo sapiens
taaagcattccaa

SEQ ID NO: 2622682 - DNA, 20 bp, Homo sapiens
taaagcctgagtttgctttc

SEQ ID NO: 2622683 - DNA, 21 bp, Homo sapiens
taaagcctgctttttaagtgt

SEQ ID NO: 2622684 - DNA, 20 bp, Homo sapiens
taaagctaaaatgattttat

SEQ ID NO: 2622685 - DNA, 19 bp, Homo sapiens
taaagctactgatttcctt

SEQ ID NO: 2622686 - DNA, 18 bp, Homo sapiens
taaagctcgaaaacaatt

SEQ ID NO: 2622687 - DNA, 17 bp, Homo sapiens
taaaggctacctttgta

SEQ ID NO: 2622688 - DNA, 22 bp, Homo sapiens
taaaggtggtatgtgtgtgtat

SEQ ID NO: 2622689 - DNA, 23 bp, Homo sapiens
taaaggtggtatgtgtgtgtatg

SEQ ID NO: 2622690 - DNA, 21 bp, Homo sapiens
taaaggtggtgaggcaataaa

SEQ ID NO: 2622691 - DNA, 16 bp, Homo sapiens
taaagtatcatgcatt

SEQ ID NO: 2622692 - DNA, 17 bp, Homo sapiens
taaagtatcatgcattc

SEQ ID NO: 2622693 - DNA, 15 bp, Homo sapiens
taaagtatgtaaaca

SEQ ID NO: 2622694 - DNA, 22 bp, Homo sapiens
taaagtatgtaaagtatgtaaa

SEQ ID NO: 2622695 - DNA, 18 bp, Homo sapiens
taaagtattcttctcttc

SEQ ID NO: 2622696 - DNA, 18 bp, Homo sapiens
taaagtcaggtccaattt

SEQ ID NO: 2622697 - DNA, 11 bp, Homo sapiens
taaagtgatta

SEQ ID NO: 2622698 - DNA, 16 bp, Homo sapiens
taaagtgattaaacgt

SEQ ID NO: 2622699 - DNA, 18 bp, Homo sapiens
taaagtgattaaacgtgc

SEQ ID NO: 2622700 - DNA, 15 bp, Homo sapiens
taaagtgtatttttt

SEQ ID NO: 2622701 - DNA, 19 bp, Homo sapiens
taaagtgtatttttttact

SEQ ID NO: 2622702 - DNA, 20 bp, Homo sapiens
taaagttagtctactcttaa

SEQ ID NO: 2622703 - DNA, 21 bp, Homo sapiens
taaataaaacattttcacaca

SEQ ID NO: 2622704 - DNA, 20 bp, Homo sapiens
taaataaaatttgttgcata

SEQ ID NO: 2622705 - DNA, 15 bp, Homo sapiens
taaataaagtatcat

SEQ ID NO: 2622706 - DNA, 18 bp, Homo sapiens
taaataaatgtcattaaa

SEQ ID NO: 2622707 - DNA, 15 bp, Homo sapiens
taaatacagacacta

SEQ ID NO: 2622708 - DNA, 17 bp, Homo sapiens
taaatacagacactaag

SEQ ID NO: 2622709 - DNA, 19 bp, Homo sapiens
taaatacagacactaagtt

SEQ ID NO: 2622710 - DNA, 22 bp, Homo sapiens
taaatacagacactaagttata

SEQ ID NO: 2622711 - DNA, 23 bp, Homo sapiens
taaatacagtcttccatttgcaa

SEQ ID NO: 2622712 - DNA, 13 bp, Homo sapiens
taaatacctctta

SEQ ID NO: 2622713 - DNA, 18 bp, Homo sapiens
taaatagagtttgctatt

SEQ ID NO: 2622714 - DNA, 15 bp, Homo sapiens
taaatagctatatcc

SEQ ID NO: 2622715 - DNA, 17 bp, Homo sapiens
taaatagctatatccat

SEQ ID NO: 2622716 - DNA, 18 bp, Homo sapiens
taaatagctatatccatg

SEQ ID NO: 2622717 - DNA, 16 bp, Homo sapiens
taaataggagaggatg

SEQ ID NO: 2622718 - DNA, 13 bp, Homo sapiens
taaatataattct

SEQ ID NO: 2622719 - DNA, 18 bp, Homo sapiens
taaatataattctgtaaa

SEQ ID NO: 2622720 - DNA, 14 bp, Homo sapiens
taaatatataaaaa

SEQ ID NO: 2622721 - DNA, 17 bp, Homo sapiens
taaatatcttctgattt

SEQ ID NO: 2622722 - DNA, 14 bp, Homo sapiens
taaatatgcagtga

SEQ ID NO: 2622723 - DNA, 23 bp, Homo sapiens
taaatatgcctctcctttgtata

SEQ ID NO: 2622724 - DNA, 21 bp, Homo sapiens
taaatatgttagcaaagagtt

SEQ ID NO: 2622725 - DNA, 18 bp, Homo sapiens
taaatatttacatatgaa

SEQ ID NO: 2622726 - DNA, 13 bp, Homo sapiens
taaatatttcaag

SEQ ID NO: 2622727 - DNA, 13 bp, Homo sapiens
taaatatttcctt

SEQ ID NO: 2622728 - DNA, 22 bp, Homo sapiens
taaatattttttcttttctatt

SEQ ID NO: 2622729 - DNA, 19 bp, Homo sapiens
taaatcaagttggcttcta

SEQ ID NO: 2622730 - DNA, 13 bp, Homo sapiens
taaatcaataaag

SEQ ID NO: 2622731 - DNA, 23 bp, Homo sapiens
taaatcaatgtcacttaaaggct

SEQ ID NO: 2622732 - DNA, 19 bp, Homo sapiens
taaatcagccgtgtaacca

SEQ ID NO: 2622733 - DNA, 19 bp, Homo sapiens
taaatctccaaaataaaac

SEQ ID NO: 2622734 - DNA, 21 bp, Homo sapiens
taaatctccaaaataaaactt

SEQ ID NO: 2622735 - DNA, 20 bp, Homo sapiens
taaatctgttgccaagctgg

SEQ ID NO: 2622736 - DNA, 17 bp, Homo sapiens
taaatgaagcagcttta

SEQ ID NO: 2622737 - DNA, 22 bp, Homo sapiens
taaatgaagcagctttaaacaa

SEQ ID NO: 2622738 - DNA, 13 bp, Homo sapiens
taaatgaatgttt

SEQ ID NO: 2622739 - DNA, 18 bp, Homo sapiens
taaatgagctatgtatta

SEQ ID NO: 2622740 - DNA, 17 bp, Homo sapiens
taaatgattcttagtga

SEQ ID NO: 2622741 - DNA, 17 bp, Homo sapiens
taaatgatttcattcaa

SEQ ID NO: 2622742 - DNA, 14 bp, Homo sapiens
taaatgcaatatgt

SEQ ID NO: 2622743 - DNA, 23 bp, Homo sapiens
taaatgcacctggaatatataac

SEQ ID NO: 2622744 - DNA, 21 bp, Homo sapiens
taaatgcatatcctgagccat

SEQ ID NO: 2622745 - DNA, 17 bp, Homo sapiens
taaatgcccagcccctt

SEQ ID NO: 2622746 - DNA, 19 bp, Homo sapiens
taaatgggggtgcatttga

SEQ ID NO: 2622747 - DNA, 16 bp, Homo sapiens
taaatgtaaagatatt

SEQ ID NO: 2622748 - DNA, 17 bp, Homo sapiens
taaatgtaaagatattt

SEQ ID NO: 2622749 - DNA, 14 bp, Homo sapiens
taaatgtaacagtc

SEQ ID NO: 2622750 - DNA, 22 bp, Homo sapiens
taaatgtctctttaatgtcaca

SEQ ID NO: 2622751 - DNA, 21 bp, Homo sapiens
taaatgtcttttttttaatgt

SEQ ID NO: 2622752 - DNA, 20 bp, Homo sapiens
taaattaacttttataaact

SEQ ID NO: 2622753 - DNA, 22 bp, Homo sapiens
taaattaacttttataaacttt

SEQ ID NO: 2622754 - DNA, 13 bp, Homo sapiens
taaattaagacat

SEQ ID NO: 2622755 - DNA, 21 bp, Homo sapiens
taaattaggaataaataaaaa

SEQ ID NO: 2622756 - DNA, 22 bp, Homo sapiens
taaattaggaataaataaaaat

SEQ ID NO: 2622757 - DNA, 18 bp, Homo sapiens
taaattagtatttattta

SEQ ID NO: 2622758 - DNA, 16 bp, Homo sapiens
taaattatactggaga

SEQ ID NO: 2622759 - DNA, 19 bp, Homo sapiens
taaattattagtttacatc

SEQ ID NO: 2622760 - DNA, 11 bp, Homo sapiens
taaattatttt

SEQ ID NO: 2622761 - DNA, 23 bp, Homo sapiens
taaattcaaccactgtaaaatga

SEQ ID NO: 2622762 - DNA, 13 bp, Homo sapiens
taaattcatttta

SEQ ID NO: 2622763 - DNA, 16 bp, Homo sapiens
taaattccactggact

SEQ ID NO: 2622764 - DNA, 16 bp, Homo sapiens
taaattcttgcaaagt

SEQ ID NO: 2622765 - DNA, 22 bp, Homo sapiens
taaattcttgcaaagtatccct

SEQ ID NO: 2622766 - DNA, 13 bp, Homo sapiens
taaattgaataat

SEQ ID NO: 2622767 - DNA, 20 bp, Homo sapiens
taaattgacacttaaaaatg

SEQ ID NO: 2622768 - DNA, 15 bp, Homo sapiens
taaatttatttactg

SEQ ID NO: 2622769 - DNA, 18 bp, Homo sapiens
taaatttatttactgcta

SEQ ID NO: 2622770 - DNA, 15 bp, Homo sapiens
taaatttgtaagttt

SEQ ID NO: 2622771 - DNA, 17 bp, Homo sapiens
taaatttgtaagtttca

SEQ ID NO: 2622772 - DNA, 20 bp, Homo sapiens
taacaaactacatgtaatcc

SEQ ID NO: 2622773 - DNA, 16 bp, Homo sapiens
taacaactatgatttg

SEQ ID NO: 2622774 - DNA, 21 bp, Homo sapiens
taacaactatgatttggaaaa

SEQ ID NO: 2622775 - DNA, 16 bp, Homo sapiens
taacaagatctttcag

SEQ ID NO: 2622776 - DNA, 18 bp, Homo sapiens
taacaagatctttcagga

SEQ ID NO: 2622777 - DNA, 17 bp, Homo sapiens
taacaagctcccaggcc

SEQ ID NO: 2622778 - DNA, 21 bp, Homo sapiens
taacaataactactgtgttcc

SEQ ID NO: 2622779 - DNA, 23 bp, Homo sapiens
taacaataactactgtgttcctg

SEQ ID NO: 2622780 - DNA, 14 bp, Homo sapiens
taacaatgttaagg

SEQ ID NO: 2622781 - DNA, 16 bp, Homo sapiens
tacacagtctgcaaga

SEQ ID NO: 2622782 - DNA, 17 bp, Homo sapiens
tacacatctcagaccct

SEQ ID NO: 2622783 - DNA, 20 bp, Homo sapiens
tacacattcggctccctgga

SEQ ID NO: 2622784 - DNA, 17 bp, Homo sapiens
tacacatttttcagata

SEQ ID NO: 2622785 - DNA, 19 bp, Homo sapiens
tacacatttttcagatata

SEQ ID NO: 2622786 - DNA, 19 bp, Homo sapiens
tacaccactacattctgtt

SEQ ID NO: 2622787 - DNA, 14 bp, Homo sapiens
tacacccaaagagg

SEQ ID NO: 2622788 - DNA, 16 bp, Homo sapiens
tacacccttttccagc

SEQ ID NO: 2622789 - DNA, 12 bp, Homo sapiens
tacacctaactc

SEQ ID NO: 2622790 - DNA, 13 bp, Homo sapiens
tacacgggactga

SEQ ID NO: 2622791 - DNA, 20 bp, Homo sapiens
tacactaagggtgtaagtaa

SEQ ID NO: 2622792 - DNA, 13 bp, Homo sapiens
tacactatcttaa

SEQ ID NO: 2622793 - DNA, 18 bp, Homo sapiens
tacactccagcctgagca

SEQ ID NO: 2622794 - DNA, 14 bp, Homo sapiens
tacactccagtgag

SEQ ID NO: 2622795 - DNA, 16 bp, Homo sapiens
tacactgacacctttg

SEQ ID NO: 2622796 - DNA, 23 bp, Homo sapiens
tacactgacacctttgcaggcat

SEQ ID NO: 2622797 - DNA, 16 bp, Homo sapiens
tacactgtatttgtat

SEQ ID NO: 2622798 - DNA, 22 bp, Homo sapiens
tacactgtgctgagtctgaagg

SEQ ID NO: 2622799 - DNA, 17 bp, Homo sapiens
tacactgtttcaaactt

SEQ ID NO: 2622800 - DNA, 14 bp, Homo sapiens
tacacttactgttg

SEQ ID NO: 2622801 - DNA, 19 bp, Homo sapiens
tacacttactgttgtccta

SEQ ID NO: 2622802 - DNA, 21 bp, Homo sapiens
tacacttactgttgtcctatg

SEQ ID NO: 2622803 - DNA, 13 bp, Homo sapiens
tacactttatgca

SEQ ID NO: 2622804 - DNA, 18 bp, Homo sapiens
tacacttttttggggata

SEQ ID NO: 2622805 - DNA, 22 bp, Homo sapiens
tacagaaagtggtgctcagttg

SEQ ID NO: 2622806 - DNA, 18 bp, Homo sapiens
tacagaaattagccgggc

SEQ ID NO: 2622807 - DNA, 17 bp, Homo sapiens
tacagaactctttcaaa

SEQ ID NO: 2622808 - DNA, 19 bp, Homo sapiens
tacagaactctttcaaaac

SEQ ID NO: 2622809 - DNA, 14 bp, Homo sapiens
tacagacactaagt

SEQ ID NO: 2622810 - DNA, 21 bp, Homo sapiens
tacagaccgaactgttgtata

SEQ ID NO: 2622811 - DNA, 13 bp, Homo sapiens
tacagacgtatgc

SEQ ID NO: 2622812 - DNA, 16 bp, Homo sapiens
tacagacgtatgctta

SEQ ID NO: 2622813 - DNA, 19 bp, Homo sapiens
tacagagcccacgccccca

SEQ ID NO: 2622814 - DNA, 22 bp, Homo sapiens
tacagagcccacgcccccactg

SEQ ID NO: 2622815 - DNA, 16 bp, Homo sapiens
tacagagcttccctga

SEQ ID NO: 2622816 - DNA, 19 bp, Homo sapiens
tacagcaacaatttatgaa

SEQ ID NO: 2622817 - DNA, 22 bp, Homo sapiens
tacagcaacaatttatgaattg

SEQ ID NO: 2622818 - DNA, 14 bp, Homo sapiens
tacagcactactct

SEQ ID NO: 2622819 - DNA, 17 bp, Homo sapiens
tacagcactactctgtg

SEQ ID NO: 2622820 - DNA, 22 bp, Homo sapiens
tacagccaaagataatctctca

SEQ ID NO: 2622821 - DNA, 16 bp, Homo sapiens
tacagcgagaggcaga

SEQ ID NO: 2622822 - DNA, 14 bp, Homo sapiens
tacagctgcctgca

SEQ ID NO: 2622823 - DNA, 20 bp, Homo sapiens
tacagctgggtggcactgcc

SEQ ID NO: 2622824 - DNA, 16 bp, Homo sapiens
tacagctgtttaagat

SEQ ID NO: 2622825 - DNA, 18 bp, Homo sapiens
tacagctttcatgattag

SEQ ID NO: 2622826 - DNA, 20 bp, Homo sapiens
tacagctttgtgactgtata

SEQ ID NO: 2622827 - DNA, 22 bp, Homo sapiens
tacagctttgtgactgtatata

SEQ ID NO: 2622828 - DNA, 18 bp, Homo sapiens
tacaggaaaagctgctga

SEQ ID NO: 2622829 - DNA, 14 bp, Homo sapiens
tacaggcacaaaat

SEQ ID NO: 2622830 - DNA, 16 bp, Homo sapiens
tacaggcacccaccat

SEQ ID NO: 2622831 - DNA, 21 bp, Homo sapiens
tacagggcatgcattttgcag

SEQ ID NO: 2622832 - DNA, 16 bp, Homo sapiens
tacaggtgtgagtcac

SEQ ID NO: 2622833 - DNA, 13 bp, Homo sapiens
tacaggttacaac

SEQ ID NO: 2622834 - DNA, 15 bp, Homo sapiens
tacagtatctcaggg

SEQ ID NO: 2622835 - DNA, 17 bp, Homo sapiens
tacagtcttgcagcagg

SEQ ID NO: 2622836 - DNA, 12 bp, Homo sapiens
tacagtcttgta

SEQ ID NO: 2622837 - DNA, 23 bp, Homo sapiens
tacagtgaaaatgtaagctgttt

SEQ ID NO: 2622838 - DNA, 14 bp, Homo sapiens
tacagtgagccaag

SEQ ID NO: 2622839 - DNA, 19 bp, Homo sapiens
tacagttactcagaattct

SEQ ID NO: 2622840 - DNA, 23 bp, Homo sapiens
tacagttactcagaattctctag

SEQ ID NO: 2622841 - DNA, 11 bp, Homo sapiens
tacagttcttc

SEQ ID NO: 2622842 - DNA, 19 bp, Homo sapiens
tacagttgaaaaacagctg

SEQ ID NO: 2622843 - DNA, 15 bp, Homo sapiens
tacagttgttggcct

SEQ ID NO: 2622844 - DNA, 18 bp, Homo sapiens
tacagttgttggcctccg

SEQ ID NO: 2622845 - DNA, 15 bp, Homo sapiens
tacagtttgctgtac

SEQ ID NO: 2622846 - DNA, 17 bp, Homo sapiens
tacagtttgctgtacta

SEQ ID NO: 2622847 - DNA, 19 bp, Homo sapiens
tacagtttgttagtatgag

SEQ ID NO: 2622848 - DNA, 21 bp, Homo sapiens
tacagtttgttagtatgaggc

SEQ ID NO: 2622849 - DNA, 13 bp, Homo sapiens
tacataactgaaa

SEQ ID NO: 2622850 - DNA, 17 bp, Homo sapiens
tacataactgaaaatgt

SEQ ID NO: 2622851 - DNA, 23 bp, Homo sapiens
tacataatgcgtgcataccactt

SEQ ID NO: 2622852 - DNA, 14 bp, Homo sapiens
tacatagatgctta

SEQ ID NO: 2622853 - DNA, 17 bp, Homo sapiens
tacatagatgcttagtc

SEQ ID NO: 2622854 - DNA, 21 bp, Homo sapiens
tacatagcctatatttacagt

SEQ ID NO: 2622855 - DNA, 18 bp, Homo sapiens
tacatatcacctcatggc

SEQ ID NO: 2622856 - DNA, 22 bp, Homo sapiens
tacatatgagtgtggaagccgg

SEQ ID NO: 2622857 - DNA, 15 bp, Homo sapiens
tacatatgtaaaata

SEQ ID NO: 2622858 - DNA, 16 bp, Homo sapiens
tacatatgtaaaataa

SEQ ID NO: 2622859 - DNA, 18 bp, Homo sapiens
tacatcttttttcacaaa

SEQ ID NO: 2622860 - DNA, 17 bp, Homo sapiens
tacatgaaaacacattt

SEQ ID NO: 2622861 - DNA, 18 bp, Homo sapiens
tacatgaaaacacatttt

SEQ ID NO: 2622862 - DNA, 12 bp, Homo sapiens
tacatgaaacag

SEQ ID NO: 2622863 - DNA, 13 bp, Homo sapiens
tacatgaaacaga

SEQ ID NO: 2622864 - DNA, 21 bp, Homo sapiens
tacatgacatttatttttcat

SEQ ID NO: 2622865 - DNA, 21 bp, Homo sapiens
tacatgaggtactgagagtga

SEQ ID NO: 2622866 - DNA, 11 bp, Homo sapiens
tacatgcatac

SEQ ID NO: 2622867 - DNA, 17 bp, Homo sapiens
tacatgcatacttcaaa

SEQ ID NO: 2622868 - DNA, 19 bp, Homo sapiens
tacatgcatacttcaaaag

SEQ ID NO: 2622869 - DNA, 21 bp, Homo sapiens
tacatgcatacttcaaaagta

SEQ ID NO: 2622870 - DNA, 14 bp, Homo sapiens
tacatgctgctaat

SEQ ID NO: 2622871 - DNA, 16 bp, Homo sapiens
tacatggccagtgtga

SEQ ID NO: 2622872 - DNA, 22 bp, Homo sapiens
tacatgtattatttcattatgt

SEQ ID NO: 2622873 - DNA, 17 bp, Homo sapiens
tacatgtgccgaatgtg

SEQ ID NO: 2622874 - DNA, 20 bp, Homo sapiens
tacatgtgccgaatgtgcag

SEQ ID NO: 2622875 - DNA, 12 bp, Homo sapiens
tacattaatgtt

SEQ ID NO: 2622876 - DNA, 23 bp, Homo sapiens
tacattaatgttaattcagcact

SEQ ID NO: 2622877 - DNA, 15 bp, Homo sapiens
tacattaattatcta

SEQ ID NO: 2622878 - DNA, 13 bp, Homo sapiens
tacattctgttaa

SEQ ID NO: 2622879 - DNA, 23 bp, Homo sapiens
tacattgtttgtctgtcttcata

SEQ ID NO: 2622880 - DNA, 14 bp, Homo sapiens
tacatttatgattt

SEQ ID NO: 2622881 - DNA, 22 bp, Homo sapiens
tacatttatgatttaataaaat

SEQ ID NO: 2622882 - DNA, 16 bp, Homo sapiens
tacatttccctgtgct

SEQ ID NO: 2622883 - DNA, 22 bp, Homo sapiens
tacatttctcctttgataaaat

SEQ ID NO: 2622884 - DNA, 23 bp, Homo sapiens
tacatttctcctttgataaaata

SEQ ID NO: 2622885 - DNA, 14 bp, Homo sapiens
tacatttctgaaat

SEQ ID NO: 2622886 - DNA, 14 bp, Homo sapiens
taccaactttctgt

SEQ ID NO: 2622887 - DNA, 15 bp, Homo sapiens
taccaactttctgta

SEQ ID NO: 2622888 - DNA, 22 bp, Homo sapiens
taccaatagattccccattgcc

SEQ ID NO: 2622889 - DNA, 22 bp, Homo sapiens
taccaatcattttaattattat

SEQ ID NO: 2622890 - DNA, 15 bp, Homo sapiens
taccaatgaaaaaat

SEQ ID NO: 2622891 - DNA, 11 bp, Homo sapiens
taccaatgcat

SEQ ID NO: 2622892 - DNA, 13 bp, Homo sapiens
taccacagacata

SEQ ID NO: 2622893 - DNA, 15 bp, Homo sapiens
taccacccaatgctg

SEQ ID NO: 2622894 - DNA, 15 bp, Homo sapiens
taccacccccacacc

SEQ ID NO: 2622895 - DNA, 15 bp, Homo sapiens
taccaccccttcctg

SEQ ID NO: 2622896 - DNA, 22 bp, Homo sapiens
taccagacggttcaccagcctc

SEQ ID NO: 2622897 - DNA, 15 bp, Homo sapiens
taccagactgtgtat

SEQ ID NO: 2622898 - DNA, 18 bp, Homo sapiens
taccagccagtaaatggg

SEQ ID NO: 2622899 - DNA, 18 bp, Homo sapiens
taccagcgcccgctgggc

SEQ ID NO: 2622900 - DNA, 15 bp, Homo sapiens
taccatgaaacaaag

SEQ ID NO: 2622901 - DNA, 16 bp, Homo sapiens
taccatgccatttaaa

SEQ ID NO: 2622902 - DNA, 15 bp, Homo sapiens
taccatgtgcctgat

SEQ ID NO: 2622903 - DNA, 16 bp, Homo sapiens
taccatttcagagagg

SEQ ID NO: 2622904 - DNA, 20 bp, Homo sapiens
taccattttttaaggaaaca

SEQ ID NO: 2622905 - DNA, 21 bp, Homo sapiens
taccattttttaaggaaacaa

SEQ ID NO: 2622906 - DNA, 21 bp, Homo sapiens
tacccaaccactcaaattaat

SEQ ID NO: 2622907 - DNA, 23 bp, Homo sapiens
tacccacccccacccaagggcct

SEQ ID NO: 2622908 - DNA, 21 bp, Homo sapiens
tacccacgttctcacacccac

SEQ ID NO: 2622909 - DNA, 15 bp, Homo sapiens
tacccactgctctgg

SEQ ID NO: 2622910 - DNA, 16 bp, Homo sapiens
tacccagagaagcccc

SEQ ID NO: 2622911 - DNA, 21 bp, Homo sapiens
tacccagagaagccccttccc

SEQ ID NO: 2622912 - DNA, 14 bp, Homo sapiens
tacccagccatctg

SEQ ID NO: 2622913 - DNA, 22 bp, Homo sapiens
tacccaggtgctaggaacactc

SEQ ID NO: 2622914 - DNA, 12 bp, Homo sapiens
tacccatatccc

SEQ ID NO: 2622915 - DNA, 18 bp, Homo sapiens
tacccatgactttatatg

SEQ ID NO: 2622916 - DNA, 21 bp, Homo sapiens
tacccattcgtggtgatcaat

SEQ ID NO: 2622917 - DNA, 16 bp, Homo sapiens
taccccaattccttgt

SEQ ID NO: 2622918 - DNA, 14 bp, Homo sapiens
taccccaccctcag

SEQ ID NO: 2622919 - DNA, 16 bp, Homo sapiens
taccctagccattcct

SEQ ID NO: 2622920 - DNA, 21 bp, Homo sapiens
taccctcaggcataggcctgg

SEQ ID NO: 2622921 - DNA, 12 bp, Homo sapiens
taccctcctcca

SEQ ID NO: 2622922 - DNA, 12 bp, Homo sapiens
taccctcctggc

SEQ ID NO: 2622923 - DNA, 20 bp, Homo sapiens
taccctcgggcccacctggc

SEQ ID NO: 2622924 - DNA, 17 bp, Homo sapiens
taccctctcagctccag

SEQ ID NO: 2622925 - DNA, 12 bp, Homo sapiens
taccctctggag

SEQ ID NO: 2622926 - DNA, 14 bp, Homo sapiens
taggtcactggctc

SEQ ID NO: 2622927 - DNA, 21 bp, Homo sapiens
taggtcactggctctccaagt

SEQ ID NO: 2622928 - DNA, 14 bp, Homo sapiens
taggtctcttcccc

SEQ ID NO: 2622929 - DNA, 17 bp, Homo sapiens
taggtctgatattcaaa

SEQ ID NO: 2622930 - DNA, 15 bp, Homo sapiens
taggtggcaaggctg

SEQ ID NO: 2622931 - DNA, 15 bp, Homo sapiens
taggtttaactcaga

SEQ ID NO: 2622932 - DNA, 16 bp, Homo sapiens
taggttttgtttgcta

SEQ ID NO: 2622933 - DNA, 21 bp, Homo sapiens
taggttttgtttgctatctta

SEQ ID NO: 2622934 - DNA, 13 bp, Homo sapiens
tagtaaagaaatt

SEQ ID NO: 2622935 - DNA, 14 bp, Homo sapiens
tagtaatcacagtt

SEQ ID NO: 2622936 - DNA, 20 bp, Homo sapiens
tagtaatgctacgtgtgatt

SEQ ID NO: 2622937 - DNA, 22 bp, Homo sapiens
tagtaatgctacgtgtgatttt

SEQ ID NO: 2622938 - DNA, 23 bp, Homo sapiens
tagtacaggtaaggtgagggaat

SEQ ID NO: 2622939 - DNA, 23 bp, Homo sapiens
tagtaccaatcattttaattatt

SEQ ID NO: 2622940 - DNA, 15 bp, Homo sapiens
tagtacctgaaaagt

SEQ ID NO: 2622941 - DNA, 17 bp, Homo sapiens
tagtactcctgcaaaat

SEQ ID NO: 2622942 - DNA, 22 bp, Homo sapiens
tagtacttgaaatctaggatta

SEQ ID NO: 2622943 - DNA, 13 bp, Homo sapiens
tagtagagacagg

SEQ ID NO: 2622944 - DNA, 14 bp, Homo sapiens
tagtagagacaggg

SEQ ID NO: 2622945 - DNA, 17 bp, Homo sapiens
tagtagccctttctgtg

SEQ ID NO: 2622946 - DNA, 19 bp, Homo sapiens
tagtagttcctgctacaac

SEQ ID NO: 2622947 - DNA, 16 bp, Homo sapiens
tagtataaagaaaagt

SEQ ID NO: 2622948 - DNA, 15 bp, Homo sapiens
tagtatcctccaggt

SEQ ID NO: 2622949 - DNA, 17 bp, Homo sapiens
tagtatcctccaggttt

SEQ ID NO: 2622950 - DNA, 23 bp, Homo sapiens
tagtatcctccaggtttttcaat

SEQ ID NO: 2622951 - DNA, 15 bp, Homo sapiens
tagtatctaacatgt

SEQ ID NO: 2622952 - DNA, 16 bp, Homo sapiens
tagtatctagcaatca

SEQ ID NO: 2622953 - DNA, 17 bp, Homo sapiens
tagtatgaggcatttgt

SEQ ID NO: 2622954 - DNA, 16 bp, Homo sapiens
tagtcaaattatgtat

SEQ ID NO: 2622955 - DNA, 20 bp, Homo sapiens
tagtcactgagacagcccgg

SEQ ID NO: 2622956 - DNA, 13 bp, Homo sapiens
tagtcactttttt

SEQ ID NO: 2622957 - DNA, 20 bp, Homo sapiens
tagtcactttttttttccaa

SEQ ID NO: 2622958 - DNA, 23 bp, Homo sapiens
tagtccagctttgttcttcttaa

SEQ ID NO: 2622959 - DNA, 14 bp, Homo sapiens
tagtcccagctact

SEQ ID NO: 2622960 - DNA, 21 bp, Homo sapiens
tagtcccagctactcagaagc

SEQ ID NO: 2622961 - DNA, 20 bp, Homo sapiens
tagtcccagctactcaggag

SEQ ID NO: 2622962 - DNA, 18 bp, Homo sapiens
tagtccctcatgcaaatc

SEQ ID NO: 2622963 - DNA, 14 bp, Homo sapiens
tagtcccttcccct

SEQ ID NO: 2622964 - DNA, 15 bp, Homo sapiens
tagtcccttcccctc

SEQ ID NO: 2622965 - DNA, 20 bp, Homo sapiens
tagtcccttcccctccctgg

SEQ ID NO: 2622966 - DNA, 20 bp, Homo sapiens
tagtcgtggagatgtcttcg

SEQ ID NO: 2622967 - DNA, 21 bp, Homo sapiens
tagtcgtggagatgtcttcgt

SEQ ID NO: 2622968 - DNA, 14 bp, Homo sapiens
tagtctctgtgctt

SEQ ID NO: 2622969 - DNA, 15 bp, Homo sapiens
tagtcttcaagcaga

SEQ ID NO: 2622970 - DNA, 19 bp, Homo sapiens
tagtgaaggcttctctctg

SEQ ID NO: 2622971 - DNA, 18 bp, Homo sapiens
tagtgacccggaggccac

SEQ ID NO: 2622972 - DNA, 20 bp, Homo sapiens
tagtgacccggaggccacat

SEQ ID NO: 2622973 - DNA, 15 bp, Homo sapiens
tagtgatcacagcag

SEQ ID NO: 2622974 - DNA, 20 bp, Homo sapiens
tagtgatcacagcagcttct

SEQ ID NO: 2622975 - DNA, 17 bp, Homo sapiens
tagtgatctgaacagaa

SEQ ID NO: 2622976 - DNA, 22 bp, Homo sapiens
tagtgcagctgattttaacaat

SEQ ID NO: 2622977 - DNA, 12 bp, Homo sapiens
tagtgctgtgaa

SEQ ID NO: 2622978 - DNA, 13 bp, Homo sapiens
tagtgctgtgaaa

SEQ ID NO: 2622979 - DNA, 16 bp, Homo sapiens
tagtgctgtgaaaaaa

SEQ ID NO: 2622980 - DNA, 17 bp, Homo sapiens
tagtgctgtgaaaaaaa

SEQ ID NO: 2622981 - DNA, 14 bp, Homo sapiens
tagtggcttcaaaa

SEQ ID NO: 2622982 - DNA, 16 bp, Homo sapiens
tagtggtctttgtaag

SEQ ID NO: 2622983 - DNA, 18 bp, Homo sapiens
tagtggtctttgtaagag

SEQ ID NO: 2622984 - DNA, 11 bp, Homo sapiens
tagtgtaaaat

SEQ ID NO: 2622985 - DNA, 19 bp, Homo sapiens
tagtgtaaaataagaatga

SEQ ID NO: 2622986 - DNA, 17 bp, Homo sapiens
tagtgtcacttacctag

SEQ ID NO: 2622987 - DNA, 19 bp, Homo sapiens
tagttaaatttctggacct

SEQ ID NO: 2622988 - DNA, 15 bp, Homo sapiens
tagttactatatgcc

SEQ ID NO: 2622989 - DNA, 14 bp, Homo sapiens
tagttactcattca

SEQ ID NO: 2622990 - DNA, 22 bp, Homo sapiens
tagttagccaatatttttctta

SEQ ID NO: 2622991 - DNA, 20 bp, Homo sapiens
tagttaggatagcatttttg

SEQ ID NO: 2622992 - DNA, 18 bp, Homo sapiens
tagttcatccaatcctca

SEQ ID NO: 2622993 - DNA, 12 bp, Homo sapiens
tagttcctgcta

SEQ ID NO: 2622994 - DNA, 18 bp, Homo sapiens
tagttgaactgatagtta

SEQ ID NO: 2622995 - DNA, 17 bp, Homo sapiens
tagttgcaatagaacag

SEQ ID NO: 2622996 - DNA, 22 bp, Homo sapiens
tagttgcgtggactctgcacat

SEQ ID NO: 2622997 - DNA, 15 bp, Homo sapiens
tagttggtgttcaaa

SEQ ID NO: 2622998 - DNA, 22 bp, Homo sapiens
tagttgtgaccttagtgtttct

SEQ ID NO: 2622999 - DNA, 17 bp, Homo sapiens
tagtttacctctttaaa

SEQ ID NO: 2623000 - DNA, 16 bp, Homo sapiens
tagtttctgttctgtg

SEQ ID NO: 2623001 - DNA, 20 bp, Homo sapiens
tagtttctgttctgtggaaa

SEQ ID NO: 2623002 - DNA, 12 bp, Homo sapiens
tagtttcttgtg

SEQ ID NO: 2623003 - DNA, 14 bp, Homo sapiens
tagtttctttggga

SEQ ID NO: 2623004 - DNA, 21 bp, Homo sapiens
tagtttgattaaattcttgca

SEQ ID NO: 2623005 - DNA, 12 bp, Homo sapiens
tagtttgcagtt

SEQ ID NO: 2623006 - DNA, 18 bp, Homo sapiens
tagtttgcattcctgata

SEQ ID NO: 2623007 - DNA, 11 bp, Homo sapiens
tagtttggatt

SEQ ID NO: 2623008 - DNA, 14 bp, Homo sapiens
tagttttactttta

SEQ ID NO: 2623009 - DNA, 22 bp, Homo sapiens
tagttttacttttaaactgtgt

SEQ ID NO: 2623010 - DNA, 17 bp, Homo sapiens
tataaaacaggtcaata

SEQ ID NO: 2623011 - DNA, 14 bp, Homo sapiens
tataaaagactgac

SEQ ID NO: 2623012 - DNA, 23 bp, Homo sapiens
tataaacttagtgcggacaagtt

SEQ ID NO: 2623013 - DNA, 15 bp, Homo sapiens
tataaactttacctt

SEQ ID NO: 2623014 - DNA, 17 bp, Homo sapiens
tataaactttacctttt

SEQ ID NO: 2623015 - DNA, 22 bp, Homo sapiens
tataaagaacaaggtagttttt

SEQ ID NO: 2623016 - DNA, 16 bp, Homo sapiens
tataaagtaaagctaa

SEQ ID NO: 2623017 - DNA, 23 bp, Homo sapiens
tataaatcgcttttgataatcaa

SEQ ID NO: 2623018 - DNA, 18 bp, Homo sapiens
tataaatgccaaagtctt

SEQ ID NO: 2623019 - DNA, 16 bp, Homo sapiens
tataaatgctattttt

SEQ ID NO: 2623020 - DNA, 16 bp, Homo sapiens
tataaatggtgttttt

SEQ ID NO: 2623021 - DNA, 15 bp, Homo sapiens
tataaatttatttac

SEQ ID NO: 2623022 - DNA, 16 bp, Homo sapiens
tataaatttatttact

SEQ ID NO: 2623023 - DNA, 13 bp, Homo sapiens
tataacaggttat

SEQ ID NO: 2623024 - DNA, 21 bp, Homo sapiens
tataacaggttattttagttt

SEQ ID NO: 2623025 - DNA, 21 bp, Homo sapiens
tataactcatcataaaataaa

SEQ ID NO: 2623026 - DNA, 23 bp, Homo sapiens
tataactctgcactactcctctg

SEQ ID NO: 2623027 - DNA, 18 bp, Homo sapiens
tataacttaaaatatttt

SEQ ID NO: 2623028 - DNA, 19 bp, Homo sapiens
tataacttatattgtaaga

SEQ ID NO: 2623029 - DNA, 24 bp, Homo sapiens
tataacttatattgtaagaaatac

SEQ ID NO: 2623030 - DNA, 16 bp, Homo sapiens
tataagattagaatga

SEQ ID NO: 2623031 - DNA, 22 bp, Homo sapiens
tataaggaaagcaataaatgaa

SEQ ID NO: 2623032 - DNA, 23 bp, Homo sapiens
tataaggaaagcaataaatgaat

SEQ ID NO: 2623033 - DNA, 13 bp, Homo sapiens
tataataaaagga

SEQ ID NO: 2623034 - DNA, 22 bp, Homo sapiens
tataataaaaggaaaagcaaat

SEQ ID NO: 2623035 - DNA, 15 bp, Homo sapiens
tataatatcctttgt

SEQ ID NO: 2623036 - DNA, 22 bp, Homo sapiens
tataatatttttaattaaataa

SEQ ID NO: 2623037 - DNA, 20 bp, Homo sapiens
tataatcacttttttccaca

SEQ ID NO: 2623038 - DNA, 20 bp, Homo sapiens
tataatgaatgaaacatttt

SEQ ID NO: 2623039 - DNA, 18 bp, Homo sapiens
tataatgaatgagagaat

SEQ ID NO: 2623040 - DNA, 16 bp, Homo sapiens
tataatggtttcaaag

SEQ ID NO: 2623041 - DNA, 14 bp, Homo sapiens
tataatgtaagctc

SEQ ID NO: 2623042 - DNA, 19 bp, Homo sapiens
tataatgtaagctctactg

SEQ ID NO: 2623043 - DNA, 14 bp, Homo sapiens
tataattctgtaaa

SEQ ID NO: 2623044 - DNA, 14 bp, Homo sapiens
tataattctgtaca

SEQ ID NO: 2623045 - DNA, 20 bp, Homo sapiens
tataattctgtacatagcct

SEQ ID NO: 2623046 - DNA, 15 bp, Homo sapiens
tataatttaacttca

SEQ ID NO: 2623047 - DNA, 19 bp, Homo sapiens
tataatttttaaagtatat

SEQ ID NO: 2623048 - DNA, 19 bp, Homo sapiens
tataattttttagagagct

SEQ ID NO: 2623049 - DNA, 22 bp, Homo sapiens
tatacaaccctggcattatgtc

SEQ ID NO: 2623050 - DNA, 22 bp, Homo sapiens
tatacacttacactttatgcac

SEQ ID NO: 2623051 - DNA, 16 bp, Homo sapiens
tatacagtaactttat

SEQ ID NO: 2623052 - DNA, 19 bp, Homo sapiens
tatacagtaactttatgtg

SEQ ID NO: 2623053 - DNA, 13 bp, Homo sapiens
tatacataaacaa

SEQ ID NO: 2623054 - DNA, 19 bp, Homo sapiens
tataccagtataattgagt

SEQ ID NO: 2623055 - DNA, 13 bp, Homo sapiens
tatacgtgtagct

SEQ ID NO: 2623056 - DNA, 15 bp, Homo sapiens
tatacgtgtagctat

SEQ ID NO: 2623057 - DNA, 15 bp, Homo sapiens
tatactaagaaaaga

SEQ ID NO: 2623058 - DNA, 17 bp, Homo sapiens
tatactcactttctaga

SEQ ID NO: 2623059 - DNA, 11 bp, Homo sapiens
tatactgtaaa

SEQ ID NO: 2623060 - DNA, 14 bp, Homo sapiens
tatactgtaaagaa

SEQ ID NO: 2623061 - DNA, 13 bp, Homo sapiens
tatactgtattaa

SEQ ID NO: 2623062 - DNA, 21 bp, Homo sapiens
tatacttttttcttatttaac

SEQ ID NO: 2623063 - DNA, 17 bp, Homo sapiens
tatagaactgaatgaga

SEQ ID NO: 2623064 - DNA, 21 bp, Homo sapiens
tatagaatatttattacctct

SEQ ID NO: 2623065 - DNA, 16 bp, Homo sapiens
tatagacaaataataa

SEQ ID NO: 2623066 - DNA, 15 bp, Homo sapiens
tatagatcccccaga

SEQ ID NO: 2623067 - DNA, 17 bp, Homo sapiens
tatagatgggaatgaag

SEQ ID NO: 2623068 - DNA, 23 bp, Homo sapiens
tatagcaatccatgttagttttt

SEQ ID NO: 2623069 - DNA, 13 bp, Homo sapiens
tatagcccaggtc

SEQ ID NO: 2623070 - DNA, 18 bp, Homo sapiens
tatagcctaggtgacaga

SEQ ID NO: 2623071 - DNA, 21 bp, Homo sapiens
tatttggaatttatatacaac

SEQ ID NO: 2623072 - DNA, 17 bp, Homo sapiens
tatttggtactgtattt

SEQ ID NO: 2623073 - DNA, 21 bp, Homo sapiens
tatttggtttggccatctctg

SEQ ID NO: 2623074 - DNA, 22 bp, Homo sapiens
tatttgtaaatttatgtgatgg

SEQ ID NO: 2623075 - DNA, 14 bp, Homo sapiens
tatttgtgactaat

SEQ ID NO: 2623076 - DNA, 17 bp, Homo sapiens
tatttgtgactaattgt

SEQ ID NO: 2623077 - DNA, 21 bp, Homo sapiens
tatttgtgactaattgtataa

SEQ ID NO: 2623078 - DNA, 22 bp, Homo sapiens
tatttgtgactaattgtataac

SEQ ID NO: 2623079 - DNA, 14 bp, Homo sapiens
tatttgtggaataa

SEQ ID NO: 2623080 - DNA, 15 bp, Homo sapiens
tatttgtgtatttaa

SEQ ID NO: 2623081 - DNA, 17 bp, Homo sapiens
tatttgtgtatttaaca

SEQ ID NO: 2623082 - DNA, 12 bp, Homo sapiens
tatttgtgtttt

SEQ ID NO: 2623083 - DNA, 17 bp, Homo sapiens
tatttgttaaatattta

SEQ ID NO: 2623084 - DNA, 22 bp, Homo sapiens
tatttgttaatggtttgaatat

SEQ ID NO: 2623085 - DNA, 14 bp, Homo sapiens
tatttgttattttc

SEQ ID NO: 2623086 - DNA, 17 bp, Homo sapiens
tatttgttattttcagt

SEQ ID NO: 2623087 - DNA, 15 bp, Homo sapiens
tatttgtttgcatag

SEQ ID NO: 2623088 - DNA, 14 bp, Homo sapiens
tattttacaatttt

SEQ ID NO: 2623089 - DNA, 16 bp, Homo sapiens
tattttagtttctgtt

SEQ ID NO: 2623090 - DNA, 21 bp, Homo sapiens
tattttagtttctgttctgtg

SEQ ID NO: 2623091 - DNA, 15 bp, Homo sapiens
tattttatcctctgg

SEQ ID NO: 2623092 - DNA, 17 bp, Homo sapiens
tattttatttttttcta

SEQ ID NO: 2623093 - DNA, 13 bp, Homo sapiens
tattttcaagaaa

SEQ ID NO: 2623094 - DNA, 13 bp, Homo sapiens
tattttcaccatt

SEQ ID NO: 2623095 - DNA, 13 bp, Homo sapiens
tattttcattgta

SEQ ID NO: 2623096 - DNA, 18 bp, Homo sapiens
tattttcccccttttctg

SEQ ID NO: 2623097 - DNA, 22 bp, Homo sapiens
tattttccctattagagaagag

SEQ ID NO: 2623098 - DNA, 22 bp, Homo sapiens
tattttctggtagatagaaata

SEQ ID NO: 2623099 - DNA, 14 bp, Homo sapiens
tattttctgttcta

SEQ ID NO: 2623100 - DNA, 16 bp, Homo sapiens
tattttcttttgtaaa

SEQ ID NO: 2623101 - DNA, 12 bp, Homo sapiens
tattttgaatca

SEQ ID NO: 2623102 - DNA, 15 bp, Homo sapiens
tattttgaatcaata

SEQ ID NO: 2623103 - DNA, 16 bp, Homo sapiens
tattttgaatgtgaag

SEQ ID NO: 2623104 - DNA, 16 bp, Homo sapiens
tattttggagaaatta

SEQ ID NO: 2623105 - DNA, 17 bp, Homo sapiens
tattttggtacttttat

SEQ ID NO: 2623106 - DNA, 19 bp, Homo sapiens
tattttggttcttagttct

SEQ ID NO: 2623107 - DNA, 15 bp, Homo sapiens
tattttgtatatatc

SEQ ID NO: 2623108 - DNA, 21 bp, Homo sapiens
tatttttaatatatactatga

SEQ ID NO: 2623109 - DNA, 12 bp, Homo sapiens
tatttttaatgg

SEQ ID NO: 2623110 - DNA, 15 bp, Homo sapiens
tatttttactgccac

SEQ ID NO: 2623111 - DNA, 12 bp, Homo sapiens
tatttttatctt

SEQ ID NO: 2623112 - DNA, 17 bp, Homo sapiens
tatttttgcatggcact

SEQ ID NO: 2623113 - DNA, 13 bp, Homo sapiens
tatttttgccctg

SEQ ID NO: 2623114 - DNA, 20 bp, Homo sapiens
tatttttggcagtctgaatt

SEQ ID NO: 2623115 - DNA, 17 bp, Homo sapiens
tatttttgtagagccag

SEQ ID NO: 2623116 - DNA, 13 bp, Homo sapiens
tattttttaagta

SEQ ID NO: 2623117 - DNA, 15 bp, Homo sapiens
tattttttaagtatt

SEQ ID NO: 2623118 - DNA, 12 bp, Homo sapiens
tattttttaatt

SEQ ID NO: 2623119 - DNA, 17 bp, Homo sapiens
tattttttattgttttc

SEQ ID NO: 2623120 - DNA, 13 bp, Homo sapiens
tattttttcagac

SEQ ID NO: 2623121 - DNA, 22 bp, Homo sapiens
tattttttgaggctatgaatat

SEQ ID NO: 2623122 - DNA, 14 bp, Homo sapiens
tatttttttactaa

SEQ ID NO: 2623123 - DNA, 17 bp, Homo sapiens
tatttttttcttttctt

SEQ ID NO: 2623124 - DNA, 17 bp, Homo sapiens
tattttttttaagtatt

SEQ ID NO: 2623125 - DNA, 19 bp, Homo sapiens
tcaaaaaaaaaaaaatgca

SEQ ID NO: 2623126 - DNA, 23 bp, Homo sapiens
tcaaaaacacagtgtttttgtaa

SEQ ID NO: 2623127 - DNA, 22 bp, Homo sapiens
tcaaaaactttggagtcccctc

SEQ ID NO: 2623128 - DNA, 15 bp, Homo sapiens
tcaaaaagtgtttat

SEQ ID NO: 2623129 - DNA, 23 bp, Homo sapiens
tcaaaaagtgtttatttttcata

SEQ ID NO: 2623130 - DNA, 15 bp, Homo sapiens
tcaaaacagagatgt

SEQ ID NO: 2623131 - DNA, 15 bp, Homo sapiens
tcaaaaccttttgaa

SEQ ID NO: 2623132 - DNA, 18 bp, Homo sapiens
tcaaaacggggcagccaa

SEQ ID NO: 2623133 - DNA, 22 bp, Homo sapiens
tcaaaacggttttactgcagct

SEQ ID NO: 2623134 - DNA, 18 bp, Homo sapiens
tcaaaagaaagaaaatca

SEQ ID NO: 2623135 - DNA, 12 bp, Homo sapiens
tcaaaagacaat

SEQ ID NO: 2623136 - DNA, 19 bp, Homo sapiens
tcaaaagacaattctttat

SEQ ID NO: 2623137 - DNA, 15 bp, Homo sapiens
tcaaaagctggatta

SEQ ID NO: 2623138 - DNA, 15 bp, Homo sapiens
tcaaaagtattttcc

SEQ ID NO: 2623139 - DNA, 17 bp, Homo sapiens
tcaaaagtattttcctg

SEQ ID NO: 2623140 - DNA, 20 bp, Homo sapiens
tcaaaagtattttcctgtaa

SEQ ID NO: 2623141 - DNA, 13 bp, Homo sapiens
tcaaaataaaaac

SEQ ID NO: 2623142 - DNA, 15 bp, Homo sapiens
tcaaaatatgttctt

SEQ ID NO: 2623143 - DNA, 19 bp, Homo sapiens
tcaaaatatttgtacatag

SEQ ID NO: 2623144 - DNA, 15 bp, Homo sapiens
tcaaaatgacagcca

SEQ ID NO: 2623145 - DNA, 24 bp, Homo sapiens
tcaaaattagtgctttttgtgtca

SEQ ID NO: 2623146 - DNA, 17 bp, Homo sapiens
tcaaacaaagccagaag

SEQ ID NO: 2623147 - DNA, 12 bp, Homo sapiens
tcaaacactgca

SEQ ID NO: 2623148 - DNA, 20 bp, Homo sapiens
tcaaaccaaatcactgaact

SEQ ID NO: 2623149 - DNA, 20 bp, Homo sapiens
tcaaaccccgaccacctgcc

SEQ ID NO: 2623150 - DNA, 20 bp, Homo sapiens
tcaaaccgcactcacccatg

SEQ ID NO: 2623151 - DNA, 17 bp, Homo sapiens
tcaaacctcctcttctg

SEQ ID NO: 2623152 - DNA, 18 bp, Homo sapiens
tcaaacctgtttaaatat

SEQ ID NO: 2623153 - DNA, 19 bp, Homo sapiens
tcaaacctgtttaaatatt

SEQ ID NO: 2623154 - DNA, 22 bp, Homo sapiens
tcaaacctgtttaaatatttca

SEQ ID NO: 2623155 - DNA, 16 bp, Homo sapiens
tcaaactgaagccaga

SEQ ID NO: 2623156 - DNA, 19 bp, Homo sapiens
tcaaactgaggaatttcac

SEQ ID NO: 2623157 - DNA, 20 bp, Homo sapiens
tcaaactgccttggcttcag

SEQ ID NO: 2623158 - DNA, 16 bp, Homo sapiens
tcaaagagaaaactta

SEQ ID NO: 2623159 - DNA, 13 bp, Homo sapiens
tcaaagatatttt

SEQ ID NO: 2623160 - DNA, 20 bp, Homo sapiens
tcaaagatattttgctttgt

SEQ ID NO: 2623161 - DNA, 22 bp, Homo sapiens
tcaaagatattttgctttgtga

SEQ ID NO: 2623162 - DNA, 16 bp, Homo sapiens
tcaaagcaaggaaact

SEQ ID NO: 2623163 - DNA, 18 bp, Homo sapiens
tcaaagcaatgcattttg

SEQ ID NO: 2623164 - DNA, 15 bp, Homo sapiens
tcaaagccacactct

SEQ ID NO: 2623165 - DNA, 14 bp, Homo sapiens
tcaaagtaaaactt

SEQ ID NO: 2623166 - DNA, 19 bp, Homo sapiens
tcaaagtaaaacttgctgc

SEQ ID NO: 2623167 - DNA, 13 bp, Homo sapiens
tcaaagttttgaa

SEQ ID NO: 2623168 - DNA, 14 bp, Homo sapiens
tcaaagttttgaaa

SEQ ID NO: 2623169 - DNA, 15 bp, Homo sapiens
tcaaagttttgaaaa

SEQ ID NO: 2623170 - DNA, 18 bp, Homo sapiens
tcaaagttttgaaaagct

SEQ ID NO: 2623171 - DNA, 12 bp, Homo sapiens
tcaaatacttta

SEQ ID NO: 2623172 - DNA, 24 bp, Homo sapiens
tcaaatcagtcagtgcaaatgtca

SEQ ID NO: 2623173 - DNA, 14 bp, Homo sapiens
tcaaatctattcag

SEQ ID NO: 2623174 - DNA, 15 bp, Homo sapiens
tcaaatctattcaga

SEQ ID NO: 2623175 - DNA, 16 bp, Homo sapiens
tcaaatgacccaaaga

SEQ ID NO: 2623176 - DNA, 21 bp, Homo sapiens
tcaaatgcttggcttctcata

SEQ ID NO: 2623177 - DNA, 16 bp, Homo sapiens
tcaaattctcaaccta

SEQ ID NO: 2623178 - DNA, 12 bp, Homo sapiens
tcaaattgtatc

SEQ ID NO: 2623179 - DNA, 13 bp, Homo sapiens
tcaaattgtatct

SEQ ID NO: 2623180 - DNA, 12 bp, Homo sapiens
tcaaatttcaca

SEQ ID NO: 2623181 - DNA, 16 bp, Homo sapiens
tcaacaagggagagac

SEQ ID NO: 2623182 - DNA, 18 bp, Homo sapiens
tcaacactcccttcccat

SEQ ID NO: 2623183 - DNA, 16 bp, Homo sapiens
tcaacagctatgctgg

SEQ ID NO: 2623184 - DNA, 14 bp, Homo sapiens
tcaacatcaatgtt

SEQ ID NO: 2623185 - DNA, 17 bp, Homo sapiens
tcaacatcaatgttcat

SEQ ID NO: 2623186 - DNA, 19 bp, Homo sapiens
tcaacatcaatgttcattg

SEQ ID NO: 2623187 - DNA, 20 bp, Homo sapiens
tcaacatcaatgttcattgt

SEQ ID NO: 2623188 - DNA, 21 bp, Homo sapiens
tcaacatcaatgttcattgta

SEQ ID NO: 2623189 - DNA, 15 bp, Homo sapiens
tcaacatcttttaca

SEQ ID NO: 2623190 - DNA, 20 bp, Homo sapiens
tcaacatgttactgaccagc

SEQ ID NO: 2623191 - DNA, 14 bp, Homo sapiens
tcaacatttacatg

SEQ ID NO: 2623192 - DNA, 17 bp, Homo sapiens
tcaacatttacatgtat

SEQ ID NO: 2623193 - DNA, 19 bp, Homo sapiens
tcaaccccttcgctcctgt

SEQ ID NO: 2623194 - DNA, 19 bp, Homo sapiens
tcaaccctccctcagcccc

SEQ ID NO: 2623195 - DNA, 13 bp, Homo sapiens
tcaaccctggaga

SEQ ID NO: 2623196 - DNA, 20 bp, Homo sapiens
tcaacccttttgtctgcctc

SEQ ID NO: 2623197 - DNA, 18 bp, Homo sapiens
tcaacctaccaccccttc

SEQ ID NO: 2623198 - DNA, 20 bp, Homo sapiens
tcaacctaccaccccttcct

SEQ ID NO: 2623199 - DNA, 23 bp, Homo sapiens
tcaacctaccaccccttcctgtc

SEQ ID NO: 2623200 - DNA, 13 bp, Homo sapiens
tcaacctcctgga

SEQ ID NO: 2623201 - DNA, 17 bp, Homo sapiens
tcaacctgggcaaagcc

SEQ ID NO: 2623202 - DNA, 23 bp, Homo sapiens
tcaacgcttaaaggtgtcttcct

SEQ ID NO: 2623203 - DNA, 20 bp, Homo sapiens
tcaactcagactagtttagt

SEQ ID NO: 2623204 - DNA, 18 bp, Homo sapiens
tcaactgaccagcctcca

SEQ ID NO: 2623205 - DNA, 14 bp, Homo sapiens
tcaactgcctactc

SEQ ID NO: 2623206 - DNA, 18 bp, Homo sapiens
tcaactgcctactccaaa

SEQ ID NO: 2623207 - DNA, 18 bp, Homo sapiens
tcaactgggctgaacact

SEQ ID NO: 2623208 - DNA, 13 bp, Homo sapiens
tcaagaaactgag

SEQ ID NO: 2623209 - DNA, 23 bp, Homo sapiens
tcaagaaactgaggaattttctt

SEQ ID NO: 2623210 - DNA, 16 bp, Homo sapiens
tcaagaccttctcccc

SEQ ID NO: 2623211 - DNA, 16 bp, Homo sapiens
tcaagagctgccctcc

SEQ ID NO: 2623212 - DNA, 17 bp, Homo sapiens
tcaagagctgccctcct

SEQ ID NO: 2623213 - DNA, 16 bp, Homo sapiens
tcaagatcaatgaaat

SEQ ID NO: 2623214 - DNA, 22 bp, Homo sapiens
tcaagatgatgatgatctttaa

SEQ ID NO: 2623215 - DNA, 19 bp, Homo sapiens
tcaagattttgaatgcttc

SEQ ID NO: 2623216 - DNA, 12 bp, Homo sapiens
tcaggggtgtgc

SEQ ID NO: 2623217 - DNA, 14 bp, Homo sapiens
tcagggtccctggt

SEQ ID NO: 2623218 - DNA, 18 bp, Homo sapiens
tcagggtccctggtggca

SEQ ID NO: 2623219 - DNA, 18 bp, Homo sapiens
tcagggttggcccctgcc

SEQ ID NO: 2623220 - DNA, 16 bp, Homo sapiens
tcaggtaacaggcaga

SEQ ID NO: 2623221 - DNA, 21 bp, Homo sapiens
tcaggtaacaggcagatacag

SEQ ID NO: 2623222 - DNA, 23 bp, Homo sapiens
tcaggtaacaggcagatacagga

SEQ ID NO: 2623223 - DNA, 13 bp, Homo sapiens
tcaggtagctgcc

SEQ ID NO: 2623224 - DNA, 19 bp, Homo sapiens
tcaggtagttgcaattgaa

SEQ ID NO: 2623225 - DNA, 15 bp, Homo sapiens
tcaggtatgttgcct

SEQ ID NO: 2623226 - DNA, 16 bp, Homo sapiens
tcaggtatgttgcctt

SEQ ID NO: 2623227 - DNA, 21 bp, Homo sapiens
tcaggtatgttgcctttatgg

SEQ ID NO: 2623228 - DNA, 17 bp, Homo sapiens
tcaggtattaagaaaat

SEQ ID NO: 2623229 - DNA, 15 bp, Homo sapiens
tcaggtgagaagcag

SEQ ID NO: 2623230 - DNA, 20 bp, Homo sapiens
tcaggtgctgccatccaggt

SEQ ID NO: 2623231 - DNA, 18 bp, Homo sapiens
tcaggtggggcagcttga

SEQ ID NO: 2623232 - DNA, 20 bp, Homo sapiens
tcaggtggggcagcttgagg

SEQ ID NO: 2623233 - DNA, 18 bp, Homo sapiens
tcaggttatcgaaataac

SEQ ID NO: 2623234 - DNA, 21 bp, Homo sapiens
tcaggttatcgaaataacaat

SEQ ID NO: 2623235 - DNA, 23 bp, Homo sapiens
tcaggttatcgaaataacaatgt

SEQ ID NO: 2623236 - DNA, 18 bp, Homo sapiens
tcaggttcttagtgtcac

SEQ ID NO: 2623237 - DNA, 15 bp, Homo sapiens
tcaggttgctggttg

SEQ ID NO: 2623238 - DNA, 21 bp, Homo sapiens
tcaggttgctggttgctgtgt

SEQ ID NO: 2623239 - DNA, 20 bp, Homo sapiens
tcaggttgtagtaaagaaat

SEQ ID NO: 2623240 - DNA, 13 bp, Homo sapiens
tcaggttttgtaa

SEQ ID NO: 2623241 - DNA, 21 bp, Homo sapiens
tcagtaacttacccttaggga

SEQ ID NO: 2623242 - DNA, 21 bp, Homo sapiens
tcagtaagacgacaaggaaag

SEQ ID NO: 2623243 - DNA, 14 bp, Homo sapiens
tcagtacctggagg

SEQ ID NO: 2623244 - DNA, 16 bp, Homo sapiens
tcagtacctggaggag

SEQ ID NO: 2623245 - DNA, 18 bp, Homo sapiens
tcagtacctggaggagga

SEQ ID NO: 2623246 - DNA, 23 bp, Homo sapiens
tcagtaggtgcccagaataagtt

SEQ ID NO: 2623247 - DNA, 20 bp, Homo sapiens
tcagtatctgtatctctctc

SEQ ID NO: 2623248 - DNA, 24 bp, Homo sapiens
tcagtatctgtatctctctctctt

SEQ ID NO: 2623249 - DNA, 14 bp, Homo sapiens
tcagtatgtggaag

SEQ ID NO: 2623250 - DNA, 16 bp, Homo sapiens
tcagtattgaagcatt

SEQ ID NO: 2623251 - DNA, 17 bp, Homo sapiens
tcagtattgaagcattt

SEQ ID NO: 2623252 - DNA, 16 bp, Homo sapiens
tcagtattttccctgc

SEQ ID NO: 2623253 - DNA, 19 bp, Homo sapiens
tcagtcagtgcaaatgtca

SEQ ID NO: 2623254 - DNA, 14 bp, Homo sapiens
tcagtcatgcataa

SEQ ID NO: 2623255 - DNA, 20 bp, Homo sapiens
tcagtcatgcataaatatgc

SEQ ID NO: 2623256 - DNA, 17 bp, Homo sapiens
tcagtcccatcagagag

SEQ ID NO: 2623257 - DNA, 15 bp, Homo sapiens
tcagtcccctcccat

SEQ ID NO: 2623258 - DNA, 13 bp, Homo sapiens
tcagtccctatgt

SEQ ID NO: 2623259 - DNA, 17 bp, Homo sapiens
tcagtccctatgtattt

SEQ ID NO: 2623260 - DNA, 15 bp, Homo sapiens
tcagtctatccacag

SEQ ID NO: 2623261 - DNA, 20 bp, Homo sapiens
tcagtctcccttctcccatg

SEQ ID NO: 2623262 - DNA, 15 bp, Homo sapiens
tcagtctctgagcag

SEQ ID NO: 2623263 - DNA, 19 bp, Homo sapiens
tcagtctggtgggaggacg

SEQ ID NO: 2623264 - DNA, 14 bp, Homo sapiens
tcagtgaggcccag

SEQ ID NO: 2623265 - DNA, 18 bp, Homo sapiens
tcagtgaggcccagggag

SEQ ID NO: 2623266 - DNA, 19 bp, Homo sapiens
tcagtgatgtaccatgaaa

SEQ ID NO: 2623267 - DNA, 14 bp, Homo sapiens
tcagtgcaaagatt

SEQ ID NO: 2623268 - DNA, 14 bp, Homo sapiens
tcagtgctgtggcc

SEQ ID NO: 2623269 - DNA, 16 bp, Homo sapiens
tcagtggaagaagcag

SEQ ID NO: 2623270 - DNA, 19 bp, Homo sapiens
tcagtggactttccacccc

SEQ ID NO: 2623271 - DNA, 12 bp, Homo sapiens
tcagtggagcca

SEQ ID NO: 2623272 - DNA, 13 bp, Homo sapiens
tcagtggcagctg

SEQ ID NO: 2623273 - DNA, 16 bp, Homo sapiens
tcagtggcagctgctt

SEQ ID NO: 2623274 - DNA, 20 bp, Homo sapiens
tcagtggcatggctccagtc

SEQ ID NO: 2623275 - DNA, 15 bp, Homo sapiens
tcagtgtaatttctt

SEQ ID NO: 2623276 - DNA, 18 bp, Homo sapiens
tcagtgtaatttctttgc

SEQ ID NO: 2623277 - DNA, 13 bp, Homo sapiens
tcagtgtcccggg

SEQ ID NO: 2623278 - DNA, 17 bp, Homo sapiens
tcagtgtcccgggcccg

SEQ ID NO: 2623279 - DNA, 13 bp, Homo sapiens
tcagtgtctcaca

SEQ ID NO: 2623280 - DNA, 15 bp, Homo sapiens
tcagtgtctcacact

SEQ ID NO: 2623281 - DNA, 21 bp, Homo sapiens
tcagtgtctcacactggcgta

SEQ ID NO: 2623282 - DNA, 15 bp, Homo sapiens
tcagtgttaaatgtg

SEQ ID NO: 2623283 - DNA, 21 bp, Homo sapiens
tcagtgttaaatgtgatgaat

SEQ ID NO: 2623284 - DNA, 14 bp, Homo sapiens
tcagttacagaaag

SEQ ID NO: 2623285 - DNA, 20 bp, Homo sapiens
tcagttcagaatcacttctg

SEQ ID NO: 2623286 - DNA, 14 bp, Homo sapiens
tcagttcccagaat

SEQ ID NO: 2623287 - DNA, 18 bp, Homo sapiens
tcagttcccagaatcaaa

SEQ ID NO: 2623288 - DNA, 19 bp, Homo sapiens
tcagttcccttggcctcag

SEQ ID NO: 2623289 - DNA, 20 bp, Homo sapiens
tcagttcccttggcctcaga

SEQ ID NO: 2623290 - DNA, 20 bp, Homo sapiens
tcagttccgatttcccaggc

SEQ ID NO: 2623291 - DNA, 20 bp, Homo sapiens
tcagttcctgcccttggcct

SEQ ID NO: 2623292 - DNA, 19 bp, Homo sapiens
tcagttctcttgattttca

SEQ ID NO: 2623293 - DNA, 14 bp, Homo sapiens
tcagttggctgact

SEQ ID NO: 2623294 - DNA, 19 bp, Homo sapiens
tcagtttgctagcagaaat

SEQ ID NO: 2623295 - DNA, 16 bp, Homo sapiens
tcagtttgtgtgtctt

SEQ ID NO: 2623296 - DNA, 13 bp, Homo sapiens
tcagttttaacta

SEQ ID NO: 2623297 - DNA, 17 bp, Homo sapiens
tcagttttatcattttc

SEQ ID NO: 2623298 - DNA, 14 bp, Homo sapiens
tcataacctagcct

SEQ ID NO: 2623299 - DNA, 15 bp, Homo sapiens
tcataagtatttcaa

SEQ ID NO: 2623300 - DNA, 12 bp, Homo sapiens
tcataatgtgaa

SEQ ID NO: 2623301 - DNA, 18 bp, Homo sapiens
tcataatgtgaagtgtta

SEQ ID NO: 2623302 - DNA, 14 bp, Homo sapiens
tcatacacttcctt

SEQ ID NO: 2623303 - DNA, 15 bp, Homo sapiens
tcataccaatgaaaa

SEQ ID NO: 2623304 - DNA, 13 bp, Homo sapiens
tcatacccacccc

SEQ ID NO: 2623305 - DNA, 20 bp, Homo sapiens
tcatacccacccccacccaa

SEQ ID NO: 2623306 - DNA, 21 bp, Homo sapiens
tcatacccacccccacccaag

SEQ ID NO: 2623307 - DNA, 15 bp, Homo sapiens
tcatacctacatgta

SEQ ID NO: 2623308 - DNA, 16 bp, Homo sapiens
tcatacctacatgtat

SEQ ID NO: 2623309 - DNA, 14 bp, Homo sapiens
tcatacgtccacca

SEQ ID NO: 2623310 - DNA, 19 bp, Homo sapiens
tcatactgtgctggagcca

SEQ ID NO: 2623311 - DNA, 20 bp, Homo sapiens
tcatactgtgctggagccac

SEQ ID NO: 2623312 - DNA, 22 bp, Homo sapiens
tcatagaaatgtaacttttgta

SEQ ID NO: 2623313 - DNA, 14 bp, Homo sapiens
tcatagcacttccc

SEQ ID NO: 2623314 - DNA, 18 bp, Homo sapiens
tcatagcagattttaatt

SEQ ID NO: 2623315 - DNA, 21 bp, Homo sapiens
tcatagcattaactaatctat

SEQ ID NO: 2623316 - DNA, 18 bp, Homo sapiens
tcatagcccagatcagct

SEQ ID NO: 2623317 - DNA, 12 bp, Homo sapiens
tcatagctaaga

SEQ ID NO: 2623318 - DNA, 18 bp, Homo sapiens
tcatagggtctcttcagg

SEQ ID NO: 2623319 - DNA, 16 bp, Homo sapiens
tcatagttattgtttc

SEQ ID NO: 2623320 - DNA, 13 bp, Homo sapiens
tcatagtttaatt

SEQ ID NO: 2623321 - DNA, 18 bp, Homo sapiens
tcatatggcccagtgtca

SEQ ID NO: 2623322 - DNA, 21 bp, Homo sapiens
tcatatgtaccatgtacatga

SEQ ID NO: 2623323 - DNA, 19 bp, Homo sapiens
tcatatgttgctcagtctc

SEQ ID NO: 2623324 - DNA, 20 bp, Homo sapiens
tcatatgttgctcagtctcc

SEQ ID NO: 2623325 - DNA, 12 bp, Homo sapiens
tcatattgaata

SEQ ID NO: 2623326 - DNA, 14 bp, Homo sapiens
tcatattgtgccaa

SEQ ID NO: 2623327 - DNA, 15 bp, Homo sapiens
tcatattgtgccaat

SEQ ID NO: 2623328 - DNA, 12 bp, Homo sapiens
tcatatttaaag

SEQ ID NO: 2623329 - DNA, 19 bp, Homo sapiens
tcatatttaaagacaggga

SEQ ID NO: 2623330 - DNA, 20 bp, Homo sapiens
tcatatttacttcttataca

SEQ ID NO: 2623331 - DNA, 15 bp, Homo sapiens
tcatattttctttca

SEQ ID NO: 2623332 - DNA, 19 bp, Homo sapiens
tcatattttgattattgta

SEQ ID NO: 2623333 - DNA, 17 bp, Homo sapiens
tcatcaatgaatgaatg

SEQ ID NO: 2623334 - DNA, 14 bp, Homo sapiens
tcatcactcccctc

SEQ ID NO: 2623335 - DNA, 15 bp, Homo sapiens
tcatcactcccctcc

SEQ ID NO: 2623336 - DNA, 22 bp, Homo sapiens
tcatcactggatgaagattctc

SEQ ID NO: 2623337 - DNA, 15 bp, Homo sapiens
tcatcacttttcagt

SEQ ID NO: 2623338 - DNA, 13 bp, Homo sapiens
tcatcaggatgaa

SEQ ID NO: 2623339 - DNA, 14 bp, Homo sapiens
tcatcaggatgaac

SEQ ID NO: 2623340 - DNA, 16 bp, Homo sapiens
tcatcagtattgaagc

SEQ ID NO: 2623341 - DNA, 21 bp, Homo sapiens
tcatcagtattgaagcatttt

SEQ ID NO: 2623342 - DNA, 15 bp, Homo sapiens
tcatcagtggagcca

SEQ ID NO: 2623343 - DNA, 13 bp, Homo sapiens
tcatcataaaata

SEQ ID NO: 2623344 - DNA, 15 bp, Homo sapiens
tcatcataaaataaa

SEQ ID NO: 2623345 - DNA, 20 bp, Homo sapiens
tcatcattgtatatatgtgt

SEQ ID NO: 2623346 - DNA, 19 bp, Homo sapiens
tcatccaatcctcactggg

SEQ ID NO: 2623347 - DNA, 14 bp, Homo sapiens
tcatccacattgtt

SEQ ID NO: 2623348 - DNA, 17 bp, Homo sapiens
tcatccacattgtttta

SEQ ID NO: 2623349 - DNA, 19 bp, Homo sapiens
tcatccacattgttttaaa

SEQ ID NO: 2623350 - DNA, 14 bp, Homo sapiens
tcatccagggctct

SEQ ID NO: 2623351 - DNA, 17 bp, Homo sapiens
tcatccatcatcatgtg

SEQ ID NO: 2623352 - DNA, 14 bp, Homo sapiens
tcatccattctatt

SEQ ID NO: 2623353 - DNA, 19 bp, Homo sapiens
tcatccattctattgttaa

SEQ ID NO: 2623354 - DNA, 13 bp, Homo sapiens
tcatcccagctgc

SEQ ID NO: 2623355 - DNA, 20 bp, Homo sapiens
tcatccccacctgtcttcaa

SEQ ID NO: 2623356 - DNA, 17 bp, Homo sapiens
tcatcccctcacttgcc

SEQ ID NO: 2623357 - DNA, 17 bp, Homo sapiens
tcatccctaatgctgca

SEQ ID NO: 2623358 - DNA, 21 bp, Homo sapiens
tcatccctatgggattcagtg

SEQ ID NO: 2623359 - DNA, 15 bp, Homo sapiens
tcatccggcagcctg

SEQ ID NO: 2623360 - DNA, 13 bp, Homo sapiens
tcatcctgcaggc

SEQ ID NO: 2623361 - DNA, 17 bp, Homo sapiens
tcatcctttccagcatg

SEQ ID NO: 2623362 - DNA, 17 bp, Homo sapiens
tccatatattagcattt

SEQ ID NO: 2623363 - DNA, 18 bp, Homo sapiens
tccatatattagcattta

SEQ ID NO: 2623364 - DNA, 17 bp, Homo sapiens
tccatatgacctcatgc

SEQ ID NO: 2623365 - DNA, 14 bp, Homo sapiens
tccatattcatgta

SEQ ID NO: 2623366 - DNA, 14 bp, Homo sapiens
tccatatttattca

SEQ ID NO: 2623367 - DNA, 14 bp, Homo sapiens
tccatcatgtcccc

SEQ ID NO: 2623368 - DNA, 16 bp, Homo sapiens
tccatcatgtccccaa

SEQ ID NO: 2623369 - DNA, 15 bp, Homo sapiens
tccatccacatggga

SEQ ID NO: 2623370 - DNA, 14 bp, Homo sapiens
tccatcccatcatc

SEQ ID NO: 2623371 - DNA, 14 bp, Homo sapiens
tccatccctacccc

SEQ ID NO: 2623372 - DNA, 18 bp, Homo sapiens
tccatccctaccccctaa

SEQ ID NO: 2623373 - DNA, 21 bp, Homo sapiens
tccatctaaatacctgccctg

SEQ ID NO: 2623374 - DNA, 16 bp, Homo sapiens
tccatctccaagaatg

SEQ ID NO: 2623375 - DNA, 20 bp, Homo sapiens
tccatctccaagaatgctga

SEQ ID NO: 2623376 - DNA, 21 bp, Homo sapiens
tccatctccaagaatgctgaa

SEQ ID NO: 2623377 - DNA, 23 bp, Homo sapiens
tccatctcgccacccctccttcc

SEQ ID NO: 2623378 - DNA, 18 bp, Homo sapiens
tccatctttcctgatggc

SEQ ID NO: 2623379 - DNA, 18 bp, Homo sapiens
tccatgaaaacgttttat

SEQ ID NO: 2623380 - DNA, 12 bp, Homo sapiens
tccatgaaaatg

SEQ ID NO: 2623381 - DNA, 18 bp, Homo sapiens
tccatgaatcgcttctct

SEQ ID NO: 2623382 - DNA, 20 bp, Homo sapiens
tccatgaatcgcttctcttt

SEQ ID NO: 2623383 - DNA, 13 bp, Homo sapiens
tccatgagcaccc

SEQ ID NO: 2623384 - DNA, 15 bp, Homo sapiens
tccatgagcacccca

SEQ ID NO: 2623385 - DNA, 17 bp, Homo sapiens
tccatgagtcccctgtt

SEQ ID NO: 2623386 - DNA, 14 bp, Homo sapiens
tccatgctgcctcc

SEQ ID NO: 2623387 - DNA, 16 bp, Homo sapiens
tccatggaatgcttga

SEQ ID NO: 2623388 - DNA, 17 bp, Homo sapiens
tccatggaatgcttgaa

SEQ ID NO: 2623389 - DNA, 18 bp, Homo sapiens
tccatggaatgcttgaaa

SEQ ID NO: 2623390 - DNA, 21 bp, Homo sapiens
tccatggaatgcttgaaaaat

SEQ ID NO: 2623391 - DNA, 22 bp, Homo sapiens
tccatggaatgcttgaaaaatg

SEQ ID NO: 2623392 - DNA, 13 bp, Homo sapiens
tccatggactttg

SEQ ID NO: 2623393 - DNA, 17 bp, Homo sapiens
tccatgggcagagccca

SEQ ID NO: 2623394 - DNA, 18 bp, Homo sapiens
tccatgggcagagcccaa

SEQ ID NO: 2623395 - DNA, 21 bp, Homo sapiens
tccatgtactgtagtttttct

SEQ ID NO: 2623396 - DNA, 16 bp, Homo sapiens
tccatgtcgcctctgc

SEQ ID NO: 2623397 - DNA, 18 bp, Homo sapiens
tccatgtcgcctctgcat

SEQ ID NO: 2623398 - DNA, 14 bp, Homo sapiens
tccatgtcggcctc

SEQ ID NO: 2623399 - DNA, 15 bp, Homo sapiens
tccatgtcggcctct

SEQ ID NO: 2623400 - DNA, 14 bp, Homo sapiens
tccatgtgccccct

SEQ ID NO: 2623401 - DNA, 20 bp, Homo sapiens
tccatgtgggctagttgggc

SEQ ID NO: 2623402 - DNA, 18 bp, Homo sapiens
tccatgtggttcttcaaa

SEQ ID NO: 2623403 - DNA, 11 bp, Homo sapiens
tccatgtgtgt

SEQ ID NO: 2623404 - DNA, 22 bp, Homo sapiens
tccattaacttagcatgtgttg

SEQ ID NO: 2623405 - DNA, 13 bp, Homo sapiens
tccattatcatgt

SEQ ID NO: 2623406 - DNA, 14 bp, Homo sapiens
tccattatcatgtg

SEQ ID NO: 2623407 - DNA, 20 bp, Homo sapiens
tccattatcatgtgtaatca

SEQ ID NO: 2623408 - DNA, 14 bp, Homo sapiens
tccattatttatat

SEQ ID NO: 2623409 - DNA, 12 bp, Homo sapiens
tccattccagaa

SEQ ID NO: 2623410 - DNA, 22 bp, Homo sapiens
tccattggtttacctgtgaaat

SEQ ID NO: 2623411 - DNA, 14 bp, Homo sapiens
tccattgtttgaaa

SEQ ID NO: 2623412 - DNA, 14 bp, Homo sapiens
tccatttagttctt

SEQ ID NO: 2623413 - DNA, 16 bp, Homo sapiens
tcccaaaggactccac

SEQ ID NO: 2623414 - DNA, 22 bp, Homo sapiens
tcccaaaggactccacccatcc

SEQ ID NO: 2623415 - DNA, 15 bp, Homo sapiens
tcccaaagtgctggg

SEQ ID NO: 2623416 - DNA, 21 bp, Homo sapiens
tcccaacaggaggacaattca

SEQ ID NO: 2623417 - DNA, 13 bp, Homo sapiens
tcccaactcaccc

SEQ ID NO: 2623418 - DNA, 18 bp, Homo sapiens
tcccaactcaccccagcc

SEQ ID NO: 2623419 - DNA, 17 bp, Homo sapiens
tcccaactcctataatt

SEQ ID NO: 2623420 - DNA, 15 bp, Homo sapiens
tcccaagctctgctc

SEQ ID NO: 2623421 - DNA, 13 bp, Homo sapiens
tcccaagctgggc

SEQ ID NO: 2623422 - DNA, 22 bp, Homo sapiens
tcccaagctgggccccagccca

SEQ ID NO: 2623423 - DNA, 22 bp, Homo sapiens
tcccaaggaaagccccagcact

SEQ ID NO: 2623424 - DNA, 20 bp, Homo sapiens
tcccaattaggaagtgtaac

SEQ ID NO: 2623425 - DNA, 14 bp, Homo sapiens
tcccacaaaggaga

SEQ ID NO: 2623426 - DNA, 18 bp, Homo sapiens
tcccacacctccacagtt

SEQ ID NO: 2623427 - DNA, 13 bp, Homo sapiens
tcccacaggcagc

SEQ ID NO: 2623428 - DNA, 15 bp, Homo sapiens
tcccaccacagcagg

SEQ ID NO: 2623429 - DNA, 17 bp, Homo sapiens
tcccaccaggctgctca

SEQ ID NO: 2623430 - DNA, 22 bp, Homo sapiens
tcccacccacatgtgacacata

SEQ ID NO: 2623431 - DNA, 12 bp, Homo sapiens
tcccacccaccg

SEQ ID NO: 2623432 - DNA, 17 bp, Homo sapiens
tcccacccccttctctg

SEQ ID NO: 2623433 - DNA, 18 bp, Homo sapiens
tcccacccgatgctgctt

SEQ ID NO: 2623434 - DNA, 20 bp, Homo sapiens
tcccacccgatgctgctttc

SEQ ID NO: 2623435 - DNA, 15 bp, Homo sapiens
tcccacctcagcctc

SEQ ID NO: 2623436 - DNA, 18 bp, Homo sapiens
tcccacctcagcctcccg

SEQ ID NO: 2623437 - DNA, 23 bp, Homo sapiens
tcccacctccccctcccccttct

SEQ ID NO: 2623438 - DNA, 16 bp, Homo sapiens
tcccaccttggctgca

SEQ ID NO: 2623439 - DNA, 17 bp, Homo sapiens
tcccaccttggctgcag

SEQ ID NO: 2623440 - DNA, 19 bp, Homo sapiens
tcccaccttggctgcaggg

SEQ ID NO: 2623441 - DNA, 18 bp, Homo sapiens
tcccacgaatttgctggg

SEQ ID NO: 2623442 - DNA, 20 bp, Homo sapiens
tcccacgaatttgctgggga

SEQ ID NO: 2623443 - DNA, 15 bp, Homo sapiens
tcccactatctgggt

SEQ ID NO: 2623444 - DNA, 13 bp, Homo sapiens
tcccactcacccc

SEQ ID NO: 2623445 - DNA, 18 bp, Homo sapiens
tcccactgcctcaggttc

SEQ ID NO: 2623446 - DNA, 21 bp, Homo sapiens
tcccacttggcatcagctggc

SEQ ID NO: 2623447 - DNA, 12 bp, Homo sapiens
tcccacttgtca

SEQ ID NO: 2623448 - DNA, 17 bp, Homo sapiens
tcccagaacacactcca

SEQ ID NO: 2623449 - DNA, 18 bp, Homo sapiens
tcccagaatcaaagcaat

SEQ ID NO: 2623450 - DNA, 19 bp, Homo sapiens
tcccagaatcaaagcaatg

SEQ ID NO: 2623451 - DNA, 18 bp, Homo sapiens
tcccagagcaggaggccc

SEQ ID NO: 2623452 - DNA, 16 bp, Homo sapiens
tcccagaggctgcccc

SEQ ID NO: 2623453 - DNA, 21 bp, Homo sapiens
tcccagagggtttccatgggg

SEQ ID NO: 2623454 - DNA, 16 bp, Homo sapiens
tcccagatacttgggg

SEQ ID NO: 2623455 - DNA, 18 bp, Homo sapiens
tcccagatacttgggggg

SEQ ID NO: 2623456 - DNA, 18 bp, Homo sapiens
tcccagcactttgggagg

SEQ ID NO: 2623457 - DNA, 21 bp, Homo sapiens
tcccagcagccctaaggatct

SEQ ID NO: 2623458 - DNA, 12 bp, Homo sapiens
tcccagccaccc

SEQ ID NO: 2623459 - DNA, 20 bp, Homo sapiens
tcccagccactcgggaggct

SEQ ID NO: 2623460 - DNA, 10 bp, Homo sapiens
tcccagcctg

SEQ ID NO: 2623461 - DNA, 13 bp, Homo sapiens
tcccagctactca

SEQ ID NO: 2623462 - DNA, 16 bp, Homo sapiens
tcccagctactcagaa

SEQ ID NO: 2623463 - DNA, 16 bp, Homo sapiens
tcccagctacttggga

SEQ ID NO: 2623464 - DNA, 17 bp, Homo sapiens
tcccagctacttgggaa

SEQ ID NO: 2623465 - DNA, 18 bp, Homo sapiens
tcccagctacttgggagg

SEQ ID NO: 2623466 - DNA, 18 bp, Homo sapiens
tcccagctgccatgtttc

SEQ ID NO: 2623467 - DNA, 21 bp, Homo sapiens
tcccagctgtgctctggacag

SEQ ID NO: 2623468 - DNA, 22 bp, Homo sapiens
tcccagctgtgctctggacagg

SEQ ID NO: 2623469 - DNA, 21 bp, Homo sapiens
tcccaggcattccccaggagg

SEQ ID NO: 2623470 - DNA, 22 bp, Homo sapiens
tcccaggcattccccaggaggc

SEQ ID NO: 2623471 - DNA, 15 bp, Homo sapiens
tcccaggccaggctc

SEQ ID NO: 2623472 - DNA, 21 bp, Homo sapiens
tcccaggccaggctccttcct

SEQ ID NO: 2623473 - DNA, 23 bp, Homo sapiens
tcccagggccagggccctgcaga

SEQ ID NO: 2623474 - DNA, 21 bp, Homo sapiens
tcccaggggcccaaggcggcc

SEQ ID NO: 2623475 - DNA, 22 bp, Homo sapiens
tcccaggggcccaaggcggccc

SEQ ID NO: 2623476 - DNA, 16 bp, Homo sapiens
tcccagggtagcccgc

SEQ ID NO: 2623477 - DNA, 18 bp, Homo sapiens
tcccagggtagcccgcct

SEQ ID NO: 2623478 - DNA, 22 bp, Homo sapiens
tcccagggtagcccgcctgcca

SEQ ID NO: 2623479 - DNA, 23 bp, Homo sapiens
tcccagggtagcccgcctgccag

SEQ ID NO: 2623480 - DNA, 22 bp, Homo sapiens
tcccagtcaccttgtggcaagc

SEQ ID NO: 2623481 - DNA, 14 bp, Homo sapiens
tcccagtcatttaa

SEQ ID NO: 2623482 - DNA, 20 bp, Homo sapiens
tcccagtccaaatgtcctcc

SEQ ID NO: 2623483 - DNA, 22 bp, Homo sapiens
tcccagtctacccagagaagcc

SEQ ID NO: 2623484 - DNA, 20 bp, Homo sapiens
tcccagtgacacttcagaga

SEQ ID NO: 2623485 - DNA, 20 bp, Homo sapiens
tcccagtggcctcaaccctc

SEQ ID NO: 2623486 - DNA, 19 bp, Homo sapiens
tcccagtggctgctgccca

SEQ ID NO: 2623487 - DNA, 21 bp, Homo sapiens
tcccagtggctgctgcccagg

SEQ ID NO: 2623488 - DNA, 15 bp, Homo sapiens
tcccagttcaggagt

SEQ ID NO: 2623489 - DNA, 22 bp, Homo sapiens
tcccataaccgctgattctcag

SEQ ID NO: 2623490 - DNA, 15 bp, Homo sapiens
tcccataagctatag

SEQ ID NO: 2623491 - DNA, 15 bp, Homo sapiens
tcccatcacccgcta

SEQ ID NO: 2623492 - DNA, 12 bp, Homo sapiens
tcccatccaggc

SEQ ID NO: 2623493 - DNA, 13 bp, Homo sapiens
tcccatccccctg

SEQ ID NO: 2623494 - DNA, 19 bp, Homo sapiens
tcccatctcacacatgagc

SEQ ID NO: 2623495 - DNA, 20 bp, Homo sapiens
tcccatctcacacatgagca

SEQ ID NO: 2623496 - DNA, 21 bp, Homo sapiens
tcccatctgtgaaaggaaaga

SEQ ID NO: 2623497 - DNA, 16 bp, Homo sapiens
tcccatgacccacccc

SEQ ID NO: 2623498 - DNA, 16 bp, Homo sapiens
tcccatgacccaggct

SEQ ID NO: 2623499 - DNA, 20 bp, Homo sapiens
tcccatgagcctcagcatcc

SEQ ID NO: 2623500 - DNA, 21 bp, Homo sapiens
tcccatggacactccagtgcc

SEQ ID NO: 2623501 - DNA, 19 bp, Homo sapiens
tcccatggagccccagccc

SEQ ID NO: 2623502 - DNA, 16 bp, Homo sapiens
tcccatgtaacagaaa

SEQ ID NO: 2623503 - DNA, 22 bp, Homo sapiens
tcccatgtatttatctctattt

SEQ ID NO: 2623504 - DNA, 10 bp, Homo sapiens
tcccatgtgg

SEQ ID NO: 2623505 - DNA, 22 bp, Homo sapiens
tcccattttgcaaaatttccag

SEQ ID NO: 2623506 - DNA, 16 bp, Homo sapiens
tcctggccctctgtgt

SEQ ID NO: 2623507 - DNA, 16 bp, Homo sapiens
tcctggcctggcttct

SEQ ID NO: 2623508 - DNA, 17 bp, Homo sapiens
tcctgggagaacctcag

SEQ ID NO: 2623509 - DNA, 17 bp, Homo sapiens
tcctgggagtgagctgg

SEQ ID NO: 2623510 - DNA, 17 bp, Homo sapiens
tcctgggatgtggctgc

SEQ ID NO: 2623511 - DNA, 22 bp, Homo sapiens
tcctgggatgtggctgcagcag

SEQ ID NO: 2623512 - DNA, 21 bp, Homo sapiens
tcctgggccctctctgctctg

SEQ ID NO: 2623513 - DNA, 23 bp, Homo sapiens
tcctgggccctctctgctctgcg

SEQ ID NO: 2623514 - DNA, 14 bp, Homo sapiens
tcctgggcgccctg

SEQ ID NO: 2623515 - DNA, 18 bp, Homo sapiens
tcctgggcgccctggaag

SEQ ID NO: 2623516 - DNA, 20 bp, Homo sapiens
tcctgggcgccctggaagcc

SEQ ID NO: 2623517 - DNA, 12 bp, Homo sapiens
tcctgggctggt

SEQ ID NO: 2623518 - DNA, 15 bp, Homo sapiens
tcctggggctccctt

SEQ ID NO: 2623519 - DNA, 21 bp, Homo sapiens
tcctgggggttctttcttcct

SEQ ID NO: 2623520 - DNA, 22 bp, Homo sapiens
tcctgggggttctttcttcctc

SEQ ID NO: 2623521 - DNA, 23 bp, Homo sapiens
tcctgggggttctttcttcctct

SEQ ID NO: 2623522 - DNA, 21 bp, Homo sapiens
tcctgggttttgtattctctg

SEQ ID NO: 2623523 - DNA, 22 bp, Homo sapiens
tcctgggttttgtattctctga

SEQ ID NO: 2623524 - DNA, 16 bp, Homo sapiens
tcctggtacccagcca

SEQ ID NO: 2623525 - DNA, 17 bp, Homo sapiens
tcctggtacccagccat

SEQ ID NO: 2623526 - DNA, 18 bp, Homo sapiens
tcctggtacccagccatc

SEQ ID NO: 2623527 - DNA, 17 bp, Homo sapiens
tcctggtcttgagatgt

SEQ ID NO: 2623528 - DNA, 20 bp, Homo sapiens
tcctggtgccaatttcaagt

SEQ ID NO: 2623529 - DNA, 23 bp, Homo sapiens
tcctggttcccgtttctccacct

SEQ ID NO: 2623530 - DNA, 22 bp, Homo sapiens
tcctgtaaaaaaaaaaaagtta

SEQ ID NO: 2623531 - DNA, 23 bp, Homo sapiens
tcctgtaacacaagccacagaag

SEQ ID NO: 2623532 - DNA, 22 bp, Homo sapiens
tcctgtacctcttgagccttga

SEQ ID NO: 2623533 - DNA, 15 bp, Homo sapiens
tcctgtagcatcttc

SEQ ID NO: 2623534 - DNA, 16 bp, Homo sapiens
tcctgtagctctccct

SEQ ID NO: 2623535 - DNA, 13 bp, Homo sapiens
tcctgtatgttgt

SEQ ID NO: 2623536 - DNA, 17 bp, Homo sapiens
tcctgtccacacccagc

SEQ ID NO: 2623537 - DNA, 19 bp, Homo sapiens
tcctgtccctcatccatag

SEQ ID NO: 2623538 - DNA, 18 bp, Homo sapiens
tcctgtcccttctcttaa

SEQ ID NO: 2623539 - DNA, 13 bp, Homo sapiens
tcctgtctgccag

SEQ ID NO: 2623540 - DNA, 14 bp, Homo sapiens
tcctgtctgccagc

SEQ ID NO: 2623541 - DNA, 21 bp, Homo sapiens
tcctgtctgccagccagcagc

SEQ ID NO: 2623542 - DNA, 22 bp, Homo sapiens
tcctgtctgccagccagcagcc

SEQ ID NO: 2623543 - DNA, 11 bp, Homo sapiens
tcctgtcttcc

SEQ ID NO: 2623544 - DNA, 21 bp, Homo sapiens
tcctgtctttaaagcctgcct

SEQ ID NO: 2623545 - DNA, 20 bp, Homo sapiens
tcctgtgcatgggtgaaggg

SEQ ID NO: 2623546 - DNA, 17 bp, Homo sapiens
tcctgtgcccacatccc

SEQ ID NO: 2623547 - DNA, 21 bp, Homo sapiens
tcctgtggcaggcagcgccaa

SEQ ID NO: 2623548 - DNA, 18 bp, Homo sapiens
tcctgtgtaatcatttct

SEQ ID NO: 2623549 - DNA, 22 bp, Homo sapiens
tcctgtgtaatcatttcttggg

SEQ ID NO: 2623550 - DNA, 18 bp, Homo sapiens
tcctgtgtgtgcgcctac

SEQ ID NO: 2623551 - DNA, 20 bp, Homo sapiens
tcctgtgttttttctgccac

SEQ ID NO: 2623552 - DNA, 22 bp, Homo sapiens
tcctgttaggtattagaaagtg

SEQ ID NO: 2623553 - DNA, 19 bp, Homo sapiens
tcctgttgcacccagccct

SEQ ID NO: 2623554 - DNA, 22 bp, Homo sapiens
tcctgtttgggcccctctccca

SEQ ID NO: 2623555 - DNA, 14 bp, Homo sapiens
tcctgtttttcaca

SEQ ID NO: 2623556 - DNA, 23 bp, Homo sapiens
tccttaaactgtgtggactgtga

SEQ ID NO: 2623557 - DNA, 21 bp, Homo sapiens
tccttacaagttagaaaacat

SEQ ID NO: 2623558 - DNA, 22 bp, Homo sapiens
tccttacaagttagaaaacata

SEQ ID NO: 2623559 - DNA, 14 bp, Homo sapiens
tccttaccagcaga

SEQ ID NO: 2623560 - DNA, 17 bp, Homo sapiens
tccttaccagcagagca

SEQ ID NO: 2623561 - DNA, 18 bp, Homo sapiens
tccttaccagcagagcac

SEQ ID NO: 2623562 - DNA, 14 bp, Homo sapiens
tccttacccatctg

SEQ ID NO: 2623563 - DNA, 18 bp, Homo sapiens
tccttacccatctgcacc

SEQ ID NO: 2623564 - DNA, 14 bp, Homo sapiens
tccttacctcttcc

SEQ ID NO: 2623565 - DNA, 17 bp, Homo sapiens
tccttacctcttccgga

SEQ ID NO: 2623566 - DNA, 15 bp, Homo sapiens
tccttacctttttat

SEQ ID NO: 2623567 - DNA, 20 bp, Homo sapiens
tccttacctttttatttgca

SEQ ID NO: 2623568 - DNA, 19 bp, Homo sapiens
tccttagagacatcaaaat

SEQ ID NO: 2623569 - DNA, 15 bp, Homo sapiens
tccttagtcttctca

SEQ ID NO: 2623570 - DNA, 18 bp, Homo sapiens
tccttagtcttctcatag

SEQ ID NO: 2623571 - DNA, 21 bp, Homo sapiens
tccttatcactgacacaaaaa

SEQ ID NO: 2623572 - DNA, 23 bp, Homo sapiens
tccttcaagaactctgggctgct

SEQ ID NO: 2623573 - DNA, 20 bp, Homo sapiens
tccttcaagttagctcagga

SEQ ID NO: 2623574 - DNA, 20 bp, Homo sapiens
tccttcacatcctgtgtttc

SEQ ID NO: 2623575 - DNA, 22 bp, Homo sapiens
tccttcacctttgtccccaccg

SEQ ID NO: 2623576 - DNA, 13 bp, Homo sapiens
tccttcagcctga

SEQ ID NO: 2623577 - DNA, 18 bp, Homo sapiens
tccttcagcttccatttc

SEQ ID NO: 2623578 - DNA, 20 bp, Homo sapiens
tccttccaacaggagctggg

SEQ ID NO: 2623579 - DNA, 12 bp, Homo sapiens
tccttccacctc

SEQ ID NO: 2623580 - DNA, 21 bp, Homo sapiens
tccttccaggcccccaccact

SEQ ID NO: 2623581 - DNA, 15 bp, Homo sapiens
tccttccatcaaata

SEQ ID NO: 2623582 - DNA, 15 bp, Homo sapiens
tccttcccttctcca

SEQ ID NO: 2623583 - DNA, 16 bp, Homo sapiens
tccttcctcacaccag

SEQ ID NO: 2623584 - DNA, 21 bp, Homo sapiens
tccttcctcacaccaggcttg

SEQ ID NO: 2623585 - DNA, 17 bp, Homo sapiens
tccttcctgtcttcctg

SEQ ID NO: 2623586 - DNA, 19 bp, Homo sapiens
tccttcctgtcttcctgca

SEQ ID NO: 2623587 - DNA, 19 bp, Homo sapiens
tccttccttgctgtcctag

SEQ ID NO: 2623588 - DNA, 12 bp, Homo sapiens
tccttctccctt

SEQ ID NO: 2623589 - DNA, 12 bp, Homo sapiens
tccttctctgtc

SEQ ID NO: 2623590 - DNA, 15 bp, Homo sapiens
tccttctgaagtgtt

SEQ ID NO: 2623591 - DNA, 17 bp, Homo sapiens
tccttctgaccacagca

SEQ ID NO: 2623592 - DNA, 22 bp, Homo sapiens
tccttgaaaacactgttctctg

SEQ ID NO: 2623593 - DNA, 22 bp, Homo sapiens
tccttgatctgtatatacaata

SEQ ID NO: 2623594 - DNA, 14 bp, Homo sapiens
tccttgcacccctc

SEQ ID NO: 2623595 - DNA, 15 bp, Homo sapiens
tccttgcacccctca

SEQ ID NO: 2623596 - DNA, 22 bp, Homo sapiens
tccttgcacccctcactctggc

SEQ ID NO: 2623597 - DNA, 17 bp, Homo sapiens
tccttgcatcaattttt

SEQ ID NO: 2623598 - DNA, 21 bp, Homo sapiens
tccttgctctccctcttctca

SEQ ID NO: 2623599 - DNA, 15 bp, Homo sapiens
tccttgctctgcacc

SEQ ID NO: 2623600 - DNA, 14 bp, Homo sapiens
tccttgctctgcag

SEQ ID NO: 2623601 - DNA, 17 bp, Homo sapiens
tccttgctgtcctaggc

SEQ ID NO: 2623602 - DNA, 22 bp, Homo sapiens
tccttgcttatgacatcacttg

SEQ ID NO: 2623603 - DNA, 16 bp, Homo sapiens
tccttggaagtttcat

SEQ ID NO: 2623604 - DNA, 20 bp, Homo sapiens
tccttgggaggccccactgg

SEQ ID NO: 2623605 - DNA, 22 bp, Homo sapiens
tccttgggaggccccactgggg

SEQ ID NO: 2623606 - DNA, 16 bp, Homo sapiens
tccttgggccctttga

SEQ ID NO: 2623607 - DNA, 14 bp, Homo sapiens
tccttggggcaggc

SEQ ID NO: 2623608 - DNA, 14 bp, Homo sapiens
tccttgtccccaca

SEQ ID NO: 2623609 - DNA, 17 bp, Homo sapiens
tccttgtccccacactc

SEQ ID NO: 2623610 - DNA, 12 bp, Homo sapiens
tccttgtgcatg

SEQ ID NO: 2623611 - DNA, 22 bp, Homo sapiens
tccttgtggtttatgtcatcat

SEQ ID NO: 2623612 - DNA, 14 bp, Homo sapiens
tccttgtgttacta

SEQ ID NO: 2623613 - DNA, 17 bp, Homo sapiens
tcctttaaatccttcca

SEQ ID NO: 2623614 - DNA, 21 bp, Homo sapiens
tcctttaattttttactattt

SEQ ID NO: 2623615 - DNA, 21 bp, Homo sapiens
tcctttatgtggaaaacagaa

SEQ ID NO: 2623616 - DNA, 21 bp, Homo sapiens
tcctttcagggaatttcagga

SEQ ID NO: 2623617 - DNA, 21 bp, Homo sapiens
tcctttctatcatttttgtac

SEQ ID NO: 2623618 - DNA, 15 bp, Homo sapiens
tcctttgcactgagg

SEQ ID NO: 2623619 - DNA, 10 bp, Homo sapiens
tcctttgttc

SEQ ID NO: 2623620 - DNA, 16 bp, Homo sapiens
tcctttgttcttacct

SEQ ID NO: 2623621 - DNA, 20 bp, Homo sapiens
tccttttaaatcttgatacc

SEQ ID NO: 2623622 - DNA, 17 bp, Homo sapiens
tccttttaattttcctg

SEQ ID NO: 2623623 - DNA, 13 bp, Homo sapiens
tccttttagccta

SEQ ID NO: 2623624 - DNA, 14 bp, Homo sapiens
tccttttagcctag

SEQ ID NO: 2623625 - DNA, 15 bp, Homo sapiens
tccttttagcctagt

SEQ ID NO: 2623626 - DNA, 15 bp, Homo sapiens
tccttttcctctctc

SEQ ID NO: 2623627 - DNA, 14 bp, Homo sapiens
tcgaaataacaatg

SEQ ID NO: 2623628 - DNA, 18 bp, Homo sapiens
tcgaaataacaatgttaa

SEQ ID NO: 2623629 - DNA, 13 bp, Homo sapiens
tcgaactggctgc

SEQ ID NO: 2623630 - DNA, 15 bp, Homo sapiens
tcgaagctcagccca

SEQ ID NO: 2623631 - DNA, 14 bp, Homo sapiens
tcgaccccaaagcc

SEQ ID NO: 2623632 - DNA, 20 bp, Homo sapiens
tcgacctgcggctgctgtgt

SEQ ID NO: 2623633 - DNA, 16 bp, Homo sapiens
tcgactcagcctcagg

SEQ ID NO: 2623634 - DNA, 16 bp, Homo sapiens
tcgactcaggatccag

SEQ ID NO: 2623635 - DNA, 21 bp, Homo sapiens
tcgactcaggatccagtccct

SEQ ID NO: 2623636 - DNA, 16 bp, Homo sapiens
tcgactgtgacctgtg

SEQ ID NO: 2623637 - DNA, 14 bp, Homo sapiens
tcgagaccagtctg

SEQ ID NO: 2623638 - DNA, 17 bp, Homo sapiens
tcgagcagtcctgcctc

SEQ ID NO: 2623639 - DNA, 22 bp, Homo sapiens
tcgagcagtcctgcctcagcct

SEQ ID NO: 2623640 - DNA, 14 bp, Homo sapiens
tcgagcatgcctgg

SEQ ID NO: 2623641 - DNA, 13 bp, Homo sapiens
tcgaggacaggga

SEQ ID NO: 2623642 - DNA, 14 bp, Homo sapiens
tcgaggacagggag

SEQ ID NO: 2623643 - DNA, 17 bp, Homo sapiens
tcgaggcggatctttgg

SEQ ID NO: 2623644 - DNA, 20 bp, Homo sapiens
tcgaggggctctcagctcag

SEQ ID NO: 2623645 - DNA, 19 bp, Homo sapiens
tcgatgaagcccaataaac

SEQ ID NO: 2623646 - DNA, 15 bp, Homo sapiens
tcgattcatattgaa

SEQ ID NO: 2623647 - DNA, 17 bp, Homo sapiens
tcgattcatattgaata

SEQ ID NO: 2623648 - DNA, 12 bp, Homo sapiens
tcgcacctacca

SEQ ID NO: 2623649 - DNA, 17 bp, Homo sapiens
tcgcatcaaaagacaat

SEQ ID NO: 2623650 - DNA, 19 bp, Homo sapiens
tctgactcatatcccctat

SEQ ID NO: 2623651 - DNA, 15 bp, Homo sapiens
tctgagaaagactat

SEQ ID NO: 2623652 - DNA, 21 bp, Homo sapiens
tctgagaaagactattcaaac

SEQ ID NO: 2623653 - DNA, 18 bp, Homo sapiens
tctgagaaggtccttaat

SEQ ID NO: 2623654 - DNA, 20 bp, Homo sapiens
tctgagaattccaaggagtt

SEQ ID NO: 2623655 - DNA, 19 bp, Homo sapiens
tctgagacaaagcaatgga

SEQ ID NO: 2623656 - DNA, 24 bp, Homo sapiens
tctgagatcaaaacggttttactg

SEQ ID NO: 2623657 - DNA, 15 bp, Homo sapiens
tctgagcaagagctg

SEQ ID NO: 2623658 - DNA, 15 bp, Homo sapiens
tctgagcacacttta

SEQ ID NO: 2623659 - DNA, 22 bp, Homo sapiens
tctgagccagttcagtacctgg

SEQ ID NO: 2623660 - DNA, 13 bp, Homo sapiens
tctgagcccgggc

SEQ ID NO: 2623661 - DNA, 17 bp, Homo sapiens
tctgagcccgggctgcc

SEQ ID NO: 2623662 - DNA, 18 bp, Homo sapiens
tctgagcccgggctgcct

SEQ ID NO: 2623663 - DNA, 20 bp, Homo sapiens
tctgagcccgggctgcctgg

SEQ ID NO: 2623664 - DNA, 17 bp, Homo sapiens
tctgagccctcaaagtg

SEQ ID NO: 2623665 - DNA, 18 bp, Homo sapiens
tctgagccctcaaagtga

SEQ ID NO: 2623666 - DNA, 15 bp, Homo sapiens
tctgagctgctctga

SEQ ID NO: 2623667 - DNA, 18 bp, Homo sapiens
tctgaggaatccagaccc

SEQ ID NO: 2623668 - DNA, 22 bp, Homo sapiens
tctgaggaatccagacccggct

SEQ ID NO: 2623669 - DNA, 20 bp, Homo sapiens
tctgaggacattccaagaca

SEQ ID NO: 2623670 - DNA, 19 bp, Homo sapiens
tctgaggctctttctgggc

SEQ ID NO: 2623671 - DNA, 21 bp, Homo sapiens
tctgaggctggatcctagcct

SEQ ID NO: 2623672 - DNA, 12 bp, Homo sapiens
tctgaggctgta

SEQ ID NO: 2623673 - DNA, 17 bp, Homo sapiens
tctgagggaggaggcca

SEQ ID NO: 2623674 - DNA, 20 bp, Homo sapiens
tctgagggaggaggccacct

SEQ ID NO: 2623675 - DNA, 15 bp, Homo sapiens
tctgagggcttcctt

SEQ ID NO: 2623676 - DNA, 21 bp, Homo sapiens
tctgaggtgcctgtcccaccc

SEQ ID NO: 2623677 - DNA, 15 bp, Homo sapiens
tctgagtttcattct

SEQ ID NO: 2623678 - DNA, 20 bp, Homo sapiens
tctgagtttcattctcctgc

SEQ ID NO: 2623679 - DNA, 16 bp, Homo sapiens
tctgatacccagagca

SEQ ID NO: 2623680 - DNA, 23 bp, Homo sapiens
tctgataggaatgtgaaagcacg

SEQ ID NO: 2623681 - DNA, 21 bp, Homo sapiens
tctgatccctctacagagctt

SEQ ID NO: 2623682 - DNA, 21 bp, Homo sapiens
tctgatctccatggcttcctc

SEQ ID NO: 2623683 - DNA, 15 bp, Homo sapiens
tctgatctgtgcttt

SEQ ID NO: 2623684 - DNA, 18 bp, Homo sapiens
tctgatctgtgctttcca

SEQ ID NO: 2623685 - DNA, 21 bp, Homo sapiens
tctgatctgtgctttccagct

SEQ ID NO: 2623686 - DNA, 20 bp, Homo sapiens
tctgattcccaagctctgct

SEQ ID NO: 2623687 - DNA, 21 bp, Homo sapiens
tctgattcccaagctctgctc

SEQ ID NO: 2623688 - DNA, 18 bp, Homo sapiens
tctgattggctcacccaa

SEQ ID NO: 2623689 - DNA, 20 bp, Homo sapiens
tctgattgtaacgttgctgt

SEQ ID NO: 2623690 - DNA, 14 bp, Homo sapiens
tctgcaactttaag

SEQ ID NO: 2623691 - DNA, 23 bp, Homo sapiens
tctgcaagggcagaacactaacc

SEQ ID NO: 2623692 - DNA, 17 bp, Homo sapiens
tctgcaaggtctttggt

SEQ ID NO: 2623693 - DNA, 13 bp, Homo sapiens
tctgcaagtcaga

SEQ ID NO: 2623694 - DNA, 14 bp, Homo sapiens
tctgcaagtcagag

SEQ ID NO: 2623695 - DNA, 15 bp, Homo sapiens
tctgcaagtcagagg

SEQ ID NO: 2623696 - DNA, 16 bp, Homo sapiens
tctgcaagtcagagga

SEQ ID NO: 2623697 - DNA, 23 bp, Homo sapiens
tctgcaagtcagaggatggccag

SEQ ID NO: 2623698 - DNA, 20 bp, Homo sapiens
tctgcaattcccctctgctg

SEQ ID NO: 2623699 - DNA, 21 bp, Homo sapiens
tctgcaattcccctctgctgc

SEQ ID NO: 2623700 - DNA, 19 bp, Homo sapiens
tctgcacaagctgcaccct

SEQ ID NO: 2623701 - DNA, 13 bp, Homo sapiens
tctgcacagatgg

SEQ ID NO: 2623702 - DNA, 15 bp, Homo sapiens
tctgcacagctggcc

SEQ ID NO: 2623703 - DNA, 12 bp, Homo sapiens
tctgcacatgtc

SEQ ID NO: 2623704 - DNA, 21 bp, Homo sapiens
tctgcacatgtcttgtacatg

SEQ ID NO: 2623705 - DNA, 17 bp, Homo sapiens
tctgcacccccctgggc

SEQ ID NO: 2623706 - DNA, 12 bp, Homo sapiens
tctgcaccctcc

SEQ ID NO: 2623707 - DNA, 17 bp, Homo sapiens
tctgcaccctccaccct

SEQ ID NO: 2623708 - DNA, 18 bp, Homo sapiens
tctgcaccctccaccctg

SEQ ID NO: 2623709 - DNA, 23 bp, Homo sapiens
tctgcaccctggggcctggacct

SEQ ID NO: 2623710 - DNA, 12 bp, Homo sapiens
tctgcactactc

SEQ ID NO: 2623711 - DNA, 14 bp, Homo sapiens
tctgcactactcct

SEQ ID NO: 2623712 - DNA, 19 bp, Homo sapiens
tctgcactactcctctgca

SEQ ID NO: 2623713 - DNA, 20 bp, Homo sapiens
tctgcactactcctctgcag

SEQ ID NO: 2623714 - DNA, 21 bp, Homo sapiens
tctgcactactcctctgcagt

SEQ ID NO: 2623715 - DNA, 14 bp, Homo sapiens
tctgcactcccctg

SEQ ID NO: 2623716 - DNA, 15 bp, Homo sapiens
tctgcactcccctgc

SEQ ID NO: 2623717 - DNA, 16 bp, Homo sapiens
tctgcactcccctgct

SEQ ID NO: 2623718 - DNA, 18 bp, Homo sapiens
tctgcactcccctgctgg

SEQ ID NO: 2623719 - DNA, 19 bp, Homo sapiens
tctgcactcccctgctggg

SEQ ID NO: 2623720 - DNA, 20 bp, Homo sapiens
tctgcactcccctgctgggt

SEQ ID NO: 2623721 - DNA, 18 bp, Homo sapiens
tctgcagcaataaagcag

SEQ ID NO: 2623722 - DNA, 13 bp, Homo sapiens
tctgcagctgacc

SEQ ID NO: 2623723 - DNA, 15 bp, Homo sapiens
tctgcagctgtttta

SEQ ID NO: 2623724 - DNA, 13 bp, Homo sapiens
tctgcaggcaggg

SEQ ID NO: 2623725 - DNA, 21 bp, Homo sapiens
tctgcaggttcttcttcctga

SEQ ID NO: 2623726 - DNA, 16 bp, Homo sapiens
tctgcagtagtctctg

SEQ ID NO: 2623727 - DNA, 21 bp, Homo sapiens
tctgcagtagtctctgtgctt

SEQ ID NO: 2623728 - DNA, 19 bp, Homo sapiens
tctgcatcagctgctgaaa

SEQ ID NO: 2623729 - DNA, 21 bp, Homo sapiens
tctgcatcagctgctgaaaca

SEQ ID NO: 2623730 - DNA, 13 bp, Homo sapiens
tctgcatctgacc

SEQ ID NO: 2623731 - DNA, 20 bp, Homo sapiens
tctgcatctgaccacgtgct

SEQ ID NO: 2623732 - DNA, 17 bp, Homo sapiens
tctgcatcttggggaca

SEQ ID NO: 2623733 - DNA, 16 bp, Homo sapiens
tctgcatgcggcccag

SEQ ID NO: 2623734 - DNA, 17 bp, Homo sapiens
tctgcattcaggatcaa

SEQ ID NO: 2623735 - DNA, 16 bp, Homo sapiens
tctgcattctagtact

SEQ ID NO: 2623736 - DNA, 21 bp, Homo sapiens
tctgcattttcaccccaccct

SEQ ID NO: 2623737 - DNA, 18 bp, Homo sapiens
tctgcattttgctattgt

SEQ ID NO: 2623738 - DNA, 22 bp, Homo sapiens
tctgcattttgctattgtaaat

SEQ ID NO: 2623739 - DNA, 19 bp, Homo sapiens
tctgccaatttttgccttc

SEQ ID NO: 2623740 - DNA, 22 bp, Homo sapiens
tctgccagaagatcccctcagg

SEQ ID NO: 2623741 - DNA, 23 bp, Homo sapiens
tctgccagaagatcccctcagga

SEQ ID NO: 2623742 - DNA, 13 bp, Homo sapiens
tctgccagccaca

SEQ ID NO: 2623743 - DNA, 15 bp, Homo sapiens
tctgccagccagcag

SEQ ID NO: 2623744 - DNA, 19 bp, Homo sapiens
tctgccagccagcagccag

SEQ ID NO: 2623745 - DNA, 13 bp, Homo sapiens
tctgccagggagc

SEQ ID NO: 2623746 - DNA, 19 bp, Homo sapiens
tctgccagggagcttgaaa

SEQ ID NO: 2623747 - DNA, 18 bp, Homo sapiens
tctgcccacattggaccc

SEQ ID NO: 2623748 - DNA, 12 bp, Homo sapiens
tctgcccactcc

SEQ ID NO: 2623749 - DNA, 13 bp, Homo sapiens
tctgcccactccc

SEQ ID NO: 2623750 - DNA, 12 bp, Homo sapiens
tctgcccagctt

SEQ ID NO: 2623751 - DNA, 22 bp, Homo sapiens
tctgcccaggggtgccccctcc

SEQ ID NO: 2623752 - DNA, 23 bp, Homo sapiens
tctgcccaggggtgccccctcct

SEQ ID NO: 2623753 - DNA, 16 bp, Homo sapiens
tctgccccagctctgg

SEQ ID NO: 2623754 - DNA, 14 bp, Homo sapiens
tctgcccctccccc

SEQ ID NO: 2623755 - DNA, 16 bp, Homo sapiens
tctgcccctcccccaa

SEQ ID NO: 2623756 - DNA, 13 bp, Homo sapiens
tctgcccctccct

SEQ ID NO: 2623757 - DNA, 22 bp, Homo sapiens
tctgcccctctccaggcgccgg

SEQ ID NO: 2623758 - DNA, 23 bp, Homo sapiens
tctgcccgggaaggtcaccagca

SEQ ID NO: 2623759 - DNA, 19 bp, Homo sapiens
tctgccctccaagaccttc

SEQ ID NO: 2623760 - DNA, 18 bp, Homo sapiens
tctgccctgccctagctc

SEQ ID NO: 2623761 - DNA, 17 bp, Homo sapiens
tctgcctcccatcaccc

SEQ ID NO: 2623762 - DNA, 21 bp, Homo sapiens
tctgcctcccatcacccgcta

SEQ ID NO: 2623763 - DNA, 15 bp, Homo sapiens
tctgcctcctcttca

SEQ ID NO: 2623764 - DNA, 22 bp, Homo sapiens
tctgcctctgacacacagctct

SEQ ID NO: 2623765 - DNA, 18 bp, Homo sapiens
tctgcctcttctgggagg

SEQ ID NO: 2623766 - DNA, 17 bp, Homo sapiens
tctgcctgcccaggccc

SEQ ID NO: 2623767 - DNA, 20 bp, Homo sapiens
tctgcctgcccaggcccctg

SEQ ID NO: 2623768 - DNA, 21 bp, Homo sapiens
tctgcctgcccaggcccctgc

SEQ ID NO: 2623769 - DNA, 12 bp, Homo sapiens
tctgcctgtccc

SEQ ID NO: 2623770 - DNA, 13 bp, Homo sapiens
tctgcctgtccct

SEQ ID NO: 2623771 - DNA, 18 bp, Homo sapiens
tctgcctgtccctctcag

SEQ ID NO: 2623772 - DNA, 21 bp, Homo sapiens
tctgcctgtccctctcaggca

SEQ ID NO: 2623773 - DNA, 21 bp, Homo sapiens
tctgcctgttataactctgca

SEQ ID NO: 2623774 - DNA, 15 bp, Homo sapiens
tctgccttagtctca

SEQ ID NO: 2623775 - DNA, 19 bp, Homo sapiens
tctgccttagtctcagttt

SEQ ID NO: 2623776 - DNA, 22 bp, Homo sapiens
tctgcctttggggacttttctt

SEQ ID NO: 2623777 - DNA, 21 bp, Homo sapiens
tctgctaacttggagccccag

SEQ ID NO: 2623778 - DNA, 22 bp, Homo sapiens
tctgctaacttggagccccagt

SEQ ID NO: 2623779 - DNA, 15 bp, Homo sapiens
tctgctcagcagcta

SEQ ID NO: 2623780 - DNA, 12 bp, Homo sapiens
tctgctcatcat

SEQ ID NO: 2623781 - DNA, 14 bp, Homo sapiens
tctgctcatcattc

SEQ ID NO: 2623782 - DNA, 20 bp, Homo sapiens
tctgctccaccacatcctcc

SEQ ID NO: 2623783 - DNA, 15 bp, Homo sapiens
tctgctccacccttg

SEQ ID NO: 2623784 - DNA, 16 bp, Homo sapiens
tctgctccacccttgg

SEQ ID NO: 2623785 - DNA, 18 bp, Homo sapiens
tctgctccacccttggcc

SEQ ID NO: 2623786 - DNA, 19 bp, Homo sapiens
tctgctccacccttggcct

SEQ ID NO: 2623787 - DNA, 21 bp, Homo sapiens
tctgctccacccttggcctgt

SEQ ID NO: 2623788 - DNA, 12 bp, Homo sapiens
tctgctcctctc

SEQ ID NO: 2623789 - DNA, 14 bp, Homo sapiens
tctgctcctctcca

SEQ ID NO: 2623790 - DNA, 21 bp, Homo sapiens
tctgctctgcgtgtcacctgt

SEQ ID NO: 2623791 - DNA, 20 bp, Homo sapiens
tctgctgacagacacaggcc

SEQ ID NO: 2623792 - DNA, 21 bp, Homo sapiens
tctgctgacagacacaggccc

SEQ ID NO: 2623793 - DNA, 19 bp, Homo sapiens
tgaaagcagggacttgaac

SEQ ID NO: 2623794 - DNA, 17 bp, Homo sapiens
tgaaagcatccatgtgt

SEQ ID NO: 2623795 - DNA, 23 bp, Homo sapiens
tgaaagccagctgccgaccagag

SEQ ID NO: 2623796 - DNA, 13 bp, Homo sapiens
tgaaagcccaagt

SEQ ID NO: 2623797 - DNA, 12 bp, Homo sapiens
tgaaaggaaaga

SEQ ID NO: 2623798 - DNA, 18 bp, Homo sapiens
tgaaagggcccagagagg

SEQ ID NO: 2623799 - DNA, 18 bp, Homo sapiens
tgaaagtccagaaactgt

SEQ ID NO: 2623800 - DNA, 21 bp, Homo sapiens
tgaaataaagaaattgcaata

SEQ ID NO: 2623801 - DNA, 15 bp, Homo sapiens
tgaaatatacacaca

SEQ ID NO: 2623802 - DNA, 17 bp, Homo sapiens
tgaaatatacacacagc

SEQ ID NO: 2623803 - DNA, 21 bp, Homo sapiens
tgaaatgaggtcagagcctgc

SEQ ID NO: 2623804 - DNA, 19 bp, Homo sapiens
tgaaatgcagagtcaatga

SEQ ID NO: 2623805 - DNA, 16 bp, Homo sapiens
tgaaatgctctccttt

SEQ ID NO: 2623806 - DNA, 22 bp, Homo sapiens
tgaaattaaccatagatgtaga

SEQ ID NO: 2623807 - DNA, 20 bp, Homo sapiens
tgaaattactacaaaatttg

SEQ ID NO: 2623808 - DNA, 23 bp, Homo sapiens
tgaaattactacaaaatttgaaa

SEQ ID NO: 2623809 - DNA, 22 bp, Homo sapiens
tgaaattacttatcatccacat

SEQ ID NO: 2623810 - DNA, 19 bp, Homo sapiens
tgaaattatgtatgtttac

SEQ ID NO: 2623811 - DNA, 21 bp, Homo sapiens
tgaaattatgtatgtttacat

SEQ ID NO: 2623812 - DNA, 23 bp, Homo sapiens
tgaaattatgtatgtttacatat

SEQ ID NO: 2623813 - DNA, 18 bp, Homo sapiens
tgaaattgtttaagtgtt

SEQ ID NO: 2623814 - DNA, 12 bp, Homo sapiens
tgaaatttcaga

SEQ ID NO: 2623815 - DNA, 14 bp, Homo sapiens
tgaaattttaacct

SEQ ID NO: 2623816 - DNA, 18 bp, Homo sapiens
tgaaattttccaatgtct

SEQ ID NO: 2623817 - DNA, 20 bp, Homo sapiens
tgaaattttccaatgtctgc

SEQ ID NO: 2623818 - DNA, 18 bp, Homo sapiens
tgaaattttctagacttt

SEQ ID NO: 2623819 - DNA, 13 bp, Homo sapiens
tgaacaaatttac

SEQ ID NO: 2623820 - DNA, 18 bp, Homo sapiens
tgaacaaatttacagaga

SEQ ID NO: 2623821 - DNA, 11 bp, Homo sapiens
tgaacaagaat

SEQ ID NO: 2623822 - DNA, 19 bp, Homo sapiens
tgaacaagttgtttcattg

SEQ ID NO: 2623823 - DNA, 22 bp, Homo sapiens
tgaacaagttgtttcattgact

SEQ ID NO: 2623824 - DNA, 16 bp, Homo sapiens
tgaacaatcaaagcac

SEQ ID NO: 2623825 - DNA, 13 bp, Homo sapiens
tgaacaattctct

SEQ ID NO: 2623826 - DNA, 18 bp, Homo sapiens
tgaacactccaattaagg

SEQ ID NO: 2623827 - DNA, 22 bp, Homo sapiens
tgaacactgggggaggggacat

SEQ ID NO: 2623828 - DNA, 14 bp, Homo sapiens
tgaacattccagag

SEQ ID NO: 2623829 - DNA, 12 bp, Homo sapiens
tgaacattgcat

SEQ ID NO: 2623830 - DNA, 22 bp, Homo sapiens
tgaacatttatcaatcagtata

SEQ ID NO: 2623831 - DNA, 22 bp, Homo sapiens
tgaaccacatcttgctctgctg

SEQ ID NO: 2623832 - DNA, 23 bp, Homo sapiens
tgaaccacatcttgctctgctga

SEQ ID NO: 2623833 - DNA, 14 bp, Homo sapiens
tgaaccacttccct

SEQ ID NO: 2623834 - DNA, 14 bp, Homo sapiens
tgaaccctgtgctg

SEQ ID NO: 2623835 - DNA, 15 bp, Homo sapiens
tgaaccctgtgctgg

SEQ ID NO: 2623836 - DNA, 15 bp, Homo sapiens
tgaacggtgagcatt

SEQ ID NO: 2623837 - DNA, 16 bp, Homo sapiens
tgaactaataaaagca

SEQ ID NO: 2623838 - DNA, 21 bp, Homo sapiens
tgaactatggacggtgctcca

SEQ ID NO: 2623839 - DNA, 23 bp, Homo sapiens
tgaactattccccagcagggtct

SEQ ID NO: 2623840 - DNA, 18 bp, Homo sapiens
tgaactcaaactgaggaa

SEQ ID NO: 2623841 - DNA, 13 bp, Homo sapiens
tgaactcagccaa

SEQ ID NO: 2623842 - DNA, 15 bp, Homo sapiens
tgaactcagccaagc

SEQ ID NO: 2623843 - DNA, 16 bp, Homo sapiens
tgaactcagccaagca

SEQ ID NO: 2623844 - DNA, 20 bp, Homo sapiens
tgaactcagccaagcacagt

SEQ ID NO: 2623845 - DNA, 21 bp, Homo sapiens
tgaactcagccaagcacagtg

SEQ ID NO: 2623846 - DNA, 22 bp, Homo sapiens
tgaactcagccaagcacagtgg

SEQ ID NO: 2623847 - DNA, 12 bp, Homo sapiens
tgaactcctggc

SEQ ID NO: 2623848 - DNA, 16 bp, Homo sapiens
tgaactcctggcctca

SEQ ID NO: 2623849 - DNA, 15 bp, Homo sapiens
tgaactcttcaatct

SEQ ID NO: 2623850 - DNA, 20 bp, Homo sapiens
tgaactctttgaatgacaaa

SEQ ID NO: 2623851 - DNA, 21 bp, Homo sapiens
tgaactgacaggcagcctgga

SEQ ID NO: 2623852 - DNA, 15 bp, Homo sapiens
tgaactgataaagat

SEQ ID NO: 2623853 - DNA, 18 bp, Homo sapiens
tgaactgatagttactgt

SEQ ID NO: 2623854 - DNA, 23 bp, Homo sapiens
tgaactgggtacttgtggacaca

SEQ ID NO: 2623855 - DNA, 13 bp, Homo sapiens
tgaactggttcat

SEQ ID NO: 2623856 - DNA, 18 bp, Homo sapiens
tgaacttaaaatgaaagt

SEQ ID NO: 2623857 - DNA, 16 bp, Homo sapiens
tgaacttattctgtag

SEQ ID NO: 2623858 - DNA, 19 bp, Homo sapiens
tgaacttcgcatcaaaaga

SEQ ID NO: 2623859 - DNA, 18 bp, Homo sapiens
tgaacttctctcagactt

SEQ ID NO: 2623860 - DNA, 22 bp, Homo sapiens
tgaacttctctcagacttactt

SEQ ID NO: 2623861 - DNA, 16 bp, Homo sapiens
tgaactttgctgagcc

SEQ ID NO: 2623862 - DNA, 13 bp, Homo sapiens
tgaactttttgta

SEQ ID NO: 2623863 - DNA, 17 bp, Homo sapiens
tgaagaaaactccttta

SEQ ID NO: 2623864 - DNA, 15 bp, Homo sapiens
tgaagaaaagtgggc

SEQ ID NO: 2623865 - DNA, 20 bp, Homo sapiens
tgaagaaagggtgtttttct

SEQ ID NO: 2623866 - DNA, 13 bp, Homo sapiens
tgaagaactgagg

SEQ ID NO: 2623867 - DNA, 11 bp, Homo sapiens
tgaagaagaga

SEQ ID NO: 2623868 - DNA, 21 bp, Homo sapiens
tgaagacaatgacttactgta

SEQ ID NO: 2623869 - DNA, 19 bp, Homo sapiens
tgaagactcattcttctgt

SEQ ID NO: 2623870 - DNA, 24 bp, Homo sapiens
tgaagagaaccgagcaaagatcaa

SEQ ID NO: 2623871 - DNA, 20 bp, Homo sapiens
tgaagagaagggcagggctg

SEQ ID NO: 2623872 - DNA, 16 bp, Homo sapiens
tgaagagatttttcat

SEQ ID NO: 2623873 - DNA, 17 bp, Homo sapiens
tgaagaggcgggccagc

SEQ ID NO: 2623874 - DNA, 20 bp, Homo sapiens
tgaagaggcgggccagccag

SEQ ID NO: 2623875 - DNA, 23 bp, Homo sapiens
tgaagaggcgggccagccaggcg

SEQ ID NO: 2623876 - DNA, 21 bp, Homo sapiens
tgaagagggagaagcatgaaa

SEQ ID NO: 2623877 - DNA, 14 bp, Homo sapiens
tgaagaggggcagc

SEQ ID NO: 2623878 - DNA, 16 bp, Homo sapiens
tgaagaggggcagccc

SEQ ID NO: 2623879 - DNA, 18 bp, Homo sapiens
tgaagaggggcagccctt

SEQ ID NO: 2623880 - DNA, 19 bp, Homo sapiens
tgaagaggggcagcccttg

SEQ ID NO: 2623881 - DNA, 15 bp, Homo sapiens
tgaagaggtgagcac

SEQ ID NO: 2623882 - DNA, 23 bp, Homo sapiens
tgaagagtcctctgaatgaacct

SEQ ID NO: 2623883 - DNA, 15 bp, Homo sapiens
tgaagatatttttcc

SEQ ID NO: 2623884 - DNA, 22 bp, Homo sapiens
tgaagatcatatacgtgaaaat

SEQ ID NO: 2623885 - DNA, 12 bp, Homo sapiens
tgaagatgaaca

SEQ ID NO: 2623886 - DNA, 17 bp, Homo sapiens
tgaagatgtagaggaga

SEQ ID NO: 2623887 - DNA, 15 bp, Homo sapiens
tgaagcaaacacatt

SEQ ID NO: 2623888 - DNA, 17 bp, Homo sapiens
tgaagcaaagcaccagc

SEQ ID NO: 2623889 - DNA, 18 bp, Homo sapiens
tgaagcaaatcagaaact

SEQ ID NO: 2623890 - DNA, 19 bp, Homo sapiens
tgaagcaggagaatcactt

SEQ ID NO: 2623891 - DNA, 14 bp, Homo sapiens
tgaagcagttgtgt

SEQ ID NO: 2623892 - DNA, 16 bp, Homo sapiens
tgaagcattttataaa

SEQ ID NO: 2623893 - DNA, 18 bp, Homo sapiens
tgaagcattttataaatc

SEQ ID NO: 2623894 - DNA, 15 bp, Homo sapiens
tgaagccaaagccaa

SEQ ID NO: 2623895 - DNA, 22 bp, Homo sapiens
tgaagccctccaaaagcactta

SEQ ID NO: 2623896 - DNA, 15 bp, Homo sapiens
tgaagccttagccag

SEQ ID NO: 2623897 - DNA, 23 bp, Homo sapiens
tgaagctcacctgttgcttacaa

SEQ ID NO: 2623898 - DNA, 23 bp, Homo sapiens
tgaagcttgtgtatccattatca

SEQ ID NO: 2623899 - DNA, 14 bp, Homo sapiens
tgaagctttatacg

SEQ ID NO: 2623900 - DNA, 19 bp, Homo sapiens
tgaaggaacattccttagt

SEQ ID NO: 2623901 - DNA, 19 bp, Homo sapiens
tgaaggacattgcggacag

SEQ ID NO: 2623902 - DNA, 20 bp, Homo sapiens
tgaaggagagcccttcattt

SEQ ID NO: 2623903 - DNA, 11 bp, Homo sapiens
tgaaggagccc

SEQ ID NO: 2623904 - DNA, 17 bp, Homo sapiens
tgaaggaggtgagggat

SEQ ID NO: 2623905 - DNA, 14 bp, Homo sapiens
tgaaggcaatgcca

SEQ ID NO: 2623906 - DNA, 15 bp, Homo sapiens
tgaaggccccgccca

SEQ ID NO: 2623907 - DNA, 20 bp, Homo sapiens
tgaaggccccgcccaggctt

SEQ ID NO: 2623908 - DNA, 21 bp, Homo sapiens
tgaagggaaaggatattttct

SEQ ID NO: 2623909 - DNA, 14 bp, Homo sapiens
tgaagggagagcca

SEQ ID NO: 2623910 - DNA, 16 bp, Homo sapiens
tgaagggagagccagc

SEQ ID NO: 2623911 - DNA, 19 bp, Homo sapiens
tgaagggagagccagctcc

SEQ ID NO: 2623912 - DNA, 16 bp, Homo sapiens
tgaagggaggtgggga

SEQ ID NO: 2623913 - DNA, 24 bp, Homo sapiens
tgaagggattttagtcacacgtgg

SEQ ID NO: 2623914 - DNA, 22 bp, Homo sapiens
tgaaggggccaaggagggtgag

SEQ ID NO: 2623915 - DNA, 15 bp, Homo sapiens
tgaaggttaggattt

SEQ ID NO: 2623916 - DNA, 16 bp, Homo sapiens
tgaagtaatatgcaca

SEQ ID NO: 2623917 - DNA, 20 bp, Homo sapiens
tgaagtaatatgcacacatt

SEQ ID NO: 2623918 - DNA, 22 bp, Homo sapiens
tgaagtaatatgcacacatttt

SEQ ID NO: 2623919 - DNA, 23 bp, Homo sapiens
tgaagtacccgttcacatttttg

SEQ ID NO: 2623920 - DNA, 15 bp, Homo sapiens
tgaagtagtttgtat

SEQ ID NO: 2623921 - DNA, 16 bp, Homo sapiens
tgaagtcgttgtgagg

SEQ ID NO: 2623922 - DNA, 17 bp, Homo sapiens
tgaagtcgttgtgaggg

SEQ ID NO: 2623923 - DNA, 19 bp, Homo sapiens
tgaagtctctgaagtgaaa

SEQ ID NO: 2623924 - DNA, 14 bp, Homo sapiens
tgaagtctgaaatt

SEQ ID NO: 2623925 - DNA, 12 bp, Homo sapiens
tgaagtgaaact

SEQ ID NO: 2623926 - DNA, 23 bp, Homo sapiens
tgaagtgagctgagattgcacca

SEQ ID NO: 2623927 - DNA, 22 bp, Homo sapiens
tgaagtgtgtttccttcagtgc

SEQ ID NO: 2623928 - DNA, 23 bp, Homo sapiens
tgaagtgttaatactagttgtga

SEQ ID NO: 2623929 - DNA, 17 bp, Homo sapiens
tgaagtttcactccgga

SEQ ID NO: 2623930 - DNA, 16 bp, Homo sapiens
tgaagtttccttggct

SEQ ID NO: 2623931 - DNA, 19 bp, Homo sapiens
tgaagtttccttggctggt

SEQ ID NO: 2623932 - DNA, 19 bp, Homo sapiens
tgaataaaaatatgtacaa

SEQ ID NO: 2623933 - DNA, 15 bp, Homo sapiens
tgaataaaaatgcac

SEQ ID NO: 2623934 - DNA, 13 bp, Homo sapiens
tgaataaaattat

SEQ ID NO: 2623935 - DNA, 20 bp, Homo sapiens
tgaataaaattattttggat

SEQ ID NO: 2623936 - DNA, 18 bp, Homo sapiens
tgaataaagcctgctttt

SEQ ID NO: 2623937 - DNA, 19 bp, Homo sapiens
tgaggccgctagaggcctg

SEQ ID NO: 2623938 - DNA, 23 bp, Homo sapiens
tgaggccgctagaggcctgagga

SEQ ID NO: 2623939 - DNA, 19 bp, Homo sapiens
tgaggcctcagtggacttt

SEQ ID NO: 2623940 - DNA, 14 bp, Homo sapiens
tgaggcctcttgga

SEQ ID NO: 2623941 - DNA, 18 bp, Homo sapiens
tgaggcctgccctcaggg

SEQ ID NO: 2623942 - DNA, 14 bp, Homo sapiens
tgaggcctggccag

SEQ ID NO: 2623943 - DNA, 23 bp, Homo sapiens
tgaggctagtgtggtgtttcctg

SEQ ID NO: 2623944 - DNA, 21 bp, Homo sapiens
tgaggctcaggggtgtgcctg

SEQ ID NO: 2623945 - DNA, 16 bp, Homo sapiens
tgaggctctgcccttg

SEQ ID NO: 2623946 - DNA, 13 bp, Homo sapiens
tgaggctgagact

SEQ ID NO: 2623947 - DNA, 18 bp, Homo sapiens
tgaggctgagactgcggg

SEQ ID NO: 2623948 - DNA, 13 bp, Homo sapiens
tgaggctgcagcg

SEQ ID NO: 2623949 - DNA, 11 bp, Homo sapiens
tgaggctgggc

SEQ ID NO: 2623950 - DNA, 16 bp, Homo sapiens
tgaggcttccagagag

SEQ ID NO: 2623951 - DNA, 16 bp, Homo sapiens
tgaggcttgctgagag

SEQ ID NO: 2623952 - DNA, 17 bp, Homo sapiens
tgaggcttgctgagagg

SEQ ID NO: 2623953 - DNA, 13 bp, Homo sapiens
tgagggaccagcc

SEQ ID NO: 2623954 - DNA, 18 bp, Homo sapiens
tgagggaccagccaagag

SEQ ID NO: 2623955 - DNA, 13 bp, Homo sapiens
tgagggaggaggc

SEQ ID NO: 2623956 - DNA, 14 bp, Homo sapiens
tgagggaggaggcc

SEQ ID NO: 2623957 - DNA, 20 bp, Homo sapiens
tgagggaggaggccacctct

SEQ ID NO: 2623958 - DNA, 11 bp, Homo sapiens
tgagggcagtc

SEQ ID NO: 2623959 - DNA, 14 bp, Homo sapiens
tgagggcccagagc

SEQ ID NO: 2623960 - DNA, 16 bp, Homo sapiens
tgagggcccagagcag

SEQ ID NO: 2623961 - DNA, 14 bp, Homo sapiens
tgagggcccctctg

SEQ ID NO: 2623962 - DNA, 17 bp, Homo sapiens
tgagggcccctctgccc

SEQ ID NO: 2623963 - DNA, 21 bp, Homo sapiens
tgaggggaggatcactggagc

SEQ ID NO: 2623964 - DNA, 17 bp, Homo sapiens
tgaggggcatctgcccc

SEQ ID NO: 2623965 - DNA, 14 bp, Homo sapiens
tgaggggctcctgg

SEQ ID NO: 2623966 - DNA, 23 bp, Homo sapiens
tgagggtaaccccaaacctccaa

SEQ ID NO: 2623967 - DNA, 22 bp, Homo sapiens
tgagggtcagagaggagtcaga

SEQ ID NO: 2623968 - DNA, 14 bp, Homo sapiens
tgagggtggagact

SEQ ID NO: 2623969 - DNA, 18 bp, Homo sapiens
tgagggtttcagagagcc

SEQ ID NO: 2623970 - DNA, 18 bp, Homo sapiens
tgaggtcagagcctgcag

SEQ ID NO: 2623971 - DNA, 20 bp, Homo sapiens
tgaggtccagccctggctga

SEQ ID NO: 2623972 - DNA, 23 bp, Homo sapiens
tgaggtctaggaacatacttcag

SEQ ID NO: 2623973 - DNA, 17 bp, Homo sapiens
tgaggtctcttgaggga

SEQ ID NO: 2623974 - DNA, 15 bp, Homo sapiens
tgaggtctgaaatgg

SEQ ID NO: 2623975 - DNA, 23 bp, Homo sapiens
tgaggtctgctcggccgtcttca

SEQ ID NO: 2623976 - DNA, 20 bp, Homo sapiens
tgaggtctgttctttccaaa

SEQ ID NO: 2623977 - DNA, 19 bp, Homo sapiens
tgaggtcttttgacatgtg

SEQ ID NO: 2623978 - DNA, 20 bp, Homo sapiens
tgaggtcttttgacatgtgg

SEQ ID NO: 2623979 - DNA, 21 bp, Homo sapiens
tgaggtcttttgacatgtgga

SEQ ID NO: 2623980 - DNA, 23 bp, Homo sapiens
tgaggtcttttgacatgtggaaa

SEQ ID NO: 2623981 - DNA, 16 bp, Homo sapiens
tgaggtgaaagggagc

SEQ ID NO: 2623982 - DNA, 17 bp, Homo sapiens
tgaggtgcagagtgccc

SEQ ID NO: 2623983 - DNA, 20 bp, Homo sapiens
tgaggtgcagagtgcccaga

SEQ ID NO: 2623984 - DNA, 21 bp, Homo sapiens
tgaggtgcccagctagctgca

SEQ ID NO: 2623985 - DNA, 22 bp, Homo sapiens
tgaggtgcccagctagctgcag

SEQ ID NO: 2623986 - DNA, 14 bp, Homo sapiens
tgaggtgcctgtcc

SEQ ID NO: 2623987 - DNA, 16 bp, Homo sapiens
tgaggtggcacttttt

SEQ ID NO: 2623988 - DNA, 21 bp, Homo sapiens
tgaggtgggaggatctcttga

SEQ ID NO: 2623989 - DNA, 11 bp, Homo sapiens
tgaggtgggcc

SEQ ID NO: 2623990 - DNA, 14 bp, Homo sapiens
tgaggtgggcccag

SEQ ID NO: 2623991 - DNA, 17 bp, Homo sapiens
tgaggtggtctgaatgt

SEQ ID NO: 2623992 - DNA, 20 bp, Homo sapiens
tgaggtggtctgaatgttct

SEQ ID NO: 2623993 - DNA, 18 bp, Homo sapiens
tgaggtgtcttaagcctt

SEQ ID NO: 2623994 - DNA, 15 bp, Homo sapiens
tgaggtgtgggggct

SEQ ID NO: 2623995 - DNA, 12 bp, Homo sapiens
tgaggttaggag

SEQ ID NO: 2623996 - DNA, 15 bp, Homo sapiens
tgaggttgcttacta

SEQ ID NO: 2623997 - DNA, 15 bp, Homo sapiens
tgaggtttttaagcc

SEQ ID NO: 2623998 - DNA, 17 bp, Homo sapiens
tgagtaagaaatgctgc

SEQ ID NO: 2623999 - DNA, 14 bp, Homo sapiens
tgagtaagagctgg

SEQ ID NO: 2624000 - DNA, 21 bp, Homo sapiens
tgagtaagagctggtgtctga

SEQ ID NO: 2624001 - DNA, 23 bp, Homo sapiens
tgagtaagagctggtgtctgatt

SEQ ID NO: 2624002 - DNA, 16 bp, Homo sapiens
tgagtacgttgtgcat

SEQ ID NO: 2624003 - DNA, 17 bp, Homo sapiens
tgagtacgttgtgcatt

SEQ ID NO: 2624004 - DNA, 20 bp, Homo sapiens
tgagtacgttgtgcatttgg

SEQ ID NO: 2624005 - DNA, 13 bp, Homo sapiens
tgagtcaatgtgc

SEQ ID NO: 2624006 - DNA, 16 bp, Homo sapiens
tgagtcaccaagccca

SEQ ID NO: 2624007 - DNA, 13 bp, Homo sapiens
tgagtcccagtgg

SEQ ID NO: 2624008 - DNA, 15 bp, Homo sapiens
tgagtcccagtggga

SEQ ID NO: 2624009 - DNA, 18 bp, Homo sapiens
tgagtccttgaaaatatt

SEQ ID NO: 2624010 - DNA, 18 bp, Homo sapiens
tgagtcgaggacagggag

SEQ ID NO: 2624011 - DNA, 17 bp, Homo sapiens
tgagtcgtacagaaagc

SEQ ID NO: 2624012 - DNA, 15 bp, Homo sapiens
tgagtctcttcagaa

SEQ ID NO: 2624013 - DNA, 15 bp, Homo sapiens
tgagtctgaaggctg

SEQ ID NO: 2624014 - DNA, 17 bp, Homo sapiens
tgagtctgaaggctggg

SEQ ID NO: 2624015 - DNA, 18 bp, Homo sapiens
tgagtctgaaggctgggt

SEQ ID NO: 2624016 - DNA, 16 bp, Homo sapiens
tgagtcttggcggcag

SEQ ID NO: 2624017 - DNA, 17 bp, Homo sapiens
tgagtcttggcggcagc

SEQ ID NO: 2624018 - DNA, 18 bp, Homo sapiens
tgagtcttggcggcagca

SEQ ID NO: 2624019 - DNA, 21 bp, Homo sapiens
tgagtcttggcggcagcagcc

SEQ ID NO: 2624020 - DNA, 22 bp, Homo sapiens
tgagtgagggtttctgagctgc

SEQ ID NO: 2624021 - DNA, 20 bp, Homo sapiens
tgagtgatcctccaacttca

SEQ ID NO: 2624022 - DNA, 19 bp, Homo sapiens
tgagtgctctgatccctct

SEQ ID NO: 2624023 - DNA, 21 bp, Homo sapiens
tgagtgggggatcacagcctc

SEQ ID NO: 2624024 - DNA, 22 bp, Homo sapiens
tgagtggggttatctctgtgtt

SEQ ID NO: 2624025 - DNA, 21 bp, Homo sapiens
tgagtgggtgaataatacagt

SEQ ID NO: 2624026 - DNA, 14 bp, Homo sapiens
tgagtgtaagtgtg

SEQ ID NO: 2624027 - DNA, 17 bp, Homo sapiens
tgagtgtggctcccctc

SEQ ID NO: 2624028 - DNA, 14 bp, Homo sapiens
tgagttattttaat

SEQ ID NO: 2624029 - DNA, 15 bp, Homo sapiens
tgagttcaggtagct

SEQ ID NO: 2624030 - DNA, 18 bp, Homo sapiens
tgagttcataaatttatg

SEQ ID NO: 2624031 - DNA, 17 bp, Homo sapiens
tgagttcataccctgtt

SEQ ID NO: 2624032 - DNA, 18 bp, Homo sapiens
tgagttcataccctgtta

SEQ ID NO: 2624033 - DNA, 16 bp, Homo sapiens
tgagttctcagggctc

SEQ ID NO: 2624034 - DNA, 22 bp, Homo sapiens
tgagttctcagggctcctgcct

SEQ ID NO: 2624035 - DNA, 19 bp, Homo sapiens
tgagttgattcagctctgc

SEQ ID NO: 2624036 - DNA, 14 bp, Homo sapiens
tgagttggctggga

SEQ ID NO: 2624037 - DNA, 19 bp, Homo sapiens
tgagtttagtaaggctgtg

SEQ ID NO: 2624038 - DNA, 17 bp, Homo sapiens
tgagtttatatctctca

SEQ ID NO: 2624039 - DNA, 14 bp, Homo sapiens
tgagtttcatagct

SEQ ID NO: 2624040 - DNA, 13 bp, Homo sapiens
tgagtttgcttat

SEQ ID NO: 2624041 - DNA, 13 bp, Homo sapiens
tgagtttttgata

SEQ ID NO: 2624042 - DNA, 19 bp, Homo sapiens
tgagtttttgatagcttta

SEQ ID NO: 2624043 - DNA, 14 bp, Homo sapiens
tgataaacatttaa

SEQ ID NO: 2624044 - DNA, 18 bp, Homo sapiens
tgataagagaatcaacat

SEQ ID NO: 2624045 - DNA, 21 bp, Homo sapiens
tgataagagggcacacactgt

SEQ ID NO: 2624046 - DNA, 24 bp, Homo sapiens
tgataagcagtcatcctcagatca

SEQ ID NO: 2624047 - DNA, 19 bp, Homo sapiens
tgataatattgtggtgcca

SEQ ID NO: 2624048 - DNA, 14 bp, Homo sapiens
tgataatgttaaat

SEQ ID NO: 2624049 - DNA, 16 bp, Homo sapiens
tgataatgttaaattt

SEQ ID NO: 2624050 - DNA, 14 bp, Homo sapiens
tgataattgcattc

SEQ ID NO: 2624051 - DNA, 16 bp, Homo sapiens
tgatacaagattagaa

SEQ ID NO: 2624052 - DNA, 23 bp, Homo sapiens
tgatacactatgaagatgtttca

SEQ ID NO: 2624053 - DNA, 19 bp, Homo sapiens
tgatacccccctctgtctt

SEQ ID NO: 2624054 - DNA, 15 bp, Homo sapiens
tgatacttttaagag

SEQ ID NO: 2624055 - DNA, 23 bp, Homo sapiens
tgatagcaagtgaatttttctct

SEQ ID NO: 2624056 - DNA, 17 bp, Homo sapiens
tgatagcacagaccctg

SEQ ID NO: 2624057 - DNA, 23 bp, Homo sapiens
tgatagcacagaccctgccctgt

SEQ ID NO: 2624058 - DNA, 13 bp, Homo sapiens
tgatagctttatt

SEQ ID NO: 2624059 - DNA, 14 bp, Homo sapiens
tgatataaataaaa

SEQ ID NO: 2624060 - DNA, 22 bp, Homo sapiens
tgatatagaacagtgcttgcca

SEQ ID NO: 2624061 - DNA, 21 bp, Homo sapiens
tgatatcatgcccctgtactc

SEQ ID NO: 2624062 - DNA, 17 bp, Homo sapiens
tgatatggagccctgta

SEQ ID NO: 2624063 - DNA, 16 bp, Homo sapiens
tgatatggcagaagac

SEQ ID NO: 2624064 - DNA, 17 bp, Homo sapiens
tgatatggcagaagaca

SEQ ID NO: 2624065 - DNA, 21 bp, Homo sapiens
tgatatgtaaacataattctt

SEQ ID NO: 2624066 - DNA, 16 bp, Homo sapiens
tgatattaaaggagtt

SEQ ID NO: 2624067 - DNA, 23 bp, Homo sapiens
tgatattaaaggagttaagagta

SEQ ID NO: 2624068 - DNA, 16 bp, Homo sapiens
tgatattccatgaatg

SEQ ID NO: 2624069 - DNA, 19 bp, Homo sapiens
tgatattccatgaatgtat

SEQ ID NO: 2624070 - DNA, 21 bp, Homo sapiens
tgatattccccccacttaaga

SEQ ID NO: 2624071 - DNA, 17 bp, Homo sapiens
tgatattttctgtgcct

SEQ ID NO: 2624072 - DNA, 18 bp, Homo sapiens
tgatcaaagccacactct

SEQ ID NO: 2624073 - DNA, 15 bp, Homo sapiens
tgatcaaattcattt

SEQ ID NO: 2624074 - DNA, 17 bp, Homo sapiens
tgatcaaattcattttt

SEQ ID NO: 2624075 - DNA, 23 bp, Homo sapiens
tgatcaaattcatttttttcact

SEQ ID NO: 2624076 - DNA, 20 bp, Homo sapiens
tgatcaagggaatgtaactg

SEQ ID NO: 2624077 - DNA, 15 bp, Homo sapiens
tgatcaattaaatgt

SEQ ID NO: 2624078 - DNA, 17 bp, Homo sapiens
tgatcaattaaatgtag

SEQ ID NO: 2624079 - DNA, 12 bp, Homo sapiens
tgatcacactct

SEQ ID NO: 2624080 - DNA, 15 bp, Homo sapiens
tgatcacactctggg

SEQ ID NO: 2624081 - DNA, 16 bp, Homo sapiens
tgcccgtcttcagcct

SEQ ID NO: 2624082 - DNA, 18 bp, Homo sapiens
tgcccgtcttcagcctag

SEQ ID NO: 2624083 - DNA, 19 bp, Homo sapiens
tgcccgtcttcagcctagc

SEQ ID NO: 2624084 - DNA, 19 bp, Homo sapiens
tgccctaaagtgtattttt

SEQ ID NO: 2624085 - DNA, 17 bp, Homo sapiens
tgccctcatggcccctc

SEQ ID NO: 2624086 - DNA, 19 bp, Homo sapiens
tgccctcatggcccctctg

SEQ ID NO: 2624087 - DNA, 19 bp, Homo sapiens
tgccctccaagaccttctc

SEQ ID NO: 2624088 - DNA, 22 bp, Homo sapiens
tgccctccaagaccttctcctt

SEQ ID NO: 2624089 - DNA, 21 bp, Homo sapiens
tgccctccacagccgcagcct

SEQ ID NO: 2624090 - DNA, 20 bp, Homo sapiens
tgccctccatcccgacatgg

SEQ ID NO: 2624091 - DNA, 16 bp, Homo sapiens
tgccctccccagagca

SEQ ID NO: 2624092 - DNA, 20 bp, Homo sapiens
tgccctccccagagcactgg

SEQ ID NO: 2624093 - DNA, 19 bp, Homo sapiens
tgccctccttgtccaccca

SEQ ID NO: 2624094 - DNA, 15 bp, Homo sapiens
tgccctcgctgcttc

SEQ ID NO: 2624095 - DNA, 15 bp, Homo sapiens
tgccctcgtggccag

SEQ ID NO: 2624096 - DNA, 17 bp, Homo sapiens
tgccctcgtggccagcc

SEQ ID NO: 2624097 - DNA, 19 bp, Homo sapiens
tgccctcgtggccagcccg

SEQ ID NO: 2624098 - DNA, 21 bp, Homo sapiens
tgccctcgtggccagcccggc

SEQ ID NO: 2624099 - DNA, 15 bp, Homo sapiens
tgccctgacctccca

SEQ ID NO: 2624100 - DNA, 17 bp, Homo sapiens
tgccctgacctcccagc

SEQ ID NO: 2624101 - DNA, 20 bp, Homo sapiens
tgccctgacctcccagccct

SEQ ID NO: 2624102 - DNA, 22 bp, Homo sapiens
tgccctgacctcccagccctat

SEQ ID NO: 2624103 - DNA, 16 bp, Homo sapiens
tgccctgcccacctgg

SEQ ID NO: 2624104 - DNA, 20 bp, Homo sapiens
tgccctgcccacctggcctc

SEQ ID NO: 2624105 - DNA, 21 bp, Homo sapiens
tgccctgcccacctggcctct

SEQ ID NO: 2624106 - DNA, 11 bp, Homo sapiens
tgccctgcccc

SEQ ID NO: 2624107 - DNA, 16 bp, Homo sapiens
tgccctgccctagctc

SEQ ID NO: 2624108 - DNA, 23 bp, Homo sapiens
tgccctgctgccgcctcccagcc

SEQ ID NO: 2624109 - DNA, 12 bp, Homo sapiens
tgccctggccct

SEQ ID NO: 2624110 - DNA, 14 bp, Homo sapiens
tgccctggccctga

SEQ ID NO: 2624111 - DNA, 16 bp, Homo sapiens
tgccctggccctgagg

SEQ ID NO: 2624112 - DNA, 17 bp, Homo sapiens
tgccctggtagggcagt

SEQ ID NO: 2624113 - DNA, 13 bp, Homo sapiens
tgccctggtggag

SEQ ID NO: 2624114 - DNA, 14 bp, Homo sapiens
tgccctggtggaga

SEQ ID NO: 2624115 - DNA, 23 bp, Homo sapiens
tgccctggtggagaaagcactga

SEQ ID NO: 2624116 - DNA, 19 bp, Homo sapiens
tgccctgttaaaagatgaa

SEQ ID NO: 2624117 - DNA, 17 bp, Homo sapiens
tgccctgttctctacca

SEQ ID NO: 2624118 - DNA, 20 bp, Homo sapiens
tgcccttacacttactgttg

SEQ ID NO: 2624119 - DNA, 16 bp, Homo sapiens
tgcccttccctgtccc

SEQ ID NO: 2624120 - DNA, 20 bp, Homo sapiens
tgcccttccctgtccctcta

SEQ ID NO: 2624121 - DNA, 15 bp, Homo sapiens
tgcccttgccctgac

SEQ ID NO: 2624122 - DNA, 17 bp, Homo sapiens
tgcccttgccctgacct

SEQ ID NO: 2624123 - DNA, 19 bp, Homo sapiens
tgcccttgccctgacctcc

SEQ ID NO: 2624124 - DNA, 15 bp, Homo sapiens
tgccgacagaaggaa

SEQ ID NO: 2624125 - DNA, 15 bp, Homo sapiens
tgccgaccgaggctg

SEQ ID NO: 2624126 - DNA, 22 bp, Homo sapiens
tgccgaccgaggctggagctgg

SEQ ID NO: 2624127 - DNA, 13 bp, Homo sapiens
tgccgcctcccag

SEQ ID NO: 2624128 - DNA, 14 bp, Homo sapiens
tgccgcctcccagc

SEQ ID NO: 2624129 - DNA, 16 bp, Homo sapiens
tgccgcctcccagcct

SEQ ID NO: 2624130 - DNA, 21 bp, Homo sapiens
tgccgcgtcgccctcccaggc

SEQ ID NO: 2624131 - DNA, 16 bp, Homo sapiens
tgccggccggggctga

SEQ ID NO: 2624132 - DNA, 20 bp, Homo sapiens
tgccggctctttccttgctc

SEQ ID NO: 2624133 - DNA, 16 bp, Homo sapiens
tgccgtctacctgagg

SEQ ID NO: 2624134 - DNA, 20 bp, Homo sapiens
tgccgtgtgccctcgggcga

SEQ ID NO: 2624135 - DNA, 18 bp, Homo sapiens
tgcctaataaacatcctt

SEQ ID NO: 2624136 - DNA, 18 bp, Homo sapiens
tgcctagggcctggtcca

SEQ ID NO: 2624137 - DNA, 18 bp, Homo sapiens
tgcctcaatgtgaccagg

SEQ ID NO: 2624138 - DNA, 14 bp, Homo sapiens
tgcctcacagctgg

SEQ ID NO: 2624139 - DNA, 13 bp, Homo sapiens
tgcctcagcctcc

SEQ ID NO: 2624140 - DNA, 14 bp, Homo sapiens
tgcctcagcctccc

SEQ ID NO: 2624141 - DNA, 12 bp, Homo sapiens
tgcctccaccac

SEQ ID NO: 2624142 - DNA, 15 bp, Homo sapiens
tgcctccaccaccac

SEQ ID NO: 2624143 - DNA, 16 bp, Homo sapiens
tgcctccaccaccact

SEQ ID NO: 2624144 - DNA, 17 bp, Homo sapiens
tgcctccaccaccactg

SEQ ID NO: 2624145 - DNA, 20 bp, Homo sapiens
tgcctccaccaccactggcc

SEQ ID NO: 2624146 - DNA, 21 bp, Homo sapiens
tgcctccaccaccactggcca

SEQ ID NO: 2624147 - DNA, 18 bp, Homo sapiens
tgcctccaccccccagaa

SEQ ID NO: 2624148 - DNA, 15 bp, Homo sapiens
tgcctccaccctctg

SEQ ID NO: 2624149 - DNA, 13 bp, Homo sapiens
tgcctccaggtgt

SEQ ID NO: 2624150 - DNA, 16 bp, Homo sapiens
tgcctccccaaccctg

SEQ ID NO: 2624151 - DNA, 21 bp, Homo sapiens
tgcctccctcaccctgagccc

SEQ ID NO: 2624152 - DNA, 17 bp, Homo sapiens
tgcctccttccacctcc

SEQ ID NO: 2624153 - DNA, 21 bp, Homo sapiens
tgcctcctttgtgaggaagcc

SEQ ID NO: 2624154 - DNA, 21 bp, Homo sapiens
tgcctctcatcaactgaatga

SEQ ID NO: 2624155 - DNA, 13 bp, Homo sapiens
tgcctctctgttt

SEQ ID NO: 2624156 - DNA, 16 bp, Homo sapiens
tgcctctgacacacag

SEQ ID NO: 2624157 - DNA, 21 bp, Homo sapiens
tgcctctgacacacagctctg

SEQ ID NO: 2624158 - DNA, 14 bp, Homo sapiens
tgcctctgcctctg

SEQ ID NO: 2624159 - DNA, 17 bp, Homo sapiens
tgcctctgcctctgaca

SEQ ID NO: 2624160 - DNA, 13 bp, Homo sapiens
tgcctctgggact

SEQ ID NO: 2624161 - DNA, 16 bp, Homo sapiens
tgcctctgtttgacaa

SEQ ID NO: 2624162 - DNA, 23 bp, Homo sapiens
tgcctcttccagtcttcctgaca

SEQ ID NO: 2624163 - DNA, 22 bp, Homo sapiens
tgcctgaagtcacacagtgagt

SEQ ID NO: 2624164 - DNA, 15 bp, Homo sapiens
tgcctgaatatttgt

SEQ ID NO: 2624165 - DNA, 19 bp, Homo sapiens
tgcctgagggcccctctgc

SEQ ID NO: 2624166 - DNA, 22 bp, Homo sapiens
tgcctgagggcccctctgccca

SEQ ID NO: 2624167 - DNA, 19 bp, Homo sapiens
tgcctgagggcgaggggag

SEQ ID NO: 2624168 - DNA, 15 bp, Homo sapiens
tgcctgaggtctgta

SEQ ID NO: 2624169 - DNA, 16 bp, Homo sapiens
tgcctgagtgcctggc

SEQ ID NO: 2624170 - DNA, 18 bp, Homo sapiens
tgcctgatccagcctctc

SEQ ID NO: 2624171 - DNA, 20 bp, Homo sapiens
tgcctgattgccaagctcag

SEQ ID NO: 2624172 - DNA, 14 bp, Homo sapiens
tgcctgcagagaga

SEQ ID NO: 2624173 - DNA, 16 bp, Homo sapiens
tgcctgcagagagaag

SEQ ID NO: 2624174 - DNA, 22 bp, Homo sapiens
tgcctgcagccccgcgcctcct

SEQ ID NO: 2624175 - DNA, 13 bp, Homo sapiens
tgcctgcattctg

SEQ ID NO: 2624176 - DNA, 14 bp, Homo sapiens
tgcctgcccacccg

SEQ ID NO: 2624177 - DNA, 18 bp, Homo sapiens
tgcctgccccaaacaaat

SEQ ID NO: 2624178 - DNA, 18 bp, Homo sapiens
tgcctgcccccctcatct

SEQ ID NO: 2624179 - DNA, 22 bp, Homo sapiens
tgcctgcttttcactgctgcaa

SEQ ID NO: 2624180 - DNA, 20 bp, Homo sapiens
tgcctggatggggctgcacc

SEQ ID NO: 2624181 - DNA, 20 bp, Homo sapiens
tgcctggccaggcagatctg

SEQ ID NO: 2624182 - DNA, 19 bp, Homo sapiens
tgcctggccccctgtcctc

SEQ ID NO: 2624183 - DNA, 17 bp, Homo sapiens
tgcctggcctggcacac

SEQ ID NO: 2624184 - DNA, 11 bp, Homo sapiens
tgcctggctca

SEQ ID NO: 2624185 - DNA, 15 bp, Homo sapiens
tgcctggctcagagc

SEQ ID NO: 2624186 - DNA, 16 bp, Homo sapiens
tgcctgggaatgtatt

SEQ ID NO: 2624187 - DNA, 12 bp, Homo sapiens
tgcctgggctgt

SEQ ID NO: 2624188 - DNA, 17 bp, Homo sapiens
tgcctggtggcagctgc

SEQ ID NO: 2624189 - DNA, 18 bp, Homo sapiens
tgcctgtaatcacagcta

SEQ ID NO: 2624190 - DNA, 15 bp, Homo sapiens
tgcctgtagcagtga

SEQ ID NO: 2624191 - DNA, 19 bp, Homo sapiens
tgcctgtagttaggaaata

SEQ ID NO: 2624192 - DNA, 22 bp, Homo sapiens
tgcctgtagttaggaaataaaa

SEQ ID NO: 2624193 - DNA, 15 bp, Homo sapiens
tgcctgtccagcctg

SEQ ID NO: 2624194 - DNA, 16 bp, Homo sapiens
tgcctgtccagcctgg

SEQ ID NO: 2624195 - DNA, 19 bp, Homo sapiens
tgcctgtcccacccccacc

SEQ ID NO: 2624196 - DNA, 14 bp, Homo sapiens
tgcctgtgccaccc

SEQ ID NO: 2624197 - DNA, 21 bp, Homo sapiens
tgcctgtgtgacatcagtggc

SEQ ID NO: 2624198 - DNA, 18 bp, Homo sapiens
tgcctgttataactctgc

SEQ ID NO: 2624199 - DNA, 19 bp, Homo sapiens
tgcctgttataactctgca

SEQ ID NO: 2624200 - DNA, 16 bp, Homo sapiens
tgcctgttcagctcca

SEQ ID NO: 2624201 - DNA, 17 bp, Homo sapiens
tgcctgttcagctccag

SEQ ID NO: 2624202 - DNA, 18 bp, Homo sapiens
tgcctgttcagctccagc

SEQ ID NO: 2624203 - DNA, 12 bp, Homo sapiens
tgcctgttcagt

SEQ ID NO: 2624204 - DNA, 13 bp, Homo sapiens
tgcctgttcagtt

SEQ ID NO: 2624205 - DNA, 17 bp, Homo sapiens
tgccttaaagtcagtaa

SEQ ID NO: 2624206 - DNA, 16 bp, Homo sapiens
tgccttaactggagcc

SEQ ID NO: 2624207 - DNA, 20 bp, Homo sapiens
tgccttaccctcatgttctt

SEQ ID NO: 2624208 - DNA, 21 bp, Homo sapiens
tgccttattagagtgtctttc

SEQ ID NO: 2624209 - DNA, 23 bp, Homo sapiens
tgccttattagagtgtctttcca

SEQ ID NO: 2624210 - DNA, 19 bp, Homo sapiens
tgccttccacgctgtctcc

SEQ ID NO: 2624211 - DNA, 23 bp, Homo sapiens
tgccttccacgctgtctccagac

SEQ ID NO: 2624212 - DNA, 17 bp, Homo sapiens
tgccttccataattatg

SEQ ID NO: 2624213 - DNA, 15 bp, Homo sapiens
tgccttcccctgggc

SEQ ID NO: 2624214 - DNA, 17 bp, Homo sapiens
tgccttcctcctgggcc

SEQ ID NO: 2624215 - DNA, 19 bp, Homo sapiens
tgccttcctcctgggccct

SEQ ID NO: 2624216 - DNA, 23 bp, Homo sapiens
tgccttctccagacaaaccagaa

SEQ ID NO: 2624217 - DNA, 16 bp, Homo sapiens
tgccttcttcacccag

SEQ ID NO: 2624218 - DNA, 20 bp, Homo sapiens
tgccttcttctttttgctgt

SEQ ID NO: 2624219 - DNA, 15 bp, Homo sapiens
tgccttgaaccactt

SEQ ID NO: 2624220 - DNA, 14 bp, Homo sapiens
tgccttgaagccac

SEQ ID NO: 2624221 - DNA, 18 bp, Homo sapiens
tgccttggaagttgcatg

SEQ ID NO: 2624222 - DNA, 21 bp, Homo sapiens
tgccttggagggtcccaagct

SEQ ID NO: 2624223 - DNA, 19 bp, Homo sapiens
tgccttgggctgctcctca

SEQ ID NO: 2624224 - DNA, 18 bp, Homo sapiens
tgccttggggaatttcct

SEQ ID NO: 2624225 - DNA, 23 bp, Homo sapiens
tgctgaatacagaggcaactgca

SEQ ID NO: 2624226 - DNA, 17 bp, Homo sapiens
tgctgaatggttttcaa

SEQ ID NO: 2624227 - DNA, 18 bp, Homo sapiens
tgctgaatgttgggactg

SEQ ID NO: 2624228 - DNA, 15 bp, Homo sapiens
tgctgacagacacag

SEQ ID NO: 2624229 - DNA, 15 bp, Homo sapiens
tgctgacctccacag

SEQ ID NO: 2624230 - DNA, 16 bp, Homo sapiens
tgctgacctccacagc

SEQ ID NO: 2624231 - DNA, 16 bp, Homo sapiens
tgctgagggaccagcc

SEQ ID NO: 2624232 - DNA, 20 bp, Homo sapiens
tgctgagggaccagccaaga

SEQ ID NO: 2624233 - DNA, 14 bp, Homo sapiens
tgctgagtctgaag

SEQ ID NO: 2624234 - DNA, 21 bp, Homo sapiens
tgctgagtctgaaggctgggt

SEQ ID NO: 2624235 - DNA, 23 bp, Homo sapiens
tgctgagtctgaaggctgggttc

SEQ ID NO: 2624236 - DNA, 14 bp, Homo sapiens
tgctgatgttcagt

SEQ ID NO: 2624237 - DNA, 18 bp, Homo sapiens
tgctgatgttcagtgtaa

SEQ ID NO: 2624238 - DNA, 13 bp, Homo sapiens
tgctgcaaacctg

SEQ ID NO: 2624239 - DNA, 15 bp, Homo sapiens
tgctgcaaggccttt

SEQ ID NO: 2624240 - DNA, 18 bp, Homo sapiens
tgctgcagttgccagtca

SEQ ID NO: 2624241 - DNA, 13 bp, Homo sapiens
tgctgccatccag

SEQ ID NO: 2624242 - DNA, 14 bp, Homo sapiens
tgctgcccatgcca

SEQ ID NO: 2624243 - DNA, 21 bp, Homo sapiens
tgctgcccgtcttcagcctag

SEQ ID NO: 2624244 - DNA, 10 bp, Homo sapiens
tgctgccctg

SEQ ID NO: 2624245 - DNA, 13 bp, Homo sapiens
tgctgccctgccc

SEQ ID NO: 2624246 - DNA, 16 bp, Homo sapiens
tgctgccctgcccacc

SEQ ID NO: 2624247 - DNA, 13 bp, Homo sapiens
tgctgccctgcgg

SEQ ID NO: 2624248 - DNA, 12 bp, Homo sapiens
tgctgccctgtg

SEQ ID NO: 2624249 - DNA, 16 bp, Homo sapiens
tgctgccgcctcccag

SEQ ID NO: 2624250 - DNA, 17 bp, Homo sapiens
tgctgcctccccaaccc

SEQ ID NO: 2624251 - DNA, 15 bp, Homo sapiens
tgctgcctgcctgtc

SEQ ID NO: 2624252 - DNA, 16 bp, Homo sapiens
tgctgcctgcctgtct

SEQ ID NO: 2624253 - DNA, 16 bp, Homo sapiens
tgctgcgcccttacct

SEQ ID NO: 2624254 - DNA, 20 bp, Homo sapiens
tgctgcgcccttaccttccc

SEQ ID NO: 2624255 - DNA, 12 bp, Homo sapiens
tgctgctgctgc

SEQ ID NO: 2624256 - DNA, 16 bp, Homo sapiens
tgctgctgctgcgccc

SEQ ID NO: 2624257 - DNA, 13 bp, Homo sapiens
tgctgctgtccct

SEQ ID NO: 2624258 - DNA, 12 bp, Homo sapiens
tgctgcttgagg

SEQ ID NO: 2624259 - DNA, 18 bp, Homo sapiens
tgctgctttcccctgtgg

SEQ ID NO: 2624260 - DNA, 21 bp, Homo sapiens
tgctgctttcccctgtgggga

SEQ ID NO: 2624261 - DNA, 14 bp, Homo sapiens
tgctggagaggtta

SEQ ID NO: 2624262 - DNA, 20 bp, Homo sapiens
tgctggagccactaactaga

SEQ ID NO: 2624263 - DNA, 15 bp, Homo sapiens
tgctggataaaatga

SEQ ID NO: 2624264 - DNA, 17 bp, Homo sapiens
tgctggataaaatgagg

SEQ ID NO: 2624265 - DNA, 22 bp, Homo sapiens
tgctggatattttcaaattgta

SEQ ID NO: 2624266 - DNA, 23 bp, Homo sapiens
tgctggatcacagctgctttctg

SEQ ID NO: 2624267 - DNA, 20 bp, Homo sapiens
tgctggcccctcacctgggc

SEQ ID NO: 2624268 - DNA, 12 bp, Homo sapiens
tgctggcctgga

SEQ ID NO: 2624269 - DNA, 18 bp, Homo sapiens
tgctggcctggatctccc

SEQ ID NO: 2624270 - DNA, 13 bp, Homo sapiens
tgctggcctggcc

SEQ ID NO: 2624271 - DNA, 14 bp, Homo sapiens
tgctggcgcctctg

SEQ ID NO: 2624272 - DNA, 15 bp, Homo sapiens
tgctggcgcctctgc

SEQ ID NO: 2624273 - DNA, 21 bp, Homo sapiens
tgctggctgcccagacccctc

SEQ ID NO: 2624274 - DNA, 16 bp, Homo sapiens
tgctggctggttagag

SEQ ID NO: 2624275 - DNA, 16 bp, Homo sapiens
tgctgggactgagcca

SEQ ID NO: 2624276 - DNA, 20 bp, Homo sapiens
tgctgggattacaggtgtga

SEQ ID NO: 2624277 - DNA, 22 bp, Homo sapiens
tgctggggacggggggccccag

SEQ ID NO: 2624278 - DNA, 23 bp, Homo sapiens
tgctggggacggggggccccagt

SEQ ID NO: 2624279 - DNA, 23 bp, Homo sapiens
tgctggggcaagtccctgactct

SEQ ID NO: 2624280 - DNA, 16 bp, Homo sapiens
tgctgggtaaactgtg

SEQ ID NO: 2624281 - DNA, 14 bp, Homo sapiens
tgctgggttggtgc

SEQ ID NO: 2624282 - DNA, 21 bp, Homo sapiens
tgctgggttggtgcacagtga

SEQ ID NO: 2624283 - DNA, 19 bp, Homo sapiens
tgctggtcacagcctcctc

SEQ ID NO: 2624284 - DNA, 15 bp, Homo sapiens
tgctggtgtcctgac

SEQ ID NO: 2624285 - DNA, 22 bp, Homo sapiens
tgctggtgtcctgaccaccctc

SEQ ID NO: 2624286 - DNA, 14 bp, Homo sapiens
tgctggttgctgtg

SEQ ID NO: 2624287 - DNA, 15 bp, Homo sapiens
tgctggttgctgtgt

SEQ ID NO: 2624288 - DNA, 16 bp, Homo sapiens
tgctggttgctgtgtg

SEQ ID NO: 2624289 - DNA, 15 bp, Homo sapiens
tgctggtttttcagt

SEQ ID NO: 2624290 - DNA, 16 bp, Homo sapiens
tgctggtttttcagtt

SEQ ID NO: 2624291 - DNA, 17 bp, Homo sapiens
tgctgtaaaaactgtgg

SEQ ID NO: 2624292 - DNA, 15 bp, Homo sapiens
tgctgtagacatttg

SEQ ID NO: 2624293 - DNA, 21 bp, Homo sapiens
tgctgtccagacagcctgtat

SEQ ID NO: 2624294 - DNA, 19 bp, Homo sapiens
tgctgtctgatctgtgctt

SEQ ID NO: 2624295 - DNA, 12 bp, Homo sapiens
tgctgtgaaaaa

SEQ ID NO: 2624296 - DNA, 19 bp, Homo sapiens
tgctgtgaattagctcact

SEQ ID NO: 2624297 - DNA, 12 bp, Homo sapiens
tgctgtgggaac

SEQ ID NO: 2624298 - DNA, 21 bp, Homo sapiens
tgctgtgggtgatatggacag

SEQ ID NO: 2624299 - DNA, 15 bp, Homo sapiens
tgctgtgtatctgat

SEQ ID NO: 2624300 - DNA, 11 bp, Homo sapiens
tgctgtgtggt

SEQ ID NO: 2624301 - DNA, 19 bp, Homo sapiens
tgctgttgattgctaaatg

SEQ ID NO: 2624302 - DNA, 21 bp, Homo sapiens
tgctgttgatttctttccaga

SEQ ID NO: 2624303 - DNA, 18 bp, Homo sapiens
tgcttaaaaatcattgat

SEQ ID NO: 2624304 - DNA, 19 bp, Homo sapiens
tgcttaaaaatcattgatt

SEQ ID NO: 2624305 - DNA, 19 bp, Homo sapiens
tgcttaacttcacatattg

SEQ ID NO: 2624306 - DNA, 14 bp, Homo sapiens
tgcttacaattttt

SEQ ID NO: 2624307 - DNA, 20 bp, Homo sapiens
tgcttacacatctcagaccc

SEQ ID NO: 2624308 - DNA, 15 bp, Homo sapiens
tgcttacatttttac

SEQ ID NO: 2624309 - DNA, 18 bp, Homo sapiens
tgcttacatttttacaat

SEQ ID NO: 2624310 - DNA, 23 bp, Homo sapiens
tgcttactaagctttgccagctg

SEQ ID NO: 2624311 - DNA, 14 bp, Homo sapiens
tgcttactgatata

SEQ ID NO: 2624312 - DNA, 22 bp, Homo sapiens
tgcttactgatatattttacaa

SEQ ID NO: 2624313 - DNA, 17 bp, Homo sapiens
tgcttagacataacaaa

SEQ ID NO: 2624314 - DNA, 16 bp, Homo sapiens
tgcttattgttccaag

SEQ ID NO: 2624315 - DNA, 15 bp, Homo sapiens
tgcttattttaaaat

SEQ ID NO: 2624316 - DNA, 19 bp, Homo sapiens
tgcttcaaatccatccaga

SEQ ID NO: 2624317 - DNA, 16 bp, Homo sapiens
tgcttcaattaataaa

SEQ ID NO: 2624318 - DNA, 14 bp, Homo sapiens
tgcttcagcctccc

SEQ ID NO: 2624319 - DNA, 17 bp, Homo sapiens
tgcttcagcctgaggct

SEQ ID NO: 2624320 - DNA, 23 bp, Homo sapiens
tgcttccagtgaggctctgccct

SEQ ID NO: 2624321 - DNA, 18 bp, Homo sapiens
tgcttcccatcctaccct

SEQ ID NO: 2624322 - DNA, 23 bp, Homo sapiens
tgcttcccatcctaccctcgggc

SEQ ID NO: 2624323 - DNA, 20 bp, Homo sapiens
tgcttcccattgtggctcct

SEQ ID NO: 2624324 - DNA, 23 bp, Homo sapiens
tgcttcccattgtggctcctatc

SEQ ID NO: 2624325 - DNA, 15 bp, Homo sapiens
tgcttccctctgcct

SEQ ID NO: 2624326 - DNA, 12 bp, Homo sapiens
tgcttcctagaa

SEQ ID NO: 2624327 - DNA, 21 bp, Homo sapiens
tgcttcctagaagttactgaa

SEQ ID NO: 2624328 - DNA, 15 bp, Homo sapiens
tgcttcgggcccttc

SEQ ID NO: 2624329 - DNA, 16 bp, Homo sapiens
tgcttctctacagact

SEQ ID NO: 2624330 - DNA, 13 bp, Homo sapiens
tgcttctgggaga

SEQ ID NO: 2624331 - DNA, 17 bp, Homo sapiens
tgcttctttcattttct

SEQ ID NO: 2624332 - DNA, 16 bp, Homo sapiens
tgcttgaaaaatgtgc

SEQ ID NO: 2624333 - DNA, 22 bp, Homo sapiens
tgcttgaaaaatgtgcaaaaca

SEQ ID NO: 2624334 - DNA, 17 bp, Homo sapiens
tgcttgaacccaggaga

SEQ ID NO: 2624335 - DNA, 17 bp, Homo sapiens
tgcttgcagtagatttt

SEQ ID NO: 2624336 - DNA, 17 bp, Homo sapiens
tgcttgccacagagcgg

SEQ ID NO: 2624337 - DNA, 19 bp, Homo sapiens
tgcttgcctagggcctggt

SEQ ID NO: 2624338 - DNA, 22 bp, Homo sapiens
tgcttgcctagggcctggtcca

SEQ ID NO: 2624339 - DNA, 16 bp, Homo sapiens
tgcttggaggaaggaa

SEQ ID NO: 2624340 - DNA, 19 bp, Homo sapiens
tgcttggctgcttggcctt

SEQ ID NO: 2624341 - DNA, 15 bp, Homo sapiens
tgcttgggaaggggc

SEQ ID NO: 2624342 - DNA, 17 bp, Homo sapiens
tgcttgggtggagaagc

SEQ ID NO: 2624343 - DNA, 15 bp, Homo sapiens
tgcttgttgggattc

SEQ ID NO: 2624344 - DNA, 14 bp, Homo sapiens
tgcttgtttcctag

SEQ ID NO: 2624345 - DNA, 23 bp, Homo sapiens
tgcttgtttgctcacctggggtg

SEQ ID NO: 2624346 - DNA, 13 bp, Homo sapiens
tgctttaatatca

SEQ ID NO: 2624347 - DNA, 15 bp, Homo sapiens
tgctttaatatcatc

SEQ ID NO: 2624348 - DNA, 19 bp, Homo sapiens
tgctttaattgttaagata

SEQ ID NO: 2624349 - DNA, 14 bp, Homo sapiens
tgctttactgtcaa

SEQ ID NO: 2624350 - DNA, 13 bp, Homo sapiens
tgctttagcttga

SEQ ID NO: 2624351 - DNA, 20 bp, Homo sapiens
tgctttcagattaaaattgt

SEQ ID NO: 2624352 - DNA, 13 bp, Homo sapiens
tgctttccagctc

SEQ ID NO: 2624353 - DNA, 14 bp, Homo sapiens
tgctttccagctca

SEQ ID NO: 2624354 - DNA, 15 bp, Homo sapiens
tgctttcccctgtgg

SEQ ID NO: 2624355 - DNA, 16 bp, Homo sapiens
tgctttccctgaactg

SEQ ID NO: 2624356 - DNA, 17 bp, Homo sapiens
tgctttccgtggcactg

SEQ ID NO: 2624357 - DNA, 20 bp, Homo sapiens
tgctttccgtggcactgcat

SEQ ID NO: 2624358 - DNA, 22 bp, Homo sapiens
tgctttgaagcagttgtgtcag

SEQ ID NO: 2624359 - DNA, 22 bp, Homo sapiens
tgctttgtgatttttgtaattt

SEQ ID NO: 2624360 - DNA, 14 bp, Homo sapiens
tgctttttctaatg

SEQ ID NO: 2624361 - DNA, 22 bp, Homo sapiens
tggaaaaaatgatgttcattta

SEQ ID NO: 2624362 - DNA, 20 bp, Homo sapiens
tggaaaaaccacccccaaat

SEQ ID NO: 2624363 - DNA, 17 bp, Homo sapiens
tggaaaaatagcctgcc

SEQ ID NO: 2624364 - DNA, 20 bp, Homo sapiens
tggaaaaatagcctgcctct

SEQ ID NO: 2624365 - DNA, 22 bp, Homo sapiens
tggaaaagggtcttgggaaata

SEQ ID NO: 2624366 - DNA, 11 bp, Homo sapiens
tggaaaataaa

SEQ ID NO: 2624367 - DNA, 20 bp, Homo sapiens
tggaaacctgccctgcctga

SEQ ID NO: 2624368 - DNA, 22 bp, Homo sapiens
tggaaacctgccctgcctgagg

SEQ ID NO: 2624369 - DNA, 19 bp, Homo sapiens
tggaaactctttaacttct

SEQ ID NO: 2624370 - DNA, 23 bp, Homo sapiens
tggctctgcaatgggcactggga

SEQ ID NO: 2624371 - DNA, 15 bp, Homo sapiens
tggctcttctgccca

SEQ ID NO: 2624372 - DNA, 21 bp, Homo sapiens
tggctcttgatacccccctct

SEQ ID NO: 2624373 - DNA, 18 bp, Homo sapiens
tggctgaaccctgtgctg

SEQ ID NO: 2624374 - DNA, 20 bp, Homo sapiens
tggctgaaccctgtgctggt

SEQ ID NO: 2624375 - DNA, 14 bp, Homo sapiens
tggctgaaggactg

SEQ ID NO: 2624376 - DNA, 23 bp, Homo sapiens
tggctgcaaagggtatcaggtgc

SEQ ID NO: 2624377 - DNA, 23 bp, Homo sapiens
tggctgcagcagcggtggcctct

SEQ ID NO: 2624378 - DNA, 15 bp, Homo sapiens
tggctgcagggagtc

SEQ ID NO: 2624379 - DNA, 20 bp, Homo sapiens
tggctgcccagacccctctg

SEQ ID NO: 2624380 - DNA, 15 bp, Homo sapiens
tggctgctagcactt

SEQ ID NO: 2624381 - DNA, 14 bp, Homo sapiens
tggctgctgaaggc

SEQ ID NO: 2624382 - DNA, 16 bp, Homo sapiens
tggctggaagggagga

SEQ ID NO: 2624383 - DNA, 14 bp, Homo sapiens
tggctggctgcagt

SEQ ID NO: 2624384 - DNA, 17 bp, Homo sapiens
tggctgggaactgcaga

SEQ ID NO: 2624385 - DNA, 12 bp, Homo sapiens
tggctgggccca

SEQ ID NO: 2624386 - DNA, 16 bp, Homo sapiens
tggctgggggcaggag

SEQ ID NO: 2624387 - DNA, 20 bp, Homo sapiens
tggctgggggcctcagtgcc

SEQ ID NO: 2624388 - DNA, 12 bp, Homo sapiens
tggctgtgagga

SEQ ID NO: 2624389 - DNA, 14 bp, Homo sapiens
tggctgtgcctctg

SEQ ID NO: 2624390 - DNA, 17 bp, Homo sapiens
tggctgtgcctctgcct

SEQ ID NO: 2624391 - DNA, 22 bp, Homo sapiens
tggctgtgcctctgcctgtctc

SEQ ID NO: 2624392 - DNA, 22 bp, Homo sapiens
tggctgtgttctggtgaggcct

SEQ ID NO: 2624393 - DNA, 13 bp, Homo sapiens
tggctgttggctg

SEQ ID NO: 2624394 - DNA, 15 bp, Homo sapiens
tggctgttggctggg

SEQ ID NO: 2624395 - DNA, 16 bp, Homo sapiens
tggcttaatgcttctt

SEQ ID NO: 2624396 - DNA, 17 bp, Homo sapiens
tggcttcaaaatagaga

SEQ ID NO: 2624397 - DNA, 14 bp, Homo sapiens
tggcttcacggaag

SEQ ID NO: 2624398 - DNA, 16 bp, Homo sapiens
tggcttcatctgtcaa

SEQ ID NO: 2624399 - DNA, 20 bp, Homo sapiens
tggcttcattagagcaggcg

SEQ ID NO: 2624400 - DNA, 20 bp, Homo sapiens
tggcttccaggtatctccag

SEQ ID NO: 2624401 - DNA, 21 bp, Homo sapiens
tggcttccaggtatctccagg

SEQ ID NO: 2624402 - DNA, 22 bp, Homo sapiens
tggcttccaggtatctccagga

SEQ ID NO: 2624403 - DNA, 15 bp, Homo sapiens
tggcttcctcctgcg

SEQ ID NO: 2624404 - DNA, 13 bp, Homo sapiens
tggcttctcatac

SEQ ID NO: 2624405 - DNA, 20 bp, Homo sapiens
tggcttgaagccaagtcagc

SEQ ID NO: 2624406 - DNA, 14 bp, Homo sapiens
tggcttgtgtgttt

SEQ ID NO: 2624407 - DNA, 16 bp, Homo sapiens
tggcttgtgtgtttca

SEQ ID NO: 2624408 - DNA, 19 bp, Homo sapiens
tggcttgtgtgtttcactt

SEQ ID NO: 2624409 - DNA, 17 bp, Homo sapiens
tggctttcattattagt

SEQ ID NO: 2624410 - DNA, 15 bp, Homo sapiens
tggcttttgtgcatt

SEQ ID NO: 2624411 - DNA, 19 bp, Homo sapiens
tggcttttttcctcctgtg

SEQ ID NO: 2624412 - DNA, 16 bp, Homo sapiens
tgggaaaacactgcca

SEQ ID NO: 2624413 - DNA, 18 bp, Homo sapiens
tgggaaagcattgtaaat

SEQ ID NO: 2624414 - DNA, 15 bp, Homo sapiens
tgggaaagccacctc

SEQ ID NO: 2624415 - DNA, 16 bp, Homo sapiens
tgggaaaggggaagtt

SEQ ID NO: 2624416 - DNA, 20 bp, Homo sapiens
tgggaacccaagtccaagca

SEQ ID NO: 2624417 - DNA, 20 bp, Homo sapiens
tgggaaccccttcatcctct

SEQ ID NO: 2624418 - DNA, 15 bp, Homo sapiens
tgggaactcacctgg

SEQ ID NO: 2624419 - DNA, 16 bp, Homo sapiens
tgggaactgcagacct

SEQ ID NO: 2624420 - DNA, 17 bp, Homo sapiens
tgggaactgcagacctg

SEQ ID NO: 2624421 - DNA, 13 bp, Homo sapiens
tgggaagacatga

SEQ ID NO: 2624422 - DNA, 23 bp, Homo sapiens
tgggaagaccagctttgcagtga

SEQ ID NO: 2624423 - DNA, 18 bp, Homo sapiens
tgggaagacgaggccctc

SEQ ID NO: 2624424 - DNA, 19 bp, Homo sapiens
tgggaagacgcctgagctc

SEQ ID NO: 2624425 - DNA, 15 bp, Homo sapiens
tgggaaggccagctg

SEQ ID NO: 2624426 - DNA, 13 bp, Homo sapiens
tgggaataaatat

SEQ ID NO: 2624427 - DNA, 15 bp, Homo sapiens
tgggaataaatatgc

SEQ ID NO: 2624428 - DNA, 13 bp, Homo sapiens
tgggaatgaagct

SEQ ID NO: 2624429 - DNA, 20 bp, Homo sapiens
tgggaatgaagcttgtgtat

SEQ ID NO: 2624430 - DNA, 21 bp, Homo sapiens
tgggaatgaagcttgtgtatc

SEQ ID NO: 2624431 - DNA, 15 bp, Homo sapiens
tgggaatgagacata

SEQ ID NO: 2624432 - DNA, 22 bp, Homo sapiens
tgggaatgtattattctgcagc

SEQ ID NO: 2624433 - DNA, 13 bp, Homo sapiens
tgggacaccctgt

SEQ ID NO: 2624434 - DNA, 19 bp, Homo sapiens
tgggaccgccagatggggc

SEQ ID NO: 2624435 - DNA, 19 bp, Homo sapiens
tgggacctaggggcgccgc

SEQ ID NO: 2624436 - DNA, 14 bp, Homo sapiens
tgggactacaggca

SEQ ID NO: 2624437 - DNA, 16 bp, Homo sapiens
tgggactacaggcacc

SEQ ID NO: 2624438 - DNA, 18 bp, Homo sapiens
tgggactacaggcaccca

SEQ ID NO: 2624439 - DNA, 16 bp, Homo sapiens
tgggactgagccagtc

SEQ ID NO: 2624440 - DNA, 20 bp, Homo sapiens
tgggactgagccagtcccag

SEQ ID NO: 2624441 - DNA, 19 bp, Homo sapiens
tgggacttccttgctctcc

SEQ ID NO: 2624442 - DNA, 14 bp, Homo sapiens
tgggagaacctcag

SEQ ID NO: 2624443 - DNA, 15 bp, Homo sapiens
tgggagaacctcagg

SEQ ID NO: 2624444 - DNA, 22 bp, Homo sapiens
tgggagaacctcaggcttcctt

SEQ ID NO: 2624445 - DNA, 23 bp, Homo sapiens
tgggagaacctcaggcttccttg

SEQ ID NO: 2624446 - DNA, 19 bp, Homo sapiens
tgggagaatgtcagtatgt

SEQ ID NO: 2624447 - DNA, 20 bp, Homo sapiens
tgggagaatgtcagtatgtg

SEQ ID NO: 2624448 - DNA, 21 bp, Homo sapiens
tgggagaattcttacatgttt

SEQ ID NO: 2624449 - DNA, 23 bp, Homo sapiens
tgggagaggatttttttctgagc

SEQ ID NO: 2624450 - DNA, 17 bp, Homo sapiens
tgggagaggtgccagca

SEQ ID NO: 2624451 - DNA, 22 bp, Homo sapiens
tgggagaggtgccagcaactga

SEQ ID NO: 2624452 - DNA, 23 bp, Homo sapiens
tgggagatatatttttaagataa

SEQ ID NO: 2624453 - DNA, 21 bp, Homo sapiens
tgggagcagcggtttggggag

SEQ ID NO: 2624454 - DNA, 12 bp, Homo sapiens
tgggagccaggg

SEQ ID NO: 2624455 - DNA, 16 bp, Homo sapiens
tgggagccccagggtc

SEQ ID NO: 2624456 - DNA, 23 bp, Homo sapiens
tgggagccccagggtcttcccta

SEQ ID NO: 2624457 - DNA, 14 bp, Homo sapiens
tgggagccgggtct

SEQ ID NO: 2624458 - DNA, 23 bp, Homo sapiens
tgggagccgggtctgcctcttct

SEQ ID NO: 2624459 - DNA, 22 bp, Homo sapiens
tgggagcctgcaaactcactgc

SEQ ID NO: 2624460 - DNA, 20 bp, Homo sapiens
tgggagcgtgggaggcggga

SEQ ID NO: 2624461 - DNA, 17 bp, Homo sapiens
tgggagctcctctcctg

SEQ ID NO: 2624462 - DNA, 20 bp, Homo sapiens
tgggagctcctctcctggag

SEQ ID NO: 2624463 - DNA, 22 bp, Homo sapiens
tgggagctcctctcctggagga

SEQ ID NO: 2624464 - DNA, 12 bp, Homo sapiens
tgggagctgcct

SEQ ID NO: 2624465 - DNA, 21 bp, Homo sapiens
tgggagctgcctgttcagctc

SEQ ID NO: 2624466 - DNA, 18 bp, Homo sapiens
tgggagctggttagaaat

SEQ ID NO: 2624467 - DNA, 20 bp, Homo sapiens
tgggagctggttagaaatgc

SEQ ID NO: 2624468 - DNA, 15 bp, Homo sapiens
tgggaggaaatttga

SEQ ID NO: 2624469 - DNA, 16 bp, Homo sapiens
tgggaggatctcttga

SEQ ID NO: 2624470 - DNA, 20 bp, Homo sapiens
tgggaggatctcttgagcct

SEQ ID NO: 2624471 - DNA, 22 bp, Homo sapiens
tgggaggatctcttgagcctgg

SEQ ID NO: 2624472 - DNA, 20 bp, Homo sapiens
tgggaggattctatgaggca

SEQ ID NO: 2624473 - DNA, 18 bp, Homo sapiens
tgggaggcatggccctgg

SEQ ID NO: 2624474 - DNA, 14 bp, Homo sapiens
tgggaggccaagga

SEQ ID NO: 2624475 - DNA, 20 bp, Homo sapiens
tgggaggccccactggggaa

SEQ ID NO: 2624476 - DNA, 17 bp, Homo sapiens
tgggaggcgggagtgga

SEQ ID NO: 2624477 - DNA, 20 bp, Homo sapiens
tgggaggctcacccccttct

SEQ ID NO: 2624478 - DNA, 11 bp, Homo sapiens
tgggaggctga

SEQ ID NO: 2624479 - DNA, 14 bp, Homo sapiens
tgggaggctgaggc

SEQ ID NO: 2624480 - DNA, 14 bp, Homo sapiens
tgggagggcagcag

SEQ ID NO: 2624481 - DNA, 17 bp, Homo sapiens
tgggagggcagcagggc

SEQ ID NO: 2624482 - DNA, 16 bp, Homo sapiens
tgggaggggcaggctg

SEQ ID NO: 2624483 - DNA, 17 bp, Homo sapiens
tgggaggtcaaggctgc

SEQ ID NO: 2624484 - DNA, 20 bp, Homo sapiens
tgggagtccccttttctttt

SEQ ID NO: 2624485 - DNA, 14 bp, Homo sapiens
tgggagtgggccca

SEQ ID NO: 2624486 - DNA, 23 bp, Homo sapiens
tgggataaagatgcaaggaccag

SEQ ID NO: 2624487 - DNA, 23 bp, Homo sapiens
tgggatctgcccctccctgcttc

SEQ ID NO: 2624488 - DNA, 19 bp, Homo sapiens
tgggatgcttgcctagggc

SEQ ID NO: 2624489 - DNA, 16 bp, Homo sapiens
tgggatggtggagggc

SEQ ID NO: 2624490 - DNA, 18 bp, Homo sapiens
tgggatggtggagggcca

SEQ ID NO: 2624491 - DNA, 23 bp, Homo sapiens
tgggatgtggctgcagcagcggt

SEQ ID NO: 2624492 - DNA, 16 bp, Homo sapiens
tgggattcctgaccca

SEQ ID NO: 2624493 - DNA, 20 bp, Homo sapiens
tgggattcctgacccaggcc

SEQ ID NO: 2624494 - DNA, 23 bp, Homo sapiens
tgggattgacagaagcttctgcc

SEQ ID NO: 2624495 - DNA, 19 bp, Homo sapiens
tgggattgagtctgtgcca

SEQ ID NO: 2624496 - DNA, 21 bp, Homo sapiens
tgggattgggggctggtgcca

SEQ ID NO: 2624497 - DNA, 15 bp, Homo sapiens
tgggcaaaaaactcg

SEQ ID NO: 2624498 - DNA, 16 bp, Homo sapiens
tgggcaaaaaactcga

SEQ ID NO: 2624499 - DNA, 22 bp, Homo sapiens
tgggcaaaactgaattataaga

SEQ ID NO: 2624500 - DNA, 16 bp, Homo sapiens
tgggcaacagagcaag

SEQ ID NO: 2624501 - DNA, 20 bp, Homo sapiens
tgggcacccaccctgggacc

SEQ ID NO: 2624502 - DNA, 21 bp, Homo sapiens
tgggcacccagcctctaggga

SEQ ID NO: 2624503 - DNA, 15 bp, Homo sapiens
tgggcacctggggag

SEQ ID NO: 2624504 - DNA, 17 bp, Homo sapiens
tgggcacctggggagtg

SEQ ID NO: 2624505 - DNA, 19 bp, Homo sapiens
tgggcagaagggagaagga

SEQ ID NO: 2624506 - DNA, 23 bp, Homo sapiens
tgggcagagcagagaccatccct

SEQ ID NO: 2624507 - DNA, 16 bp, Homo sapiens
tgggcagatctacccc

SEQ ID NO: 2624508 - DNA, 15 bp, Homo sapiens
tgggcagattttcag

SEQ ID NO: 2624509 - DNA, 17 bp, Homo sapiens
tgggcagattttcagca

SEQ ID NO: 2624510 - DNA, 16 bp, Homo sapiens
tgggcagcatagcaag

SEQ ID NO: 2624511 - DNA, 15 bp, Homo sapiens
tgggcagccaggctg

SEQ ID NO: 2624512 - DNA, 10 bp, Homo sapiens
tgggcagctc

SEQ ID NO: 2624513 - DNA, 19 bp, Homo sapiens
tgggcagctcatctctgtc

SEQ ID NO: 2624514 - DNA, 20 bp, Homo sapiens
tgtatcccccccctgtatag

SEQ ID NO: 2624515 - DNA, 21 bp, Homo sapiens
tgtatcccccccctgtatagt

SEQ ID NO: 2624516 - DNA, 13 bp, Homo sapiens
tgtatcctggggc

SEQ ID NO: 2624517 - DNA, 14 bp, Homo sapiens
tgtatcctggggct

SEQ ID NO: 2624518 - DNA, 17 bp, Homo sapiens
tgtatcgtatagctgta

SEQ ID NO: 2624519 - DNA, 17 bp, Homo sapiens
tgtatctagtgcagctg

SEQ ID NO: 2624520 - DNA, 19 bp, Homo sapiens
tgtatctctgaagcatgtt

SEQ ID NO: 2624521 - DNA, 13 bp, Homo sapiens
tgtatctgagcag

SEQ ID NO: 2624522 - DNA, 13 bp, Homo sapiens
tgtatgatgtgtt

SEQ ID NO: 2624523 - DNA, 18 bp, Homo sapiens
tgtatgatgtgttgtgat

SEQ ID NO: 2624524 - DNA, 18 bp, Homo sapiens
tgtatgcacgtgtgcaca

SEQ ID NO: 2624525 - DNA, 12 bp, Homo sapiens
tgtatgcagcta

SEQ ID NO: 2624526 - DNA, 16 bp, Homo sapiens
tgtatgccaagtgaga

SEQ ID NO: 2624527 - DNA, 15 bp, Homo sapiens
tgtatggttctgtgc

SEQ ID NO: 2624528 - DNA, 12 bp, Homo sapiens
tgtatgtataat

SEQ ID NO: 2624529 - DNA, 15 bp, Homo sapiens
tgtatgtataattca

SEQ ID NO: 2624530 - DNA, 14 bp, Homo sapiens
tgtatgtcttggac

SEQ ID NO: 2624531 - DNA, 12 bp, Homo sapiens
tgtatgtggggg

SEQ ID NO: 2624532 - DNA, 20 bp, Homo sapiens
tgtatgtgggggtctgtgtg

SEQ ID NO: 2624533 - DNA, 21 bp, Homo sapiens
tgtatgtgggggtctgtgtgt

SEQ ID NO: 2624534 - DNA, 22 bp, Homo sapiens
tgtatgtgggggtctgtgtgtt

SEQ ID NO: 2624535 - DNA, 14 bp, Homo sapiens
tgtatgtgtgtatg

SEQ ID NO: 2624536 - DNA, 16 bp, Homo sapiens
tgtatgtttacatatc

SEQ ID NO: 2624537 - DNA, 16 bp, Homo sapiens
tgtatgtttgcacact

SEQ ID NO: 2624538 - DNA, 11 bp, Homo sapiens
tgtatgttttg

SEQ ID NO: 2624539 - DNA, 16 bp, Homo sapiens
tgtattaagaatgaaa

SEQ ID NO: 2624540 - DNA, 18 bp, Homo sapiens
tgtattaagagtgaaaat

SEQ ID NO: 2624541 - DNA, 21 bp, Homo sapiens
tgtattaagttgttaataaaa

SEQ ID NO: 2624542 - DNA, 13 bp, Homo sapiens
tgtattatttcat

SEQ ID NO: 2624543 - DNA, 20 bp, Homo sapiens
tgtattatttcattatgtaa

SEQ ID NO: 2624544 - DNA, 21 bp, Homo sapiens
tgtattcacccgtccagacct

SEQ ID NO: 2624545 - DNA, 14 bp, Homo sapiens
tgtattcagcttta

SEQ ID NO: 2624546 - DNA, 17 bp, Homo sapiens
tgtattcagtgagggtc

SEQ ID NO: 2624547 - DNA, 17 bp, Homo sapiens
tgtattcatcttttgta

SEQ ID NO: 2624548 - DNA, 21 bp, Homo sapiens
tgtattccaagacatgtctgt

SEQ ID NO: 2624549 - DNA, 13 bp, Homo sapiens
tgtattctctgag

SEQ ID NO: 2624550 - DNA, 14 bp, Homo sapiens
tgtattctctgagc

SEQ ID NO: 2624551 - DNA, 19 bp, Homo sapiens
tgtattctctgagctgtgc

SEQ ID NO: 2624552 - DNA, 20 bp, Homo sapiens
tgtattctctgagctgtgca

SEQ ID NO: 2624553 - DNA, 21 bp, Homo sapiens
tgtattcttaaattcatttta

SEQ ID NO: 2624554 - DNA, 17 bp, Homo sapiens
tgtattctttgatgtta

SEQ ID NO: 2624555 - DNA, 21 bp, Homo sapiens
tgtattctttgatgttaacac

SEQ ID NO: 2624556 - DNA, 23 bp, Homo sapiens
tgtattctttgatgttaacacat

SEQ ID NO: 2624557 - DNA, 16 bp, Homo sapiens
tgtattgaatcatgta

SEQ ID NO: 2624558 - DNA, 14 bp, Homo sapiens
tgtattggcctgga

SEQ ID NO: 2624559 - DNA, 21 bp, Homo sapiens
tgtattgtaccttttaacacc

SEQ ID NO: 2624560 - DNA, 15 bp, Homo sapiens
tgtattgttcccagt

SEQ ID NO: 2624561 - DNA, 15 bp, Homo sapiens
tgtatttaattttga

SEQ ID NO: 2624562 - DNA, 14 bp, Homo sapiens
tgtatttataaata

SEQ ID NO: 2624563 - DNA, 15 bp, Homo sapiens
tgtatttgtgactaa

SEQ ID NO: 2624564 - DNA, 16 bp, Homo sapiens
tgtatttgtgactaat

SEQ ID NO: 2624565 - DNA, 18 bp, Homo sapiens
tgtatttgtgactaattg

SEQ ID NO: 2624566 - DNA, 22 bp, Homo sapiens
tgtatttgtgactaattgtata

SEQ ID NO: 2624567 - DNA, 18 bp, Homo sapiens
tgtatttgttaatggttt

SEQ ID NO: 2624568 - DNA, 14 bp, Homo sapiens
tgtattttaactca

SEQ ID NO: 2624569 - DNA, 19 bp, Homo sapiens
tgtattttactaataaaat

SEQ ID NO: 2624570 - DNA, 10 bp, Homo sapiens
tgtattttcc

SEQ ID NO: 2624571 - DNA, 15 bp, Homo sapiens
tgtcaaaataatttt

SEQ ID NO: 2624572 - DNA, 22 bp, Homo sapiens
tgtcaaacaaagccagaagctg

SEQ ID NO: 2624573 - DNA, 16 bp, Homo sapiens
tgtcaaactgtagaaa

SEQ ID NO: 2624574 - DNA, 18 bp, Homo sapiens
tgtcaaactgtagaaatg

SEQ ID NO: 2624575 - DNA, 15 bp, Homo sapiens
tgtcaactatgatat

SEQ ID NO: 2624576 - DNA, 15 bp, Homo sapiens
tgtcaactgacctaa

SEQ ID NO: 2624577 - DNA, 20 bp, Homo sapiens
tgtcaacttctggctcctca

SEQ ID NO: 2624578 - DNA, 14 bp, Homo sapiens
tgtcaagaaagagc

SEQ ID NO: 2624579 - DNA, 15 bp, Homo sapiens
tgtcaagccataatt

SEQ ID NO: 2624580 - DNA, 16 bp, Homo sapiens
tgtcaagtctctgctg

SEQ ID NO: 2624581 - DNA, 18 bp, Homo sapiens
tgtcaagttcctttgggt

SEQ ID NO: 2624582 - DNA, 15 bp, Homo sapiens
tgtcaagttgtgctt

SEQ ID NO: 2624583 - DNA, 21 bp, Homo sapiens
tgtcaatattaaatacagaca

SEQ ID NO: 2624584 - DNA, 17 bp, Homo sapiens
tgtcaatatttaaacat

SEQ ID NO: 2624585 - DNA, 21 bp, Homo sapiens
tgtcacaatcctaacacatta

SEQ ID NO: 2624586 - DNA, 13 bp, Homo sapiens
tgtcacacacttt

SEQ ID NO: 2624587 - DNA, 21 bp, Homo sapiens
tgtcacaggcaggtccagggt

SEQ ID NO: 2624588 - DNA, 18 bp, Homo sapiens
tgtcaccgtggaccttcc

SEQ ID NO: 2624589 - DNA, 19 bp, Homo sapiens
tgtcaccgtggaccttcct

SEQ ID NO: 2624590 - DNA, 21 bp, Homo sapiens
tgtcactggtagaccaaaata

SEQ ID NO: 2624591 - DNA, 23 bp, Homo sapiens
tgtcactggtagaccaaaataaa

SEQ ID NO: 2624592 - DNA, 21 bp, Homo sapiens
tgtcacttactgtttctgtca

SEQ ID NO: 2624593 - DNA, 16 bp, Homo sapiens
tgtcagaaaccagtta

SEQ ID NO: 2624594 - DNA, 23 bp, Homo sapiens
tgtcagacatccatgtttgtaaa

SEQ ID NO: 2624595 - DNA, 23 bp, Homo sapiens
tgtcagactttaaagaataatat

SEQ ID NO: 2624596 - DNA, 11 bp, Homo sapiens
tgtcagagctg

SEQ ID NO: 2624597 - DNA, 16 bp, Homo sapiens
tgtcagagttctgctc

SEQ ID NO: 2624598 - DNA, 15 bp, Homo sapiens
tgtcagatatgatat

SEQ ID NO: 2624599 - DNA, 15 bp, Homo sapiens
tgtcagcatagaagt

SEQ ID NO: 2624600 - DNA, 20 bp, Homo sapiens
tgtcagccgagccgggcctg

SEQ ID NO: 2624601 - DNA, 23 bp, Homo sapiens
tgtcagcgcaggtttagtttact

SEQ ID NO: 2624602 - DNA, 16 bp, Homo sapiens
tgtcagctgaacctgg

SEQ ID NO: 2624603 - DNA, 18 bp, Homo sapiens
tgtcagcttttgcttcat

SEQ ID NO: 2624604 - DNA, 16 bp, Homo sapiens
tgtcaggaacagaagg

SEQ ID NO: 2624605 - DNA, 18 bp, Homo sapiens
tgtcaggaacagaaggat

SEQ ID NO: 2624606 - DNA, 21 bp, Homo sapiens
tgtcaggcctgacggggagga

SEQ ID NO: 2624607 - DNA, 20 bp, Homo sapiens
tgtcaggctgctggcgcctc

SEQ ID NO: 2624608 - DNA, 22 bp, Homo sapiens
tgtcaggggcggggagggtgac

SEQ ID NO: 2624609 - DNA, 20 bp, Homo sapiens
tgtcaggtggggcagcttga

SEQ ID NO: 2624610 - DNA, 14 bp, Homo sapiens
tgtcataagaatga

SEQ ID NO: 2624611 - DNA, 17 bp, Homo sapiens
tgtcataagaatgaata

SEQ ID NO: 2624612 - DNA, 20 bp, Homo sapiens
tgtcatatatggggggccaa

SEQ ID NO: 2624613 - DNA, 19 bp, Homo sapiens
tgtcatatattactagcat

SEQ ID NO: 2624614 - DNA, 21 bp, Homo sapiens
tgtcatatgtaggtgtctgca

SEQ ID NO: 2624615 - DNA, 22 bp, Homo sapiens
tgtcatcaattgaatggtcagc

SEQ ID NO: 2624616 - DNA, 15 bp, Homo sapiens
tgtcatcagaagata

SEQ ID NO: 2624617 - DNA, 19 bp, Homo sapiens
tgtcatcattgtatatatg

SEQ ID NO: 2624618 - DNA, 23 bp, Homo sapiens
tgtcatctttcttctattttatt

SEQ ID NO: 2624619 - DNA, 16 bp, Homo sapiens
tgtcatgaacatgttc

SEQ ID NO: 2624620 - DNA, 19 bp, Homo sapiens
tgtcatgaattcttatgct

SEQ ID NO: 2624621 - DNA, 21 bp, Homo sapiens
tgtcatgaattcttatgctta

SEQ ID NO: 2624622 - DNA, 15 bp, Homo sapiens
tgtcatgcccccctc

SEQ ID NO: 2624623 - DNA, 23 bp, Homo sapiens
tgtcatgcccccctcaaacctcc

SEQ ID NO: 2624624 - DNA, 17 bp, Homo sapiens
tgtcattaaaggtatca

SEQ ID NO: 2624625 - DNA, 16 bp, Homo sapiens
tgtcatttatatagat

SEQ ID NO: 2624626 - DNA, 15 bp, Homo sapiens
tgtcatttttgcagt

SEQ ID NO: 2624627 - DNA, 22 bp, Homo sapiens
tgtccaaactgcctaagccctc

SEQ ID NO: 2624628 - DNA, 18 bp, Homo sapiens
tgtccaaagcagggtctg

SEQ ID NO: 2624629 - DNA, 19 bp, Homo sapiens
tgtccaaaggaggctggca

SEQ ID NO: 2624630 - DNA, 18 bp, Homo sapiens
tgtccaacccgaggcccg

SEQ ID NO: 2624631 - DNA, 15 bp, Homo sapiens
tgtccaagaagccca

SEQ ID NO: 2624632 - DNA, 22 bp, Homo sapiens
tgtccaagaagcccaggaaagg

SEQ ID NO: 2624633 - DNA, 17 bp, Homo sapiens
tgtccaagtgtgtgtgc

SEQ ID NO: 2624634 - DNA, 14 bp, Homo sapiens
tgtccaatcctatg

SEQ ID NO: 2624635 - DNA, 15 bp, Homo sapiens
tgtccacacccagct

SEQ ID NO: 2624636 - DNA, 14 bp, Homo sapiens
tgtccacagatgcc

SEQ ID NO: 2624637 - DNA, 18 bp, Homo sapiens
tgtccacagatgcctcca

SEQ ID NO: 2624638 - DNA, 20 bp, Homo sapiens
tgtccacagatgcctccacc

SEQ ID NO: 2624639 - DNA, 21 bp, Homo sapiens
tgtccagaagaatattcagga

SEQ ID NO: 2624640 - DNA, 13 bp, Homo sapiens
tgtccagacagcc

SEQ ID NO: 2624641 - DNA, 23 bp, Homo sapiens
tgtccagcctgggcagccaggct

SEQ ID NO: 2624642 - DNA, 13 bp, Homo sapiens
tgtccagggccct

SEQ ID NO: 2624643 - DNA, 17 bp, Homo sapiens
tgtccagttcccagaag

SEQ ID NO: 2624644 - DNA, 16 bp, Homo sapiens
tgtccatgtgtgtgca

SEQ ID NO: 2624645 - DNA, 17 bp, Homo sapiens
tgtccattgtccaatcc

SEQ ID NO: 2624646 - DNA, 16 bp, Homo sapiens
tgtcccaacttgtaaa

SEQ ID NO: 2624647 - DNA, 17 bp, Homo sapiens
tgtcccacccccacccc

SEQ ID NO: 2624648 - DNA, 22 bp, Homo sapiens
tgtcccacccccacccccagct

SEQ ID NO: 2624649 - DNA, 20 bp, Homo sapiens
tgtcccactcaagccaagca

SEQ ID NO: 2624650 - DNA, 17 bp, Homo sapiens
tgtcccaggtcctcact

SEQ ID NO: 2624651 - DNA, 14 bp, Homo sapiens
tgtcccatgaccca

SEQ ID NO: 2624652 - DNA, 17 bp, Homo sapiens
tgtcccatggacactcc

SEQ ID NO: 2624653 - DNA, 18 bp, Homo sapiens
tgtccccaaacctgcaag

SEQ ID NO: 2624654 - DNA, 14 bp, Homo sapiens
tgtccccaaatccg

SEQ ID NO: 2624655 - DNA, 13 bp, Homo sapiens
tgtccccaccgca

SEQ ID NO: 2624656 - DNA, 19 bp, Homo sapiens
tgtccccaccgcagacagg

SEQ ID NO: 2624657 - DNA, 20 bp, Homo sapiens
tgtccccctaatattaggga

SEQ ID NO: 2624658 - DNA, 18 bp, Homo sapiens
tgttgacgaagtctcttt

SEQ ID NO: 2624659 - DNA, 20 bp, Homo sapiens
tgttgacttattttctctgt

SEQ ID NO: 2624660 - DNA, 18 bp, Homo sapiens
tgttgagaattgtgctca

SEQ ID NO: 2624661 - DNA, 17 bp, Homo sapiens
tgttgagccaggcctgg

SEQ ID NO: 2624662 - DNA, 16 bp, Homo sapiens
tgttgagccttttccc

SEQ ID NO: 2624663 - DNA, 18 bp, Homo sapiens
tgttgagccttttccctc

SEQ ID NO: 2624664 - DNA, 19 bp, Homo sapiens
tgttgaggtggtctgaatg

SEQ ID NO: 2624665 - DNA, 23 bp, Homo sapiens
tgttgaggtggtctgaatgttct

SEQ ID NO: 2624666 - DNA, 19 bp, Homo sapiens
tgttgataaattccactgg

SEQ ID NO: 2624667 - DNA, 12 bp, Homo sapiens
tgttgatcccaa

SEQ ID NO: 2624668 - DNA, 20 bp, Homo sapiens
tgttgattgcaggaataagg

SEQ ID NO: 2624669 - DNA, 13 bp, Homo sapiens
tgttgattgctaa

SEQ ID NO: 2624670 - DNA, 19 bp, Homo sapiens
tgttgattgctaaatgtaa

SEQ ID NO: 2624671 - DNA, 18 bp, Homo sapiens
tgttgattttctgttgta

SEQ ID NO: 2624672 - DNA, 17 bp, Homo sapiens
tgttgcacccagccctg

SEQ ID NO: 2624673 - DNA, 14 bp, Homo sapiens
tgttgcatggatgt

SEQ ID NO: 2624674 - DNA, 23 bp, Homo sapiens
tgttgcccaggctggcgtgcagt

SEQ ID NO: 2624675 - DNA, 23 bp, Homo sapiens
tgttgctcaaatctattcagaca

SEQ ID NO: 2624676 - DNA, 14 bp, Homo sapiens
tgttgcttacaatt

SEQ ID NO: 2624677 - DNA, 16 bp, Homo sapiens
tgttgcttacaatttt

SEQ ID NO: 2624678 - DNA, 21 bp, Homo sapiens
tgttggaaaagaatacagaaa

SEQ ID NO: 2624679 - DNA, 13 bp, Homo sapiens
tgttggacccgct

SEQ ID NO: 2624680 - DNA, 19 bp, Homo sapiens
tgttggataaatcagtggt

SEQ ID NO: 2624681 - DNA, 11 bp, Homo sapiens
tgttggatctt

SEQ ID NO: 2624682 - DNA, 17 bp, Homo sapiens
tgttggatttataaatg

SEQ ID NO: 2624683 - DNA, 20 bp, Homo sapiens
tgttggatttttgtcttgtg

SEQ ID NO: 2624684 - DNA, 18 bp, Homo sapiens
tgttggcacatcctatgc

SEQ ID NO: 2624685 - DNA, 19 bp, Homo sapiens
tgttggcacatcctatgca

SEQ ID NO: 2624686 - DNA, 22 bp, Homo sapiens
tgttggcactcacagacctgga

SEQ ID NO: 2624687 - DNA, 11 bp, Homo sapiens
tgttggccagg

SEQ ID NO: 2624688 - DNA, 15 bp, Homo sapiens
tgttggcctctgcaa

SEQ ID NO: 2624689 - DNA, 15 bp, Homo sapiens
tgttggctaatgaag

SEQ ID NO: 2624690 - DNA, 15 bp, Homo sapiens
tgttgggattcctga

SEQ ID NO: 2624691 - DNA, 18 bp, Homo sapiens
tgttgggattcctgaccc

SEQ ID NO: 2624692 - DNA, 14 bp, Homo sapiens
tgttggtcatttta

SEQ ID NO: 2624693 - DNA, 19 bp, Homo sapiens
tgttggttccaagccctgg

SEQ ID NO: 2624694 - DNA, 14 bp, Homo sapiens
tgttgtacatttat

SEQ ID NO: 2624695 - DNA, 20 bp, Homo sapiens
tgttgtacatttatgattta

SEQ ID NO: 2624696 - DNA, 15 bp, Homo sapiens
tgttgtatgccttta

SEQ ID NO: 2624697 - DNA, 13 bp, Homo sapiens
tgttgtattttaa

SEQ ID NO: 2624698 - DNA, 14 bp, Homo sapiens
tgttgtcagctgaa

SEQ ID NO: 2624699 - DNA, 15 bp, Homo sapiens
tgttgtcattgctgt

SEQ ID NO: 2624700 - DNA, 14 bp, Homo sapiens
tgttgttaaatatc

SEQ ID NO: 2624701 - DNA, 11 bp, Homo sapiens
tgttgttattt

SEQ ID NO: 2624702 - DNA, 13 bp, Homo sapiens
tgttgttatttaa

SEQ ID NO: 2624703 - DNA, 12 bp, Homo sapiens
tgttgtttcttt

SEQ ID NO: 2624704 - DNA, 13 bp, Homo sapiens
tgttgtttctttc

SEQ ID NO: 2624705 - DNA, 17 bp, Homo sapiens
tgtttaaagagaggtta

SEQ ID NO: 2624706 - DNA, 15 bp, Homo sapiens
tgtttaaataaagta

SEQ ID NO: 2624707 - DNA, 18 bp, Homo sapiens
tgtttacactctttgtaa

SEQ ID NO: 2624708 - DNA, 19 bp, Homo sapiens
tgtttacactctttgtaag

SEQ ID NO: 2624709 - DNA, 13 bp, Homo sapiens
tgtttactaggga

SEQ ID NO: 2624710 - DNA, 16 bp, Homo sapiens
tgtttacttaaagatt

SEQ ID NO: 2624711 - DNA, 17 bp, Homo sapiens
tgtttagagttgcaatc

SEQ ID NO: 2624712 - DNA, 16 bp, Homo sapiens
tgtttagataatacac

SEQ ID NO: 2624713 - DNA, 19 bp, Homo sapiens
tgtttagtaaactcaataa

SEQ ID NO: 2624714 - DNA, 14 bp, Homo sapiens
tgtttagttgcaga

SEQ ID NO: 2624715 - DNA, 16 bp, Homo sapiens
tgtttatacctttgcc

SEQ ID NO: 2624716 - DNA, 21 bp, Homo sapiens
tgtttatagcaaacttggaat

SEQ ID NO: 2624717 - DNA, 20 bp, Homo sapiens
tgtttatataaatgctttta

SEQ ID NO: 2624718 - DNA, 23 bp, Homo sapiens
tgtttatggcctcagctgcctca

SEQ ID NO: 2624719 - DNA, 16 bp, Homo sapiens
tgtttattaacaaatt

SEQ ID NO: 2624720 - DNA, 19 bp, Homo sapiens
tgtttattaacaaattatg

SEQ ID NO: 2624721 - DNA, 18 bp, Homo sapiens
tgtttattcctgataata

SEQ ID NO: 2624722 - DNA, 23 bp, Homo sapiens
tgtttatttataagcagatttaa

SEQ ID NO: 2624723 - DNA, 16 bp, Homo sapiens
tgtttatttttcatat

SEQ ID NO: 2624724 - DNA, 19 bp, Homo sapiens
tgtttatttttcatattgt

SEQ ID NO: 2624725 - DNA, 16 bp, Homo sapiens
tgtttcaaaataaaaa

SEQ ID NO: 2624726 - DNA, 18 bp, Homo sapiens
tgtttcaaacacaaatgc

SEQ ID NO: 2624727 - DNA, 21 bp, Homo sapiens
tgtttcaagtggggctcgcca

SEQ ID NO: 2624728 - DNA, 21 bp, Homo sapiens
tgtttcatgttttgtgactat

SEQ ID NO: 2624729 - DNA, 23 bp, Homo sapiens
tgtttcctagcacacacttttgg

SEQ ID NO: 2624730 - DNA, 21 bp, Homo sapiens
tgtttcctggcactgcttcca

SEQ ID NO: 2624731 - DNA, 23 bp, Homo sapiens
tgtttcctggcactgcttccagt

SEQ ID NO: 2624732 - DNA, 12 bp, Homo sapiens
tgtttccttcag

SEQ ID NO: 2624733 - DNA, 22 bp, Homo sapiens
tgtttcggagacgggaccgggc

SEQ ID NO: 2624734 - DNA, 16 bp, Homo sapiens
tgtttctccccctggg

SEQ ID NO: 2624735 - DNA, 12 bp, Homo sapiens
tgtttctgactc

SEQ ID NO: 2624736 - DNA, 21 bp, Homo sapiens
tgtttctgcagtagtctctgt

SEQ ID NO: 2624737 - DNA, 15 bp, Homo sapiens
tgtttctgttattaa

SEQ ID NO: 2624738 - DNA, 19 bp, Homo sapiens
tgtttctgttattaacaaa

SEQ ID NO: 2624739 - DNA, 22 bp, Homo sapiens
tgtttgacaaagttactgattc

SEQ ID NO: 2624740 - DNA, 22 bp, Homo sapiens
tgtttgaggtttttaagcctta

SEQ ID NO: 2624741 - DNA, 17 bp, Homo sapiens
tgtttgattcagacagc

SEQ ID NO: 2624742 - DNA, 23 bp, Homo sapiens
tgtttgcacgttatggtgtttct

SEQ ID NO: 2624743 - DNA, 20 bp, Homo sapiens
tgtttgccttctacttttaa

SEQ ID NO: 2624744 - DNA, 15 bp, Homo sapiens
tgtttgcttattgtt

SEQ ID NO: 2624745 - DNA, 20 bp, Homo sapiens
tgtttgcttattgttccaag

SEQ ID NO: 2624746 - DNA, 19 bp, Homo sapiens
tgtttggagacattcctgg

SEQ ID NO: 2624747 - DNA, 16 bp, Homo sapiens
tgtttgggcagaaggg

SEQ ID NO: 2624748 - DNA, 19 bp, Homo sapiens
tgtttggggatgagaaagg

SEQ ID NO: 2624749 - DNA, 19 bp, Homo sapiens
tgtttgtataatgaatgag

SEQ ID NO: 2624750 - DNA, 15 bp, Homo sapiens
tgtttgtatgtataa

SEQ ID NO: 2624751 - DNA, 14 bp, Homo sapiens
tgtttgtgctgtgg

SEQ ID NO: 2624752 - DNA, 14 bp, Homo sapiens
tgtttgtggcctca

SEQ ID NO: 2624753 - DNA, 11 bp, Homo sapiens
tgtttgtgtgt

SEQ ID NO: 2624754 - DNA, 22 bp, Homo sapiens
tgtttgtttctccccctgggct

SEQ ID NO: 2624755 - DNA, 12 bp, Homo sapiens
tgttttaaaaag

SEQ ID NO: 2624756 - DNA, 20 bp, Homo sapiens
tgttttaaaaagaaacaaga

SEQ ID NO: 2624757 - DNA, 13 bp, Homo sapiens
tgttttaacaaaa

SEQ ID NO: 2624758 - DNA, 14 bp, Homo sapiens
tgttttaacaaaaa

SEQ ID NO: 2624759 - DNA, 19 bp, Homo sapiens
tgttttaaggatgcttgta

SEQ ID NO: 2624760 - DNA, 16 bp, Homo sapiens
tgttttaattccatga

SEQ ID NO: 2624761 - DNA, 23 bp, Homo sapiens
tgttttaatttaaacacctcctc

SEQ ID NO: 2624762 - DNA, 18 bp, Homo sapiens
tgttttactgtgaaactg

SEQ ID NO: 2624763 - DNA, 19 bp, Homo sapiens
tgttttagacaaatactca

SEQ ID NO: 2624764 - DNA, 20 bp, Homo sapiens
tgttttagacaaatactcat

SEQ ID NO: 2624765 - DNA, 21 bp, Homo sapiens
tgttttagacaaatactcatg

SEQ ID NO: 2624766 - DNA, 24 bp, Homo sapiens
tgttttagacaaatactcatgtgt

SEQ ID NO: 2624767 - DNA, 16 bp, Homo sapiens
tgttttagttaaattt

SEQ ID NO: 2624768 - DNA, 12 bp, Homo sapiens
tgttttatcatg

SEQ ID NO: 2624769 - DNA, 23 bp, Homo sapiens
tgttttatcatgacatgttatat

SEQ ID NO: 2624770 - DNA, 18 bp, Homo sapiens
tgttttccattgtttgaa

SEQ ID NO: 2624771 - DNA, 12 bp, Homo sapiens
tgttttccctga

SEQ ID NO: 2624772 - DNA, 12 bp, Homo sapiens
tgttttctgaat

SEQ ID NO: 2624773 - DNA, 23 bp, Homo sapiens
tgttttctgagcccgggctgcct

SEQ ID NO: 2624774 - DNA, 17 bp, Homo sapiens
tgttttcttttggtaaa

SEQ ID NO: 2624775 - DNA, 12 bp, Homo sapiens
tgttttgataaa

SEQ ID NO: 2624776 - DNA, 18 bp, Homo sapiens
tgttttgataaagtagta

SEQ ID NO: 2624777 - DNA, 20 bp, Homo sapiens
tgttttgatgtttgtggcct

SEQ ID NO: 2624778 - DNA, 16 bp, Homo sapiens
tgttttggtatctgtt

SEQ ID NO: 2624779 - DNA, 16 bp, Homo sapiens
tgtttttaaaaatcat

SEQ ID NO: 2624780 - DNA, 19 bp, Homo sapiens
tgtttttaaaagtttcaat

SEQ ID NO: 2624781 - DNA, 17 bp, Homo sapiens
tgtttttaagctgtttc

SEQ ID NO: 2624782 - DNA, 20 bp, Homo sapiens
tgtttttaagctgtttccat

SEQ ID NO: 2624783 - DNA, 13 bp, Homo sapiens
tgtttttacccat

SEQ ID NO: 2624784 - DNA, 20 bp, Homo sapiens
tgtttttccttgtatttaaa

SEQ ID NO: 2624785 - DNA, 16 bp, Homo sapiens
tgtttttgaaggcaga

SEQ ID NO: 2624786 - DNA, 18 bp, Homo sapiens
tgtttttgaaggcagaaa

SEQ ID NO: 2624787 - DNA, 15 bp, Homo sapiens
tgtttttgtaaagtg

SEQ ID NO: 2624788 - DNA, 19 bp, Homo sapiens
tgtttttgtatttttaatg

SEQ ID NO: 2624789 - DNA, 17 bp, Homo sapiens
tgttttttcctgagctt

SEQ ID NO: 2624790 - DNA, 15 bp, Homo sapiens
tgttttttctgccac

SEQ ID NO: 2624791 - DNA, 16 bp, Homo sapiens
tgttttttgaaaacat

SEQ ID NO: 2624792 - DNA, 14 bp, Homo sapiens
tgttttttggtctt

SEQ ID NO: 2624793 - DNA, 21 bp, Homo sapiens
ttaaaaaaaggcattgtttga

SEQ ID NO: 2624794 - DNA, 20 bp, Homo sapiens
ttaaaaagaaacaagatgct

SEQ ID NO: 2624795 - DNA, 15 bp, Homo sapiens
ttaaaaatgcaaatc

SEQ ID NO: 2624796 - DNA, 14 bp, Homo sapiens
ttaaaaatgtaaat

SEQ ID NO: 2624797 - DNA, 23 bp, Homo sapiens
ttaaaagaaaataaaaaaaagaa

SEQ ID NO: 2624798 - DNA, 15 bp, Homo sapiens
ttaaaagatgaaaat

SEQ ID NO: 2624799 - DNA, 16 bp, Homo sapiens
ttaaaagattcatttt

SEQ ID NO: 2624800 - DNA, 21 bp, Homo sapiens
ttaaaagattcatttttaatc

SEQ ID NO: 2624801 - DNA, 17 bp, Homo sapiens
ttaaaatatttatttat

SEQ ID NO: 2624802 - DNA, 16 bp, Homo sapiens
ttaaaatgattgtaaa

SEQ ID NO: 2624803 - DNA, 21 bp, Homo sapiens
ttcagaatcacttctgagaac

SEQ ID NO: 2624804 - DNA, 16 bp, Homo sapiens
ttcagacagctgcctg

SEQ ID NO: 2624805 - DNA, 19 bp, Homo sapiens
ttcagactttgcttcccat

SEQ ID NO: 2624806 - DNA, 15 bp, Homo sapiens
ttcagagagctggta

SEQ ID NO: 2624807 - DNA, 22 bp, Homo sapiens
ttcagaggccctcgctgccagc

SEQ ID NO: 2624808 - DNA, 17 bp, Homo sapiens
ttcagataactgttatt

SEQ ID NO: 2624809 - DNA, 12 bp, Homo sapiens
ttcagatataaa

SEQ ID NO: 2624810 - DNA, 19 bp, Homo sapiens
ttcagatataaaagactga

SEQ ID NO: 2624811 - DNA, 15 bp, Homo sapiens
ttcagatatatatca

SEQ ID NO: 2624812 - DNA, 14 bp, Homo sapiens
ttcagatgtcttct

SEQ ID NO: 2624813 - DNA, 22 bp, Homo sapiens
ttcagattcccagagcaaaata

SEQ ID NO: 2624814 - DNA, 20 bp, Homo sapiens
ttcagattttaaaaagtctt

SEQ ID NO: 2624815 - DNA, 13 bp, Homo sapiens
ttcagcaagacaa

SEQ ID NO: 2624816 - DNA, 22 bp, Homo sapiens
ttcagcacctacagtgtacagt

SEQ ID NO: 2624817 - DNA, 23 bp, Homo sapiens
ttcagcacctacagtgtacagtc

SEQ ID NO: 2624818 - DNA, 21 bp, Homo sapiens
ttcagccatcaacaagagttg

SEQ ID NO: 2624819 - DNA, 20 bp, Homo sapiens
ttcagctaagctaggaatga

SEQ ID NO: 2624820 - DNA, 14 bp, Homo sapiens
ttcaggaagatgaa

SEQ ID NO: 2624821 - DNA, 20 bp, Homo sapiens
ttcaggagcagcctcagaac

SEQ ID NO: 2624822 - DNA, 17 bp, Homo sapiens
ttcaggatactctgtca

SEQ ID NO: 2624823 - DNA, 18 bp, Homo sapiens
ttcagggaatttcaggaa

SEQ ID NO: 2624824 - DNA, 20 bp, Homo sapiens
ttcaggggactcagccctga

SEQ ID NO: 2624825 - DNA, 23 bp, Homo sapiens
ttcaggggactcagccctgaggt

SEQ ID NO: 2624826 - DNA, 22 bp, Homo sapiens
ttcaggggggttgtgaggcctg

SEQ ID NO: 2624827 - DNA, 16 bp, Homo sapiens
ttcagggtcctgagat

SEQ ID NO: 2624828 - DNA, 15 bp, Homo sapiens
ttcagggtgatgcca

SEQ ID NO: 2624829 - DNA, 16 bp, Homo sapiens
ttcagggtgatgccag

SEQ ID NO: 2624830 - DNA, 17 bp, Homo sapiens
ttcagggttggcccctg

SEQ ID NO: 2624831 - DNA, 16 bp, Homo sapiens
ttcaggtaacaggcag

SEQ ID NO: 2624832 - DNA, 16 bp, Homo sapiens
ttcaggtatgttgcct

SEQ ID NO: 2624833 - DNA, 23 bp, Homo sapiens
ttcaggtgacatgtgaaaccttt

SEQ ID NO: 2624834 - DNA, 22 bp, Homo sapiens
ttcaggttatcgaaataacaat

SEQ ID NO: 2624835 - DNA, 14 bp, Homo sapiens
ttcagtaagccgtg

SEQ ID NO: 2624836 - DNA, 14 bp, Homo sapiens
ttcagtaataactc

SEQ ID NO: 2624837 - DNA, 21 bp, Homo sapiens
ttcagtaccctctcagctcca

SEQ ID NO: 2624838 - DNA, 16 bp, Homo sapiens
ttcagtataatttaac

SEQ ID NO: 2624839 - DNA, 18 bp, Homo sapiens
ttcagtattttggagaaa

SEQ ID NO: 2624840 - DNA, 19 bp, Homo sapiens
ttcagtattttggagaaat

SEQ ID NO: 2624841 - DNA, 20 bp, Homo sapiens
ttcagtattttggagaaatt

SEQ ID NO: 2624842 - DNA, 16 bp, Homo sapiens
ttcagtgaaagcatca

SEQ ID NO: 2624843 - DNA, 15 bp, Homo sapiens
ttcagtggcagctgc

SEQ ID NO: 2624844 - DNA, 17 bp, Homo sapiens
ttcagtggcagctgctt

SEQ ID NO: 2624845 - DNA, 16 bp, Homo sapiens
ttcagtggcagggctc

SEQ ID NO: 2624846 - DNA, 17 bp, Homo sapiens
ttcagtggcagggctca

SEQ ID NO: 2624847 - DNA, 17 bp, Homo sapiens
ttcagtgtaatttcttt

SEQ ID NO: 2624848 - DNA, 21 bp, Homo sapiens
ttcagtgtaatttctttgcct

SEQ ID NO: 2624849 - DNA, 20 bp, Homo sapiens
ttcagtgtatggaaataaat

SEQ ID NO: 2624850 - DNA, 18 bp, Homo sapiens
ttcagtgtcccgggcccg

SEQ ID NO: 2624851 - DNA, 13 bp, Homo sapiens
ttcagttacagaa

SEQ ID NO: 2624852 - DNA, 14 bp, Homo sapiens
ttcagttacagaaa

SEQ ID NO: 2624853 - DNA, 15 bp, Homo sapiens
ttcagttcccagaat

SEQ ID NO: 2624854 - DNA, 17 bp, Homo sapiens
ttcagttcccagaatca

SEQ ID NO: 2624855 - DNA, 19 bp, Homo sapiens
ttcagttcccagaatcaaa

SEQ ID NO: 2624856 - DNA, 16 bp, Homo sapiens
ttcagttgattttaca

SEQ ID NO: 2624857 - DNA, 17 bp, Homo sapiens
ttcagttttatctttaa

SEQ ID NO: 2624858 - DNA, 12 bp, Homo sapiens
ttcataaatgaa

SEQ ID NO: 2624859 - DNA, 16 bp, Homo sapiens
ttcataaatgaatttt

SEQ ID NO: 2624860 - DNA, 14 bp, Homo sapiens
ttcataactttcat

SEQ ID NO: 2624861 - DNA, 17 bp, Homo sapiens
ttcataagtatttcaaa

SEQ ID NO: 2624862 - DNA, 18 bp, Homo sapiens
ttcatacacagcctgggc

SEQ ID NO: 2624863 - DNA, 14 bp, Homo sapiens
ttcataggtcactg

SEQ ID NO: 2624864 - DNA, 19 bp, Homo sapiens
ttcataggtcactggctct

SEQ ID NO: 2624865 - DNA, 18 bp, Homo sapiens
ttcatatatgaggacttg

SEQ ID NO: 2624866 - DNA, 20 bp, Homo sapiens
ttcatatctatttattaaat

SEQ ID NO: 2624867 - DNA, 20 bp, Homo sapiens
ttcatatgacattcatgcct

SEQ ID NO: 2624868 - DNA, 14 bp, Homo sapiens
ttcatatgttgctc

SEQ ID NO: 2624869 - DNA, 16 bp, Homo sapiens
ttcatattgtgccaat

SEQ ID NO: 2624870 - DNA, 16 bp, Homo sapiens
ttcatatttacttctt

SEQ ID NO: 2624871 - DNA, 16 bp, Homo sapiens
ttcatcaaatggaaga

SEQ ID NO: 2624872 - DNA, 19 bp, Homo sapiens
ttcatcatattatacagac

SEQ ID NO: 2624873 - DNA, 21 bp, Homo sapiens
ttcatcatcctaagctattca

SEQ ID NO: 2624874 - DNA, 16 bp, Homo sapiens
ttcatccaatcctcac

SEQ ID NO: 2624875 - DNA, 18 bp, Homo sapiens
ttcatccaatcctcactg

SEQ ID NO: 2624876 - DNA, 18 bp, Homo sapiens
ttcatccggcagcctgga

SEQ ID NO: 2624877 - DNA, 14 bp, Homo sapiens
ttcatctccaggga

SEQ ID NO: 2624878 - DNA, 13 bp, Homo sapiens
ttcatctgggaaa

SEQ ID NO: 2624879 - DNA, 18 bp, Homo sapiens
ttcatctgttgttttgtt

SEQ ID NO: 2624880 - DNA, 22 bp, Homo sapiens
ttcatgaaaatagctctttcag

SEQ ID NO: 2624881 - DNA, 15 bp, Homo sapiens
ttcatgattttgaaa

SEQ ID NO: 2624882 - DNA, 14 bp, Homo sapiens
ttcatgcaatgaca

SEQ ID NO: 2624883 - DNA, 15 bp, Homo sapiens
ttcatgcaatgacat

SEQ ID NO: 2624884 - DNA, 21 bp, Homo sapiens
ttcatgcaatgacatcttcaa

SEQ ID NO: 2624885 - DNA, 13 bp, Homo sapiens
ttcatgcatggaa

SEQ ID NO: 2624886 - DNA, 16 bp, Homo sapiens
ttcatgcatggaaatt

SEQ ID NO: 2624887 - DNA, 19 bp, Homo sapiens
ttcatgccaccatggccag

SEQ ID NO: 2624888 - DNA, 17 bp, Homo sapiens
ttcatggcagaaggcaa

SEQ ID NO: 2624889 - DNA, 14 bp, Homo sapiens
ttcatgtaaactgt

SEQ ID NO: 2624890 - DNA, 12 bp, Homo sapiens
ttcatgtttctt

SEQ ID NO: 2624891 - DNA, 17 bp, Homo sapiens
ttcatgttttaacaaaa

SEQ ID NO: 2624892 - DNA, 13 bp, Homo sapiens
ttcattaaagcat

SEQ ID NO: 2624893 - DNA, 13 bp, Homo sapiens
ttcattacagctt

SEQ ID NO: 2624894 - DNA, 13 bp, Homo sapiens
ttcattacctttt

SEQ ID NO: 2624895 - DNA, 13 bp, Homo sapiens
ttcattagagcag

SEQ ID NO: 2624896 - DNA, 17 bp, Homo sapiens
ttcattatgtaaaatgt

SEQ ID NO: 2624897 - DNA, 22 bp, Homo sapiens
ttcattattagtactgctcttg

SEQ ID NO: 2624898 - DNA, 18 bp, Homo sapiens
ttcattattggaattaac

SEQ ID NO: 2624899 - DNA, 9 bp, Homo sapiens
ttcattcag

SEQ ID NO: 2624900 - DNA, 18 bp, Homo sapiens
ttcattcctaacacagca

SEQ ID NO: 2624901 - DNA, 16 bp, Homo sapiens
ttcattgactatcaaa

SEQ ID NO: 2624902 - DNA, 19 bp, Homo sapiens
ttcattgagagttttgtct

SEQ ID NO: 2624903 - DNA, 18 bp, Homo sapiens
ttcattgatatgaaaaat

SEQ ID NO: 2624904 - DNA, 19 bp, Homo sapiens
ttcattgcactttgattag

SEQ ID NO: 2624905 - DNA, 18 bp, Homo sapiens
ttcattgtaatgttactg

SEQ ID NO: 2624906 - DNA, 17 bp, Homo sapiens
ttcattgtataaaaata

SEQ ID NO: 2624907 - DNA, 13 bp, Homo sapiens
ttcatttaaaatg

SEQ ID NO: 2624908 - DNA, 16 bp, Homo sapiens
ttcatttactgtggct

SEQ ID NO: 2624909 - DNA, 13 bp, Homo sapiens
ttcatttcattgt

SEQ ID NO: 2624910 - DNA, 15 bp, Homo sapiens
ttcatttcattgtat

SEQ ID NO: 2624911 - DNA, 18 bp, Homo sapiens
ttcatttgagaagtaaac

SEQ ID NO: 2624912 - DNA, 17 bp, Homo sapiens
ttcattttgaaaaacac

SEQ ID NO: 2624913 - DNA, 15 bp, Homo sapiens
ttccaaaaaaatact

SEQ ID NO: 2624914 - DNA, 18 bp, Homo sapiens
ttccaaaagtggcctctt

SEQ ID NO: 2624915 - DNA, 16 bp, Homo sapiens
ttccaaacctgacaga

SEQ ID NO: 2624916 - DNA, 13 bp, Homo sapiens
ttccaaagtacac

SEQ ID NO: 2624917 - DNA, 14 bp, Homo sapiens
ttccaaagttaaca

SEQ ID NO: 2624918 - DNA, 23 bp, Homo sapiens
ttccaaattcacaagttgtgttt

SEQ ID NO: 2624919 - DNA, 15 bp, Homo sapiens
ttccaaattctgctt

SEQ ID NO: 2624920 - DNA, 16 bp, Homo sapiens
ttccaacaaagggttt

SEQ ID NO: 2624921 - DNA, 17 bp, Homo sapiens
ttccaacaccacagaca

SEQ ID NO: 2624922 - DNA, 22 bp, Homo sapiens
ttccaacaccacagacacacac

SEQ ID NO: 2624923 - DNA, 14 bp, Homo sapiens
ttccaacagtgagt

SEQ ID NO: 2624924 - DNA, 15 bp, Homo sapiens
ttccaaccccaactc

SEQ ID NO: 2624925 - DNA, 12 bp, Homo sapiens
ttccaagacagt

SEQ ID NO: 2624926 - DNA, 22 bp, Homo sapiens
ttccaagacagtatacagtcct

SEQ ID NO: 2624927 - DNA, 16 bp, Homo sapiens
ttccaagacatgtctg

SEQ ID NO: 2624928 - DNA, 20 bp, Homo sapiens
ttccaagacattgtcaataa

SEQ ID NO: 2624929 - DNA, 13 bp, Homo sapiens
ttccaaggcttct

SEQ ID NO: 2624930 - DNA, 17 bp, Homo sapiens
ttccaagggtactaagg

SEQ ID NO: 2624931 - DNA, 14 bp, Homo sapiens
ttccaagtgtgcat

SEQ ID NO: 2624932 - DNA, 16 bp, Homo sapiens
ttccaagttgctaata

SEQ ID NO: 2624933 - DNA, 13 bp, Homo sapiens
ttccaataaacca

SEQ ID NO: 2624934 - DNA, 16 bp, Homo sapiens
ttccaatatgatgact

SEQ ID NO: 2624935 - DNA, 21 bp, Homo sapiens
ttccaattttctggaatacat

SEQ ID NO: 2624936 - DNA, 16 bp, Homo sapiens
ttccacacccccaccc

SEQ ID NO: 2624937 - DNA, 18 bp, Homo sapiens
ttccaccatcaagccacc

SEQ ID NO: 2624938 - DNA, 12 bp, Homo sapiens
ttccaccccctc

SEQ ID NO: 2624939 - DNA, 15 bp, Homo sapiens
ttccaccccctccct

SEQ ID NO: 2624940 - DNA, 20 bp, Homo sapiens
ttccaccccctccctggcct

SEQ ID NO: 2624941 - DNA, 12 bp, Homo sapiens
ttccacctccct

SEQ ID NO: 2624942 - DNA, 14 bp, Homo sapiens
ttccacgatgaaaa

SEQ ID NO: 2624943 - DNA, 19 bp, Homo sapiens
ttccacgctgtctccagac

SEQ ID NO: 2624944 - DNA, 22 bp, Homo sapiens
ttccacggagccactcctctga

SEQ ID NO: 2624945 - DNA, 12 bp, Homo sapiens
ttccactaaccc

SEQ ID NO: 2624946 - DNA, 16 bp, Homo sapiens
ttccactgaagtagtg

SEQ ID NO: 2624947 - DNA, 20 bp, Homo sapiens
ttccactgagctccatgtgc

SEQ ID NO: 2624948 - DNA, 23 bp, Homo sapiens
ttccactgcctgggatgatgcag

SEQ ID NO: 2624949 - DNA, 14 bp, Homo sapiens
ttgaaaagctatta

SEQ ID NO: 2624950 - DNA, 16 bp, Homo sapiens
ttgaaaaggtgacctt

SEQ ID NO: 2624951 - DNA, 19 bp, Homo sapiens
ttgaaaattattttaaaca

SEQ ID NO: 2624952 - DNA, 22 bp, Homo sapiens
ttgaaaattattttaaacaaaa

SEQ ID NO: 2624953 - DNA, 20 bp, Homo sapiens
ttgaaaattcaaaaagtgtt

SEQ ID NO: 2624954 - DNA, 23 bp, Homo sapiens
ttgaaacaatactcataatgtga

SEQ ID NO: 2624955 - DNA, 15 bp, Homo sapiens
ttgaaagaaaatatg

SEQ ID NO: 2624956 - DNA, 17 bp, Homo sapiens
ttgaaagagaaccagtt

SEQ ID NO: 2624957 - DNA, 17 bp, Homo sapiens
ttgaaagttttcagaac

SEQ ID NO: 2624958 - DNA, 18 bp, Homo sapiens
ttgaaattaacctctcac

SEQ ID NO: 2624959 - DNA, 21 bp, Homo sapiens
ttgaaattatgtatgtttaca

SEQ ID NO: 2624960 - DNA, 16 bp, Homo sapiens
ttgaaccacttccctc

SEQ ID NO: 2624961 - DNA, 18 bp, Homo sapiens
ttgaacccgggaggcaga

SEQ ID NO: 2624962 - DNA, 15 bp, Homo sapiens
ttgaactcagatctg

SEQ ID NO: 2624963 - DNA, 22 bp, Homo sapiens
ttgaacttaaataaatgtcatt

SEQ ID NO: 2624964 - DNA, 17 bp, Homo sapiens
ttgaactttgacctctg

SEQ ID NO: 2624965 - DNA, 20 bp, Homo sapiens
ttgaactttgacctctgcag

SEQ ID NO: 2624966 - DNA, 22 bp, Homo sapiens
ttgaacttttttccactgaagt

SEQ ID NO: 2624967 - DNA, 15 bp, Homo sapiens
ttgaagacactgaaa

SEQ ID NO: 2624968 - DNA, 13 bp, Homo sapiens
ttgaagcatttta

SEQ ID NO: 2624969 - DNA, 14 bp, Homo sapiens
ttgaagcattttat

SEQ ID NO: 2624970 - DNA, 17 bp, Homo sapiens
ttgaagcattttataaa

SEQ ID NO: 2624971 - DNA, 22 bp, Homo sapiens
ttgaagcattttataaatcgct

SEQ ID NO: 2624972 - DNA, 23 bp, Homo sapiens
ttgaagcattttataaatcgctt

SEQ ID NO: 2624973 - DNA, 13 bp, Homo sapiens
ttgaagctctggt

SEQ ID NO: 2624974 - DNA, 18 bp, Homo sapiens
ttgaaggaggtgagggat

SEQ ID NO: 2624975 - DNA, 15 bp, Homo sapiens
ttgaaggcagaaagc

SEQ ID NO: 2624976 - DNA, 18 bp, Homo sapiens
ttgaagggtaaagaagtt

SEQ ID NO: 2624977 - DNA, 12 bp, Homo sapiens
ttgaagtaatga

SEQ ID NO: 2624978 - DNA, 19 bp, Homo sapiens
ttgaataatggtaccagat

SEQ ID NO: 2624979 - DNA, 15 bp, Homo sapiens
ttgaatataaacact

SEQ ID NO: 2624980 - DNA, 18 bp, Homo sapiens
ttgaatataaacactata

SEQ ID NO: 2624981 - DNA, 20 bp, Homo sapiens
ttgaatataatatatttgtg

SEQ ID NO: 2624982 - DNA, 21 bp, Homo sapiens
ttgaatataatatatttgtgt

SEQ ID NO: 2624983 - DNA, 10 bp, Homo sapiens
ttgaatcaat

SEQ ID NO: 2624984 - DNA, 22 bp, Homo sapiens
ttgaatcaataatatattttct

SEQ ID NO: 2624985 - DNA, 13 bp, Homo sapiens
ttgaatcacagta

SEQ ID NO: 2624986 - DNA, 22 bp, Homo sapiens
ttgaatcatgtagtatcaaata

SEQ ID NO: 2624987 - DNA, 18 bp, Homo sapiens
ttgaatgaaaaatttaag

SEQ ID NO: 2624988 - DNA, 17 bp, Homo sapiens
ttgaatgacaacagaag

SEQ ID NO: 2624989 - DNA, 21 bp, Homo sapiens
ttgaatgacaacagaagcttc

SEQ ID NO: 2624990 - DNA, 16 bp, Homo sapiens
ttgaatgcttcctgac

SEQ ID NO: 2624991 - DNA, 20 bp, Homo sapiens
ttgaatgctttttgaatgtt

SEQ ID NO: 2624992 - DNA, 18 bp, Homo sapiens
ttgaatggcctgccttga

SEQ ID NO: 2624993 - DNA, 12 bp, Homo sapiens
ttgaatgtcttt

SEQ ID NO: 2624994 - DNA, 17 bp, Homo sapiens
ttgaatgtcttttgaat

SEQ ID NO: 2624995 - DNA, 23 bp, Homo sapiens
ttgaattaaattaggaataaata

SEQ ID NO: 2624996 - DNA, 13 bp, Homo sapiens
ttgaattatcttg

SEQ ID NO: 2624997 - DNA, 21 bp, Homo sapiens
ttgaattcttggttgaggaaa

SEQ ID NO: 2624998 - DNA, 15 bp, Homo sapiens
ttgaattgtaactgt

SEQ ID NO: 2624999 - DNA, 16 bp, Homo sapiens
ttgacaaccatgagac

SEQ ID NO: 2625000 - DNA, 23 bp, Homo sapiens
ttgacactagcccaatgaaatga

SEQ ID NO: 2625001 - DNA, 14 bp, Homo sapiens
ttgacactatatct

SEQ ID NO: 2625002 - DNA, 19 bp, Homo sapiens
ttgacacttaaaaatggtt

SEQ ID NO: 2625003 - DNA, 16 bp, Homo sapiens
ttgacagaacactgtc

SEQ ID NO: 2625004 - DNA, 20 bp, Homo sapiens
ttgacataacactataaagg

SEQ ID NO: 2625005 - DNA, 14 bp, Homo sapiens
ttgacccacaagaa

SEQ ID NO: 2625006 - DNA, 15 bp, Homo sapiens
ttgacctcaggtgat

SEQ ID NO: 2625007 - DNA, 15 bp, Homo sapiens
ttgacctctgcagca

SEQ ID NO: 2625008 - DNA, 12 bp, Homo sapiens
ttgacctgaggc

SEQ ID NO: 2625009 - DNA, 22 bp, Homo sapiens
ttgacgccatcccagccccaat

SEQ ID NO: 2625010 - DNA, 17 bp, Homo sapiens
ttgactatcaaactgaa

SEQ ID NO: 2625011 - DNA, 19 bp, Homo sapiens
ttgactcacctgttacttg

SEQ ID NO: 2625012 - DNA, 21 bp, Homo sapiens
ttgactcttttgccattaaac

SEQ ID NO: 2625013 - DNA, 12 bp, Homo sapiens
ttgactgttttt

SEQ ID NO: 2625014 - DNA, 15 bp, Homo sapiens
ttgacttattttctc

SEQ ID NO: 2625015 - DNA, 19 bp, Homo sapiens
ttgacttgacagaacactg

SEQ ID NO: 2625016 - DNA, 21 bp, Homo sapiens
ttgacttgacagaacactgtc

SEQ ID NO: 2625017 - DNA, 14 bp, Homo sapiens
ttgactttcaggta

SEQ ID NO: 2625018 - DNA, 21 bp, Homo sapiens
ttgactttcaggtactaaata

SEQ ID NO: 2625019 - DNA, 17 bp, Homo sapiens
ttgactttttgcattta

SEQ ID NO: 2625020 - DNA, 21 bp, Homo sapiens
ttgagaactgcatatgtttcg

SEQ ID NO: 2625021 - DNA, 18 bp, Homo sapiens
ttgagaagttttgtacag

SEQ ID NO: 2625022 - DNA, 23 bp, Homo sapiens
ttgagagaaatatgaagaactga

SEQ ID NO: 2625023 - DNA, 17 bp, Homo sapiens
ttgagagaccaggcaaa

SEQ ID NO: 2625024 - DNA, 19 bp, Homo sapiens
ttgagcccacaaagcctta

SEQ ID NO: 2625025 - DNA, 13 bp, Homo sapiens
ttgagcccaggag

SEQ ID NO: 2625026 - DNA, 23 bp, Homo sapiens
ttgagccccaagtcctgaagagg

SEQ ID NO: 2625027 - DNA, 11 bp, Homo sapiens
ttgagcctggg

SEQ ID NO: 2625028 - DNA, 21 bp, Homo sapiens
ttgagctgttgcctcagtccc

SEQ ID NO: 2625029 - DNA, 18 bp, Homo sapiens
ttgagctgttttccctga

SEQ ID NO: 2625030 - DNA, 13 bp, Homo sapiens
ttgaggaaaacaa

SEQ ID NO: 2625031 - DNA, 23 bp, Homo sapiens
ttgaggaaaacaagcattcacaa

SEQ ID NO: 2625032 - DNA, 17 bp, Homo sapiens
ttgaggactatggaaat

SEQ ID NO: 2625033 - DNA, 12 bp, Homo sapiens
ttgaggagcccc

SEQ ID NO: 2625034 - DNA, 16 bp, Homo sapiens
ttgaggagccccagct

SEQ ID NO: 2625035 - DNA, 21 bp, Homo sapiens
ttgaggatatattttcacttt

SEQ ID NO: 2625036 - DNA, 22 bp, Homo sapiens
ttgaggatatattttcactttg

SEQ ID NO: 2625037 - DNA, 15 bp, Homo sapiens
ttgagggcccagagc

SEQ ID NO: 2625038 - DNA, 23 bp, Homo sapiens
ttgagggcccagagcaggaagca

SEQ ID NO: 2625039 - DNA, 13 bp, Homo sapiens
ttgagggtaggag

SEQ ID NO: 2625040 - DNA, 13 bp, Homo sapiens
ttgagggttgggc

SEQ ID NO: 2625041 - DNA, 16 bp, Homo sapiens
ttgagggttgggctgg

SEQ ID NO: 2625042 - DNA, 21 bp, Homo sapiens
ttgaggtccagccctggctga

SEQ ID NO: 2625043 - DNA, 15 bp, Homo sapiens
ttgaggtctgttctt

SEQ ID NO: 2625044 - DNA, 16 bp, Homo sapiens
ttgaggtctgttcttt

SEQ ID NO: 2625045 - DNA, 17 bp, Homo sapiens
ttgaggtcttttgacat

SEQ ID NO: 2625046 - DNA, 19 bp, Homo sapiens
ttgaggtcttttgacatgt

SEQ ID NO: 2625047 - DNA, 22 bp, Homo sapiens
ttgaggtcttttgacatgtgga

SEQ ID NO: 2625048 - DNA, 23 bp, Homo sapiens
ttgaggtcttttgacatgtggaa

SEQ ID NO: 2625049 - DNA, 22 bp, Homo sapiens
ttgaggtggcactttttcattt

SEQ ID NO: 2625050 - DNA, 16 bp, Homo sapiens
ttgagtcaaaaaatct

SEQ ID NO: 2625051 - DNA, 17 bp, Homo sapiens
ttgagtgttttaagata

SEQ ID NO: 2625052 - DNA, 14 bp, Homo sapiens
ttgagttttcagtg

SEQ ID NO: 2625053 - DNA, 18 bp, Homo sapiens
ttgagttttcttctgtga

SEQ ID NO: 2625054 - DNA, 12 bp, Homo sapiens
ttgataaagttt

SEQ ID NO: 2625055 - DNA, 19 bp, Homo sapiens
ttgataaattccactggac

SEQ ID NO: 2625056 - DNA, 13 bp, Homo sapiens
ttgataactttgc

SEQ ID NO: 2625057 - DNA, 16 bp, Homo sapiens
ttgataagagggcaca

SEQ ID NO: 2625058 - DNA, 13 bp, Homo sapiens
ttgataatgttaa

SEQ ID NO: 2625059 - DNA, 21 bp, Homo sapiens
ttgataatgttaaatttgtaa

SEQ ID NO: 2625060 - DNA, 18 bp, Homo sapiens
ttgatagcacagaccctg

SEQ ID NO: 2625061 - DNA, 21 bp, Homo sapiens
ttgatagcacagaccctgccc

SEQ ID NO: 2625062 - DNA, 23 bp, Homo sapiens
ttgatagcacagaccctgccctg

SEQ ID NO: 2625063 - DNA, 14 bp, Homo sapiens
ttgatagctttatt

SEQ ID NO: 2625064 - DNA, 20 bp, Homo sapiens
ttgatatacttttttcttat

SEQ ID NO: 2625065 - DNA, 17 bp, Homo sapiens
ttgatatagaacagtgc

SEQ ID NO: 2625066 - DNA, 13 bp, Homo sapiens
ttgatatgaaaaa

SEQ ID NO: 2625067 - DNA, 16 bp, Homo sapiens
ttgatatgaaaaatat

SEQ ID NO: 2625068 - DNA, 19 bp, Homo sapiens
ttgatcattttccccccac

SEQ ID NO: 2625069 - DNA, 19 bp, Homo sapiens
ttgatcgcctttcccaggt

SEQ ID NO: 2625070 - DNA, 20 bp, Homo sapiens
ttgatgcattaaaagaaaat

SEQ ID NO: 2625071 - DNA, 17 bp, Homo sapiens
ttgatgctggagaggtt

SEQ ID NO: 2625072 - DNA, 14 bp, Homo sapiens
ttgatggagatatt

SEQ ID NO: 2625073 - DNA, 13 bp, Homo sapiens
ttgatgggttcta

SEQ ID NO: 2625074 - DNA, 19 bp, Homo sapiens
ttgatgtacagtctgtcat

SEQ ID NO: 2625075 - DNA, 20 bp, Homo sapiens
ttgatgtacagtctgtcatg

SEQ ID NO: 2625076 - DNA, 16 bp, Homo sapiens
ttgatgtgtgtctagg

SEQ ID NO: 2625077 - DNA, 13 bp, Homo sapiens
ttgatgttggctg

SEQ ID NO: 2625078 - DNA, 22 bp, Homo sapiens
ttgatgtttgtggcctcagaat

SEQ ID NO: 2625079 - DNA, 20 bp, Homo sapiens
ttgattaaattcttgcaaag

SEQ ID NO: 2625080 - DNA, 21 bp, Homo sapiens
ttgattaaattcttgcaaagt

SEQ ID NO: 2625081 - DNA, 18 bp, Homo sapiens
ttgattaatccagaataa

SEQ ID NO: 2625082 - DNA, 17 bp, Homo sapiens
ttgattattcagtgtca

SEQ ID NO: 2625083 - DNA, 14 bp, Homo sapiens
ttgattcagacagc

SEQ ID NO: 2625084 - DNA, 16 bp, Homo sapiens
ttgattcagacagctg

SEQ ID NO: 2625085 - DNA, 23 bp, Homo sapiens
ttgattcagacagctgcctggga

SEQ ID NO: 2625086 - DNA, 16 bp, Homo sapiens
ttgattcagctctgca

SEQ ID NO: 2625087 - DNA, 17 bp, Homo sapiens
ttgattgtcagctacta

SEQ ID NO: 2625088 - DNA, 19 bp, Homo sapiens
ttgcaaaatagcatttgtt

SEQ ID NO: 2625089 - DNA, 11 bp, Homo sapiens
ttgcaaaattt

SEQ ID NO: 2625090 - DNA, 21 bp, Homo sapiens
ttgcaaaatttccagtacctt

SEQ ID NO: 2625091 - DNA, 12 bp, Homo sapiens
ttgcaaacttta

SEQ ID NO: 2625092 - DNA, 22 bp, Homo sapiens
ttgcaaaggagctcactgtggt

SEQ ID NO: 2625093 - DNA, 22 bp, Homo sapiens
ttgtgactaattgtataacagg

SEQ ID NO: 2625094 - DNA, 18 bp, Homo sapiens
ttgtgatacaatgctgtg

SEQ ID NO: 2625095 - DNA, 16 bp, Homo sapiens
ttgtgatatggagccc

SEQ ID NO: 2625096 - DNA, 17 bp, Homo sapiens
ttgtgatatggagccct

SEQ ID NO: 2625097 - DNA, 17 bp, Homo sapiens
ttgtgattatttcactt

SEQ ID NO: 2625098 - DNA, 22 bp, Homo sapiens
ttgtgattatttcactttagat

SEQ ID NO: 2625099 - DNA, 23 bp, Homo sapiens
ttgtgattcaatctgtaaactgt

SEQ ID NO: 2625100 - DNA, 11 bp, Homo sapiens
ttgtgatttga

SEQ ID NO: 2625101 - DNA, 22 bp, Homo sapiens
ttgtgatttgactgtttttacc

SEQ ID NO: 2625102 - DNA, 17 bp, Homo sapiens
ttgtgatttttgtaatt

SEQ ID NO: 2625103 - DNA, 17 bp, Homo sapiens
ttgtgcattatctagat

SEQ ID NO: 2625104 - DNA, 17 bp, Homo sapiens
ttgtgccaatatgtatt

SEQ ID NO: 2625105 - DNA, 22 bp, Homo sapiens
ttgtgccatagtcacatggcct

SEQ ID NO: 2625106 - DNA, 12 bp, Homo sapiens
ttgtgcccctgc

SEQ ID NO: 2625107 - DNA, 22 bp, Homo sapiens
ttgtgctgatcgtgctaaattt

SEQ ID NO: 2625108 - DNA, 16 bp, Homo sapiens
ttgtgcttttcctatt

SEQ ID NO: 2625109 - DNA, 14 bp, Homo sapiens
ttgtggagccccac

SEQ ID NO: 2625110 - DNA, 18 bp, Homo sapiens
ttgtggatgttttaattc

SEQ ID NO: 2625111 - DNA, 21 bp, Homo sapiens
ttgtggatgttttaattccat

SEQ ID NO: 2625112 - DNA, 23 bp, Homo sapiens
ttgtggatgttttaattccatga

SEQ ID NO: 2625113 - DNA, 21 bp, Homo sapiens
ttgtggatttaacagaaatgt

SEQ ID NO: 2625114 - DNA, 22 bp, Homo sapiens
ttgtggatttaacagaaatgta

SEQ ID NO: 2625115 - DNA, 13 bp, Homo sapiens
ttgtggcctggga

SEQ ID NO: 2625116 - DNA, 21 bp, Homo sapiens
ttgtggcctgggcctcctcac

SEQ ID NO: 2625117 - DNA, 21 bp, Homo sapiens
ttgtgtaatagaaaactgaaa

SEQ ID NO: 2625118 - DNA, 13 bp, Homo sapiens
ttgtgtatttaac

SEQ ID NO: 2625119 - DNA, 14 bp, Homo sapiens
ttgtgtatttaaca

SEQ ID NO: 2625120 - DNA, 10 bp, Homo sapiens
ttgtgtgtgg

SEQ ID NO: 2625121 - DNA, 13 bp, Homo sapiens
ttgtgtgtgggag

SEQ ID NO: 2625122 - DNA, 19 bp, Homo sapiens
ttgtgtgtgggctgtgagt

SEQ ID NO: 2625123 - DNA, 12 bp, Homo sapiens
ttgtgtgtgtgc

SEQ ID NO: 2625124 - DNA, 20 bp, Homo sapiens
ttgtgtgttatttaaatgag

SEQ ID NO: 2625125 - DNA, 13 bp, Homo sapiens
ttgtgttactaag

SEQ ID NO: 2625126 - DNA, 13 bp, Homo sapiens
ttgtgttctaata

SEQ ID NO: 2625127 - DNA, 21 bp, Homo sapiens
ttgtgtttttaatttatttat

SEQ ID NO: 2625128 - DNA, 18 bp, Homo sapiens
ttgttaactcttgtctat

SEQ ID NO: 2625129 - DNA, 19 bp, Homo sapiens
ttgttaataaaagtacatg

SEQ ID NO: 2625130 - DNA, 21 bp, Homo sapiens
ttgttaataaaagtacatgtt

SEQ ID NO: 2625131 - DNA, 19 bp, Homo sapiens
ttgttaatgaaaatgtcag

SEQ ID NO: 2625132 - DNA, 21 bp, Homo sapiens
ttgttacaggcaccgagaatg

SEQ ID NO: 2625133 - DNA, 14 bp, Homo sapiens
ttgttacattttta

SEQ ID NO: 2625134 - DNA, 22 bp, Homo sapiens
ttgttagtatgaggcatttgtt

SEQ ID NO: 2625135 - DNA, 14 bp, Homo sapiens
ttgttatggcttaa

SEQ ID NO: 2625136 - DNA, 19 bp, Homo sapiens
ttgttatggcttaatgaca

SEQ ID NO: 2625137 - DNA, 15 bp, Homo sapiens
ttgttattttgcaac

SEQ ID NO: 2625138 - DNA, 13 bp, Homo sapiens
ttgttcacactct

SEQ ID NO: 2625139 - DNA, 16 bp, Homo sapiens
ttgttccaagacattg

SEQ ID NO: 2625140 - DNA, 17 bp, Homo sapiens
ttgttcttaattgcact

SEQ ID NO: 2625141 - DNA, 17 bp, Homo sapiens
ttgttcttggtttgtaa

SEQ ID NO: 2625142 - DNA, 19 bp, Homo sapiens
ttgttcttggtttgtaaat

SEQ ID NO: 2625143 - DNA, 18 bp, Homo sapiens
ttgttgacagttctgaag

SEQ ID NO: 2625144 - DNA, 22 bp, Homo sapiens
ttgttgaggtggtctgaatgtt

SEQ ID NO: 2625145 - DNA, 20 bp, Homo sapiens
ttgttgataaattccactgg

SEQ ID NO: 2625146 - DNA, 18 bp, Homo sapiens
ttgttgctgttgatgttt

SEQ ID NO: 2625147 - DNA, 15 bp, Homo sapiens
ttgttggagcctgca

SEQ ID NO: 2625148 - DNA, 20 bp, Homo sapiens
ttgttggatcttcaatggct

SEQ ID NO: 2625149 - DNA, 21 bp, Homo sapiens
ttgttggcctccggcctcccc

SEQ ID NO: 2625150 - DNA, 19 bp, Homo sapiens
ttgttgggattcctgaccc

SEQ ID NO: 2625151 - DNA, 23 bp, Homo sapiens
ttgttgtttgccatactttgtct

SEQ ID NO: 2625152 - DNA, 23 bp, Homo sapiens
ttgtttacttaaagatttatcaa

SEQ ID NO: 2625153 - DNA, 18 bp, Homo sapiens
ttgtttatacctttgcct

SEQ ID NO: 2625154 - DNA, 20 bp, Homo sapiens
ttgtttcattgactatcaaa

SEQ ID NO: 2625155 - DNA, 16 bp, Homo sapiens
ttgtttctccccctgg

SEQ ID NO: 2625156 - DNA, 17 bp, Homo sapiens
ttgtttctccccctggg

SEQ ID NO: 2625157 - DNA, 19 bp, Homo sapiens
ttgtttcttccaaagcaca

SEQ ID NO: 2625158 - DNA, 23 bp, Homo sapiens
ttgtttgatgcattaaaagaaaa

SEQ ID NO: 2625159 - DNA, 15 bp, Homo sapiens
ttgtttgcttattgt

SEQ ID NO: 2625160 - DNA, 19 bp, Homo sapiens
ttgtttgtatgtataattc

SEQ ID NO: 2625161 - DNA, 19 bp, Homo sapiens
ttgttttgacggatgattg

SEQ ID NO: 2625162 - DNA, 14 bp, Homo sapiens
ttgttttgttttaa

SEQ ID NO: 2625163 - DNA, 21 bp, Homo sapiens
tttaaaaagaaacaagatgct

SEQ ID NO: 2625164 - DNA, 12 bp, Homo sapiens
tttaaaaatcat

SEQ ID NO: 2625165 - DNA, 15 bp, Homo sapiens
tttaaaacatgtaat

SEQ ID NO: 2625166 - DNA, 21 bp, Homo sapiens
tttaaaacccatttaaatttt

SEQ ID NO: 2625167 - DNA, 23 bp, Homo sapiens
tttaaaagaatgggcagttacat

SEQ ID NO: 2625168 - DNA, 14 bp, Homo sapiens
tttaaaagattcat

SEQ ID NO: 2625169 - DNA, 16 bp, Homo sapiens
tttaaaatcatttctg

SEQ ID NO: 2625170 - DNA, 15 bp, Homo sapiens
tttaaaatctgtcac

SEQ ID NO: 2625171 - DNA, 12 bp, Homo sapiens
tttaaaatgatt

SEQ ID NO: 2625172 - DNA, 20 bp, Homo sapiens
tttaaacaaaatagaagctg

SEQ ID NO: 2625173 - DNA, 12 bp, Homo sapiens
tttaaacaaatt

SEQ ID NO: 2625174 - DNA, 14 bp, Homo sapiens
tttaaacaaattca

SEQ ID NO: 2625175 - DNA, 13 bp, Homo sapiens
tttaaacagcagt

SEQ ID NO: 2625176 - DNA, 20 bp, Homo sapiens
tttaaacatggttacaatca

SEQ ID NO: 2625177 - DNA, 15 bp, Homo sapiens
tttaaactgattcat

SEQ ID NO: 2625178 - DNA, 15 bp, Homo sapiens
tttaaactgtgtaca

SEQ ID NO: 2625179 - DNA, 19 bp, Homo sapiens
tttaaactgtgtacataac

SEQ ID NO: 2625180 - DNA, 15 bp, Homo sapiens
tttaaagagaggtta

SEQ ID NO: 2625181 - DNA, 12 bp, Homo sapiens
tttaaaggaaaa

SEQ ID NO: 2625182 - DNA, 15 bp, Homo sapiens
tttaaaggaaaaaat

SEQ ID NO: 2625183 - DNA, 17 bp, Homo sapiens
tttaaagtgattaaacg

SEQ ID NO: 2625184 - DNA, 19 bp, Homo sapiens
tttaaagtgtttctgttat

SEQ ID NO: 2625185 - DNA, 13 bp, Homo sapiens
tttaaataaagta

SEQ ID NO: 2625186 - DNA, 22 bp, Homo sapiens
tttaaataaagtatcatgcatt

SEQ ID NO: 2625187 - DNA, 13 bp, Homo sapiens
tttaaatataatt

SEQ ID NO: 2625188 - DNA, 15 bp, Homo sapiens
tttaaatataattct

SEQ ID NO: 2625189 - DNA, 21 bp, Homo sapiens
tttaaatataattctgtaaat

SEQ ID NO: 2625190 - DNA, 18 bp, Homo sapiens
tttaaatgcataaatgca

SEQ ID NO: 2625191 - DNA, 16 bp, Homo sapiens
tttaaatgtaaaacat

SEQ ID NO: 2625192 - DNA, 18 bp, Homo sapiens
tttaacaataactactgt

SEQ ID NO: 2625193 - DNA, 22 bp, Homo sapiens
tttaacaataactactgtgttc

SEQ ID NO: 2625194 - DNA, 18 bp, Homo sapiens
tttaacacctgatgtgta

SEQ ID NO: 2625195 - DNA, 21 bp, Homo sapiens
tttaacacctgatgtgtacat

SEQ ID NO: 2625196 - DNA, 14 bp, Homo sapiens
tttaacagaaatgt

SEQ ID NO: 2625197 - DNA, 24 bp, Homo sapiens
tttaactcaatattttccatgaaa

SEQ ID NO: 2625198 - DNA, 12 bp, Homo sapiens
tttaactcagat

SEQ ID NO: 2625199 - DNA, 23 bp, Homo sapiens
tttaactcgagaccttttcaact

SEQ ID NO: 2625200 - DNA, 12 bp, Homo sapiens
tttaactctgtc

SEQ ID NO: 2625201 - DNA, 14 bp, Homo sapiens
tttaactttaagtt

SEQ ID NO: 2625202 - DNA, 22 bp, Homo sapiens
tttaagaaaaaataacacacat

SEQ ID NO: 2625203 - DNA, 22 bp, Homo sapiens
tttaagaaaaaggatgcacaga

SEQ ID NO: 2625204 - DNA, 22 bp, Homo sapiens
tttaagacagtcccatcaaaac

SEQ ID NO: 2625205 - DNA, 17 bp, Homo sapiens
tttaagacgtgtttgtg

SEQ ID NO: 2625206 - DNA, 14 bp, Homo sapiens
tttaagactgtaat

SEQ ID NO: 2625207 - DNA, 15 bp, Homo sapiens
tttaagataatagtt

SEQ ID NO: 2625208 - DNA, 17 bp, Homo sapiens
tttaagatttttctcaa

SEQ ID NO: 2625209 - DNA, 13 bp, Homo sapiens
tttaagcagctct

SEQ ID NO: 2625210 - DNA, 14 bp, Homo sapiens
tttaagcattgttt

SEQ ID NO: 2625211 - DNA, 21 bp, Homo sapiens
tttaagcattgtttgcttatt

SEQ ID NO: 2625212 - DNA, 23 bp, Homo sapiens
tttaagcattgtttgcttattgt

SEQ ID NO: 2625213 - DNA, 20 bp, Homo sapiens
tttaagcccatcaattatag

SEQ ID NO: 2625214 - DNA, 21 bp, Homo sapiens
tttaagctgttactgtcttca

SEQ ID NO: 2625215 - DNA, 22 bp, Homo sapiens
tttaagcttatttaattaaaaa

SEQ ID NO: 2625216 - DNA, 20 bp, Homo sapiens
tttaagggtttgtggaaaat

SEQ ID NO: 2625217 - DNA, 12 bp, Homo sapiens
tttaagtattta

SEQ ID NO: 2625218 - DNA, 13 bp, Homo sapiens
tttaagtatttat

SEQ ID NO: 2625219 - DNA, 15 bp, Homo sapiens
tttaagtatttatat

SEQ ID NO: 2625220 - DNA, 20 bp, Homo sapiens
tttaagtatttatatattta

SEQ ID NO: 2625221 - DNA, 20 bp, Homo sapiens
tttaagtgcgtgtgtagagt

SEQ ID NO: 2625222 - DNA, 16 bp, Homo sapiens
tttaagtgctgcattt

SEQ ID NO: 2625223 - DNA, 19 bp, Homo sapiens
tttaagtgctgcatttaaa

SEQ ID NO: 2625224 - DNA, 23 bp, Homo sapiens
tttaagttctggatgcatttctc

SEQ ID NO: 2625225 - DNA, 14 bp, Homo sapiens
tttaagttgtttgc

SEQ ID NO: 2625226 - DNA, 17 bp, Homo sapiens
tttaataaaataattct

SEQ ID NO: 2625227 - DNA, 14 bp, Homo sapiens
tttaataacaattg

SEQ ID NO: 2625228 - DNA, 22 bp, Homo sapiens
tttaataacattaccttactgt

SEQ ID NO: 2625229 - DNA, 23 bp, Homo sapiens
tttaataacattaccttactgtg

SEQ ID NO: 2625230 - DNA, 19 bp, Homo sapiens
tttaatagaatataattat

SEQ ID NO: 2625231 - DNA, 14 bp, Homo sapiens
tttaatagtgttaa

SEQ ID NO: 2625232 - DNA, 17 bp, Homo sapiens
tttaatagtgttaatca

SEQ ID NO: 2625233 - DNA, 15 bp, Homo sapiens
tttaatataaagcct

SEQ ID NO: 2625234 - DNA, 14 bp, Homo sapiens
tttaatatagctat

SEQ ID NO: 2625235 - DNA, 18 bp, Homo sapiens
tttaatatgggttctttt

SEQ ID NO: 2625236 - DNA, 15 bp, Homo sapiens
tttaatattgagaaa

SEQ ID NO: 2625237 - DNA, 22 bp, Homo sapiens
tttcttacaggcacaaaatgat

SEQ ID NO: 2625238 - DNA, 20 bp, Homo sapiens
tttcttactgatttttaagt

SEQ ID NO: 2625239 - DNA, 12 bp, Homo sapiens
tttcttagcttt

SEQ ID NO: 2625240 - DNA, 13 bp, Homo sapiens
tttcttagctttt

SEQ ID NO: 2625241 - DNA, 17 bp, Homo sapiens
tttcttatcttctgcaa

SEQ ID NO: 2625242 - DNA, 13 bp, Homo sapiens
tttcttcctctgc

SEQ ID NO: 2625243 - DNA, 22 bp, Homo sapiens
tttcttgactcttgttttcagt

SEQ ID NO: 2625244 - DNA, 22 bp, Homo sapiens
tttcttgaggtactctgcacat

SEQ ID NO: 2625245 - DNA, 17 bp, Homo sapiens
tttcttggttcataaat

SEQ ID NO: 2625246 - DNA, 19 bp, Homo sapiens
tttcttgtaatttaaacag

SEQ ID NO: 2625247 - DNA, 14 bp, Homo sapiens
tttctttaaaagaa

SEQ ID NO: 2625248 - DNA, 15 bp, Homo sapiens
tttctttaaaagaat

SEQ ID NO: 2625249 - DNA, 20 bp, Homo sapiens
tttctttaaaagaatgggca

SEQ ID NO: 2625250 - DNA, 15 bp, Homo sapiens
tttctttaagaaagt

SEQ ID NO: 2625251 - DNA, 16 bp, Homo sapiens
tttctttaagaaagta

SEQ ID NO: 2625252 - DNA, 20 bp, Homo sapiens
tttctttagagcattgccat

SEQ ID NO: 2625253 - DNA, 14 bp, Homo sapiens
tttctttcaaaatt

SEQ ID NO: 2625254 - DNA, 13 bp, Homo sapiens
tttctttctagtg

SEQ ID NO: 2625255 - DNA, 16 bp, Homo sapiens
tttctttgaatgcttt

SEQ ID NO: 2625256 - DNA, 13 bp, Homo sapiens
tttctttgtggct

SEQ ID NO: 2625257 - DNA, 14 bp, Homo sapiens
tttcttttcacata

SEQ ID NO: 2625258 - DNA, 23 bp, Homo sapiens
tttcttttggtaaagactggctt

SEQ ID NO: 2625259 - DNA, 14 bp, Homo sapiens
tttctttttcttct

SEQ ID NO: 2625260 - DNA, 16 bp, Homo sapiens
tttgaaaaattcctat

SEQ ID NO: 2625261 - DNA, 13 bp, Homo sapiens
tttgaaaagctat

SEQ ID NO: 2625262 - DNA, 16 bp, Homo sapiens
tttgaaacaatactca

SEQ ID NO: 2625263 - DNA, 19 bp, Homo sapiens
tttgaaatagtctgtgtga

SEQ ID NO: 2625264 - DNA, 20 bp, Homo sapiens
tttgaaatagtctgtgtgaa

SEQ ID NO: 2625265 - DNA, 15 bp, Homo sapiens
tttgaaatcagcata

SEQ ID NO: 2625266 - DNA, 21 bp, Homo sapiens
tttgaactcagatctgtctga

SEQ ID NO: 2625267 - DNA, 19 bp, Homo sapiens
tttgaactgataaagatga

SEQ ID NO: 2625268 - DNA, 22 bp, Homo sapiens
tttgaagatgccgcatttggat

SEQ ID NO: 2625269 - DNA, 14 bp, Homo sapiens
tttgaatgacaaag

SEQ ID NO: 2625270 - DNA, 14 bp, Homo sapiens
tttgacaaggggca

SEQ ID NO: 2625271 - DNA, 19 bp, Homo sapiens
tttgacagtgttgaaaatg

SEQ ID NO: 2625272 - DNA, 13 bp, Homo sapiens
tttgacatgtgga

SEQ ID NO: 2625273 - DNA, 17 bp, Homo sapiens
tttgacatgtggaaagt

SEQ ID NO: 2625274 - DNA, 19 bp, Homo sapiens
tttgacctctgcagcaata

SEQ ID NO: 2625275 - DNA, 14 bp, Homo sapiens
tttgacgccatccc

SEQ ID NO: 2625276 - DNA, 16 bp, Homo sapiens
tttgacgccatcccag

SEQ ID NO: 2625277 - DNA, 18 bp, Homo sapiens
tttgactcttgcaatcca

SEQ ID NO: 2625278 - DNA, 12 bp, Homo sapiens
tttgactctttt

SEQ ID NO: 2625279 - DNA, 21 bp, Homo sapiens
tttgagaaacaacaatttcta

SEQ ID NO: 2625280 - DNA, 16 bp, Homo sapiens
tttgagaaattaagta

SEQ ID NO: 2625281 - DNA, 15 bp, Homo sapiens
tttgagacagtttct

SEQ ID NO: 2625282 - DNA, 20 bp, Homo sapiens
tttgagacagtttcttagct

SEQ ID NO: 2625283 - DNA, 19 bp, Homo sapiens
tttgagaccagcctgggca

SEQ ID NO: 2625284 - DNA, 17 bp, Homo sapiens
tttgagatcagcctggg

SEQ ID NO: 2625285 - DNA, 15 bp, Homo sapiens
tttgagcaactttct

SEQ ID NO: 2625286 - DNA, 15 bp, Homo sapiens
tttgagcagggctca

SEQ ID NO: 2625287 - DNA, 20 bp, Homo sapiens
tttgagctctgcagcccagg

SEQ ID NO: 2625288 - DNA, 20 bp, Homo sapiens
tttgaggatatattttcact

SEQ ID NO: 2625289 - DNA, 22 bp, Homo sapiens
tttgaggatatattttcacttt

SEQ ID NO: 2625290 - DNA, 14 bp, Homo sapiens
tttgagtgctctga

SEQ ID NO: 2625291 - DNA, 18 bp, Homo sapiens
tttgataatcaactgggc

SEQ ID NO: 2625292 - DNA, 20 bp, Homo sapiens
tttgataatcaactgggctg

SEQ ID NO: 2625293 - DNA, 14 bp, Homo sapiens
tttgataatgttaa

SEQ ID NO: 2625294 - DNA, 17 bp, Homo sapiens
tttgataatgttaaatt

SEQ ID NO: 2625295 - DNA, 18 bp, Homo sapiens
tttgatagtattgtgcat

SEQ ID NO: 2625296 - DNA, 15 bp, Homo sapiens
tttgatgctgtttga

SEQ ID NO: 2625297 - DNA, 17 bp, Homo sapiens
tttgatgtttgtggcct

SEQ ID NO: 2625298 - DNA, 19 bp, Homo sapiens
tttgatgtttgtggcctca

SEQ ID NO: 2625299 - DNA, 21 bp, Homo sapiens
tttgattaaattcttgcaaag

SEQ ID NO: 2625300 - DNA, 23 bp, Homo sapiens
tttgattaaattcttgcaaagta

SEQ ID NO: 2625301 - DNA, 15 bp, Homo sapiens
tttgattcagacagc

SEQ ID NO: 2625302 - DNA, 22 bp, Homo sapiens
tttgattcagacagctgcctgg

SEQ ID NO: 2625303 - DNA, 12 bp, Homo sapiens
tttgatttatgc

SEQ ID NO: 2625304 - DNA, 13 bp, Homo sapiens
tttgatttctatt

SEQ ID NO: 2625305 - DNA, 12 bp, Homo sapiens
tttgcaaaattt

SEQ ID NO: 2625306 - DNA, 20 bp, Homo sapiens
tttgcaagggaaaagtctct

SEQ ID NO: 2625307 - DNA, 21 bp, Homo sapiens
tttgcaagggaaaagtctctt

SEQ ID NO: 2625308 - DNA, 19 bp, Homo sapiens
tttgcaatggctatatggc

SEQ ID NO: 2625309 - DNA, 15 bp, Homo sapiens
tttgcacccctccca

SEQ ID NO: 2625310 - DNA, 16 bp, Homo sapiens
tttgcacccctcccat

SEQ ID NO: 2625311 - DNA, 22 bp, Homo sapiens
tttgcactgagggccacactat

SEQ ID NO: 2625312 - DNA, 17 bp, Homo sapiens
tttgcactgtatgctgg

SEQ ID NO: 2625313 - DNA, 15 bp, Homo sapiens
tttgcagatgacaaa

SEQ ID NO: 2625314 - DNA, 16 bp, Homo sapiens
tttgcagatgacaaaa

SEQ ID NO: 2625315 - DNA, 21 bp, Homo sapiens
tttgcagcagtgagtctcttc

SEQ ID NO: 2625316 - DNA, 21 bp, Homo sapiens
tttgcagctgagagaaaataa

SEQ ID NO: 2625317 - DNA, 21 bp, Homo sapiens
tttgcagtagagtcatctcca

SEQ ID NO: 2625318 - DNA, 16 bp, Homo sapiens
tttgcataacaattcc

SEQ ID NO: 2625319 - DNA, 17 bp, Homo sapiens
tttgcataacaattcct

SEQ ID NO: 2625320 - DNA, 18 bp, Homo sapiens
tttgcataacaattcctc

SEQ ID NO: 2625321 - DNA, 21 bp, Homo sapiens
tttgcatagattccctgagca

SEQ ID NO: 2625322 - DNA, 22 bp, Homo sapiens
tttgcataggtgatctcattta

SEQ ID NO: 2625323 - DNA, 23 bp, Homo sapiens
tttgcatagtaccaatcatttta

SEQ ID NO: 2625324 - DNA, 23 bp, Homo sapiens
tttgcatggcacttgcatctgtg

SEQ ID NO: 2625325 - DNA, 14 bp, Homo sapiens
tttgcattcaaatt

SEQ ID NO: 2625326 - DNA, 17 bp, Homo sapiens
tttgcattcaaattaag

SEQ ID NO: 2625327 - DNA, 16 bp, Homo sapiens
tttgcatttaaaacag

SEQ ID NO: 2625328 - DNA, 17 bp, Homo sapiens
tttgcatttaaaacaga

SEQ ID NO: 2625329 - DNA, 19 bp, Homo sapiens
tttgccaccctcatgctgt

SEQ ID NO: 2625330 - DNA, 21 bp, Homo sapiens
tttgccagaacagtttgtaca

SEQ ID NO: 2625331 - DNA, 20 bp, Homo sapiens
tttgccagctgctgctggat

SEQ ID NO: 2625332 - DNA, 15 bp, Homo sapiens
tttgccagtgggaac

SEQ ID NO: 2625333 - DNA, 21 bp, Homo sapiens
tttgccctggtagggcagtaa

SEQ ID NO: 2625334 - DNA, 15 bp, Homo sapiens
tttgcccttaaggac

SEQ ID NO: 2625335 - DNA, 13 bp, Homo sapiens
tttgcctctgcct

SEQ ID NO: 2625336 - DNA, 17 bp, Homo sapiens
tttgcctcttccagtct

SEQ ID NO: 2625337 - DNA, 20 bp, Homo sapiens
tttgcctcttttctctgtgc

SEQ ID NO: 2625338 - DNA, 16 bp, Homo sapiens
tttgcctgttcagtta

SEQ ID NO: 2625339 - DNA, 20 bp, Homo sapiens
tttgcctgttcagttacaga

SEQ ID NO: 2625340 - DNA, 18 bp, Homo sapiens
tttgctatcttaattttg

SEQ ID NO: 2625341 - DNA, 19 bp, Homo sapiens
tttgctatgagctggggat

SEQ ID NO: 2625342 - DNA, 16 bp, Homo sapiens
tttgctattgtaaata

SEQ ID NO: 2625343 - DNA, 10 bp, Homo sapiens
tttgctgcca

SEQ ID NO: 2625344 - DNA, 15 bp, Homo sapiens
tttgctggaataagt

SEQ ID NO: 2625345 - DNA, 21 bp, Homo sapiens
tttgctgtagaagatggcact

SEQ ID NO: 2625346 - DNA, 15 bp, Homo sapiens
tttgcttattgttcc

SEQ ID NO: 2625347 - DNA, 16 bp, Homo sapiens
tttgcttattgttcca

SEQ ID NO: 2625348 - DNA, 19 bp, Homo sapiens
tttgcttattgttccaaga

SEQ ID NO: 2625349 - DNA, 16 bp, Homo sapiens
tttgcttgaaagaaaa

SEQ ID NO: 2625350 - DNA, 17 bp, Homo sapiens
tttgcttgcagtagatt

SEQ ID NO: 2625351 - DNA, 15 bp, Homo sapiens
tttgctttgtgattt

SEQ ID NO: 2625352 - DNA, 22 bp, Homo sapiens
tttgcttttcctttgtttttat

SEQ ID NO: 2625353 - DNA, 12 bp, Homo sapiens
tttggaaaataa

SEQ ID NO: 2625354 - DNA, 14 bp, Homo sapiens
tttggaggtgctta

SEQ ID NO: 2625355 - DNA, 20 bp, Homo sapiens
tttggatataggtcagtgag

SEQ ID NO: 2625356 - DNA, 21 bp, Homo sapiens
tttggatgggagtgagacaga

SEQ ID NO: 2625357 - DNA, 20 bp, Homo sapiens
tttggattcttatgtagcag

SEQ ID NO: 2625358 - DNA, 11 bp, Homo sapiens
tttggcactgg

SEQ ID NO: 2625359 - DNA, 13 bp, Homo sapiens
tttggcaggtgca

SEQ ID NO: 2625360 - DNA, 20 bp, Homo sapiens
tttggcatctgtttaaagta

SEQ ID NO: 2625361 - DNA, 12 bp, Homo sapiens
tttggcccccga

SEQ ID NO: 2625362 - DNA, 17 bp, Homo sapiens
tttggcctgcactaatt

SEQ ID NO: 2625363 - DNA, 14 bp, Homo sapiens
tttggcgggccaag

SEQ ID NO: 2625364 - DNA, 17 bp, Homo sapiens
tttggcgggccaaggac

SEQ ID NO: 2625365 - DNA, 12 bp, Homo sapiens
tttgggaagggg

SEQ ID NO: 2625366 - DNA, 18 bp, Homo sapiens
tttggggcgaggcagagg

SEQ ID NO: 2625367 - DNA, 22 bp, Homo sapiens
tttggggtacccactgctctgg

SEQ ID NO: 2625368 - DNA, 20 bp, Homo sapiens
tttggtctttaatgaaaagc

SEQ ID NO: 2625369 - DNA, 19 bp, Homo sapiens
tttggtggtttcagaaatg

SEQ ID NO: 2625370 - DNA, 19 bp, Homo sapiens
tttggtgtgtggagatgca

SEQ ID NO: 2625371 - DNA, 12 bp, Homo sapiens
tttggtgtgttc

SEQ ID NO: 2625372 - DNA, 22 bp, Homo sapiens
tttggttaagtctgttttatga

SEQ ID NO: 2625373 - DNA, 13 bp, Homo sapiens
tttggttctaata

SEQ ID NO: 2625374 - DNA, 17 bp, Homo sapiens
tttggttgaataaacta

SEQ ID NO: 2625375 - DNA, 17 bp, Homo sapiens
tttgtaaattaactttt

SEQ ID NO: 2625376 - DNA, 17 bp, Homo sapiens
tttgtaaatttatgtga

SEQ ID NO: 2625377 - DNA, 15 bp, Homo sapiens
tttgtaagatgctgg

SEQ ID NO: 2625378 - DNA, 19 bp, Homo sapiens
tttgtacagacgtatgctt

SEQ ID NO: 2625379 - DNA, 17 bp, Homo sapiens
tttgtacagtttgctgt

SEQ ID NO: 2625380 - DNA, 18 bp, Homo sapiens
tttgtacagtttgctgta

SEQ ID NO: 2625381 - DNA, 19 bp, Homo sapiens
tttgtacatatgtaaaata

SEQ ID NO: 2625382 - DNA, 13 bp, Homo sapiens
aaaaaaaaagttc

SEQ ID NO: 2625383 - DNA, 10 bp, Homo sapiens
aaaaaaagaa

SEQ ID NO: 2625384 - DNA, 12 bp, Homo sapiens
aaaaaaagtatt

SEQ ID NO: 2625385 - DNA, 14 bp, Homo sapiens
aaaaaaagtattat

SEQ ID NO: 2625386 - DNA, 13 bp, Homo sapiens
aaaaaaatgctga

SEQ ID NO: 2625387 - DNA, 11 bp, Homo sapiens
aaaaaaattta

SEQ ID NO: 2625388 - DNA, 15 bp, Homo sapiens
aaaaaacagaggcca

SEQ ID NO: 2625389 - DNA, 19 bp, Homo sapiens
aaaaaactcgaggactgta

SEQ ID NO: 2625390 - DNA, 22 bp, Homo sapiens
aaaaaactgctgactgttttct

SEQ ID NO: 2625391 - DNA, 9 bp, Homo sapiens
aaaaaagaa

SEQ ID NO: 2625392 - DNA, 19 bp, Homo sapiens
aaaaaaggacaatttcaaa

SEQ ID NO: 2625393 - DNA, 12 bp, Homo sapiens
aaaaaagttata

SEQ ID NO: 2625394 - DNA, 16 bp, Homo sapiens
aaaaaatactgccaga

SEQ ID NO: 2625395 - DNA, 20 bp, Homo sapiens
aaaaaatgctgaacattgca

SEQ ID NO: 2625396 - DNA, 22 bp, Homo sapiens
aaaaaattagaaattggctgga

SEQ ID NO: 2625397 - DNA, 12 bp, Homo sapiens
aaaaaatttaag

SEQ ID NO: 2625398 - DNA, 17 bp, Homo sapiens
aaaaacacctagcttta

SEQ ID NO: 2625399 - DNA, 15 bp, Homo sapiens
aaaaacagcattgct

SEQ ID NO: 2625400 - DNA, 19 bp, Homo sapiens
aaaaacagcattgctttct

SEQ ID NO: 2625401 - DNA, 14 bp, Homo sapiens
aaaaacatggcctt

SEQ ID NO: 2625402 - DNA, 14 bp, Homo sapiens
aaaaagacagggct

SEQ ID NO: 2625403 - DNA, 19 bp, Homo sapiens
aaaaagaggaaagaatgaa

SEQ ID NO: 2625404 - DNA, 13 bp, Homo sapiens
aaaaagcagctac

SEQ ID NO: 2625405 - DNA, 17 bp, Homo sapiens
aaaaagcctccagtcca

SEQ ID NO: 2625406 - DNA, 18 bp, Homo sapiens
aaaaagctcatattttgt

SEQ ID NO: 2625407 - DNA, 19 bp, Homo sapiens
aaaaagctcatattttgta

SEQ ID NO: 2625408 - DNA, 14 bp, Homo sapiens
aaaaaggaggaaga

SEQ ID NO: 2625409 - DNA, 12 bp, Homo sapiens
aaaaaggcagga

SEQ ID NO: 2625410 - DNA, 21 bp, Homo sapiens
aaaaagtaagtaccactcagg

SEQ ID NO: 2625411 - DNA, 19 bp, Homo sapiens
aaaaagtattattttccaa

SEQ ID NO: 2625412 - DNA, 22 bp, Homo sapiens
aaaaagtctacgctctcctttc

SEQ ID NO: 2625413 - DNA, 17 bp, Homo sapiens
aaaaagttatataggtt

SEQ ID NO: 2625414 - DNA, 14 bp, Homo sapiens
aaaaagtttccata

SEQ ID NO: 2625415 - DNA, 11 bp, Homo sapiens
aaaaatactgc

SEQ ID NO: 2625416 - DNA, 22 bp, Homo sapiens
aaaaatacttgtcaatatttaa

SEQ ID NO: 2625417 - DNA, 11 bp, Homo sapiens
aaaaatattta

SEQ ID NO: 2625418 - DNA, 12 bp, Homo sapiens
aaaaatgaaagc

SEQ ID NO: 2625419 - DNA, 17 bp, Homo sapiens
aaaaatgacagatgttg

SEQ ID NO: 2625420 - DNA, 23 bp, Homo sapiens
aaaaatgcaaatcctatgtgatt

SEQ ID NO: 2625421 - DNA, 18 bp, Homo sapiens
aaaaatgcccttaaatca

SEQ ID NO: 2625422 - DNA, 19 bp, Homo sapiens
aaaaatgctgaacattgca

SEQ ID NO: 2625423 - DNA, 18 bp, Homo sapiens
aaaaatgggacttctttt

SEQ ID NO: 2625424 - DNA, 17 bp, Homo sapiens
aaaaatggtttaaatgg

SEQ ID NO: 2625425 - DNA, 12 bp, Homo sapiens
aaaaatgtaaat

SEQ ID NO: 2625426 - DNA, 22 bp, Homo sapiens
aaaaatgttggatttataaatg

SEQ ID NO: 2625427 - DNA, 19 bp, Homo sapiens
aaaaattcctttgtgtttc

SEQ ID NO: 2625428 - DNA, 23 bp, Homo sapiens
aaaaattgtttcaaaataaaaac

SEQ ID NO: 2625429 - DNA, 15 bp, Homo sapiens
aaaaatttaagcatt

SEQ ID NO: 2625430 - DNA, 18 bp, Homo sapiens
aaaaatttaagcattgtt

SEQ ID NO: 2625431 - DNA, 18 bp, Homo sapiens
aaaatgttttagcaattt

SEQ ID NO: 2625432 - DNA, 23 bp, Homo sapiens
aaaattatgtttgccactttgca

SEQ ID NO: 2625433 - DNA, 19 bp, Homo sapiens
aaaattattttaaacaaaa

SEQ ID NO: 2625434 - DNA, 17 bp, Homo sapiens
aaaattcaaaaagtgtt

SEQ ID NO: 2625435 - DNA, 13 bp, Homo sapiens
aaaattcagtgga

SEQ ID NO: 2625436 - DNA, 20 bp, Homo sapiens
aaaattctcagtcagtaatt

SEQ ID NO: 2625437 - DNA, 13 bp, Homo sapiens
aaaattcttggaa

SEQ ID NO: 2625438 - DNA, 23 bp, Homo sapiens
aaaattgatatacttttttctta

SEQ ID NO: 2625439 - DNA, 21 bp, Homo sapiens
aaaattgtatgttaagttact

SEQ ID NO: 2625440 - DNA, 15 bp, Homo sapiens
aaaatttaagcattg

SEQ ID NO: 2625441 - DNA, 15 bp, Homo sapiens
aaaatttaagtgcgt

SEQ ID NO: 2625442 - DNA, 19 bp, Homo sapiens
aaaatttagaaatataatt

SEQ ID NO: 2625443 - DNA, 16 bp, Homo sapiens
aaaatttgccctccca

SEQ ID NO: 2625444 - DNA, 13 bp, Homo sapiens
aaaatttgttgca

SEQ ID NO: 2625445 - DNA, 19 bp, Homo sapiens
aaaatttgtttgaaatctt

SEQ ID NO: 2625446 - DNA, 16 bp, Homo sapiens
aaaattttttttcatg

SEQ ID NO: 2625447 - DNA, 13 bp, Homo sapiens
aaacaaaaacact

SEQ ID NO: 2625448 - DNA, 12 bp, Homo sapiens
aaacaaaataga

SEQ ID NO: 2625449 - DNA, 11 bp, Homo sapiens
aaacaaagaag

SEQ ID NO: 2625450 - DNA, 15 bp, Homo sapiens
aaacaaagcttagca

SEQ ID NO: 2625451 - DNA, 22 bp, Homo sapiens
aaacaaagcttagcaggagagg

SEQ ID NO: 2625452 - DNA, 17 bp, Homo sapiens
aaacaaaggttgagatg

SEQ ID NO: 2625453 - DNA, 12 bp, Homo sapiens
aaacaaatatgc

SEQ ID NO: 2625454 - DNA, 13 bp, Homo sapiens
aaacaaatatgca

SEQ ID NO: 2625455 - DNA, 19 bp, Homo sapiens
aaacaaattcatattctgt

SEQ ID NO: 2625456 - DNA, 18 bp, Homo sapiens
aaacaagaccacgtttct

SEQ ID NO: 2625457 - DNA, 19 bp, Homo sapiens
aaacaagatgctggatgtc

SEQ ID NO: 2625458 - DNA, 21 bp, Homo sapiens
aaacaatactcataatgtgaa

SEQ ID NO: 2625459 - DNA, 22 bp, Homo sapiens
aaacaatagtaattctcaggcc

SEQ ID NO: 2625460 - DNA, 14 bp, Homo sapiens
aaacaatattgttt

SEQ ID NO: 2625461 - DNA, 17 bp, Homo sapiens
aaacaatattgtttcta

SEQ ID NO: 2625462 - DNA, 19 bp, Homo sapiens
aaacacaaatgcagggatt

SEQ ID NO: 2625463 - DNA, 14 bp, Homo sapiens
aaacacaatatttt

SEQ ID NO: 2625464 - DNA, 17 bp, Homo sapiens
aaacacactgaggcagg

SEQ ID NO: 2625465 - DNA, 19 bp, Homo sapiens
aaacacactgaggcaggga

SEQ ID NO: 2625466 - DNA, 11 bp, Homo sapiens
aaacacagcaa

SEQ ID NO: 2625467 - DNA, 12 bp, Homo sapiens
aaacacagcaag

SEQ ID NO: 2625468 - DNA, 16 bp, Homo sapiens
aaacacagtgtttttg

SEQ ID NO: 2625469 - DNA, 19 bp, Homo sapiens
aaacacagtgtttttgtaa

SEQ ID NO: 2625470 - DNA, 20 bp, Homo sapiens
aaacacagtgtttttgtaaa

SEQ ID NO: 2625471 - DNA, 11 bp, Homo sapiens
aaacacatttt

SEQ ID NO: 2625472 - DNA, 14 bp, Homo sapiens
aaacaccttctctg

SEQ ID NO: 2625473 - DNA, 17 bp, Homo sapiens
aaacactcggcatttca

SEQ ID NO: 2625474 - DNA, 14 bp, Homo sapiens
aaacactgcaggca

SEQ ID NO: 2625475 - DNA, 19 bp, Homo sapiens
aaacactgttctctgccct

SEQ ID NO: 2625476 - DNA, 22 bp, Homo sapiens
aaacactgttctctgccctcca

SEQ ID NO: 2625477 - DNA, 13 bp, Homo sapiens
aaacagaaacaaa

SEQ ID NO: 2625478 - DNA, 19 bp, Homo sapiens
aaacagaaacaaaaacact

SEQ ID NO: 2625479 - DNA, 21 bp, Homo sapiens
aaacagaacatcattagaaca

SEQ ID NO: 2625480 - DNA, 12 bp, Homo sapiens
aaacagacactg

SEQ ID NO: 2625481 - DNA, 22 bp, Homo sapiens
aaacagagacaggcccaagaga

SEQ ID NO: 2625482 - DNA, 20 bp, Homo sapiens
aaacagaggccatggcagaa

SEQ ID NO: 2625483 - DNA, 17 bp, Homo sapiens
aaacagcattgctttct

SEQ ID NO: 2625484 - DNA, 18 bp, Homo sapiens
aaacagcattgctttctg

SEQ ID NO: 2625485 - DNA, 15 bp, Homo sapiens
aaacagcgtttaaga

SEQ ID NO: 2625486 - DNA, 20 bp, Homo sapiens
aaacagtctcaggaaatcaa

SEQ ID NO: 2625487 - DNA, 13 bp, Homo sapiens
aaacagtgttttg

SEQ ID NO: 2625488 - DNA, 18 bp, Homo sapiens
aaacagttaactttcaga

SEQ ID NO: 2625489 - DNA, 22 bp, Homo sapiens
aaacatatttgttaaatattta

SEQ ID NO: 2625490 - DNA, 22 bp, Homo sapiens
aaacatcacacacacagacaga

SEQ ID NO: 2625491 - DNA, 16 bp, Homo sapiens
aaacatcagttactct

SEQ ID NO: 2625492 - DNA, 19 bp, Homo sapiens
aaacatcagttactctgaa

SEQ ID NO: 2625493 - DNA, 22 bp, Homo sapiens
aaacatcagttactctgaaggg

SEQ ID NO: 2625494 - DNA, 23 bp, Homo sapiens
aaacatcagttactctgaagggc

SEQ ID NO: 2625495 - DNA, 16 bp, Homo sapiens
aaacatgctacacact

SEQ ID NO: 2625496 - DNA, 16 bp, Homo sapiens
aaacatggcctttgct

SEQ ID NO: 2625497 - DNA, 21 bp, Homo sapiens
aaacatggtagaattggagag

SEQ ID NO: 2625498 - DNA, 17 bp, Homo sapiens
aaacatgttagaagcaa

SEQ ID NO: 2625499 - DNA, 16 bp, Homo sapiens
aaacattgaagtaatg

SEQ ID NO: 2625500 - DNA, 21 bp, Homo sapiens
aaacattttgtggtcattaag

SEQ ID NO: 2625501 - DNA, 15 bp, Homo sapiens
aaaccaaaaactgaa

SEQ ID NO: 2625502 - DNA, 18 bp, Homo sapiens
aaaccaaatcactgaact

SEQ ID NO: 2625503 - DNA, 23 bp, Homo sapiens
aaaccaagtcaagtgaaaaagga

SEQ ID NO: 2625504 - DNA, 20 bp, Homo sapiens
aaaccacaaggctgttgcat

SEQ ID NO: 2625505 - DNA, 16 bp, Homo sapiens
aaaccacagcagttga

SEQ ID NO: 2625506 - DNA, 16 bp, Homo sapiens
aaaccacagccctgtc

SEQ ID NO: 2625507 - DNA, 23 bp, Homo sapiens
aaaccaccagtgcccaaagtctg

SEQ ID NO: 2625508 - DNA, 23 bp, Homo sapiens
aaaccatgaagagatttttcatg

SEQ ID NO: 2625509 - DNA, 23 bp, Homo sapiens
aaacccaccttgttggagcctgc

SEQ ID NO: 2625510 - DNA, 15 bp, Homo sapiens
aaacccagactgaac

SEQ ID NO: 2625511 - DNA, 13 bp, Homo sapiens
aaaccctcgaggc

SEQ ID NO: 2625512 - DNA, 24 bp, Homo sapiens
aaaccctcgaggcggatctttgga

SEQ ID NO: 2625513 - DNA, 20 bp, Homo sapiens
aaacctaagtcctttatgtg

SEQ ID NO: 2625514 - DNA, 15 bp, Homo sapiens
aaacctctgtgagca

SEQ ID NO: 2625515 - DNA, 14 bp, Homo sapiens
aaacctctgttcag

SEQ ID NO: 2625516 - DNA, 14 bp, Homo sapiens
aaacctgccctgcc

SEQ ID NO: 2625517 - DNA, 15 bp, Homo sapiens
aaacctggatgtcac

SEQ ID NO: 2625518 - DNA, 19 bp, Homo sapiens
aaacctgtttaaatatttc

SEQ ID NO: 2625519 - DNA, 17 bp, Homo sapiens
aaaccttattgtacctc

SEQ ID NO: 2625520 - DNA, 22 bp, Homo sapiens
aaaccttggtgtagttgaactg

SEQ ID NO: 2625521 - DNA, 17 bp, Homo sapiens
aaacctttagggcagct

SEQ ID NO: 2625522 - DNA, 19 bp, Homo sapiens
aaacctttcaaatttcaca

SEQ ID NO: 2625523 - DNA, 13 bp, Homo sapiens
aaaccttttgaaa

SEQ ID NO: 2625524 - DNA, 20 bp, Homo sapiens
aaaccttttggaaaatctgc

SEQ ID NO: 2625525 - DNA, 19 bp, Homo sapiens
aaaccttttttaagatttt

SEQ ID NO: 2625526 - DNA, 20 bp, Homo sapiens
aaaccttttttaagattttt

SEQ ID NO: 2625527 - DNA, 21 bp, Homo sapiens
aaaccttttttaagatttttc

SEQ ID NO: 2625528 - DNA, 17 bp, Homo sapiens
aaacgatttaattctct

SEQ ID NO: 2625529 - DNA, 18 bp, Homo sapiens
aaacgatttaattctctt

SEQ ID NO: 2625530 - DNA, 20 bp, Homo sapiens
aaacggattattttttcaga

SEQ ID NO: 2625531 - DNA, 17 bp, Homo sapiens
aaacgtatgcatgtgaa

SEQ ID NO: 2625532 - DNA, 21 bp, Homo sapiens
aaacgttttattgtgttttta

SEQ ID NO: 2625533 - DNA, 13 bp, Homo sapiens
aaactaaattgta

SEQ ID NO: 2625534 - DNA, 15 bp, Homo sapiens
aaactaacagataag

SEQ ID NO: 2625535 - DNA, 20 bp, Homo sapiens
aaactaacagataagcaaga

SEQ ID NO: 2625536 - DNA, 18 bp, Homo sapiens
aaacttgctttatgcctt

SEQ ID NO: 2625537 - DNA, 20 bp, Homo sapiens
aaactttacccaaaaactaa

SEQ ID NO: 2625538 - DNA, 17 bp, Homo sapiens
aaactttacctttttta

SEQ ID NO: 2625539 - DNA, 12 bp, Homo sapiens
aaactttatgct

SEQ ID NO: 2625540 - DNA, 19 bp, Homo sapiens
aaactttatgctaagtgaa

SEQ ID NO: 2625541 - DNA, 24 bp, Homo sapiens
aaacttttttgaaataataaatct

SEQ ID NO: 2625542 - DNA, 11 bp, Homo sapiens
aaagaaaaaaa

SEQ ID NO: 2625543 - DNA, 18 bp, Homo sapiens
aaagaaaaaataattgat

SEQ ID NO: 2625544 - DNA, 13 bp, Homo sapiens
aaagaaaatatgc

SEQ ID NO: 2625545 - DNA, 14 bp, Homo sapiens
aaagaaaatatgca

SEQ ID NO: 2625546 - DNA, 15 bp, Homo sapiens
aaagaaaatatgcat

SEQ ID NO: 2625547 - DNA, 17 bp, Homo sapiens
aaagaaaatatgcatct

SEQ ID NO: 2625548 - DNA, 14 bp, Homo sapiens
aaagaaagagagaa

SEQ ID NO: 2625549 - DNA, 17 bp, Homo sapiens
aaagaaagagagaaaat

SEQ ID NO: 2625550 - DNA, 21 bp, Homo sapiens
aaagaacatggacttgtatat

SEQ ID NO: 2625551 - DNA, 18 bp, Homo sapiens
aaagaagacatgttttag

SEQ ID NO: 2625552 - DNA, 12 bp, Homo sapiens
aaagaagagaca

SEQ ID NO: 2625553 - DNA, 16 bp, Homo sapiens
aaagaatgaaagagta

SEQ ID NO: 2625554 - DNA, 17 bp, Homo sapiens
aaagaatggaaggtgga

SEQ ID NO: 2625555 - DNA, 18 bp, Homo sapiens
aaagaatgggcagttaca

SEQ ID NO: 2625556 - DNA, 11 bp, Homo sapiens
aaagacaattc

SEQ ID NO: 2625557 - DNA, 12 bp, Homo sapiens
aaagacaattct

SEQ ID NO: 2625558 - DNA, 13 bp, Homo sapiens
aaagacaattctt

SEQ ID NO: 2625559 - DNA, 14 bp, Homo sapiens
aaagacagagctgg

SEQ ID NO: 2625560 - DNA, 22 bp, Homo sapiens
aaagacagggctgataagctaa

SEQ ID NO: 2625561 - DNA, 15 bp, Homo sapiens
aaagacatgaatatg

SEQ ID NO: 2625562 - DNA, 15 bp, Homo sapiens
aaagactattcaaac

SEQ ID NO: 2625563 - DNA, 18 bp, Homo sapiens
aaagactattcaaacagt

SEQ ID NO: 2625564 - DNA, 21 bp, Homo sapiens
aaagactattcaaacagtctc

SEQ ID NO: 2625565 - DNA, 23 bp, Homo sapiens
aaagactattcaaacagtctcag

SEQ ID NO: 2625566 - DNA, 14 bp, Homo sapiens
aaagactccaaaga

SEQ ID NO: 2625567 - DNA, 13 bp, Homo sapiens
aaagactggcttt

SEQ ID NO: 2625568 - DNA, 23 bp, Homo sapiens
aaagactggcttttattaatgca

SEQ ID NO: 2625569 - DNA, 14 bp, Homo sapiens
aaagagagaaaata

SEQ ID NO: 2625570 - DNA, 16 bp, Homo sapiens
aaagagagaaaataaa

SEQ ID NO: 2625571 - DNA, 18 bp, Homo sapiens
aaagagagaaaataaaaa

SEQ ID NO: 2625572 - DNA, 21 bp, Homo sapiens
aaagagagaaaataaaaagtt

SEQ ID NO: 2625573 - DNA, 11 bp, Homo sapiens
aaagagaggtt

SEQ ID NO: 2625574 - DNA, 12 bp, Homo sapiens
aaagagatattt

SEQ ID NO: 2625575 - DNA, 13 bp, Homo sapiens
aaagagatttcaa

SEQ ID NO: 2625576 - DNA, 20 bp, Homo sapiens
aaagaggcagcttgaaactg

SEQ ID NO: 2625577 - DNA, 23 bp, Homo sapiens
aaagagtagacatttctcttact

SEQ ID NO: 2625578 - DNA, 15 bp, Homo sapiens
aaagatacagttact

SEQ ID NO: 2625579 - DNA, 16 bp, Homo sapiens
aaagatacgactttat

SEQ ID NO: 2625580 - DNA, 22 bp, Homo sapiens
aaagatacgactttattttctg

SEQ ID NO: 2625581 - DNA, 13 bp, Homo sapiens
aaagatgaaaata

SEQ ID NO: 2625582 - DNA, 16 bp, Homo sapiens
aaagatgaaaatattt

SEQ ID NO: 2625583 - DNA, 19 bp, Homo sapiens
aaagatgcttctcactgcc

SEQ ID NO: 2625584 - DNA, 16 bp, Homo sapiens
aaagatggatgtgctt

SEQ ID NO: 2625585 - DNA, 22 bp, Homo sapiens
aaagatggctgtgcctctgcct

SEQ ID NO: 2625586 - DNA, 20 bp, Homo sapiens
aaagatgtttgtcagatatg

SEQ ID NO: 2625587 - DNA, 22 bp, Homo sapiens
aaagattactttttctttatgt

SEQ ID NO: 2625588 - DNA, 13 bp, Homo sapiens
aaagattcatttt

SEQ ID NO: 2625589 - DNA, 13 bp, Homo sapiens
aaagcaaatgaga

SEQ ID NO: 2625590 - DNA, 15 bp, Homo sapiens
aaagcaataaatgaa

SEQ ID NO: 2625591 - DNA, 17 bp, Homo sapiens
aaagcacagtttgaaca

SEQ ID NO: 2625592 - DNA, 16 bp, Homo sapiens
aaagcacattgaaaga

SEQ ID NO: 2625593 - DNA, 21 bp, Homo sapiens
aaagcaccaaaataagaaaag

SEQ ID NO: 2625594 - DNA, 23 bp, Homo sapiens
aaagcaccaaaataagaaaagat

SEQ ID NO: 2625595 - DNA, 17 bp, Homo sapiens
aaagcactgacttctaa

SEQ ID NO: 2625596 - DNA, 19 bp, Homo sapiens
aaagcacttggactcttgc

SEQ ID NO: 2625597 - DNA, 13 bp, Homo sapiens
aaagcagcatctg

SEQ ID NO: 2625598 - DNA, 15 bp, Homo sapiens
aaagcagcgtttcta

SEQ ID NO: 2625599 - DNA, 16 bp, Homo sapiens
aaagcatcacctcagg

SEQ ID NO: 2625600 - DNA, 22 bp, Homo sapiens
aaagcattcaatttattcaaga

SEQ ID NO: 2625601 - DNA, 20 bp, Homo sapiens
aaagccaaatcaaaatatgt

SEQ ID NO: 2625602 - DNA, 23 bp, Homo sapiens
aaagccaagtttatatacaatta

SEQ ID NO: 2625603 - DNA, 19 bp, Homo sapiens
aaagccagtgactccagga

SEQ ID NO: 2625604 - DNA, 18 bp, Homo sapiens
aaagcccaaagtggtata

SEQ ID NO: 2625605 - DNA, 16 bp, Homo sapiens
aaagcccaacctcctg

SEQ ID NO: 2625606 - DNA, 15 bp, Homo sapiens
aaagcccagagacag

SEQ ID NO: 2625607 - DNA, 16 bp, Homo sapiens
aaagcccattcattcc

SEQ ID NO: 2625608 - DNA, 17 bp, Homo sapiens
aaagcccattcattcca

SEQ ID NO: 2625609 - DNA, 19 bp, Homo sapiens
aaagcccttaggaagaatt

SEQ ID NO: 2625610 - DNA, 23 bp, Homo sapiens
aaagcccttccatgtcgcctctg

SEQ ID NO: 2625611 - DNA, 21 bp, Homo sapiens
aaagccgttgtttacttaaag

SEQ ID NO: 2625612 - DNA, 23 bp, Homo sapiens
aaagccgttgtttacttaaagat

SEQ ID NO: 2625613 - DNA, 16 bp, Homo sapiens
aaagcctctgctgcca

SEQ ID NO: 2625614 - DNA, 21 bp, Homo sapiens
aaagccttgtgtctacagaga

SEQ ID NO: 2625615 - DNA, 16 bp, Homo sapiens
aaagctaggcctggcc

SEQ ID NO: 2625616 - DNA, 15 bp, Homo sapiens
aaagctattagccag

SEQ ID NO: 2625617 - DNA, 18 bp, Homo sapiens
aaagctattagccaggat

SEQ ID NO: 2625618 - DNA, 20 bp, Homo sapiens
aaagctattagccaggatca

SEQ ID NO: 2625619 - DNA, 23 bp, Homo sapiens
aaagctattagccaggatcatgg

SEQ ID NO: 2625620 - DNA, 21 bp, Homo sapiens
aaagctgcctgtagttaggaa

SEQ ID NO: 2625621 - DNA, 15 bp, Homo sapiens
aaagcttagcaggag

SEQ ID NO: 2625622 - DNA, 15 bp, Homo sapiens
aaagcttgttaagat

SEQ ID NO: 2625623 - DNA, 18 bp, Homo sapiens
aaaggaaaatagtaatgt

SEQ ID NO: 2625624 - DNA, 23 bp, Homo sapiens
aaaggaaatctcaccccatccca

SEQ ID NO: 2625625 - DNA, 15 bp, Homo sapiens
aaaggaaatgattga

SEQ ID NO: 2625626 - DNA, 23 bp, Homo sapiens
aaaggaaggttctggtgtgaact

SEQ ID NO: 2625627 - DNA, 21 bp, Homo sapiens
aaaggaatccactcccaggca

SEQ ID NO: 2625628 - DNA, 23 bp, Homo sapiens
aaaggaattggcatgtgtatgtt

SEQ ID NO: 2625629 - DNA, 15 bp, Homo sapiens
aaaggacaatttcaa

SEQ ID NO: 2625630 - DNA, 16 bp, Homo sapiens
aaaggactctggggtt

SEQ ID NO: 2625631 - DNA, 17 bp, Homo sapiens
aaaggagagctagcagc

SEQ ID NO: 2625632 - DNA, 13 bp, Homo sapiens
aaaggaggctggc

SEQ ID NO: 2625633 - DNA, 15 bp, Homo sapiens
aaaggatattttctt

SEQ ID NO: 2625634 - DNA, 14 bp, Homo sapiens
aaaggatgcacaga

SEQ ID NO: 2625635 - DNA, 18 bp, Homo sapiens
aaaggattcatgtggaat

SEQ ID NO: 2625636 - DNA, 12 bp, Homo sapiens
aaaggcacagtg

SEQ ID NO: 2625637 - DNA, 21 bp, Homo sapiens
aaaggcataagaccctaagcc

SEQ ID NO: 2625638 - DNA, 15 bp, Homo sapiens
aaaggcatattgctt

SEQ ID NO: 2625639 - DNA, 17 bp, Homo sapiens
aaaggcatattgctttt

SEQ ID NO: 2625640 - DNA, 17 bp, Homo sapiens
aaaggccaaacctctgt

SEQ ID NO: 2625641 - DNA, 18 bp, Homo sapiens
aaaggccaaacctctgtt

SEQ ID NO: 2625642 - DNA, 18 bp, Homo sapiens
aaaggccagctggcagca

SEQ ID NO: 2625643 - DNA, 12 bp, Homo sapiens
aaaggcccccta

SEQ ID NO: 2625644 - DNA, 19 bp, Homo sapiens
aaaggctaggtacacagct

SEQ ID NO: 2625645 - DNA, 19 bp, Homo sapiens
aaaggctcagtctcaggag

SEQ ID NO: 2625646 - DNA, 16 bp, Homo sapiens
aaaggctccaggagca

SEQ ID NO: 2625647 - DNA, 13 bp, Homo sapiens
aaaggctgtggta

SEQ ID NO: 2625648 - DNA, 16 bp, Homo sapiens
aaagggaactgaacat

SEQ ID NO: 2625649 - DNA, 21 bp, Homo sapiens
aaagggaactgaacattccag

SEQ ID NO: 2625650 - DNA, 18 bp, Homo sapiens
aaagggaagttgtgcctt

SEQ ID NO: 2625651 - DNA, 22 bp, Homo sapiens
aaagggacttggaagctccgct

SEQ ID NO: 2625652 - DNA, 13 bp, Homo sapiens
aaatctattcaga

SEQ ID NO: 2625653 - DNA, 16 bp, Homo sapiens
aaatctcaattcttcc

SEQ ID NO: 2625654 - DNA, 12 bp, Homo sapiens
aaatctctaata

SEQ ID NO: 2625655 - DNA, 18 bp, Homo sapiens
aaatctgctttttaaaga

SEQ ID NO: 2625656 - DNA, 22 bp, Homo sapiens
aaatctgtccaaaggaggctgg

SEQ ID NO: 2625657 - DNA, 19 bp, Homo sapiens
aaatctgtgatgatcctca

SEQ ID NO: 2625658 - DNA, 23 bp, Homo sapiens
aaatctgtgatgatcctcatatg

SEQ ID NO: 2625659 - DNA, 19 bp, Homo sapiens
aaatctgtgcctgagaaca

SEQ ID NO: 2625660 - DNA, 18 bp, Homo sapiens
aaatctgtttgatccctg

SEQ ID NO: 2625661 - DNA, 18 bp, Homo sapiens
aaatcttttagtcattat

SEQ ID NO: 2625662 - DNA, 14 bp, Homo sapiens
aaatcttttctatt

SEQ ID NO: 2625663 - DNA, 18 bp, Homo sapiens
aaatgaaaacatgtaata

SEQ ID NO: 2625664 - DNA, 12 bp, Homo sapiens
aaatgaaattgt

SEQ ID NO: 2625665 - DNA, 11 bp, Homo sapiens
aaatgaagtgc

SEQ ID NO: 2625666 - DNA, 15 bp, Homo sapiens
aaatgaataatttcc

SEQ ID NO: 2625667 - DNA, 18 bp, Homo sapiens
aaatgaataatttcccaa

SEQ ID NO: 2625668 - DNA, 15 bp, Homo sapiens
aaatgaatgttgtct

SEQ ID NO: 2625669 - DNA, 14 bp, Homo sapiens
aaatgacagatgtt

SEQ ID NO: 2625670 - DNA, 19 bp, Homo sapiens
aaatgatgatgtggaagaa

SEQ ID NO: 2625671 - DNA, 23 bp, Homo sapiens
aaatgatgttcatttagattgaa

SEQ ID NO: 2625672 - DNA, 15 bp, Homo sapiens
aaatgattcttagtg

SEQ ID NO: 2625673 - DNA, 17 bp, Homo sapiens
aaatgcaaacacacaaa

SEQ ID NO: 2625674 - DNA, 15 bp, Homo sapiens
aaatgcaatatgtat

SEQ ID NO: 2625675 - DNA, 14 bp, Homo sapiens
aaatgcacctggaa

SEQ ID NO: 2625676 - DNA, 19 bp, Homo sapiens
aaatgcatatcctgagcca

SEQ ID NO: 2625677 - DNA, 15 bp, Homo sapiens
aaatgcatattgtat

SEQ ID NO: 2625678 - DNA, 13 bp, Homo sapiens
aaatgcatggagg

SEQ ID NO: 2625679 - DNA, 12 bp, Homo sapiens
aaatgcattgta

SEQ ID NO: 2625680 - DNA, 13 bp, Homo sapiens
aaatgcattgtat

SEQ ID NO: 2625681 - DNA, 20 bp, Homo sapiens
aaatgcattgtatcgatgtt

SEQ ID NO: 2625682 - DNA, 13 bp, Homo sapiens
aaatgcccagccc

SEQ ID NO: 2625683 - DNA, 22 bp, Homo sapiens
aaatgcccttacacttactgtt

SEQ ID NO: 2625684 - DNA, 23 bp, Homo sapiens
aaatgccttaccctcatgttctt

SEQ ID NO: 2625685 - DNA, 16 bp, Homo sapiens
aaatgcctttgagaca

SEQ ID NO: 2625686 - DNA, 19 bp, Homo sapiens
aaatgcctttgagacagtt

SEQ ID NO: 2625687 - DNA, 20 bp, Homo sapiens
aaatgcctttgagacagttt

SEQ ID NO: 2625688 - DNA, 15 bp, Homo sapiens
aaatggaagacacat

SEQ ID NO: 2625689 - DNA, 16 bp, Homo sapiens
aaatggacactgtgcc

SEQ ID NO: 2625690 - DNA, 13 bp, Homo sapiens
aaatggccatttg

SEQ ID NO: 2625691 - DNA, 23 bp, Homo sapiens
aaatggccatttgctttttcacc

SEQ ID NO: 2625692 - DNA, 16 bp, Homo sapiens
aaatggctcagatgcc

SEQ ID NO: 2625693 - DNA, 16 bp, Homo sapiens
aaatgggacttctttt

SEQ ID NO: 2625694 - DNA, 21 bp, Homo sapiens
aaatgggacttcttttcacat

SEQ ID NO: 2625695 - DNA, 15 bp, Homo sapiens
aaatgggcagagcag

SEQ ID NO: 2625696 - DNA, 15 bp, Homo sapiens
aaatgggggtgcatt

SEQ ID NO: 2625697 - DNA, 17 bp, Homo sapiens
aaatgggggtgcatttg

SEQ ID NO: 2625698 - DNA, 16 bp, Homo sapiens
aaatggtgtacataat

SEQ ID NO: 2625699 - DNA, 16 bp, Homo sapiens
aaatgtaacagtctga

SEQ ID NO: 2625700 - DNA, 17 bp, Homo sapiens
aaatgtaacttttgtaa

SEQ ID NO: 2625701 - DNA, 16 bp, Homo sapiens
aaatgtaggtatgaat

SEQ ID NO: 2625702 - DNA, 14 bp, Homo sapiens
aaatgtatcttatt

SEQ ID NO: 2625703 - DNA, 19 bp, Homo sapiens
aaatgtctagttgtaacac

SEQ ID NO: 2625704 - DNA, 18 bp, Homo sapiens
aaatgtcttctgtattca

SEQ ID NO: 2625705 - DNA, 20 bp, Homo sapiens
aaatgtcttttttttaatgt

SEQ ID NO: 2625706 - DNA, 13 bp, Homo sapiens
aaatgtgattttt

SEQ ID NO: 2625707 - DNA, 16 bp, Homo sapiens
aaatgtgatttttctg

SEQ ID NO: 2625708 - DNA, 17 bp, Homo sapiens
aaatgtgcaaaacagcg

SEQ ID NO: 2625709 - DNA, 20 bp, Homo sapiens
aaatgtgtatcggatgcttt

SEQ ID NO: 2625710 - DNA, 13 bp, Homo sapiens
aaatgttcacttt

SEQ ID NO: 2625711 - DNA, 15 bp, Homo sapiens
aaatgttcagaaggt

SEQ ID NO: 2625712 - DNA, 13 bp, Homo sapiens
aaatgttcatcaa

SEQ ID NO: 2625713 - DNA, 12 bp, Homo sapiens
aaatgttgaata

SEQ ID NO: 2625714 - DNA, 15 bp, Homo sapiens
aaatgttgaataaaa

SEQ ID NO: 2625715 - DNA, 21 bp, Homo sapiens
aaatgttggatttataaatgc

SEQ ID NO: 2625716 - DNA, 13 bp, Homo sapiens
aaatgtttctgca

SEQ ID NO: 2625717 - DNA, 15 bp, Homo sapiens
aaatgtttctgcagt

SEQ ID NO: 2625718 - DNA, 16 bp, Homo sapiens
aaatgtttttctgcca

SEQ ID NO: 2625719 - DNA, 21 bp, Homo sapiens
aaatgtttttctgccagggag

SEQ ID NO: 2625720 - DNA, 19 bp, Homo sapiens
aaattaaaaaaaaaaaact

SEQ ID NO: 2625721 - DNA, 13 bp, Homo sapiens
aaattaaagctga

SEQ ID NO: 2625722 - DNA, 13 bp, Homo sapiens
aaattaactttta

SEQ ID NO: 2625723 - DNA, 14 bp, Homo sapiens
aaattaacttttat

SEQ ID NO: 2625724 - DNA, 23 bp, Homo sapiens
aaattaacttttataaactttac

SEQ ID NO: 2625725 - DNA, 19 bp, Homo sapiens
aaattaccagagttgttct

SEQ ID NO: 2625726 - DNA, 15 bp, Homo sapiens
aaattactacaaaat

SEQ ID NO: 2625727 - DNA, 14 bp, Homo sapiens
aaattagatgaact

SEQ ID NO: 2625728 - DNA, 19 bp, Homo sapiens
aaattagctgtgtgaaata

SEQ ID NO: 2625729 - DNA, 18 bp, Homo sapiens
aaattaggaataaataaa

SEQ ID NO: 2625730 - DNA, 19 bp, Homo sapiens
aaattaggatttcatgatt

SEQ ID NO: 2625731 - DNA, 19 bp, Homo sapiens
aaattaggttttgtacaat

SEQ ID NO: 2625732 - DNA, 15 bp, Homo sapiens
aaattatttattatt

SEQ ID NO: 2625733 - DNA, 13 bp, Homo sapiens
aaattatttgaaa

SEQ ID NO: 2625734 - DNA, 13 bp, Homo sapiens
aaattatttgtgt

SEQ ID NO: 2625735 - DNA, 17 bp, Homo sapiens
aaattattttaaacaaa

SEQ ID NO: 2625736 - DNA, 22 bp, Homo sapiens
aaattcatttttttcactggag

SEQ ID NO: 2625737 - DNA, 17 bp, Homo sapiens
aaattcctattgtgatt

SEQ ID NO: 2625738 - DNA, 23 bp, Homo sapiens
aaattcctattgtgatttgactg

SEQ ID NO: 2625739 - DNA, 23 bp, Homo sapiens
aaattccttagcttagacctcag

SEQ ID NO: 2625740 - DNA, 19 bp, Homo sapiens
aaattctataggaacatat

SEQ ID NO: 2625741 - DNA, 23 bp, Homo sapiens
aaattctataggaacatatgaaa

SEQ ID NO: 2625742 - DNA, 15 bp, Homo sapiens
aaattcttgcaaagt

SEQ ID NO: 2625743 - DNA, 20 bp, Homo sapiens
aaattgaaaggcattctctg

SEQ ID NO: 2625744 - DNA, 22 bp, Homo sapiens
aaattgaaaggcattctctgaa

SEQ ID NO: 2625745 - DNA, 13 bp, Homo sapiens
aaattgaataatg

SEQ ID NO: 2625746 - DNA, 15 bp, Homo sapiens
aaattgacattgctt

SEQ ID NO: 2625747 - DNA, 12 bp, Homo sapiens
aaattgcacaat

SEQ ID NO: 2625748 - DNA, 22 bp, Homo sapiens
aaattgctcctaagcttcaaat

SEQ ID NO: 2625749 - DNA, 18 bp, Homo sapiens
aaattgcttactttggaa

SEQ ID NO: 2625750 - DNA, 16 bp, Homo sapiens
aaattggaacagaatg

SEQ ID NO: 2625751 - DNA, 21 bp, Homo sapiens
aaattgtttcaaaataaaaac

SEQ ID NO: 2625752 - DNA, 14 bp, Homo sapiens
aaatttaagcattg

SEQ ID NO: 2625753 - DNA, 15 bp, Homo sapiens
aaatttaagtatctt

SEQ ID NO: 2625754 - DNA, 23 bp, Homo sapiens
aaatttaagtatcttttttcaaa

SEQ ID NO: 2625755 - DNA, 20 bp, Homo sapiens
aaatttaatatagctatttt

SEQ ID NO: 2625756 - DNA, 15 bp, Homo sapiens
aaatttagtttttgt

SEQ ID NO: 2625757 - DNA, 18 bp, Homo sapiens
aaatttagtttttgttct

SEQ ID NO: 2625758 - DNA, 15 bp, Homo sapiens
aaatttatgtgatgg

SEQ ID NO: 2625759 - DNA, 22 bp, Homo sapiens
aaatttccagtacctttgtcac

SEQ ID NO: 2625760 - DNA, 16 bp, Homo sapiens
aaatttccccaacagt

SEQ ID NO: 2625761 - DNA, 12 bp, Homo sapiens
aaatttctaaat

SEQ ID NO: 2625762 - DNA, 14 bp, Homo sapiens
aaatttgtaagttt

SEQ ID NO: 2625763 - DNA, 15 bp, Homo sapiens
aaatttgtaagtttc

SEQ ID NO: 2625764 - DNA, 17 bp, Homo sapiens
aaatttgtaagtttcag

SEQ ID NO: 2625765 - DNA, 19 bp, Homo sapiens
aaatttgttattttgcaac

SEQ ID NO: 2625766 - DNA, 22 bp, Homo sapiens
aaattttaatatgggttctttt

SEQ ID NO: 2625767 - DNA, 18 bp, Homo sapiens
aaattttcacataaaata

SEQ ID NO: 2625768 - DNA, 14 bp, Homo sapiens
aaattttctagact

SEQ ID NO: 2625769 - DNA, 18 bp, Homo sapiens
aaattttctagactttct

SEQ ID NO: 2625770 - DNA, 20 bp, Homo sapiens
aaattttctagactttctgt

SEQ ID NO: 2625771 - DNA, 21 bp, Homo sapiens
aaattttgtgatatggagccc

SEQ ID NO: 2625772 - DNA, 18 bp, Homo sapiens
aaatttttcagatgcttc

SEQ ID NO: 2625773 - DNA, 20 bp, Homo sapiens
aaatttttcagatgcttctg

SEQ ID NO: 2625774 - DNA, 17 bp, Homo sapiens
aaattttttttcatgtt

SEQ ID NO: 2625775 - DNA, 19 bp, Homo sapiens
aacaaaaacactaaaaata

SEQ ID NO: 2625776 - DNA, 14 bp, Homo sapiens
aacaaaaagcttcc

SEQ ID NO: 2625777 - DNA, 17 bp, Homo sapiens
aacaaagaagacaacat

SEQ ID NO: 2625778 - DNA, 13 bp, Homo sapiens
aacaaagaaggtt

SEQ ID NO: 2625779 - DNA, 15 bp, Homo sapiens
aacaaagcacagtgt

SEQ ID NO: 2625780 - DNA, 14 bp, Homo sapiens
aacaaagccagaag

SEQ ID NO: 2625781 - DNA, 17 bp, Homo sapiens
aacaaagccagaagctg

SEQ ID NO: 2625782 - DNA, 17 bp, Homo sapiens
aacaaagcttagcagga

SEQ ID NO: 2625783 - DNA, 16 bp, Homo sapiens
aacaaaggttgagatg

SEQ ID NO: 2625784 - DNA, 12 bp, Homo sapiens
aacaaatatgca

SEQ ID NO: 2625785 - DNA, 19 bp, Homo sapiens
aacaaattaggttttgtac

SEQ ID NO: 2625786 - DNA, 12 bp, Homo sapiens
aacaagaattgg

SEQ ID NO: 2625787 - DNA, 14 bp, Homo sapiens
aacaaggaagtcaa

SEQ ID NO: 2625788 - DNA, 21 bp, Homo sapiens
aacaagggagagacctcatca

SEQ ID NO: 2625789 - DNA, 19 bp, Homo sapiens
aacaagggtggcatcccag

SEQ ID NO: 2625790 - DNA, 19 bp, Homo sapiens
aacaagtcgatgaactatt

SEQ ID NO: 2625791 - DNA, 17 bp, Homo sapiens
aaccaccgctccccagc

SEQ ID NO: 2625792 - DNA, 19 bp, Homo sapiens
aaccactcaaattaatctt

SEQ ID NO: 2625793 - DNA, 22 bp, Homo sapiens
aaccactctatcaagtattata

SEQ ID NO: 2625794 - DNA, 13 bp, Homo sapiens
aaccactgaatct

SEQ ID NO: 2625795 - DNA, 18 bp, Homo sapiens
aagacatgaatgcacact

SEQ ID NO: 2625796 - DNA, 19 bp, Homo sapiens
aagacatggggaggaagga

SEQ ID NO: 2625797 - DNA, 13 bp, Homo sapiens
aagacatgtctgt

SEQ ID NO: 2625798 - DNA, 13 bp, Homo sapiens
aagacatgtttta

SEQ ID NO: 2625799 - DNA, 14 bp, Homo sapiens
aagacatgttttag

SEQ ID NO: 2625800 - DNA, 17 bp, Homo sapiens
aagaccacaaaaattga

SEQ ID NO: 2625801 - DNA, 16 bp, Homo sapiens
aagaccaccacctcag

SEQ ID NO: 2625802 - DNA, 17 bp, Homo sapiens
aagaccacgtttctaaa

SEQ ID NO: 2625803 - DNA, 13 bp, Homo sapiens
aagacccaaaagg

SEQ ID NO: 2625804 - DNA, 13 bp, Homo sapiens
aagaccctccccg

SEQ ID NO: 2625805 - DNA, 18 bp, Homo sapiens
aagacccttgtggtccca

SEQ ID NO: 2625806 - DNA, 19 bp, Homo sapiens
aagaccttctccttcacct

SEQ ID NO: 2625807 - DNA, 13 bp, Homo sapiens
aagacgctgtgct

SEQ ID NO: 2625808 - DNA, 19 bp, Homo sapiens
aagacgctgtgctgccctg

SEQ ID NO: 2625809 - DNA, 16 bp, Homo sapiens
aagacgtgattttgct

SEQ ID NO: 2625810 - DNA, 15 bp, Homo sapiens
aagacgtgtttgtgt

SEQ ID NO: 2625811 - DNA, 16 bp, Homo sapiens
aagacgtgtttgtgtt

SEQ ID NO: 2625812 - DNA, 23 bp, Homo sapiens
aagacgtgtttgtgtttgtgtgt

SEQ ID NO: 2625813 - DNA, 16 bp, Homo sapiens
aagactatctaaatgt

SEQ ID NO: 2625814 - DNA, 15 bp, Homo sapiens
aagactgtggctgct

SEQ ID NO: 2625815 - DNA, 16 bp, Homo sapiens
aagactgttgctcaaa

SEQ ID NO: 2625816 - DNA, 18 bp, Homo sapiens
aagacttggcaacagaag

SEQ ID NO: 2625817 - DNA, 19 bp, Homo sapiens
aagacttggcaacagaagc

SEQ ID NO: 2625818 - DNA, 20 bp, Homo sapiens
aagactttgggataggaaaa

SEQ ID NO: 2625819 - DNA, 13 bp, Homo sapiens
aagagaaaaaata

SEQ ID NO: 2625820 - DNA, 13 bp, Homo sapiens
aagagaaaagaaa

SEQ ID NO: 2625821 - DNA, 15 bp, Homo sapiens
aagagaaaagaaaaa

SEQ ID NO: 2625822 - DNA, 16 bp, Homo sapiens
aagagaaaagaaaaaa

SEQ ID NO: 2625823 - DNA, 21 bp, Homo sapiens
aagagaaccgagcaaagatca

SEQ ID NO: 2625824 - DNA, 19 bp, Homo sapiens
aagagacaaacacctccca

SEQ ID NO: 2625825 - DNA, 20 bp, Homo sapiens
aagagacagtcaccccagga

SEQ ID NO: 2625826 - DNA, 14 bp, Homo sapiens
aagagactggagca

SEQ ID NO: 2625827 - DNA, 12 bp, Homo sapiens
aagagagaaaaa

SEQ ID NO: 2625828 - DNA, 14 bp, Homo sapiens
aagagagaaaataa

SEQ ID NO: 2625829 - DNA, 19 bp, Homo sapiens
aagagagaaaataaaaagt

SEQ ID NO: 2625830 - DNA, 20 bp, Homo sapiens
aagagagaaaataaaaagtt

SEQ ID NO: 2625831 - DNA, 22 bp, Homo sapiens
aagagagaaaataaaaagttaa

SEQ ID NO: 2625832 - DNA, 21 bp, Homo sapiens
aagagagaaagaagtaggcat

SEQ ID NO: 2625833 - DNA, 22 bp, Homo sapiens
aagagagcttaatgataatatt

SEQ ID NO: 2625834 - DNA, 11 bp, Homo sapiens
aagagaggagt

SEQ ID NO: 2625835 - DNA, 18 bp, Homo sapiens
aagagaggagttcaatga

SEQ ID NO: 2625836 - DNA, 20 bp, Homo sapiens
aagagatattttaaaatgag

SEQ ID NO: 2625837 - DNA, 21 bp, Homo sapiens
aagagatattttaaaatgaga

SEQ ID NO: 2625838 - DNA, 17 bp, Homo sapiens
aagagatgggcttgttt

SEQ ID NO: 2625839 - DNA, 20 bp, Homo sapiens
aagagatgggcttgttttct

SEQ ID NO: 2625840 - DNA, 19 bp, Homo sapiens
aagagattgtggtttcatt

SEQ ID NO: 2625841 - DNA, 17 bp, Homo sapiens
aagagattgttgtttgc

SEQ ID NO: 2625842 - DNA, 14 bp, Homo sapiens
aagagatttcaaga

SEQ ID NO: 2625843 - DNA, 15 bp, Homo sapiens
aagagatttttcatg

SEQ ID NO: 2625844 - DNA, 13 bp, Homo sapiens
aagagcacacttg

SEQ ID NO: 2625845 - DNA, 13 bp, Homo sapiens
aagagcagcctgt

SEQ ID NO: 2625846 - DNA, 18 bp, Homo sapiens
aagagcagcctgtggcat

SEQ ID NO: 2625847 - DNA, 19 bp, Homo sapiens
aagagccatataagtttga

SEQ ID NO: 2625848 - DNA, 14 bp, Homo sapiens
aagagcctggagaa

SEQ ID NO: 2625849 - DNA, 21 bp, Homo sapiens
aagagcctggagaagctgatg

SEQ ID NO: 2625850 - DNA, 11 bp, Homo sapiens
aagagctgagg

SEQ ID NO: 2625851 - DNA, 19 bp, Homo sapiens
aagagctgttcacagccag

SEQ ID NO: 2625852 - DNA, 14 bp, Homo sapiens
aagaggaaagaatg

SEQ ID NO: 2625853 - DNA, 15 bp, Homo sapiens
aagaggaaagaatga

SEQ ID NO: 2625854 - DNA, 21 bp, Homo sapiens
aagaggagtttcgaggtagag

SEQ ID NO: 2625855 - DNA, 16 bp, Homo sapiens
aagaggcagaaaattg

SEQ ID NO: 2625856 - DNA, 11 bp, Homo sapiens
aagaggcaggg

SEQ ID NO: 2625857 - DNA, 14 bp, Homo sapiens
aagaggcagggtct

SEQ ID NO: 2625858 - DNA, 15 bp, Homo sapiens
aagaggccaatgccc

SEQ ID NO: 2625859 - DNA, 15 bp, Homo sapiens
aagaggcgggccagc

SEQ ID NO: 2625860 - DNA, 22 bp, Homo sapiens
aagaggcgggccagccaggcgg

SEQ ID NO: 2625861 - DNA, 23 bp, Homo sapiens
aagagggaagaaagagaaggagc

SEQ ID NO: 2625862 - DNA, 17 bp, Homo sapiens
aagagggacgcctgggg

SEQ ID NO: 2625863 - DNA, 23 bp, Homo sapiens
aagagggagggagggctccagac

SEQ ID NO: 2625864 - DNA, 12 bp, Homo sapiens
aagagggcctgt

SEQ ID NO: 2625865 - DNA, 14 bp, Homo sapiens
aagagggcctgtgg

SEQ ID NO: 2625866 - DNA, 13 bp, Homo sapiens
aagaggggcagcc

SEQ ID NO: 2625867 - DNA, 15 bp, Homo sapiens
aagaggggctgggct

SEQ ID NO: 2625868 - DNA, 14 bp, Homo sapiens
aagaggggtggaga

SEQ ID NO: 2625869 - DNA, 21 bp, Homo sapiens
aagaggtatttatctttactt

SEQ ID NO: 2625870 - DNA, 16 bp, Homo sapiens
aagaggtgactgggcc

SEQ ID NO: 2625871 - DNA, 16 bp, Homo sapiens
aagaggtttttcttaa

SEQ ID NO: 2625872 - DNA, 20 bp, Homo sapiens
aagagtagaaactgcaggga

SEQ ID NO: 2625873 - DNA, 19 bp, Homo sapiens
aagagtagcatttcattct

SEQ ID NO: 2625874 - DNA, 13 bp, Homo sapiens
aagagtaggaaga

SEQ ID NO: 2625875 - DNA, 20 bp, Homo sapiens
aagagtaggaagactttgga

SEQ ID NO: 2625876 - DNA, 19 bp, Homo sapiens
aagagtagttgatgttgca

SEQ ID NO: 2625877 - DNA, 22 bp, Homo sapiens
aagagtgacagtggattgcatt

SEQ ID NO: 2625878 - DNA, 14 bp, Homo sapiens
aagagtgcattttc

SEQ ID NO: 2625879 - DNA, 20 bp, Homo sapiens
aagagtgcgccgagtctgtc

SEQ ID NO: 2625880 - DNA, 15 bp, Homo sapiens
aagagtgtactgggg

SEQ ID NO: 2625881 - DNA, 12 bp, Homo sapiens
aagagtgtagaa

SEQ ID NO: 2625882 - DNA, 15 bp, Homo sapiens
aagagtgtagaagca

SEQ ID NO: 2625883 - DNA, 19 bp, Homo sapiens
aagagtgtagatcagagca

SEQ ID NO: 2625884 - DNA, 14 bp, Homo sapiens
aagataaatgtgct

SEQ ID NO: 2625885 - DNA, 19 bp, Homo sapiens
aagataacaagatctttca

SEQ ID NO: 2625886 - DNA, 20 bp, Homo sapiens
aagataacaagatctttcag

SEQ ID NO: 2625887 - DNA, 22 bp, Homo sapiens
aagataacaagatctttcagga

SEQ ID NO: 2625888 - DNA, 16 bp, Homo sapiens
aagataataatatatg

SEQ ID NO: 2625889 - DNA, 17 bp, Homo sapiens
aagatacagttactcag

SEQ ID NO: 2625890 - DNA, 15 bp, Homo sapiens
aagatagcagggcat

SEQ ID NO: 2625891 - DNA, 12 bp, Homo sapiens
aagatatggaca

SEQ ID NO: 2625892 - DNA, 13 bp, Homo sapiens
aagatatttatat

SEQ ID NO: 2625893 - DNA, 19 bp, Homo sapiens
aagatattttaaaatctgt

SEQ ID NO: 2625894 - DNA, 22 bp, Homo sapiens
aagatattttgctttgtgattt

SEQ ID NO: 2625895 - DNA, 17 bp, Homo sapiens
aagatatttttatcttt

SEQ ID NO: 2625896 - DNA, 15 bp, Homo sapiens
aagatatttttcatg

SEQ ID NO: 2625897 - DNA, 20 bp, Homo sapiens
aagatcaaaaggttaataaa

SEQ ID NO: 2625898 - DNA, 15 bp, Homo sapiens
aagatcaaaataaaa

SEQ ID NO: 2625899 - DNA, 22 bp, Homo sapiens
aagatcaaaataaaaagtgaca

SEQ ID NO: 2625900 - DNA, 16 bp, Homo sapiens
aagatcatgtacccca

SEQ ID NO: 2625901 - DNA, 22 bp, Homo sapiens
aagatcctaaaacaaaagctca

SEQ ID NO: 2625902 - DNA, 23 bp, Homo sapiens
aagatcctaccccaattccttgt

SEQ ID NO: 2625903 - DNA, 16 bp, Homo sapiens
aagatcgcccccacct

SEQ ID NO: 2625904 - DNA, 19 bp, Homo sapiens
aagatctgtgcagccccgc

SEQ ID NO: 2625905 - DNA, 13 bp, Homo sapiens
aagatctttcagg

SEQ ID NO: 2625906 - DNA, 13 bp, Homo sapiens
aagatgaaaatat

SEQ ID NO: 2625907 - DNA, 14 bp, Homo sapiens
aagatgaaaatatt

SEQ ID NO: 2625908 - DNA, 13 bp, Homo sapiens
aagatgacacaag

SEQ ID NO: 2625909 - DNA, 23 bp, Homo sapiens
aagatgacattgctaagatgctc

SEQ ID NO: 2625910 - DNA, 15 bp, Homo sapiens
aagatgatcagacct

SEQ ID NO: 2625911 - DNA, 14 bp, Homo sapiens
aagatgatcatttg

SEQ ID NO: 2625912 - DNA, 15 bp, Homo sapiens
aagatgctcttctgt

SEQ ID NO: 2625913 - DNA, 17 bp, Homo sapiens
aagatgctcttctgtgg

SEQ ID NO: 2625914 - DNA, 22 bp, Homo sapiens
aagatgctggatgtctgccaat

SEQ ID NO: 2625915 - DNA, 11 bp, Homo sapiens
aagatgctggg

SEQ ID NO: 2625916 - DNA, 16 bp, Homo sapiens
aagatgctgggttggt

SEQ ID NO: 2625917 - DNA, 16 bp, Homo sapiens
aagatggattctcaga

SEQ ID NO: 2625918 - DNA, 21 bp, Homo sapiens
aagatggattggtgtaaaagg

SEQ ID NO: 2625919 - DNA, 18 bp, Homo sapiens
aagatggcatcctgtgaa

SEQ ID NO: 2625920 - DNA, 20 bp, Homo sapiens
aagatggctgtgcctctgcc

SEQ ID NO: 2625921 - DNA, 21 bp, Homo sapiens
aagatggctgtgcctctgcct

SEQ ID NO: 2625922 - DNA, 16 bp, Homo sapiens
aagatggtatatttgg

SEQ ID NO: 2625923 - DNA, 17 bp, Homo sapiens
aagattactttttcttt

SEQ ID NO: 2625924 - DNA, 11 bp, Homo sapiens
aagattagaag

SEQ ID NO: 2625925 - DNA, 15 bp, Homo sapiens
aagattcaggtatgt

SEQ ID NO: 2625926 - DNA, 20 bp, Homo sapiens
aagattcatatttacttctt

SEQ ID NO: 2625927 - DNA, 21 bp, Homo sapiens
aagattcatttttaatcatga

SEQ ID NO: 2625928 - DNA, 16 bp, Homo sapiens
aagattgcttaaaata

SEQ ID NO: 2625929 - DNA, 14 bp, Homo sapiens
aagatttatcaaat

SEQ ID NO: 2625930 - DNA, 13 bp, Homo sapiens
aagattttaaatt

SEQ ID NO: 2625931 - DNA, 19 bp, Homo sapiens
aagattttgaaatttttat

SEQ ID NO: 2625932 - DNA, 21 bp, Homo sapiens
aagattttggaggagaaggac

SEQ ID NO: 2625933 - DNA, 13 bp, Homo sapiens
aagatttttctca

SEQ ID NO: 2625934 - DNA, 14 bp, Homo sapiens
aagatttttctcaa

SEQ ID NO: 2625935 - DNA, 15 bp, Homo sapiens
aagatttttctcaaa

SEQ ID NO: 2625936 - DNA, 19 bp, Homo sapiens
aagatttttctcaaagttt

SEQ ID NO: 2625937 - DNA, 17 bp, Homo sapiens
aagcaaatcagaaactt

SEQ ID NO: 2625938 - DNA, 18 bp, Homo sapiens
aagcaaatgtgacctgtg

SEQ ID NO: 2625939 - DNA, 14 bp, Homo sapiens
aagcaaattgatga

SEQ ID NO: 2625940 - DNA, 18 bp, Homo sapiens
aagcaacctgggtccaaa

SEQ ID NO: 2625941 - DNA, 15 bp, Homo sapiens
aagcaagagagatgt

SEQ ID NO: 2625942 - DNA, 17 bp, Homo sapiens
aagcaagagagatgttt

SEQ ID NO: 2625943 - DNA, 18 bp, Homo sapiens
aagcaagagagatgtttt

SEQ ID NO: 2625944 - DNA, 22 bp, Homo sapiens
aagcaagtgattgggacagagg

SEQ ID NO: 2625945 - DNA, 17 bp, Homo sapiens
aagcaataaagaagagt

SEQ ID NO: 2625946 - DNA, 16 bp, Homo sapiens
aagcaataaatgaatg

SEQ ID NO: 2625947 - DNA, 16 bp, Homo sapiens
aagctctagtgggaag

SEQ ID NO: 2625948 - DNA, 17 bp, Homo sapiens
aagctctgctcctctcc

SEQ ID NO: 2625949 - DNA, 15 bp, Homo sapiens
aagctctggctgaac

SEQ ID NO: 2625950 - DNA, 21 bp, Homo sapiens
aagctctggtgacaccagcct

SEQ ID NO: 2625951 - DNA, 19 bp, Homo sapiens
aagctgcaccctcaggcag

SEQ ID NO: 2625952 - DNA, 15 bp, Homo sapiens
aagctgcctgctttt

SEQ ID NO: 2625953 - DNA, 20 bp, Homo sapiens
aagctgcctgcttttcactg

SEQ ID NO: 2625954 - DNA, 15 bp, Homo sapiens
aagctgcctggtata

SEQ ID NO: 2625955 - DNA, 21 bp, Homo sapiens
aagctgcctgtagttaggaaa

SEQ ID NO: 2625956 - DNA, 16 bp, Homo sapiens
aagctgctctggaatt

SEQ ID NO: 2625957 - DNA, 21 bp, Homo sapiens
aagctgctttaaaaaaataca

SEQ ID NO: 2625958 - DNA, 11 bp, Homo sapiens
aagctggaagc

SEQ ID NO: 2625959 - DNA, 19 bp, Homo sapiens
aagctggaggactagaacc

SEQ ID NO: 2625960 - DNA, 13 bp, Homo sapiens
aagctgggcaggt

SEQ ID NO: 2625961 - DNA, 18 bp, Homo sapiens
aagctggtcccactcagt

SEQ ID NO: 2625962 - DNA, 19 bp, Homo sapiens
aagctgtgacttctccagg

SEQ ID NO: 2625963 - DNA, 13 bp, Homo sapiens
aagctgttgtaca

SEQ ID NO: 2625964 - DNA, 20 bp, Homo sapiens
aagctgttgtacatttatga

SEQ ID NO: 2625965 - DNA, 20 bp, Homo sapiens
aagcttcttaaatgagaagg

SEQ ID NO: 2625966 - DNA, 14 bp, Homo sapiens
aagcttggcagccg

SEQ ID NO: 2625967 - DNA, 12 bp, Homo sapiens
aagcttgtgtat

SEQ ID NO: 2625968 - DNA, 22 bp, Homo sapiens
aagctttcatgtaaactgtgca

SEQ ID NO: 2625969 - DNA, 15 bp, Homo sapiens
aagctttctgtctcc

SEQ ID NO: 2625970 - DNA, 17 bp, Homo sapiens
aagctttgccagctgct

SEQ ID NO: 2625971 - DNA, 17 bp, Homo sapiens
aaggaaaaataaatatt

SEQ ID NO: 2625972 - DNA, 20 bp, Homo sapiens
aaggaaaccacagctgctgg

SEQ ID NO: 2625973 - DNA, 15 bp, Homo sapiens
aaggaaaccagtgca

SEQ ID NO: 2625974 - DNA, 15 bp, Homo sapiens
aaggaaacccagctc

SEQ ID NO: 2625975 - DNA, 13 bp, Homo sapiens
aaggaaagcaata

SEQ ID NO: 2625976 - DNA, 22 bp, Homo sapiens
aaggaaagggggtcccagtggg

SEQ ID NO: 2625977 - DNA, 22 bp, Homo sapiens
aaggaaataccagttctgggca

SEQ ID NO: 2625978 - DNA, 16 bp, Homo sapiens
aaggaaatctcacccc

SEQ ID NO: 2625979 - DNA, 22 bp, Homo sapiens
aaggaaatctcaccccatccca

SEQ ID NO: 2625980 - DNA, 13 bp, Homo sapiens
aaggaagactaga

SEQ ID NO: 2625981 - DNA, 22 bp, Homo sapiens
aaggaagccacagctggtggta

SEQ ID NO: 2625982 - DNA, 16 bp, Homo sapiens
aaggaagctccactgt

SEQ ID NO: 2625983 - DNA, 12 bp, Homo sapiens
aaggaaggaaag

SEQ ID NO: 2625984 - DNA, 16 bp, Homo sapiens
aaggaaggaaagaaag

SEQ ID NO: 2625985 - DNA, 16 bp, Homo sapiens
aaggaaggttttctcc

SEQ ID NO: 2625986 - DNA, 21 bp, Homo sapiens
aaggaataaattgctccttga

SEQ ID NO: 2625987 - DNA, 21 bp, Homo sapiens
aaggaatatgggagaaatagt

SEQ ID NO: 2625988 - DNA, 20 bp, Homo sapiens
aaggaatccactcccaggca

SEQ ID NO: 2625989 - DNA, 17 bp, Homo sapiens
aaggaatctccagtttt

SEQ ID NO: 2625990 - DNA, 20 bp, Homo sapiens
aaggaattctaggcatccca

SEQ ID NO: 2625991 - DNA, 23 bp, Homo sapiens
aaggacaaaaatgaactgaagtt

SEQ ID NO: 2625992 - DNA, 17 bp, Homo sapiens
aaggacagagtatgaac

SEQ ID NO: 2625993 - DNA, 18 bp, Homo sapiens
aaggacattgcggacagc

SEQ ID NO: 2625994 - DNA, 14 bp, Homo sapiens
aagtattttcctgt

SEQ ID NO: 2625995 - DNA, 17 bp, Homo sapiens
aagtcacatcacaggac

SEQ ID NO: 2625996 - DNA, 23 bp, Homo sapiens
aagtcactcccaagccccctcct

SEQ ID NO: 2625997 - DNA, 21 bp, Homo sapiens
aagtcactggccagtggctgg

SEQ ID NO: 2625998 - DNA, 20 bp, Homo sapiens
aagtcagaggatggccagtg

SEQ ID NO: 2625999 - DNA, 19 bp, Homo sapiens
aagtcagctttgccttcca

SEQ ID NO: 2626000 - DNA, 19 bp, Homo sapiens
aagtcatgcaaaggctggg

SEQ ID NO: 2626001 - DNA, 14 bp, Homo sapiens
aagtcatgtgcatt

SEQ ID NO: 2626002 - DNA, 12 bp, Homo sapiens
aagtcatgttcc

SEQ ID NO: 2626003 - DNA, 18 bp, Homo sapiens
aagtcattttaactttat

SEQ ID NO: 2626004 - DNA, 19 bp, Homo sapiens
aagtccagatttacactgg

SEQ ID NO: 2626005 - DNA, 22 bp, Homo sapiens
aagtccagatttacactgggag

SEQ ID NO: 2626006 - DNA, 14 bp, Homo sapiens
aagtccccaggccc

SEQ ID NO: 2626007 - DNA, 18 bp, Homo sapiens
aagtccccaggccccagg

SEQ ID NO: 2626008 - DNA, 19 bp, Homo sapiens
aagtccctgactctctgtg

SEQ ID NO: 2626009 - DNA, 21 bp, Homo sapiens
aagtccctgttttctgagccc

SEQ ID NO: 2626010 - DNA, 22 bp, Homo sapiens
aagtccctgttttctgagcccg

SEQ ID NO: 2626011 - DNA, 18 bp, Homo sapiens
aagtcctcttttctgaga

SEQ ID NO: 2626012 - DNA, 23 bp, Homo sapiens
aagtcctgaagaggcgggccagc

SEQ ID NO: 2626013 - DNA, 18 bp, Homo sapiens
aagtccttacctcttccg

SEQ ID NO: 2626014 - DNA, 13 bp, Homo sapiens
aagtcctttatgt

SEQ ID NO: 2626015 - DNA, 15 bp, Homo sapiens
aagtcgaattaatag

SEQ ID NO: 2626016 - DNA, 21 bp, Homo sapiens
aagtctcactggctgtcagta

SEQ ID NO: 2626017 - DNA, 17 bp, Homo sapiens
aagtctctaggttctga

SEQ ID NO: 2626018 - DNA, 19 bp, Homo sapiens
aagtctctgaagtgaaact

SEQ ID NO: 2626019 - DNA, 18 bp, Homo sapiens
aagtctcttttctttaga

SEQ ID NO: 2626020 - DNA, 22 bp, Homo sapiens
aagtctgtgtgatgaactttct

SEQ ID NO: 2626021 - DNA, 12 bp, Homo sapiens
aagtctgtttta

SEQ ID NO: 2626022 - DNA, 18 bp, Homo sapiens
aagtctgttttatgactt

SEQ ID NO: 2626023 - DNA, 23 bp, Homo sapiens
aagtctgttttatgacttcatta

SEQ ID NO: 2626024 - DNA, 16 bp, Homo sapiens
aagtgaaatcaaaggt

SEQ ID NO: 2626025 - DNA, 19 bp, Homo sapiens
aagtgaagacaatgactta

SEQ ID NO: 2626026 - DNA, 17 bp, Homo sapiens
aagtgaatttgaatgaa

SEQ ID NO: 2626027 - DNA, 19 bp, Homo sapiens
aagtgaatttgaatgaaaa

SEQ ID NO: 2626028 - DNA, 14 bp, Homo sapiens
aagtgaatttttct

SEQ ID NO: 2626029 - DNA, 18 bp, Homo sapiens
aagtgacaaggccccaga

SEQ ID NO: 2626030 - DNA, 15 bp, Homo sapiens
aagtgacagggaagc

SEQ ID NO: 2626031 - DNA, 16 bp, Homo sapiens
aagtgacagggaagct

SEQ ID NO: 2626032 - DNA, 19 bp, Homo sapiens
aagtgactgttcaagagca

SEQ ID NO: 2626033 - DNA, 19 bp, Homo sapiens
aagtgactttggctgcatg

SEQ ID NO: 2626034 - DNA, 15 bp, Homo sapiens
aagtgagacagtcca

SEQ ID NO: 2626035 - DNA, 14 bp, Homo sapiens
aagtgagagctggg

SEQ ID NO: 2626036 - DNA, 15 bp, Homo sapiens
aagtgagagctgggt

SEQ ID NO: 2626037 - DNA, 15 bp, Homo sapiens
aagtgataatttctg

SEQ ID NO: 2626038 - DNA, 14 bp, Homo sapiens
aagtgatcaataaa

SEQ ID NO: 2626039 - DNA, 13 bp, Homo sapiens
aagtgatcctccc

SEQ ID NO: 2626040 - DNA, 23 bp, Homo sapiens
aagtgatcctcccacctcagcct

SEQ ID NO: 2626041 - DNA, 21 bp, Homo sapiens
aagtgattaaacgtgcagact

SEQ ID NO: 2626042 - DNA, 15 bp, Homo sapiens
aagtgattctcctgc

SEQ ID NO: 2626043 - DNA, 12 bp, Homo sapiens
aagtgcaggctg

SEQ ID NO: 2626044 - DNA, 13 bp, Homo sapiens
aagtgcaggctgg

SEQ ID NO: 2626045 - DNA, 21 bp, Homo sapiens
aagtgcaggctggcaccgcct

SEQ ID NO: 2626046 - DNA, 21 bp, Homo sapiens
aagtgccagtcttgtgtctgc

SEQ ID NO: 2626047 - DNA, 22 bp, Homo sapiens
aagtgcgtccacgagctgttta

SEQ ID NO: 2626048 - DNA, 16 bp, Homo sapiens
aagtgcgtgtgtagag

SEQ ID NO: 2626049 - DNA, 17 bp, Homo sapiens
aagtgcgtgtgtagagt

SEQ ID NO: 2626050 - DNA, 19 bp, Homo sapiens
aagtgcgtgtgtagagtta

SEQ ID NO: 2626051 - DNA, 21 bp, Homo sapiens
aagtgcgtgtgtagagttaag

SEQ ID NO: 2626052 - DNA, 12 bp, Homo sapiens
aagtgctgggat

SEQ ID NO: 2626053 - DNA, 22 bp, Homo sapiens
aagtgctgggattacaggtgtg

SEQ ID NO: 2626054 - DNA, 19 bp, Homo sapiens
aagtggaaaaatagcctgc

SEQ ID NO: 2626055 - DNA, 13 bp, Homo sapiens
aagtggaaatgtt

SEQ ID NO: 2626056 - DNA, 18 bp, Homo sapiens
aagtggactggcccctgg

SEQ ID NO: 2626057 - DNA, 13 bp, Homo sapiens
aagtggggctcgc

SEQ ID NO: 2626058 - DNA, 13 bp, Homo sapiens
aagtggtgctcag

SEQ ID NO: 2626059 - DNA, 14 bp, Homo sapiens
aagtgtaaagcatt

SEQ ID NO: 2626060 - DNA, 21 bp, Homo sapiens
aagtgtaaagcattccaacaa

SEQ ID NO: 2626061 - DNA, 14 bp, Homo sapiens
aagtgtaacagctg

SEQ ID NO: 2626062 - DNA, 15 bp, Homo sapiens
aagtgtaacagctga

SEQ ID NO: 2626063 - DNA, 17 bp, Homo sapiens
aagtgtaacagctgagg

SEQ ID NO: 2626064 - DNA, 19 bp, Homo sapiens
aagtgtaagaaacacactg

SEQ ID NO: 2626065 - DNA, 17 bp, Homo sapiens
aagtgtgaacaaaagat

SEQ ID NO: 2626066 - DNA, 20 bp, Homo sapiens
aagtgtgattgggaataaat

SEQ ID NO: 2626067 - DNA, 18 bp, Homo sapiens
aagtgtgcatattgtaca

SEQ ID NO: 2626068 - DNA, 17 bp, Homo sapiens
aagtgtgggtctgtgtg

SEQ ID NO: 2626069 - DNA, 18 bp, Homo sapiens
aagtgtgggtctgtgtgt

SEQ ID NO: 2626070 - DNA, 20 bp, Homo sapiens
aagtgtgggtctgtgtgtgt

SEQ ID NO: 2626071 - DNA, 13 bp, Homo sapiens
aagtgtggtagag

SEQ ID NO: 2626072 - DNA, 22 bp, Homo sapiens
aagtgtgtatgtgcgtgtgtgc

SEQ ID NO: 2626073 - DNA, 11 bp, Homo sapiens
aagtgtgtgtg

SEQ ID NO: 2626074 - DNA, 16 bp, Homo sapiens
aagtgtgttgttgctt

SEQ ID NO: 2626075 - DNA, 19 bp, Homo sapiens
aataaaatgaggacatgtt

SEQ ID NO: 2626076 - DNA, 17 bp, Homo sapiens
aataaaatttgttgcat

SEQ ID NO: 2626077 - DNA, 18 bp, Homo sapiens
aataaaattttttttcat

SEQ ID NO: 2626078 - DNA, 13 bp, Homo sapiens
aataaacaaataa

SEQ ID NO: 2626079 - DNA, 23 bp, Homo sapiens
aataaacatccttcaagaactct

SEQ ID NO: 2626080 - DNA, 10 bp, Homo sapiens
aataaaccat

SEQ ID NO: 2626081 - DNA, 21 bp, Homo sapiens
aataaacgatttaattctctt

SEQ ID NO: 2626082 - DNA, 18 bp, Homo sapiens
aataaactcaatgagctc

SEQ ID NO: 2626083 - DNA, 17 bp, Homo sapiens
aataaacttttttttga

SEQ ID NO: 2626084 - DNA, 15 bp, Homo sapiens
aataaagagttagaa

SEQ ID NO: 2626085 - DNA, 19 bp, Homo sapiens
aataaagatcatgtaaaag

SEQ ID NO: 2626086 - DNA, 20 bp, Homo sapiens
aataaagatcatgtaaaagt

SEQ ID NO: 2626087 - DNA, 18 bp, Homo sapiens
aataaagccttcaaactc

SEQ ID NO: 2626088 - DNA, 15 bp, Homo sapiens
aataaagtatcatgc

SEQ ID NO: 2626089 - DNA, 18 bp, Homo sapiens
aataaagtatcatgcatt

SEQ ID NO: 2626090 - DNA, 12 bp, Homo sapiens
aataaataaatg

SEQ ID NO: 2626091 - DNA, 14 bp, Homo sapiens
aataaataaatgca

SEQ ID NO: 2626092 - DNA, 21 bp, Homo sapiens
aataaatagctatatccatgt

SEQ ID NO: 2626093 - DNA, 15 bp, Homo sapiens
aataaatatctgtac

SEQ ID NO: 2626094 - DNA, 11 bp, Homo sapiens
aataaatatgc

SEQ ID NO: 2626095 - DNA, 13 bp, Homo sapiens
aataaatatgcct

SEQ ID NO: 2626096 - DNA, 14 bp, Homo sapiens
aataaatatttatg

SEQ ID NO: 2626097 - DNA, 18 bp, Homo sapiens
aataaatgagctatgtat

SEQ ID NO: 2626098 - DNA, 22 bp, Homo sapiens
aataaatgagctatgtattaac

SEQ ID NO: 2626099 - DNA, 19 bp, Homo sapiens
aataaatgcaatatgtatt

SEQ ID NO: 2626100 - DNA, 13 bp, Homo sapiens
aataaatgtcttt

SEQ ID NO: 2626101 - DNA, 17 bp, Homo sapiens
aataaattatttattat

SEQ ID NO: 2626102 - DNA, 21 bp, Homo sapiens
aataaatttggttctaataga

SEQ ID NO: 2626103 - DNA, 15 bp, Homo sapiens
aataacaatgttaag

SEQ ID NO: 2626104 - DNA, 24 bp, Homo sapiens
aataacaatgttaaggaaactctt

SEQ ID NO: 2626105 - DNA, 20 bp, Homo sapiens
aataacacacatataaacat

SEQ ID NO: 2626106 - DNA, 15 bp, Homo sapiens
aataacagtgcatat

SEQ ID NO: 2626107 - DNA, 13 bp, Homo sapiens
aataacattacct

SEQ ID NO: 2626108 - DNA, 22 bp, Homo sapiens
aataaccacttaaaaaatgtcc

SEQ ID NO: 2626109 - DNA, 15 bp, Homo sapiens
aataactaaaaggta

SEQ ID NO: 2626110 - DNA, 14 bp, Homo sapiens
aataactactgtgt

SEQ ID NO: 2626111 - DNA, 17 bp, Homo sapiens
aataagacataacgttt

SEQ ID NO: 2626112 - DNA, 14 bp, Homo sapiens
aataagagaaagaa

SEQ ID NO: 2626113 - DNA, 17 bp, Homo sapiens
aataagtggttatttct

SEQ ID NO: 2626114 - DNA, 21 bp, Homo sapiens
aataagttcaaattcttctga

SEQ ID NO: 2626115 - DNA, 11 bp, Homo sapiens
aataataaatc

SEQ ID NO: 2626116 - DNA, 11 bp, Homo sapiens
aataatatgca

SEQ ID NO: 2626117 - DNA, 16 bp, Homo sapiens
aataatctatttctat

SEQ ID NO: 2626118 - DNA, 14 bp, Homo sapiens
aataatctttgggt

SEQ ID NO: 2626119 - DNA, 21 bp, Homo sapiens
aataatggtaccagataaaat

SEQ ID NO: 2626120 - DNA, 20 bp, Homo sapiens
aataatggtcccatccaggc

SEQ ID NO: 2626121 - DNA, 19 bp, Homo sapiens
aataatgtacatctggcct

SEQ ID NO: 2626122 - DNA, 17 bp, Homo sapiens
aataatgtgaaactgga

SEQ ID NO: 2626123 - DNA, 21 bp, Homo sapiens
aataattgatcaaattcattt

SEQ ID NO: 2626124 - DNA, 22 bp, Homo sapiens
aataatttcccaattaggaagt

SEQ ID NO: 2626125 - DNA, 20 bp, Homo sapiens
aataatttcctggtgtgaag

SEQ ID NO: 2626126 - DNA, 21 bp, Homo sapiens
aatacaccacctcactcctgt

SEQ ID NO: 2626127 - DNA, 16 bp, Homo sapiens
aatacaccactacatt

SEQ ID NO: 2626128 - DNA, 21 bp, Homo sapiens
aatacaccactacattctgtt

SEQ ID NO: 2626129 - DNA, 21 bp, Homo sapiens
aatacaccaggtagaacacaa

SEQ ID NO: 2626130 - DNA, 13 bp, Homo sapiens
aatacagacacta

SEQ ID NO: 2626131 - DNA, 20 bp, Homo sapiens
aatacagacactaagttata

SEQ ID NO: 2626132 - DNA, 24 bp, Homo sapiens
aatacagccaaagataatctctca

SEQ ID NO: 2626133 - DNA, 23 bp, Homo sapiens
aatacagggcatgcattttgcag

SEQ ID NO: 2626134 - DNA, 18 bp, Homo sapiens
aatacagttgttggcctc

SEQ ID NO: 2626135 - DNA, 17 bp, Homo sapiens
aatacatgacatttatt

SEQ ID NO: 2626136 - DNA, 23 bp, Homo sapiens
aatacatgacatttatttttcat

SEQ ID NO: 2626137 - DNA, 13 bp, Homo sapiens
aatacatgcatct

SEQ ID NO: 2626138 - DNA, 14 bp, Homo sapiens
aatacatgctgcta

SEQ ID NO: 2626139 - DNA, 12 bp, Homo sapiens
aataccaaggaa

SEQ ID NO: 2626140 - DNA, 19 bp, Homo sapiens
aataccagccagtaaatgg

SEQ ID NO: 2626141 - DNA, 13 bp, Homo sapiens
aataccagttctg

SEQ ID NO: 2626142 - DNA, 22 bp, Homo sapiens
aataccattttttaaggaaaca

SEQ ID NO: 2626143 - DNA, 14 bp, Homo sapiens
aatacctcttagct

SEQ ID NO: 2626144 - DNA, 12 bp, Homo sapiens
aatacctgccct

SEQ ID NO: 2626145 - DNA, 17 bp, Homo sapiens
aatactatttttactgc

SEQ ID NO: 2626146 - DNA, 16 bp, Homo sapiens
aatattaaatacagac

SEQ ID NO: 2626147 - DNA, 17 bp, Homo sapiens
aatattaaatacagaca

SEQ ID NO: 2626148 - DNA, 20 bp, Homo sapiens
aatattaaatacagacacta

SEQ ID NO: 2626149 - DNA, 19 bp, Homo sapiens
aatattagatgtgatttaa

SEQ ID NO: 2626150 - DNA, 20 bp, Homo sapiens
aatattagatgtgatttaat

SEQ ID NO: 2626151 - DNA, 15 bp, Homo sapiens
aatattagctttact

SEQ ID NO: 2626152 - DNA, 16 bp, Homo sapiens
aatattatactaagaa

SEQ ID NO: 2626153 - DNA, 12 bp, Homo sapiens
aatattccagag

SEQ ID NO: 2626154 - DNA, 15 bp, Homo sapiens
aatattccctagaaa

SEQ ID NO: 2626155 - DNA, 12 bp, Homo sapiens
aatattcctgaa

SEQ ID NO: 2626156 - DNA, 15 bp, Homo sapiens
aatattcctgaatga

SEQ ID NO: 2626157 - DNA, 19 bp, Homo sapiens
aatattgagaaagaaacta

SEQ ID NO: 2626158 - DNA, 23 bp, Homo sapiens
aatattgtgaagaaaaataaagt

SEQ ID NO: 2626159 - DNA, 20 bp, Homo sapiens
aatatttaaaatttattgct

SEQ ID NO: 2626160 - DNA, 14 bp, Homo sapiens
aatatttaaacagc

SEQ ID NO: 2626161 - DNA, 16 bp, Homo sapiens
aatatttaaacagcag

SEQ ID NO: 2626162 - DNA, 13 bp, Homo sapiens
aatatttaaacat

SEQ ID NO: 2626163 - DNA, 14 bp, Homo sapiens
aatatttatatatt

SEQ ID NO: 2626164 - DNA, 15 bp, Homo sapiens
aatatttatgtaaac

SEQ ID NO: 2626165 - DNA, 19 bp, Homo sapiens
aatatttatgtctatttaa

SEQ ID NO: 2626166 - DNA, 14 bp, Homo sapiens
aatatttattacct

SEQ ID NO: 2626167 - DNA, 15 bp, Homo sapiens
aatatttattacctc

SEQ ID NO: 2626168 - DNA, 18 bp, Homo sapiens
aatatttattacctctga

SEQ ID NO: 2626169 - DNA, 13 bp, Homo sapiens
aatatttatttat

SEQ ID NO: 2626170 - DNA, 14 bp, Homo sapiens
aatatttcaagaca

SEQ ID NO: 2626171 - DNA, 16 bp, Homo sapiens
aatatttcaagacatt

SEQ ID NO: 2626172 - DNA, 12 bp, Homo sapiens
aatatttgctga

SEQ ID NO: 2626173 - DNA, 15 bp, Homo sapiens
aatattttctgggtt

SEQ ID NO: 2626174 - DNA, 14 bp, Homo sapiens
aatattttgaatca

SEQ ID NO: 2626175 - DNA, 16 bp, Homo sapiens
aatattttgaatcaat

SEQ ID NO: 2626176 - DNA, 20 bp, Homo sapiens
aatattttgctagtttttga

SEQ ID NO: 2626177 - DNA, 13 bp, Homo sapiens
aatatttttctta

SEQ ID NO: 2626178 - DNA, 15 bp, Homo sapiens
aatcaaatatgcaaa

SEQ ID NO: 2626179 - DNA, 16 bp, Homo sapiens
aatcaaatatgcaaag

SEQ ID NO: 2626180 - DNA, 19 bp, Homo sapiens
aatcaactgggctgaacac

SEQ ID NO: 2626181 - DNA, 15 bp, Homo sapiens
aatcaagaaacttaa

SEQ ID NO: 2626182 - DNA, 20 bp, Homo sapiens
aatcaagatttaatcctaga

SEQ ID NO: 2626183 - DNA, 13 bp, Homo sapiens
aatcaagcctctg

SEQ ID NO: 2626184 - DNA, 22 bp, Homo sapiens
aatcaatgctataactatgttg

SEQ ID NO: 2626185 - DNA, 22 bp, Homo sapiens
aatcaatttaaacccattttag

SEQ ID NO: 2626186 - DNA, 15 bp, Homo sapiens
aatcacagttggcct

SEQ ID NO: 2626187 - DNA, 20 bp, Homo sapiens
aatcacgtaaagctagaaat

SEQ ID NO: 2626188 - DNA, 17 bp, Homo sapiens
aatcactaaaaatgatc

SEQ ID NO: 2626189 - DNA, 12 bp, Homo sapiens
aatcactcttgt

SEQ ID NO: 2626190 - DNA, 18 bp, Homo sapiens
aatcactcttgtggatgt

SEQ ID NO: 2626191 - DNA, 14 bp, Homo sapiens
aatcagatcatttc

SEQ ID NO: 2626192 - DNA, 14 bp, Homo sapiens
aatcagcaagaaga

SEQ ID NO: 2626193 - DNA, 23 bp, Homo sapiens
aatcagctatttactgccaaagg

SEQ ID NO: 2626194 - DNA, 20 bp, Homo sapiens
aatcagctccttcctggaga

SEQ ID NO: 2626195 - DNA, 14 bp, Homo sapiens
aatcagtataattc

SEQ ID NO: 2626196 - DNA, 21 bp, Homo sapiens
aatcagtcagtgcaaatgtca

SEQ ID NO: 2626197 - DNA, 15 bp, Homo sapiens
aatcagtcccctccc

SEQ ID NO: 2626198 - DNA, 18 bp, Homo sapiens
aatcataaactgtgtgca

SEQ ID NO: 2626199 - DNA, 22 bp, Homo sapiens
aatcatagtactctttgtagca

SEQ ID NO: 2626200 - DNA, 21 bp, Homo sapiens
aatcatataataaatgtacat

SEQ ID NO: 2626201 - DNA, 17 bp, Homo sapiens
aatcatgaaatatgcat

SEQ ID NO: 2626202 - DNA, 18 bp, Homo sapiens
aatcatggaatggttata

SEQ ID NO: 2626203 - DNA, 19 bp, Homo sapiens
aatcatgtacatttctgaa

SEQ ID NO: 2626204 - DNA, 23 bp, Homo sapiens
aatcattaggtgtgactgaattt

SEQ ID NO: 2626205 - DNA, 14 bp, Homo sapiens
aatcattgctttga

SEQ ID NO: 2626206 - DNA, 21 bp, Homo sapiens
aatcattgctttgaagcagtt

SEQ ID NO: 2626207 - DNA, 21 bp, Homo sapiens
aatgctggttttcctaaatgc

SEQ ID NO: 2626208 - DNA, 21 bp, Homo sapiens
aatgctgtgccctaaagtgta

SEQ ID NO: 2626209 - DNA, 20 bp, Homo sapiens
aatgcttatcatctaaagat

SEQ ID NO: 2626210 - DNA, 16 bp, Homo sapiens
aatgcttgaaaaatgt

SEQ ID NO: 2626211 - DNA, 21 bp, Homo sapiens
aatgcttggcttctcatacgt

SEQ ID NO: 2626212 - DNA, 12 bp, Homo sapiens
aatgctttcgat

SEQ ID NO: 2626213 - DNA, 12 bp, Homo sapiens
aatggaaactga

SEQ ID NO: 2626214 - DNA, 16 bp, Homo sapiens
aatggaaactgaatgc

SEQ ID NO: 2626215 - DNA, 18 bp, Homo sapiens
aatggaaccccaccactg

SEQ ID NO: 2626216 - DNA, 18 bp, Homo sapiens
aatggaaggtttgtatat

SEQ ID NO: 2626217 - DNA, 20 bp, Homo sapiens
aatggactaacttgtctttg

SEQ ID NO: 2626218 - DNA, 19 bp, Homo sapiens
aatggagtcagtttgcagt

SEQ ID NO: 2626219 - DNA, 19 bp, Homo sapiens
aatggcacagcccaaagaa

SEQ ID NO: 2626220 - DNA, 17 bp, Homo sapiens
aatggcctcctccctta

SEQ ID NO: 2626221 - DNA, 14 bp, Homo sapiens
aatggcctgccttg

SEQ ID NO: 2626222 - DNA, 22 bp, Homo sapiens
aatggcctgccttgaagccact

SEQ ID NO: 2626223 - DNA, 20 bp, Homo sapiens
aatggcgcagtgcctctggt

SEQ ID NO: 2626224 - DNA, 19 bp, Homo sapiens
aatggcgtgaacccgggag

SEQ ID NO: 2626225 - DNA, 16 bp, Homo sapiens
aatggctaattcccag

SEQ ID NO: 2626226 - DNA, 21 bp, Homo sapiens
aatggcttatccagctggtga

SEQ ID NO: 2626227 - DNA, 16 bp, Homo sapiens
aatgggaatattttat

SEQ ID NO: 2626228 - DNA, 17 bp, Homo sapiens
aatgggacttcttttca

SEQ ID NO: 2626229 - DNA, 13 bp, Homo sapiens
aatgggcagagca

SEQ ID NO: 2626230 - DNA, 21 bp, Homo sapiens
aatgggcagttacatgcatac

SEQ ID NO: 2626231 - DNA, 19 bp, Homo sapiens
aatgggggtagcagctgga

SEQ ID NO: 2626232 - DNA, 16 bp, Homo sapiens
aatgggtatctatatt

SEQ ID NO: 2626233 - DNA, 15 bp, Homo sapiens
aatggtatagcaaat

SEQ ID NO: 2626234 - DNA, 14 bp, Homo sapiens
aatggtccaggaga

SEQ ID NO: 2626235 - DNA, 16 bp, Homo sapiens
aatggtccagggttga

SEQ ID NO: 2626236 - DNA, 17 bp, Homo sapiens
aatggtcccatccaggc

SEQ ID NO: 2626237 - DNA, 16 bp, Homo sapiens
aatggtcgcccaggag

SEQ ID NO: 2626238 - DNA, 10 bp, Homo sapiens
aatggtgcct

SEQ ID NO: 2626239 - DNA, 14 bp, Homo sapiens
aatggttataaaag

SEQ ID NO: 2626240 - DNA, 19 bp, Homo sapiens
aatggttataaaagtgatt

SEQ ID NO: 2626241 - DNA, 19 bp, Homo sapiens
aatggttccatgcctgagg

SEQ ID NO: 2626242 - DNA, 17 bp, Homo sapiens
aatggtttgcaaggaag

SEQ ID NO: 2626243 - DNA, 18 bp, Homo sapiens
aatggtttgcaaggaagc

SEQ ID NO: 2626244 - DNA, 19 bp, Homo sapiens
aatggtttgcaaggaagcc

SEQ ID NO: 2626245 - DNA, 18 bp, Homo sapiens
aatgtaaatattctatat

SEQ ID NO: 2626246 - DNA, 15 bp, Homo sapiens
aatgtaacttttgta

SEQ ID NO: 2626247 - DNA, 22 bp, Homo sapiens
aatgtaacttttgtaagacaaa

SEQ ID NO: 2626248 - DNA, 14 bp, Homo sapiens
aatgtaagctgttt

SEQ ID NO: 2626249 - DNA, 16 bp, Homo sapiens
aatgtaattgaataaa

SEQ ID NO: 2626250 - DNA, 21 bp, Homo sapiens
aatgtacagcaaggagattta

SEQ ID NO: 2626251 - DNA, 15 bp, Homo sapiens
aatgtacattaatta

SEQ ID NO: 2626252 - DNA, 12 bp, Homo sapiens
aatgtactgaga

SEQ ID NO: 2626253 - DNA, 15 bp, Homo sapiens
aatgtactgagattt

SEQ ID NO: 2626254 - DNA, 17 bp, Homo sapiens
aatgtagctggtttcct

SEQ ID NO: 2626255 - DNA, 21 bp, Homo sapiens
aatgtaggccaaatttgtagt

SEQ ID NO: 2626256 - DNA, 13 bp, Homo sapiens
aatgtatatgcac

SEQ ID NO: 2626257 - DNA, 18 bp, Homo sapiens
aatgtatcaggaaatata

SEQ ID NO: 2626258 - DNA, 16 bp, Homo sapiens
aatgtatcttattcac

SEQ ID NO: 2626259 - DNA, 17 bp, Homo sapiens
aatgtatcttattcaca

SEQ ID NO: 2626260 - DNA, 13 bp, Homo sapiens
aatgtatgtgcac

SEQ ID NO: 2626261 - DNA, 20 bp, Homo sapiens
aatgtatgtgcactgtcact

SEQ ID NO: 2626262 - DNA, 21 bp, Homo sapiens
aatgtatgtgcactgtcactt

SEQ ID NO: 2626263 - DNA, 17 bp, Homo sapiens
aatgtattattctgcag

SEQ ID NO: 2626264 - DNA, 19 bp, Homo sapiens
aatgtattgaacttggaaa

SEQ ID NO: 2626265 - DNA, 22 bp, Homo sapiens
aatgtattgtaccttttaacac

SEQ ID NO: 2626266 - DNA, 23 bp, Homo sapiens
aatgtattgtaccttttaacacc

SEQ ID NO: 2626267 - DNA, 19 bp, Homo sapiens
aatgtattgttggtaatta

SEQ ID NO: 2626268 - DNA, 21 bp, Homo sapiens
aatgtatttatttaaaagatt

SEQ ID NO: 2626269 - DNA, 13 bp, Homo sapiens
aatgtcacaggca

SEQ ID NO: 2626270 - DNA, 19 bp, Homo sapiens
aatgtcagaaaccagttat

SEQ ID NO: 2626271 - DNA, 15 bp, Homo sapiens
aatgtcagatacaat

SEQ ID NO: 2626272 - DNA, 16 bp, Homo sapiens
aatgtcagatacaatg

SEQ ID NO: 2626273 - DNA, 17 bp, Homo sapiens
aatgtcagatacaatgt

SEQ ID NO: 2626274 - DNA, 18 bp, Homo sapiens
aatgtccatgatggaata

SEQ ID NO: 2626275 - DNA, 18 bp, Homo sapiens
aatgtcctccagaagcct

SEQ ID NO: 2626276 - DNA, 21 bp, Homo sapiens
aatgtcctccagaagcctctg

SEQ ID NO: 2626277 - DNA, 12 bp, Homo sapiens
aatgtctaaatg

SEQ ID NO: 2626278 - DNA, 17 bp, Homo sapiens
aatgtctaaatgctgaa

SEQ ID NO: 2626279 - DNA, 18 bp, Homo sapiens
aatgtctaaatgctgaaa

SEQ ID NO: 2626280 - DNA, 21 bp, Homo sapiens
aatgtcttcatttcattgtat

SEQ ID NO: 2626281 - DNA, 22 bp, Homo sapiens
aatgtcttctgtattcacttat

SEQ ID NO: 2626282 - DNA, 13 bp, Homo sapiens
aatgtcttgtgtt

SEQ ID NO: 2626283 - DNA, 18 bp, Homo sapiens
aatgtctttgttggaaaa

SEQ ID NO: 2626284 - DNA, 22 bp, Homo sapiens
aatgtctttgttggaaaagaat

SEQ ID NO: 2626285 - DNA, 17 bp, Homo sapiens
aatgtgaaaagaaaaat

SEQ ID NO: 2626286 - DNA, 14 bp, Homo sapiens
aatgtgaagtgtta

SEQ ID NO: 2626287 - DNA, 20 bp, Homo sapiens
aatgtgatgaatactgtatt

SEQ ID NO: 2626288 - DNA, 19 bp, Homo sapiens
aatgtgcaggtttgttaca

SEQ ID NO: 2626289 - DNA, 12 bp, Homo sapiens
aatgtgctgtgt

SEQ ID NO: 2626290 - DNA, 16 bp, Homo sapiens
aatgtgctgtgtaaag

SEQ ID NO: 2626291 - DNA, 19 bp, Homo sapiens
aatgtgtatcggatgcttt

SEQ ID NO: 2626292 - DNA, 19 bp, Homo sapiens
aatgtgtgccatagagttt

SEQ ID NO: 2626293 - DNA, 22 bp, Homo sapiens
aatgttaaggaaactcttatct

SEQ ID NO: 2626294 - DNA, 16 bp, Homo sapiens
aatgttacattattat

SEQ ID NO: 2626295 - DNA, 13 bp, Homo sapiens
aatgttactgatc

SEQ ID NO: 2626296 - DNA, 22 bp, Homo sapiens
aatgttactgatcatgcattgt

SEQ ID NO: 2626297 - DNA, 15 bp, Homo sapiens
aatgttagatagtta

SEQ ID NO: 2626298 - DNA, 22 bp, Homo sapiens
aatgttatgttgtgttctaata

SEQ ID NO: 2626299 - DNA, 22 bp, Homo sapiens
aatgttatttgttattttcagt

SEQ ID NO: 2626300 - DNA, 12 bp, Homo sapiens
aatgttcatcat

SEQ ID NO: 2626301 - DNA, 22 bp, Homo sapiens
aatgttcattgtaatgttactg

SEQ ID NO: 2626302 - DNA, 17 bp, Homo sapiens
aatgttctgacattaac

SEQ ID NO: 2626303 - DNA, 20 bp, Homo sapiens
aatgttgcttaggatgtgtg

SEQ ID NO: 2626304 - DNA, 22 bp, Homo sapiens
aatgttggatttataaatgcta

SEQ ID NO: 2626305 - DNA, 15 bp, Homo sapiens
aatgttgttatttaa

SEQ ID NO: 2626306 - DNA, 12 bp, Homo sapiens
aatgtttccttt

SEQ ID NO: 2626307 - DNA, 13 bp, Homo sapiens
aatgtttccttta

SEQ ID NO: 2626308 - DNA, 14 bp, Homo sapiens
aattcaaagctcta

SEQ ID NO: 2626309 - DNA, 18 bp, Homo sapiens
aattcaaagctctattaa

SEQ ID NO: 2626310 - DNA, 14 bp, Homo sapiens
aattcaaccctttg

SEQ ID NO: 2626311 - DNA, 15 bp, Homo sapiens
aattcaactcagact

SEQ ID NO: 2626312 - DNA, 20 bp, Homo sapiens
aattcagatatatttttcac

SEQ ID NO: 2626313 - DNA, 13 bp, Homo sapiens
aattcatattctg

SEQ ID NO: 2626314 - DNA, 11 bp, Homo sapiens
aattcatgaac

SEQ ID NO: 2626315 - DNA, 23 bp, Homo sapiens
aattcatgaacttcgcatcaaaa

SEQ ID NO: 2626316 - DNA, 12 bp, Homo sapiens
aattccaaggag

SEQ ID NO: 2626317 - DNA, 13 bp, Homo sapiens
aattccactggac

SEQ ID NO: 2626318 - DNA, 21 bp, Homo sapiens
aattccactggacttgagctt

SEQ ID NO: 2626319 - DNA, 22 bp, Homo sapiens
aattccactgtcaagaaagagc

SEQ ID NO: 2626320 - DNA, 22 bp, Homo sapiens
aattccacttataggaattgac

SEQ ID NO: 2626321 - DNA, 11 bp, Homo sapiens
aattccatgaa

SEQ ID NO: 2626322 - DNA, 19 bp, Homo sapiens
aattcccattttgcaaaat

SEQ ID NO: 2626323 - DNA, 21 bp, Homo sapiens
aattcccattttgcaaaattt

SEQ ID NO: 2626324 - DNA, 10 bp, Homo sapiens
aattccctat

SEQ ID NO: 2626325 - DNA, 22 bp, Homo sapiens
aattccctatcttttagtttta

SEQ ID NO: 2626326 - DNA, 16 bp, Homo sapiens
aattccctctctctga

SEQ ID NO: 2626327 - DNA, 21 bp, Homo sapiens
aattccctctctctgactctc

SEQ ID NO: 2626328 - DNA, 23 bp, Homo sapiens
aattccctctctctgactctcaa

SEQ ID NO: 2626329 - DNA, 14 bp, Homo sapiens
aattccctgctgtc

SEQ ID NO: 2626330 - DNA, 19 bp, Homo sapiens
aattccctggcctttcata

SEQ ID NO: 2626331 - DNA, 20 bp, Homo sapiens
aattcctattgtgatttgac

SEQ ID NO: 2626332 - DNA, 13 bp, Homo sapiens
aattcctctggga

SEQ ID NO: 2626333 - DNA, 14 bp, Homo sapiens
aattcctctgggaa

SEQ ID NO: 2626334 - DNA, 11 bp, Homo sapiens
aattcctgggc

SEQ ID NO: 2626335 - DNA, 14 bp, Homo sapiens
aattctactttgag

SEQ ID NO: 2626336 - DNA, 17 bp, Homo sapiens
aattctcaacctaccac

SEQ ID NO: 2626337 - DNA, 15 bp, Homo sapiens
aattctcttatccaa

SEQ ID NO: 2626338 - DNA, 15 bp, Homo sapiens
aattctgctacctca

SEQ ID NO: 2626339 - DNA, 17 bp, Homo sapiens
aattctgtacatagcct

SEQ ID NO: 2626340 - DNA, 21 bp, Homo sapiens
aattctgtacatagcctatat

SEQ ID NO: 2626341 - DNA, 22 bp, Homo sapiens
aattctgtactgatttttgtaa

SEQ ID NO: 2626342 - DNA, 12 bp, Homo sapiens
aattctgtttta

SEQ ID NO: 2626343 - DNA, 18 bp, Homo sapiens
aattctgtttttctaggc

SEQ ID NO: 2626344 - DNA, 17 bp, Homo sapiens
aattcttacaaacatgt

SEQ ID NO: 2626345 - DNA, 15 bp, Homo sapiens
aattcttatgcttat

SEQ ID NO: 2626346 - DNA, 13 bp, Homo sapiens
aattcttctgaac

SEQ ID NO: 2626347 - DNA, 23 bp, Homo sapiens
aattcttctgaactcaaactgag

SEQ ID NO: 2626348 - DNA, 15 bp, Homo sapiens
aattcttggaatact

SEQ ID NO: 2626349 - DNA, 16 bp, Homo sapiens
aattcttgtatattat

SEQ ID NO: 2626350 - DNA, 18 bp, Homo sapiens
aattctttgacctgttgg

SEQ ID NO: 2626351 - DNA, 22 bp, Homo sapiens
aattctttgacctgttgggagt

SEQ ID NO: 2626352 - DNA, 17 bp, Homo sapiens
aattgaaaggcattctc

SEQ ID NO: 2626353 - DNA, 21 bp, Homo sapiens
aattgaaaggcattctctgaa

SEQ ID NO: 2626354 - DNA, 22 bp, Homo sapiens
aattgaaaggcattctctgaag

SEQ ID NO: 2626355 - DNA, 22 bp, Homo sapiens
aattgaataatggtaccagata

SEQ ID NO: 2626356 - DNA, 23 bp, Homo sapiens
aattgaataatggtaccagataa

SEQ ID NO: 2626357 - DNA, 18 bp, Homo sapiens
aattgacagatcaagctg

SEQ ID NO: 2626358 - DNA, 23 bp, Homo sapiens
aattgacagatcaagctgtgaga

SEQ ID NO: 2626359 - DNA, 15 bp, Homo sapiens
aattgagattagagg

SEQ ID NO: 2626360 - DNA, 22 bp, Homo sapiens
aattgattattctgattccact

SEQ ID NO: 2626361 - DNA, 14 bp, Homo sapiens
aattgcacttttaa

SEQ ID NO: 2626362 - DNA, 18 bp, Homo sapiens
aattgcacttttaaacct

SEQ ID NO: 2626363 - DNA, 20 bp, Homo sapiens
aattgctcctaagcttcaaa

SEQ ID NO: 2626364 - DNA, 12 bp, Homo sapiens
aattgctccttg

SEQ ID NO: 2626365 - DNA, 15 bp, Homo sapiens
aattgcttacatttt

SEQ ID NO: 2626366 - DNA, 18 bp, Homo sapiens
aattggaccatcctattt

SEQ ID NO: 2626367 - DNA, 18 bp, Homo sapiens
aattggtatcaagaaagt

SEQ ID NO: 2626368 - DNA, 21 bp, Homo sapiens
aattgtacatatttgtggaat

SEQ ID NO: 2626369 - DNA, 13 bp, Homo sapiens
aattgtataacag

SEQ ID NO: 2626370 - DNA, 16 bp, Homo sapiens
aattgtataacaggtt

SEQ ID NO: 2626371 - DNA, 18 bp, Homo sapiens
aattgtataacaggttat

SEQ ID NO: 2626372 - DNA, 20 bp, Homo sapiens
aattgtatcagaggcctata

SEQ ID NO: 2626373 - DNA, 22 bp, Homo sapiens
aattgtatcagaggcctataat

SEQ ID NO: 2626374 - DNA, 11 bp, Homo sapiens
aattgtgatgt

SEQ ID NO: 2626375 - DNA, 15 bp, Homo sapiens
aattgttaagatatg

SEQ ID NO: 2626376 - DNA, 17 bp, Homo sapiens
aattgttgtttctttct

SEQ ID NO: 2626377 - DNA, 19 bp, Homo sapiens
aattgttgtttctttctag

SEQ ID NO: 2626378 - DNA, 13 bp, Homo sapiens
aatttaaaaaata

SEQ ID NO: 2626379 - DNA, 19 bp, Homo sapiens
aatttaaacaggcccagca

SEQ ID NO: 2626380 - DNA, 18 bp, Homo sapiens
aatttaaacccattttag

SEQ ID NO: 2626381 - DNA, 12 bp, Homo sapiens
aatttaaagcaa

SEQ ID NO: 2626382 - DNA, 21 bp, Homo sapiens
aatttaaagggtgtacttata

SEQ ID NO: 2626383 - DNA, 14 bp, Homo sapiens
aatttaaatataat

SEQ ID NO: 2626384 - DNA, 16 bp, Homo sapiens
aatttaaatataattc

SEQ ID NO: 2626385 - DNA, 19 bp, Homo sapiens
aatttaaatataattctgt

SEQ ID NO: 2626386 - DNA, 20 bp, Homo sapiens
aatttaaatataattctgta

SEQ ID NO: 2626387 - DNA, 23 bp, Homo sapiens
aatttaaatataattctgtaaat

SEQ ID NO: 2626388 - DNA, 11 bp, Homo sapiens
aatttaagcat

SEQ ID NO: 2626389 - DNA, 14 bp, Homo sapiens
aatttaagtatctt

SEQ ID NO: 2626390 - DNA, 18 bp, Homo sapiens
aatttaattcatgtttct

SEQ ID NO: 2626391 - DNA, 15 bp, Homo sapiens
aatttatacaatatc

SEQ ID NO: 2626392 - DNA, 17 bp, Homo sapiens
aatttatcacacttctg

SEQ ID NO: 2626393 - DNA, 19 bp, Homo sapiens
aatttatcctgaaatttca

SEQ ID NO: 2626394 - DNA, 19 bp, Homo sapiens
aatttattagttaatatat

SEQ ID NO: 2626395 - DNA, 13 bp, Homo sapiens
aatttattatggc

SEQ ID NO: 2626396 - DNA, 18 bp, Homo sapiens
aatttattattgaaattg

SEQ ID NO: 2626397 - DNA, 20 bp, Homo sapiens
aatttatttatactatttag

SEQ ID NO: 2626398 - DNA, 17 bp, Homo sapiens
aatttatttattaagat

SEQ ID NO: 2626399 - DNA, 20 bp, Homo sapiens
aatttcaggttttgtaaaga

SEQ ID NO: 2626400 - DNA, 11 bp, Homo sapiens
aatttccagag

SEQ ID NO: 2626401 - DNA, 15 bp, Homo sapiens
aatttccagtacctt

SEQ ID NO: 2626402 - DNA, 22 bp, Homo sapiens
aatttcccacaccgtgtaaacc

SEQ ID NO: 2626403 - DNA, 14 bp, Homo sapiens
aatttccccaacag

SEQ ID NO: 2626404 - DNA, 13 bp, Homo sapiens
aatttcctctatt

SEQ ID NO: 2626405 - DNA, 16 bp, Homo sapiens
aatttcctttatattt

SEQ ID NO: 2626406 - DNA, 21 bp, Homo sapiens
aatttcctttatatttagtga

SEQ ID NO: 2626407 - DNA, 21 bp, Homo sapiens
aatttctaaatctccaaaata

SEQ ID NO: 2626408 - DNA, 18 bp, Homo sapiens
aatttctaccatttcaga

SEQ ID NO: 2626409 - DNA, 19 bp, Homo sapiens
aatttctccccagggtgga

SEQ ID NO: 2626410 - DNA, 13 bp, Homo sapiens
aatttctgtcctt

SEQ ID NO: 2626411 - DNA, 17 bp, Homo sapiens
aatttcttggtaagaag

SEQ ID NO: 2626412 - DNA, 18 bp, Homo sapiens
aatttctttgcctgttca

SEQ ID NO: 2626413 - DNA, 18 bp, Homo sapiens
aatttgaaaataattgtt

SEQ ID NO: 2626414 - DNA, 16 bp, Homo sapiens
aatttgaatgaaaaat

SEQ ID NO: 2626415 - DNA, 17 bp, Homo sapiens
aatttgagatacaaaca

SEQ ID NO: 2626416 - DNA, 14 bp, Homo sapiens
aatttgaggacaac

SEQ ID NO: 2626417 - DNA, 21 bp, Homo sapiens
aatttgatacatatgtgaata

SEQ ID NO: 2626418 - DNA, 18 bp, Homo sapiens
aatttgatcgttccagtt

SEQ ID NO: 2626419 - DNA, 15 bp, Homo sapiens
aatttgatttctatt

SEQ ID NO: 2626420 - DNA, 20 bp, Homo sapiens
cagcatgggcccaggaatgc

SEQ ID NO: 2626421 - DNA, 17 bp, Homo sapiens
cagcattgctggttcta

SEQ ID NO: 2626422 - DNA, 16 bp, Homo sapiens
cagcattgctttctga

SEQ ID NO: 2626423 - DNA, 16 bp, Homo sapiens
cagcatttctgaagtg

SEQ ID NO: 2626424 - DNA, 18 bp, Homo sapiens
cagcattttactgattca

SEQ ID NO: 2626425 - DNA, 19 bp, Homo sapiens
cagccaaacccatgaggca

SEQ ID NO: 2626426 - DNA, 16 bp, Homo sapiens
cagccaaaccctgtct

SEQ ID NO: 2626427 - DNA, 17 bp, Homo sapiens
cagccaaaccctgtctg

SEQ ID NO: 2626428 - DNA, 18 bp, Homo sapiens
cagccaacaggtggcagg

SEQ ID NO: 2626429 - DNA, 22 bp, Homo sapiens
cagccaacaggtggcaggacca

SEQ ID NO: 2626430 - DNA, 12 bp, Homo sapiens
cagccaacccct

SEQ ID NO: 2626431 - DNA, 21 bp, Homo sapiens
cagccaacgagtaatttattg

SEQ ID NO: 2626432 - DNA, 17 bp, Homo sapiens
cagccaagcacagtggt

SEQ ID NO: 2626433 - DNA, 16 bp, Homo sapiens
cagccacacacacaga

SEQ ID NO: 2626434 - DNA, 19 bp, Homo sapiens
cagccacacacacagaaaa

SEQ ID NO: 2626435 - DNA, 15 bp, Homo sapiens
cagccacattcctga

SEQ ID NO: 2626436 - DNA, 19 bp, Homo sapiens
cagccacattcctgatgct

SEQ ID NO: 2626437 - DNA, 12 bp, Homo sapiens
cagccaccagcg

SEQ ID NO: 2626438 - DNA, 21 bp, Homo sapiens
cagccaccccgggctctctgc

SEQ ID NO: 2626439 - DNA, 17 bp, Homo sapiens
cagccacggccaggcca

SEQ ID NO: 2626440 - DNA, 23 bp, Homo sapiens
cagccacggccaggccagaggga

SEQ ID NO: 2626441 - DNA, 14 bp, Homo sapiens
cagccagactggca

SEQ ID NO: 2626442 - DNA, 18 bp, Homo sapiens
cagccagactggcacagt

SEQ ID NO: 2626443 - DNA, 20 bp, Homo sapiens
cagccagactggcacagttt

SEQ ID NO: 2626444 - DNA, 20 bp, Homo sapiens
cagccagagttcctgcggag

SEQ ID NO: 2626445 - DNA, 22 bp, Homo sapiens
cagccagatggactccagcctg

SEQ ID NO: 2626446 - DNA, 13 bp, Homo sapiens
cagccagcaatga

SEQ ID NO: 2626447 - DNA, 16 bp, Homo sapiens
cagccagctctcagcc

SEQ ID NO: 2626448 - DNA, 18 bp, Homo sapiens
cagccagctctcagccaa

SEQ ID NO: 2626449 - DNA, 11 bp, Homo sapiens
cagccaggagc

SEQ ID NO: 2626450 - DNA, 16 bp, Homo sapiens
cagccaggagctgggc

SEQ ID NO: 2626451 - DNA, 13 bp, Homo sapiens
cagccaggccaca

SEQ ID NO: 2626452 - DNA, 14 bp, Homo sapiens
cagccaggcgggct

SEQ ID NO: 2626453 - DNA, 15 bp, Homo sapiens
cagccaggcgggctc

SEQ ID NO: 2626454 - DNA, 16 bp, Homo sapiens
cagccaggctctgtgc

SEQ ID NO: 2626455 - DNA, 18 bp, Homo sapiens
cagccaggctctgtgctg

SEQ ID NO: 2626456 - DNA, 16 bp, Homo sapiens
cagccagggctgctag

SEQ ID NO: 2626457 - DNA, 23 bp, Homo sapiens
cagccagggctgctagacggagg

SEQ ID NO: 2626458 - DNA, 13 bp, Homo sapiens
cagccaggtgcct

SEQ ID NO: 2626459 - DNA, 16 bp, Homo sapiens
cagccaggtgccttgg

SEQ ID NO: 2626460 - DNA, 16 bp, Homo sapiens
cagccagtgacctgag

SEQ ID NO: 2626461 - DNA, 20 bp, Homo sapiens
cagccagtgacctgaggaag

SEQ ID NO: 2626462 - DNA, 22 bp, Homo sapiens
cagccagtgacctgaggaagcg

SEQ ID NO: 2626463 - DNA, 18 bp, Homo sapiens
cagccatctgcccagggg

SEQ ID NO: 2626464 - DNA, 13 bp, Homo sapiens
cagccatgtgctg

SEQ ID NO: 2626465 - DNA, 16 bp, Homo sapiens
cagccattaccatgga

SEQ ID NO: 2626466 - DNA, 19 bp, Homo sapiens
cagccattcactgccccca

SEQ ID NO: 2626467 - DNA, 19 bp, Homo sapiens
cagccattggctatttaaa

SEQ ID NO: 2626468 - DNA, 12 bp, Homo sapiens
cagcccaccccc

SEQ ID NO: 2626469 - DNA, 13 bp, Homo sapiens
cagcccaccctcc

SEQ ID NO: 2626470 - DNA, 15 bp, Homo sapiens
cagcccaccctcctg

SEQ ID NO: 2626471 - DNA, 15 bp, Homo sapiens
cagcccacttctgcc

SEQ ID NO: 2626472 - DNA, 23 bp, Homo sapiens
cagcccaggccggggtggagcat

SEQ ID NO: 2626473 - DNA, 17 bp, Homo sapiens
cagcccatgcccacctg

SEQ ID NO: 2626474 - DNA, 19 bp, Homo sapiens
cagcccatgcccacctgcc

SEQ ID NO: 2626475 - DNA, 13 bp, Homo sapiens
cagccccacccag

SEQ ID NO: 2626476 - DNA, 18 bp, Homo sapiens
cagccccagtgcccacag

SEQ ID NO: 2626477 - DNA, 11 bp, Homo sapiens
cagccccatcc

SEQ ID NO: 2626478 - DNA, 12 bp, Homo sapiens
cagccccatcct

SEQ ID NO: 2626479 - DNA, 14 bp, Homo sapiens
cagccccattctgc

SEQ ID NO: 2626480 - DNA, 16 bp, Homo sapiens
cagccccattctgcct

SEQ ID NO: 2626481 - DNA, 20 bp, Homo sapiens
cagccccattctgcctgccc

SEQ ID NO: 2626482 - DNA, 21 bp, Homo sapiens
cagcccccacagtgctgtctg

SEQ ID NO: 2626483 - DNA, 20 bp, Homo sapiens
cagccccctttgggcccagg

SEQ ID NO: 2626484 - DNA, 19 bp, Homo sapiens
cagccccggccctgggctc

SEQ ID NO: 2626485 - DNA, 21 bp, Homo sapiens
cagcccctcccaccacagcag

SEQ ID NO: 2626486 - DNA, 19 bp, Homo sapiens
cagcccctggatgcagcct

SEQ ID NO: 2626487 - DNA, 23 bp, Homo sapiens
cagcccctggatgcagcctcaca

SEQ ID NO: 2626488 - DNA, 15 bp, Homo sapiens
cagcccggctcccac

SEQ ID NO: 2626489 - DNA, 19 bp, Homo sapiens
cagcccggctggttttgta

SEQ ID NO: 2626490 - DNA, 17 bp, Homo sapiens
cagcccgggctctgcct

SEQ ID NO: 2626491 - DNA, 14 bp, Homo sapiens
cagagtcctttcca

SEQ ID NO: 2626492 - DNA, 15 bp, Homo sapiens
cagagtcggaacgga

SEQ ID NO: 2626493 - DNA, 22 bp, Homo sapiens
cagagtctcactgttgcccagg

SEQ ID NO: 2626494 - DNA, 15 bp, Homo sapiens
cagagtgagacccag

SEQ ID NO: 2626495 - DNA, 15 bp, Homo sapiens
cagagtgagaccctg

SEQ ID NO: 2626496 - DNA, 19 bp, Homo sapiens
cagagtgagaccctgtctc

SEQ ID NO: 2626497 - DNA, 20 bp, Homo sapiens
cagagtgagaccctgtctct

SEQ ID NO: 2626498 - DNA, 17 bp, Homo sapiens
cagagtgagactctgtc

SEQ ID NO: 2626499 - DNA, 18 bp, Homo sapiens
cagagtgagactctgtct

SEQ ID NO: 2626500 - DNA, 18 bp, Homo sapiens
cagagtgcaagcccctgc

SEQ ID NO: 2626501 - DNA, 20 bp, Homo sapiens
cagagtgcaagcccctgctc

SEQ ID NO: 2626502 - DNA, 15 bp, Homo sapiens
cagagtggcctggcc

SEQ ID NO: 2626503 - DNA, 23 bp, Homo sapiens
cagagtggcctggccaggagctc

SEQ ID NO: 2626504 - DNA, 12 bp, Homo sapiens
cagagttcacta

SEQ ID NO: 2626505 - DNA, 18 bp, Homo sapiens
cagagttccccatgcaga

SEQ ID NO: 2626506 - DNA, 22 bp, Homo sapiens
cagagttcctgcggagtgaaga

SEQ ID NO: 2626507 - DNA, 23 bp, Homo sapiens
cagagttcctgcggagtgaagag

SEQ ID NO: 2626508 - DNA, 20 bp, Homo sapiens
cagagttgctgcaaacctga

SEQ ID NO: 2626509 - DNA, 14 bp, Homo sapiens
cagagttgttacat

SEQ ID NO: 2626510 - DNA, 15 bp, Homo sapiens
cagagttgttacatt

SEQ ID NO: 2626511 - DNA, 18 bp, Homo sapiens
cagagttgttacattttt

SEQ ID NO: 2626512 - DNA, 21 bp, Homo sapiens
cagataaaattatagatggga

SEQ ID NO: 2626513 - DNA, 20 bp, Homo sapiens
cagataactgttatttataa

SEQ ID NO: 2626514 - DNA, 21 bp, Homo sapiens
cagataactgttatttataat

SEQ ID NO: 2626515 - DNA, 19 bp, Homo sapiens
cagataagaatgctggttt

SEQ ID NO: 2626516 - DNA, 21 bp, Homo sapiens
cagataagaatgctggttttc

SEQ ID NO: 2626517 - DNA, 20 bp, Homo sapiens
cagataagcaagagagatgt

SEQ ID NO: 2626518 - DNA, 15 bp, Homo sapiens
cagataatcagcctc

SEQ ID NO: 2626519 - DNA, 16 bp, Homo sapiens
cagataatcagcctct

SEQ ID NO: 2626520 - DNA, 18 bp, Homo sapiens
cagataatcagcctctta

SEQ ID NO: 2626521 - DNA, 20 bp, Homo sapiens
cagatacaggaaaagctgct

SEQ ID NO: 2626522 - DNA, 15 bp, Homo sapiens
cagatacctcaccct

SEQ ID NO: 2626523 - DNA, 19 bp, Homo sapiens
cagatacttggggggctga

SEQ ID NO: 2626524 - DNA, 19 bp, Homo sapiens
cagatagatatatgctctg

SEQ ID NO: 2626525 - DNA, 22 bp, Homo sapiens
cagatataaaagactgaccaat

SEQ ID NO: 2626526 - DNA, 18 bp, Homo sapiens
cagatataaatggctggt

SEQ ID NO: 2626527 - DNA, 22 bp, Homo sapiens
cagatataaatggctggttttt

SEQ ID NO: 2626528 - DNA, 16 bp, Homo sapiens
cagatatatttttcac

SEQ ID NO: 2626529 - DNA, 18 bp, Homo sapiens
cagatatatttttcacag

SEQ ID NO: 2626530 - DNA, 19 bp, Homo sapiens
cagatatatttttcacagt

SEQ ID NO: 2626531 - DNA, 20 bp, Homo sapiens
cagatatttatatttttatt

SEQ ID NO: 2626532 - DNA, 20 bp, Homo sapiens
cagatattttttcagaaata

SEQ ID NO: 2626533 - DNA, 17 bp, Homo sapiens
cagatcaagctgtgaga

SEQ ID NO: 2626534 - DNA, 22 bp, Homo sapiens
cagatcaccagcccggcctgct

SEQ ID NO: 2626535 - DNA, 12 bp, Homo sapiens
cagatcccagct

SEQ ID NO: 2626536 - DNA, 13 bp, Homo sapiens
cagatcctcttgg

SEQ ID NO: 2626537 - DNA, 18 bp, Homo sapiens
cagatcggatctgttgca

SEQ ID NO: 2626538 - DNA, 14 bp, Homo sapiens
cagatctcctggca

SEQ ID NO: 2626539 - DNA, 17 bp, Homo sapiens
cagatctggtcccttgc

SEQ ID NO: 2626540 - DNA, 14 bp, Homo sapiens
cagatctgtgcccc

SEQ ID NO: 2626541 - DNA, 18 bp, Homo sapiens
cagatctgtgccccatgc

SEQ ID NO: 2626542 - DNA, 21 bp, Homo sapiens
cagatctgtgccccatgcctg

SEQ ID NO: 2626543 - DNA, 23 bp, Homo sapiens
cagatctgtgccccatgcctgtc

SEQ ID NO: 2626544 - DNA, 20 bp, Homo sapiens
cagatgacaaaaattcaact

SEQ ID NO: 2626545 - DNA, 23 bp, Homo sapiens
cagatgcaaagaggcaagaggct

SEQ ID NO: 2626546 - DNA, 16 bp, Homo sapiens
cagatgcagagagcca

SEQ ID NO: 2626547 - DNA, 20 bp, Homo sapiens
cagatgcagagagccatttt

SEQ ID NO: 2626548 - DNA, 15 bp, Homo sapiens
cagatgcccagaggg

SEQ ID NO: 2626549 - DNA, 19 bp, Homo sapiens
cagatgcccagagggccca

SEQ ID NO: 2626550 - DNA, 20 bp, Homo sapiens
cagatgcccagagggcccag

SEQ ID NO: 2626551 - DNA, 20 bp, Homo sapiens
cagatgctgatgttcagtgt

SEQ ID NO: 2626552 - DNA, 22 bp, Homo sapiens
cagatgctgatgttcagtgtaa

SEQ ID NO: 2626553 - DNA, 21 bp, Homo sapiens
cagatgctttcctgcacatta

SEQ ID NO: 2626554 - DNA, 15 bp, Homo sapiens
cagatggatttgcct

SEQ ID NO: 2626555 - DNA, 15 bp, Homo sapiens
cagatggggcctctg

SEQ ID NO: 2626556 - DNA, 18 bp, Homo sapiens
cagatgggtgcttggagg

SEQ ID NO: 2626557 - DNA, 22 bp, Homo sapiens
cagatggttttataatctgatt

SEQ ID NO: 2626558 - DNA, 13 bp, Homo sapiens
cagatgtcttctg

SEQ ID NO: 2626559 - DNA, 18 bp, Homo sapiens
cagatgtcttctgcctgt

SEQ ID NO: 2626560 - DNA, 17 bp, Homo sapiens
cagatgttttacgtctg

SEQ ID NO: 2626561 - DNA, 14 bp, Homo sapiens
cagattcacactgt

SEQ ID NO: 2626562 - DNA, 19 bp, Homo sapiens
cagattcccagagcaaaat

SEQ ID NO: 2626563 - DNA, 21 bp, Homo sapiens
cagattcccagagcaaaataa

SEQ ID NO: 2626564 - DNA, 14 bp, Homo sapiens
cagattctttcctg

SEQ ID NO: 2626565 - DNA, 17 bp, Homo sapiens
cagattctttcctgagg

SEQ ID NO: 2626566 - DNA, 18 bp, Homo sapiens
cagattctttcctgaggc

SEQ ID NO: 2626567 - DNA, 19 bp, Homo sapiens
cagattgcaacaggctggg

SEQ ID NO: 2626568 - DNA, 23 bp, Homo sapiens
cagattgcatgtgactctgaagc

SEQ ID NO: 2626569 - DNA, 14 bp, Homo sapiens
cagattgttatcta

SEQ ID NO: 2626570 - DNA, 19 bp, Homo sapiens
cagcttttttttcccccct

SEQ ID NO: 2626571 - DNA, 18 bp, Homo sapiens
caggaaaagctgctgaca

SEQ ID NO: 2626572 - DNA, 20 bp, Homo sapiens
caggaaaggctccaggagca

SEQ ID NO: 2626573 - DNA, 15 bp, Homo sapiens
caggaaatatatatg

SEQ ID NO: 2626574 - DNA, 23 bp, Homo sapiens
caggaaatcaaatatgcaaagca

SEQ ID NO: 2626575 - DNA, 22 bp, Homo sapiens
caggaacacccgactcctcaaa

SEQ ID NO: 2626576 - DNA, 13 bp, Homo sapiens
caggaacagaagg

SEQ ID NO: 2626577 - DNA, 18 bp, Homo sapiens
caggaacagaaggatgaa

SEQ ID NO: 2626578 - DNA, 15 bp, Homo sapiens
caggaactcccagca

SEQ ID NO: 2626579 - DNA, 13 bp, Homo sapiens
caggaactgggcc

SEQ ID NO: 2626580 - DNA, 22 bp, Homo sapiens
caggaagaaaggagtctgcaca

SEQ ID NO: 2626581 - DNA, 18 bp, Homo sapiens
caggaagatcttaaattt

SEQ ID NO: 2626582 - DNA, 21 bp, Homo sapiens
caggaagcctgcagtcctgga

SEQ ID NO: 2626583 - DNA, 14 bp, Homo sapiens
caggaagctcaggg

SEQ ID NO: 2626584 - DNA, 16 bp, Homo sapiens
caggaagctcagggcc

SEQ ID NO: 2626585 - DNA, 17 bp, Homo sapiens
caggaagctcagggcct

SEQ ID NO: 2626586 - DNA, 19 bp, Homo sapiens
caggaagctcagggcctgg

SEQ ID NO: 2626587 - DNA, 15 bp, Homo sapiens
caggaagctgctccg

SEQ ID NO: 2626588 - DNA, 18 bp, Homo sapiens
caggaagggggtccaccc

SEQ ID NO: 2626589 - DNA, 15 bp, Homo sapiens
caggaagtagaggag

SEQ ID NO: 2626590 - DNA, 23 bp, Homo sapiens
caggaataaggccttaatatgtt

SEQ ID NO: 2626591 - DNA, 16 bp, Homo sapiens
caggaatcaagagctg

SEQ ID NO: 2626592 - DNA, 18 bp, Homo sapiens
caggaatcaagagctgcc

SEQ ID NO: 2626593 - DNA, 13 bp, Homo sapiens
caggaatgggctg

SEQ ID NO: 2626594 - DNA, 16 bp, Homo sapiens
caggacaacgaggaag

SEQ ID NO: 2626595 - DNA, 19 bp, Homo sapiens
caggacaacgaggaagccc

SEQ ID NO: 2626596 - DNA, 16 bp, Homo sapiens
caggacatgctgaagc

SEQ ID NO: 2626597 - DNA, 13 bp, Homo sapiens
caggaccagctgg

SEQ ID NO: 2626598 - DNA, 14 bp, Homo sapiens
caggaccagctggg

SEQ ID NO: 2626599 - DNA, 15 bp, Homo sapiens
caggaccagctgggg

SEQ ID NO: 2626600 - DNA, 14 bp, Homo sapiens
caggaccaggacta

SEQ ID NO: 2626601 - DNA, 21 bp, Homo sapiens
caggaccagggatttccatga

SEQ ID NO: 2626602 - DNA, 16 bp, Homo sapiens
caggaccatgggacca

SEQ ID NO: 2626603 - DNA, 22 bp, Homo sapiens
caggaccatgggaccaggtctt

SEQ ID NO: 2626604 - DNA, 14 bp, Homo sapiens
caggacccagagga

SEQ ID NO: 2626605 - DNA, 21 bp, Homo sapiens
caggacccatcacgcctgtgc

SEQ ID NO: 2626606 - DNA, 17 bp, Homo sapiens
caggacccccttcccct

SEQ ID NO: 2626607 - DNA, 21 bp, Homo sapiens
caggacctcagagtccaggcc

SEQ ID NO: 2626608 - DNA, 13 bp, Homo sapiens
caggacctcaggt

SEQ ID NO: 2626609 - DNA, 14 bp, Homo sapiens
caggacgcttctga

SEQ ID NO: 2626610 - DNA, 22 bp, Homo sapiens
caggacgcttctgaatgctgct

SEQ ID NO: 2626611 - DNA, 20 bp, Homo sapiens
caggactcagctccccagag

SEQ ID NO: 2626612 - DNA, 15 bp, Homo sapiens
caggactccccaggc

SEQ ID NO: 2626613 - DNA, 15 bp, Homo sapiens
caggactccctcctc

SEQ ID NO: 2626614 - DNA, 19 bp, Homo sapiens
caggactccctcctcacct

SEQ ID NO: 2626615 - DNA, 23 bp, Homo sapiens
caggactccctcctcacctctgg

SEQ ID NO: 2626616 - DNA, 20 bp, Homo sapiens
caggactctgcccagaccac

SEQ ID NO: 2626617 - DNA, 15 bp, Homo sapiens
caggactctgcctcc

SEQ ID NO: 2626618 - DNA, 16 bp, Homo sapiens
caggactctgcctcct

SEQ ID NO: 2626619 - DNA, 19 bp, Homo sapiens
caggactgcaacaggcttg

SEQ ID NO: 2626620 - DNA, 14 bp, Homo sapiens
caggactgtgactc

SEQ ID NO: 2626621 - DNA, 21 bp, Homo sapiens
caggacttaacggctccagga

SEQ ID NO: 2626622 - DNA, 16 bp, Homo sapiens
cagggtctgggcagga

SEQ ID NO: 2626623 - DNA, 13 bp, Homo sapiens
cagggtcttccct

SEQ ID NO: 2626624 - DNA, 17 bp, Homo sapiens
cagggtcttttcatctg

SEQ ID NO: 2626625 - DNA, 23 bp, Homo sapiens
cagggtcttttcatctgggaaag

SEQ ID NO: 2626626 - DNA, 22 bp, Homo sapiens
cagggtgagagctgctctggaa

SEQ ID NO: 2626627 - DNA, 16 bp, Homo sapiens
cagggtgatgccaggt

SEQ ID NO: 2626628 - DNA, 13 bp, Homo sapiens
cagggtgctgtgg

SEQ ID NO: 2626629 - DNA, 18 bp, Homo sapiens
cagggtggtgctgggact

SEQ ID NO: 2626630 - DNA, 19 bp, Homo sapiens
cagggtggtgctgggactg

SEQ ID NO: 2626631 - DNA, 18 bp, Homo sapiens
cagggttcaaaatgtctg

SEQ ID NO: 2626632 - DNA, 15 bp, Homo sapiens
cagggttcccccagc

SEQ ID NO: 2626633 - DNA, 22 bp, Homo sapiens
cagggttcccccagccctgtgg

SEQ ID NO: 2626634 - DNA, 19 bp, Homo sapiens
cagggttgaccccagagga

SEQ ID NO: 2626635 - DNA, 14 bp, Homo sapiens
cagggttggcccct

SEQ ID NO: 2626636 - DNA, 16 bp, Homo sapiens
cagggttgggcccaga

SEQ ID NO: 2626637 - DNA, 16 bp, Homo sapiens
cagggttttgccatgt

SEQ ID NO: 2626638 - DNA, 15 bp, Homo sapiens
caggtaacaggcaga

SEQ ID NO: 2626639 - DNA, 17 bp, Homo sapiens
caggtaacaggcagata

SEQ ID NO: 2626640 - DNA, 15 bp, Homo sapiens
caggtaatgagggac

SEQ ID NO: 2626641 - DNA, 17 bp, Homo sapiens
caggtaatgagggactg

SEQ ID NO: 2626642 - DNA, 20 bp, Homo sapiens
caggtaatgagggactggaa

SEQ ID NO: 2626643 - DNA, 13 bp, Homo sapiens
caggtaatgtgaa

SEQ ID NO: 2626644 - DNA, 19 bp, Homo sapiens
caggtaatgtgaataaatt

SEQ ID NO: 2626645 - DNA, 16 bp, Homo sapiens
caggtagctgcccctg

SEQ ID NO: 2626646 - DNA, 19 bp, Homo sapiens
caggtagctgcccctggct

SEQ ID NO: 2626647 - DNA, 22 bp, Homo sapiens
caggtagctgcccctggctctg

SEQ ID NO: 2626648 - DNA, 23 bp, Homo sapiens
caggtagctgcccctggctctga

SEQ ID NO: 2626649 - DNA, 23 bp, Homo sapiens
caggtagttgcaattgaattaaa

SEQ ID NO: 2626650 - DNA, 17 bp, Homo sapiens
caggtatagactcctga

SEQ ID NO: 2626651 - DNA, 22 bp, Homo sapiens
caggtatctccaggattgaaga

SEQ ID NO: 2626652 - DNA, 20 bp, Homo sapiens
caggtatgaccttctaggaa

SEQ ID NO: 2626653 - DNA, 15 bp, Homo sapiens
caggtatgttgcctt

SEQ ID NO: 2626654 - DNA, 22 bp, Homo sapiens
caggtcaatacagtacaggcag

SEQ ID NO: 2626655 - DNA, 22 bp, Homo sapiens
caggtcctctgatacccagagc

SEQ ID NO: 2626656 - DNA, 12 bp, Homo sapiens
caggtctcccac

SEQ ID NO: 2626657 - DNA, 13 bp, Homo sapiens
caggtctcccacg

SEQ ID NO: 2626658 - DNA, 22 bp, Homo sapiens
caggtctcccacgtgggagaca

SEQ ID NO: 2626659 - DNA, 11 bp, Homo sapiens
caggtctcctc

SEQ ID NO: 2626660 - DNA, 17 bp, Homo sapiens
caggtctcctcttaaaa

SEQ ID NO: 2626661 - DNA, 23 bp, Homo sapiens
caggtcttgaactcctggcctca

SEQ ID NO: 2626662 - DNA, 20 bp, Homo sapiens
caggtcttggagctgagcct

SEQ ID NO: 2626663 - DNA, 18 bp, Homo sapiens
caggtgaccttctgggaa

SEQ ID NO: 2626664 - DNA, 20 bp, Homo sapiens
caggtgagaagcagaggaag

SEQ ID NO: 2626665 - DNA, 16 bp, Homo sapiens
caggtgatccacccac

SEQ ID NO: 2626666 - DNA, 17 bp, Homo sapiens
caggtgatccacccacc

SEQ ID NO: 2626667 - DNA, 20 bp, Homo sapiens
caggtgatccacccacctca

SEQ ID NO: 2626668 - DNA, 23 bp, Homo sapiens
caggtgatccacccacctcagcc

SEQ ID NO: 2626669 - DNA, 15 bp, Homo sapiens
caggtgcacaagctc

SEQ ID NO: 2626670 - DNA, 17 bp, Homo sapiens
caggtgcacaagctcca

SEQ ID NO: 2626671 - DNA, 18 bp, Homo sapiens
caggtgcacaagctccaa

SEQ ID NO: 2626672 - DNA, 21 bp, Homo sapiens
caggtgcacaagctccaagct

SEQ ID NO: 2626673 - DNA, 15 bp, Homo sapiens
caggtgcagtggctc

SEQ ID NO: 2626674 - DNA, 13 bp, Homo sapiens
caggtgcctccag

SEQ ID NO: 2626675 - DNA, 21 bp, Homo sapiens
caggtgcctccaggtgtgcac

SEQ ID NO: 2626676 - DNA, 13 bp, Homo sapiens
caggtgccttgga

SEQ ID NO: 2626677 - DNA, 18 bp, Homo sapiens
caggtgctaggaacactc

SEQ ID NO: 2626678 - DNA, 13 bp, Homo sapiens
caggtgctgccat

SEQ ID NO: 2626679 - DNA, 13 bp, Homo sapiens
caggtgctgctgc

SEQ ID NO: 2626680 - DNA, 23 bp, Homo sapiens
caggtggaggtgtcaggctgctg

SEQ ID NO: 2626681 - DNA, 16 bp, Homo sapiens
caggtggcaggaccag

SEQ ID NO: 2626682 - DNA, 18 bp, Homo sapiens
caggtggcaggaccagga

SEQ ID NO: 2626683 - DNA, 22 bp, Homo sapiens
caggtggctctgaggtgcctgt

SEQ ID NO: 2626684 - DNA, 21 bp, Homo sapiens
caggtgggcgtggtcactgct

SEQ ID NO: 2626685 - DNA, 23 bp, Homo sapiens
caggtgggcgtggtcactgctgt

SEQ ID NO: 2626686 - DNA, 19 bp, Homo sapiens
caggtgggcttcccagtgg

SEQ ID NO: 2626687 - DNA, 22 bp, Homo sapiens
caggtgggcttcccagtggctg

SEQ ID NO: 2626688 - DNA, 20 bp, Homo sapiens
caggtggggagactgggctg

SEQ ID NO: 2626689 - DNA, 12 bp, Homo sapiens
caggtggggagg

SEQ ID NO: 2626690 - DNA, 15 bp, Homo sapiens
caggtggggaggggg

SEQ ID NO: 2626691 - DNA, 23 bp, Homo sapiens
caggtggggagtcagggacccct

SEQ ID NO: 2626692 - DNA, 21 bp, Homo sapiens
caggtggggtcactctggcag

SEQ ID NO: 2626693 - DNA, 20 bp, Homo sapiens
caggtggtggcactgagccc

SEQ ID NO: 2626694 - DNA, 22 bp, Homo sapiens
caggtggtggcactgagccccc

SEQ ID NO: 2626695 - DNA, 21 bp, Homo sapiens
caggtggtggctgcaaggtgg

SEQ ID NO: 2626696 - DNA, 19 bp, Homo sapiens
caggtgtccctgcacttgc

SEQ ID NO: 2626697 - DNA, 16 bp, Homo sapiens
caggtgtgaaccacca

SEQ ID NO: 2626698 - DNA, 22 bp, Homo sapiens
caggtgtgagtcaccaagccca

SEQ ID NO: 2626699 - DNA, 15 bp, Homo sapiens
caggtgtgcacgtgg

SEQ ID NO: 2626700 - DNA, 18 bp, Homo sapiens
caggtgtgccgacagaag

SEQ ID NO: 2626701 - DNA, 20 bp, Homo sapiens
caggtgtgtccacctgggca

SEQ ID NO: 2626702 - DNA, 20 bp, Homo sapiens
caggtgttctacactcatct

SEQ ID NO: 2626703 - DNA, 11 bp, Homo sapiens
caggttacaac

SEQ ID NO: 2626704 - DNA, 15 bp, Homo sapiens
caggttacaacagat

SEQ ID NO: 2626705 - DNA, 19 bp, Homo sapiens
caggttacaacagatttgt

SEQ ID NO: 2626706 - DNA, 23 bp, Homo sapiens
caggttacaacagatttgtgaac

SEQ ID NO: 2626707 - DNA, 19 bp, Homo sapiens
caggttagaacctagaagg

SEQ ID NO: 2626708 - DNA, 22 bp, Homo sapiens
caggttcacaggcgaggcctgg

SEQ ID NO: 2626709 - DNA, 17 bp, Homo sapiens
caggttctatttggaat

SEQ ID NO: 2626710 - DNA, 19 bp, Homo sapiens
caggttctatttggaattt

SEQ ID NO: 2626711 - DNA, 18 bp, Homo sapiens
caggttgctggttgctgt

SEQ ID NO: 2626712 - DNA, 20 bp, Homo sapiens
caggttgctggttgctgtgt

SEQ ID NO: 2626713 - DNA, 18 bp, Homo sapiens
caggttgctttgccctgg

SEQ ID NO: 2626714 - DNA, 20 bp, Homo sapiens
caggttgggaatgaggcttg

SEQ ID NO: 2626715 - DNA, 18 bp, Homo sapiens
caggtttaagctgttact

SEQ ID NO: 2626716 - DNA, 20 bp, Homo sapiens
caggtttctggtctctaggc

SEQ ID NO: 2626717 - DNA, 19 bp, Homo sapiens
caggtttttcaattaaacg

SEQ ID NO: 2626718 - DNA, 21 bp, Homo sapiens
caggtttttcaattaaacgga

SEQ ID NO: 2626719 - DNA, 22 bp, Homo sapiens
caggtttttcaattaaacggat

SEQ ID NO: 2626720 - DNA, 10 bp, Homo sapiens
cagtaaacat

SEQ ID NO: 2626721 - DNA, 14 bp, Homo sapiens
cagtaaacttttaa

SEQ ID NO: 2626722 - DNA, 19 bp, Homo sapiens
cagtaaatgggggtgcatt

SEQ ID NO: 2626723 - DNA, 16 bp, Homo sapiens
cagtaactttatgtgt

SEQ ID NO: 2626724 - DNA, 18 bp, Homo sapiens
cagtaagtatctggagga

SEQ ID NO: 2626725 - DNA, 12 bp, Homo sapiens
cagtaataactc

SEQ ID NO: 2626726 - DNA, 13 bp, Homo sapiens
cagtaatatttat

SEQ ID NO: 2626727 - DNA, 12 bp, Homo sapiens
cagtacaggcag

SEQ ID NO: 2626728 - DNA, 19 bp, Homo sapiens
cagtaccctctcagctcca

SEQ ID NO: 2626729 - DNA, 20 bp, Homo sapiens
cagtacctataaagtaaagc

SEQ ID NO: 2626730 - DNA, 20 bp, Homo sapiens
cagtacctcctgtctctggc

SEQ ID NO: 2626731 - DNA, 23 bp, Homo sapiens
cagtaccttcaaactagggccaa

SEQ ID NO: 2626732 - DNA, 15 bp, Homo sapiens
cagtacctttgtcac

SEQ ID NO: 2626733 - DNA, 16 bp, Homo sapiens
cagtacctttgtcaca

SEQ ID NO: 2626734 - DNA, 20 bp, Homo sapiens
cagtagaaggtcggaggctt

SEQ ID NO: 2626735 - DNA, 23 bp, Homo sapiens
cagtagaaggtcggaggcttggg

SEQ ID NO: 2626736 - DNA, 17 bp, Homo sapiens
cagtagtctctgtgctt

SEQ ID NO: 2626737 - DNA, 14 bp, Homo sapiens
ccaaaggcccccta

SEQ ID NO: 2626738 - DNA, 15 bp, Homo sapiens
ccaaagtacactgtt

SEQ ID NO: 2626739 - DNA, 18 bp, Homo sapiens
ccaaagtacactgtttca

SEQ ID NO: 2626740 - DNA, 11 bp, Homo sapiens
ccaaataaaaa

SEQ ID NO: 2626741 - DNA, 20 bp, Homo sapiens
ccaaataaaaactaaattgt

SEQ ID NO: 2626742 - DNA, 16 bp, Homo sapiens
ccaaataagaaaccta

SEQ ID NO: 2626743 - DNA, 15 bp, Homo sapiens
ccaaatcagctgcta

SEQ ID NO: 2626744 - DNA, 17 bp, Homo sapiens
ccaaatccgaacctcct

SEQ ID NO: 2626745 - DNA, 22 bp, Homo sapiens
ccaaatccgaacctcctctgtg

SEQ ID NO: 2626746 - DNA, 23 bp, Homo sapiens
ccaaatccgaacctcctctgtga

SEQ ID NO: 2626747 - DNA, 24 bp, Homo sapiens
ccaaatccgaacctcctctgtgaa

SEQ ID NO: 2626748 - DNA, 18 bp, Homo sapiens
ccaaatcctctccagcta

SEQ ID NO: 2626749 - DNA, 17 bp, Homo sapiens
ccaaatgcatggtgcag

SEQ ID NO: 2626750 - DNA, 14 bp, Homo sapiens
ccaaattatttgtg

SEQ ID NO: 2626751 - DNA, 20 bp, Homo sapiens
ccaaattccttggcatgcct

SEQ ID NO: 2626752 - DNA, 13 bp, Homo sapiens
ccaacaaagctgt

SEQ ID NO: 2626753 - DNA, 14 bp, Homo sapiens
ccaacaaagctgtt

SEQ ID NO: 2626754 - DNA, 22 bp, Homo sapiens
ccaacaatcctagtgctttcct

SEQ ID NO: 2626755 - DNA, 16 bp, Homo sapiens
ccaacaccacagacac

SEQ ID NO: 2626756 - DNA, 23 bp, Homo sapiens
ccaacaccacagacacacacacg

SEQ ID NO: 2626757 - DNA, 14 bp, Homo sapiens
ccaacactcaagaa

SEQ ID NO: 2626758 - DNA, 22 bp, Homo sapiens
ccaacagatgcttttctgtctc

SEQ ID NO: 2626759 - DNA, 15 bp, Homo sapiens
ccaacaggagctggg

SEQ ID NO: 2626760 - DNA, 23 bp, Homo sapiens
ccaacaggagctgggatcctaag

SEQ ID NO: 2626761 - DNA, 19 bp, Homo sapiens
ccaacagtcaaaacagaga

SEQ ID NO: 2626762 - DNA, 12 bp, Homo sapiens
ccaacagtgtga

SEQ ID NO: 2626763 - DNA, 22 bp, Homo sapiens
ccaacagtgtgaagttagaatt

SEQ ID NO: 2626764 - DNA, 16 bp, Homo sapiens
ccaacatactcccatc

SEQ ID NO: 2626765 - DNA, 18 bp, Homo sapiens
ccaacatactcccatctg

SEQ ID NO: 2626766 - DNA, 19 bp, Homo sapiens
ccaacatactcccatctgt

SEQ ID NO: 2626767 - DNA, 20 bp, Homo sapiens
ccaacatactcccatctgtg

SEQ ID NO: 2626768 - DNA, 16 bp, Homo sapiens
ccaacatcaacatctt

SEQ ID NO: 2626769 - DNA, 13 bp, Homo sapiens
ccaacccccaccc

SEQ ID NO: 2626770 - DNA, 12 bp, Homo sapiens
ccaacccctgtg

SEQ ID NO: 2626771 - DNA, 18 bp, Homo sapiens
ccaaccctgtttcctgag

SEQ ID NO: 2626772 - DNA, 12 bp, Homo sapiens
ccaacccttccc

SEQ ID NO: 2626773 - DNA, 14 bp, Homo sapiens
ccaacctctggagc

SEQ ID NO: 2626774 - DNA, 17 bp, Homo sapiens
ccaacctggggagccag

SEQ ID NO: 2626775 - DNA, 23 bp, Homo sapiens
ccaaccttagatgttctaagtct

SEQ ID NO: 2626776 - DNA, 21 bp, Homo sapiens
ccaacggagagcgcctgcccc

SEQ ID NO: 2626777 - DNA, 24 bp, Homo sapiens
ccaacggcaagggaacaagtactt

SEQ ID NO: 2626778 - DNA, 13 bp, Homo sapiens
ccaactcacccca

SEQ ID NO: 2626779 - DNA, 16 bp, Homo sapiens
ccaactcaccccagcc

SEQ ID NO: 2626780 - DNA, 21 bp, Homo sapiens
ccaactcaccccagccccaaa

SEQ ID NO: 2626781 - DNA, 19 bp, Homo sapiens
ccaacttcttcagagctga

SEQ ID NO: 2626782 - DNA, 21 bp, Homo sapiens
ccaacttgagggcccagagca

SEQ ID NO: 2626783 - DNA, 13 bp, Homo sapiens
ccaacttggcttt

SEQ ID NO: 2626784 - DNA, 14 bp, Homo sapiens
ccaacttggctttc

SEQ ID NO: 2626785 - DNA, 17 bp, Homo sapiens
ccaacttgtaaatacac

SEQ ID NO: 2626786 - DNA, 13 bp, Homo sapiens
ccacgcccccact

SEQ ID NO: 2626787 - DNA, 13 bp, Homo sapiens
ccacgctggagtg

SEQ ID NO: 2626788 - DNA, 18 bp, Homo sapiens
ccacgctggagtgcagtg

SEQ ID NO: 2626789 - DNA, 19 bp, Homo sapiens
ccacgctggagtgcagtga

SEQ ID NO: 2626790 - DNA, 20 bp, Homo sapiens
ccacgctgtctccagacccc

SEQ ID NO: 2626791 - DNA, 21 bp, Homo sapiens
ccacgctgtctccagaccccc

SEQ ID NO: 2626792 - DNA, 12 bp, Homo sapiens
ccacggagccac

SEQ ID NO: 2626793 - DNA, 14 bp, Homo sapiens
ccacggccaggcca

SEQ ID NO: 2626794 - DNA, 18 bp, Homo sapiens
ccacggccaggccagagg

SEQ ID NO: 2626795 - DNA, 23 bp, Homo sapiens
ccacggccaggccagagggagtg

SEQ ID NO: 2626796 - DNA, 18 bp, Homo sapiens
ccacggctctaggtgggg

SEQ ID NO: 2626797 - DNA, 18 bp, Homo sapiens
ccacgggaagtttagaga

SEQ ID NO: 2626798 - DNA, 21 bp, Homo sapiens
ccacggtctgttcttgaagca

SEQ ID NO: 2626799 - DNA, 16 bp, Homo sapiens
ccacgttctcacaccc

SEQ ID NO: 2626800 - DNA, 17 bp, Homo sapiens
ccacgttctcacaccca

SEQ ID NO: 2626801 - DNA, 22 bp, Homo sapiens
ccactaactagagcagccctgg

SEQ ID NO: 2626802 - DNA, 21 bp, Homo sapiens
ccactacactccagcctgagc

SEQ ID NO: 2626803 - DNA, 18 bp, Homo sapiens
ccactacattctgttaat

SEQ ID NO: 2626804 - DNA, 22 bp, Homo sapiens
ccactacggaatagttggctag

SEQ ID NO: 2626805 - DNA, 23 bp, Homo sapiens
ccactacggaatagttggctagg

SEQ ID NO: 2626806 - DNA, 16 bp, Homo sapiens
ccactactcaaaaatt

SEQ ID NO: 2626807 - DNA, 12 bp, Homo sapiens
ccactcaagcca

SEQ ID NO: 2626808 - DNA, 16 bp, Homo sapiens
ccactcaagccaagca

SEQ ID NO: 2626809 - DNA, 16 bp, Homo sapiens
ccactcacacagccag

SEQ ID NO: 2626810 - DNA, 17 bp, Homo sapiens
ccactcacacagccagg

SEQ ID NO: 2626811 - DNA, 21 bp, Homo sapiens
ccactcacacagccaggtgcc

SEQ ID NO: 2626812 - DNA, 16 bp, Homo sapiens
ccactcaccagtgtcc

SEQ ID NO: 2626813 - DNA, 22 bp, Homo sapiens
ccactcacgaatattatgccca

SEQ ID NO: 2626814 - DNA, 13 bp, Homo sapiens
ccactcaggaggc

SEQ ID NO: 2626815 - DNA, 18 bp, Homo sapiens
ccactcaggcatttgact

SEQ ID NO: 2626816 - DNA, 13 bp, Homo sapiens
ccactcaggccaa

SEQ ID NO: 2626817 - DNA, 18 bp, Homo sapiens
ccactcagtccatagcag

SEQ ID NO: 2626818 - DNA, 16 bp, Homo sapiens
ccactccccaccttca

SEQ ID NO: 2626819 - DNA, 12 bp, Homo sapiens
ccactcctctga

SEQ ID NO: 2626820 - DNA, 12 bp, Homo sapiens
ccactctcccca

SEQ ID NO: 2626821 - DNA, 13 bp, Homo sapiens
ccactctccccac

SEQ ID NO: 2626822 - DNA, 14 bp, Homo sapiens
ccactctccccaca

SEQ ID NO: 2626823 - DNA, 15 bp, Homo sapiens
ccactctccccacac

SEQ ID NO: 2626824 - DNA, 16 bp, Homo sapiens
ccactctccccacact

SEQ ID NO: 2626825 - DNA, 17 bp, Homo sapiens
ccactctccccacacta

SEQ ID NO: 2626826 - DNA, 11 bp, Homo sapiens
ccactctgtgc

SEQ ID NO: 2626827 - DNA, 14 bp, Homo sapiens
ccactgaagctggg

SEQ ID NO: 2626828 - DNA, 15 bp, Homo sapiens
ccactgaagctggga

SEQ ID NO: 2626829 - DNA, 12 bp, Homo sapiens
ccactgagctcc

SEQ ID NO: 2626830 - DNA, 13 bp, Homo sapiens
ccactgagggcag

SEQ ID NO: 2626831 - DNA, 16 bp, Homo sapiens
ccactgcacagagctc

SEQ ID NO: 2626832 - DNA, 20 bp, Homo sapiens
ccactgcacagagctctcca

SEQ ID NO: 2626833 - DNA, 14 bp, Homo sapiens
ccactgcaccgggc

SEQ ID NO: 2626834 - DNA, 17 bp, Homo sapiens
ccactgcaccgggccac

SEQ ID NO: 2626835 - DNA, 19 bp, Homo sapiens
ccactgcactatagcctag

SEQ ID NO: 2626836 - DNA, 20 bp, Homo sapiens
ccactgcactatagcctagg

SEQ ID NO: 2626837 - DNA, 23 bp, Homo sapiens
ccactgcactccagcctgggtga

SEQ ID NO: 2626838 - DNA, 21 bp, Homo sapiens
ccactgcatcgtttcatcttc

SEQ ID NO: 2626839 - DNA, 15 bp, Homo sapiens
ccactgcccaccccc

SEQ ID NO: 2626840 - DNA, 16 bp, Homo sapiens
ccactgcccaccccct

SEQ ID NO: 2626841 - DNA, 20 bp, Homo sapiens
ccactgcccgagctggtgca

SEQ ID NO: 2626842 - DNA, 14 bp, Homo sapiens
ccactgcctactgc

SEQ ID NO: 2626843 - DNA, 19 bp, Homo sapiens
ccactgcctcaggttccta

SEQ ID NO: 2626844 - DNA, 12 bp, Homo sapiens
ccactgcctgcc

SEQ ID NO: 2626845 - DNA, 13 bp, Homo sapiens
ccactgcctgccc

SEQ ID NO: 2626846 - DNA, 11 bp, Homo sapiens
ccactgctctg

SEQ ID NO: 2626847 - DNA, 15 bp, Homo sapiens
ccactgctctggtta

SEQ ID NO: 2626848 - DNA, 20 bp, Homo sapiens
ccactgcttttggtctgtgt

SEQ ID NO: 2626849 - DNA, 17 bp, Homo sapiens
ccactggccaccaggct

SEQ ID NO: 2626850 - DNA, 20 bp, Homo sapiens
ccactggccaccaggctggc

SEQ ID NO: 2626851 - DNA, 19 bp, Homo sapiens
ccactggggtccagggagc

SEQ ID NO: 2626852 - DNA, 22 bp, Homo sapiens
ccactgtcctgggcgccctgga

SEQ ID NO: 2626853 - DNA, 16 bp, Homo sapiens
ccactgtgccatgtgc

SEQ ID NO: 2626854 - DNA, 19 bp, Homo sapiens
ccactgtgctgaattctgc

SEQ ID NO: 2626855 - DNA, 12 bp, Homo sapiens
ccactgtgtata

SEQ ID NO: 2626856 - DNA, 12 bp, Homo sapiens
ccacttacctag

SEQ ID NO: 2626857 - DNA, 13 bp, Homo sapiens
ccacttaccttca

SEQ ID NO: 2626858 - DNA, 19 bp, Homo sapiens
ccacttaccttcaataaag

SEQ ID NO: 2626859 - DNA, 16 bp, Homo sapiens
atgcagagagccattt

SEQ ID NO: 2626860 - DNA, 18 bp, Homo sapiens
atgtaaagtatgtaaaca

SEQ ID NO: 2626861 - DNA, 15 bp, Homo sapiens
atgtaaatattctat

SEQ ID NO: 2626862 - DNA, 16 bp, Homo sapiens
atgtaacagtctgatc

SEQ ID NO: 2626863 - DNA, 22 bp, Homo sapiens
atgtaagggaaactgccagcaa

SEQ ID NO: 2626864 - DNA, 22 bp, Homo sapiens
atgtaataaggttgaacacttt

SEQ ID NO: 2626865 - DNA, 14 bp, Homo sapiens
atgtaataatgtga

SEQ ID NO: 2626866 - DNA, 16 bp, Homo sapiens
atgtaatcaatgtttc

SEQ ID NO: 2626867 - DNA, 17 bp, Homo sapiens
atgtaattaagtactat

SEQ ID NO: 2626868 - DNA, 15 bp, Homo sapiens
atgtacagtctgtca

SEQ ID NO: 2626869 - DNA, 20 bp, Homo sapiens
atgtacatttccaaattcac

SEQ ID NO: 2626870 - DNA, 18 bp, Homo sapiens
atgtaccatgaaacaaag

SEQ ID NO: 2626871 - DNA, 20 bp, Homo sapiens
atttacagtgaaaatgtaag

SEQ ID NO: 2626872 - DNA, 23 bp, Homo sapiens
atttacagtgaaaatgtaagctg

SEQ ID NO: 2626873 - DNA, 14 bp, Homo sapiens
atttacatatgaaa

SEQ ID NO: 2626874 - DNA, 21 bp, Homo sapiens
atttacatatgaaatttaata

SEQ ID NO: 2626875 - DNA, 16 bp, Homo sapiens
atttacatgtattatt

SEQ ID NO: 2626876 - DNA, 22 bp, Homo sapiens
atttacatgtattatttcatta

SEQ ID NO: 2626877 - DNA, 18 bp, Homo sapiens
atttaccacagcagctga

SEQ ID NO: 2626878 - DNA, 23 bp, Homo sapiens
atttaccagcctccgtatttcag

SEQ ID NO: 2626879 - DNA, 19 bp, Homo sapiens
atttacccttcttttctga

SEQ ID NO: 2626880 - DNA, 21 bp, Homo sapiens
atttactaagccacaagaaat

SEQ ID NO: 2626881 - DNA, 21 bp, Homo sapiens
atttactgctagtcttaagaa

SEQ ID NO: 2626882 - DNA, 20 bp, Homo sapiens
atttacttgccattactcaa

SEQ ID NO: 2626883 - DNA, 22 bp, Homo sapiens
atttagaaagaagcccaatatt

SEQ ID NO: 2626884 - DNA, 15 bp, Homo sapiens
atttagaaatataat

SEQ ID NO: 2626885 - DNA, 23 bp, Homo sapiens
atttagagatgaattaaatttaa

SEQ ID NO: 2626886 - DNA, 23 bp, Homo sapiens
atttagcacatactacacattca

SEQ ID NO: 2626887 - DNA, 22 bp, Homo sapiens
atttagcatgacaagccccagg

SEQ ID NO: 2626888 - DNA, 21 bp, Homo sapiens
atttagtgtttttacctctgt

SEQ ID NO: 2626889 - DNA, 16 bp, Homo sapiens
atttagttctttgtta

SEQ ID NO: 2626890 - DNA, 15 bp, Homo sapiens
atttagtttgattat

SEQ ID NO: 2626891 - DNA, 19 bp, Homo sapiens
atttagtttttgttcttaa

SEQ ID NO: 2626892 - DNA, 17 bp, Homo sapiens
atttataaatgctattt

SEQ ID NO: 2626893 - DNA, 14 bp, Homo sapiens
atttataactcatc

SEQ ID NO: 2626894 - DNA, 17 bp, Homo sapiens
atttataactcatcata

SEQ ID NO: 2626895 - DNA, 18 bp, Homo sapiens
atttataactcatcataa

SEQ ID NO: 2626896 - DNA, 20 bp, Homo sapiens
atttataactcatcataaaa

SEQ ID NO: 2626897 - DNA, 14 bp, Homo sapiens
atttataatgtttg

SEQ ID NO: 2626898 - DNA, 14 bp, Homo sapiens
atttatactattta

SEQ ID NO: 2626899 - DNA, 14 bp, Homo sapiens
atttatagtttgta

SEQ ID NO: 2626900 - DNA, 16 bp, Homo sapiens
atttatagtttgtaca

SEQ ID NO: 2626901 - DNA, 15 bp, Homo sapiens
atttatatagattat

SEQ ID NO: 2626902 - DNA, 14 bp, Homo sapiens
atttatatatgtat

SEQ ID NO: 2626903 - DNA, 20 bp, Homo sapiens
atttatatatttataactca

SEQ ID NO: 2626904 - DNA, 13 bp, Homo sapiens
atttatatttcac

SEQ ID NO: 2626905 - DNA, 17 bp, Homo sapiens
atttatcaaatcagtca

SEQ ID NO: 2626906 - DNA, 14 bp, Homo sapiens
atttatcagtgaca

SEQ ID NO: 2626907 - DNA, 18 bp, Homo sapiens
atttatcctgaaatttca

SEQ ID NO: 2626908 - DNA, 19 bp, Homo sapiens
atttatcctgaaatttcag

SEQ ID NO: 2626909 - DNA, 14 bp, Homo sapiens
atttatctctattt

SEQ ID NO: 2626910 - DNA, 22 bp, Homo sapiens
atttatctctatttaatattta

SEQ ID NO: 2626911 - DNA, 20 bp, Homo sapiens
atttatctgggattatggtt

SEQ ID NO: 2626912 - DNA, 22 bp, Homo sapiens
atttatctttacttttaaacag

SEQ ID NO: 2626913 - DNA, 15 bp, Homo sapiens
atttatgatttaata

SEQ ID NO: 2626914 - DNA, 16 bp, Homo sapiens
atttatgatttaataa

SEQ ID NO: 2626915 - DNA, 17 bp, Homo sapiens
atttatgatttaataaa

SEQ ID NO: 2626916 - DNA, 18 bp, Homo sapiens
atttatggtcaacactta

SEQ ID NO: 2626917 - DNA, 21 bp, Homo sapiens
atttatgtagatgtgcatttt

SEQ ID NO: 2626918 - DNA, 22 bp, Homo sapiens
atttatgtgtgaggagctgctg

SEQ ID NO: 2626919 - DNA, 19 bp, Homo sapiens
atttattaaaatgattgta

SEQ ID NO: 2626920 - DNA, 21 bp, Homo sapiens
atttattaaaatgattgtaaa

SEQ ID NO: 2626921 - DNA, 22 bp, Homo sapiens
atttattaaatgcccagcccct

SEQ ID NO: 2626922 - DNA, 16 bp, Homo sapiens
atttattaagatggat

SEQ ID NO: 2626923 - DNA, 22 bp, Homo sapiens
atttattaagatggattctcag

SEQ ID NO: 2626924 - DNA, 23 bp, Homo sapiens
atttattaagatggattctcaga

SEQ ID NO: 2626925 - DNA, 16 bp, Homo sapiens
atttattatggcacat

SEQ ID NO: 2626926 - DNA, 15 bp, Homo sapiens
atttattattgaaat

SEQ ID NO: 2626927 - DNA, 14 bp, Homo sapiens
atttattattttca

SEQ ID NO: 2626928 - DNA, 14 bp, Homo sapiens
atttattcaagaaa

SEQ ID NO: 2626929 - DNA, 20 bp, Homo sapiens
atttattcagcttcatttgt

SEQ ID NO: 2626930 - DNA, 14 bp, Homo sapiens
atttattctgctca

SEQ ID NO: 2626931 - DNA, 14 bp, Homo sapiens
atttattgcttgat

SEQ ID NO: 2626932 - DNA, 13 bp, Homo sapiens
atttatttaaaag

SEQ ID NO: 2626933 - DNA, 14 bp, Homo sapiens
atttatttaaattt

SEQ ID NO: 2626934 - DNA, 17 bp, Homo sapiens
atttatttaatgttatg

SEQ ID NO: 2626935 - DNA, 17 bp, Homo sapiens
atttatttactgctagt

SEQ ID NO: 2626936 - DNA, 17 bp, Homo sapiens
atttctttgcctgttca

SEQ ID NO: 2626937 - DNA, 20 bp, Homo sapiens
atttctttgcctgttcagtt

SEQ ID NO: 2626938 - DNA, 21 bp, Homo sapiens
atttctttgttatcaaacttc

SEQ ID NO: 2626939 - DNA, 23 bp, Homo sapiens
atttcttttgccgttattaaaaa

SEQ ID NO: 2626940 - DNA, 11 bp, Homo sapiens
atttgaaagaa

SEQ ID NO: 2626941 - DNA, 11 bp, Homo sapiens
atttgaaattt

SEQ ID NO: 2626942 - DNA, 13 bp, Homo sapiens
atttgaatgaaaa

SEQ ID NO: 2626943 - DNA, 14 bp, Homo sapiens
atttgaatgaaaaa

SEQ ID NO: 2626944 - DNA, 16 bp, Homo sapiens
atttgaatgaaaaatt

SEQ ID NO: 2626945 - DNA, 19 bp, Homo sapiens
atttgaatgaaaaatttaa

SEQ ID NO: 2626946 - DNA, 13 bp, Homo sapiens
atttgactgtttt

SEQ ID NO: 2626947 - DNA, 16 bp, Homo sapiens
atttgagcagggctca

SEQ ID NO: 2626948 - DNA, 22 bp, Homo sapiens
atttgaggggaaaacaccataa

SEQ ID NO: 2626949 - DNA, 13 bp, Homo sapiens
atttgaggtcaag

SEQ ID NO: 2626950 - DNA, 15 bp, Homo sapiens
atttgaggtctgttc

SEQ ID NO: 2626951 - DNA, 17 bp, Homo sapiens
atttgaggtctgttctt

SEQ ID NO: 2626952 - DNA, 21 bp, Homo sapiens
atttgaggtctgttctttcca

SEQ ID NO: 2626953 - DNA, 17 bp, Homo sapiens
atttgatttctattcaa

SEQ ID NO: 2626954 - DNA, 15 bp, Homo sapiens
atttgcaagggaaaa

SEQ ID NO: 2626955 - DNA, 19 bp, Homo sapiens
atttgcaagtcatggctgt

SEQ ID NO: 2626956 - DNA, 15 bp, Homo sapiens
atttgcagagacagg

SEQ ID NO: 2626957 - DNA, 22 bp, Homo sapiens
atttgcataacaattcctctac

SEQ ID NO: 2626958 - DNA, 24 bp, Homo sapiens
atttgccatgggcttcactgtata

SEQ ID NO: 2626959 - DNA, 22 bp, Homo sapiens
atttgcctattcccacacctcc

SEQ ID NO: 2626960 - DNA, 15 bp, Homo sapiens
atttgcctgtgccac

SEQ ID NO: 2626961 - DNA, 15 bp, Homo sapiens
atttgcgaatggttc

SEQ ID NO: 2626962 - DNA, 18 bp, Homo sapiens
atttgctttttcaccaga

SEQ ID NO: 2626963 - DNA, 13 bp, Homo sapiens
atttggaaaataa

SEQ ID NO: 2626964 - DNA, 11 bp, Homo sapiens
atttggagact

SEQ ID NO: 2626965 - DNA, 16 bp, Homo sapiens
atttggggcttatttt

SEQ ID NO: 2626966 - DNA, 20 bp, Homo sapiens
atttggtggtttcagaaatg

SEQ ID NO: 2626967 - DNA, 23 bp, Homo sapiens
atttgtaaaaacagcattgcttt

SEQ ID NO: 2626968 - DNA, 19 bp, Homo sapiens
atttgtaaatttatgtgat

SEQ ID NO: 2626969 - DNA, 14 bp, Homo sapiens
atttgtaagtttca

SEQ ID NO: 2626970 - DNA, 17 bp, Homo sapiens
atttgtaagtttcaggt

SEQ ID NO: 2626971 - DNA, 20 bp, Homo sapiens
atttgtaattgcttacattt

SEQ ID NO: 2626972 - DNA, 21 bp, Homo sapiens
atttgtacatagttatttatt

SEQ ID NO: 2626973 - DNA, 16 bp, Homo sapiens
atttgtacatatgtaa

SEQ ID NO: 2626974 - DNA, 20 bp, Homo sapiens
atttgtatctctgaagcatg

SEQ ID NO: 2626975 - DNA, 23 bp, Homo sapiens
atttgtatctctgaagcatgttt

SEQ ID NO: 2626976 - DNA, 15 bp, Homo sapiens
atttgtccaattctc

SEQ ID NO: 2626977 - DNA, 23 bp, Homo sapiens
atttgtgaaatgatggtgaaagt

SEQ ID NO: 2626978 - DNA, 11 bp, Homo sapiens
atttgtgacta

SEQ ID NO: 2626979 - DNA, 17 bp, Homo sapiens
atttgtgatacaatgct

SEQ ID NO: 2626980 - DNA, 11 bp, Homo sapiens
atttgtggaat

SEQ ID NO: 2626981 - DNA, 12 bp, Homo sapiens
atttgtggaata

SEQ ID NO: 2626982 - DNA, 21 bp, Homo sapiens
atttgtgtaatagaaaactga

SEQ ID NO: 2626983 - DNA, 22 bp, Homo sapiens
atttgtgtatttaacagggagg

SEQ ID NO: 2626984 - DNA, 14 bp, Homo sapiens
atttgtgtgtgtgc

SEQ ID NO: 2626985 - DNA, 15 bp, Homo sapiens
atttgtgtgtgtgca

SEQ ID NO: 2626986 - DNA, 16 bp, Homo sapiens
atttgttaaatattta

SEQ ID NO: 2626987 - DNA, 17 bp, Homo sapiens
atttgttaaatatttac

SEQ ID NO: 2626988 - DNA, 18 bp, Homo sapiens
atttgttaaatatttaca

SEQ ID NO: 2626989 - DNA, 16 bp, Homo sapiens
atttgttattttgcaa

SEQ ID NO: 2626990 - DNA, 14 bp, Homo sapiens
atttgttgaaatta

SEQ ID NO: 2626991 - DNA, 16 bp, Homo sapiens
atttgttgaaattatg

SEQ ID NO: 2626992 - DNA, 18 bp, Homo sapiens
atttgttgaaattatgta

SEQ ID NO: 2626993 - DNA, 11 bp, Homo sapiens
atttgttgcat

SEQ ID NO: 2626994 - DNA, 14 bp, Homo sapiens
atttgttggaatga

SEQ ID NO: 2626995 - DNA, 16 bp, Homo sapiens
atttgtttaaaaggat

SEQ ID NO: 2626996 - DNA, 14 bp, Homo sapiens
atttgtttgaactg

SEQ ID NO: 2626997 - DNA, 21 bp, Homo sapiens
atttgttttgacggatgattg

SEQ ID NO: 2626998 - DNA, 18 bp, Homo sapiens
attttaaaaagtcttcac

SEQ ID NO: 2626999 - DNA, 22 bp, Homo sapiens
attttaaaaatacagatagata

SEQ ID NO: 2627000 - DNA, 14 bp, Homo sapiens
attttaaaatgaga

SEQ ID NO: 2627001 - DNA, 15 bp, Homo sapiens
attttaaataaaaga

SEQ ID NO: 2627002 - DNA, 20 bp, Homo sapiens
attttaaataaaagtgatca

SEQ ID NO: 2627003 - DNA, 13 bp, Homo sapiens
attttaacaaaag

SEQ ID NO: 2627004 - DNA, 18 bp, Homo sapiens
attttaacaaaagcaaga

SEQ ID NO: 2627005 - DNA, 16 bp, Homo sapiens
attttaacaataacta

SEQ ID NO: 2627006 - DNA, 22 bp, Homo sapiens
attttaacctatgatattttct

SEQ ID NO: 2627007 - DNA, 13 bp, Homo sapiens
attttaactcata

SEQ ID NO: 2627008 - DNA, 13 bp, Homo sapiens
attttaactctgt

SEQ ID NO: 2627009 - DNA, 15 bp, Homo sapiens
attttaactttatca

SEQ ID NO: 2627010 - DNA, 16 bp, Homo sapiens
attttaagtgctttgt

SEQ ID NO: 2627011 - DNA, 23 bp, Homo sapiens
attttaattattattcttcataa

SEQ ID NO: 2627012 - DNA, 18 bp, Homo sapiens
attttaatttatgagttt

SEQ ID NO: 2627013 - DNA, 19 bp, Homo sapiens
caaccccagttctgctcct

SEQ ID NO: 2627014 - DNA, 20 bp, Homo sapiens
caaccccagttctgctcctc

SEQ ID NO: 2627015 - DNA, 13 bp, Homo sapiens
caacccccacccc

SEQ ID NO: 2627016 - DNA, 12 bp, Homo sapiens
caacccctgtgg

SEQ ID NO: 2627017 - DNA, 16 bp, Homo sapiens
caaccccttcgctcct

SEQ ID NO: 2627018 - DNA, 17 bp, Homo sapiens
caaccccttcgctcctg

SEQ ID NO: 2627019 - DNA, 19 bp, Homo sapiens
caaccctcctatcacctcc

SEQ ID NO: 2627020 - DNA, 22 bp, Homo sapiens
caaccctcctatcacctcccct

SEQ ID NO: 2627021 - DNA, 12 bp, Homo sapiens
caaccctgcaaa

SEQ ID NO: 2627022 - DNA, 16 bp, Homo sapiens
caaccctgcccctgcc

SEQ ID NO: 2627023 - DNA, 13 bp, Homo sapiens
caaccctggagag

SEQ ID NO: 2627024 - DNA, 11 bp, Homo sapiens
caaccctgtct

SEQ ID NO: 2627025 - DNA, 16 bp, Homo sapiens
caaccctgtttcctga

SEQ ID NO: 2627026 - DNA, 17 bp, Homo sapiens
caaccctgtttcctgag

SEQ ID NO: 2627027 - DNA, 15 bp, Homo sapiens
caacccttacccctt

SEQ ID NO: 2627028 - DNA, 19 bp, Homo sapiens
caacccttttgtctgcctc

SEQ ID NO: 2627029 - DNA, 14 bp, Homo sapiens
caaccgatgctcca

SEQ ID NO: 2627030 - DNA, 18 bp, Homo sapiens
caaccgatgctccagcca

SEQ ID NO: 2627031 - DNA, 21 bp, Homo sapiens
caaccgatgctccagccaacc

SEQ ID NO: 2627032 - DNA, 20 bp, Homo sapiens
caaccggggagcccccgccc

SEQ ID NO: 2627033 - DNA, 22 bp, Homo sapiens
caacctaccaccccttcctgtc

SEQ ID NO: 2627034 - DNA, 14 bp, Homo sapiens
caacctcattgaca

SEQ ID NO: 2627035 - DNA, 14 bp, Homo sapiens
caacctcctgggct

SEQ ID NO: 2627036 - DNA, 16 bp, Homo sapiens
caacctgattgtgtct

SEQ ID NO: 2627037 - DNA, 17 bp, Homo sapiens
caacctgattgtgtctc

SEQ ID NO: 2627038 - DNA, 18 bp, Homo sapiens
caacctgggtccaaataa

SEQ ID NO: 2627039 - DNA, 20 bp, Homo sapiens
caacctgttacctactttga

SEQ ID NO: 2627040 - DNA, 16 bp, Homo sapiens
caaccttgagacagct

SEQ ID NO: 2627041 - DNA, 13 bp, Homo sapiens
caacgaggaagcc

SEQ ID NO: 2627042 - DNA, 15 bp, Homo sapiens
caacgaggaagccct

SEQ ID NO: 2627043 - DNA, 21 bp, Homo sapiens
caacgcttaaaggtgtcttcc

SEQ ID NO: 2627044 - DNA, 13 bp, Homo sapiens
caacgtctgtgcc

SEQ ID NO: 2627045 - DNA, 17 bp, Homo sapiens
caacgtggcccagagaa

SEQ ID NO: 2627046 - DNA, 16 bp, Homo sapiens
caactagacattctgt

SEQ ID NO: 2627047 - DNA, 17 bp, Homo sapiens
caactaggcttcagcat

SEQ ID NO: 2627048 - DNA, 22 bp, Homo sapiens
caactatgatatggtaaaagtt

SEQ ID NO: 2627049 - DNA, 15 bp, Homo sapiens
caactcaccccagcc

SEQ ID NO: 2627050 - DNA, 16 bp, Homo sapiens
caactcaccccagccc

SEQ ID NO: 2627051 - DNA, 18 bp, Homo sapiens
caactcaccccagcccca

SEQ ID NO: 2627052 - DNA, 12 bp, Homo sapiens
caactcagacta

SEQ ID NO: 2627053 - DNA, 19 bp, Homo sapiens
caactcctagggccactga

SEQ ID NO: 2627054 - DNA, 14 bp, Homo sapiens
caactcgctttagg

SEQ ID NO: 2627055 - DNA, 13 bp, Homo sapiens
caactctttgaga

SEQ ID NO: 2627056 - DNA, 18 bp, Homo sapiens
caactgaatgaggtcagc

SEQ ID NO: 2627057 - DNA, 15 bp, Homo sapiens
caactgaccagcctc

SEQ ID NO: 2627058 - DNA, 14 bp, Homo sapiens
caactgaggcagac

SEQ ID NO: 2627059 - DNA, 21 bp, Homo sapiens
caactgaggcagacagcagct

SEQ ID NO: 2627060 - DNA, 22 bp, Homo sapiens
caactgcctactccaaaatgtt

SEQ ID NO: 2627061 - DNA, 13 bp, Homo sapiens
caactgtatatat

SEQ ID NO: 2627062 - DNA, 18 bp, Homo sapiens
caacttcagcagtaccta

SEQ ID NO: 2627063 - DNA, 19 bp, Homo sapiens
caacttctacttctgccct

SEQ ID NO: 2627064 - DNA, 20 bp, Homo sapiens
caacttctttttattttctt

SEQ ID NO: 2627065 - DNA, 19 bp, Homo sapiens
caacttgagggcccagagc

SEQ ID NO: 2627066 - DNA, 22 bp, Homo sapiens
caacttgagggcccagagcagg

SEQ ID NO: 2627067 - DNA, 12 bp, Homo sapiens
caacttgggaac

SEQ ID NO: 2627068 - DNA, 17 bp, Homo sapiens
caacttgtctttttctg

SEQ ID NO: 2627069 - DNA, 22 bp, Homo sapiens
caactttaagcagctcttgcta

SEQ ID NO: 2627070 - DNA, 11 bp, Homo sapiens
caactttctgt

SEQ ID NO: 2627071 - DNA, 12 bp, Homo sapiens
caactttctgta

SEQ ID NO: 2627072 - DNA, 18 bp, Homo sapiens
caagaaactgaggaattt

SEQ ID NO: 2627073 - DNA, 15 bp, Homo sapiens
caagaaagaaacccg

SEQ ID NO: 2627074 - DNA, 17 bp, Homo sapiens
caagaaatgaaagcagg

SEQ ID NO: 2627075 - DNA, 12 bp, Homo sapiens
caagaagacatg

SEQ ID NO: 2627076 - DNA, 14 bp, Homo sapiens
caagaagcccagga

SEQ ID NO: 2627077 - DNA, 22 bp, Homo sapiens
caagaagggttttccaccctgg

SEQ ID NO: 2627078 - DNA, 20 bp, Homo sapiens
caagaataatcacgctttcc

SEQ ID NO: 2627079 - DNA, 23 bp, Homo sapiens
caagaataatcacgctttcctga

SEQ ID NO: 2627080 - DNA, 23 bp, Homo sapiens
caagaatcagtctatccacagag

SEQ ID NO: 2627081 - DNA, 19 bp, Homo sapiens
caagaatcagtgcaaagat

SEQ ID NO: 2627082 - DNA, 16 bp, Homo sapiens
caagaatgctgaaacc

SEQ ID NO: 2627083 - DNA, 21 bp, Homo sapiens
caagaatggggatcacagaga

SEQ ID NO: 2627084 - DNA, 22 bp, Homo sapiens
caagaattgaagcaggactaaa

SEQ ID NO: 2627085 - DNA, 23 bp, Homo sapiens
caagaatttcttggtaagaagcc

SEQ ID NO: 2627086 - DNA, 22 bp, Homo sapiens
caagaatttgatcgttccagtt

SEQ ID NO: 2627087 - DNA, 15 bp, Homo sapiens
caagacacatcccta

SEQ ID NO: 2627088 - DNA, 17 bp, Homo sapiens
caagacagaagctgaag

SEQ ID NO: 2627089 - DNA, 13 bp, Homo sapiens
caagacagatgcc

SEQ ID NO: 2627090 - DNA, 16 bp, Homo sapiens
caagacagatgcccca

SEQ ID NO: 2627091 - DNA, 22 bp, Homo sapiens
caagacagatgccccagagctg

SEQ ID NO: 2627092 - DNA, 15 bp, Homo sapiens
caagacatgtctgtt

SEQ ID NO: 2627093 - DNA, 15 bp, Homo sapiens
caagacattaaatct

SEQ ID NO: 2627094 - DNA, 13 bp, Homo sapiens
caagacattgtca

SEQ ID NO: 2627095 - DNA, 14 bp, Homo sapiens
caagacattgtcaa

SEQ ID NO: 2627096 - DNA, 18 bp, Homo sapiens
caagacattgtcaataaa

SEQ ID NO: 2627097 - DNA, 14 bp, Homo sapiens
caagaccacgtttc

SEQ ID NO: 2627098 - DNA, 16 bp, Homo sapiens
caagaccacgtttcta

SEQ ID NO: 2627099 - DNA, 18 bp, Homo sapiens
caagacccttgtggtccc

SEQ ID NO: 2627100 - DNA, 22 bp, Homo sapiens
caagacccttgtggtcccaccc

SEQ ID NO: 2627101 - DNA, 17 bp, Homo sapiens
caagaccttctccttca

SEQ ID NO: 2627102 - DNA, 23 bp, Homo sapiens
caagaccttctccttcacctttg

SEQ ID NO: 2627103 - DNA, 13 bp, Homo sapiens
caagacgctgtgc

SEQ ID NO: 2627104 - DNA, 18 bp, Homo sapiens
caagacgctgtgctgccc

SEQ ID NO: 2627105 - DNA, 22 bp, Homo sapiens
caagacgctgtgctgccctgcc

SEQ ID NO: 2627106 - DNA, 23 bp, Homo sapiens
caagacgctgtgctgccctgccc

SEQ ID NO: 2627107 - DNA, 22 bp, Homo sapiens
caagactggaaggtggggacag

SEQ ID NO: 2627108 - DNA, 12 bp, Homo sapiens
caagagactctg

SEQ ID NO: 2627109 - DNA, 13 bp, Homo sapiens
caagagcacactt

SEQ ID NO: 2627110 - DNA, 16 bp, Homo sapiens
caagagcacacttggc

SEQ ID NO: 2627111 - DNA, 15 bp, Homo sapiens
caagagcagaggcag

SEQ ID NO: 2627112 - DNA, 14 bp, Homo sapiens
caagagcagcctgt

SEQ ID NO: 2627113 - DNA, 21 bp, Homo sapiens
caagagcagcctgtggcatct

SEQ ID NO: 2627114 - DNA, 14 bp, Homo sapiens
caagagctgccctc

SEQ ID NO: 2627115 - DNA, 16 bp, Homo sapiens
caagagctgccctcct

SEQ ID NO: 2627116 - DNA, 15 bp, Homo sapiens
caagaggctgaggca

SEQ ID NO: 2627117 - DNA, 23 bp, Homo sapiens
caagaggggtggagactgcttcc

SEQ ID NO: 2627118 - DNA, 15 bp, Homo sapiens
caagatatggacaca

SEQ ID NO: 2627119 - DNA, 16 bp, Homo sapiens
caagatcgcgccactg

SEQ ID NO: 2627120 - DNA, 19 bp, Homo sapiens
caagatgagagaactggag

SEQ ID NO: 2627121 - DNA, 16 bp, Homo sapiens
caagatgtcagactgg

SEQ ID NO: 2627122 - DNA, 21 bp, Homo sapiens
caagattgcttaaaatagcaa

SEQ ID NO: 2627123 - DNA, 19 bp, Homo sapiens
caagcaaaggtgaagagac

SEQ ID NO: 2627124 - DNA, 12 bp, Homo sapiens
caagcaagctcc

SEQ ID NO: 2627125 - DNA, 16 bp, Homo sapiens
caagcacagtggtggc

SEQ ID NO: 2627126 - DNA, 20 bp, Homo sapiens
caagcacatctgcattttca

SEQ ID NO: 2627127 - DNA, 18 bp, Homo sapiens
caagcacctagcctcgct

SEQ ID NO: 2627128 - DNA, 17 bp, Homo sapiens
caagcacctcctgcctc

SEQ ID NO: 2627129 - DNA, 23 bp, Homo sapiens
caagcactgctaggcgagtgcca

SEQ ID NO: 2627130 - DNA, 20 bp, Homo sapiens
caagcagaggtggccagagc

SEQ ID NO: 2627131 - DNA, 12 bp, Homo sapiens
caagcagccaag

SEQ ID NO: 2627132 - DNA, 14 bp, Homo sapiens
caagcagccaagct

SEQ ID NO: 2627133 - DNA, 22 bp, Homo sapiens
caagcagcgaccgccccctcct

SEQ ID NO: 2627134 - DNA, 17 bp, Homo sapiens
caagcaggaaatgaaaa

SEQ ID NO: 2627135 - DNA, 15 bp, Homo sapiens
caagcaggaagctca

SEQ ID NO: 2627136 - DNA, 16 bp, Homo sapiens
caagcaggaagctcag

SEQ ID NO: 2627137 - DNA, 16 bp, Homo sapiens
caagcataccaacacg

SEQ ID NO: 2627138 - DNA, 22 bp, Homo sapiens
caagcatttaatgtagccatgg

SEQ ID NO: 2627139 - DNA, 15 bp, Homo sapiens
caagccaacttgtaa

SEQ ID NO: 2627140 - DNA, 19 bp, Homo sapiens
caagccaagcagccaagct

SEQ ID NO: 2627141 - DNA, 21 bp, Homo sapiens
caagccaagcagccaagctcc

SEQ ID NO: 2627142 - DNA, 15 bp, Homo sapiens
caagccaatcccctc

SEQ ID NO: 2627143 - DNA, 19 bp, Homo sapiens
caagccacagaagccagga

SEQ ID NO: 2627144 - DNA, 14 bp, Homo sapiens
caagccagctggag

SEQ ID NO: 2627145 - DNA, 21 bp, Homo sapiens
caagcccgacttgctgttttg

SEQ ID NO: 2627146 - DNA, 21 bp, Homo sapiens
caagccctggagccaactgct

SEQ ID NO: 2627147 - DNA, 15 bp, Homo sapiens
caagcgattcttctg

SEQ ID NO: 2627148 - DNA, 22 bp, Homo sapiens
caagcgattcttctgcttcagc

SEQ ID NO: 2627149 - DNA, 18 bp, Homo sapiens
caagcgtgagccactgca

SEQ ID NO: 2627150 - DNA, 17 bp, Homo sapiens
caagctagaaggccaca

SEQ ID NO: 2627151 - DNA, 16 bp, Homo sapiens
caagctcaggaccagg

SEQ ID NO: 2627152 - DNA, 19 bp, Homo sapiens
caagctccaagctcccagg

SEQ ID NO: 2627153 - DNA, 19 bp, Homo sapiens
caccatgttggccaggctg

SEQ ID NO: 2627154 - DNA, 14 bp, Homo sapiens
caccattaaaaggg

SEQ ID NO: 2627155 - DNA, 22 bp, Homo sapiens
caccattaaaagggattaccca

SEQ ID NO: 2627156 - DNA, 13 bp, Homo sapiens
caccattcaggtc

SEQ ID NO: 2627157 - DNA, 18 bp, Homo sapiens
cacccaagggcctggcct

SEQ ID NO: 2627158 - DNA, 23 bp, Homo sapiens
cacccaagggcctggcctgagct

SEQ ID NO: 2627159 - DNA, 16 bp, Homo sapiens
cacctctccaagggct

SEQ ID NO: 2627160 - DNA, 22 bp, Homo sapiens
cacctctccaagggcttctgca

SEQ ID NO: 2627161 - DNA, 12 bp, Homo sapiens
cacctctccctc

SEQ ID NO: 2627162 - DNA, 23 bp, Homo sapiens
cacctctccctcaacaagggaga

SEQ ID NO: 2627163 - DNA, 15 bp, Homo sapiens
cacctctctcactcc

SEQ ID NO: 2627164 - DNA, 22 bp, Homo sapiens
cacctctgaaaacggccctctt

SEQ ID NO: 2627165 - DNA, 19 bp, Homo sapiens
cacctctgcacaagctgca

SEQ ID NO: 2627166 - DNA, 14 bp, Homo sapiens
cacctcttcacccc

SEQ ID NO: 2627167 - DNA, 19 bp, Homo sapiens
cacctctttgtgttttatt

SEQ ID NO: 2627168 - DNA, 23 bp, Homo sapiens
cacctgaagactcattcttctgt

SEQ ID NO: 2627169 - DNA, 20 bp, Homo sapiens
cacctgactctgaaatctga

SEQ ID NO: 2627170 - DNA, 21 bp, Homo sapiens
cacctgagcccggatgcttct

SEQ ID NO: 2627171 - DNA, 24 bp, Homo sapiens
cacctgaggtgggcccaggaccag

SEQ ID NO: 2627172 - DNA, 18 bp, Homo sapiens
cacctgaggttaggagtt

SEQ ID NO: 2627173 - DNA, 11 bp, Homo sapiens
cacctgatgtg

SEQ ID NO: 2627174 - DNA, 18 bp, Homo sapiens
cacctgattcaactaaaa

SEQ ID NO: 2627175 - DNA, 21 bp, Homo sapiens
cacctgattcaactaaaaaaa

SEQ ID NO: 2627176 - DNA, 13 bp, Homo sapiens
cactccagtgcca

SEQ ID NO: 2627177 - DNA, 12 bp, Homo sapiens
cactcccctgct

SEQ ID NO: 2627178 - DNA, 14 bp, Homo sapiens
cactcccctgctgg

SEQ ID NO: 2627179 - DNA, 13 bp, Homo sapiens
cactccctgcaac

SEQ ID NO: 2627180 - DNA, 19 bp, Homo sapiens
cactcccttcccataagct

SEQ ID NO: 2627181 - DNA, 20 bp, Homo sapiens
cactcccttctacctgccac

SEQ ID NO: 2627182 - DNA, 22 bp, Homo sapiens
cactcccttctacctgccactc

SEQ ID NO: 2627183 - DNA, 12 bp, Homo sapiens
cactcctagaga

SEQ ID NO: 2627184 - DNA, 19 bp, Homo sapiens
cactcctagagaacgcagc

SEQ ID NO: 2627185 - DNA, 23 bp, Homo sapiens
cactcctctgactcagggctcct

SEQ ID NO: 2627186 - DNA, 20 bp, Homo sapiens
cactcctgagacccctggcc

SEQ ID NO: 2627187 - DNA, 23 bp, Homo sapiens
cactcctgagacccctggcctcc

SEQ ID NO: 2627188 - DNA, 19 bp, Homo sapiens
cactcctggggcctcttgg

SEQ ID NO: 2627189 - DNA, 18 bp, Homo sapiens
cactcctgttacttacct

SEQ ID NO: 2627190 - DNA, 21 bp, Homo sapiens
cactccttcacagatgggtgc

SEQ ID NO: 2627191 - DNA, 15 bp, Homo sapiens
cactcgcccgcccac

SEQ ID NO: 2627192 - DNA, 18 bp, Homo sapiens
cactcgcccgcccactgt

SEQ ID NO: 2627193 - DNA, 18 bp, Homo sapiens
cactctaaaaggttcagg

SEQ ID NO: 2627194 - DNA, 20 bp, Homo sapiens
cactctaaaaggttcaggga

SEQ ID NO: 2627195 - DNA, 15 bp, Homo sapiens
cactctccccacact

SEQ ID NO: 2627196 - DNA, 20 bp, Homo sapiens
cactctctgaagatgatcat

SEQ ID NO: 2627197 - DNA, 23 bp, Homo sapiens
cactctctgaagatgatcatttg

SEQ ID NO: 2627198 - DNA, 19 bp, Homo sapiens
cactctgactggcacagtc

SEQ ID NO: 2627199 - DNA, 12 bp, Homo sapiens
cactctgctgct

SEQ ID NO: 2627200 - DNA, 12 bp, Homo sapiens
cactctggcagc

SEQ ID NO: 2627201 - DNA, 13 bp, Homo sapiens
cactctggcagct

SEQ ID NO: 2627202 - DNA, 19 bp, Homo sapiens
cactctggcagctcagaga

SEQ ID NO: 2627203 - DNA, 23 bp, Homo sapiens
cactctggcagctcagagagggt

SEQ ID NO: 2627204 - DNA, 17 bp, Homo sapiens
cactctgggctccagag

SEQ ID NO: 2627205 - DNA, 13 bp, Homo sapiens
cactctgttattt

SEQ ID NO: 2627206 - DNA, 20 bp, Homo sapiens
cactctgttatttagactca

SEQ ID NO: 2627207 - DNA, 18 bp, Homo sapiens
cactcttattgcccacgc

SEQ ID NO: 2627208 - DNA, 18 bp, Homo sapiens
cactgaaaacatctggaa

SEQ ID NO: 2627209 - DNA, 16 bp, Homo sapiens
cactgaaatatacaca

SEQ ID NO: 2627210 - DNA, 19 bp, Homo sapiens
cactgaagaaaccttcaga

SEQ ID NO: 2627211 - DNA, 13 bp, Homo sapiens
cactgaagctggg

SEQ ID NO: 2627212 - DNA, 13 bp, Homo sapiens
cactgaatattta

SEQ ID NO: 2627213 - DNA, 16 bp, Homo sapiens
cactgacacctttgca

SEQ ID NO: 2627214 - DNA, 21 bp, Homo sapiens
cactgacacctttgcaggcat

SEQ ID NO: 2627215 - DNA, 22 bp, Homo sapiens
cactgacacctttgcaggcatg

SEQ ID NO: 2627216 - DNA, 13 bp, Homo sapiens
cactgacactggt

SEQ ID NO: 2627217 - DNA, 20 bp, Homo sapiens
cactgacactggtattcctg

SEQ ID NO: 2627218 - DNA, 23 bp, Homo sapiens
cactgacactggtattcctgcct

SEQ ID NO: 2627219 - DNA, 13 bp, Homo sapiens
cactgacagcctc

SEQ ID NO: 2627220 - DNA, 14 bp, Homo sapiens
cactgacagcctcc

SEQ ID NO: 2627221 - DNA, 16 bp, Homo sapiens
cactgacagcctccca

SEQ ID NO: 2627222 - DNA, 20 bp, Homo sapiens
cactgacagcctcccacccc

SEQ ID NO: 2627223 - DNA, 17 bp, Homo sapiens
cactgaccatccactct

SEQ ID NO: 2627224 - DNA, 23 bp, Homo sapiens
cactgaccatccactctaccctc

SEQ ID NO: 2627225 - DNA, 12 bp, Homo sapiens
cactgagacagc

SEQ ID NO: 2627226 - DNA, 17 bp, Homo sapiens
cactgagacagcccggg

SEQ ID NO: 2627227 - DNA, 22 bp, Homo sapiens
cactgagacagcccgggctctg

SEQ ID NO: 2627228 - DNA, 13 bp, Homo sapiens
cactgagcccccc

SEQ ID NO: 2627229 - DNA, 13 bp, Homo sapiens
cactgaggcaggg

SEQ ID NO: 2627230 - DNA, 18 bp, Homo sapiens
cactgaggcagggaagtc

SEQ ID NO: 2627231 - DNA, 23 bp, Homo sapiens
cactgcaacctccgcctcttggg

SEQ ID NO: 2627232 - DNA, 17 bp, Homo sapiens
cactgcaacttctgcct

SEQ ID NO: 2627233 - DNA, 19 bp, Homo sapiens
cactgcacacacctcagag

SEQ ID NO: 2627234 - DNA, 22 bp, Homo sapiens
cactgcacacacctcagaggct

SEQ ID NO: 2627235 - DNA, 15 bp, Homo sapiens
cactgcacagagctc

SEQ ID NO: 2627236 - DNA, 15 bp, Homo sapiens
cactgcaccgggcca

SEQ ID NO: 2627237 - DNA, 15 bp, Homo sapiens
cactgcactccagcc

SEQ ID NO: 2627238 - DNA, 18 bp, Homo sapiens
cactgcactccagcctgg

SEQ ID NO: 2627239 - DNA, 20 bp, Homo sapiens
cactgcactccagcctgggc

SEQ ID NO: 2627240 - DNA, 14 bp, Homo sapiens
cactgcagcctcaa

SEQ ID NO: 2627241 - DNA, 19 bp, Homo sapiens
cactgcagcctcaacctcc

SEQ ID NO: 2627242 - DNA, 20 bp, Homo sapiens
cactgcagcctcaacctcct

SEQ ID NO: 2627243 - DNA, 23 bp, Homo sapiens
cactgcagcctcaacctcctggg

SEQ ID NO: 2627244 - DNA, 13 bp, Homo sapiens
cactgcaggggcc

SEQ ID NO: 2627245 - DNA, 14 bp, Homo sapiens
cactgccatatact

SEQ ID NO: 2627246 - DNA, 17 bp, Homo sapiens
cactgccatgcagggcc

SEQ ID NO: 2627247 - DNA, 15 bp, Homo sapiens
cactgcccaccccct

SEQ ID NO: 2627248 - DNA, 18 bp, Homo sapiens
cactgcccaccccctcaa

SEQ ID NO: 2627249 - DNA, 15 bp, Homo sapiens
cactgcccgagctgg

SEQ ID NO: 2627250 - DNA, 16 bp, Homo sapiens
cactgcccgagctggt

SEQ ID NO: 2627251 - DNA, 16 bp, Homo sapiens
cactgcctcaggttcc

SEQ ID NO: 2627252 - DNA, 16 bp, Homo sapiens
cactgcctctccctgg

SEQ ID NO: 2627253 - DNA, 21 bp, Homo sapiens
cactgctaggcgagtgccagg

SEQ ID NO: 2627254 - DNA, 19 bp, Homo sapiens
cactgctcaagaagacatg

SEQ ID NO: 2627255 - DNA, 22 bp, Homo sapiens
cactgctgcaaggcctttctgt

SEQ ID NO: 2627256 - DNA, 15 bp, Homo sapiens
cactgctgcccagcc

SEQ ID NO: 2627257 - DNA, 16 bp, Homo sapiens
cactgcttccagtgag

SEQ ID NO: 2627258 - DNA, 19 bp, Homo sapiens
cactgcttccagtgaggct

SEQ ID NO: 2627259 - DNA, 14 bp, Homo sapiens
cactgcttgaggaa

SEQ ID NO: 2627260 - DNA, 16 bp, Homo sapiens
cactggactccggccc

SEQ ID NO: 2627261 - DNA, 12 bp, Homo sapiens
cactggagccca

SEQ ID NO: 2627262 - DNA, 13 bp, Homo sapiens
cactggagcccag

SEQ ID NO: 2627263 - DNA, 19 bp, Homo sapiens
cactggaggagagaagaat

SEQ ID NO: 2627264 - DNA, 17 bp, Homo sapiens
cactggagtgcagggag

SEQ ID NO: 2627265 - DNA, 19 bp, Homo sapiens
cactggcattgtccctgtg

SEQ ID NO: 2627266 - DNA, 21 bp, Homo sapiens
cactggccaccaggctggcgc

SEQ ID NO: 2627267 - DNA, 11 bp, Homo sapiens
cactggctctc

SEQ ID NO: 2627268 - DNA, 18 bp, Homo sapiens
cactggctctccaagtgc

SEQ ID NO: 2627269 - DNA, 21 bp, Homo sapiens
cactggctgagcggatgcatc

SEQ ID NO: 2627270 - DNA, 22 bp, Homo sapiens
cactggctgtcagtatgacatt

SEQ ID NO: 2627271 - DNA, 13 bp, Homo sapiens
cactgggaaacag

SEQ ID NO: 2627272 - DNA, 17 bp, Homo sapiens
cactgggacttgcaaaa

SEQ ID NO: 2627273 - DNA, 16 bp, Homo sapiens
cactgggagaggtgcc

SEQ ID NO: 2627274 - DNA, 20 bp, Homo sapiens
cactgggagaggtgccagca

SEQ ID NO: 2627275 - DNA, 23 bp, Homo sapiens
cactgggagaggtgccagcaact

SEQ ID NO: 2627276 - DNA, 21 bp, Homo sapiens
cactggggaaataacagctgt

SEQ ID NO: 2627277 - DNA, 13 bp, Homo sapiens
cactggggctggc

SEQ ID NO: 2627278 - DNA, 15 bp, Homo sapiens
cactggggtgccgcc

SEQ ID NO: 2627279 - DNA, 18 bp, Homo sapiens
cactgggtggggtgagga

SEQ ID NO: 2627280 - DNA, 19 bp, Homo sapiens
cactgggtggggtgaggac

SEQ ID NO: 2627281 - DNA, 21 bp, Homo sapiens
cactgggtggggtgaggacca

SEQ ID NO: 2627282 - DNA, 16 bp, Homo sapiens
cactggtattcctgcc

SEQ ID NO: 2627283 - DNA, 20 bp, Homo sapiens
cactggtattcctgcctcca

SEQ ID NO: 2627284 - DNA, 17 bp, Homo sapiens
cactggtgacatgtctt

SEQ ID NO: 2627285 - DNA, 22 bp, Homo sapiens
cactggtgactgcgatcttcag

SEQ ID NO: 2627286 - DNA, 20 bp, Homo sapiens
cactggtgtgacctgagggc

SEQ ID NO: 2627287 - DNA, 23 bp, Homo sapiens
cactggtgtgagggcccctgcct

SEQ ID NO: 2627288 - DNA, 22 bp, Homo sapiens
cactggttcttcttggtctcag

SEQ ID NO: 2627289 - DNA, 13 bp, Homo sapiens
cactgtaaaatga

SEQ ID NO: 2627290 - DNA, 14 bp, Homo sapiens
cactgtaaaatgaa

SEQ ID NO: 2627291 - DNA, 20 bp, Homo sapiens
cactgtacaaggtacccctt

SEQ ID NO: 2627292 - DNA, 18 bp, Homo sapiens
cactgtagaatgatttca

SEQ ID NO: 2627293 - DNA, 13 bp, Homo sapiens
cactgtataaata

SEQ ID NO: 2627294 - DNA, 14 bp, Homo sapiens
cactgtatttgtat

SEQ ID NO: 2627295 - DNA, 17 bp, Homo sapiens
cactgtatttgtatctc

SEQ ID NO: 2627296 - DNA, 16 bp, Homo sapiens
cactgtcaccctccac

SEQ ID NO: 2627297 - DNA, 18 bp, Homo sapiens
cactgtcactgtttctct

SEQ ID NO: 2627298 - DNA, 19 bp, Homo sapiens
cactgtcactttgctctgg

SEQ ID NO: 2627299 - DNA, 16 bp, Homo sapiens
cactgtccctcaaatg

SEQ ID NO: 2627300 - DNA, 14 bp, Homo sapiens
cactgtcctccaag

SEQ ID NO: 2627301 - DNA, 17 bp, Homo sapiens
cactgtcctccaagcca

SEQ ID NO: 2627302 - DNA, 13 bp, Homo sapiens
cactgtcctgggc

SEQ ID NO: 2627303 - DNA, 12 bp, Homo sapiens
cactgtctcagt

SEQ ID NO: 2627304 - DNA, 10 bp, Homo sapiens
cactgtctga

SEQ ID NO: 2627305 - DNA, 20 bp, Homo sapiens
cactgtgcacatctgtgtct

SEQ ID NO: 2627306 - DNA, 22 bp, Homo sapiens
cactgtgcacatctgtgtcttg

SEQ ID NO: 2627307 - DNA, 15 bp, Homo sapiens
cactgtgccatgtgc

SEQ ID NO: 2627308 - DNA, 12 bp, Homo sapiens
cactgtgccctg

SEQ ID NO: 2627309 - DNA, 13 bp, Homo sapiens
cactgtgccctgg

SEQ ID NO: 2627310 - DNA, 18 bp, Homo sapiens
cactgtgccctggtggag

SEQ ID NO: 2627311 - DNA, 19 bp, Homo sapiens
cactgtgctaataacagtg

SEQ ID NO: 2627312 - DNA, 21 bp, Homo sapiens
cactgtgctaataacagtgca

SEQ ID NO: 2627313 - DNA, 13 bp, Homo sapiens
cactgtgctcagg

SEQ ID NO: 2627314 - DNA, 16 bp, Homo sapiens
cactgtgctcagggct

SEQ ID NO: 2627315 - DNA, 15 bp, Homo sapiens
cactgtgctgagtct

SEQ ID NO: 2627316 - DNA, 20 bp, Homo sapiens
cactgtgctgagtctgaagg

SEQ ID NO: 2627317 - DNA, 14 bp, Homo sapiens
cactgtgggaaggc

SEQ ID NO: 2627318 - DNA, 17 bp, Homo sapiens
cactgtgggaaggccag

SEQ ID NO: 2627319 - DNA, 21 bp, Homo sapiens
cactgtgggaaggccagctgc

SEQ ID NO: 2627320 - DNA, 20 bp, Homo sapiens
cactgttccagcctgccctc

SEQ ID NO: 2627321 - DNA, 19 bp, Homo sapiens
cactgttccccctgtgcag

SEQ ID NO: 2627322 - DNA, 14 bp, Homo sapiens
cactgttccctctg

SEQ ID NO: 2627323 - DNA, 17 bp, Homo sapiens
cactgttccctctgctc

SEQ ID NO: 2627324 - DNA, 20 bp, Homo sapiens
cactgttccctctgctcctg

SEQ ID NO: 2627325 - DNA, 23 bp, Homo sapiens
cactgttctattcatctcaagga

SEQ ID NO: 2627326 - DNA, 14 bp, Homo sapiens
cactgttctctgcc

SEQ ID NO: 2627327 - DNA, 14 bp, Homo sapiens
acacacaacaatta

SEQ ID NO: 2627328 - DNA, 12 bp, Homo sapiens
acacacacacac

SEQ ID NO: 2627329 - DNA, 13 bp, Homo sapiens
acacacacacaca

SEQ ID NO: 2627330 - DNA, 16 bp, Homo sapiens
acacacacacacacag

SEQ ID NO: 2627331 - DNA, 14 bp, Homo sapiens
acacacacacacag

SEQ ID NO: 2627332 - DNA, 16 bp, Homo sapiens
acacacacacacagcc

SEQ ID NO: 2627333 - DNA, 15 bp, Homo sapiens
acacacacacacagg

SEQ ID NO: 2627334 - DNA, 14 bp, Homo sapiens
acacacacacacat

SEQ ID NO: 2627335 - DNA, 15 bp, Homo sapiens
acacacacacacatg

SEQ ID NO: 2627336 - DNA, 16 bp, Homo sapiens
acacacacacacatgc

SEQ ID NO: 2627337 - DNA, 14 bp, Homo sapiens
acacacacacatgc

SEQ ID NO: 2627338 - DNA, 13 bp, Homo sapiens
acacacacacgca

SEQ ID NO: 2627339 - DNA, 16 bp, Homo sapiens
acacacacacgcacgc

SEQ ID NO: 2627340 - DNA, 13 bp, Homo sapiens
acacacacagaaa

SEQ ID NO: 2627341 - DNA, 13 bp, Homo sapiens
acacacacagcca

SEQ ID NO: 2627342 - DNA, 14 bp, Homo sapiens
acacacacatgcat

SEQ ID NO: 2627343 - DNA, 12 bp, Homo sapiens
acacacacgcac

SEQ ID NO: 2627344 - DNA, 14 bp, Homo sapiens
acacacacgcacgc

SEQ ID NO: 2627345 - DNA, 19 bp, Homo sapiens
acactgaagttaacagaga

SEQ ID NO: 2627346 - DNA, 22 bp, Homo sapiens
acactgacacctttgcaggcat

SEQ ID NO: 2627347 - DNA, 16 bp, Homo sapiens
acactgcaggcatcac

SEQ ID NO: 2627348 - DNA, 21 bp, Homo sapiens
acactgcaggcatcacagcta

SEQ ID NO: 2627349 - DNA, 14 bp, Homo sapiens
acactgcatgtttg

SEQ ID NO: 2627350 - DNA, 19 bp, Homo sapiens
acactgcttgtgtttttaa

SEQ ID NO: 2627351 - DNA, 19 bp, Homo sapiens
acactggaggagagaagaa

SEQ ID NO: 2627352 - DNA, 21 bp, Homo sapiens
acactggaggagagaagaatg

SEQ ID NO: 2627353 - DNA, 17 bp, Homo sapiens
acactgggtgcccaagc

SEQ ID NO: 2627354 - DNA, 22 bp, Homo sapiens
acactgtgcccagcccggacct

SEQ ID NO: 2627355 - DNA, 23 bp, Homo sapiens
acactgtgcccagcccggacctt

SEQ ID NO: 2627356 - DNA, 15 bp, Homo sapiens
acactgtgccctggt

SEQ ID NO: 2627357 - DNA, 20 bp, Homo sapiens
acactgttctgaaagtgact

SEQ ID NO: 2627358 - DNA, 11 bp, Homo sapiens
acacttaacag

SEQ ID NO: 2627359 - DNA, 14 bp, Homo sapiens
acacttaacagatg

SEQ ID NO: 2627360 - DNA, 18 bp, Homo sapiens
acacttacactttatgca

SEQ ID NO: 2627361 - DNA, 19 bp, Homo sapiens
acacttcagagagctggta

SEQ ID NO: 2627362 - DNA, 13 bp, Homo sapiens
acacttcctgtcc

SEQ ID NO: 2627363 - DNA, 19 bp, Homo sapiens
acacttcctgtccagagag

SEQ ID NO: 2627364 - DNA, 17 bp, Homo sapiens
acacttggttgggtcct

SEQ ID NO: 2627365 - DNA, 12 bp, Homo sapiens
acagaaaatata

SEQ ID NO: 2627366 - DNA, 13 bp, Homo sapiens
acagaaaatatac

SEQ ID NO: 2627367 - DNA, 14 bp, Homo sapiens
acagaaaatatact

SEQ ID NO: 2627368 - DNA, 17 bp, Homo sapiens
acagaaaatatactgta

SEQ ID NO: 2627369 - DNA, 19 bp, Homo sapiens
acagaaaatatactgtaaa

SEQ ID NO: 2627370 - DNA, 17 bp, Homo sapiens
acagaaacaaaaacact

SEQ ID NO: 2627371 - DNA, 16 bp, Homo sapiens
acagaaaggttttctt

SEQ ID NO: 2627372 - DNA, 14 bp, Homo sapiens
acagaaatgtacag

SEQ ID NO: 2627373 - DNA, 16 bp, Homo sapiens
acagaaatgtacagca

SEQ ID NO: 2627374 - DNA, 14 bp, Homo sapiens
acagaacactgtct

SEQ ID NO: 2627375 - DNA, 16 bp, Homo sapiens
acagaaccttgttatt

SEQ ID NO: 2627376 - DNA, 12 bp, Homo sapiens
acagaagcagct

SEQ ID NO: 2627377 - DNA, 15 bp, Homo sapiens
acagaagcagctctt

SEQ ID NO: 2627378 - DNA, 21 bp, Homo sapiens
acagaagccaggagcaaatgt

SEQ ID NO: 2627379 - DNA, 21 bp, Homo sapiens
acagaagcctcactgcaagca

SEQ ID NO: 2627380 - DNA, 17 bp, Homo sapiens
acagaagtcatgaagcc

SEQ ID NO: 2627381 - DNA, 17 bp, Homo sapiens
acagaattctgctacct

SEQ ID NO: 2627382 - DNA, 14 bp, Homo sapiens
acagacaacagaag

SEQ ID NO: 2627383 - DNA, 11 bp, Homo sapiens
acagacacaca

SEQ ID NO: 2627384 - DNA, 18 bp, Homo sapiens
acagacacaggcccggct

SEQ ID NO: 2627385 - DNA, 14 bp, Homo sapiens
acagacactggcat

SEQ ID NO: 2627386 - DNA, 20 bp, Homo sapiens
acagaccacatctttatctg

SEQ ID NO: 2627387 - DNA, 18 bp, Homo sapiens
acagaccgaactgttgta

SEQ ID NO: 2627388 - DNA, 19 bp, Homo sapiens
acagaccgaactgttgtat

SEQ ID NO: 2627389 - DNA, 21 bp, Homo sapiens
acagacctggagcccctgggt

SEQ ID NO: 2627390 - DNA, 15 bp, Homo sapiens
acagacgtatgctta

SEQ ID NO: 2627391 - DNA, 19 bp, Homo sapiens
acagactggaagcacagct

SEQ ID NO: 2627392 - DNA, 15 bp, Homo sapiens
acagacttctccaga

SEQ ID NO: 2627393 - DNA, 23 bp, Homo sapiens
acagagacaggcccaagagatga

SEQ ID NO: 2627394 - DNA, 15 bp, Homo sapiens
acagagcaagactct

SEQ ID NO: 2627395 - DNA, 20 bp, Homo sapiens
acagagcccacgcccccact

SEQ ID NO: 2627396 - DNA, 21 bp, Homo sapiens
acagagcgagagtctgtctca

SEQ ID NO: 2627397 - DNA, 14 bp, Homo sapiens
acagagctgggatg

SEQ ID NO: 2627398 - DNA, 18 bp, Homo sapiens
acagagctgggatgtttc

SEQ ID NO: 2627399 - DNA, 21 bp, Homo sapiens
acagagctgggatgtttctgt

SEQ ID NO: 2627400 - DNA, 21 bp, Homo sapiens
acagagctggttgggaagaca

SEQ ID NO: 2627401 - DNA, 15 bp, Homo sapiens
acagagcttccctga

SEQ ID NO: 2627402 - DNA, 16 bp, Homo sapiens
acagagcttccctgac

SEQ ID NO: 2627403 - DNA, 19 bp, Homo sapiens
acagaggaagaatttgtta

SEQ ID NO: 2627404 - DNA, 14 bp, Homo sapiens
acagaggaagagca

SEQ ID NO: 2627405 - DNA, 23 bp, Homo sapiens
acagaggcagccccattctgcct

SEQ ID NO: 2627406 - DNA, 17 bp, Homo sapiens
acagaggccatggcaga

SEQ ID NO: 2627407 - DNA, 12 bp, Homo sapiens
acagaggcctgc

SEQ ID NO: 2627408 - DNA, 16 bp, Homo sapiens
acagagggaagaaaag

SEQ ID NO: 2627409 - DNA, 24 bp, Homo sapiens
acagagtggtctttctggagaggt

SEQ ID NO: 2627410 - DNA, 18 bp, Homo sapiens
acagataagcaagagaga

SEQ ID NO: 2627411 - DNA, 14 bp, Homo sapiens
acagatataaatgg

SEQ ID NO: 2627412 - DNA, 18 bp, Homo sapiens
acagatcaagctgtgaga

SEQ ID NO: 2627413 - DNA, 18 bp, Homo sapiens
acagatgccccagagctg

SEQ ID NO: 2627414 - DNA, 21 bp, Homo sapiens
acagatgcttttctgtctctg

SEQ ID NO: 2627415 - DNA, 20 bp, Homo sapiens
acagatgtaaaagacttttt

SEQ ID NO: 2627416 - DNA, 17 bp, Homo sapiens
acagattcacactgtct

SEQ ID NO: 2627417 - DNA, 12 bp, Homo sapiens
acagatttgtga

SEQ ID NO: 2627418 - DNA, 15 bp, Homo sapiens
acagatttttacaaa

SEQ ID NO: 2627419 - DNA, 16 bp, Homo sapiens
acagatttttacaaat

SEQ ID NO: 2627420 - DNA, 17 bp, Homo sapiens
acagcaacaatttatga

SEQ ID NO: 2627421 - DNA, 12 bp, Homo sapiens
acagcactactc

SEQ ID NO: 2627422 - DNA, 15 bp, Homo sapiens
acagcactactctgt

SEQ ID NO: 2627423 - DNA, 17 bp, Homo sapiens
acagcactactctgtgc

SEQ ID NO: 2627424 - DNA, 20 bp, Homo sapiens
acagcactggctctctccag

SEQ ID NO: 2627425 - DNA, 17 bp, Homo sapiens
acagcagcccctgcaca

SEQ ID NO: 2627426 - DNA, 16 bp, Homo sapiens
acagcagctcaggcac

SEQ ID NO: 2627427 - DNA, 17 bp, Homo sapiens
acagcagctcaggcaca

SEQ ID NO: 2627428 - DNA, 12 bp, Homo sapiens
acagcagcttca

SEQ ID NO: 2627429 - DNA, 13 bp, Homo sapiens
acagcagcttcac

SEQ ID NO: 2627430 - DNA, 17 bp, Homo sapiens
acagcagcttcaccaga

SEQ ID NO: 2627431 - DNA, 16 bp, Homo sapiens
acagcagtgtcatcag

SEQ ID NO: 2627432 - DNA, 17 bp, Homo sapiens
acagcagtgtcatcaga

SEQ ID NO: 2627433 - DNA, 19 bp, Homo sapiens
acagcagtgttccccatct

SEQ ID NO: 2627434 - DNA, 15 bp, Homo sapiens
acagcagttgaaaag

SEQ ID NO: 2627435 - DNA, 22 bp, Homo sapiens
acagcagttgaaaagactccaa

SEQ ID NO: 2627436 - DNA, 13 bp, Homo sapiens
acagccaacaggt

SEQ ID NO: 2627437 - DNA, 18 bp, Homo sapiens
acagccacacacacagaa

SEQ ID NO: 2627438 - DNA, 22 bp, Homo sapiens
acagccacacacacagaaaata

SEQ ID NO: 2627439 - DNA, 15 bp, Homo sapiens
acagccacggccagg

SEQ ID NO: 2627440 - DNA, 17 bp, Homo sapiens
acagccacggccaggcc

SEQ ID NO: 2627441 - DNA, 18 bp, Homo sapiens
acagccacggccaggcca

SEQ ID NO: 2627442 - DNA, 16 bp, Homo sapiens
acagccagactggcac

SEQ ID NO: 2627443 - DNA, 17 bp, Homo sapiens
acagccaggtgccttgg

SEQ ID NO: 2627444 - DNA, 19 bp, Homo sapiens
acagccaggtgccttggag

SEQ ID NO: 2627445 - DNA, 17 bp, Homo sapiens
acagcccgggctctgcc

SEQ ID NO: 2627446 - DNA, 18 bp, Homo sapiens
acagcccgggctctgcct

SEQ ID NO: 2627447 - DNA, 20 bp, Homo sapiens
acagccgctcctgtctgcca

SEQ ID NO: 2627448 - DNA, 18 bp, Homo sapiens
acagcctcacttgaatgt

SEQ ID NO: 2627449 - DNA, 15 bp, Homo sapiens
acagcctcccctgcc

SEQ ID NO: 2627450 - DNA, 17 bp, Homo sapiens
acagcctcccctgccag

SEQ ID NO: 2627451 - DNA, 12 bp, Homo sapiens
acagcctcctct

SEQ ID NO: 2627452 - DNA, 13 bp, Homo sapiens
acagcctcctctg

SEQ ID NO: 2627453 - DNA, 17 bp, Homo sapiens
acagcctcctctgtctg

SEQ ID NO: 2627454 - DNA, 13 bp, Homo sapiens
acagcggcccctg

SEQ ID NO: 2627455 - DNA, 16 bp, Homo sapiens
acagcggggccccagg

SEQ ID NO: 2627456 - DNA, 17 bp, Homo sapiens
acagcgtttaagactgt

SEQ ID NO: 2627457 - DNA, 19 bp, Homo sapiens
acagctaacaattgtgaag

SEQ ID NO: 2627458 - DNA, 15 bp, Homo sapiens
acagctaatgggaca

SEQ ID NO: 2627459 - DNA, 13 bp, Homo sapiens
acagctacacaga

SEQ ID NO: 2627460 - DNA, 23 bp, Homo sapiens
acagctcagttctagtctctctg

SEQ ID NO: 2627461 - DNA, 14 bp, Homo sapiens
acagctccctctgc

SEQ ID NO: 2627462 - DNA, 17 bp, Homo sapiens
acagctccctctgcctg

SEQ ID NO: 2627463 - DNA, 12 bp, Homo sapiens
acagctccttct

SEQ ID NO: 2627464 - DNA, 14 bp, Homo sapiens
acagctctgtcctg

SEQ ID NO: 2627465 - DNA, 16 bp, Homo sapiens
acagctctgtcctggg

SEQ ID NO: 2627466 - DNA, 17 bp, Homo sapiens
acagctcttctccaggc

SEQ ID NO: 2627467 - DNA, 20 bp, Homo sapiens
acagctcttctccaggctgt

SEQ ID NO: 2627468 - DNA, 16 bp, Homo sapiens
acagctgagagacttt

SEQ ID NO: 2627469 - DNA, 22 bp, Homo sapiens
acagctgagagacttttaatca

SEQ ID NO: 2627470 - DNA, 22 bp, Homo sapiens
acagctgaggtctcttgaggga

SEQ ID NO: 2627471 - DNA, 11 bp, Homo sapiens
acagctgctgg

SEQ ID NO: 2627472 - DNA, 15 bp, Homo sapiens
acagctgctttctgt

SEQ ID NO: 2627473 - DNA, 19 bp, Homo sapiens
acagctgggtggcactgcc

SEQ ID NO: 2627474 - DNA, 14 bp, Homo sapiens
acagctgtttaaga

SEQ ID NO: 2627475 - DNA, 17 bp, Homo sapiens
acagcttcagccaggag

SEQ ID NO: 2627476 - DNA, 21 bp, Homo sapiens
acagcttcagccaggagctgg

SEQ ID NO: 2627477 - DNA, 20 bp, Homo sapiens
acagcttcccctctctcctc

SEQ ID NO: 2627478 - DNA, 20 bp, Homo sapiens
acagcttctcatcctgcagg

SEQ ID NO: 2627479 - DNA, 20 bp, Homo sapiens
acagctttcatgattagcaa

SEQ ID NO: 2627480 - DNA, 15 bp, Homo sapiens
acagctttgtgactg

SEQ ID NO: 2627481 - DNA, 10 bp, Homo sapiens
acaggaagat

SEQ ID NO: 2627482 - DNA, 20 bp, Homo sapiens
acaggaaggtggtgcttaca

SEQ ID NO: 2627483 - DNA, 17 bp, Homo sapiens
acaggaagtcttcaggg

SEQ ID NO: 2627484 - DNA, 20 bp, Homo sapiens
acaggacagtgcttcagcct

SEQ ID NO: 2627485 - DNA, 14 bp, Homo sapiens
acaggactctgcct

SEQ ID NO: 2627486 - DNA, 14 bp, Homo sapiens
acaggagctgggat

SEQ ID NO: 2627487 - DNA, 18 bp, Homo sapiens
acaggagggcaagggcca

SEQ ID NO: 2627488 - DNA, 14 bp, Homo sapiens
acaggatcagtctg

SEQ ID NO: 2627489 - DNA, 15 bp, Homo sapiens
acaggatcagtctga

SEQ ID NO: 2627490 - DNA, 14 bp, Homo sapiens
acaggatgaaggca

SEQ ID NO: 2627491 - DNA, 22 bp, Homo sapiens
agccactcctctgactcagggc

SEQ ID NO: 2627492 - DNA, 16 bp, Homo sapiens
agccactgcaccgggc

SEQ ID NO: 2627493 - DNA, 22 bp, Homo sapiens
agccactgcaccgggccacaga

SEQ ID NO: 2627494 - DNA, 15 bp, Homo sapiens
agccacttaccttca

SEQ ID NO: 2627495 - DNA, 18 bp, Homo sapiens
agccacttaccttcaata

SEQ ID NO: 2627496 - DNA, 14 bp, Homo sapiens
agccagactctggt

SEQ ID NO: 2627497 - DNA, 14 bp, Homo sapiens
agccagactggcac

SEQ ID NO: 2627498 - DNA, 14 bp, Homo sapiens
agccagagaagtga

SEQ ID NO: 2627499 - DNA, 16 bp, Homo sapiens
agccagagaagtgaca

SEQ ID NO: 2627500 - DNA, 17 bp, Homo sapiens
agccagagaagtgacag

SEQ ID NO: 2627501 - DNA, 19 bp, Homo sapiens
agccagagaagtgacaggg

SEQ ID NO: 2627502 - DNA, 13 bp, Homo sapiens
agccagaggtctg

SEQ ID NO: 2627503 - DNA, 17 bp, Homo sapiens
agccagatcctcttggt

SEQ ID NO: 2627504 - DNA, 11 bp, Homo sapiens
agccagcagcc

SEQ ID NO: 2627505 - DNA, 14 bp, Homo sapiens
agccagcagccagc

SEQ ID NO: 2627506 - DNA, 16 bp, Homo sapiens
agccagcagccagctc

SEQ ID NO: 2627507 - DNA, 22 bp, Homo sapiens
agccagcgggaatggcagctgc

SEQ ID NO: 2627508 - DNA, 17 bp, Homo sapiens
agccagcgtcctcctct

SEQ ID NO: 2627509 - DNA, 15 bp, Homo sapiens
agccagctctcagcc

SEQ ID NO: 2627510 - DNA, 16 bp, Homo sapiens
agccagctctcagcca

SEQ ID NO: 2627511 - DNA, 16 bp, Homo sapiens
agccagctctgcatta

SEQ ID NO: 2627512 - DNA, 20 bp, Homo sapiens
agccagctgccgaccagagc

SEQ ID NO: 2627513 - DNA, 16 bp, Homo sapiens
agccagctttccctgc

SEQ ID NO: 2627514 - DNA, 14 bp, Homo sapiens
agccaggagctggg

SEQ ID NO: 2627515 - DNA, 20 bp, Homo sapiens
agccaggatcatggtgtaat

SEQ ID NO: 2627516 - DNA, 22 bp, Homo sapiens
agccaggatcatggtgtaataa

SEQ ID NO: 2627517 - DNA, 14 bp, Homo sapiens
agccaggccacaag

SEQ ID NO: 2627518 - DNA, 14 bp, Homo sapiens
agccaggctctgtg

SEQ ID NO: 2627519 - DNA, 12 bp, Homo sapiens
agccagggccag

SEQ ID NO: 2627520 - DNA, 22 bp, Homo sapiens
agccagggctatgggagcagct

SEQ ID NO: 2627521 - DNA, 11 bp, Homo sapiens
agccagggctg

SEQ ID NO: 2627522 - DNA, 14 bp, Homo sapiens
agccagggctgcta

SEQ ID NO: 2627523 - DNA, 21 bp, Homo sapiens
agccagggctgctagacggag

SEQ ID NO: 2627524 - DNA, 14 bp, Homo sapiens
agccaggtgccttg

SEQ ID NO: 2627525 - DNA, 18 bp, Homo sapiens
agccaggtgccttggagg

SEQ ID NO: 2627526 - DNA, 16 bp, Homo sapiens
agccagtaaacagagg

SEQ ID NO: 2627527 - DNA, 22 bp, Homo sapiens
agccagtaaatgggggtgcatt

SEQ ID NO: 2627528 - DNA, 21 bp, Homo sapiens
agccagtgacctgaggaagcg

SEQ ID NO: 2627529 - DNA, 13 bp, Homo sapiens
agccagtgactcc

SEQ ID NO: 2627530 - DNA, 16 bp, Homo sapiens
agccagtgactccagg

SEQ ID NO: 2627531 - DNA, 22 bp, Homo sapiens
agccagttcagtacctggagga

SEQ ID NO: 2627532 - DNA, 14 bp, Homo sapiens
agccatcccagcct

SEQ ID NO: 2627533 - DNA, 17 bp, Homo sapiens
agccatcccagccttgg

SEQ ID NO: 2627534 - DNA, 19 bp, Homo sapiens
agccatcccagccttggca

SEQ ID NO: 2627535 - DNA, 22 bp, Homo sapiens
agccatctctctactcctacct

SEQ ID NO: 2627536 - DNA, 15 bp, Homo sapiens
agccatctgcccagg

SEQ ID NO: 2627537 - DNA, 19 bp, Homo sapiens
agccatctgcccaggggtg

SEQ ID NO: 2627538 - DNA, 18 bp, Homo sapiens
agccatgataactgcaat

SEQ ID NO: 2627539 - DNA, 12 bp, Homo sapiens
agccatgggacc

SEQ ID NO: 2627540 - DNA, 14 bp, Homo sapiens
agccattcactgcc

SEQ ID NO: 2627541 - DNA, 20 bp, Homo sapiens
agccattcctggtacccagc

SEQ ID NO: 2627542 - DNA, 18 bp, Homo sapiens
agccattgttggctttcc

SEQ ID NO: 2627543 - DNA, 15 bp, Homo sapiens
agccattttgtgaat

SEQ ID NO: 2627544 - DNA, 16 bp, Homo sapiens
agccattttgtgaatg

SEQ ID NO: 2627545 - DNA, 14 bp, Homo sapiens
agcccaaagaagga

SEQ ID NO: 2627546 - DNA, 16 bp, Homo sapiens
agcccaaagaaggaaa

SEQ ID NO: 2627547 - DNA, 23 bp, Homo sapiens
agcccaaagtggtatagaaatgc

SEQ ID NO: 2627548 - DNA, 23 bp, Homo sapiens
agcccaaggtttaaacttctctg

SEQ ID NO: 2627549 - DNA, 20 bp, Homo sapiens
agcccaatattataattttt

SEQ ID NO: 2627550 - DNA, 13 bp, Homo sapiens
agcccaccctcct

SEQ ID NO: 2627551 - DNA, 15 bp, Homo sapiens
agcccaccctcctgt

SEQ ID NO: 2627552 - DNA, 19 bp, Homo sapiens
agcccaccctcctgtcttc

SEQ ID NO: 2627553 - DNA, 18 bp, Homo sapiens
agcccacgcccccactgg

SEQ ID NO: 2627554 - DNA, 19 bp, Homo sapiens
agcccacgcccccactggt

SEQ ID NO: 2627555 - DNA, 22 bp, Homo sapiens
agcccacttctgccatattctg

SEQ ID NO: 2627556 - DNA, 18 bp, Homo sapiens
agcccagaggtaacagaa

SEQ ID NO: 2627557 - DNA, 20 bp, Homo sapiens
agcccagaggtaacagaaca

SEQ ID NO: 2627558 - DNA, 15 bp, Homo sapiens
agcccagcagggcct

SEQ ID NO: 2627559 - DNA, 20 bp, Homo sapiens
agcccagcagggcctcaaag

SEQ ID NO: 2627560 - DNA, 23 bp, Homo sapiens
agcccagccattaccatggagac

SEQ ID NO: 2627561 - DNA, 11 bp, Homo sapiens
agcccaggagt

SEQ ID NO: 2627562 - DNA, 19 bp, Homo sapiens
agcccaggagtttgaggct

SEQ ID NO: 2627563 - DNA, 20 bp, Homo sapiens
agcccagggagcggaaagca

SEQ ID NO: 2627564 - DNA, 10 bp, Homo sapiens
agcccagggt

SEQ ID NO: 2627565 - DNA, 18 bp, Homo sapiens
agcccagggttcccccag

SEQ ID NO: 2627566 - DNA, 11 bp, Homo sapiens
agcccatgccc

SEQ ID NO: 2627567 - DNA, 20 bp, Homo sapiens
agcccatgcccacctgccca

SEQ ID NO: 2627568 - DNA, 19 bp, Homo sapiens
agcccatggccctcccagt

SEQ ID NO: 2627569 - DNA, 22 bp, Homo sapiens
agcccattcattccattctgga

SEQ ID NO: 2627570 - DNA, 13 bp, Homo sapiens
agcccatttcaat

SEQ ID NO: 2627571 - DNA, 17 bp, Homo sapiens
agccccaaaactctcct

SEQ ID NO: 2627572 - DNA, 18 bp, Homo sapiens
agccccaaaactctcctc

SEQ ID NO: 2627573 - DNA, 15 bp, Homo sapiens
agccccaagtcctga

SEQ ID NO: 2627574 - DNA, 12 bp, Homo sapiens
agccccacccag

SEQ ID NO: 2627575 - DNA, 13 bp, Homo sapiens
agccccacccagg

SEQ ID NO: 2627576 - DNA, 14 bp, Homo sapiens
agccccagccccct

SEQ ID NO: 2627577 - DNA, 13 bp, Homo sapiens
agccccaggcagg

SEQ ID NO: 2627578 - DNA, 17 bp, Homo sapiens
agccccatcctctgtac

SEQ ID NO: 2627579 - DNA, 23 bp, Homo sapiens
agccccatcctctgtacagagcc

SEQ ID NO: 2627580 - DNA, 16 bp, Homo sapiens
agccccattctgcctg

SEQ ID NO: 2627581 - DNA, 22 bp, Homo sapiens
agccggcctctctggcctccca

SEQ ID NO: 2627582 - DNA, 13 bp, Homo sapiens
agccggcggccca

SEQ ID NO: 2627583 - DNA, 18 bp, Homo sapiens
agccggcggcccaagccc

SEQ ID NO: 2627584 - DNA, 13 bp, Homo sapiens
agccgggcctggg

SEQ ID NO: 2627585 - DNA, 22 bp, Homo sapiens
agccgggcgtggtggcgggcac

SEQ ID NO: 2627586 - DNA, 21 bp, Homo sapiens
agccgggtctgcctcttctgg

SEQ ID NO: 2627587 - DNA, 16 bp, Homo sapiens
agccgtcagccaaatg

SEQ ID NO: 2627588 - DNA, 17 bp, Homo sapiens
agccgtgatgctcaggc

SEQ ID NO: 2627589 - DNA, 20 bp, Homo sapiens
agccgtgatgctcaggcttg

SEQ ID NO: 2627590 - DNA, 16 bp, Homo sapiens
agccgtgccctgcccc

SEQ ID NO: 2627591 - DNA, 18 bp, Homo sapiens
agcctaagatgaagagga

SEQ ID NO: 2627592 - DNA, 16 bp, Homo sapiens
agcctacctgctctcc

SEQ ID NO: 2627593 - DNA, 20 bp, Homo sapiens
agcctaggggtcagggacca

SEQ ID NO: 2627594 - DNA, 23 bp, Homo sapiens
agcctaggggtcagggaccaagg

SEQ ID NO: 2627595 - DNA, 15 bp, Homo sapiens
agcctaggtgacaga

SEQ ID NO: 2627596 - DNA, 20 bp, Homo sapiens
agcctagttcatccaatcct

SEQ ID NO: 2627597 - DNA, 22 bp, Homo sapiens
agcctagttcatccaatcctca

SEQ ID NO: 2627598 - DNA, 18 bp, Homo sapiens
agcctcaacctcctgggc

SEQ ID NO: 2627599 - DNA, 18 bp, Homo sapiens
agcctcacagtccttacc

SEQ ID NO: 2627600 - DNA, 17 bp, Homo sapiens
agcctcacttgaatgtg

SEQ ID NO: 2627601 - DNA, 14 bp, Homo sapiens
agcctcagcatcct

SEQ ID NO: 2627602 - DNA, 21 bp, Homo sapiens
agcctcagcatcctggcaccc

SEQ ID NO: 2627603 - DNA, 14 bp, Homo sapiens
agcctcatccgagg

SEQ ID NO: 2627604 - DNA, 17 bp, Homo sapiens
agcctcatccgaggcag

SEQ ID NO: 2627605 - DNA, 19 bp, Homo sapiens
agcctcatccgaggcaggg

SEQ ID NO: 2627606 - DNA, 15 bp, Homo sapiens
agcctcatgtccact

SEQ ID NO: 2627607 - DNA, 13 bp, Homo sapiens
agcctccagcctc

SEQ ID NO: 2627608 - DNA, 17 bp, Homo sapiens
agcctccatttagttct

SEQ ID NO: 2627609 - DNA, 21 bp, Homo sapiens
agcctcccaaagtgctgggat

SEQ ID NO: 2627610 - DNA, 16 bp, Homo sapiens
agcctcccctgccagg

SEQ ID NO: 2627611 - DNA, 19 bp, Homo sapiens
agcctcccctgccagggca

SEQ ID NO: 2627612 - DNA, 20 bp, Homo sapiens
agcctcccctgccagggcag

SEQ ID NO: 2627613 - DNA, 22 bp, Homo sapiens
agcctccctctgacctgcaggc

SEQ ID NO: 2627614 - DNA, 18 bp, Homo sapiens
agcctccgtatttcagac

SEQ ID NO: 2627615 - DNA, 14 bp, Homo sapiens
agcctcctccagcc

SEQ ID NO: 2627616 - DNA, 11 bp, Homo sapiens
agcctcctctg

SEQ ID NO: 2627617 - DNA, 19 bp, Homo sapiens
agcctcctctgtctgccct

SEQ ID NO: 2627618 - DNA, 17 bp, Homo sapiens
agcctcctgacctgagg

SEQ ID NO: 2627619 - DNA, 18 bp, Homo sapiens
agcctcctgacctgaggc

SEQ ID NO: 2627620 - DNA, 11 bp, Homo sapiens
agcctcctgag

SEQ ID NO: 2627621 - DNA, 18 bp, Homo sapiens
agcctctcacctgtactc

SEQ ID NO: 2627622 - DNA, 14 bp, Homo sapiens
agcctctctcccag

SEQ ID NO: 2627623 - DNA, 16 bp, Homo sapiens
agcctctctcccagtc

SEQ ID NO: 2627624 - DNA, 23 bp, Homo sapiens
agcctctgaaaaccaatgttctc

SEQ ID NO: 2627625 - DNA, 13 bp, Homo sapiens
agcctctgctgcc

SEQ ID NO: 2627626 - DNA, 23 bp, Homo sapiens
agcctctggcattagaattattt

SEQ ID NO: 2627627 - DNA, 15 bp, Homo sapiens
agcctctggctagag

SEQ ID NO: 2627628 - DNA, 20 bp, Homo sapiens
agcctgaattttgttgctgt

SEQ ID NO: 2627629 - DNA, 20 bp, Homo sapiens
agcctgaccaacatggagaa

SEQ ID NO: 2627630 - DNA, 17 bp, Homo sapiens
agcctgagtctcctgtg

SEQ ID NO: 2627631 - DNA, 19 bp, Homo sapiens
agcctgcaaactcactgct

SEQ ID NO: 2627632 - DNA, 19 bp, Homo sapiens
agcctgcagggtggtgctg

SEQ ID NO: 2627633 - DNA, 23 bp, Homo sapiens
agcctgcagggtggtgctgggac

SEQ ID NO: 2627634 - DNA, 20 bp, Homo sapiens
agcctgcaggtgctgctgcg

SEQ ID NO: 2627635 - DNA, 13 bp, Homo sapiens
agcctgcctggag

SEQ ID NO: 2627636 - DNA, 20 bp, Homo sapiens
agcctgctggtcacagcctc

SEQ ID NO: 2627637 - DNA, 17 bp, Homo sapiens
agcctggccccatggtc

SEQ ID NO: 2627638 - DNA, 22 bp, Homo sapiens
agcctggctcccacaggcagct

SEQ ID NO: 2627639 - DNA, 14 bp, Homo sapiens
agcctggcttctgg

SEQ ID NO: 2627640 - DNA, 23 bp, Homo sapiens
agcctggcttctggagcccttgg

SEQ ID NO: 2627641 - DNA, 20 bp, Homo sapiens
agcctgggaggtcaaggctg

SEQ ID NO: 2627642 - DNA, 17 bp, Homo sapiens
agcctgggcaacagagc

SEQ ID NO: 2627643 - DNA, 17 bp, Homo sapiens
agcctgggcagccaggc

SEQ ID NO: 2627644 - DNA, 18 bp, Homo sapiens
agcctgggcagccaggct

SEQ ID NO: 2627645 - DNA, 21 bp, Homo sapiens
agcctgggcagccaggctgcc

SEQ ID NO: 2627646 - DNA, 15 bp, Homo sapiens
agcctgggcgacaga

SEQ ID NO: 2627647 - DNA, 12 bp, Homo sapiens
agcctgtgcctc

SEQ ID NO: 2627648 - DNA, 17 bp, Homo sapiens
agcctgtgcctctggga

SEQ ID NO: 2627649 - DNA, 14 bp, Homo sapiens
agcctgtggcatct

SEQ ID NO: 2627650 - DNA, 21 bp, Homo sapiens
agcctgtggcatctttgcctt

SEQ ID NO: 2627651 - DNA, 22 bp, Homo sapiens
agcctgttcccctcactggatg

SEQ ID NO: 2627652 - DNA, 20 bp, Homo sapiens
agcctgttttaagttctgga

SEQ ID NO: 2627653 - DNA, 20 bp, Homo sapiens
agccttagaagtcacacagt

SEQ ID NO: 2627654 - DNA, 15 bp, Homo sapiens
agccttatcaagtgt

SEQ ID NO: 2627655 - DNA, 19 bp, Homo sapiens
agccttatcaagtgtcttc

SEQ ID NO: 2627656 - DNA, 14 bp, Homo sapiens
agccttccaggggt

SEQ ID NO: 2627657 - DNA, 20 bp, Homo sapiens
agccttccccttgcccaggg

SEQ ID NO: 2627658 - DNA, 12 bp, Homo sapiens
agctccttggga

SEQ ID NO: 2627659 - DNA, 18 bp, Homo sapiens
agctcgtgtatcctgggg

SEQ ID NO: 2627660 - DNA, 20 bp, Homo sapiens
agctcgtgtatcctggggct

SEQ ID NO: 2627661 - DNA, 19 bp, Homo sapiens
agctctagacaaccctgca

SEQ ID NO: 2627662 - DNA, 13 bp, Homo sapiens
agctctcagccaa

SEQ ID NO: 2627663 - DNA, 13 bp, Homo sapiens
agctctccagctc

SEQ ID NO: 2627664 - DNA, 19 bp, Homo sapiens
agctctgaaaccagtgtta

SEQ ID NO: 2627665 - DNA, 16 bp, Homo sapiens
agctctgcagcccagg

SEQ ID NO: 2627666 - DNA, 12 bp, Homo sapiens
agctctgctcct

SEQ ID NO: 2627667 - DNA, 18 bp, Homo sapiens
agctctggctgaaccctg

SEQ ID NO: 2627668 - DNA, 19 bp, Homo sapiens
agctctggctgaaccctgt

SEQ ID NO: 2627669 - DNA, 20 bp, Homo sapiens
agctctggctgaaccctgtg

SEQ ID NO: 2627670 - DNA, 21 bp, Homo sapiens
agctctggctgaaccctgtgc

SEQ ID NO: 2627671 - DNA, 22 bp, Homo sapiens
agctctggctgaaccctgtgct

SEQ ID NO: 2627672 - DNA, 23 bp, Homo sapiens
agctctggctgaaccctgtgctg

SEQ ID NO: 2627673 - DNA, 12 bp, Homo sapiens
agctctggcttc

SEQ ID NO: 2627674 - DNA, 20 bp, Homo sapiens
agctctggcttccagaaaac

SEQ ID NO: 2627675 - DNA, 17 bp, Homo sapiens
agctctggtccatagag

SEQ ID NO: 2627676 - DNA, 17 bp, Homo sapiens
agctctggtgacaccag

SEQ ID NO: 2627677 - DNA, 23 bp, Homo sapiens
agctctggtgagtcttggcggca

SEQ ID NO: 2627678 - DNA, 16 bp, Homo sapiens
agctcttcaggcctcc

SEQ ID NO: 2627679 - DNA, 18 bp, Homo sapiens
agctcttcaggcctccct

SEQ ID NO: 2627680 - DNA, 15 bp, Homo sapiens
agctcttctccaggc

SEQ ID NO: 2627681 - DNA, 18 bp, Homo sapiens
agctcttctccaggctgt

SEQ ID NO: 2627682 - DNA, 19 bp, Homo sapiens
agctcttgcccttccctgt

SEQ ID NO: 2627683 - DNA, 21 bp, Homo sapiens
agctcttgcccttccctgtcc

SEQ ID NO: 2627684 - DNA, 15 bp, Homo sapiens
agctcttgctaatca

SEQ ID NO: 2627685 - DNA, 16 bp, Homo sapiens
agctcttggctccact

SEQ ID NO: 2627686 - DNA, 22 bp, Homo sapiens
agctctttggcagtctatatgt

SEQ ID NO: 2627687 - DNA, 22 bp, Homo sapiens
agctgaaaacctaagtccttta

SEQ ID NO: 2627688 - DNA, 15 bp, Homo sapiens
agctgaacctgggta

SEQ ID NO: 2627689 - DNA, 20 bp, Homo sapiens
agctgacacaaacctgcctg

SEQ ID NO: 2627690 - DNA, 12 bp, Homo sapiens
agctgacatgga

SEQ ID NO: 2627691 - DNA, 16 bp, Homo sapiens
agctgacccagcccct

SEQ ID NO: 2627692 - DNA, 17 bp, Homo sapiens
agctgacctctgttgtc

SEQ ID NO: 2627693 - DNA, 21 bp, Homo sapiens
agctgacctctgttgtcctcc

SEQ ID NO: 2627694 - DNA, 21 bp, Homo sapiens
agctgacttttctgtccgagc

SEQ ID NO: 2627695 - DNA, 17 bp, Homo sapiens
agctgaggcagcagtgt

SEQ ID NO: 2627696 - DNA, 22 bp, Homo sapiens
agctgaggggggccgtgcccag

SEQ ID NO: 2627697 - DNA, 18 bp, Homo sapiens
agctgaggtctcttgagg

SEQ ID NO: 2627698 - DNA, 20 bp, Homo sapiens
agctgatgaacttattctgt

SEQ ID NO: 2627699 - DNA, 22 bp, Homo sapiens
agctgatgaacttattctgtag

SEQ ID NO: 2627700 - DNA, 14 bp, Homo sapiens
agctgattttaaca

SEQ ID NO: 2627701 - DNA, 19 bp, Homo sapiens
agctgattttaacaataac

SEQ ID NO: 2627702 - DNA, 20 bp, Homo sapiens
agctgcacagggcagctggg

SEQ ID NO: 2627703 - DNA, 13 bp, Homo sapiens
agctgcaccctca

SEQ ID NO: 2627704 - DNA, 22 bp, Homo sapiens
agctgcaccctcaggcaggtgg

SEQ ID NO: 2627705 - DNA, 16 bp, Homo sapiens
agctgcacctgccagc

SEQ ID NO: 2627706 - DNA, 13 bp, Homo sapiens
agctgcagagcca

SEQ ID NO: 2627707 - DNA, 21 bp, Homo sapiens
agctgcatcctccaagaatct

SEQ ID NO: 2627708 - DNA, 14 bp, Homo sapiens
agctgcccctggct

SEQ ID NO: 2627709 - DNA, 17 bp, Homo sapiens
agctgccgaccagagcc

SEQ ID NO: 2627710 - DNA, 16 bp, Homo sapiens
agctgcctcttctgtg

SEQ ID NO: 2627711 - DNA, 14 bp, Homo sapiens
agctgcctgtagtt

SEQ ID NO: 2627712 - DNA, 15 bp, Homo sapiens
agctgcctgtagtta

SEQ ID NO: 2627713 - DNA, 19 bp, Homo sapiens
agctgcctgtagttaggaa

SEQ ID NO: 2627714 - DNA, 14 bp, Homo sapiens
agctgcctgtgcct

SEQ ID NO: 2627715 - DNA, 20 bp, Homo sapiens
agctgcctgttcagctccag

SEQ ID NO: 2627716 - DNA, 17 bp, Homo sapiens
agctgcggtccacccag

SEQ ID NO: 2627717 - DNA, 13 bp, Homo sapiens
agctgctacaaag

SEQ ID NO: 2627718 - DNA, 17 bp, Homo sapiens
agctgctccccagcagc

SEQ ID NO: 2627719 - DNA, 20 bp, Homo sapiens
agctgctccccagcagcgga

SEQ ID NO: 2627720 - DNA, 15 bp, Homo sapiens
agctgctctggaaaa

SEQ ID NO: 2627721 - DNA, 16 bp, Homo sapiens
agctgctctgtcttct

SEQ ID NO: 2627722 - DNA, 15 bp, Homo sapiens
agctgctgaaacaac

SEQ ID NO: 2627723 - DNA, 12 bp, Homo sapiens
agctgctgacag

SEQ ID NO: 2627724 - DNA, 14 bp, Homo sapiens
agctgctggcttgc

SEQ ID NO: 2627725 - DNA, 15 bp, Homo sapiens
agctgcttgtgtccc

SEQ ID NO: 2627726 - DNA, 23 bp, Homo sapiens
agctgcttttgtctatgggactc

SEQ ID NO: 2627727 - DNA, 17 bp, Homo sapiens
agctggagaaatatggt

SEQ ID NO: 2627728 - DNA, 15 bp, Homo sapiens
agctggagaagaccc

SEQ ID NO: 2627729 - DNA, 19 bp, Homo sapiens
agctggagcctggtgccct

SEQ ID NO: 2627730 - DNA, 13 bp, Homo sapiens
agctggaggacta

SEQ ID NO: 2627731 - DNA, 14 bp, Homo sapiens
agctggatgagaat

SEQ ID NO: 2627732 - DNA, 19 bp, Homo sapiens
agctggcaaaggtggctct

SEQ ID NO: 2627733 - DNA, 15 bp, Homo sapiens
agctggcattacagc

SEQ ID NO: 2627734 - DNA, 19 bp, Homo sapiens
agctggccccgccgcctgg

SEQ ID NO: 2627735 - DNA, 15 bp, Homo sapiens
agctggcccgtgaca

SEQ ID NO: 2627736 - DNA, 19 bp, Homo sapiens
agctggccgtgggcctggg

SEQ ID NO: 2627737 - DNA, 21 bp, Homo sapiens
agctggcgtcatgcaaagtca

SEQ ID NO: 2627738 - DNA, 16 bp, Homo sapiens
agctgggactacaggt

SEQ ID NO: 2627739 - DNA, 13 bp, Homo sapiens
agctgggaggcaa

SEQ ID NO: 2627740 - DNA, 16 bp, Homo sapiens
agctgggaggcaagag

SEQ ID NO: 2627741 - DNA, 17 bp, Homo sapiens
agctgggaggcaagagg

SEQ ID NO: 2627742 - DNA, 22 bp, Homo sapiens
aggcctacatgctttgtgaaca

SEQ ID NO: 2627743 - DNA, 16 bp, Homo sapiens
aggcctataaccccag

SEQ ID NO: 2627744 - DNA, 16 bp, Homo sapiens
aggcctataatgaagc

SEQ ID NO: 2627745 - DNA, 16 bp, Homo sapiens
aggcctcagtggactt

SEQ ID NO: 2627746 - DNA, 17 bp, Homo sapiens
aggcctccatctcatgt

SEQ ID NO: 2627747 - DNA, 22 bp, Homo sapiens
aggcctccctctctcttctgct

SEQ ID NO: 2627748 - DNA, 21 bp, Homo sapiens
aggcctctcattccagaggaa

SEQ ID NO: 2627749 - DNA, 13 bp, Homo sapiens
aggcctctgtgtc

SEQ ID NO: 2627750 - DNA, 18 bp, Homo sapiens
aggcctcttggacctctg

SEQ ID NO: 2627751 - DNA, 13 bp, Homo sapiens
aggcctgcctgtt

SEQ ID NO: 2627752 - DNA, 12 bp, Homo sapiens
aggcctggccag

SEQ ID NO: 2627753 - DNA, 22 bp, Homo sapiens
aggcctggccagatgcaccagc

SEQ ID NO: 2627754 - DNA, 13 bp, Homo sapiens
aggcctggccagg

SEQ ID NO: 2627755 - DNA, 12 bp, Homo sapiens
aggcctgggtgc

SEQ ID NO: 2627756 - DNA, 17 bp, Homo sapiens
aggcctgggtgctggct

SEQ ID NO: 2627757 - DNA, 19 bp, Homo sapiens
aggccttatctccaagacc

SEQ ID NO: 2627758 - DNA, 15 bp, Homo sapiens
aggccttgcgctgtt

SEQ ID NO: 2627759 - DNA, 21 bp, Homo sapiens
aggcctttagatattattcat

SEQ ID NO: 2627760 - DNA, 14 bp, Homo sapiens
aggcgagtgccagg

SEQ ID NO: 2627761 - DNA, 17 bp, Homo sapiens
aggcgagtgccaggact

SEQ ID NO: 2627762 - DNA, 22 bp, Homo sapiens
aggcgcactttcctcctggcag

SEQ ID NO: 2627763 - DNA, 21 bp, Homo sapiens
aggcgcagtgcttctctacag

SEQ ID NO: 2627764 - DNA, 14 bp, Homo sapiens
aggcgccggcgggc

SEQ ID NO: 2627765 - DNA, 20 bp, Homo sapiens
aggcggagagtacagtgagc

SEQ ID NO: 2627766 - DNA, 14 bp, Homo sapiens
aggcgggaaggagg

SEQ ID NO: 2627767 - DNA, 12 bp, Homo sapiens
aggcgggccagc

SEQ ID NO: 2627768 - DNA, 21 bp, Homo sapiens
aggcggtgggcacccaccctg

SEQ ID NO: 2627769 - DNA, 21 bp, Homo sapiens
aggcgtccgcgcgccagcaca

SEQ ID NO: 2627770 - DNA, 21 bp, Homo sapiens
aggcgtctgtatattttggga

SEQ ID NO: 2627771 - DNA, 18 bp, Homo sapiens
aggcgtggagctgcctga

SEQ ID NO: 2627772 - DNA, 21 bp, Homo sapiens
aggctaaagcccagagacagc

SEQ ID NO: 2627773 - DNA, 18 bp, Homo sapiens
aggctacaattttctccc

SEQ ID NO: 2627774 - DNA, 19 bp, Homo sapiens
aggctacaattttctccca

SEQ ID NO: 2627775 - DNA, 13 bp, Homo sapiens
aggctacctttgt

SEQ ID NO: 2627776 - DNA, 17 bp, Homo sapiens
aggctactgtcagctcc

SEQ ID NO: 2627777 - DNA, 15 bp, Homo sapiens
aggctagatcatgaa

SEQ ID NO: 2627778 - DNA, 23 bp, Homo sapiens
aggctagtgtggtgtttcctggc

SEQ ID NO: 2627779 - DNA, 23 bp, Homo sapiens
aggctatacttgtcttgttcacc

SEQ ID NO: 2627780 - DNA, 22 bp, Homo sapiens
aggctatggggatagatgtgtg

SEQ ID NO: 2627781 - DNA, 16 bp, Homo sapiens
aggctattattttcac

SEQ ID NO: 2627782 - DNA, 15 bp, Homo sapiens
aggctcaactaggga

SEQ ID NO: 2627783 - DNA, 16 bp, Homo sapiens
aggctcaactagggag

SEQ ID NO: 2627784 - DNA, 16 bp, Homo sapiens
aggctcacccccttct

SEQ ID NO: 2627785 - DNA, 13 bp, Homo sapiens
aggctcagagatg

SEQ ID NO: 2627786 - DNA, 21 bp, Homo sapiens
aggctcagagatgtgcaccca

SEQ ID NO: 2627787 - DNA, 23 bp, Homo sapiens
aggctcagtctcaggagcatggg

SEQ ID NO: 2627788 - DNA, 21 bp, Homo sapiens
aggctcatagggaagacctgc

SEQ ID NO: 2627789 - DNA, 15 bp, Homo sapiens
aggctccagagggca

SEQ ID NO: 2627790 - DNA, 16 bp, Homo sapiens
aggctccagagggcac

SEQ ID NO: 2627791 - DNA, 14 bp, Homo sapiens
aggctccaggagca

SEQ ID NO: 2627792 - DNA, 16 bp, Homo sapiens
aggctccaggagcagc

SEQ ID NO: 2627793 - DNA, 23 bp, Homo sapiens
aggctccaggagcagccacattc

SEQ ID NO: 2627794 - DNA, 21 bp, Homo sapiens
aggctcctgccagtgtggaac

SEQ ID NO: 2627795 - DNA, 19 bp, Homo sapiens
aggctcctttagcgcccag

SEQ ID NO: 2627796 - DNA, 19 bp, Homo sapiens
aggctcgagcatgcctgga

SEQ ID NO: 2627797 - DNA, 19 bp, Homo sapiens
aggctctgacccagtgaga

SEQ ID NO: 2627798 - DNA, 15 bp, Homo sapiens
aggctctgcacagat

SEQ ID NO: 2627799 - DNA, 11 bp, Homo sapiens
aggctctgccc

SEQ ID NO: 2627800 - DNA, 17 bp, Homo sapiens
aggctctgccctgccct

SEQ ID NO: 2627801 - DNA, 13 bp, Homo sapiens
aggctctgccctt

SEQ ID NO: 2627802 - DNA, 13 bp, Homo sapiens
aggctctgtgctg

SEQ ID NO: 2627803 - DNA, 18 bp, Homo sapiens
aggctctgtgctgaccct

SEQ ID NO: 2627804 - DNA, 18 bp, Homo sapiens
aggctctttctgggccaa

SEQ ID NO: 2627805 - DNA, 21 bp, Homo sapiens
aggctctttggggtcagccag

SEQ ID NO: 2627806 - DNA, 15 bp, Homo sapiens
aggctgaccaagaga

SEQ ID NO: 2627807 - DNA, 17 bp, Homo sapiens
aggctgaccaagagaga

SEQ ID NO: 2627808 - DNA, 18 bp, Homo sapiens
aggctgaccaagagagaa

SEQ ID NO: 2627809 - DNA, 19 bp, Homo sapiens
aggctgaccaagagagaaa

SEQ ID NO: 2627810 - DNA, 16 bp, Homo sapiens
aggctgagaacactgt

SEQ ID NO: 2627811 - DNA, 19 bp, Homo sapiens
aggctgagaacactgtgaa

SEQ ID NO: 2627812 - DNA, 13 bp, Homo sapiens
aggctgagacagg

SEQ ID NO: 2627813 - DNA, 15 bp, Homo sapiens
aggctgagacaggag

SEQ ID NO: 2627814 - DNA, 18 bp, Homo sapiens
aggctgagacaggagaat

SEQ ID NO: 2627815 - DNA, 17 bp, Homo sapiens
aggctgagactgcggga

SEQ ID NO: 2627816 - DNA, 14 bp, Homo sapiens
aggctgaggaaagg

SEQ ID NO: 2627817 - DNA, 18 bp, Homo sapiens
aggctgaggcaagagaat

SEQ ID NO: 2627818 - DNA, 22 bp, Homo sapiens
aggctgaggggaggatcactgg

SEQ ID NO: 2627819 - DNA, 17 bp, Homo sapiens
aggctgataattccagt

SEQ ID NO: 2627820 - DNA, 23 bp, Homo sapiens
aggctgatgccaagttgtttgag

SEQ ID NO: 2627821 - DNA, 20 bp, Homo sapiens
aggctgcagaaggccaagaa

SEQ ID NO: 2627822 - DNA, 15 bp, Homo sapiens
aggctgcagcgagct

SEQ ID NO: 2627823 - DNA, 12 bp, Homo sapiens
aggctgcccccg

SEQ ID NO: 2627824 - DNA, 20 bp, Homo sapiens
aggctgcccccggccccctg

SEQ ID NO: 2627825 - DNA, 22 bp, Homo sapiens
aggctgcccccggccccctggt

SEQ ID NO: 2627826 - DNA, 15 bp, Homo sapiens
aggctgctcagggct

SEQ ID NO: 2627827 - DNA, 19 bp, Homo sapiens
aggctgctggcgcctctgc

SEQ ID NO: 2627828 - DNA, 12 bp, Homo sapiens
aggctggagaag

SEQ ID NO: 2627829 - DNA, 13 bp, Homo sapiens
aggctggagaagc

SEQ ID NO: 2627830 - DNA, 20 bp, Homo sapiens
aggctggagaagctcaccca

SEQ ID NO: 2627831 - DNA, 18 bp, Homo sapiens
aggctggagcccagggag

SEQ ID NO: 2627832 - DNA, 14 bp, Homo sapiens
aggctggagctggc

SEQ ID NO: 2627833 - DNA, 17 bp, Homo sapiens
aggctggagctggcgtc

SEQ ID NO: 2627834 - DNA, 18 bp, Homo sapiens
aggctggagctggcgtct

SEQ ID NO: 2627835 - DNA, 20 bp, Homo sapiens
aggctggagtgcagtggcgt

SEQ ID NO: 2627836 - DNA, 19 bp, Homo sapiens
aggctggcaccgccttctc

SEQ ID NO: 2627837 - DNA, 18 bp, Homo sapiens
aggctggcagctctccag

SEQ ID NO: 2627838 - DNA, 20 bp, Homo sapiens
aggctggcagctctccagtc

SEQ ID NO: 2627839 - DNA, 15 bp, Homo sapiens
aggctggcaggtatg

SEQ ID NO: 2627840 - DNA, 14 bp, Homo sapiens
aggctggcgcagcc

SEQ ID NO: 2627841 - DNA, 20 bp, Homo sapiens
aggctggcgtgcagtggtgc

SEQ ID NO: 2627842 - DNA, 14 bp, Homo sapiens
aggctggcttgtcc

SEQ ID NO: 2627843 - DNA, 13 bp, Homo sapiens
aggctgggctccc

SEQ ID NO: 2627844 - DNA, 14 bp, Homo sapiens
aggctgggttctga

SEQ ID NO: 2627845 - DNA, 17 bp, Homo sapiens
aggctgggttctgatcc

SEQ ID NO: 2627846 - DNA, 20 bp, Homo sapiens
aggctggtgctgtggccagg

SEQ ID NO: 2627847 - DNA, 22 bp, Homo sapiens
aggctggtgctgtggccagggt

SEQ ID NO: 2627848 - DNA, 13 bp, Homo sapiens
aggctgtatccca

SEQ ID NO: 2627849 - DNA, 22 bp, Homo sapiens
aggctgtcttctcaggctctgc

SEQ ID NO: 2627850 - DNA, 23 bp, Homo sapiens
aggctgtcttctcaggctctgcc

SEQ ID NO: 2627851 - DNA, 18 bp, Homo sapiens
aggcttagtcactgagac

SEQ ID NO: 2627852 - DNA, 21 bp, Homo sapiens
aggcttagtcactgagacagc

SEQ ID NO: 2627853 - DNA, 23 bp, Homo sapiens
aggcttagtcactgagacagccc

SEQ ID NO: 2627854 - DNA, 12 bp, Homo sapiens
aggcttcaccct

SEQ ID NO: 2627855 - DNA, 19 bp, Homo sapiens
aggcttgctgagaggggct

SEQ ID NO: 2627856 - DNA, 22 bp, Homo sapiens
aggcttgggaccgccagatggg

SEQ ID NO: 2627857 - DNA, 17 bp, Homo sapiens
aggcttgtcagagctgg

SEQ ID NO: 2627858 - DNA, 15 bp, Homo sapiens
agggaaaacattcca

SEQ ID NO: 2627859 - DNA, 18 bp, Homo sapiens
agggaaaacattccatcc

SEQ ID NO: 2627860 - DNA, 14 bp, Homo sapiens
agggaaactgccag

SEQ ID NO: 2627861 - DNA, 21 bp, Homo sapiens
agggaaactgccagcaacgca

SEQ ID NO: 2627862 - DNA, 23 bp, Homo sapiens
agggaaagaaagttgcacggctg

SEQ ID NO: 2627863 - DNA, 22 bp, Homo sapiens
agggaaatagaaaaaccctgcc

SEQ ID NO: 2627864 - DNA, 15 bp, Homo sapiens
agggaaatatcattt

SEQ ID NO: 2627865 - DNA, 19 bp, Homo sapiens
agggaaccgttattataat

SEQ ID NO: 2627866 - DNA, 22 bp, Homo sapiens
agggaaccgttattataattgt

SEQ ID NO: 2627867 - DNA, 16 bp, Homo sapiens
agggaagcctgaaaaa

SEQ ID NO: 2627868 - DNA, 21 bp, Homo sapiens
agggaagctacaggttacaac

SEQ ID NO: 2627869 - DNA, 16 bp, Homo sapiens
agggaagctggccgag

SEQ ID NO: 2627870 - DNA, 23 bp, Homo sapiens
agggaaggaactctggcttccag

SEQ ID NO: 2627871 - DNA, 12 bp, Homo sapiens
agggaagggtgg

SEQ ID NO: 2627872 - DNA, 16 bp, Homo sapiens
agggaagtaacagtaa

SEQ ID NO: 2627873 - DNA, 22 bp, Homo sapiens
agggaagtaacagtaacgcagg

SEQ ID NO: 2627874 - DNA, 22 bp, Homo sapiens
agggaatgcctgagtgcctggc

SEQ ID NO: 2627875 - DNA, 18 bp, Homo sapiens
agggaattgaggtctgct

SEQ ID NO: 2627876 - DNA, 16 bp, Homo sapiens
agggaattgcagagta

SEQ ID NO: 2627877 - DNA, 14 bp, Homo sapiens
agggacaccagcca

SEQ ID NO: 2627878 - DNA, 13 bp, Homo sapiens
agggacagagggg

SEQ ID NO: 2627879 - DNA, 15 bp, Homo sapiens
agggacatattcatt

SEQ ID NO: 2627880 - DNA, 19 bp, Homo sapiens
agggaccaactgggcccaa

SEQ ID NO: 2627881 - DNA, 14 bp, Homo sapiens
agggaccaaggacc

SEQ ID NO: 2627882 - DNA, 21 bp, Homo sapiens
agggaccaaggcaaggcaggt

SEQ ID NO: 2627883 - DNA, 14 bp, Homo sapiens
agggaccagccaag

SEQ ID NO: 2627884 - DNA, 12 bp, Homo sapiens
agggacccctcc

SEQ ID NO: 2627885 - DNA, 14 bp, Homo sapiens
agggacccctcctc

SEQ ID NO: 2627886 - DNA, 23 bp, Homo sapiens
agggacccctgcccttgtcccac

SEQ ID NO: 2627887 - DNA, 22 bp, Homo sapiens
agggacgcctgggggtgccagg

SEQ ID NO: 2627888 - DNA, 21 bp, Homo sapiens
agggacgctacccgggaaggg

SEQ ID NO: 2627889 - DNA, 20 bp, Homo sapiens
agggactcatcatttccatt

SEQ ID NO: 2627890 - DNA, 23 bp, Homo sapiens
agggactgccagtccccctgccc

SEQ ID NO: 2627891 - DNA, 15 bp, Homo sapiens
agggactggaaccag

SEQ ID NO: 2627892 - DNA, 20 bp, Homo sapiens
agctgggaggcatggccctg

SEQ ID NO: 2627893 - DNA, 21 bp, Homo sapiens
agctgggaggcatggccctgg

SEQ ID NO: 2627894 - DNA, 22 bp, Homo sapiens
agctgggaggcatggccctggg

SEQ ID NO: 2627895 - DNA, 15 bp, Homo sapiens
agctgggccccagcc

SEQ ID NO: 2627896 - DNA, 17 bp, Homo sapiens
agctgggccccagccca

SEQ ID NO: 2627897 - DNA, 18 bp, Homo sapiens
agctgggccccagcccac

SEQ ID NO: 2627898 - DNA, 14 bp, Homo sapiens
agctgggctctgcc

SEQ ID NO: 2627899 - DNA, 15 bp, Homo sapiens
agctgggctctgcca

SEQ ID NO: 2627900 - DNA, 22 bp, Homo sapiens
agctgggctctgccaccctacc

SEQ ID NO: 2627901 - DNA, 15 bp, Homo sapiens
agctggggatgtctc

SEQ ID NO: 2627902 - DNA, 16 bp, Homo sapiens
agctgggggccatgag

SEQ ID NO: 2627903 - DNA, 20 bp, Homo sapiens
agctgggtaatcgatggggg

SEQ ID NO: 2627904 - DNA, 18 bp, Homo sapiens
agctgggtggcactgcca

SEQ ID NO: 2627905 - DNA, 19 bp, Homo sapiens
agctgggtggcactgccat

SEQ ID NO: 2627906 - DNA, 19 bp, Homo sapiens
agctggtgcattacagaga

SEQ ID NO: 2627907 - DNA, 21 bp, Homo sapiens
agctggtgcattacagagagg

SEQ ID NO: 2627908 - DNA, 15 bp, Homo sapiens
agctggttagaaatg

SEQ ID NO: 2627909 - DNA, 15 bp, Homo sapiens
agctggttggagagc

SEQ ID NO: 2627910 - DNA, 21 bp, Homo sapiens
agctggtttcctcattcctga

SEQ ID NO: 2627911 - DNA, 14 bp, Homo sapiens
agctgtaaaccaga

SEQ ID NO: 2627912 - DNA, 19 bp, Homo sapiens
agctgtaaggcatgaagga

SEQ ID NO: 2627913 - DNA, 23 bp, Homo sapiens
agctgtagtagccctttctgtgt

SEQ ID NO: 2627914 - DNA, 16 bp, Homo sapiens
agctgtattgaatcat

SEQ ID NO: 2627915 - DNA, 19 bp, Homo sapiens
agctgtattgaatcatgta

SEQ ID NO: 2627916 - DNA, 20 bp, Homo sapiens
agctgtcttgtccttgctgg

SEQ ID NO: 2627917 - DNA, 19 bp, Homo sapiens
agctgtgagacagtgggaa

SEQ ID NO: 2627918 - DNA, 21 bp, Homo sapiens
agctgtgagacagtgggaaat

SEQ ID NO: 2627919 - DNA, 17 bp, Homo sapiens
agctgtgctctggacag

SEQ ID NO: 2627920 - DNA, 14 bp, Homo sapiens
agctgttactgtct

SEQ ID NO: 2627921 - DNA, 16 bp, Homo sapiens
agctgttcacagccag

SEQ ID NO: 2627922 - DNA, 14 bp, Homo sapiens
agctgttcagctgg

SEQ ID NO: 2627923 - DNA, 20 bp, Homo sapiens
agctgttctgtcccttggag

SEQ ID NO: 2627924 - DNA, 22 bp, Homo sapiens
agctgttctgtcccttggagct

SEQ ID NO: 2627925 - DNA, 13 bp, Homo sapiens
agctgttgcctca

SEQ ID NO: 2627926 - DNA, 22 bp, Homo sapiens
agctgtttactagggatccctc

SEQ ID NO: 2627927 - DNA, 13 bp, Homo sapiens
agctgtttatgca

SEQ ID NO: 2627928 - DNA, 20 bp, Homo sapiens
agctgtttatggcctcagct

SEQ ID NO: 2627929 - DNA, 18 bp, Homo sapiens
agctgttttagttaaatt

SEQ ID NO: 2627930 - DNA, 20 bp, Homo sapiens
agctgttttagttaaatttc

SEQ ID NO: 2627931 - DNA, 19 bp, Homo sapiens
agcttacaagccagctgga

SEQ ID NO: 2627932 - DNA, 15 bp, Homo sapiens
agcttagactaaggc

SEQ ID NO: 2627933 - DNA, 19 bp, Homo sapiens
agcttcagccaggagctgg

SEQ ID NO: 2627934 - DNA, 13 bp, Homo sapiens
agcttcaggttat

SEQ ID NO: 2627935 - DNA, 17 bp, Homo sapiens
agcttcatataccagca

SEQ ID NO: 2627936 - DNA, 23 bp, Homo sapiens
agcttccattccaagcctgacca

SEQ ID NO: 2627937 - DNA, 14 bp, Homo sapiens
agcttcgcgtgaga

SEQ ID NO: 2627938 - DNA, 18 bp, Homo sapiens
agcttctaccatgaacag

SEQ ID NO: 2627939 - DNA, 17 bp, Homo sapiens
agcttctattagccagt

SEQ ID NO: 2627940 - DNA, 23 bp, Homo sapiens
agcttctattatagccacatccc

SEQ ID NO: 2627941 - DNA, 13 bp, Homo sapiens
agcttctctgtga

SEQ ID NO: 2627942 - DNA, 18 bp, Homo sapiens
agcttctgaggcgctgct

SEQ ID NO: 2627943 - DNA, 16 bp, Homo sapiens
agcttctggtactctc

SEQ ID NO: 2627944 - DNA, 16 bp, Homo sapiens
agcttgaaagttttca

SEQ ID NO: 2627945 - DNA, 22 bp, Homo sapiens
agcttgaagatcgttagtatct

SEQ ID NO: 2627946 - DNA, 15 bp, Homo sapiens
agcttgagcctgaaa

SEQ ID NO: 2627947 - DNA, 19 bp, Homo sapiens
agggacttggaagctccgc

SEQ ID NO: 2627948 - DNA, 20 bp, Homo sapiens
agggacttggaagctccgct

SEQ ID NO: 2627949 - DNA, 16 bp, Homo sapiens
agggagaaggatctag

SEQ ID NO: 2627950 - DNA, 14 bp, Homo sapiens
agggagagaagata

SEQ ID NO: 2627951 - DNA, 23 bp, Homo sapiens
agggagagacctcatcaggatga

SEQ ID NO: 2627952 - DNA, 21 bp, Homo sapiens
agggagcaagtccttcccttt

SEQ ID NO: 2627953 - DNA, 13 bp, Homo sapiens
agggagcactggg

SEQ ID NO: 2627954 - DNA, 13 bp, Homo sapiens
agggagctgggac

SEQ ID NO: 2627955 - DNA, 15 bp, Homo sapiens
agggagggcttctgc

SEQ ID NO: 2627956 - DNA, 20 bp, Homo sapiens
agggaggtgtttaaagagag

SEQ ID NO: 2627957 - DNA, 14 bp, Homo sapiens
agggagtcccctcc

SEQ ID NO: 2627958 - DNA, 19 bp, Homo sapiens
agggagtgacagaggcagc

SEQ ID NO: 2627959 - DNA, 15 bp, Homo sapiens
agggataaggtacct

SEQ ID NO: 2627960 - DNA, 20 bp, Homo sapiens
aggggttttaggtctcttcc

SEQ ID NO: 2627961 - DNA, 21 bp, Homo sapiens
aggtgggcttcccagtggctg

SEQ ID NO: 2627962 - DNA, 14 bp, Homo sapiens
aggtggggcagctt

SEQ ID NO: 2627963 - DNA, 16 bp, Homo sapiens
aggtggggcagcttga

SEQ ID NO: 2627964 - DNA, 23 bp, Homo sapiens
aggtggggcagcttgagggttgg

SEQ ID NO: 2627965 - DNA, 21 bp, Homo sapiens
aggtggggcgggaaagccagt

SEQ ID NO: 2627966 - DNA, 18 bp, Homo sapiens
agtggatctccaaggacc

SEQ ID NO: 2627967 - DNA, 13 bp, Homo sapiens
agtggatgatgtt

SEQ ID NO: 2627968 - DNA, 15 bp, Homo sapiens
agtggatgatgtttc

SEQ ID NO: 2627969 - DNA, 14 bp, Homo sapiens
agtggattgcattt

SEQ ID NO: 2627970 - DNA, 20 bp, Homo sapiens
agtggcctcaaccctccctc

SEQ ID NO: 2627971 - DNA, 21 bp, Homo sapiens
agtggcctcaaccctccctca

SEQ ID NO: 2627972 - DNA, 14 bp, Homo sapiens
agtggcctctttgt

SEQ ID NO: 2627973 - DNA, 15 bp, Homo sapiens
agtggcctctttgtc

SEQ ID NO: 2627974 - DNA, 19 bp, Homo sapiens
agtggcctggccaggagct

SEQ ID NO: 2627975 - DNA, 22 bp, Homo sapiens
agtggcctggccaggagctctt

SEQ ID NO: 2627976 - DNA, 16 bp, Homo sapiens
agtggctgtcatcagc

SEQ ID NO: 2627977 - DNA, 23 bp, Homo sapiens
agtggcttaaaacaacactcaca

SEQ ID NO: 2627978 - DNA, 15 bp, Homo sapiens
agtgggacagagtct

SEQ ID NO: 2627979 - DNA, 14 bp, Homo sapiens
agtgggagctgcct

SEQ ID NO: 2627980 - DNA, 16 bp, Homo sapiens
agtgggaggggcaggc

SEQ ID NO: 2627981 - DNA, 18 bp, Homo sapiens
agtgggaggggcaggctg

SEQ ID NO: 2627982 - DNA, 20 bp, Homo sapiens
agtgggatctgtcacaccag

SEQ ID NO: 2627983 - DNA, 22 bp, Homo sapiens
agtgggcccaatgcactttgtt

SEQ ID NO: 2627984 - DNA, 15 bp, Homo sapiens
agtggggctcgccat

SEQ ID NO: 2627985 - DNA, 18 bp, Homo sapiens
agtggggctcgccatgcc

SEQ ID NO: 2627986 - DNA, 19 bp, Homo sapiens
agtgggggagagcaggctg

SEQ ID NO: 2627987 - DNA, 21 bp, Homo sapiens
agtgggggagagcaggctggc

SEQ ID NO: 2627988 - DNA, 19 bp, Homo sapiens
agtggggttgcaaccactg

SEQ ID NO: 2627989 - DNA, 22 bp, Homo sapiens
agtggggttgcaaccactgcaa

SEQ ID NO: 2627990 - DNA, 19 bp, Homo sapiens
agtgggtgaataatacagt

SEQ ID NO: 2627991 - DNA, 18 bp, Homo sapiens
agtgggttattctggagt

SEQ ID NO: 2627992 - DNA, 16 bp, Homo sapiens
agtggtaagctctggc

SEQ ID NO: 2627993 - DNA, 16 bp, Homo sapiens
agtggtatagaaatgc

SEQ ID NO: 2627994 - DNA, 18 bp, Homo sapiens
agtggtatagaaatgctg

SEQ ID NO: 2627995 - DNA, 18 bp, Homo sapiens
agtggtccatggaatgct

SEQ ID NO: 2627996 - DNA, 19 bp, Homo sapiens
agtggtccatggaatgctt

SEQ ID NO: 2627997 - DNA, 22 bp, Homo sapiens
agtggtcgcttactttgagtga

SEQ ID NO: 2627998 - DNA, 15 bp, Homo sapiens
agtggtctttctgga

SEQ ID NO: 2627999 - DNA, 16 bp, Homo sapiens
agtggtctttctggag

SEQ ID NO: 2628000 - DNA, 13 bp, Homo sapiens
agtggtctttgta

SEQ ID NO: 2628001 - DNA, 16 bp, Homo sapiens
agtggtctttgtaaga

SEQ ID NO: 2628002 - DNA, 19 bp, Homo sapiens
agtggtctttgtaagagtg

SEQ ID NO: 2628003 - DNA, 13 bp, Homo sapiens
agtttctgttctg

SEQ ID NO: 2628004 - DNA, 18 bp, Homo sapiens
agtttctgttctgtggaa

SEQ ID NO: 2628005 - DNA, 23 bp, Homo sapiens
agtttctgttctgtggaaagtgt

SEQ ID NO: 2628006 - DNA, 18 bp, Homo sapiens
agtttgaaggaaacagtt

SEQ ID NO: 2628007 - DNA, 20 bp, Homo sapiens
agtttgagatcagcctgggc

SEQ ID NO: 2628008 - DNA, 14 bp, Homo sapiens
agtttgaggctgca

SEQ ID NO: 2628009 - DNA, 16 bp, Homo sapiens
agtttgattaaattct

SEQ ID NO: 2628010 - DNA, 23 bp, Homo sapiens
agtttgattaaattcttgcaaag

SEQ ID NO: 2628011 - DNA, 17 bp, Homo sapiens
agtttgattattcagtg

SEQ ID NO: 2628012 - DNA, 20 bp, Homo sapiens
agtttgcactgtatgctgga

SEQ ID NO: 2628013 - DNA, 14 bp, Homo sapiens
agtttgctattaga

SEQ ID NO: 2628014 - DNA, 11 bp, Homo sapiens
agtttgctgta

SEQ ID NO: 2628015 - DNA, 20 bp, Homo sapiens
agtttgggggttttgctgtt

SEQ ID NO: 2628016 - DNA, 15 bp, Homo sapiens
agtttgtacatgcat

SEQ ID NO: 2628017 - DNA, 15 bp, Homo sapiens
agtttgtgtgtctta

SEQ ID NO: 2628018 - DNA, 16 bp, Homo sapiens
agtttgtgtgtcttaa

SEQ ID NO: 2628019 - DNA, 22 bp, Homo sapiens
agtttgtgtgtcttaattatta

SEQ ID NO: 2628020 - DNA, 16 bp, Homo sapiens
agtttgtgtgttgtct

SEQ ID NO: 2628021 - DNA, 16 bp, Homo sapiens
agttttaccagatgat

SEQ ID NO: 2628022 - DNA, 19 bp, Homo sapiens
agttttacttttaaactgt

SEQ ID NO: 2628023 - DNA, 21 bp, Homo sapiens
agttttagttgcagaaacatt

SEQ ID NO: 2628024 - DNA, 20 bp, Homo sapiens
agttttatcattttcaaaat

SEQ ID NO: 2628025 - DNA, 16 bp, Homo sapiens
agttttattgagaatt

SEQ ID NO: 2628026 - DNA, 21 bp, Homo sapiens
agttttattgagaattttaaa

SEQ ID NO: 2628027 - DNA, 22 bp, Homo sapiens
agttttccttctcatctgtgat

SEQ ID NO: 2628028 - DNA, 17 bp, Homo sapiens
agttttctcctcccagg

SEQ ID NO: 2628029 - DNA, 19 bp, Homo sapiens
agttttctgagaaagacta

SEQ ID NO: 2628030 - DNA, 18 bp, Homo sapiens
agttttctggctggagcc

SEQ ID NO: 2628031 - DNA, 14 bp, Homo sapiens
agttttcttctgtg

SEQ ID NO: 2628032 - DNA, 19 bp, Homo sapiens
agttttgccagaacagttt

SEQ ID NO: 2628033 - DNA, 21 bp, Homo sapiens
agttttggttgctttaatatc

SEQ ID NO: 2628034 - DNA, 14 bp, Homo sapiens
agttttgtcttgaa

SEQ ID NO: 2628035 - DNA, 15 bp, Homo sapiens
agtttttattgcttg

SEQ ID NO: 2628036 - DNA, 22 bp, Homo sapiens
agtttttcagagtggaatgctt

SEQ ID NO: 2628037 - DNA, 12 bp, Homo sapiens
agtttttctgtc

SEQ ID NO: 2628038 - DNA, 16 bp, Homo sapiens
agtttttgtaatttat

SEQ ID NO: 2628039 - DNA, 12 bp, Homo sapiens
agtttttgtact

SEQ ID NO: 2628040 - DNA, 18 bp, Homo sapiens
agtttttgtactgtaaag

SEQ ID NO: 2628041 - DNA, 12 bp, Homo sapiens
ataaaaacaaat

SEQ ID NO: 2628042 - DNA, 17 bp, Homo sapiens
ataaaaaccaagaagat

SEQ ID NO: 2628043 - DNA, 14 bp, Homo sapiens
ataaaaagatcact

SEQ ID NO: 2628044 - DNA, 18 bp, Homo sapiens
ataaaaagatcactttct

SEQ ID NO: 2628045 - DNA, 17 bp, Homo sapiens
ataaaaagtgacacagc

SEQ ID NO: 2628046 - DNA, 20 bp, Homo sapiens
ataaaaagtgacacagcagc

SEQ ID NO: 2628047 - DNA, 10 bp, Homo sapiens
ataaaaagtt

SEQ ID NO: 2628048 - DNA, 11 bp, Homo sapiens
ataaaaagtta

SEQ ID NO: 2628049 - DNA, 13 bp, Homo sapiens
ataaaaataaatt

SEQ ID NO: 2628050 - DNA, 12 bp, Homo sapiens
ataaaaatgttt

SEQ ID NO: 2628051 - DNA, 14 bp, Homo sapiens
ataaaaattctgaa

SEQ ID NO: 2628052 - DNA, 14 bp, Homo sapiens
ataaaacctttcaa

SEQ ID NO: 2628053 - DNA, 17 bp, Homo sapiens
ataaaactttgctgcca

SEQ ID NO: 2628054 - DNA, 17 bp, Homo sapiens
ataaaactttttaaaat

SEQ ID NO: 2628055 - DNA, 15 bp, Homo sapiens
ataaaagtacatgtt

SEQ ID NO: 2628056 - DNA, 20 bp, Homo sapiens
ataaaatagcaatcctaaag

SEQ ID NO: 2628057 - DNA, 19 bp, Homo sapiens
ataaaatattttcatacag

SEQ ID NO: 2628058 - DNA, 18 bp, Homo sapiens
ataaaatgaggacatgtt

SEQ ID NO: 2628059 - DNA, 20 bp, Homo sapiens
ataaaatgtgatttttctga

SEQ ID NO: 2628060 - DNA, 16 bp, Homo sapiens
ataaaattaaagctga

SEQ ID NO: 2628061 - DNA, 21 bp, Homo sapiens
ataaaattatagatgggaatg

SEQ ID NO: 2628062 - DNA, 17 bp, Homo sapiens
atacctcttagctgagt

SEQ ID NO: 2628063 - DNA, 12 bp, Homo sapiens
atacctgtcccc

SEQ ID NO: 2628064 - DNA, 13 bp, Homo sapiens
atacgataaataa

SEQ ID NO: 2628065 - DNA, 17 bp, Homo sapiens
atacgcactacatgtgg

SEQ ID NO: 2628066 - DNA, 13 bp, Homo sapiens
atacgtacacatt

SEQ ID NO: 2628067 - DNA, 15 bp, Homo sapiens
atacgtacacatttt

SEQ ID NO: 2628068 - DNA, 21 bp, Homo sapiens
atacgtgaaaattatttgaaa

SEQ ID NO: 2628069 - DNA, 21 bp, Homo sapiens
atactaaaagttcttctccaa

SEQ ID NO: 2628070 - DNA, 21 bp, Homo sapiens
atactaaccagcagaaatgcc

SEQ ID NO: 2628071 - DNA, 13 bp, Homo sapiens
atactacagtttg

SEQ ID NO: 2628072 - DNA, 14 bp, Homo sapiens
atactatatttatg

SEQ ID NO: 2628073 - DNA, 15 bp, Homo sapiens
atactatattttagg

SEQ ID NO: 2628074 - DNA, 21 bp, Homo sapiens
atactatttaaagcctcctca

SEQ ID NO: 2628075 - DNA, 18 bp, Homo sapiens
atactatttttactgcca

SEQ ID NO: 2628076 - DNA, 18 bp, Homo sapiens
atactcataatgtgaagt

SEQ ID NO: 2628077 - DNA, 11 bp, Homo sapiens
atactcatgtg

SEQ ID NO: 2628078 - DNA, 12 bp, Homo sapiens
atactcatgtgt

SEQ ID NO: 2628079 - DNA, 14 bp, Homo sapiens
atactcccatctgt

SEQ ID NO: 2628080 - DNA, 17 bp, Homo sapiens
atactcctccaaggtta

SEQ ID NO: 2628081 - DNA, 12 bp, Homo sapiens
atactctgtcag

SEQ ID NO: 2628082 - DNA, 16 bp, Homo sapiens
atactctgtcagatgg

SEQ ID NO: 2628083 - DNA, 15 bp, Homo sapiens
atactgcatactttt

SEQ ID NO: 2628084 - DNA, 14 bp, Homo sapiens
atactggaagtttt

SEQ ID NO: 2628085 - DNA, 16 bp, Homo sapiens
atactggaagttttgc

SEQ ID NO: 2628086 - DNA, 17 bp, Homo sapiens
atactggaagttttgca

SEQ ID NO: 2628087 - DNA, 14 bp, Homo sapiens
atactggcctggac

SEQ ID NO: 2628088 - DNA, 15 bp, Homo sapiens
atactggcctggact

SEQ ID NO: 2628089 - DNA, 18 bp, Homo sapiens
atactgtaaagaaagaga

SEQ ID NO: 2628090 - DNA, 19 bp, Homo sapiens
atactgtaaagaaagagag

SEQ ID NO: 2628091 - DNA, 23 bp, Homo sapiens
atactgtaaagaaagagagaaaa

SEQ ID NO: 2628092 - DNA, 16 bp, Homo sapiens
atactgtattaagagt

SEQ ID NO: 2628093 - DNA, 20 bp, Homo sapiens
atactgtattaagagtgaaa

SEQ ID NO: 2628094 - DNA, 17 bp, Homo sapiens
atactgtgctggagcca

SEQ ID NO: 2628095 - DNA, 20 bp, Homo sapiens
atacttatctctctgtgctg

SEQ ID NO: 2628096 - DNA, 14 bp, Homo sapiens
atacttcaaaagta

SEQ ID NO: 2628097 - DNA, 13 bp, Homo sapiens
atacttgagactg

SEQ ID NO: 2628098 - DNA, 23 bp, Homo sapiens
atactttaaaggaaaaaatgttg

SEQ ID NO: 2628099 - DNA, 12 bp, Homo sapiens
atactttacatg

SEQ ID NO: 2628100 - DNA, 16 bp, Homo sapiens
atacttttgccctttg

SEQ ID NO: 2628101 - DNA, 14 bp, Homo sapiens
atactttttttcac

SEQ ID NO: 2628102 - DNA, 21 bp, Homo sapiens
atagaaactcaccatgtaaaa

SEQ ID NO: 2628103 - DNA, 22 bp, Homo sapiens
atagaaagccaaatcaaaatat

SEQ ID NO: 2628104 - DNA, 20 bp, Homo sapiens
atagaaataaatagctatat

SEQ ID NO: 2628105 - DNA, 22 bp, Homo sapiens
atagaaatgctggtttttcagt

SEQ ID NO: 2628106 - DNA, 16 bp, Homo sapiens
atagaaatttccagag

SEQ ID NO: 2628107 - DNA, 16 bp, Homo sapiens
atagaagctgtagtag

SEQ ID NO: 2628108 - DNA, 19 bp, Homo sapiens
atagaaggatgtacatttc

SEQ ID NO: 2628109 - DNA, 13 bp, Homo sapiens
atagaatatttat

SEQ ID NO: 2628110 - DNA, 14 bp, Homo sapiens
atagagagagacca

SEQ ID NO: 2628111 - DNA, 14 bp, Homo sapiens
atagagatcatcct

SEQ ID NO: 2628112 - DNA, 15 bp, Homo sapiens
atagagcctgaggga

SEQ ID NO: 2628113 - DNA, 13 bp, Homo sapiens
atagagctgtatt

SEQ ID NO: 2628114 - DNA, 15 bp, Homo sapiens
atagagtatatgcac

SEQ ID NO: 2628115 - DNA, 16 bp, Homo sapiens
atagagtttaacacaa

SEQ ID NO: 2628116 - DNA, 15 bp, Homo sapiens
atagagtttgctatt

SEQ ID NO: 2628117 - DNA, 15 bp, Homo sapiens
atagatgggaatgaa

SEQ ID NO: 2628118 - DNA, 19 bp, Homo sapiens
atagatgggaatgaagctt

SEQ ID NO: 2628119 - DNA, 13 bp, Homo sapiens
atagatgggtctg

SEQ ID NO: 2628120 - DNA, 23 bp, Homo sapiens
atagatgggtctggctgagctga

SEQ ID NO: 2628121 - DNA, 22 bp, Homo sapiens
atagatgtagataaactcagaa

SEQ ID NO: 2628122 - DNA, 19 bp, Homo sapiens
atagatgtccctttcttgg

SEQ ID NO: 2628123 - DNA, 15 bp, Homo sapiens
atagattataacttg

SEQ ID NO: 2628124 - DNA, 19 bp, Homo sapiens
atagcaagacacatcccta

SEQ ID NO: 2628125 - DNA, 16 bp, Homo sapiens
atagcagacagtgttt

SEQ ID NO: 2628126 - DNA, 15 bp, Homo sapiens
atagcagcttattca

SEQ ID NO: 2628127 - DNA, 18 bp, Homo sapiens
atagcagcttattcacaa

SEQ ID NO: 2628128 - DNA, 21 bp, Homo sapiens
atagcattaactaatctattg

SEQ ID NO: 2628129 - DNA, 18 bp, Homo sapiens
atagcatttttgatttat

SEQ ID NO: 2628130 - DNA, 17 bp, Homo sapiens
atagcccagacacagaa

SEQ ID NO: 2628131 - DNA, 14 bp, Homo sapiens
atagcccagatcag

SEQ ID NO: 2628132 - DNA, 12 bp, Homo sapiens
atagcctatatt

SEQ ID NO: 2628133 - DNA, 15 bp, Homo sapiens
atagctaacatttta

SEQ ID NO: 2628134 - DNA, 15 bp, Homo sapiens
atagctacaggaagc

SEQ ID NO: 2628135 - DNA, 19 bp, Homo sapiens
atagctatatccatgtact

SEQ ID NO: 2628136 - DNA, 20 bp, Homo sapiens
atagctatatccatgtactg

SEQ ID NO: 2628137 - DNA, 18 bp, Homo sapiens
atagctattactgtctgg

SEQ ID NO: 2628138 - DNA, 19 bp, Homo sapiens
atagctcaggtgtccctgc

SEQ ID NO: 2628139 - DNA, 21 bp, Homo sapiens
atagctcaggtgtccctgcac

SEQ ID NO: 2628140 - DNA, 23 bp, Homo sapiens
atctggagagctagaacctggag

SEQ ID NO: 2628141 - DNA, 16 bp, Homo sapiens
atctgggaagatttct

SEQ ID NO: 2628142 - DNA, 15 bp, Homo sapiens
atctgggggagtgga

SEQ ID NO: 2628143 - DNA, 17 bp, Homo sapiens
atctgggggagtggaat

SEQ ID NO: 2628144 - DNA, 14 bp, Homo sapiens
atctgggtagctgt

SEQ ID NO: 2628145 - DNA, 22 bp, Homo sapiens
atctgggtgcatgatcttgagc

SEQ ID NO: 2628146 - DNA, 17 bp, Homo sapiens
atctgggttcactgcaa

SEQ ID NO: 2628147 - DNA, 17 bp, Homo sapiens
atctggtagatttttaa

SEQ ID NO: 2628148 - DNA, 20 bp, Homo sapiens
atctggtagggggaaaatgt

SEQ ID NO: 2628149 - DNA, 22 bp, Homo sapiens
atctggtttgactccgctggag

SEQ ID NO: 2628150 - DNA, 14 bp, Homo sapiens
atctgtagggctgg

SEQ ID NO: 2628151 - DNA, 15 bp, Homo sapiens
atctgtagggctgga

SEQ ID NO: 2628152 - DNA, 22 bp, Homo sapiens
atctgtatataaaatattttca

SEQ ID NO: 2628153 - DNA, 14 bp, Homo sapiens
atctgtatatacaa

SEQ ID NO: 2628154 - DNA, 21 bp, Homo sapiens
atctgtatatacaataacata

SEQ ID NO: 2628155 - DNA, 13 bp, Homo sapiens
atctgtatctctc

SEQ ID NO: 2628156 - DNA, 17 bp, Homo sapiens
atctgtatttaattttg

SEQ ID NO: 2628157 - DNA, 17 bp, Homo sapiens
atctgtcatttgagcag

SEQ ID NO: 2628158 - DNA, 19 bp, Homo sapiens
atctgtccaaaggaggctg

SEQ ID NO: 2628159 - DNA, 23 bp, Homo sapiens
atctgtccaaaggaggctggcag

SEQ ID NO: 2628160 - DNA, 13 bp, Homo sapiens
atctgtccaagga

SEQ ID NO: 2628161 - DNA, 18 bp, Homo sapiens
atctgtgaaaggaaagag

SEQ ID NO: 2628162 - DNA, 11 bp, Homo sapiens
atctgtgaata

SEQ ID NO: 2628163 - DNA, 21 bp, Homo sapiens
atctgtgaggggctctctcat

SEQ ID NO: 2628164 - DNA, 17 bp, Homo sapiens
atctgtgataattttct

SEQ ID NO: 2628165 - DNA, 23 bp, Homo sapiens
atctgtgccccatgcctgtccag

SEQ ID NO: 2628166 - DNA, 18 bp, Homo sapiens
atctgtgctttccagctc

SEQ ID NO: 2628167 - DNA, 19 bp, Homo sapiens
atctgtgggcatggtcaaa

SEQ ID NO: 2628168 - DNA, 15 bp, Homo sapiens
atctgtgtgaaaatg

SEQ ID NO: 2628169 - DNA, 21 bp, Homo sapiens
atctgtgtttttgaaatatta

SEQ ID NO: 2628170 - DNA, 19 bp, Homo sapiens
atctgttctttaatttatt

SEQ ID NO: 2628171 - DNA, 13 bp, Homo sapiens
atctgttgcaaac

SEQ ID NO: 2628172 - DNA, 13 bp, Homo sapiens
atctgtttcccag

SEQ ID NO: 2628173 - DNA, 20 bp, Homo sapiens
atctgtttttaaaaatcata

SEQ ID NO: 2628174 - DNA, 19 bp, Homo sapiens
atcttaaagtgtgtttcta

SEQ ID NO: 2628175 - DNA, 12 bp, Homo sapiens
atcttaattttg

SEQ ID NO: 2628176 - DNA, 22 bp, Homo sapiens
atcttaattttggttgtattct

SEQ ID NO: 2628177 - DNA, 15 bp, Homo sapiens
atcttactgaaggta

SEQ ID NO: 2628178 - DNA, 13 bp, Homo sapiens
atcttattcacat

SEQ ID NO: 2628179 - DNA, 15 bp, Homo sapiens
atcttcaaagcttga

SEQ ID NO: 2628180 - DNA, 19 bp, Homo sapiens
atcttcaaagcttgaagat

SEQ ID NO: 2628181 - DNA, 14 bp, Homo sapiens
atcttcagagcagg

SEQ ID NO: 2628182 - DNA, 18 bp, Homo sapiens
atcttcagagcaggggtc

SEQ ID NO: 2628183 - DNA, 15 bp, Homo sapiens
atcttctcagctccc

SEQ ID NO: 2628184 - DNA, 22 bp, Homo sapiens
atcttctcagctcccatttcta

SEQ ID NO: 2628185 - DNA, 18 bp, Homo sapiens
atcttctgccttctcatg

SEQ ID NO: 2628186 - DNA, 20 bp, Homo sapiens
atcttctggagtctccagtg

SEQ ID NO: 2628187 - DNA, 17 bp, Homo sapiens
atcttcttatgcaattt

SEQ ID NO: 2628188 - DNA, 22 bp, Homo sapiens
atcttgagcaagttccttctgg

SEQ ID NO: 2628189 - DNA, 13 bp, Homo sapiens
atcttgctctgct

SEQ ID NO: 2628190 - DNA, 16 bp, Homo sapiens
atcttgctctgctgac

SEQ ID NO: 2628191 - DNA, 19 bp, Homo sapiens
atcttgctctgctgacaga

SEQ ID NO: 2628192 - DNA, 15 bp, Homo sapiens
atcttggctcactgc

SEQ ID NO: 2628193 - DNA, 18 bp, Homo sapiens
atcttgggactgggtttg

SEQ ID NO: 2628194 - DNA, 12 bp, Homo sapiens
atcttggtaaat

SEQ ID NO: 2628195 - DNA, 15 bp, Homo sapiens
atcttgtttttccac

SEQ ID NO: 2628196 - DNA, 23 bp, Homo sapiens
atcttgtttttccactactgcta

SEQ ID NO: 2628197 - DNA, 22 bp, Homo sapiens
atctttcacacttccaccagcc

SEQ ID NO: 2628198 - DNA, 16 bp, Homo sapiens
atctttcgcacagcag

SEQ ID NO: 2628199 - DNA, 23 bp, Homo sapiens
atctttcgcacagcagttccgga

SEQ ID NO: 2628200 - DNA, 16 bp, Homo sapiens
atctttctattccaaa

SEQ ID NO: 2628201 - DNA, 14 bp, Homo sapiens
atctttctttacct

SEQ ID NO: 2628202 - DNA, 18 bp, Homo sapiens
atctttctttacctgaga

SEQ ID NO: 2628203 - DNA, 22 bp, Homo sapiens
atctttctttacctgagaccag

SEQ ID NO: 2628204 - DNA, 15 bp, Homo sapiens
atctttgccaccctc

SEQ ID NO: 2628205 - DNA, 16 bp, Homo sapiens
atctttgccaccctca

SEQ ID NO: 2628206 - DNA, 22 bp, Homo sapiens
atctttggacagaagcagctct

SEQ ID NO: 2628207 - DNA, 23 bp, Homo sapiens
atctttggacagaagcagctctt

SEQ ID NO: 2628208 - DNA, 11 bp, Homo sapiens
atcttttacat

SEQ ID NO: 2628209 - DNA, 15 bp, Homo sapiens
atcttttcacaaata

SEQ ID NO: 2628210 - DNA, 17 bp, Homo sapiens
atcttttcacaaataaa

SEQ ID NO: 2628211 - DNA, 14 bp, Homo sapiens
atcttttgtgagat

SEQ ID NO: 2628212 - DNA, 21 bp, Homo sapiens
atgaaaaaaggacaatttcaa

SEQ ID NO: 2628213 - DNA, 16 bp, Homo sapiens
atgaaaaaatgtatat

SEQ ID NO: 2628214 - DNA, 13 bp, Homo sapiens
atgaaaaatagca

SEQ ID NO: 2628215 - DNA, 13 bp, Homo sapiens
atgaaaaatatga

SEQ ID NO: 2628216 - DNA, 17 bp, Homo sapiens
atgaaaaatttaagcat

SEQ ID NO: 2628217 - DNA, 13 bp, Homo sapiens
atgaaaacatgta

SEQ ID NO: 2628218 - DNA, 13 bp, Homo sapiens
atgaaaatacaac

SEQ ID NO: 2628219 - DNA, 12 bp, Homo sapiens
atgaaaatgtca

SEQ ID NO: 2628220 - DNA, 13 bp, Homo sapiens
atgaaaatgtcag

SEQ ID NO: 2628221 - DNA, 14 bp, Homo sapiens
atgaaaattgtatg

SEQ ID NO: 2628222 - DNA, 19 bp, Homo sapiens
atgaaacaccttctctgga

SEQ ID NO: 2628223 - DNA, 16 bp, Homo sapiens
atgaaacccccacaca

SEQ ID NO: 2628224 - DNA, 19 bp, Homo sapiens
atgaaacccccacacacac

SEQ ID NO: 2628225 - DNA, 17 bp, Homo sapiens
atgaaagactgtacaaa

SEQ ID NO: 2628226 - DNA, 18 bp, Homo sapiens
atgaaagagtaaaggaaa

SEQ ID NO: 2628227 - DNA, 15 bp, Homo sapiens
atgaaagggcccaga

SEQ ID NO: 2628228 - DNA, 16 bp, Homo sapiens
atgaaaggtttacatt

SEQ ID NO: 2628229 - DNA, 20 bp, Homo sapiens
atgaaatacacaagtaaaca

SEQ ID NO: 2628230 - DNA, 13 bp, Homo sapiens
atgaaatatcaga

SEQ ID NO: 2628231 - DNA, 15 bp, Homo sapiens
atgaaatatgcatct

SEQ ID NO: 2628232 - DNA, 18 bp, Homo sapiens
atgaaatcttacagctgg

SEQ ID NO: 2628233 - DNA, 23 bp, Homo sapiens
atgaaattacttatcatccacat

SEQ ID NO: 2628234 - DNA, 22 bp, Homo sapiens
atgaaattgtctagcagagcag

SEQ ID NO: 2628235 - DNA, 15 bp, Homo sapiens
atgaacaaattgaac

SEQ ID NO: 2628236 - DNA, 18 bp, Homo sapiens
atgaacaaattgaactct

SEQ ID NO: 2628237 - DNA, 13 bp, Homo sapiens
atgaaccacatct

SEQ ID NO: 2628238 - DNA, 22 bp, Homo sapiens
atgaaccacatcttgctctgct

SEQ ID NO: 2628239 - DNA, 14 bp, Homo sapiens
atgaaccttctggc

SEQ ID NO: 2628240 - DNA, 16 bp, Homo sapiens
atgaacggtgagcatt

SEQ ID NO: 2628241 - DNA, 20 bp, Homo sapiens
atgaactattccccagcagg

SEQ ID NO: 2628242 - DNA, 20 bp, Homo sapiens
atgaactgaagtttcacatg

SEQ ID NO: 2628243 - DNA, 17 bp, Homo sapiens
atgaacttattctgtag

SEQ ID NO: 2628244 - DNA, 13 bp, Homo sapiens
atgaacttcgcat

SEQ ID NO: 2628245 - DNA, 17 bp, Homo sapiens
atgaacttcgcatcaaa

SEQ ID NO: 2628246 - DNA, 17 bp, Homo sapiens
atgaactttctcttcat

SEQ ID NO: 2628247 - DNA, 22 bp, Homo sapiens
atgaagaaaaaatacattttat

SEQ ID NO: 2628248 - DNA, 19 bp, Homo sapiens
atgaagaaaatcacttagg

SEQ ID NO: 2628249 - DNA, 14 bp, Homo sapiens
atgaagaactgagg

SEQ ID NO: 2628250 - DNA, 21 bp, Homo sapiens
atgaagacaggacagtgcttc

SEQ ID NO: 2628251 - DNA, 19 bp, Homo sapiens
atgaagagtgagagggcat

SEQ ID NO: 2628252 - DNA, 22 bp, Homo sapiens
atgaagatatttttccattttt

SEQ ID NO: 2628253 - DNA, 18 bp, Homo sapiens
atgaagatgtagaggaga

SEQ ID NO: 2628254 - DNA, 22 bp, Homo sapiens
atgaagatgtttcaaaaaatct

SEQ ID NO: 2628255 - DNA, 15 bp, Homo sapiens
atgaagcagctttaa

SEQ ID NO: 2628256 - DNA, 22 bp, Homo sapiens
atgaagcagctttaaacaaatt

SEQ ID NO: 2628257 - DNA, 17 bp, Homo sapiens
atgaagcccaagtgaaa

SEQ ID NO: 2628258 - DNA, 16 bp, Homo sapiens
atgaagccttagccag

SEQ ID NO: 2628259 - DNA, 19 bp, Homo sapiens
atgaagcttgtgtatccat

SEQ ID NO: 2628260 - DNA, 16 bp, Homo sapiens
atgaaggcaaaaaaat

SEQ ID NO: 2628261 - DNA, 16 bp, Homo sapiens
atgaaggttaggattt

SEQ ID NO: 2628262 - DNA, 22 bp, Homo sapiens
atgaaggttaggatttaacagt

SEQ ID NO: 2628263 - DNA, 17 bp, Homo sapiens
atgaaggtttctgaaaa

SEQ ID NO: 2628264 - DNA, 14 bp, Homo sapiens
atgaagtatataat

SEQ ID NO: 2628265 - DNA, 19 bp, Homo sapiens
atgaagtgtgtttccttca

SEQ ID NO: 2628266 - DNA, 23 bp, Homo sapiens
atgaagtgtgtttccttcagtgc

SEQ ID NO: 2628267 - DNA, 15 bp, Homo sapiens
atgaagtgttagata

SEQ ID NO: 2628268 - DNA, 15 bp, Homo sapiens
atgaagttgtaggta

SEQ ID NO: 2628269 - DNA, 19 bp, Homo sapiens
atatttagcaaataatttc

SEQ ID NO: 2628270 - DNA, 22 bp, Homo sapiens
atatttagttatagtttcagat

SEQ ID NO: 2628271 - DNA, 14 bp, Homo sapiens
atatttatatttca

SEQ ID NO: 2628272 - DNA, 14 bp, Homo sapiens
atatttatgtagat

SEQ ID NO: 2628273 - DNA, 15 bp, Homo sapiens
atatttctgatataa

SEQ ID NO: 2628274 - DNA, 12 bp, Homo sapiens
atatttgtacat

SEQ ID NO: 2628275 - DNA, 13 bp, Homo sapiens
atatttgtacata

SEQ ID NO: 2628276 - DNA, 12 bp, Homo sapiens
atatttgtagaa

SEQ ID NO: 2628277 - DNA, 15 bp, Homo sapiens
atatttgttatgtag

SEQ ID NO: 2628278 - DNA, 24 bp, Homo sapiens
atattttcaaattgtatctagtgc

SEQ ID NO: 2628279 - DNA, 16 bp, Homo sapiens
atattttccatgaaaa

SEQ ID NO: 2628280 - DNA, 18 bp, Homo sapiens
atattttccatgaaaatg

SEQ ID NO: 2628281 - DNA, 21 bp, Homo sapiens
atattttctttaaaagacaaa

SEQ ID NO: 2628282 - DNA, 19 bp, Homo sapiens
atattttgaatcaataata

SEQ ID NO: 2628283 - DNA, 14 bp, Homo sapiens
atattttgtatata

SEQ ID NO: 2628284 - DNA, 20 bp, Homo sapiens
atatttttatctttatatga

SEQ ID NO: 2628285 - DNA, 18 bp, Homo sapiens
atattttttgttaaatga

SEQ ID NO: 2628286 - DNA, 18 bp, Homo sapiens
atcaaaagacaattcttt

SEQ ID NO: 2628287 - DNA, 23 bp, Homo sapiens
atcaaaagacaattctttataca

SEQ ID NO: 2628288 - DNA, 20 bp, Homo sapiens
atcaaaaggttaataaagta

SEQ ID NO: 2628289 - DNA, 24 bp, Homo sapiens
atcaaaaggttaataaagtaatta

SEQ ID NO: 2628290 - DNA, 18 bp, Homo sapiens
atcaaaataaaaagtgac

SEQ ID NO: 2628291 - DNA, 15 bp, Homo sapiens
atcaaactgaagcca

SEQ ID NO: 2628292 - DNA, 16 bp, Homo sapiens
atcaaagccacactct

SEQ ID NO: 2628293 - DNA, 21 bp, Homo sapiens
atcaaaggaaaatagtaatgt

SEQ ID NO: 2628294 - DNA, 13 bp, Homo sapiens
atcaaatacttta

SEQ ID NO: 2628295 - DNA, 14 bp, Homo sapiens
atcaaatactttaa

SEQ ID NO: 2628296 - DNA, 20 bp, Homo sapiens
atcaaatttcacgtcgtctt

SEQ ID NO: 2628297 - DNA, 18 bp, Homo sapiens
atcaacaagagttgtctt

SEQ ID NO: 2628298 - DNA, 19 bp, Homo sapiens
atcaaccccttcgctcctg

SEQ ID NO: 2628299 - DNA, 15 bp, Homo sapiens
atcaagaaagtgttg

SEQ ID NO: 2628300 - DNA, 16 bp, Homo sapiens
atcaagcacagaagga

SEQ ID NO: 2628301 - DNA, 14 bp, Homo sapiens
atcaagcagccaag

SEQ ID NO: 2628302 - DNA, 11 bp, Homo sapiens
atcaagctgtg

SEQ ID NO: 2628303 - DNA, 21 bp, Homo sapiens
atcaagcttcagtttcctggt

SEQ ID NO: 2628304 - DNA, 22 bp, Homo sapiens
atcaagcttcagtttcctggtc

SEQ ID NO: 2628305 - DNA, 13 bp, Homo sapiens
atcaaggcactgc

SEQ ID NO: 2628306 - DNA, 23 bp, Homo sapiens
atcaagggaatgtaactgctgaa

SEQ ID NO: 2628307 - DNA, 18 bp, Homo sapiens
atcaatattgtcattcct

SEQ ID NO: 2628308 - DNA, 15 bp, Homo sapiens
atcaatgttcattgt

SEQ ID NO: 2628309 - DNA, 17 bp, Homo sapiens
atcaatgttcattgtaa

SEQ ID NO: 2628310 - DNA, 19 bp, Homo sapiens
atcaatttttcttatttca

SEQ ID NO: 2628311 - DNA, 16 bp, Homo sapiens
atcacaacaagaaatt

SEQ ID NO: 2628312 - DNA, 17 bp, Homo sapiens
atcacaacactggctga

SEQ ID NO: 2628313 - DNA, 14 bp, Homo sapiens
atcacacttctgtg

SEQ ID NO: 2628314 - DNA, 16 bp, Homo sapiens
atcacagagacattcc

SEQ ID NO: 2628315 - DNA, 17 bp, Homo sapiens
atcacagagacattcct

SEQ ID NO: 2628316 - DNA, 18 bp, Homo sapiens
atcacagagacattcctc

SEQ ID NO: 2628317 - DNA, 15 bp, Homo sapiens
atcacagggcagagc

SEQ ID NO: 2628318 - DNA, 12 bp, Homo sapiens
atcacagggccc

SEQ ID NO: 2628319 - DNA, 23 bp, Homo sapiens
atcacagggttgggcccagatct

SEQ ID NO: 2628320 - DNA, 21 bp, Homo sapiens
atcacagttttggttgcttta

SEQ ID NO: 2628321 - DNA, 13 bp, Homo sapiens
atcacatgtatgt

SEQ ID NO: 2628322 - DNA, 15 bp, Homo sapiens
atcacattatttgca

SEQ ID NO: 2628323 - DNA, 20 bp, Homo sapiens
atcaccaacgtctgtgccat

SEQ ID NO: 2628324 - DNA, 13 bp, Homo sapiens
atcaccagaataa

SEQ ID NO: 2628325 - DNA, 16 bp, Homo sapiens
atcaccagaataaacc

SEQ ID NO: 2628326 - DNA, 23 bp, Homo sapiens
atcaccagagagggactgacacc

SEQ ID NO: 2628327 - DNA, 19 bp, Homo sapiens
atcacccttaccatgtgcc

SEQ ID NO: 2628328 - DNA, 23 bp, Homo sapiens
atcacccttaccatgtgcctgat

SEQ ID NO: 2628329 - DNA, 20 bp, Homo sapiens
atcaccgacgcgtctcctgt

SEQ ID NO: 2628330 - DNA, 19 bp, Homo sapiens
atcaccgtgggctccctga

SEQ ID NO: 2628331 - DNA, 20 bp, Homo sapiens
atcaccgtgggctccctgac

SEQ ID NO: 2628332 - DNA, 13 bp, Homo sapiens
atcacctcccctc

SEQ ID NO: 2628333 - DNA, 15 bp, Homo sapiens
atcacctcccctcct

SEQ ID NO: 2628334 - DNA, 17 bp, Homo sapiens
atcaccttaggcaggga

SEQ ID NO: 2628335 - DNA, 17 bp, Homo sapiens
atcacgccactgcacta

SEQ ID NO: 2628336 - DNA, 23 bp, Homo sapiens
atcacgccactgcactccagcct

SEQ ID NO: 2628337 - DNA, 14 bp, Homo sapiens
atcacgctttcctg

SEQ ID NO: 2628338 - DNA, 18 bp, Homo sapiens
atcacggctcactgcagc

SEQ ID NO: 2628339 - DNA, 22 bp, Homo sapiens
atcacggctcactgcagcctca

SEQ ID NO: 2628340 - DNA, 14 bp, Homo sapiens
atcactactgcagt

SEQ ID NO: 2628341 - DNA, 16 bp, Homo sapiens
atcactcttgtggatg

SEQ ID NO: 2628342 - DNA, 17 bp, Homo sapiens
atcactcttgtggatgt

SEQ ID NO: 2628343 - DNA, 12 bp, Homo sapiens
atcactggagcc

SEQ ID NO: 2628344 - DNA, 13 bp, Homo sapiens
atcactggagccc

SEQ ID NO: 2628345 - DNA, 17 bp, Homo sapiens
atcactggagcccagga

SEQ ID NO: 2628346 - DNA, 18 bp, Homo sapiens
atcacttctgagaactca

SEQ ID NO: 2628347 - DNA, 14 bp, Homo sapiens
atcacttgtacaaa

SEQ ID NO: 2628348 - DNA, 16 bp, Homo sapiens
atcacttgtacaaaat

SEQ ID NO: 2628349 - DNA, 18 bp, Homo sapiens
atcacttgtacaaaataa

SEQ ID NO: 2628350 - DNA, 21 bp, Homo sapiens
atcacttgtacaaaataaaca

SEQ ID NO: 2628351 - DNA, 13 bp, Homo sapiens
atcacttttcagt

SEQ ID NO: 2628352 - DNA, 15 bp, Homo sapiens
atcacttttcagtga

SEQ ID NO: 2628353 - DNA, 14 bp, Homo sapiens
atcacttttttcca

SEQ ID NO: 2628354 - DNA, 14 bp, Homo sapiens
atcagaacagcaga

SEQ ID NO: 2628355 - DNA, 23 bp, Homo sapiens
atcagaagaccacaaaaattgac

SEQ ID NO: 2628356 - DNA, 18 bp, Homo sapiens
atcagaagtttctcagct

SEQ ID NO: 2628357 - DNA, 22 bp, Homo sapiens
atcagaccttggatcagatgaa

SEQ ID NO: 2628358 - DNA, 22 bp, Homo sapiens
atcagactagtgacaagctcct

SEQ ID NO: 2628359 - DNA, 14 bp, Homo sapiens
atcagaggcctata

SEQ ID NO: 2628360 - DNA, 17 bp, Homo sapiens
atcagaggcctataatg

SEQ ID NO: 2628361 - DNA, 17 bp, Homo sapiens
atcagagttgctgcaaa

SEQ ID NO: 2628362 - DNA, 14 bp, Homo sapiens
atcagattgcatgt

SEQ ID NO: 2628363 - DNA, 18 bp, Homo sapiens
atcagattgcatgtgact

SEQ ID NO: 2628364 - DNA, 23 bp, Homo sapiens
atcagcaacaaccagcatccctt

SEQ ID NO: 2628365 - DNA, 21 bp, Homo sapiens
atcagcaagtctctttatatg

SEQ ID NO: 2628366 - DNA, 18 bp, Homo sapiens
atcagcacgatttctgtt

SEQ ID NO: 2628367 - DNA, 20 bp, Homo sapiens
atgaatacaaacaatggaaa

SEQ ID NO: 2628368 - DNA, 21 bp, Homo sapiens
atgaatactgtattttgtatt

SEQ ID NO: 2628369 - DNA, 15 bp, Homo sapiens
atgaatcgcttctct

SEQ ID NO: 2628370 - DNA, 18 bp, Homo sapiens
atgaatctattatactgt

SEQ ID NO: 2628371 - DNA, 18 bp, Homo sapiens
atgaatgcccccagctgg

SEQ ID NO: 2628372 - DNA, 23 bp, Homo sapiens
atgaatggactcaaactgccttg

SEQ ID NO: 2628373 - DNA, 21 bp, Homo sapiens
atgaatggtatggaactctct

SEQ ID NO: 2628374 - DNA, 13 bp, Homo sapiens
atgaatgtatcag

SEQ ID NO: 2628375 - DNA, 16 bp, Homo sapiens
atgaatgtatcaggaa

SEQ ID NO: 2628376 - DNA, 18 bp, Homo sapiens
atgaatgtatgtgcactg

SEQ ID NO: 2628377 - DNA, 15 bp, Homo sapiens
atgaatttggagact

SEQ ID NO: 2628378 - DNA, 14 bp, Homo sapiens
ctgttatataaatg

SEQ ID NO: 2628379 - DNA, 19 bp, Homo sapiens
ctgttatcaaaactttctt

SEQ ID NO: 2628380 - DNA, 19 bp, Homo sapiens
ctgttatgctgtgacacat

SEQ ID NO: 2628381 - DNA, 14 bp, Homo sapiens
ctgttatttagact

SEQ ID NO: 2628382 - DNA, 14 bp, Homo sapiens
ctgttatttataat

SEQ ID NO: 2628383 - DNA, 20 bp, Homo sapiens
ctgttatttataatcacttt

SEQ ID NO: 2628384 - DNA, 12 bp, Homo sapiens
ctgttcaagagc

SEQ ID NO: 2628385 - DNA, 23 bp, Homo sapiens
ctgttcaagagcacacttggccc

SEQ ID NO: 2628386 - DNA, 17 bp, Homo sapiens
ctgttcaatgtttaatg

SEQ ID NO: 2628387 - DNA, 14 bp, Homo sapiens
ctgttcagctccag

SEQ ID NO: 2628388 - DNA, 18 bp, Homo sapiens
ctgttcagctccagctca

SEQ ID NO: 2628389 - DNA, 19 bp, Homo sapiens
ctgttcagctccagctcac

SEQ ID NO: 2628390 - DNA, 18 bp, Homo sapiens
ctgttcagctggttgagg

SEQ ID NO: 2628391 - DNA, 21 bp, Homo sapiens
ctgttcagctggttgaggttt

SEQ ID NO: 2628392 - DNA, 14 bp, Homo sapiens
ctgttcagttacag

SEQ ID NO: 2628393 - DNA, 17 bp, Homo sapiens
ctgttcagttacagaaa

SEQ ID NO: 2628394 - DNA, 14 bp, Homo sapiens
ctgttccagcctgc

SEQ ID NO: 2628395 - DNA, 17 bp, Homo sapiens
ctgttccccctgtgcag

SEQ ID NO: 2628396 - DNA, 14 bp, Homo sapiens
ctgttcccctcact

SEQ ID NO: 2628397 - DNA, 14 bp, Homo sapiens
ctgttccctctgct

SEQ ID NO: 2628398 - DNA, 21 bp, Homo sapiens
ctgttccttcacatcctgtgt

SEQ ID NO: 2628399 - DNA, 14 bp, Homo sapiens
ctgttctctgccct

SEQ ID NO: 2628400 - DNA, 20 bp, Homo sapiens
ctgttctctgccctccaaga

SEQ ID NO: 2628401 - DNA, 19 bp, Homo sapiens
ctgttctgtcccttggagc

SEQ ID NO: 2628402 - DNA, 15 bp, Homo sapiens
ctgttctgtggaaag

SEQ ID NO: 2628403 - DNA, 15 bp, Homo sapiens
ctgttcttggggccc

SEQ ID NO: 2628404 - DNA, 21 bp, Homo sapiens
ctgttgaaaattattttaaac

SEQ ID NO: 2628405 - DNA, 22 bp, Homo sapiens
ctgttgaaaattattttaaaca

SEQ ID NO: 2628406 - DNA, 15 bp, Homo sapiens
ctgttgagctgtttt

SEQ ID NO: 2628407 - DNA, 15 bp, Homo sapiens
ctgttgattgcagga

SEQ ID NO: 2628408 - DNA, 14 bp, Homo sapiens
ctgttgattgctaa

SEQ ID NO: 2628409 - DNA, 18 bp, Homo sapiens
ctgttgattgctaaatgt

SEQ ID NO: 2628410 - DNA, 20 bp, Homo sapiens
ctgttgattgctaaatgtaa

SEQ ID NO: 2628411 - DNA, 23 bp, Homo sapiens
ctgttgattgctaaatgtaacag

SEQ ID NO: 2628412 - DNA, 13 bp, Homo sapiens
ctgttgcacccag

SEQ ID NO: 2628413 - DNA, 14 bp, Homo sapiens
ctgttgcacccagc

SEQ ID NO: 2628414 - DNA, 21 bp, Homo sapiens
ctgttgcacccagccctggtc

SEQ ID NO: 2628415 - DNA, 14 bp, Homo sapiens
ctgttgcccaggct

SEQ ID NO: 2628416 - DNA, 15 bp, Homo sapiens
ctgttgcccaggctg

SEQ ID NO: 2628417 - DNA, 16 bp, Homo sapiens
ctgttgcccaggctgg

SEQ ID NO: 2628418 - DNA, 18 bp, Homo sapiens
ctgttgcccaggctggcg

SEQ ID NO: 2628419 - DNA, 22 bp, Homo sapiens
ctgttgctcaaatctattcaga

SEQ ID NO: 2628420 - DNA, 19 bp, Homo sapiens
ctgttggatttgtttaaaa

SEQ ID NO: 2628421 - DNA, 22 bp, Homo sapiens
ctgttggatttgtttaaaagga

SEQ ID NO: 2628422 - DNA, 21 bp, Homo sapiens
ctgttggcactcacagacctg

SEQ ID NO: 2628423 - DNA, 15 bp, Homo sapiens
ctgttggccagtgtg

SEQ ID NO: 2628424 - DNA, 20 bp, Homo sapiens
ctgttggttccaagccctgg

SEQ ID NO: 2628425 - DNA, 16 bp, Homo sapiens
ctgttgtaactaggct

SEQ ID NO: 2628426 - DNA, 22 bp, Homo sapiens
ctgttgtaactaggctcagaga

SEQ ID NO: 2628427 - DNA, 13 bp, Homo sapiens
ctgttgtacattt

SEQ ID NO: 2628428 - DNA, 14 bp, Homo sapiens
ctgttgtacattta

SEQ ID NO: 2628429 - DNA, 15 bp, Homo sapiens
ctgttgtacatttat

SEQ ID NO: 2628430 - DNA, 15 bp, Homo sapiens
ctgttgtcctcccct

SEQ ID NO: 2628431 - DNA, 21 bp, Homo sapiens
ctgttgtgtatagatgcaaga

SEQ ID NO: 2628432 - DNA, 22 bp, Homo sapiens
ctgtttaaatatttcaagacat

SEQ ID NO: 2628433 - DNA, 23 bp, Homo sapiens
ctgtttaaatgtttttctatgta

SEQ ID NO: 2628434 - DNA, 16 bp, Homo sapiens
ctgtttaatatttaaa

SEQ ID NO: 2628435 - DNA, 17 bp, Homo sapiens
ctgtttacaagaaaaaa

SEQ ID NO: 2628436 - DNA, 20 bp, Homo sapiens
ctgtttacaagaaaaaatga

SEQ ID NO: 2628437 - DNA, 14 bp, Homo sapiens
ctgtttagataata

SEQ ID NO: 2628438 - DNA, 18 bp, Homo sapiens
ctgtttagataatacacc

SEQ ID NO: 2628439 - DNA, 13 bp, Homo sapiens
ctgtttatggcct

SEQ ID NO: 2628440 - DNA, 15 bp, Homo sapiens
ctgtttatggcctca

SEQ ID NO: 2628441 - DNA, 16 bp, Homo sapiens
ctgtttatggcctcag

SEQ ID NO: 2628442 - DNA, 17 bp, Homo sapiens
ctgtttatggcctcagc

SEQ ID NO: 2628443 - DNA, 15 bp, Homo sapiens
ctgtttcaaacttta

SEQ ID NO: 2628444 - DNA, 17 bp, Homo sapiens
ctgtttcaacacagacc

SEQ ID NO: 2628445 - DNA, 12 bp, Homo sapiens
ctgtttcccagc

SEQ ID NO: 2628446 - DNA, 21 bp, Homo sapiens
ctgtttcccagcagtggactc

SEQ ID NO: 2628447 - DNA, 14 bp, Homo sapiens
ctgtttctctgctg

SEQ ID NO: 2628448 - DNA, 12 bp, Homo sapiens
ctgtttgacaaa

SEQ ID NO: 2628449 - DNA, 22 bp, Homo sapiens
ctgtttgaggatatattttcac

SEQ ID NO: 2628450 - DNA, 16 bp, Homo sapiens
ctgtttgggcccctct

SEQ ID NO: 2628451 - DNA, 17 bp, Homo sapiens
ctgtttgtcttctcccc

SEQ ID NO: 2628452 - DNA, 18 bp, Homo sapiens
ctgtttgtcttctcccca

SEQ ID NO: 2628453 - DNA, 12 bp, Homo sapiens
ctgtttgttatg

SEQ ID NO: 2628454 - DNA, 12 bp, Homo sapiens
ctgttttaaatt

SEQ ID NO: 2628455 - DNA, 14 bp, Homo sapiens
ctgttttaagttct

SEQ ID NO: 2628456 - DNA, 12 bp, Homo sapiens
ctgttttatgac

SEQ ID NO: 2628457 - DNA, 18 bp, Homo sapiens
ctgttttcctttctcacc

SEQ ID NO: 2628458 - DNA, 23 bp, Homo sapiens
ctgttttcctttctcaccgcagt

SEQ ID NO: 2628459 - DNA, 21 bp, Homo sapiens
ctgttttctctcggctcccca

SEQ ID NO: 2628460 - DNA, 14 bp, Homo sapiens
ctgttttctcttga

SEQ ID NO: 2628461 - DNA, 13 bp, Homo sapiens
ctgttttctgagc

SEQ ID NO: 2628462 - DNA, 12 bp, Homo sapiens
ctgttttgaatt

SEQ ID NO: 2628463 - DNA, 14 bp, Homo sapiens
ctgttttgttctgt

SEQ ID NO: 2628464 - DNA, 15 bp, Homo sapiens
ctgtttttaagctgt

SEQ ID NO: 2628465 - DNA, 16 bp, Homo sapiens
ctgtttttaagctgtt

SEQ ID NO: 2628466 - DNA, 20 bp, Homo sapiens
ctgtttttacccatatcccc

SEQ ID NO: 2628467 - DNA, 15 bp, Homo sapiens
ctgtttttctgggtg

SEQ ID NO: 2628468 - DNA, 13 bp, Homo sapiens
cttaaaaaatgtc

SEQ ID NO: 2628469 - DNA, 13 bp, Homo sapiens
cttaaaaatggtt

SEQ ID NO: 2628470 - DNA, 21 bp, Homo sapiens
cttaaaaatggtttaaatggt

SEQ ID NO: 2628471 - DNA, 16 bp, Homo sapiens
cttaaaaatgtaaata

SEQ ID NO: 2628472 - DNA, 14 bp, Homo sapiens
cttaaacctgggag

SEQ ID NO: 2628473 - DNA, 23 bp, Homo sapiens
cttaaaccttcagttatgatttt

SEQ ID NO: 2628474 - DNA, 21 bp, Homo sapiens
cttaaagaaagtcgaattaat

SEQ ID NO: 2628475 - DNA, 16 bp, Homo sapiens
cttaaaggtgtcttcc

SEQ ID NO: 2628476 - DNA, 21 bp, Homo sapiens
cttaaaggtgtcttcctccca

SEQ ID NO: 2628477 - DNA, 22 bp, Homo sapiens
cttaaataataaagatcatgta

SEQ ID NO: 2628478 - DNA, 16 bp, Homo sapiens
cttaaataatgtgaaa

SEQ ID NO: 2628479 - DNA, 18 bp, Homo sapiens
cttaaattttaatttatt

SEQ ID NO: 2628480 - DNA, 15 bp, Homo sapiens
cttaacatatttact

SEQ ID NO: 2628481 - DNA, 14 bp, Homo sapiens
cttaacattctgta

SEQ ID NO: 2628482 - DNA, 16 bp, Homo sapiens
cttaacggctccagga

SEQ ID NO: 2628483 - DNA, 22 bp, Homo sapiens
cttaacttaaattttaatttat

SEQ ID NO: 2628484 - DNA, 12 bp, Homo sapiens
cttaacttcaca

SEQ ID NO: 2628485 - DNA, 15 bp, Homo sapiens
cttaacttcacatat

SEQ ID NO: 2628486 - DNA, 16 bp, Homo sapiens
cttaagaactgctttc

SEQ ID NO: 2628487 - DNA, 18 bp, Homo sapiens
cttaagaattttgagcag

SEQ ID NO: 2628488 - DNA, 14 bp, Homo sapiens
cttaagcagaagca

SEQ ID NO: 2628489 - DNA, 15 bp, Homo sapiens
cttaagccatcttgg

SEQ ID NO: 2628490 - DNA, 16 bp, Homo sapiens
cttaagccatcttggt

SEQ ID NO: 2628491 - DNA, 22 bp, Homo sapiens
cttaagccatcttggtaaattt

SEQ ID NO: 2628492 - DNA, 23 bp, Homo sapiens
cttaagccatcttggtaaatttc

SEQ ID NO: 2628493 - DNA, 12 bp, Homo sapiens
cttaagcttccg

SEQ ID NO: 2628494 - DNA, 18 bp, Homo sapiens
cttaaggggcagcttcta

SEQ ID NO: 2628495 - DNA, 12 bp, Homo sapiens
cttaataaattc

SEQ ID NO: 2628496 - DNA, 17 bp, Homo sapiens
cttaataaattcagata

SEQ ID NO: 2628497 - DNA, 21 bp, Homo sapiens
cttaatacctgggtgattaca

SEQ ID NO: 2628498 - DNA, 18 bp, Homo sapiens
cttaatcttttcacaaat

SEQ ID NO: 2628499 - DNA, 19 bp, Homo sapiens
cttaatcttttcacaaata

SEQ ID NO: 2628500 - DNA, 21 bp, Homo sapiens
cttaatgatccgttccattgc

SEQ ID NO: 2628501 - DNA, 15 bp, Homo sapiens
cttaatgtttattcc

SEQ ID NO: 2628502 - DNA, 11 bp, Homo sapiens
cttaattatta

SEQ ID NO: 2628503 - DNA, 19 bp, Homo sapiens
cttaattattatttgtgtt

SEQ ID NO: 2628504 - DNA, 15 bp, Homo sapiens
cttaattgcactcta

SEQ ID NO: 2628505 - DNA, 21 bp, Homo sapiens
cttaattttggttgtattctt

SEQ ID NO: 2628506 - DNA, 23 bp, Homo sapiens
cttaattttggttgtattctttg

SEQ ID NO: 2628507 - DNA, 16 bp, Homo sapiens
cttacaagccagctgg

SEQ ID NO: 2628508 - DNA, 16 bp, Homo sapiens
cttacaattccctgct

SEQ ID NO: 2628509 - DNA, 23 bp, Homo sapiens
cttacaatttttttaattttgta

SEQ ID NO: 2628510 - DNA, 14 bp, Homo sapiens
cttacagctgggtg

SEQ ID NO: 2628511 - DNA, 18 bp, Homo sapiens
cttacagttttaaattct

SEQ ID NO: 2628512 - DNA, 15 bp, Homo sapiens
cttcagccacctctc

SEQ ID NO: 2628513 - DNA, 17 bp, Homo sapiens
cttcagccacctctctt

SEQ ID NO: 2628514 - DNA, 15 bp, Homo sapiens
cttcagccaggagct

SEQ ID NO: 2628515 - DNA, 19 bp, Homo sapiens
cttcagccaggagctgggc

SEQ ID NO: 2628516 - DNA, 14 bp, Homo sapiens
cttcagcctgaggc

SEQ ID NO: 2628517 - DNA, 16 bp, Homo sapiens
cttcagcctgaggctg

SEQ ID NO: 2628518 - DNA, 11 bp, Homo sapiens
cttcagctgac

SEQ ID NO: 2628519 - DNA, 15 bp, Homo sapiens
cttcagctgactttt

SEQ ID NO: 2628520 - DNA, 16 bp, Homo sapiens
cttcagggcagggctc

SEQ ID NO: 2628521 - DNA, 18 bp, Homo sapiens
cttcagggcagggctctg

SEQ ID NO: 2628522 - DNA, 22 bp, Homo sapiens
cttcaggggagtcccgtcagga

SEQ ID NO: 2628523 - DNA, 23 bp, Homo sapiens
cttcaggggagtcccgtcaggac

SEQ ID NO: 2628524 - DNA, 20 bp, Homo sapiens
cttcaggttatcgaaataac

SEQ ID NO: 2628525 - DNA, 22 bp, Homo sapiens
cttcaggttatcgaaataacaa

SEQ ID NO: 2628526 - DNA, 15 bp, Homo sapiens
cttcaggttcttagt

SEQ ID NO: 2628527 - DNA, 14 bp, Homo sapiens
cttcagtaagccgt

SEQ ID NO: 2628528 - DNA, 22 bp, Homo sapiens
cttcagtaccctctcagctcca

SEQ ID NO: 2628529 - DNA, 23 bp, Homo sapiens
cttcagtaccctctcagctccag

SEQ ID NO: 2628530 - DNA, 20 bp, Homo sapiens
cttcagtgtatggaaataaa

SEQ ID NO: 2628531 - DNA, 17 bp, Homo sapiens
cttcagttatgattttt

SEQ ID NO: 2628532 - DNA, 19 bp, Homo sapiens
cttcatcgtggggctctca

SEQ ID NO: 2628533 - DNA, 11 bp, Homo sapiens
cttcatctgga

SEQ ID NO: 2628534 - DNA, 16 bp, Homo sapiens
cttcatcttctcagct

SEQ ID NO: 2628535 - DNA, 17 bp, Homo sapiens
cttcatcttctcagctc

SEQ ID NO: 2628536 - DNA, 22 bp, Homo sapiens
gaatgaggtcccaggcagagaa

SEQ ID NO: 2628537 - DNA, 16 bp, Homo sapiens
gaatgatctcttcttt

SEQ ID NO: 2628538 - DNA, 15 bp, Homo sapiens
gaatgattcagtgtt

SEQ ID NO: 2628539 - DNA, 14 bp, Homo sapiens
gaatgatttttaga

SEQ ID NO: 2628540 - DNA, 20 bp, Homo sapiens
gaatgcacactagcctctcc

SEQ ID NO: 2628541 - DNA, 22 bp, Homo sapiens
gaatgcacactagcctctccag

SEQ ID NO: 2628542 - DNA, 11 bp, Homo sapiens
gaatgcagtgg

SEQ ID NO: 2628543 - DNA, 17 bp, Homo sapiens
gaatgcccccagctggc

SEQ ID NO: 2628544 - DNA, 18 bp, Homo sapiens
gaatgcccccagctggcc

SEQ ID NO: 2628545 - DNA, 14 bp, Homo sapiens
gaatgccctcaggg

SEQ ID NO: 2628546 - DNA, 21 bp, Homo sapiens
gaatgcctcaatgtgaccagg

SEQ ID NO: 2628547 - DNA, 23 bp, Homo sapiens
gaatgcggcaagaaggaattgac

SEQ ID NO: 2628548 - DNA, 22 bp, Homo sapiens
gaatgctcaagtttttcagaaa

SEQ ID NO: 2628549 - DNA, 11 bp, Homo sapiens
gaatgctcccc

SEQ ID NO: 2628550 - DNA, 22 bp, Homo sapiens
gaatgctcccccatcctcccct

SEQ ID NO: 2628551 - DNA, 22 bp, Homo sapiens
gaatgcttataggtggcctctc

SEQ ID NO: 2628552 - DNA, 16 bp, Homo sapiens
gaatgcttgaaaaatg

SEQ ID NO: 2628553 - DNA, 17 bp, Homo sapiens
gaatgcttgaaaaatgt

SEQ ID NO: 2628554 - DNA, 19 bp, Homo sapiens
gaatggattggattattta

SEQ ID NO: 2628555 - DNA, 20 bp, Homo sapiens
gaatggattggattatttaa

SEQ ID NO: 2628556 - DNA, 13 bp, Homo sapiens
gaatggcaatggt

SEQ ID NO: 2628557 - DNA, 13 bp, Homo sapiens
gaatggcagctgc

SEQ ID NO: 2628558 - DNA, 16 bp, Homo sapiens
gaatggcagctgccac

SEQ ID NO: 2628559 - DNA, 21 bp, Homo sapiens
gaatggcctgccttgaagcca

SEQ ID NO: 2628560 - DNA, 15 bp, Homo sapiens
gaatgggcagttaca

SEQ ID NO: 2628561 - DNA, 18 bp, Homo sapiens
gaatggggatcacagaga

SEQ ID NO: 2628562 - DNA, 16 bp, Homo sapiens
gaatggttataaaagt

SEQ ID NO: 2628563 - DNA, 20 bp, Homo sapiens
gaatggttccatgcctgagg

SEQ ID NO: 2628564 - DNA, 11 bp, Homo sapiens
gaatgtaatca

SEQ ID NO: 2628565 - DNA, 13 bp, Homo sapiens
gaatgtaatcaat

SEQ ID NO: 2628566 - DNA, 14 bp, Homo sapiens
gaatgtactctgtt

SEQ ID NO: 2628567 - DNA, 17 bp, Homo sapiens
gaatgtattattctgca

SEQ ID NO: 2628568 - DNA, 18 bp, Homo sapiens
gaatgtattattctgcag

SEQ ID NO: 2628569 - DNA, 19 bp, Homo sapiens
gaatgtattattctgcagc

SEQ ID NO: 2628570 - DNA, 19 bp, Homo sapiens
gaatgtcagtatgtggaag

SEQ ID NO: 2628571 - DNA, 14 bp, Homo sapiens
gaatgttgggactg

SEQ ID NO: 2628572 - DNA, 20 bp, Homo sapiens
gaatgtttacactctttgta

SEQ ID NO: 2628573 - DNA, 21 bp, Homo sapiens
gaatgtttacactctttgtaa

SEQ ID NO: 2628574 - DNA, 16 bp, Homo sapiens
gaatgtttatagcaaa

SEQ ID NO: 2628575 - DNA, 14 bp, Homo sapiens
gaatgtttattcct

SEQ ID NO: 2628576 - DNA, 15 bp, Homo sapiens
gaatgtttgcctctg

SEQ ID NO: 2628577 - DNA, 19 bp, Homo sapiens
gaatgtttgcctctgcctc

SEQ ID NO: 2628578 - DNA, 20 bp, Homo sapiens
gaattaaataaacccttcct

SEQ ID NO: 2628579 - DNA, 14 bp, Homo sapiens
gaattaacacatga

SEQ ID NO: 2628580 - DNA, 15 bp, Homo sapiens
gaattaacacatgat

SEQ ID NO: 2628581 - DNA, 16 bp, Homo sapiens
gaattaacctggtgct

SEQ ID NO: 2628582 - DNA, 22 bp, Homo sapiens
gaattaacctggtgctggatat

SEQ ID NO: 2628583 - DNA, 21 bp, Homo sapiens
gaattaagttagggaatggca

SEQ ID NO: 2628584 - DNA, 15 bp, Homo sapiens
gaattaagttatctt

SEQ ID NO: 2628585 - DNA, 20 bp, Homo sapiens
gaattaagttatctttaaaa

SEQ ID NO: 2628586 - DNA, 18 bp, Homo sapiens
gaattagtccttgcttgg

SEQ ID NO: 2628587 - DNA, 23 bp, Homo sapiens
gaattctaggcatcccaggggac

SEQ ID NO: 2628588 - DNA, 19 bp, Homo sapiens
gaattctgctacctcactg

SEQ ID NO: 2628589 - DNA, 19 bp, Homo sapiens
gaattcttacatgttttct

SEQ ID NO: 2628590 - DNA, 21 bp, Homo sapiens
gaattgacccacaagaaatga

SEQ ID NO: 2628591 - DNA, 21 bp, Homo sapiens
gaattgatcattttcccccca

SEQ ID NO: 2628592 - DNA, 21 bp, Homo sapiens
gaattgcctgcagagagaagc

SEQ ID NO: 2628593 - DNA, 20 bp, Homo sapiens
gaatttaaatataattctgt

SEQ ID NO: 2628594 - DNA, 16 bp, Homo sapiens
gaatttaataatctgt

SEQ ID NO: 2628595 - DNA, 19 bp, Homo sapiens
gaatttagggagaaatgtt

SEQ ID NO: 2628596 - DNA, 22 bp, Homo sapiens
gaatttatatacaacctgcttg

SEQ ID NO: 2628597 - DNA, 17 bp, Homo sapiens
gaatttattattgttct

SEQ ID NO: 2628598 - DNA, 13 bp, Homo sapiens
gaatttattcaat

SEQ ID NO: 2628599 - DNA, 17 bp, Homo sapiens
gaatttattcaattcct

SEQ ID NO: 2628600 - DNA, 17 bp, Homo sapiens
gaatttcacctgtaaac

SEQ ID NO: 2628601 - DNA, 21 bp, Homo sapiens
gaatttcctctattgatgtac

SEQ ID NO: 2628602 - DNA, 17 bp, Homo sapiens
gaatttctaaaaaacag

SEQ ID NO: 2628603 - DNA, 19 bp, Homo sapiens
gaatttcttcactgttgaa

SEQ ID NO: 2628604 - DNA, 17 bp, Homo sapiens
gaatttgaatgaaaaat

SEQ ID NO: 2628605 - DNA, 23 bp, Homo sapiens
gaatttgatcgttccagttccca

SEQ ID NO: 2628606 - DNA, 19 bp, Homo sapiens
gaatttgcaagtcatggct

SEQ ID NO: 2628607 - DNA, 21 bp, Homo sapiens
gaatttgtaacctcagctctg

SEQ ID NO: 2628608 - DNA, 15 bp, Homo sapiens
gaattttaagtgctt

SEQ ID NO: 2628609 - DNA, 22 bp, Homo sapiens
gaatttttttcatcttctctgg

SEQ ID NO: 2628610 - DNA, 16 bp, Homo sapiens
gacaaacacctcccag

SEQ ID NO: 2628611 - DNA, 17 bp, Homo sapiens
gacaaacacctcccagg

SEQ ID NO: 2628612 - DNA, 15 bp, Homo sapiens
gacaaaccagaagca

SEQ ID NO: 2628613 - DNA, 20 bp, Homo sapiens
gacaaactgccagttttgtt

SEQ ID NO: 2628614 - DNA, 21 bp, Homo sapiens
gacaaagacaaattctgtttc

SEQ ID NO: 2628615 - DNA, 23 bp, Homo sapiens
gacaaagatgatttaaaagggaa

SEQ ID NO: 2628616 - DNA, 19 bp, Homo sapiens
gacaaatactcatgtgtat

SEQ ID NO: 2628617 - DNA, 12 bp, Homo sapiens
gacaaattctgt

SEQ ID NO: 2628618 - DNA, 15 bp, Homo sapiens
gacaaattctgtttc

SEQ ID NO: 2628619 - DNA, 17 bp, Homo sapiens
gacaaattctgtttctt

SEQ ID NO: 2628620 - DNA, 21 bp, Homo sapiens
gacaacaaattaggttttgta

SEQ ID NO: 2628621 - DNA, 14 bp, Homo sapiens
gacaacagaagtca

SEQ ID NO: 2628622 - DNA, 18 bp, Homo sapiens
gacaaccgatgctccagc

SEQ ID NO: 2628623 - DNA, 19 bp, Homo sapiens
gacaaccgatgctccagcc

SEQ ID NO: 2628624 - DNA, 14 bp, Homo sapiens
gacaacgaggaagc

SEQ ID NO: 2628625 - DNA, 19 bp, Homo sapiens
gacaagccaacttgtaaat

SEQ ID NO: 2628626 - DNA, 23 bp, Homo sapiens
gacaagccaacttgtaaatacac

SEQ ID NO: 2628627 - DNA, 12 bp, Homo sapiens
gacaagccccag

SEQ ID NO: 2628628 - DNA, 17 bp, Homo sapiens
gacaaggaaaggcaaat

SEQ ID NO: 2628629 - DNA, 19 bp, Homo sapiens
gacaaggattgctactgtc

SEQ ID NO: 2628630 - DNA, 13 bp, Homo sapiens
gacaaggccccag

SEQ ID NO: 2628631 - DNA, 14 bp, Homo sapiens
gacaaggccccaga

SEQ ID NO: 2628632 - DNA, 19 bp, Homo sapiens
gaaattttatatgcttact

SEQ ID NO: 2628633 - DNA, 19 bp, Homo sapiens
gaacaactaggcttcagca

SEQ ID NO: 2628634 - DNA, 21 bp, Homo sapiens
gaacaactaggcttcagcata

SEQ ID NO: 2628635 - DNA, 22 bp, Homo sapiens
gaacaagtccctgtaattgttg

SEQ ID NO: 2628636 - DNA, 21 bp, Homo sapiens
gaacaatgtgctatgtgaaga

SEQ ID NO: 2628637 - DNA, 21 bp, Homo sapiens
gaacaccagagacctcaaatt

SEQ ID NO: 2628638 - DNA, 21 bp, Homo sapiens
gaacacccgactcctcaaaag

SEQ ID NO: 2628639 - DNA, 16 bp, Homo sapiens
gaacaccctatatttt

SEQ ID NO: 2628640 - DNA, 22 bp, Homo sapiens
gaacacgtccagaatttttcat

SEQ ID NO: 2628641 - DNA, 16 bp, Homo sapiens
gaacactcatgctgaa

SEQ ID NO: 2628642 - DNA, 15 bp, Homo sapiens
gaacactccttcaca

SEQ ID NO: 2628643 - DNA, 20 bp, Homo sapiens
gaacactgggggaggggaca

SEQ ID NO: 2628644 - DNA, 12 bp, Homo sapiens
gaacagaatgtt

SEQ ID NO: 2628645 - DNA, 17 bp, Homo sapiens
gaacagacaacagaagt

SEQ ID NO: 2628646 - DNA, 18 bp, Homo sapiens
gaacagacaacagaagtc

SEQ ID NO: 2628647 - DNA, 16 bp, Homo sapiens
gaacagactggaagca

SEQ ID NO: 2628648 - DNA, 18 bp, Homo sapiens
gaacagccgctcctgtct

SEQ ID NO: 2628649 - DNA, 16 bp, Homo sapiens
gaacagcttcaggtta

SEQ ID NO: 2628650 - DNA, 18 bp, Homo sapiens
gaacagtgaggtgcccag

SEQ ID NO: 2628651 - DNA, 17 bp, Homo sapiens
gaacagtgtttcccata

SEQ ID NO: 2628652 - DNA, 18 bp, Homo sapiens
gaacagtgtttcccataa

SEQ ID NO: 2628653 - DNA, 14 bp, Homo sapiens
gaacagtttgtaca

SEQ ID NO: 2628654 - DNA, 15 bp, Homo sapiens
gaacataaaatacaa

SEQ ID NO: 2628655 - DNA, 12 bp, Homo sapiens
gaacatattgtt

SEQ ID NO: 2628656 - DNA, 20 bp, Homo sapiens
gaacatcatcaaggcactgc

SEQ ID NO: 2628657 - DNA, 22 bp, Homo sapiens
gaacatcatcaaggcactgcct

SEQ ID NO: 2628658 - DNA, 15 bp, Homo sapiens
gaacatcattagaac

SEQ ID NO: 2628659 - DNA, 20 bp, Homo sapiens
gaacatccaaggagaaacag

SEQ ID NO: 2628660 - DNA, 15 bp, Homo sapiens
gaacatccctgccag

SEQ ID NO: 2628661 - DNA, 24 bp, Homo sapiens
gaaccaacaacctcaactgcctac

SEQ ID NO: 2628662 - DNA, 15 bp, Homo sapiens
gaaccaacactaaca

SEQ ID NO: 2628663 - DNA, 13 bp, Homo sapiens
gaaccaatatttg

SEQ ID NO: 2628664 - DNA, 18 bp, Homo sapiens
gaaccacatcttgctctg

SEQ ID NO: 2628665 - DNA, 17 bp, Homo sapiens
gaaccaccacacccagc

SEQ ID NO: 2628666 - DNA, 18 bp, Homo sapiens
gaaccaccacacccagcc

SEQ ID NO: 2628667 - DNA, 23 bp, Homo sapiens
gaaccaccacacccagcccactt

SEQ ID NO: 2628668 - DNA, 14 bp, Homo sapiens
gaaccacttccctc

SEQ ID NO: 2628669 - DNA, 18 bp, Homo sapiens
gaaccagggagaccgagc

SEQ ID NO: 2628670 - DNA, 23 bp, Homo sapiens
gaacccattccatttatctttct

SEQ ID NO: 2628671 - DNA, 18 bp, Homo sapiens
gaaccctgcgtggggaca

SEQ ID NO: 2628672 - DNA, 23 bp, Homo sapiens
gaaccctgtgctggtgtcctgac

SEQ ID NO: 2628673 - DNA, 23 bp, Homo sapiens
gaaccgagcaaagatcaaaataa

SEQ ID NO: 2628674 - DNA, 18 bp, Homo sapiens
gaaccgaggggctcagga

SEQ ID NO: 2628675 - DNA, 21 bp, Homo sapiens
gaaccgaggggctcaggaaaa

SEQ ID NO: 2628676 - DNA, 20 bp, Homo sapiens
gaaccgcagaagcctcccca

SEQ ID NO: 2628677 - DNA, 20 bp, Homo sapiens
gaaccgcaggaagctgctcc

SEQ ID NO: 2628678 - DNA, 17 bp, Homo sapiens
gaacctagaagggctag

SEQ ID NO: 2628679 - DNA, 17 bp, Homo sapiens
gaacctcacgcacctcc

SEQ ID NO: 2628680 - DNA, 18 bp, Homo sapiens
gaacctcacgcacctccc

SEQ ID NO: 2628681 - DNA, 19 bp, Homo sapiens
gaacctcacgcacctccca

SEQ ID NO: 2628682 - DNA, 11 bp, Homo sapiens
gaacctcaggc

SEQ ID NO: 2628683 - DNA, 14 bp, Homo sapiens
gaacctcctctgtg

SEQ ID NO: 2628684 - DNA, 15 bp, Homo sapiens
gaacctggagagcta

SEQ ID NO: 2628685 - DNA, 15 bp, Homo sapiens
gaacctggagggcta

SEQ ID NO: 2628686 - DNA, 13 bp, Homo sapiens
gaacctggagggg

SEQ ID NO: 2628687 - DNA, 20 bp, Homo sapiens
gaacctgtccttgcacactc

SEQ ID NO: 2628688 - DNA, 18 bp, Homo sapiens
gaaccttctggcctccca

SEQ ID NO: 2628689 - DNA, 21 bp, Homo sapiens
gaaccttctggcctcccacag

SEQ ID NO: 2628690 - DNA, 19 bp, Homo sapiens
gaaccttgtgcctggctca

SEQ ID NO: 2628691 - DNA, 13 bp, Homo sapiens
gaaccttgttatt

SEQ ID NO: 2628692 - DNA, 18 bp, Homo sapiens
gaaccttgttatttctca

SEQ ID NO: 2628693 - DNA, 21 bp, Homo sapiens
gaacgacaatagctttaccct

SEQ ID NO: 2628694 - DNA, 23 bp, Homo sapiens
gaacggagccccaggcctctgtg

SEQ ID NO: 2628695 - DNA, 12 bp, Homo sapiens
gaacgtttttcc

SEQ ID NO: 2628696 - DNA, 15 bp, Homo sapiens
gaactaataaaagca

SEQ ID NO: 2628697 - DNA, 22 bp, Homo sapiens
gaactacgcttgctcatttttt

SEQ ID NO: 2628698 - DNA, 17 bp, Homo sapiens
gaactatggacggtgct

SEQ ID NO: 2628699 - DNA, 15 bp, Homo sapiens
gaactattggagggt

SEQ ID NO: 2628700 - DNA, 22 bp, Homo sapiens
gaactattggagggtgggagag

SEQ ID NO: 2628701 - DNA, 16 bp, Homo sapiens
gaactcacctggggct

SEQ ID NO: 2628702 - DNA, 13 bp, Homo sapiens
gaactcattcctg

SEQ ID NO: 2628703 - DNA, 17 bp, Homo sapiens
gaactcccagcaacaca

SEQ ID NO: 2628704 - DNA, 14 bp, Homo sapiens
gaactcctggcctc

SEQ ID NO: 2628705 - DNA, 15 bp, Homo sapiens
gaactcctggcctca

SEQ ID NO: 2628706 - DNA, 19 bp, Homo sapiens
gaactctggcttccaggta

SEQ ID NO: 2628707 - DNA, 20 bp, Homo sapiens
gaactctggcttccaggtat

SEQ ID NO: 2628708 - DNA, 21 bp, Homo sapiens
gaaggagccccattcctggga

SEQ ID NO: 2628709 - DNA, 22 bp, Homo sapiens
gaaggagccccattcctgggaa

SEQ ID NO: 2628710 - DNA, 15 bp, Homo sapiens
gaaggaggaggagga

SEQ ID NO: 2628711 - DNA, 14 bp, Homo sapiens
gaaggaggctggct

SEQ ID NO: 2628712 - DNA, 15 bp, Homo sapiens
gaaggcaaagcacga

SEQ ID NO: 2628713 - DNA, 14 bp, Homo sapiens
gaaggcaaatgact

SEQ ID NO: 2628714 - DNA, 16 bp, Homo sapiens
gaaggcaaatgacttt

SEQ ID NO: 2628715 - DNA, 13 bp, Homo sapiens
gaaggcaatgcca

SEQ ID NO: 2628716 - DNA, 15 bp, Homo sapiens
gaaggcagaaagcaa

SEQ ID NO: 2628717 - DNA, 17 bp, Homo sapiens
gaaggcagcaggtggca

SEQ ID NO: 2628718 - DNA, 13 bp, Homo sapiens
gaaggcaggaaga

SEQ ID NO: 2628719 - DNA, 14 bp, Homo sapiens
gaaggccccgccca

SEQ ID NO: 2628720 - DNA, 15 bp, Homo sapiens
gaaggccccgcccag

SEQ ID NO: 2628721 - DNA, 16 bp, Homo sapiens
gaaggccccgcccagg

SEQ ID NO: 2628722 - DNA, 20 bp, Homo sapiens
gaaggcctccctagccagca

SEQ ID NO: 2628723 - DNA, 17 bp, Homo sapiens
gaaggctcgagcatgcc

SEQ ID NO: 2628724 - DNA, 18 bp, Homo sapiens
gaaggctcttctccccag

SEQ ID NO: 2628725 - DNA, 21 bp, Homo sapiens
gaaggctcttctccccagagt

SEQ ID NO: 2628726 - DNA, 19 bp, Homo sapiens
gaaggctgggttctgatcc

SEQ ID NO: 2628727 - DNA, 15 bp, Homo sapiens
gaagggaccaaggca

SEQ ID NO: 2628728 - DNA, 21 bp, Homo sapiens
gaagggaccaaggcaaggcag

SEQ ID NO: 2628729 - DNA, 13 bp, Homo sapiens
gaagggaggctgg

SEQ ID NO: 2628730 - DNA, 14 bp, Homo sapiens
gaagggaggtgggg

SEQ ID NO: 2628731 - DNA, 22 bp, Homo sapiens
gaagggcaggaaggagagcctg

SEQ ID NO: 2628732 - DNA, 23 bp, Homo sapiens
gaagggcaggaaggagagcctgc

SEQ ID NO: 2628733 - DNA, 11 bp, Homo sapiens
gaagggccagt

SEQ ID NO: 2628734 - DNA, 14 bp, Homo sapiens
gaagggccagtcct

SEQ ID NO: 2628735 - DNA, 19 bp, Homo sapiens
gaagggccagtctgggctg

SEQ ID NO: 2628736 - DNA, 19 bp, Homo sapiens
gaagggctagaacctggag

SEQ ID NO: 2628737 - DNA, 22 bp, Homo sapiens
gaagggctagaacctggagagc

SEQ ID NO: 2628738 - DNA, 18 bp, Homo sapiens
gaaggggacccccgcccc

SEQ ID NO: 2628739 - DNA, 20 bp, Homo sapiens
gaaggggacccccgccccct

SEQ ID NO: 2628740 - DNA, 22 bp, Homo sapiens
gaaggggagataagggtatctg

SEQ ID NO: 2628741 - DNA, 16 bp, Homo sapiens
gaaggggccagaggct

SEQ ID NO: 2628742 - DNA, 23 bp, Homo sapiens
gaaggggccctggtccttccagg

SEQ ID NO: 2628743 - DNA, 21 bp, Homo sapiens
gaaggtcactcttcctgcaag

SEQ ID NO: 2628744 - DNA, 16 bp, Homo sapiens
gaaggtcctgctatta

SEQ ID NO: 2628745 - DNA, 14 bp, Homo sapiens
gaaggtcggaggct

SEQ ID NO: 2628746 - DNA, 15 bp, Homo sapiens
gaaggtcggaggctt

SEQ ID NO: 2628747 - DNA, 23 bp, Homo sapiens
gaaggtggtgggggtgcagatga

SEQ ID NO: 2628748 - DNA, 12 bp, Homo sapiens
gaaggttgtaag

SEQ ID NO: 2628749 - DNA, 20 bp, Homo sapiens
gaaggtttgtgtttttctgc

SEQ ID NO: 2628750 - DNA, 14 bp, Homo sapiens
gaagtaacagtaac

SEQ ID NO: 2628751 - DNA, 21 bp, Homo sapiens
gaagtacccgttcacattttt

SEQ ID NO: 2628752 - DNA, 13 bp, Homo sapiens
gaagtaggaagta

SEQ ID NO: 2628753 - DNA, 16 bp, Homo sapiens
gaagtattataaatta

SEQ ID NO: 2628754 - DNA, 13 bp, Homo sapiens
gaagtcagagagg

SEQ ID NO: 2628755 - DNA, 15 bp, Homo sapiens
gaagtcatgaagccc

SEQ ID NO: 2628756 - DNA, 19 bp, Homo sapiens
gaagtcatgaagcccaagt

SEQ ID NO: 2628757 - DNA, 17 bp, Homo sapiens
gaagtccccaggcccca

SEQ ID NO: 2628758 - DNA, 23 bp, Homo sapiens
gaagtccccaggccccaggaagc

SEQ ID NO: 2628759 - DNA, 22 bp, Homo sapiens
gaagtccccttccatcccagag

SEQ ID NO: 2628760 - DNA, 18 bp, Homo sapiens
gaagtcgtcttaactcac

SEQ ID NO: 2628761 - DNA, 16 bp, Homo sapiens
gaagtctctgaagtga

SEQ ID NO: 2628762 - DNA, 11 bp, Homo sapiens
gaagtctgaaa

SEQ ID NO: 2628763 - DNA, 15 bp, Homo sapiens
gaagtcttagatgta

SEQ ID NO: 2628764 - DNA, 23 bp, Homo sapiens
gaagtgacaaggccccagagact

SEQ ID NO: 2628765 - DNA, 18 bp, Homo sapiens
gaagtgacagggaagcta

SEQ ID NO: 2628766 - DNA, 22 bp, Homo sapiens
gaagtgacagggaagctacagg

SEQ ID NO: 2628767 - DNA, 15 bp, Homo sapiens
gaagtgactttggct

SEQ ID NO: 2628768 - DNA, 20 bp, Homo sapiens
gaagtgactttggctgcatg

SEQ ID NO: 2628769 - DNA, 23 bp, Homo sapiens
gaagtgcccctgctgcctcccca

SEQ ID NO: 2628770 - DNA, 21 bp, Homo sapiens
gaagtgcttagtgtacttgga

SEQ ID NO: 2628771 - DNA, 18 bp, Homo sapiens
gaagtggactggcccctg

SEQ ID NO: 2628772 - DNA, 17 bp, Homo sapiens
gaagtgtaacagctgag

SEQ ID NO: 2628773 - DNA, 23 bp, Homo sapiens
gaagtgtaacagctgaggtctct

SEQ ID NO: 2628774 - DNA, 18 bp, Homo sapiens
gaagtgtgggtctgtgtg

SEQ ID NO: 2628775 - DNA, 24 bp, Homo sapiens
gaagtgtgggtctgtgtgtgtgta

SEQ ID NO: 2628776 - DNA, 15 bp, Homo sapiens
gaagtgtgtttcctt

SEQ ID NO: 2628777 - DNA, 15 bp, Homo sapiens
gaagtgttgcatgga

SEQ ID NO: 2628778 - DNA, 20 bp, Homo sapiens
gaagttagaattccttcagg

SEQ ID NO: 2628779 - DNA, 15 bp, Homo sapiens
gaagttcaccattaa

SEQ ID NO: 2628780 - DNA, 19 bp, Homo sapiens
gaagttcaccattaaaagg

SEQ ID NO: 2628781 - DNA, 20 bp, Homo sapiens
gaagttgtgccttttatagc

SEQ ID NO: 2628782 - DNA, 18 bp, Homo sapiens
gaagtttaattgacttat

SEQ ID NO: 2628783 - DNA, 21 bp, Homo sapiens
gaagtttccttggctggtgca

SEQ ID NO: 2628784 - DNA, 13 bp, Homo sapiens
gaagttttcagga

SEQ ID NO: 2628785 - DNA, 19 bp, Homo sapiens
gaagtttttgtactgtaaa

SEQ ID NO: 2628786 - DNA, 23 bp, Homo sapiens
gaataaaatactatttttactgc

SEQ ID NO: 2628787 - DNA, 16 bp, Homo sapiens
gaataaactagattac

SEQ ID NO: 2628788 - DNA, 19 bp, Homo sapiens
gaataaactagattacatt

SEQ ID NO: 2628789 - DNA, 14 bp, Homo sapiens
gaataaagttgaag

SEQ ID NO: 2628790 - DNA, 22 bp, Homo sapiens
gaataaataaatgtatcttatt

SEQ ID NO: 2628791 - DNA, 11 bp, Homo sapiens
gaataaatatg

SEQ ID NO: 2628792 - DNA, 19 bp, Homo sapiens
gaataaatatgcctctcct

SEQ ID NO: 2628793 - DNA, 23 bp, Homo sapiens
cttgcccttccctgtccctctaa

SEQ ID NO: 2628794 - DNA, 15 bp, Homo sapiens
cttgcccttgccctg

SEQ ID NO: 2628795 - DNA, 16 bp, Homo sapiens
cttgcccttgccctga

SEQ ID NO: 2628796 - DNA, 18 bp, Homo sapiens
cttgccgcgtcgccctcc

SEQ ID NO: 2628797 - DNA, 23 bp, Homo sapiens
cttgccgtctacctgaggggcct

SEQ ID NO: 2628798 - DNA, 14 bp, Homo sapiens
cttgcctagggcct

SEQ ID NO: 2628799 - DNA, 20 bp, Homo sapiens
cttgcctagggcctggtcca

SEQ ID NO: 2628800 - DNA, 12 bp, Homo sapiens
cttgcctcctgg

SEQ ID NO: 2628801 - DNA, 16 bp, Homo sapiens
cttgcctgcacaaact

SEQ ID NO: 2628802 - DNA, 12 bp, Homo sapiens
cttgcctgcagg

SEQ ID NO: 2628803 - DNA, 13 bp, Homo sapiens
cttgcctgcaggc

SEQ ID NO: 2628804 - DNA, 15 bp, Homo sapiens
cttgctaatcagtgt

SEQ ID NO: 2628805 - DNA, 16 bp, Homo sapiens
cttgctaatcagtgtc

SEQ ID NO: 2628806 - DNA, 21 bp, Homo sapiens
cttgctaatcagtgtctcaca

SEQ ID NO: 2628807 - DNA, 22 bp, Homo sapiens
cttgctaatcagtgtctcacac

SEQ ID NO: 2628808 - DNA, 22 bp, Homo sapiens
cttgctctctggccttttccta

SEQ ID NO: 2628809 - DNA, 14 bp, Homo sapiens
cttgctctgcaccc

SEQ ID NO: 2628810 - DNA, 13 bp, Homo sapiens
cttgctctgctga

SEQ ID NO: 2628811 - DNA, 22 bp, Homo sapiens
cttgctctgctgacagacacag

SEQ ID NO: 2628812 - DNA, 19 bp, Homo sapiens
cttgctctttctactctga

SEQ ID NO: 2628813 - DNA, 17 bp, Homo sapiens
cttgctgagaggggctg

SEQ ID NO: 2628814 - DNA, 17 bp, Homo sapiens
cttgctggacggggact

SEQ ID NO: 2628815 - DNA, 21 bp, Homo sapiens
cttgctggacggggactgggg

SEQ ID NO: 2628816 - DNA, 22 bp, Homo sapiens
cttgctggacggggactgggga

SEQ ID NO: 2628817 - DNA, 23 bp, Homo sapiens
cttgctggggacggggggcccca

SEQ ID NO: 2628818 - DNA, 16 bp, Homo sapiens
cttgctgtatatgcag

SEQ ID NO: 2628819 - DNA, 18 bp, Homo sapiens
cttgctgttttgttctgt

SEQ ID NO: 2628820 - DNA, 14 bp, Homo sapiens
cttgcttggctgct

SEQ ID NO: 2628821 - DNA, 18 bp, Homo sapiens
cttgcttggctgcttggc

SEQ ID NO: 2628822 - DNA, 22 bp, Homo sapiens
cttgcttgttgggattcctgac

SEQ ID NO: 2628823 - DNA, 22 bp, Homo sapiens
cttggaaaaatccagaaagaaa

SEQ ID NO: 2628824 - DNA, 17 bp, Homo sapiens
cttggaaacctgccctg

SEQ ID NO: 2628825 - DNA, 18 bp, Homo sapiens
cttggaaacctgccctgc

SEQ ID NO: 2628826 - DNA, 16 bp, Homo sapiens
cttggacctctgctct

SEQ ID NO: 2628827 - DNA, 14 bp, Homo sapiens
cttggactcttgct

SEQ ID NO: 2628828 - DNA, 18 bp, Homo sapiens
cttggactcttgctcttt

SEQ ID NO: 2628829 - DNA, 22 bp, Homo sapiens
cttggacttcttctcccccgcg

SEQ ID NO: 2628830 - DNA, 21 bp, Homo sapiens
cttggagccccagtgccaagc

SEQ ID NO: 2628831 - DNA, 13 bp, Homo sapiens
cttggaggaagga

SEQ ID NO: 2628832 - DNA, 17 bp, Homo sapiens
cttggagggtcccaagc

SEQ ID NO: 2628833 - DNA, 19 bp, Homo sapiens
cttggagggtcccaagctg

SEQ ID NO: 2628834 - DNA, 21 bp, Homo sapiens
cttggagggtcccaagctggg

SEQ ID NO: 2628835 - DNA, 23 bp, Homo sapiens
cttggagggtcccaagctgggcc

SEQ ID NO: 2628836 - DNA, 13 bp, Homo sapiens
cttggattgtccc

SEQ ID NO: 2628837 - DNA, 18 bp, Homo sapiens
cttggattgtccccgacc

SEQ ID NO: 2628838 - DNA, 17 bp, Homo sapiens
cttggcatcagctggcg

SEQ ID NO: 2628839 - DNA, 17 bp, Homo sapiens
cttggcatgccttccag

SEQ ID NO: 2628840 - DNA, 17 bp, Homo sapiens
cttggccagaagggggc

SEQ ID NO: 2628841 - DNA, 17 bp, Homo sapiens
cttggcctgtctcatcc

SEQ ID NO: 2628842 - DNA, 23 bp, Homo sapiens
cttggcctgtctcatccccaggg

SEQ ID NO: 2628843 - DNA, 12 bp, Homo sapiens
cttggctgcagg

SEQ ID NO: 2628844 - DNA, 13 bp, Homo sapiens
cttggctgcaggg

SEQ ID NO: 2628845 - DNA, 22 bp, Homo sapiens
cttggctgtagaaggagacaga

SEQ ID NO: 2628846 - DNA, 12 bp, Homo sapiens
cttggctgtgag

SEQ ID NO: 2628847 - DNA, 21 bp, Homo sapiens
cttggctgtgaggcccctgga

SEQ ID NO: 2628848 - DNA, 20 bp, Homo sapiens
cttggcttcaggggagtccc

SEQ ID NO: 2628849 - DNA, 12 bp, Homo sapiens
cttgggaaatat

SEQ ID NO: 2628850 - DNA, 18 bp, Homo sapiens
cttgggaatggatcctgg

SEQ ID NO: 2628851 - DNA, 15 bp, Homo sapiens
cttgggactgggttt

SEQ ID NO: 2628852 - DNA, 21 bp, Homo sapiens
cttgggaggccccactgggga

SEQ ID NO: 2628853 - DNA, 15 bp, Homo sapiens
cttgggaggcttccc

SEQ ID NO: 2628854 - DNA, 16 bp, Homo sapiens
cttgggaggcttcccc

SEQ ID NO: 2628855 - DNA, 17 bp, Homo sapiens
cttgggccatagctcct

SEQ ID NO: 2628856 - DNA, 16 bp, Homo sapiens
cttgggcccagctggg

SEQ ID NO: 2628857 - DNA, 21 bp, Homo sapiens
cttgggcccagctgggctctg

SEQ ID NO: 2628858 - DNA, 14 bp, Homo sapiens
cttgggcggctgag

SEQ ID NO: 2628859 - DNA, 19 bp, Homo sapiens
cttgggcttccatttgtgt

SEQ ID NO: 2628860 - DNA, 23 bp, Homo sapiens
cttgggcttccatttgtgtgtgt

SEQ ID NO: 2628861 - DNA, 17 bp, Homo sapiens
cttggggaatttcctct

SEQ ID NO: 2628862 - DNA, 14 bp, Homo sapiens
cttggggcaggcag

SEQ ID NO: 2628863 - DNA, 15 bp, Homo sapiens
cttggggcaggcagt

SEQ ID NO: 2628864 - DNA, 18 bp, Homo sapiens
cttgggggacagggctgg

SEQ ID NO: 2628865 - DNA, 21 bp, Homo sapiens
cttgggggacagggctggccc

SEQ ID NO: 2628866 - DNA, 24 bp, Homo sapiens
cttgggggatgactagaggcaggg

SEQ ID NO: 2628867 - DNA, 15 bp, Homo sapiens
cttggggggctgagg

SEQ ID NO: 2628868 - DNA, 16 bp, Homo sapiens
cttggggggctgaggt

SEQ ID NO: 2628869 - DNA, 22 bp, Homo sapiens
cttggggggctgaggtgggagg

SEQ ID NO: 2628870 - DNA, 17 bp, Homo sapiens
cttgggtcccagggaag

SEQ ID NO: 2628871 - DNA, 18 bp, Homo sapiens
cttgggtggagaagccat

SEQ ID NO: 2628872 - DNA, 22 bp, Homo sapiens
cttgggtgtaacaggtctcctc

SEQ ID NO: 2628873 - DNA, 23 bp, Homo sapiens
cttgggttcaagtgattctcctg

SEQ ID NO: 2628874 - DNA, 23 bp, Homo sapiens
cttggtactactagatgtcttta

SEQ ID NO: 2628875 - DNA, 16 bp, Homo sapiens
cttggtcaccagctcc

SEQ ID NO: 2628876 - DNA, 15 bp, Homo sapiens
cttggtcctgctgca

SEQ ID NO: 2628877 - DNA, 22 bp, Homo sapiens
cttggtcctgctgcagttgcca

SEQ ID NO: 2628878 - DNA, 15 bp, Homo sapiens
cttggtcttatttat

SEQ ID NO: 2628879 - DNA, 16 bp, Homo sapiens
cttggtcttcccaggc

SEQ ID NO: 2628880 - DNA, 14 bp, Homo sapiens
cttggttcataaat

SEQ ID NO: 2628881 - DNA, 22 bp, Homo sapiens
cttggttcataaatgaatttta

SEQ ID NO: 2628882 - DNA, 16 bp, Homo sapiens
cttggttgaggaaaca

SEQ ID NO: 2628883 - DNA, 14 bp, Homo sapiens
cttggtttgtaaat

SEQ ID NO: 2628884 - DNA, 13 bp, Homo sapiens
cttgtaaatacac

SEQ ID NO: 2628885 - DNA, 18 bp, Homo sapiens
cttgtaaatagctcaggt

SEQ ID NO: 2628886 - DNA, 12 bp, Homo sapiens
cttgtaatttaa

SEQ ID NO: 2628887 - DNA, 19 bp, Homo sapiens
cttgtacataatgcgtgca

SEQ ID NO: 2628888 - DNA, 13 bp, Homo sapiens
cttgtacatgtgt

SEQ ID NO: 2628889 - DNA, 14 bp, Homo sapiens
cttgtacatgtgta

SEQ ID NO: 2628890 - DNA, 19 bp, Homo sapiens
cttgtacatgtgtagcctg

SEQ ID NO: 2628891 - DNA, 16 bp, Homo sapiens
cttgtatagtgtaaaa

SEQ ID NO: 2628892 - DNA, 21 bp, Homo sapiens
cttgtatgaaagatggctgtg

SEQ ID NO: 2628893 - DNA, 14 bp, Homo sapiens
cttgtcaaagaagg

SEQ ID NO: 2628894 - DNA, 19 bp, Homo sapiens
cttgtcaatatttaaacat

SEQ ID NO: 2628895 - DNA, 23 bp, Homo sapiens
cttgtcactggtagaccaaaata

SEQ ID NO: 2628896 - DNA, 14 bp, Homo sapiens
cttgtcatgtgaca

SEQ ID NO: 2628897 - DNA, 20 bp, Homo sapiens
cttgtccaacccgaggcccg

SEQ ID NO: 2628898 - DNA, 21 bp, Homo sapiens
cttgtcccactcaagccaagc

SEQ ID NO: 2628899 - DNA, 14 bp, Homo sapiens
cttgtccccaaatc

SEQ ID NO: 2628900 - DNA, 20 bp, Homo sapiens
cttgtccccacactcctaca

SEQ ID NO: 2628901 - DNA, 21 bp, Homo sapiens
cttgtcccctcctcactccct

SEQ ID NO: 2628902 - DNA, 18 bp, Homo sapiens
cttgtcctagcttgggag

SEQ ID NO: 2628903 - DNA, 17 bp, Homo sapiens
cttgtctatttttgtct

SEQ ID NO: 2628904 - DNA, 13 bp, Homo sapiens
cttgtctctgggc

SEQ ID NO: 2628905 - DNA, 23 bp, Homo sapiens
cttgtctgattggctcacccaag

SEQ ID NO: 2628906 - DNA, 13 bp, Homo sapiens
cttgtctttggac

SEQ ID NO: 2628907 - DNA, 20 bp, Homo sapiens
cttgtctttggaccctgagg

SEQ ID NO: 2628908 - DNA, 12 bp, Homo sapiens
cttgtgacatat

SEQ ID NO: 2628909 - DNA, 13 bp, Homo sapiens
cttgtgacccagc

SEQ ID NO: 2628910 - DNA, 15 bp, Homo sapiens
cttgtgcagtgttga

SEQ ID NO: 2628911 - DNA, 19 bp, Homo sapiens
cttgtgccatagtcacatg

SEQ ID NO: 2628912 - DNA, 13 bp, Homo sapiens
cttgtggacacag

SEQ ID NO: 2628913 - DNA, 16 bp, Homo sapiens
cttgtggacacagctc

SEQ ID NO: 2628914 - DNA, 17 bp, Homo sapiens
cttgtggacacagctct

SEQ ID NO: 2628915 - DNA, 14 bp, Homo sapiens
cttgtggagcccca

SEQ ID NO: 2628916 - DNA, 16 bp, Homo sapiens
cttgtggagccccaca

SEQ ID NO: 2628917 - DNA, 15 bp, Homo sapiens
cttgtggtcccaccc

SEQ ID NO: 2628918 - DNA, 15 bp, Homo sapiens
cttgtgtatccatta

SEQ ID NO: 2628919 - DNA, 15 bp, Homo sapiens
cttgtgtctctgtgc

SEQ ID NO: 2628920 - DNA, 20 bp, Homo sapiens
cttgtgtgtgggctgtgagt

SEQ ID NO: 2628921 - DNA, 11 bp, Homo sapiens
cttgtgtgttt

SEQ ID NO: 2628922 - DNA, 17 bp, Homo sapiens
cttgtgtgtttcacttt

SEQ ID NO: 2628923 - DNA, 18 bp, Homo sapiens
cttgtgtgtttcactttt

SEQ ID NO: 2628924 - DNA, 19 bp, Homo sapiens
cttgtgtgttttgagagta

SEQ ID NO: 2628925 - DNA, 22 bp, Homo sapiens
cttgtgtttttaactcaatatt

SEQ ID NO: 2628926 - DNA, 15 bp, Homo sapiens
cttgttatttataac

SEQ ID NO: 2628927 - DNA, 13 bp, Homo sapiens
cttgttccagctc

SEQ ID NO: 2628928 - DNA, 14 bp, Homo sapiens
cttgttccctctcc

SEQ ID NO: 2628929 - DNA, 20 bp, Homo sapiens
cttgttgctcaaaaaatgag

SEQ ID NO: 2628930 - DNA, 14 bp, Homo sapiens
cttgttggagcctg

SEQ ID NO: 2628931 - DNA, 21 bp, Homo sapiens
cttgttgggattcctgaccca

SEQ ID NO: 2628932 - DNA, 22 bp, Homo sapiens
cttgttgggattcctgacccag

SEQ ID NO: 2628933 - DNA, 12 bp, Homo sapiens
cttgtttcaatt

SEQ ID NO: 2628934 - DNA, 14 bp, Homo sapiens
cttgtttcttttca

SEQ ID NO: 2628935 - DNA, 19 bp, Homo sapiens
cttgtttgctcacctgggg

SEQ ID NO: 2628936 - DNA, 17 bp, Homo sapiens
cttgttttcttgccaat

SEQ ID NO: 2628937 - DNA, 18 bp, Homo sapiens
ctttaaaaaaatttaagt

SEQ ID NO: 2628938 - DNA, 13 bp, Homo sapiens
ctttaaactcagg

SEQ ID NO: 2628939 - DNA, 21 bp, Homo sapiens
ctttaaaggaaaaaatgttgg

SEQ ID NO: 2628940 - DNA, 14 bp, Homo sapiens
ctttaagacatact

SEQ ID NO: 2628941 - DNA, 20 bp, Homo sapiens
ctttaagcactacataaact

SEQ ID NO: 2628942 - DNA, 16 bp, Homo sapiens
ctttaagcagctcttg

SEQ ID NO: 2628943 - DNA, 17 bp, Homo sapiens
ctttaagtttcaggata

SEQ ID NO: 2628944 - DNA, 17 bp, Homo sapiens
ctttaatcttcagtttt

SEQ ID NO: 2628945 - DNA, 16 bp, Homo sapiens
ctttaatttatttttg

SEQ ID NO: 2628946 - DNA, 21 bp, Homo sapiens
ctttaatttatttttgcatgg

SEQ ID NO: 2628947 - DNA, 21 bp, Homo sapiens
ctttacaggtatttataatat

SEQ ID NO: 2628948 - DNA, 19 bp, Homo sapiens
ctttacatgcaatttatta

SEQ ID NO: 2628949 - DNA, 17 bp, Homo sapiens
ctttaccacccccacac

SEQ ID NO: 2628950 - DNA, 19 bp, Homo sapiens
ctttaccttttttatacat

SEQ ID NO: 2628951 - DNA, 20 bp, Homo sapiens
ctttaccttttttatacata

SEQ ID NO: 2628952 - DNA, 22 bp, Homo sapiens
ctttaccttttttatacataaa

SEQ ID NO: 2628953 - DNA, 18 bp, Homo sapiens
ctttactaagatgacatt

SEQ ID NO: 2628954 - DNA, 12 bp, Homo sapiens
ctttactgtttg

SEQ ID NO: 2628955 - DNA, 14 bp, Homo sapiens
ctttacttttaaac

SEQ ID NO: 2628956 - DNA, 18 bp, Homo sapiens
ctttagagcattgccatt

SEQ ID NO: 2628957 - DNA, 23 bp, Homo sapiens
ctttagggactcaatttctcccc

SEQ ID NO: 2628958 - DNA, 19 bp, Homo sapiens
ctttagtacctgaaaagta

SEQ ID NO: 2628959 - DNA, 13 bp, Homo sapiens
ctttagtttttgt

SEQ ID NO: 2628960 - DNA, 15 bp, Homo sapiens
ctttatacaacagtg

SEQ ID NO: 2628961 - DNA, 18 bp, Homo sapiens
ctttatacaacagtgcta

SEQ ID NO: 2628962 - DNA, 20 bp, Homo sapiens
ctttatacaacagtgctaaa

SEQ ID NO: 2628963 - DNA, 22 bp, Homo sapiens
ctttatatgaagaaaatcactt

SEQ ID NO: 2628964 - DNA, 12 bp, Homo sapiens
ctttatatttag

SEQ ID NO: 2628965 - DNA, 22 bp, Homo sapiens
ctttatctaatacctctgtgtg

SEQ ID NO: 2628966 - DNA, 18 bp, Homo sapiens
ctttatctgttcttgcta

SEQ ID NO: 2628967 - DNA, 14 bp, Homo sapiens
ctttatcttgacat

SEQ ID NO: 2628968 - DNA, 22 bp, Homo sapiens
ctttatgaatgaaaaaacagtc

SEQ ID NO: 2628969 - DNA, 16 bp, Homo sapiens
ctttatggtaaagatg

SEQ ID NO: 2628970 - DNA, 14 bp, Homo sapiens
ctttatgtgtaaat

SEQ ID NO: 2628971 - DNA, 14 bp, Homo sapiens
ctttattgtgatct

SEQ ID NO: 2628972 - DNA, 11 bp, Homo sapiens
ctttattttct

SEQ ID NO: 2628973 - DNA, 18 bp, Homo sapiens
ctttattttctggtagat

SEQ ID NO: 2628974 - DNA, 23 bp, Homo sapiens
ctttattttttaagtatttatat

SEQ ID NO: 2628975 - DNA, 19 bp, Homo sapiens
ctttcaaaaccttttgaaa

SEQ ID NO: 2628976 - DNA, 18 bp, Homo sapiens
ctttcaaagaaggaattc

SEQ ID NO: 2628977 - DNA, 14 bp, Homo sapiens
ctttcaaatttcac

SEQ ID NO: 2628978 - DNA, 14 bp, Homo sapiens
ctttcaacttgcat

SEQ ID NO: 2628979 - DNA, 20 bp, Homo sapiens
ctttcacaaaattttattcc

SEQ ID NO: 2628980 - DNA, 16 bp, Homo sapiens
ctttcacacttccacc

SEQ ID NO: 2628981 - DNA, 23 bp, Homo sapiens
ctttcacacttccaccagcctgc

SEQ ID NO: 2628982 - DNA, 14 bp, Homo sapiens
ctttcacagctcct

SEQ ID NO: 2628983 - DNA, 12 bp, Homo sapiens
ctcattcctgta

SEQ ID NO: 2628984 - DNA, 22 bp, Homo sapiens
ctcattctccttgtgttactaa

SEQ ID NO: 2628985 - DNA, 18 bp, Homo sapiens
ctcattgacaagaactga

SEQ ID NO: 2628986 - DNA, 13 bp, Homo sapiens
ctcattgacctga

SEQ ID NO: 2628987 - DNA, 15 bp, Homo sapiens
ctcattgacctgagg

SEQ ID NO: 2628988 - DNA, 16 bp, Homo sapiens
ctcattgacctgaggc

SEQ ID NO: 2628989 - DNA, 17 bp, Homo sapiens
ctcattgacctgaggcc

SEQ ID NO: 2628990 - DNA, 19 bp, Homo sapiens
ctcattgacctgaggccct

SEQ ID NO: 2628991 - DNA, 20 bp, Homo sapiens
ctcatttggggtagctagag

SEQ ID NO: 2628992 - DNA, 18 bp, Homo sapiens
ctcatttgtcacacactt

SEQ ID NO: 2628993 - DNA, 15 bp, Homo sapiens
ctccaaaataaaact

SEQ ID NO: 2628994 - DNA, 16 bp, Homo sapiens
ctccaaaataaaactt

SEQ ID NO: 2628995 - DNA, 12 bp, Homo sapiens
ctccaaagaaat

SEQ ID NO: 2628996 - DNA, 13 bp, Homo sapiens
ctccaaagaaatg

SEQ ID NO: 2628997 - DNA, 23 bp, Homo sapiens
ctccaaagaggtgactgggccct

SEQ ID NO: 2628998 - DNA, 15 bp, Homo sapiens
ctccaaatgagatct

SEQ ID NO: 2628999 - DNA, 12 bp, Homo sapiens
ctccaaatgctg

SEQ ID NO: 2629000 - DNA, 16 bp, Homo sapiens
ctccaagaatgctgaa

SEQ ID NO: 2629001 - DNA, 15 bp, Homo sapiens
ctccaagaccttctc

SEQ ID NO: 2629002 - DNA, 21 bp, Homo sapiens
ctccaagaccttctccttcac

SEQ ID NO: 2629003 - DNA, 13 bp, Homo sapiens
ctccaagcaggac

SEQ ID NO: 2629004 - DNA, 19 bp, Homo sapiens
ctccaaggaggggctgtaa

SEQ ID NO: 2629005 - DNA, 21 bp, Homo sapiens
ctccaaggaggggctgtaaaa

SEQ ID NO: 2629006 - DNA, 20 bp, Homo sapiens
ctccaagggcttctgcaccc

SEQ ID NO: 2629007 - DNA, 20 bp, Homo sapiens
ctccaagtgccagaggtggg

SEQ ID NO: 2629008 - DNA, 22 bp, Homo sapiens
ctccaagtgccagaggtgggca

SEQ ID NO: 2629009 - DNA, 15 bp, Homo sapiens
ctccacagccgcagc

SEQ ID NO: 2629010 - DNA, 21 bp, Homo sapiens
ctccacagttcgacctgcggc

SEQ ID NO: 2629011 - DNA, 14 bp, Homo sapiens
ctccacatcctcca

SEQ ID NO: 2629012 - DNA, 17 bp, Homo sapiens
ctccacatcctccacgt

SEQ ID NO: 2629013 - DNA, 23 bp, Homo sapiens
ctccaccaccactggccaccagg

SEQ ID NO: 2629014 - DNA, 14 bp, Homo sapiens
ctccacccccagct

SEQ ID NO: 2629015 - DNA, 16 bp, Homo sapiens
ctccaccctctgagct

SEQ ID NO: 2629016 - DNA, 17 bp, Homo sapiens
ctccaccctctgagctt

SEQ ID NO: 2629017 - DNA, 15 bp, Homo sapiens
ctccaccctgctctc

SEQ ID NO: 2629018 - DNA, 13 bp, Homo sapiens
ctccaccctgtcc

SEQ ID NO: 2629019 - DNA, 14 bp, Homo sapiens
ctccaccctgtccc

SEQ ID NO: 2629020 - DNA, 20 bp, Homo sapiens
ctccaccctgtcccccagct

SEQ ID NO: 2629021 - DNA, 17 bp, Homo sapiens
ctccacctgccagggac

SEQ ID NO: 2629022 - DNA, 18 bp, Homo sapiens
ctccacctgctcccaggc

SEQ ID NO: 2629023 - DNA, 17 bp, Homo sapiens
ctccacgttctgctcat

SEQ ID NO: 2629024 - DNA, 16 bp, Homo sapiens
ctccactgtcacattg

SEQ ID NO: 2629025 - DNA, 13 bp, Homo sapiens
ctccactgtcacc

SEQ ID NO: 2629026 - DNA, 15 bp, Homo sapiens
ctccagaaacggcca

SEQ ID NO: 2629027 - DNA, 22 bp, Homo sapiens
ctccagaaatgtctaaatgctg

SEQ ID NO: 2629028 - DNA, 21 bp, Homo sapiens
ctccagaatctaaagccagtg

SEQ ID NO: 2629029 - DNA, 19 bp, Homo sapiens
ctccagacacatgtccaag

SEQ ID NO: 2629030 - DNA, 13 bp, Homo sapiens
ctccagactctct

SEQ ID NO: 2629031 - DNA, 16 bp, Homo sapiens
ctccagactctctgtg

SEQ ID NO: 2629032 - DNA, 13 bp, Homo sapiens
ctccagagggcac

SEQ ID NO: 2629033 - DNA, 21 bp, Homo sapiens
ctccagagggcactctgcttg

SEQ ID NO: 2629034 - DNA, 21 bp, Homo sapiens
ctccagatagctcatttcatt

SEQ ID NO: 2629035 - DNA, 21 bp, Homo sapiens
ctccagccaacccctgtggag

SEQ ID NO: 2629036 - DNA, 11 bp, Homo sapiens
ctccagccagc

SEQ ID NO: 2629037 - DNA, 24 bp, Homo sapiens
ctccagccagcaatgatgtccaga

SEQ ID NO: 2629038 - DNA, 16 bp, Homo sapiens
ctccagcccctggatg

SEQ ID NO: 2629039 - DNA, 14 bp, Homo sapiens
ctccagcctgagca

SEQ ID NO: 2629040 - DNA, 13 bp, Homo sapiens
ctccagcctggct

SEQ ID NO: 2629041 - DNA, 14 bp, Homo sapiens
ctccagcctgggca

SEQ ID NO: 2629042 - DNA, 16 bp, Homo sapiens
ctccagctcaccagcc

SEQ ID NO: 2629043 - DNA, 21 bp, Homo sapiens
ctccagctccaagacctgttg

SEQ ID NO: 2629044 - DNA, 15 bp, Homo sapiens
ctccagctgggctct

SEQ ID NO: 2629045 - DNA, 13 bp, Homo sapiens
ctccagctgttca

SEQ ID NO: 2629046 - DNA, 18 bp, Homo sapiens
ctccagctgttcagctgg

SEQ ID NO: 2629047 - DNA, 19 bp, Homo sapiens
ctccagctgttcagctggt

SEQ ID NO: 2629048 - DNA, 11 bp, Homo sapiens
ctccagcttct

SEQ ID NO: 2629049 - DNA, 13 bp, Homo sapiens
ctccagcttctgg

SEQ ID NO: 2629050 - DNA, 14 bp, Homo sapiens
ctccaggagaggag

SEQ ID NO: 2629051 - DNA, 23 bp, Homo sapiens
ctccaggagcagccacattcctg

SEQ ID NO: 2629052 - DNA, 20 bp, Homo sapiens
ctccaggcacccttctttcc

SEQ ID NO: 2629053 - DNA, 21 bp, Homo sapiens
ctccaggcacccttctttcct

SEQ ID NO: 2629054 - DNA, 13 bp, Homo sapiens
ctccaggcaggct

SEQ ID NO: 2629055 - DNA, 15 bp, Homo sapiens
ctccaggcaggctaa

SEQ ID NO: 2629056 - DNA, 13 bp, Homo sapiens
ctccaggcgccgg

SEQ ID NO: 2629057 - DNA, 17 bp, Homo sapiens
ctccaggctgtctttca

SEQ ID NO: 2629058 - DNA, 17 bp, Homo sapiens
ctccagggagtcccctc

SEQ ID NO: 2629059 - DNA, 16 bp, Homo sapiens
ctccaggtctcacggg

SEQ ID NO: 2629060 - DNA, 17 bp, Homo sapiens
ctccaggtctcacgggc

SEQ ID NO: 2629061 - DNA, 19 bp, Homo sapiens
ctccaggtgcacaagctcc

SEQ ID NO: 2629062 - DNA, 15 bp, Homo sapiens
ctccaggtttttcaa

SEQ ID NO: 2629063 - DNA, 19 bp, Homo sapiens
ctccaggtttttcaattaa

SEQ ID NO: 2629064 - DNA, 20 bp, Homo sapiens
ctccaggtttttcaattaaa

SEQ ID NO: 2629065 - DNA, 23 bp, Homo sapiens
ctccaggtttttcaattaaacgg

SEQ ID NO: 2629066 - DNA, 15 bp, Homo sapiens
ctccagtctgctgcc

SEQ ID NO: 2629067 - DNA, 14 bp, Homo sapiens
ctccagtgccaaca

SEQ ID NO: 2629068 - DNA, 19 bp, Homo sapiens
ctccagtggttgctgttga

SEQ ID NO: 2629069 - DNA, 18 bp, Homo sapiens
ctccatcagttagagctg

SEQ ID NO: 2629070 - DNA, 9 bp, Homo sapiens
ctccatctc

SEQ ID NO: 2629071 - DNA, 23 bp, Homo sapiens
ctccatctcatgtatcatctgga

SEQ ID NO: 2629072 - DNA, 13 bp, Homo sapiens
ctccatctctctg

SEQ ID NO: 2629073 - DNA, 19 bp, Homo sapiens
ctccatcttcagcttcttc

SEQ ID NO: 2629074 - DNA, 21 bp, Homo sapiens
ctccatgagacacatctcctc

SEQ ID NO: 2629075 - DNA, 13 bp, Homo sapiens
ctccatgctgcct

SEQ ID NO: 2629076 - DNA, 20 bp, Homo sapiens
ctccatggcttcctcctccc

SEQ ID NO: 2629077 - DNA, 21 bp, Homo sapiens
ctccatggcttcctcctccct

SEQ ID NO: 2629078 - DNA, 24 bp, Homo sapiens
ctccattcccgtggaacgtttttc

SEQ ID NO: 2629079 - DNA, 14 bp, Homo sapiens
ctccattctgacca

SEQ ID NO: 2629080 - DNA, 22 bp, Homo sapiens
ctcccaaggggcccaaattctt

SEQ ID NO: 2629081 - DNA, 13 bp, Homo sapiens
ctcccaagtggtg

SEQ ID NO: 2629082 - DNA, 16 bp, Homo sapiens
ctcccaagtggtgcct

SEQ ID NO: 2629083 - DNA, 16 bp, Homo sapiens
ctcccacaggcagctt

SEQ ID NO: 2629084 - DNA, 14 bp, Homo sapiens
ctcccaccaggcta

SEQ ID NO: 2629085 - DNA, 19 bp, Homo sapiens
ctcccacccccatctctcc

SEQ ID NO: 2629086 - DNA, 15 bp, Homo sapiens
ctcccacccgatgct

SEQ ID NO: 2629087 - DNA, 20 bp, Homo sapiens
ctcccacccgatgctgcttt

SEQ ID NO: 2629088 - DNA, 14 bp, Homo sapiens
ctcccacctcagcc

SEQ ID NO: 2629089 - DNA, 23 bp, Homo sapiens
ctcccactggggtccagggagca

SEQ ID NO: 2629090 - DNA, 19 bp, Homo sapiens
ctcccagcagccctaagga

SEQ ID NO: 2629091 - DNA, 21 bp, Homo sapiens
ctcccagccctatggatgtgg

SEQ ID NO: 2629092 - DNA, 20 bp, Homo sapiens
ctcccagctctagacaaccc

SEQ ID NO: 2629093 - DNA, 11 bp, Homo sapiens
ctcccaggaac

SEQ ID NO: 2629094 - DNA, 19 bp, Homo sapiens
ctcccaggagacagttcaa

SEQ ID NO: 2629095 - DNA, 17 bp, Homo sapiens
ctcccaggcattcccca

SEQ ID NO: 2629096 - DNA, 19 bp, Homo sapiens
ctcccaggcattccccagg

SEQ ID NO: 2629097 - DNA, 21 bp, Homo sapiens
ctcccaggccgagaagccagt

SEQ ID NO: 2629098 - DNA, 13 bp, Homo sapiens
ctcccaggctctc

SEQ ID NO: 2629099 - DNA, 16 bp, Homo sapiens
ctcccagtctacccag

SEQ ID NO: 2629100 - DNA, 20 bp, Homo sapiens
ctcccataaccgctgattct

SEQ ID NO: 2629101 - DNA, 14 bp, Homo sapiens
ctcccatcacccgc

SEQ ID NO: 2629102 - DNA, 17 bp, Homo sapiens
ctcccatccccctgccc

SEQ ID NO: 2629103 - DNA, 18 bp, Homo sapiens
ctcccatccccctgccct

SEQ ID NO: 2629104 - DNA, 19 bp, Homo sapiens
ctcccatccccctgccctc

SEQ ID NO: 2629105 - DNA, 13 bp, Homo sapiens
ctcccatcccctg

SEQ ID NO: 2629106 - DNA, 14 bp, Homo sapiens
ctcccatctcacac

SEQ ID NO: 2629107 - DNA, 18 bp, Homo sapiens
ctcccatctcacacatga

SEQ ID NO: 2629108 - DNA, 21 bp, Homo sapiens
ctcccatctcacacatgagca

SEQ ID NO: 2629109 - DNA, 12 bp, Homo sapiens
ctcccatctggg

SEQ ID NO: 2629110 - DNA, 15 bp, Homo sapiens
ctcccatctgtgaaa

SEQ ID NO: 2629111 - DNA, 20 bp, Homo sapiens
ctccccacggccgctccagg

SEQ ID NO: 2629112 - DNA, 21 bp, Homo sapiens
ctccccacggccgctccaggg

SEQ ID NO: 2629113 - DNA, 13 bp, Homo sapiens
ctccccactctag

SEQ ID NO: 2629114 - DNA, 22 bp, Homo sapiens
ctccccagcaagtgagagctgg

SEQ ID NO: 2629115 - DNA, 23 bp, Homo sapiens
ctccccagcaagtgagagctggg

SEQ ID NO: 2629116 - DNA, 22 bp, Homo sapiens
ctccccagcccagggttccccc

SEQ ID NO: 2629117 - DNA, 12 bp, Homo sapiens
ctccccaggcca

SEQ ID NO: 2629118 - DNA, 21 bp, Homo sapiens
ctccccaggccaggccaccag

SEQ ID NO: 2629119 - DNA, 11 bp, Homo sapiens
ctccccagttc

SEQ ID NO: 2629120 - DNA, 14 bp, Homo sapiens
ctccccatcccatg

SEQ ID NO: 2629121 - DNA, 14 bp, Homo sapiens
ctccccatgtgtcc

SEQ ID NO: 2629122 - DNA, 20 bp, Homo sapiens
ctcccccagccccatcctct

SEQ ID NO: 2629123 - DNA, 22 bp, Homo sapiens
ctcccccagccccatcctctgt

SEQ ID NO: 2629124 - DNA, 11 bp, Homo sapiens
ctcccccatcc

SEQ ID NO: 2629125 - DNA, 16 bp, Homo sapiens
ctcccccccccctcca

SEQ ID NO: 2629126 - DNA, 14 bp, Homo sapiens
ctcccccgccactc

SEQ ID NO: 2629127 - DNA, 11 bp, Homo sapiens
ctccccctgcc

SEQ ID NO: 2629128 - DNA, 12 bp, Homo sapiens
ctccccctgggc

SEQ ID NO: 2629129 - DNA, 13 bp, Homo sapiens
ctccccctgggct

SEQ ID NO: 2629130 - DNA, 14 bp, Homo sapiens
ctcccccttctccc

SEQ ID NO: 2629131 - DNA, 16 bp, Homo sapiens
ctccccggccctacca

SEQ ID NO: 2629132 - DNA, 15 bp, Homo sapiens
ctcccctaccactgt

SEQ ID NO: 2629133 - DNA, 10 bp, Homo sapiens
ctcccctcaa

SEQ ID NO: 2629134 - DNA, 19 bp, Homo sapiens
ctcccctccttgcctcctg

SEQ ID NO: 2629135 - DNA, 22 bp, Homo sapiens
ctgagcccccccaacactgtgc

SEQ ID NO: 2629136 - DNA, 13 bp, Homo sapiens
ctgagccccttcc

SEQ ID NO: 2629137 - DNA, 12 bp, Homo sapiens
ctgagccctggc

SEQ ID NO: 2629138 - DNA, 13 bp, Homo sapiens
ctgagccctggca

SEQ ID NO: 2629139 - DNA, 15 bp, Homo sapiens
ctgagccctggcagg

SEQ ID NO: 2629140 - DNA, 21 bp, Homo sapiens
ctgagcctctcacctgtactc

SEQ ID NO: 2629141 - DNA, 17 bp, Homo sapiens
ctgagccttcagtcttg

SEQ ID NO: 2629142 - DNA, 15 bp, Homo sapiens
ctgagccttgtaatt

SEQ ID NO: 2629143 - DNA, 20 bp, Homo sapiens
ctgagcgacagtgagactct

SEQ ID NO: 2629144 - DNA, 19 bp, Homo sapiens
ctgagctagaagctggagg

SEQ ID NO: 2629145 - DNA, 13 bp, Homo sapiens
ctgagctatttca

SEQ ID NO: 2629146 - DNA, 16 bp, Homo sapiens
ctgagctatttcatct

SEQ ID NO: 2629147 - DNA, 16 bp, Homo sapiens
ctgagctcctctgggc

SEQ ID NO: 2629148 - DNA, 17 bp, Homo sapiens
ctgagctcctctgggca

SEQ ID NO: 2629149 - DNA, 20 bp, Homo sapiens
ctgagctcggtggacccagg

SEQ ID NO: 2629150 - DNA, 13 bp, Homo sapiens
ctgagctgaggca

SEQ ID NO: 2629151 - DNA, 15 bp, Homo sapiens
ctgagctgaggcagc

SEQ ID NO: 2629152 - DNA, 16 bp, Homo sapiens
ctgagcttctctgtga

SEQ ID NO: 2629153 - DNA, 16 bp, Homo sapiens
ctgaggaaaggccagc

SEQ ID NO: 2629154 - DNA, 23 bp, Homo sapiens
ctgaggaagagggactgttcttt

SEQ ID NO: 2629155 - DNA, 14 bp, Homo sapiens
ctgaggacagctgt

SEQ ID NO: 2629156 - DNA, 17 bp, Homo sapiens
ctgaggacattccaaga

SEQ ID NO: 2629157 - DNA, 14 bp, Homo sapiens
ctgaggaccagcca

SEQ ID NO: 2629158 - DNA, 15 bp, Homo sapiens
ctgaggaggcctcca

SEQ ID NO: 2629159 - DNA, 19 bp, Homo sapiens
ctgaggaggcctccatctc

SEQ ID NO: 2629160 - DNA, 13 bp, Homo sapiens
ctgaggatgagct

SEQ ID NO: 2629161 - DNA, 16 bp, Homo sapiens
ctgaggatgagctgga

SEQ ID NO: 2629162 - DNA, 14 bp, Homo sapiens
ctgaggatttcaag

SEQ ID NO: 2629163 - DNA, 13 bp, Homo sapiens
ctgaggcagacag

SEQ ID NO: 2629164 - DNA, 17 bp, Homo sapiens
ctgaggcagcagtgtga

SEQ ID NO: 2629165 - DNA, 13 bp, Homo sapiens
ctgaggcccagag

SEQ ID NO: 2629166 - DNA, 16 bp, Homo sapiens
ctgaggcccagagggc

SEQ ID NO: 2629167 - DNA, 21 bp, Homo sapiens
ctgaggcccagagggcctgca

SEQ ID NO: 2629168 - DNA, 23 bp, Homo sapiens
ctgaggcccagagggcctgcaag

SEQ ID NO: 2629169 - DNA, 21 bp, Homo sapiens
ctgaggccccttctaggtggc

SEQ ID NO: 2629170 - DNA, 14 bp, Homo sapiens
ctgaggcccttctc

SEQ ID NO: 2629171 - DNA, 17 bp, Homo sapiens
ctgaggcgggagaatca

SEQ ID NO: 2629172 - DNA, 18 bp, Homo sapiens
ctgaggctctttctgggc

SEQ ID NO: 2629173 - DNA, 22 bp, Homo sapiens
ctgaggctgggctcccttccca

SEQ ID NO: 2629174 - DNA, 18 bp, Homo sapiens
ctgaggcttccagagagt

SEQ ID NO: 2629175 - DNA, 23 bp, Homo sapiens
ctgagggaaagcccagaaaagga

SEQ ID NO: 2629176 - DNA, 21 bp, Homo sapiens
ctgagggactctgaagcctct

SEQ ID NO: 2629177 - DNA, 12 bp, Homo sapiens
ctgagggagcct

SEQ ID NO: 2629178 - DNA, 17 bp, Homo sapiens
ctgagggagcctggccc

SEQ ID NO: 2629179 - DNA, 15 bp, Homo sapiens
ctgagggaggaggcc

SEQ ID NO: 2629180 - DNA, 21 bp, Homo sapiens
ctgagggaggaggccacctct

SEQ ID NO: 2629181 - DNA, 15 bp, Homo sapiens
ctgagggatctttac

SEQ ID NO: 2629182 - DNA, 23 bp, Homo sapiens
ctgagggcagaaaggttctgccc

SEQ ID NO: 2629183 - DNA, 15 bp, Homo sapiens
ctgagggccacacta

SEQ ID NO: 2629184 - DNA, 17 bp, Homo sapiens
ctgagggcccctctgcc

SEQ ID NO: 2629185 - DNA, 16 bp, Homo sapiens
ctgaggggcatctgcc

SEQ ID NO: 2629186 - DNA, 14 bp, Homo sapiens
ctgaggggcctctt

SEQ ID NO: 2629187 - DNA, 20 bp, Homo sapiens
ctgaggggggccgtgcccag

SEQ ID NO: 2629188 - DNA, 15 bp, Homo sapiens
ctgagggtccccacc

SEQ ID NO: 2629189 - DNA, 15 bp, Homo sapiens
ctgagggtggagact

SEQ ID NO: 2629190 - DNA, 20 bp, Homo sapiens
ctgagggtggagactaagcc

SEQ ID NO: 2629191 - DNA, 16 bp, Homo sapiens
ctgaggtctcttgagg

SEQ ID NO: 2629192 - DNA, 17 bp, Homo sapiens
ctgaggtgaaagggagc

SEQ ID NO: 2629193 - DNA, 19 bp, Homo sapiens
ctgaggtgaaagggagcta

SEQ ID NO: 2629194 - DNA, 17 bp, Homo sapiens
ctgaggtgcctgtccca

SEQ ID NO: 2629195 - DNA, 16 bp, Homo sapiens
ctgaggtgggcccagg

SEQ ID NO: 2629196 - DNA, 18 bp, Homo sapiens
ctgaggtgtgggggctgc

SEQ ID NO: 2629197 - DNA, 20 bp, Homo sapiens
ctgagtaagaaatgctgccc

SEQ ID NO: 2629198 - DNA, 20 bp, Homo sapiens
ctgagtagctggattacagg

SEQ ID NO: 2629199 - DNA, 14 bp, Homo sapiens
ctgagtagctggga

SEQ ID NO: 2629200 - DNA, 17 bp, Homo sapiens
ctgagtcgtacagaaag

SEQ ID NO: 2629201 - DNA, 23 bp, Homo sapiens
ctgagtcgtacagaaagctgcct

SEQ ID NO: 2629202 - DNA, 14 bp, Homo sapiens
ctgagtctcctgtg

SEQ ID NO: 2629203 - DNA, 14 bp, Homo sapiens
ctgagtctgaaggc

SEQ ID NO: 2629204 - DNA, 17 bp, Homo sapiens
ctgagtctgaaggctgg

SEQ ID NO: 2629205 - DNA, 19 bp, Homo sapiens
ctgagtctgaaggctgggt

SEQ ID NO: 2629206 - DNA, 13 bp, Homo sapiens
ctgagtgcctggc

SEQ ID NO: 2629207 - DNA, 21 bp, Homo sapiens
ctgagtggactggagtggagc

SEQ ID NO: 2629208 - DNA, 18 bp, Homo sapiens
ctgagtggatctccaagg

SEQ ID NO: 2629209 - DNA, 21 bp, Homo sapiens
ctgagttggtgttgacatgtg

SEQ ID NO: 2629210 - DNA, 19 bp, Homo sapiens
ctgagtttcattctcctgc

SEQ ID NO: 2629211 - DNA, 23 bp, Homo sapiens
ctgataaaaccatgtagaaaatt

SEQ ID NO: 2629212 - DNA, 14 bp, Homo sapiens
ctgataaagaaaga

SEQ ID NO: 2629213 - DNA, 21 bp, Homo sapiens
ctgatagttactgttgtgacc

SEQ ID NO: 2629214 - DNA, 15 bp, Homo sapiens
ctgatatatgtgttt

SEQ ID NO: 2629215 - DNA, 16 bp, Homo sapiens
ctgatatattttacaa

SEQ ID NO: 2629216 - DNA, 21 bp, Homo sapiens
ctgatatgatttaaaacatgt

SEQ ID NO: 2629217 - DNA, 19 bp, Homo sapiens
ctgatattccatgaatgta

SEQ ID NO: 2629218 - DNA, 22 bp, Homo sapiens
ctgatattgccgcactagggga

SEQ ID NO: 2629219 - DNA, 17 bp, Homo sapiens
ctgatattttacctctt

SEQ ID NO: 2629220 - DNA, 22 bp, Homo sapiens
ctgatcaagtcaccggagcttt

SEQ ID NO: 2629221 - DNA, 15 bp, Homo sapiens
ctgatcatgcattgt

SEQ ID NO: 2629222 - DNA, 15 bp, Homo sapiens
ctgatccagagcaca

SEQ ID NO: 2629223 - DNA, 20 bp, Homo sapiens
ctgatcctagttccaccatc

SEQ ID NO: 2629224 - DNA, 21 bp, Homo sapiens
ctgatcctagttccaccatca

SEQ ID NO: 2629225 - DNA, 23 bp, Homo sapiens
ctgatcctgtgaagtaaggatgt

SEQ ID NO: 2629226 - DNA, 20 bp, Homo sapiens
ctgatcgccaacctttcccc

SEQ ID NO: 2629227 - DNA, 21 bp, Homo sapiens
ctgatcgtgctaaattttcag

SEQ ID NO: 2629228 - DNA, 13 bp, Homo sapiens
ctgatctggtttg

SEQ ID NO: 2629229 - DNA, 22 bp, Homo sapiens
ctgatctgtgctttccagctca

SEQ ID NO: 2629230 - DNA, 12 bp, Homo sapiens
ctgatgctccct

SEQ ID NO: 2629231 - DNA, 18 bp, Homo sapiens
ctgatgctccctcccctg

SEQ ID NO: 2629232 - DNA, 21 bp, Homo sapiens
ctgatgctccctcccctgccc

SEQ ID NO: 2629233 - DNA, 23 bp, Homo sapiens
ctgatgctccctcccctgccctg

SEQ ID NO: 2629234 - DNA, 24 bp, Homo sapiens
ctgatgctccctcccctgccctgg

SEQ ID NO: 2629235 - DNA, 20 bp, Homo sapiens
ctgatgcttcttcagagact

SEQ ID NO: 2629236 - DNA, 22 bp, Homo sapiens
ctgatgctttgcttcaaatcca

SEQ ID NO: 2629237 - DNA, 15 bp, Homo sapiens
ctgatggacctgtca

SEQ ID NO: 2629238 - DNA, 22 bp, Homo sapiens
ctgatggcacttagctatcaga

SEQ ID NO: 2629239 - DNA, 16 bp, Homo sapiens
ctgatggcaggatggc

SEQ ID NO: 2629240 - DNA, 17 bp, Homo sapiens
ctgatggcaggatggcc

SEQ ID NO: 2629241 - DNA, 19 bp, Homo sapiens
ctgatggcttctccagggt

SEQ ID NO: 2629242 - DNA, 18 bp, Homo sapiens
ctgatgggcaacccccag

SEQ ID NO: 2629243 - DNA, 24 bp, Homo sapiens
ctgatgggcaacccccagcctgct

SEQ ID NO: 2629244 - DNA, 14 bp, Homo sapiens
ctgatggtcagctc

SEQ ID NO: 2629245 - DNA, 15 bp, Homo sapiens
ctgatgttggaagag

SEQ ID NO: 2629246 - DNA, 16 bp, Homo sapiens
ctgattacacaaaaca

SEQ ID NO: 2629247 - DNA, 14 bp, Homo sapiens
ctgattacaccagc

SEQ ID NO: 2629248 - DNA, 13 bp, Homo sapiens
ctgattagaaatg

SEQ ID NO: 2629249 - DNA, 15 bp, Homo sapiens
ctgattcaactaaaa

SEQ ID NO: 2629250 - DNA, 18 bp, Homo sapiens
ctgattcaactaaaaaaa

SEQ ID NO: 2629251 - DNA, 13 bp, Homo sapiens
ctgattcactgca

SEQ ID NO: 2629252 - DNA, 18 bp, Homo sapiens
ctgattcactgcatggct

SEQ ID NO: 2629253 - DNA, 15 bp, Homo sapiens
ctgattcccaagctc

SEQ ID NO: 2629254 - DNA, 14 bp, Homo sapiens
ctgattggctcacc

SEQ ID NO: 2629255 - DNA, 21 bp, Homo sapiens
ctgattgtgtctcttggtcct

SEQ ID NO: 2629256 - DNA, 14 bp, Homo sapiens
ctgatttcctttgg

SEQ ID NO: 2629257 - DNA, 20 bp, Homo sapiens
ctgcccagcttgggcccagc

SEQ ID NO: 2629258 - DNA, 13 bp, Homo sapiens
ctgcccaggcccc

SEQ ID NO: 2629259 - DNA, 14 bp, Homo sapiens
ctgcccaggcccct

SEQ ID NO: 2629260 - DNA, 15 bp, Homo sapiens
ctgcccaggcccctg

SEQ ID NO: 2629261 - DNA, 20 bp, Homo sapiens
ctgcccaggcccctgccacc

SEQ ID NO: 2629262 - DNA, 22 bp, Homo sapiens
ctgcccaggggagccctccacg

SEQ ID NO: 2629263 - DNA, 15 bp, Homo sapiens
ctgcccaggggtgcc

SEQ ID NO: 2629264 - DNA, 17 bp, Homo sapiens
ctgcccaggggtgcccc

SEQ ID NO: 2629265 - DNA, 18 bp, Homo sapiens
ctgcccatcacagggttg

SEQ ID NO: 2629266 - DNA, 21 bp, Homo sapiens
ctgcccatgtcgcgctcagca

SEQ ID NO: 2629267 - DNA, 16 bp, Homo sapiens
ctgccccagctctggc

SEQ ID NO: 2629268 - DNA, 18 bp, Homo sapiens
ctgccccagctctggctt

SEQ ID NO: 2629269 - DNA, 19 bp, Homo sapiens
ctgcccccaccacggccac

SEQ ID NO: 2629270 - DNA, 21 bp, Homo sapiens
ctgcccccacgagggtcagga

SEQ ID NO: 2629271 - DNA, 12 bp, Homo sapiens
ctgccccccagc

SEQ ID NO: 2629272 - DNA, 21 bp, Homo sapiens
ctgccccccagcctctggcat

SEQ ID NO: 2629273 - DNA, 18 bp, Homo sapiens
ctgcccccggccccctgg

SEQ ID NO: 2629274 - DNA, 18 bp, Homo sapiens
ctgccccctgaaacttat

SEQ ID NO: 2629275 - DNA, 20 bp, Homo sapiens
ctgccccctgaaacttattt

SEQ ID NO: 2629276 - DNA, 14 bp, Homo sapiens
ctgccccctgctgg

SEQ ID NO: 2629277 - DNA, 13 bp, Homo sapiens
ctgccccctggtg

SEQ ID NO: 2629278 - DNA, 16 bp, Homo sapiens
ctgcccccttctccca

SEQ ID NO: 2629279 - DNA, 18 bp, Homo sapiens
ctgcccccttctcccaca

SEQ ID NO: 2629280 - DNA, 21 bp, Homo sapiens
ctgccccgtcaccatctcagg

SEQ ID NO: 2629281 - DNA, 15 bp, Homo sapiens
ctgcccctcccagaa

SEQ ID NO: 2629282 - DNA, 22 bp, Homo sapiens
ctgcccctcccccaacccccac

SEQ ID NO: 2629283 - DNA, 17 bp, Homo sapiens
ctgcccctgccccgtca

SEQ ID NO: 2629284 - DNA, 13 bp, Homo sapiens
ctgcccctgttct

SEQ ID NO: 2629285 - DNA, 13 bp, Homo sapiens
ctgcccggcaggg

SEQ ID NO: 2629286 - DNA, 11 bp, Homo sapiens
ctgcccggctg

SEQ ID NO: 2629287 - DNA, 15 bp, Homo sapiens
ctgcccggctgcgga

SEQ ID NO: 2629288 - DNA, 21 bp, Homo sapiens
ctgcccgggaaggtcaccagc

SEQ ID NO: 2629289 - DNA, 19 bp, Homo sapiens
ctgcccgggcgcggccagc

SEQ ID NO: 2629290 - DNA, 23 bp, Homo sapiens
ctgcccggggcagctgccagaga

SEQ ID NO: 2629291 - DNA, 23 bp, Homo sapiens
ctgcccgtctctctcccatggag

SEQ ID NO: 2629292 - DNA, 15 bp, Homo sapiens
ctgccctagagcaca

SEQ ID NO: 2629293 - DNA, 16 bp, Homo sapiens
ctgccctagctccaca

SEQ ID NO: 2629294 - DNA, 12 bp, Homo sapiens
ctgccctcaggg

SEQ ID NO: 2629295 - DNA, 13 bp, Homo sapiens
ctgccctcaggga

SEQ ID NO: 2629296 - DNA, 19 bp, Homo sapiens
ctgccctcatggcccctct

SEQ ID NO: 2629297 - DNA, 20 bp, Homo sapiens
cggagcctcatccgaggcag

SEQ ID NO: 2629298 - DNA, 20 bp, Homo sapiens
cggagctaacactggcccct

SEQ ID NO: 2629299 - DNA, 21 bp, Homo sapiens
cggagctaacactggccccta

SEQ ID NO: 2629300 - DNA, 13 bp, Homo sapiens
cggagctggcccc

SEQ ID NO: 2629301 - DNA, 19 bp, Homo sapiens
cggaggccacatgagtccc

SEQ ID NO: 2629302 - DNA, 16 bp, Homo sapiens
cggaggctgcccccgg

SEQ ID NO: 2629303 - DNA, 22 bp, Homo sapiens
cggaggctgcccccggccccct

SEQ ID NO: 2629304 - DNA, 15 bp, Homo sapiens
cggaggcttgggacc

SEQ ID NO: 2629305 - DNA, 16 bp, Homo sapiens
cggaggcttgggaccg

SEQ ID NO: 2629306 - DNA, 18 bp, Homo sapiens
cggaggcttgtcagagct

SEQ ID NO: 2629307 - DNA, 19 bp, Homo sapiens
cggaggcttgtcagagctg

SEQ ID NO: 2629308 - DNA, 17 bp, Homo sapiens
cggagggattcccctaa

SEQ ID NO: 2629309 - DNA, 20 bp, Homo sapiens
cggagtccactcccagtgct

SEQ ID NO: 2629310 - DNA, 18 bp, Homo sapiens
cggagtcccaccttggct

SEQ ID NO: 2629311 - DNA, 23 bp, Homo sapiens
cggagtcccaccttggctgcagg

SEQ ID NO: 2629312 - DNA, 20 bp, Homo sapiens
cggagtgaagaggggcagcc

SEQ ID NO: 2629313 - DNA, 22 bp, Homo sapiens
cggagtgaagaggggcagccct

SEQ ID NO: 2629314 - DNA, 14 bp, Homo sapiens
cggatcctgggtgg

SEQ ID NO: 2629315 - DNA, 15 bp, Homo sapiens
cggatctgttgcaaa

SEQ ID NO: 2629316 - DNA, 22 bp, Homo sapiens
cggcaaccccagttctgctcct

SEQ ID NO: 2629317 - DNA, 13 bp, Homo sapiens
cggcagcagccat

SEQ ID NO: 2629318 - DNA, 13 bp, Homo sapiens
cggcatggctggg

SEQ ID NO: 2629319 - DNA, 14 bp, Homo sapiens
cggcatggctggga

SEQ ID NO: 2629320 - DNA, 15 bp, Homo sapiens
cggccacctgcggtg

SEQ ID NO: 2629321 - DNA, 11 bp, Homo sapiens
cggccaggcca

SEQ ID NO: 2629322 - DNA, 12 bp, Homo sapiens
cggccaggccag

SEQ ID NO: 2629323 - DNA, 24 bp, Homo sapiens
cggccaggccagagggagtgacag

SEQ ID NO: 2629324 - DNA, 21 bp, Homo sapiens
ctattgatgtacagtctgtca

SEQ ID NO: 2629325 - DNA, 21 bp, Homo sapiens
ctattgcaaaggttccaactg

SEQ ID NO: 2629326 - DNA, 11 bp, Homo sapiens
ctattggtaaa

SEQ ID NO: 2629327 - DNA, 14 bp, Homo sapiens
ctattgtaaatatg

SEQ ID NO: 2629328 - DNA, 17 bp, Homo sapiens
ctattgtaaatatgttt

SEQ ID NO: 2629329 - DNA, 14 bp, Homo sapiens
ctattgtagagcca

SEQ ID NO: 2629330 - DNA, 23 bp, Homo sapiens
ctattgtgatttgactgttttta

SEQ ID NO: 2629331 - DNA, 14 bp, Homo sapiens
ctattgtttattct

SEQ ID NO: 2629332 - DNA, 16 bp, Homo sapiens
ctatttaaaacttgta

SEQ ID NO: 2629333 - DNA, 17 bp, Homo sapiens
ctatttaaaacttgtaa

SEQ ID NO: 2629334 - DNA, 15 bp, Homo sapiens
ctatttaaagcctcc

SEQ ID NO: 2629335 - DNA, 14 bp, Homo sapiens
ctatttaatattta

SEQ ID NO: 2629336 - DNA, 12 bp, Homo sapiens
ctatttaatgga

SEQ ID NO: 2629337 - DNA, 21 bp, Homo sapiens
ctatttatctgtagtaaacta

SEQ ID NO: 2629338 - DNA, 14 bp, Homo sapiens
ctatttatttactg

SEQ ID NO: 2629339 - DNA, 15 bp, Homo sapiens
ctatttatttactga

SEQ ID NO: 2629340 - DNA, 17 bp, Homo sapiens
ctatttccattccagaa

SEQ ID NO: 2629341 - DNA, 15 bp, Homo sapiens
ctatttctatgagaa

SEQ ID NO: 2629342 - DNA, 13 bp, Homo sapiens
ctatttctgagaa

SEQ ID NO: 2629343 - DNA, 23 bp, Homo sapiens
ctatttctgagaaggtccttaat

SEQ ID NO: 2629344 - DNA, 17 bp, Homo sapiens
ctatttgtctttcagga

SEQ ID NO: 2629345 - DNA, 19 bp, Homo sapiens
ctattttgtaaactcaaaa

SEQ ID NO: 2629346 - DNA, 19 bp, Homo sapiens
ctatttttactgccactct

SEQ ID NO: 2629347 - DNA, 14 bp, Homo sapiens
ctatttttcagaat

SEQ ID NO: 2629348 - DNA, 18 bp, Homo sapiens
ctatttttggcagtctga

SEQ ID NO: 2629349 - DNA, 12 bp, Homo sapiens
ctatttttgtag

SEQ ID NO: 2629350 - DNA, 13 bp, Homo sapiens
ctatttttgtaga

SEQ ID NO: 2629351 - DNA, 19 bp, Homo sapiens
ctcaaaacccatctgggct

SEQ ID NO: 2629352 - DNA, 13 bp, Homo sapiens
ctcaaaactgcac

SEQ ID NO: 2629353 - DNA, 17 bp, Homo sapiens
ctcaaaactgcactgtc

SEQ ID NO: 2629354 - DNA, 20 bp, Homo sapiens
ctcaaaagcacccttgacgt

SEQ ID NO: 2629355 - DNA, 23 bp, Homo sapiens
ctcaaaataccatgccatttaaa

SEQ ID NO: 2629356 - DNA, 17 bp, Homo sapiens
ctcaaacaacactggtg

SEQ ID NO: 2629357 - DNA, 18 bp, Homo sapiens
ctcaaacactgcaggcat

SEQ ID NO: 2629358 - DNA, 14 bp, Homo sapiens
ctcaaacctcctct

SEQ ID NO: 2629359 - DNA, 20 bp, Homo sapiens
ctcaaacttttcccctgtcc

SEQ ID NO: 2629360 - DNA, 11 bp, Homo sapiens
ctcaaaggcac

SEQ ID NO: 2629361 - DNA, 14 bp, Homo sapiens
ctcaaagtctgcaa

SEQ ID NO: 2629362 - DNA, 23 bp, Homo sapiens
ctcaaagtgactattcagttttc

SEQ ID NO: 2629363 - DNA, 12 bp, Homo sapiens
ctcaaagttttg

SEQ ID NO: 2629364 - DNA, 19 bp, Homo sapiens
ctcaaagttttgaaaagct

SEQ ID NO: 2629365 - DNA, 21 bp, Homo sapiens
ctcaaagttttgaaaagctat

SEQ ID NO: 2629366 - DNA, 19 bp, Homo sapiens
ctcaaatcgtccagcgacc

SEQ ID NO: 2629367 - DNA, 13 bp, Homo sapiens
ctcaaatctattc

SEQ ID NO: 2629368 - DNA, 15 bp, Homo sapiens
ctcaaatctattcag

SEQ ID NO: 2629369 - DNA, 22 bp, Homo sapiens
ctcaaatctattcagacaagca

SEQ ID NO: 2629370 - DNA, 19 bp, Homo sapiens
ctcaaatgctcagaccagc

SEQ ID NO: 2629371 - DNA, 16 bp, Homo sapiens
ctcaaattaatctttc

SEQ ID NO: 2629372 - DNA, 20 bp, Homo sapiens
ctcaacctaccaccccttcc

SEQ ID NO: 2629373 - DNA, 17 bp, Homo sapiens
ctcaacgttacattttt

SEQ ID NO: 2629374 - DNA, 22 bp, Homo sapiens
ctcaagaagacatggagactcc

SEQ ID NO: 2629375 - DNA, 17 bp, Homo sapiens
ctcaagaggctgaggca

SEQ ID NO: 2629376 - DNA, 22 bp, Homo sapiens
ctcaagcagcgaccgccccctc

SEQ ID NO: 2629377 - DNA, 13 bp, Homo sapiens
ctcaagccctgca

SEQ ID NO: 2629378 - DNA, 14 bp, Homo sapiens
ctcaaggaaagggg

SEQ ID NO: 2629379 - DNA, 15 bp, Homo sapiens
ctcaaggacttgaaa

SEQ ID NO: 2629380 - DNA, 19 bp, Homo sapiens
ctcaaggtgggccttgcta

SEQ ID NO: 2629381 - DNA, 18 bp, Homo sapiens
ctcaagtgattctcctgc

SEQ ID NO: 2629382 - DNA, 16 bp, Homo sapiens
ctcaatattcctgaat

SEQ ID NO: 2629383 - DNA, 18 bp, Homo sapiens
ctcaatattcctgaatga

SEQ ID NO: 2629384 - DNA, 19 bp, Homo sapiens
ctcaatattttccatgaaa

SEQ ID NO: 2629385 - DNA, 15 bp, Homo sapiens
ctcaatccatgttct

SEQ ID NO: 2629386 - DNA, 18 bp, Homo sapiens
ctcaatcccagctactca

SEQ ID NO: 2629387 - DNA, 16 bp, Homo sapiens
ctcaatgagctcttcc

SEQ ID NO: 2629388 - DNA, 13 bp, Homo sapiens
ctcaatggactgg

SEQ ID NO: 2629389 - DNA, 14 bp, Homo sapiens
ctcaatggactgga

SEQ ID NO: 2629390 - DNA, 17 bp, Homo sapiens
ctcaatggactggaagg

SEQ ID NO: 2629391 - DNA, 20 bp, Homo sapiens
ctcaatggactggaagggga

SEQ ID NO: 2629392 - DNA, 14 bp, Homo sapiens
ctcaatgtgaccag

SEQ ID NO: 2629393 - DNA, 15 bp, Homo sapiens
ctcaatgtgaccagg

SEQ ID NO: 2629394 - DNA, 16 bp, Homo sapiens
ctcaatgtgaccaggg

SEQ ID NO: 2629395 - DNA, 19 bp, Homo sapiens
ctcaatgttactatctgct

SEQ ID NO: 2629396 - DNA, 14 bp, Homo sapiens
ctcaattcttccct

SEQ ID NO: 2629397 - DNA, 21 bp, Homo sapiens
ctcacaataaaaatggctcag

SEQ ID NO: 2629398 - DNA, 14 bp, Homo sapiens
ctcacacagccagg

SEQ ID NO: 2629399 - DNA, 16 bp, Homo sapiens
ctcacacagccaggtg

SEQ ID NO: 2629400 - DNA, 19 bp, Homo sapiens
ctcacacagccaggtgcct

SEQ ID NO: 2629401 - DNA, 22 bp, Homo sapiens
ctcacacagccaggtgccttgg

SEQ ID NO: 2629402 - DNA, 22 bp, Homo sapiens
ctcacacaggacccccttcccc

SEQ ID NO: 2629403 - DNA, 22 bp, Homo sapiens
ctcacacatgagcatcaggcca

SEQ ID NO: 2629404 - DNA, 23 bp, Homo sapiens
ctcacaccaggcttgcctgcagg

SEQ ID NO: 2629405 - DNA, 13 bp, Homo sapiens
ctcacacccaccg

SEQ ID NO: 2629406 - DNA, 22 bp, Homo sapiens
ctcacacccaccgtccgccctg

SEQ ID NO: 2629407 - DNA, 23 bp, Homo sapiens
ctcacacggacactcaaaagctg

SEQ ID NO: 2629408 - DNA, 17 bp, Homo sapiens
ctcacagacctggagcc

SEQ ID NO: 2629409 - DNA, 14 bp, Homo sapiens
ctcacagcacagag

SEQ ID NO: 2629410 - DNA, 17 bp, Homo sapiens
ctcacagtgttgcccag

SEQ ID NO: 2629411 - DNA, 20 bp, Homo sapiens
ctcacatagcttacaagcca

SEQ ID NO: 2629412 - DNA, 20 bp, Homo sapiens
ctcacatctttcacacttcc

SEQ ID NO: 2629413 - DNA, 15 bp, Homo sapiens
ctcacatttattctg

SEQ ID NO: 2629414 - DNA, 13 bp, Homo sapiens
ctcaccagcccca

SEQ ID NO: 2629415 - DNA, 15 bp, Homo sapiens
ctcaccagccccagt

SEQ ID NO: 2629416 - DNA, 20 bp, Homo sapiens
ctcaccagccccagtgccca

SEQ ID NO: 2629417 - DNA, 21 bp, Homo sapiens
ctcaccagccccagtgcccac

SEQ ID NO: 2629418 - DNA, 16 bp, Homo sapiens
ctcacccatgtgccaa

SEQ ID NO: 2629419 - DNA, 21 bp, Homo sapiens
ctcaccccatcccacaccctg

SEQ ID NO: 2629420 - DNA, 14 bp, Homo sapiens
ctcacccccagctt

SEQ ID NO: 2629421 - DNA, 18 bp, Homo sapiens
ctcacccccagctttgct

SEQ ID NO: 2629422 - DNA, 16 bp, Homo sapiens
ctcacccccttctcca

SEQ ID NO: 2629423 - DNA, 14 bp, Homo sapiens
ctcacccgaggctg

SEQ ID NO: 2629424 - DNA, 20 bp, Homo sapiens
ctcaccctgagccccttcct

SEQ ID NO: 2629425 - DNA, 16 bp, Homo sapiens
ctcacctctaaaacag

SEQ ID NO: 2629426 - DNA, 15 bp, Homo sapiens
ctcacctctcccttg

SEQ ID NO: 2629427 - DNA, 21 bp, Homo sapiens
ctcacctctggactggctaga

SEQ ID NO: 2629428 - DNA, 19 bp, Homo sapiens
ctcacctgagtcaccctac

SEQ ID NO: 2629429 - DNA, 20 bp, Homo sapiens
ctcacctggggctgctggcc

SEQ ID NO: 2629430 - DNA, 21 bp, Homo sapiens
ctcacctggggctgctggcct

SEQ ID NO: 2629431 - DNA, 21 bp, Homo sapiens
ctcacctgttgcttacaattt

SEQ ID NO: 2629432 - DNA, 22 bp, Homo sapiens
ctcacctgttgcttacaatttt

SEQ ID NO: 2629433 - DNA, 19 bp, Homo sapiens
ctcaccttgcaacacacag

SEQ ID NO: 2629434 - DNA, 20 bp, Homo sapiens
ctcaccttgcaacacacaga

SEQ ID NO: 2629435 - DNA, 21 bp, Homo sapiens
ctcaccttgcaacacacagac

SEQ ID NO: 2629436 - DNA, 17 bp, Homo sapiens
ctcacctttcccatctt

SEQ ID NO: 2629437 - DNA, 20 bp, Homo sapiens
ctcacgaatattatgcccag

SEQ ID NO: 2629438 - DNA, 15 bp, Homo sapiens
ctcacgcacctccca

SEQ ID NO: 2629439 - DNA, 17 bp, Homo sapiens
ctcacgggcatgggcac

SEQ ID NO: 2629440 - DNA, 20 bp, Homo sapiens
ctcactaccctattctctct

SEQ ID NO: 2629441 - DNA, 22 bp, Homo sapiens
ctcactatgaatctattatact

SEQ ID NO: 2629442 - DNA, 23 bp, Homo sapiens
ctcactatggtgccaatggaacc

SEQ ID NO: 2629443 - DNA, 17 bp, Homo sapiens
ctcactatgttgcccag

SEQ ID NO: 2629444 - DNA, 18 bp, Homo sapiens
ctcactatgttgcccagg

SEQ ID NO: 2629445 - DNA, 15 bp, Homo sapiens
ctcactcccagtcca

SEQ ID NO: 2629446 - DNA, 21 bp, Homo sapiens
ctcactcccttcccataagct

SEQ ID NO: 2629447 - DNA, 23 bp, Homo sapiens
ctcactcccttctacctgccact

SEQ ID NO: 2629448 - DNA, 12 bp, Homo sapiens
ctcactcctgag

SEQ ID NO: 2629449 - DNA, 12 bp, Homo sapiens
ctcactcctgtt

SEQ ID NO: 2629450 - DNA, 15 bp, Homo sapiens
ctcactctggcctca

SEQ ID NO: 2629451 - DNA, 21 bp, Homo sapiens
ctcactctgtcgcccagtctg

SEQ ID NO: 2629452 - DNA, 13 bp, Homo sapiens
ctcactgaaaaca

SEQ ID NO: 2629453 - DNA, 13 bp, Homo sapiens
ctcactgcagcct

SEQ ID NO: 2629454 - DNA, 14 bp, Homo sapiens
ctcactgcagcctc

SEQ ID NO: 2629455 - DNA, 15 bp, Homo sapiens
ctcactgcagcctca

SEQ ID NO: 2629456 - DNA, 16 bp, Homo sapiens
ctcactgcagcctcaa

SEQ ID NO: 2629457 - DNA, 22 bp, Homo sapiens
ctcactgcggagaaccttgtgc

SEQ ID NO: 2629458 - DNA, 17 bp, Homo sapiens
ctcactggggtcctggg

SEQ ID NO: 2629459 - DNA, 20 bp, Homo sapiens
ctcactggggtcctggggcc

SEQ ID NO: 2629460 - DNA, 13 bp, Homo sapiens
ctcactgggtggg

SEQ ID NO: 2629461 - DNA, 20 bp, Homo sapiens
ctcactgttccctctgctcc

SEQ ID NO: 2629462 - DNA, 15 bp, Homo sapiens
ctcactgttgaattt

SEQ ID NO: 2629463 - DNA, 19 bp, Homo sapiens
ctcactgttgcccaggctg

SEQ ID NO: 2629464 - DNA, 14 bp, Homo sapiens
ctcacttcaccctg

SEQ ID NO: 2629465 - DNA, 20 bp, Homo sapiens
ctcacttctgggcttcatct

SEQ ID NO: 2629466 - DNA, 21 bp, Homo sapiens
ctcacttggtgatatgtccta

SEQ ID NO: 2629467 - DNA, 13 bp, Homo sapiens
ctcagaagaaaga

SEQ ID NO: 2629468 - DNA, 13 bp, Homo sapiens
ctcagaagacact

SEQ ID NO: 2629469 - DNA, 14 bp, Homo sapiens
ctcagaagcctgag

SEQ ID NO: 2629470 - DNA, 19 bp, Homo sapiens
ctcagaaggcaaatgactt

SEQ ID NO: 2629471 - DNA, 20 bp, Homo sapiens
ctcagaaggcaaatgacttt

SEQ ID NO: 2629472 - DNA, 13 bp, Homo sapiens
ctcagaagggagg

SEQ ID NO: 2629473 - DNA, 16 bp, Homo sapiens
ctcagaaggtattcct

SEQ ID NO: 2629474 - DNA, 17 bp, Homo sapiens
ctcagaatctcaaataa

SEQ ID NO: 2629475 - DNA, 15 bp, Homo sapiens
ctcagaccagctctt

SEQ ID NO: 2629476 - DNA, 22 bp, Homo sapiens
ctcagactttggaaaatgcatt

SEQ ID NO: 2629477 - DNA, 13 bp, Homo sapiens
ctcagagagggca

SEQ ID NO: 2629478 - DNA, 15 bp, Homo sapiens
ctcagagccagtctt

SEQ ID NO: 2629479 - DNA, 17 bp, Homo sapiens
ctcagagtatggagctc

SEQ ID NO: 2629480 - DNA, 15 bp, Homo sapiens
ctcagagtccaggcc

SEQ ID NO: 2629481 - DNA, 18 bp, Homo sapiens
ctcagatctgtctgatag

SEQ ID NO: 2629482 - DNA, 23 bp, Homo sapiens
ctcagatggaaccgcaggaagct

SEQ ID NO: 2629483 - DNA, 17 bp, Homo sapiens
ctcagattatttttcct

SEQ ID NO: 2629484 - DNA, 13 bp, Homo sapiens
ctcagcacccctt

SEQ ID NO: 2629485 - DNA, 20 bp, Homo sapiens
ctcagcaccccttccatgtg

SEQ ID NO: 2629486 - DNA, 21 bp, Homo sapiens
ctcagcaccccttccatgtgg

SEQ ID NO: 2629487 - DNA, 18 bp, Homo sapiens
ctcagcagcgaccacccc

SEQ ID NO: 2629488 - DNA, 12 bp, Homo sapiens
ctcagcatacct

SEQ ID NO: 2629489 - DNA, 16 bp, Homo sapiens
ctcagcatgcatcctt

SEQ ID NO: 2629490 - DNA, 14 bp, Homo sapiens
ctcagccaagcaca

SEQ ID NO: 2629491 - DNA, 16 bp, Homo sapiens
ctcagcccacccccct

SEQ ID NO: 2629492 - DNA, 20 bp, Homo sapiens
ctcagcccctgatcctgtga

SEQ ID NO: 2629493 - DNA, 22 bp, Homo sapiens
ctcagcccctgatcctgtgaag

SEQ ID NO: 2629494 - DNA, 16 bp, Homo sapiens
ctcagcctcccaaagt

SEQ ID NO: 2629495 - DNA, 21 bp, Homo sapiens
ctcagcctcccaaagtgctgg

SEQ ID NO: 2629496 - DNA, 13 bp, Homo sapiens
ctcagcctcccag

SEQ ID NO: 2629497 - DNA, 14 bp, Homo sapiens
ctcagcctcctgag

SEQ ID NO: 2629498 - DNA, 16 bp, Homo sapiens
ctcagcctggtgggcc

SEQ ID NO: 2629499 - DNA, 18 bp, Homo sapiens
ctcagcctgtgctgcccg

SEQ ID NO: 2629500 - DNA, 14 bp, Homo sapiens
ctcagcggggacag

SEQ ID NO: 2629501 - DNA, 21 bp, Homo sapiens
ctcagcggggacagctccttc

SEQ ID NO: 2629502 - DNA, 17 bp, Homo sapiens
ctcagctcagcgccagc

SEQ ID NO: 2629503 - DNA, 14 bp, Homo sapiens
ctcagctccccaga

SEQ ID NO: 2629504 - DNA, 12 bp, Homo sapiens
ctcagctctggg

SEQ ID NO: 2629505 - DNA, 13 bp, Homo sapiens
ctcagctctggga

SEQ ID NO: 2629506 - DNA, 15 bp, Homo sapiens
ctcagctctgggaga

SEQ ID NO: 2629507 - DNA, 17 bp, Homo sapiens
ctcagctcttggctcca

SEQ ID NO: 2629508 - DNA, 12 bp, Homo sapiens
ctcagctgcctc

SEQ ID NO: 2629509 - DNA, 18 bp, Homo sapiens
ctcagctgcctcacttcc

SEQ ID NO: 2629510 - DNA, 16 bp, Homo sapiens
ctcagcttcctaccca

SEQ ID NO: 2629511 - DNA, 20 bp, Homo sapiens
ctcaggaccaaagctttcat

SEQ ID NO: 2629512 - DNA, 15 bp, Homo sapiens
ctcaggaccaggcaa

SEQ ID NO: 2629513 - DNA, 16 bp, Homo sapiens
ctcaggacctgggacc

SEQ ID NO: 2629514 - DNA, 16 bp, Homo sapiens
ctcaggactgcaacag

SEQ ID NO: 2629515 - DNA, 14 bp, Homo sapiens
ctcaggagcacagg

SEQ ID NO: 2629516 - DNA, 15 bp, Homo sapiens
ctcaggagcacaggc

SEQ ID NO: 2629517 - DNA, 22 bp, Homo sapiens
ctcaggagcacaggcagctgga

SEQ ID NO: 2629518 - DNA, 15 bp, Homo sapiens
ctcaggaggctgagg

SEQ ID NO: 2629519 - DNA, 17 bp, Homo sapiens
ctcaggaggctgaggca

SEQ ID NO: 2629520 - DNA, 23 bp, Homo sapiens
ctcaggaggctgaggcaggagga

SEQ ID NO: 2629521 - DNA, 16 bp, Homo sapiens
ctcaggaggctgaggg

SEQ ID NO: 2629522 - DNA, 19 bp, Homo sapiens
ctcaggatgcccagggcca

SEQ ID NO: 2629523 - DNA, 16 bp, Homo sapiens
ctcaggcataggcctg

SEQ ID NO: 2629524 - DNA, 17 bp, Homo sapiens
ctcaggcataggcctgg

SEQ ID NO: 2629525 - DNA, 15 bp, Homo sapiens
ctcaggcatgcctgt

SEQ ID NO: 2629526 - DNA, 16 bp, Homo sapiens
ctcaggcatgcctgtg

SEQ ID NO: 2629527 - DNA, 17 bp, Homo sapiens
ctcaggcatgcctgtgt

SEQ ID NO: 2629528 - DNA, 19 bp, Homo sapiens
ctcaggccaacaagccaac

SEQ ID NO: 2629529 - DNA, 14 bp, Homo sapiens
ctcagggacagagc

SEQ ID NO: 2629530 - DNA, 15 bp, Homo sapiens
ctcagggacagagcc

SEQ ID NO: 2629531 - DNA, 12 bp, Homo sapiens
ctcagggcccca

SEQ ID NO: 2629532 - DNA, 13 bp, Homo sapiens
ctcagggccccag

SEQ ID NO: 2629533 - DNA, 14 bp, Homo sapiens
ctcagggccccagc

SEQ ID NO: 2629534 - DNA, 14 bp, Homo sapiens
ctcagggcctggct

SEQ ID NO: 2629535 - DNA, 15 bp, Homo sapiens
ctcagggcctggctc

SEQ ID NO: 2629536 - DNA, 19 bp, Homo sapiens
ctcagggcctggctcaggt

SEQ ID NO: 2629537 - DNA, 15 bp, Homo sapiens
ctcagggcctggtcg

SEQ ID NO: 2629538 - DNA, 13 bp, Homo sapiens
ctcagggctcctg

SEQ ID NO: 2629539 - DNA, 14 bp, Homo sapiens
ctcagggctcctgc

SEQ ID NO: 2629540 - DNA, 17 bp, Homo sapiens
ctcaggggccagaggaa

SEQ ID NO: 2629541 - DNA, 18 bp, Homo sapiens
ctcaggggccagaggaac

SEQ ID NO: 2629542 - DNA, 20 bp, Homo sapiens
ctcaggggccagaggaactg

SEQ ID NO: 2629543 - DNA, 17 bp, Homo sapiens
ctcaggggcgtgtggct

SEQ ID NO: 2629544 - DNA, 16 bp, Homo sapiens
ctcaggggctgtttga

SEQ ID NO: 2629545 - DNA, 15 bp, Homo sapiens
ctcagggtccctggt

SEQ ID NO: 2629546 - DNA, 16 bp, Homo sapiens
ctcagggtccctggtg

SEQ ID NO: 2629547 - DNA, 21 bp, Homo sapiens
ctcagggtccctggtggcagc

SEQ ID NO: 2629548 - DNA, 17 bp, Homo sapiens
ctcaggtccctgcaggg

SEQ ID NO: 2629549 - DNA, 18 bp, Homo sapiens
ctcaggtccctgcagggc

SEQ ID NO: 2629550 - DNA, 13 bp, Homo sapiens
ctcaggtgaccaa

SEQ ID NO: 2629551 - DNA, 19 bp, Homo sapiens
ctcaggtgatccacccacc

SEQ ID NO: 2629552 - DNA, 22 bp, Homo sapiens
ctcaggtgatccacccacctca

SEQ ID NO: 2629553 - DNA, 23 bp, Homo sapiens
ctcaggtgatccacccacctcag

SEQ ID NO: 2629554 - DNA, 21 bp, Homo sapiens
ctcaggtggccagcctggatc

SEQ ID NO: 2629555 - DNA, 13 bp, Homo sapiens
ctcaggtgggcgt

SEQ ID NO: 2629556 - DNA, 20 bp, Homo sapiens
ctcaggttcctatggctggc

SEQ ID NO: 2629557 - DNA, 21 bp, Homo sapiens
ctcaggttgctggttgctgtg

SEQ ID NO: 2629558 - DNA, 16 bp, Homo sapiens
ctcagtcatgcataaa

SEQ ID NO: 2629559 - DNA, 22 bp, Homo sapiens
ctcagtcatgcataaatatgca

SEQ ID NO: 2629560 - DNA, 23 bp, Homo sapiens
ctcagtcatgcataaatatgcag

SEQ ID NO: 2629561 - DNA, 18 bp, Homo sapiens
ctcagtcattagactcct

SEQ ID NO: 2629562 - DNA, 15 bp, Homo sapiens
ctcagtccatagcag

SEQ ID NO: 2629563 - DNA, 17 bp, Homo sapiens
ctcagtccatagcagag

SEQ ID NO: 2629564 - DNA, 13 bp, Homo sapiens
ctcagtctcagga

SEQ ID NO: 2629565 - DNA, 16 bp, Homo sapiens
ctcagtctcaggagca

SEQ ID NO: 2629566 - DNA, 14 bp, Homo sapiens
ctcagtctcccttt

SEQ ID NO: 2629567 - DNA, 20 bp, Homo sapiens
ctcagtggactttccacccc

SEQ ID NO: 2629568 - DNA, 22 bp, Homo sapiens
ctcagtggactttccaccccct

SEQ ID NO: 2629569 - DNA, 21 bp, Homo sapiens
ctcagttcagaatcacttctg

SEQ ID NO: 2629570 - DNA, 19 bp, Homo sapiens
ctcagttcccttggcctca

SEQ ID NO: 2629571 - DNA, 20 bp, Homo sapiens
ctcagttccgatttcccagg

SEQ ID NO: 2629572 - DNA, 19 bp, Homo sapiens
ctcagttctagtctctctg

SEQ ID NO: 2629573 - DNA, 16 bp, Homo sapiens
ctcagttgtagaatgt

SEQ ID NO: 2629574 - DNA, 13 bp, Homo sapiens
ctcagtttcccta

SEQ ID NO: 2629575 - DNA, 22 bp, Homo sapiens
ctcagtttgtgtgtcttaatta

SEQ ID NO: 2629576 - DNA, 14 bp, Homo sapiens
ctcataatgtgaag

SEQ ID NO: 2629577 - DNA, 17 bp, Homo sapiens
ctcataatgtgaagtgt

SEQ ID NO: 2629578 - DNA, 14 bp, Homo sapiens
ctcatacgtccacc

SEQ ID NO: 2629579 - DNA, 15 bp, Homo sapiens
ctcatacgtccacca

SEQ ID NO: 2629580 - DNA, 15 bp, Homo sapiens
ctcatagcacttccc

SEQ ID NO: 2629581 - DNA, 14 bp, Homo sapiens
ctcatagcattaac

SEQ ID NO: 2629582 - DNA, 23 bp, Homo sapiens
ctcataggaaaagtacatttaat

SEQ ID NO: 2629583 - DNA, 18 bp, Homo sapiens
ctcatagtatggtggctg

SEQ ID NO: 2629584 - DNA, 13 bp, Homo sapiens
ctcatattgtgat

SEQ ID NO: 2629585 - DNA, 19 bp, Homo sapiens
ctcatattgtgattctgcc

SEQ ID NO: 2629586 - DNA, 12 bp, Homo sapiens
ctcatatttaaa

SEQ ID NO: 2629587 - DNA, 12 bp, Homo sapiens
ctcatattttgt

SEQ ID NO: 2629588 - DNA, 16 bp, Homo sapiens
ctcatattttgtatat

SEQ ID NO: 2629589 - DNA, 14 bp, Homo sapiens
ctcatcaactgaat

SEQ ID NO: 2629590 - DNA, 16 bp, Homo sapiens
ctcatcaactgaatga

SEQ ID NO: 2629591 - DNA, 14 bp, Homo sapiens
ctcatcactcccct

SEQ ID NO: 2629592 - DNA, 15 bp, Homo sapiens
ctcatcactcccctc

SEQ ID NO: 2629593 - DNA, 17 bp, Homo sapiens
ctcatcactcccctcca

SEQ ID NO: 2629594 - DNA, 15 bp, Homo sapiens
ctcatcactggatga

SEQ ID NO: 2629595 - DNA, 13 bp, Homo sapiens
ctcatcaggatga

SEQ ID NO: 2629596 - DNA, 14 bp, Homo sapiens
ctcatcattctctg

SEQ ID NO: 2629597 - DNA, 20 bp, Homo sapiens
ctcatcattctctgtctcat

SEQ ID NO: 2629598 - DNA, 22 bp, Homo sapiens
ctcatcattctctgtctcatcc

SEQ ID NO: 2629599 - DNA, 24 bp, Homo sapiens
ctcatccaccccatccctccccag

SEQ ID NO: 2629600 - DNA, 16 bp, Homo sapiens
ctcatccagggctctg

SEQ ID NO: 2629601 - DNA, 16 bp, Homo sapiens
ctcatccatcatcatg

SEQ ID NO: 2629602 - DNA, 14 bp, Homo sapiens
ctcatcccacgcac

SEQ ID NO: 2629603 - DNA, 13 bp, Homo sapiens
ctcatccccaggg

SEQ ID NO: 2629604 - DNA, 14 bp, Homo sapiens
ctcatccgaggcag

SEQ ID NO: 2629605 - DNA, 15 bp, Homo sapiens
ctcatcctcataccc

SEQ ID NO: 2629606 - DNA, 12 bp, Homo sapiens
ctcatctgctca

SEQ ID NO: 2629607 - DNA, 12 bp, Homo sapiens
ctcatctgtgat

SEQ ID NO: 2629608 - DNA, 18 bp, Homo sapiens
ctcatcttagtgcctgag

SEQ ID NO: 2629609 - DNA, 17 bp, Homo sapiens
ctcatcttcttcaccat

SEQ ID NO: 2629610 - DNA, 20 bp, Homo sapiens
ctcatgatcttgtgacatat

SEQ ID NO: 2629611 - DNA, 15 bp, Homo sapiens
ctcatgcagccgtga

SEQ ID NO: 2629612 - DNA, 12 bp, Homo sapiens
ctcatgcatctc

SEQ ID NO: 2629613 - DNA, 16 bp, Homo sapiens
ctcatgcatctccacc

SEQ ID NO: 2629614 - DNA, 20 bp, Homo sapiens
ctcatgcatctccacctgct

SEQ ID NO: 2629615 - DNA, 22 bp, Homo sapiens
ctcatgcatctccacctgctcc

SEQ ID NO: 2629616 - DNA, 23 bp, Homo sapiens
ctcatgccccctttcagatgtct

SEQ ID NO: 2629617 - DNA, 21 bp, Homo sapiens
ctcatggagaagcagaaatac

SEQ ID NO: 2629618 - DNA, 19 bp, Homo sapiens
ctcatggcccctctgacct

SEQ ID NO: 2629619 - DNA, 16 bp, Homo sapiens
ctcatggggtccaagt

SEQ ID NO: 2629620 - DNA, 18 bp, Homo sapiens
ctcatgtgtgctcttctt

SEQ ID NO: 2629621 - DNA, 14 bp, Homo sapiens
ctcatgttcttaat

SEQ ID NO: 2629622 - DNA, 17 bp, Homo sapiens
ctcatgttttccattgt

SEQ ID NO: 2629623 - DNA, 16 bp, Homo sapiens
ctcattaatgacactt

SEQ ID NO: 2629624 - DNA, 21 bp, Homo sapiens
ctcattccaccttcccatgcc

SEQ ID NO: 2629625 - DNA, 18 bp, Homo sapiens
ctcattcctccacctgcc

SEQ ID NO: 2629626 - DNA, 16 bp, Homo sapiens
ctcattcctgcctgtc

SEQ ID NO: 2629627 - DNA, 18 bp, Homo sapiens
ctcattcctgcctgtctc

SEQ ID NO: 2629628 - DNA, 18 bp, Homo sapiens
ctccctcctcacctctgg

SEQ ID NO: 2629629 - DNA, 21 bp, Homo sapiens
ctccctcctcacctctggact

SEQ ID NO: 2629630 - DNA, 16 bp, Homo sapiens
ctccctctcactgtct

SEQ ID NO: 2629631 - DNA, 15 bp, Homo sapiens
ctccctctctcttct

SEQ ID NO: 2629632 - DNA, 17 bp, Homo sapiens
ctccctctctcttctgc

SEQ ID NO: 2629633 - DNA, 22 bp, Homo sapiens
ctccctctctcttctgctccac

SEQ ID NO: 2629634 - DNA, 14 bp, Homo sapiens
ctccctctgacctg

SEQ ID NO: 2629635 - DNA, 17 bp, Homo sapiens
ctccctctgaggctgta

SEQ ID NO: 2629636 - DNA, 11 bp, Homo sapiens
ctccctctgga

SEQ ID NO: 2629637 - DNA, 13 bp, Homo sapiens
ctccctctggatc

SEQ ID NO: 2629638 - DNA, 14 bp, Homo sapiens
ctccctcttctcaa

SEQ ID NO: 2629639 - DNA, 21 bp, Homo sapiens
ctccctgaaaatgtttttctg

SEQ ID NO: 2629640 - DNA, 16 bp, Homo sapiens
ctccctgacccgtcta

SEQ ID NO: 2629641 - DNA, 13 bp, Homo sapiens
ctccctggcctgt

SEQ ID NO: 2629642 - DNA, 16 bp, Homo sapiens
ctccctggcctgttct

SEQ ID NO: 2629643 - DNA, 16 bp, Homo sapiens
ctccctggctctcaga

SEQ ID NO: 2629644 - DNA, 20 bp, Homo sapiens
ctccctggctctcagaaggt

SEQ ID NO: 2629645 - DNA, 14 bp, Homo sapiens
ctccctggctgccc

SEQ ID NO: 2629646 - DNA, 15 bp, Homo sapiens
ctccctggctgccct

SEQ ID NO: 2629647 - DNA, 19 bp, Homo sapiens
ctccctggctgccctggcc

SEQ ID NO: 2629648 - DNA, 21 bp, Homo sapiens
ctccctggctgccctggccct

SEQ ID NO: 2629649 - DNA, 18 bp, Homo sapiens
ctccctggttctgatgat

SEQ ID NO: 2629650 - DNA, 17 bp, Homo sapiens
ctccctgtcggcctggt

SEQ ID NO: 2629651 - DNA, 19 bp, Homo sapiens
ctccctgttgaagctctgg

SEQ ID NO: 2629652 - DNA, 19 bp, Homo sapiens
ctccctgttgacgaagtct

SEQ ID NO: 2629653 - DNA, 21 bp, Homo sapiens
ctccctgttgacgaagtctct

SEQ ID NO: 2629654 - DNA, 17 bp, Homo sapiens
ctcccttagctccctgt

SEQ ID NO: 2629655 - DNA, 17 bp, Homo sapiens
ctcccttcccataagct

SEQ ID NO: 2629656 - DNA, 17 bp, Homo sapiens
ctcccttctacctgcca

SEQ ID NO: 2629657 - DNA, 16 bp, Homo sapiens
ctcccttctcttcaca

SEQ ID NO: 2629658 - DNA, 20 bp, Homo sapiens
ctcccttggattgtccccga

SEQ ID NO: 2629659 - DNA, 17 bp, Homo sapiens
ctcccttgggttctgat

SEQ ID NO: 2629660 - DNA, 18 bp, Homo sapiens
ctcccttgggttctgata

SEQ ID NO: 2629661 - DNA, 14 bp, Homo sapiens
ctcccttgttctct

SEQ ID NO: 2629662 - DNA, 14 bp, Homo sapiens
ctccctttcccttc

SEQ ID NO: 2629663 - DNA, 17 bp, Homo sapiens
ctccctttcttccctac

SEQ ID NO: 2629664 - DNA, 14 bp, Homo sapiens
ctccctttttatat

SEQ ID NO: 2629665 - DNA, 16 bp, Homo sapiens
ctccctttttccttgt

SEQ ID NO: 2629666 - DNA, 15 bp, Homo sapiens
ctccgaccagacacc

SEQ ID NO: 2629667 - DNA, 23 bp, Homo sapiens
ctccgccattctcaagccctgca

SEQ ID NO: 2629668 - DNA, 22 bp, Homo sapiens
ctccgctttctacccagcgagc

SEQ ID NO: 2629669 - DNA, 23 bp, Homo sapiens
ctccgctttctacccagcgagcc

SEQ ID NO: 2629670 - DNA, 22 bp, Homo sapiens
ctccggcctgatgacagagcga

SEQ ID NO: 2629671 - DNA, 14 bp, Homo sapiens
ctccggcgtcagcc

SEQ ID NO: 2629672 - DNA, 17 bp, Homo sapiens
ctccggcgtcagcctcc

SEQ ID NO: 2629673 - DNA, 22 bp, Homo sapiens
ctccggcgtcagcctccagcct

SEQ ID NO: 2629674 - DNA, 14 bp, Homo sapiens
ctccgggagagggg

SEQ ID NO: 2629675 - DNA, 15 bp, Homo sapiens
ctccgtatttcagac

SEQ ID NO: 2629676 - DNA, 15 bp, Homo sapiens
ctccgtccagccgcc

SEQ ID NO: 2629677 - DNA, 18 bp, Homo sapiens
ctccgtccaggagcctgg

SEQ ID NO: 2629678 - DNA, 14 bp, Homo sapiens
ctccgtgcctccac

SEQ ID NO: 2629679 - DNA, 21 bp, Homo sapiens
ctccgtgcctccaccaccact

SEQ ID NO: 2629680 - DNA, 13 bp, Homo sapiens
ctccgtggagcag

SEQ ID NO: 2629681 - DNA, 21 bp, Homo sapiens
ctcctaccgaaaccttgcctt

SEQ ID NO: 2629682 - DNA, 13 bp, Homo sapiens
ctcctacctcagc

SEQ ID NO: 2629683 - DNA, 14 bp, Homo sapiens
ctcctacctcagcc

SEQ ID NO: 2629684 - DNA, 15 bp, Homo sapiens
ctcctagagaacgca

SEQ ID NO: 2629685 - DNA, 17 bp, Homo sapiens
ctcctagagacagaagc

SEQ ID NO: 2629686 - DNA, 22 bp, Homo sapiens
ctcctagcctgtgcctctggga

SEQ ID NO: 2629687 - DNA, 15 bp, Homo sapiens
ctcctaggaaaatac

SEQ ID NO: 2629688 - DNA, 13 bp, Homo sapiens
ctcctatctgtgt

SEQ ID NO: 2629689 - DNA, 18 bp, Homo sapiens
ctcctatctgtgttttga

SEQ ID NO: 2629690 - DNA, 15 bp, Homo sapiens
ctcctcacctctgga

SEQ ID NO: 2629691 - DNA, 22 bp, Homo sapiens
ctcctcacctctggactggcta

SEQ ID NO: 2629692 - DNA, 16 bp, Homo sapiens
ctcctcactcccttct

SEQ ID NO: 2629693 - DNA, 20 bp, Homo sapiens
ctcctcatccagggctctga

SEQ ID NO: 2629694 - DNA, 14 bp, Homo sapiens
ctcctccaaaggcc

SEQ ID NO: 2629695 - DNA, 18 bp, Homo sapiens
ctcctccaaaggccccct

SEQ ID NO: 2629696 - DNA, 21 bp, Homo sapiens
ctcctccaagacactgtggac

SEQ ID NO: 2629697 - DNA, 22 bp, Homo sapiens
ctcctccagccgccatgctcct

SEQ ID NO: 2629698 - DNA, 18 bp, Homo sapiens
ctcctccatgggagaaaa

SEQ ID NO: 2629699 - DNA, 12 bp, Homo sapiens
ctcctccctggc

SEQ ID NO: 2629700 - DNA, 18 bp, Homo sapiens
ctcctccctggctgccct

SEQ ID NO: 2629701 - DNA, 20 bp, Homo sapiens
ctcctccctggctgccctgg

SEQ ID NO: 2629702 - DNA, 22 bp, Homo sapiens
ctcctccctggctgccctggcc

SEQ ID NO: 2629703 - DNA, 15 bp, Homo sapiens
ctcctcgagggcagg

SEQ ID NO: 2629704 - DNA, 18 bp, Homo sapiens
ctcctctagctgtggggg

SEQ ID NO: 2629705 - DNA, 19 bp, Homo sapiens
ctcctctagctgtgggggt

SEQ ID NO: 2629706 - DNA, 13 bp, Homo sapiens
ctcctctcccatc

SEQ ID NO: 2629707 - DNA, 21 bp, Homo sapiens
ctcctctcccatccccctgcc

SEQ ID NO: 2629708 - DNA, 22 bp, Homo sapiens
ctcctctccccagcaagtgaga

SEQ ID NO: 2629709 - DNA, 17 bp, Homo sapiens
ctcctctcccctaccac

SEQ ID NO: 2629710 - DNA, 13 bp, Homo sapiens
ctcctctcctgga

SEQ ID NO: 2629711 - DNA, 20 bp, Homo sapiens
ctcctctcctggaggattgc

SEQ ID NO: 2629712 - DNA, 12 bp, Homo sapiens
ctcctctctgcc

SEQ ID NO: 2629713 - DNA, 18 bp, Homo sapiens
ctcctctgactcagggct

SEQ ID NO: 2629714 - DNA, 22 bp, Homo sapiens
ctcctctgactcagggctcctg

SEQ ID NO: 2629715 - DNA, 18 bp, Homo sapiens
ctcctctgcagtgccttg

SEQ ID NO: 2629716 - DNA, 15 bp, Homo sapiens
ctcctctgctgctgg

SEQ ID NO: 2629717 - DNA, 13 bp, Homo sapiens
ctcctctgggcag

SEQ ID NO: 2629718 - DNA, 14 bp, Homo sapiens
ctcctctgtccagg

SEQ ID NO: 2629719 - DNA, 23 bp, Homo sapiens
ctcctctgtgaccaatgtcttga

SEQ ID NO: 2629720 - DNA, 21 bp, Homo sapiens
ctcctcttaaaaaataaaaac

SEQ ID NO: 2629721 - DNA, 23 bp, Homo sapiens
ctcctcttcaactgaccagcctc

SEQ ID NO: 2629722 - DNA, 19 bp, Homo sapiens
ctcctcttctgacgtgcct

SEQ ID NO: 2629723 - DNA, 23 bp, Homo sapiens
ctcctcttcttttttttcattat

SEQ ID NO: 2629724 - DNA, 12 bp, Homo sapiens
ctcctcttgcca

SEQ ID NO: 2629725 - DNA, 16 bp, Homo sapiens
ctcctcttgccactgc

SEQ ID NO: 2629726 - DNA, 15 bp, Homo sapiens
ctcctgagacccctg

SEQ ID NO: 2629727 - DNA, 18 bp, Homo sapiens
ctcctgagacccctggcc

SEQ ID NO: 2629728 - DNA, 15 bp, Homo sapiens
ctcctgaggacagct

SEQ ID NO: 2629729 - DNA, 16 bp, Homo sapiens
ctcctgaggacagctg

SEQ ID NO: 2629730 - DNA, 19 bp, Homo sapiens
ctcctgaggacagctgtcc

SEQ ID NO: 2629731 - DNA, 19 bp, Homo sapiens
ctcctgaggggcatctgcc

SEQ ID NO: 2629732 - DNA, 20 bp, Homo sapiens
ctcctgaggggcatctgccc

SEQ ID NO: 2629733 - DNA, 12 bp, Homo sapiens
ctcctgcaggca

SEQ ID NO: 2629734 - DNA, 18 bp, Homo sapiens
ctcctgcaggcagccagg

SEQ ID NO: 2629735 - DNA, 18 bp, Homo sapiens
ctcctgccagtgtggaac

SEQ ID NO: 2629736 - DNA, 12 bp, Homo sapiens
ctcctgccctgt

SEQ ID NO: 2629737 - DNA, 16 bp, Homo sapiens
ctcctgccgactcctg

SEQ ID NO: 2629738 - DNA, 17 bp, Homo sapiens
ctcctgcctcagcctcc

SEQ ID NO: 2629739 - DNA, 21 bp, Homo sapiens
cgtgcacgtggagagctggtg

SEQ ID NO: 2629740 - DNA, 21 bp, Homo sapiens
cgtgcagtggtgcgatctggg

SEQ ID NO: 2629741 - DNA, 20 bp, Homo sapiens
cgtgcctccaccaccactgg

SEQ ID NO: 2629742 - DNA, 23 bp, Homo sapiens
cgtgcctccaccaccactggcca

SEQ ID NO: 2629743 - DNA, 19 bp, Homo sapiens
cgtgccttttgcacccctc

SEQ ID NO: 2629744 - DNA, 14 bp, Homo sapiens
cgtgctaaattttc

SEQ ID NO: 2629745 - DNA, 18 bp, Homo sapiens
cgtgctccagcctggctc

SEQ ID NO: 2629746 - DNA, 16 bp, Homo sapiens
cgtggacaggtgtgcc

SEQ ID NO: 2629747 - DNA, 20 bp, Homo sapiens
cgtggactccagactctctg

SEQ ID NO: 2629748 - DNA, 13 bp, Homo sapiens
cgtggactctgca

SEQ ID NO: 2629749 - DNA, 22 bp, Homo sapiens
cgtggacttggggtcagagact

SEQ ID NO: 2629750 - DNA, 17 bp, Homo sapiens
cgtggagagctggtgcc

SEQ ID NO: 2629751 - DNA, 22 bp, Homo sapiens
cgtggaggaatgctcccccatc

SEQ ID NO: 2629752 - DNA, 22 bp, Homo sapiens
cgtggcagataatcagcctctt

SEQ ID NO: 2629753 - DNA, 13 bp, Homo sapiens
cgtggcatcacct

SEQ ID NO: 2629754 - DNA, 16 bp, Homo sapiens
cgtggcatgtggcctg

SEQ ID NO: 2629755 - DNA, 17 bp, Homo sapiens
cgtgggctccctgactg

SEQ ID NO: 2629756 - DNA, 20 bp, Homo sapiens
cgtgggtctgttttcctttc

SEQ ID NO: 2629757 - DNA, 15 bp, Homo sapiens
cgtggtcaagcactc

SEQ ID NO: 2629758 - DNA, 17 bp, Homo sapiens
cgtggtcactgctgtca

SEQ ID NO: 2629759 - DNA, 15 bp, Homo sapiens
cgtgtatcctggggc

SEQ ID NO: 2629760 - DNA, 16 bp, Homo sapiens
cgtgtccccggcctca

SEQ ID NO: 2629761 - DNA, 15 bp, Homo sapiens
cgtgtccctctcgga

SEQ ID NO: 2629762 - DNA, 15 bp, Homo sapiens
cgtgtgatttttctg

SEQ ID NO: 2629763 - DNA, 21 bp, Homo sapiens
cgtgtggcaatagtgggccct

SEQ ID NO: 2629764 - DNA, 22 bp, Homo sapiens
cgtgtggcaatagtgggccctc

SEQ ID NO: 2629765 - DNA, 20 bp, Homo sapiens
cgtgtggctcacgtgtgtga

SEQ ID NO: 2629766 - DNA, 12 bp, Homo sapiens
cgtgtgtagagt

SEQ ID NO: 2629767 - DNA, 18 bp, Homo sapiens
cgtgtgtagagttaagaa

SEQ ID NO: 2629768 - DNA, 17 bp, Homo sapiens
cgtgtgtccatgtgtgt

SEQ ID NO: 2629769 - DNA, 14 bp, Homo sapiens
cgtgtttctgactc

SEQ ID NO: 2629770 - DNA, 20 bp, Homo sapiens
cgttaagggaaggaactctg

SEQ ID NO: 2629771 - DNA, 16 bp, Homo sapiens
cgttattataattgta

SEQ ID NO: 2629772 - DNA, 15 bp, Homo sapiens
cgttattgttgactt

SEQ ID NO: 2629773 - DNA, 10 bp, Homo sapiens
cgttccagcc

SEQ ID NO: 2629774 - DNA, 11 bp, Homo sapiens
cgttccagccg

SEQ ID NO: 2629775 - DNA, 13 bp, Homo sapiens
cgttccagttccc

SEQ ID NO: 2629776 - DNA, 20 bp, Homo sapiens
cgttcctattgtcattaaag

SEQ ID NO: 2629777 - DNA, 18 bp, Homo sapiens
cgttctcacacccaccgt

SEQ ID NO: 2629778 - DNA, 14 bp, Homo sapiens
cgttctgctcatca

SEQ ID NO: 2629779 - DNA, 11 bp, Homo sapiens
cgttgctgtgg

SEQ ID NO: 2629780 - DNA, 14 bp, Homo sapiens
cgttgctgtgggaa

SEQ ID NO: 2629781 - DNA, 15 bp, Homo sapiens
cgttgctgtgggaac

SEQ ID NO: 2629782 - DNA, 23 bp, Homo sapiens
cgttgctgtgggaacgagagggg

SEQ ID NO: 2629783 - DNA, 20 bp, Homo sapiens
cgttgtttacttaaagattt

SEQ ID NO: 2629784 - DNA, 20 bp, Homo sapiens
cgtttacttatcttatgcca

SEQ ID NO: 2629785 - DNA, 20 bp, Homo sapiens
cgtttcctgagaagtgtcta

SEQ ID NO: 2629786 - DNA, 12 bp, Homo sapiens
cgtttcttccct

SEQ ID NO: 2629787 - DNA, 15 bp, Homo sapiens
cgttttctgtttgga

SEQ ID NO: 2629788 - DNA, 16 bp, Homo sapiens
ctaaaaaaaaaaaagt

SEQ ID NO: 2629789 - DNA, 17 bp, Homo sapiens
ctaaaaaaaaaaaagta

SEQ ID NO: 2629790 - DNA, 17 bp, Homo sapiens
ctaaaacaataaaattt

SEQ ID NO: 2629791 - DNA, 13 bp, Homo sapiens
ctaaaagtaaaca

SEQ ID NO: 2629792 - DNA, 14 bp, Homo sapiens
ctaaaagtaaacat

SEQ ID NO: 2629793 - DNA, 13 bp, Homo sapiens
ctaaaatagccac

SEQ ID NO: 2629794 - DNA, 15 bp, Homo sapiens
ctaaaatatttattt

SEQ ID NO: 2629795 - DNA, 14 bp, Homo sapiens
ctaaaatgatttta

SEQ ID NO: 2629796 - DNA, 23 bp, Homo sapiens
ctaaaatttgccctcccatcccg

SEQ ID NO: 2629797 - DNA, 19 bp, Homo sapiens
ctaaacaagaatcagtcta

SEQ ID NO: 2629798 - DNA, 19 bp, Homo sapiens
ctaaagagtttattttaag

SEQ ID NO: 2629799 - DNA, 19 bp, Homo sapiens
ctaaaggctacctttgtat

SEQ ID NO: 2629800 - DNA, 15 bp, Homo sapiens
ctaaagtatgaagca

SEQ ID NO: 2629801 - DNA, 16 bp, Homo sapiens
ctaaagtatgtaaagt

SEQ ID NO: 2629802 - DNA, 22 bp, Homo sapiens
ctaaagtgtatttttttactaa

SEQ ID NO: 2629803 - DNA, 23 bp, Homo sapiens
ctaaataaagcttgcaacaaaat

SEQ ID NO: 2629804 - DNA, 13 bp, Homo sapiens
ctaaatatttcct

SEQ ID NO: 2629805 - DNA, 16 bp, Homo sapiens
ctaaatctagactcaa

SEQ ID NO: 2629806 - DNA, 20 bp, Homo sapiens
ctaaatctccaaaataaaac

SEQ ID NO: 2629807 - DNA, 21 bp, Homo sapiens
ctaaatggtcgcccaggagac

SEQ ID NO: 2629808 - DNA, 16 bp, Homo sapiens
ctaaatgtaacagtct

SEQ ID NO: 2629809 - DNA, 16 bp, Homo sapiens
ctaaatgttgaaagat

SEQ ID NO: 2629810 - DNA, 19 bp, Homo sapiens
ctaaattgacacttaaaaa

SEQ ID NO: 2629811 - DNA, 15 bp, Homo sapiens
ctaacacacagctcc

SEQ ID NO: 2629812 - DNA, 14 bp, Homo sapiens
ctaacacagcatgt

SEQ ID NO: 2629813 - DNA, 15 bp, Homo sapiens
ctaacaccagacaga

SEQ ID NO: 2629814 - DNA, 14 bp, Homo sapiens
ctaacacccagtct

SEQ ID NO: 2629815 - DNA, 22 bp, Homo sapiens
ctaacatataatgttgttattt

SEQ ID NO: 2629816 - DNA, 13 bp, Homo sapiens
ctaaccacatcaa

SEQ ID NO: 2629817 - DNA, 15 bp, Homo sapiens
ctaaccccaggcccc

SEQ ID NO: 2629818 - DNA, 16 bp, Homo sapiens
ctaaccccgggcgggt

SEQ ID NO: 2629819 - DNA, 12 bp, Homo sapiens
ctaacctcatct

SEQ ID NO: 2629820 - DNA, 17 bp, Homo sapiens
ctaacgttgagcccctg

SEQ ID NO: 2629821 - DNA, 22 bp, Homo sapiens
ctaacgttgagcccctggaggc

SEQ ID NO: 2629822 - DNA, 17 bp, Homo sapiens
ctaactcatactgtgct

SEQ ID NO: 2629823 - DNA, 20 bp, Homo sapiens
ctaactcatactgtgctgga

SEQ ID NO: 2629824 - DNA, 15 bp, Homo sapiens
ctaacttcaccatat

SEQ ID NO: 2629825 - DNA, 21 bp, Homo sapiens
ctaacttggagccccagtgcc

SEQ ID NO: 2629826 - DNA, 22 bp, Homo sapiens
ctaacttggagccccagtgcca

SEQ ID NO: 2629827 - DNA, 23 bp, Homo sapiens
ctaagaaaagatacgactttatt

SEQ ID NO: 2629828 - DNA, 20 bp, Homo sapiens
ctaagaaataaaactgttaa

SEQ ID NO: 2629829 - DNA, 14 bp, Homo sapiens
ctaagactacagca

SEQ ID NO: 2629830 - DNA, 14 bp, Homo sapiens
ctaagagagagaga

SEQ ID NO: 2629831 - DNA, 13 bp, Homo sapiens
ctaagagggaggg

SEQ ID NO: 2629832 - DNA, 11 bp, Homo sapiens
ctaagatgctc

SEQ ID NO: 2629833 - DNA, 14 bp, Homo sapiens
ctaagcaaaatgtg

SEQ ID NO: 2629834 - DNA, 19 bp, Homo sapiens
ctaagcagcatttctgaag

SEQ ID NO: 2629835 - DNA, 20 bp, Homo sapiens
ctaagccactcttccaaagg

SEQ ID NO: 2629836 - DNA, 12 bp, Homo sapiens
ctaagccctgtc

SEQ ID NO: 2629837 - DNA, 17 bp, Homo sapiens
ctaagcctacctgctct

SEQ ID NO: 2629838 - DNA, 16 bp, Homo sapiens
ctaagcctttccataa

SEQ ID NO: 2629839 - DNA, 17 bp, Homo sapiens
ctaagctaggaatgaaa

SEQ ID NO: 2629840 - DNA, 22 bp, Homo sapiens
ctaagctattcagtaataactc

SEQ ID NO: 2629841 - DNA, 22 bp, Homo sapiens
ctaagctcaaggcgtgaggatg

SEQ ID NO: 2629842 - DNA, 20 bp, Homo sapiens
ctaagctttgccagctgctg

SEQ ID NO: 2629843 - DNA, 19 bp, Homo sapiens
ctaaggacatttcccaggg

SEQ ID NO: 2629844 - DNA, 18 bp, Homo sapiens
ctaaggatctctcaggag

SEQ ID NO: 2629845 - DNA, 17 bp, Homo sapiens
ctaaggatgctaaacct

SEQ ID NO: 2629846 - DNA, 18 bp, Homo sapiens
ctaaggatgctaaacctt

SEQ ID NO: 2629847 - DNA, 18 bp, Homo sapiens
ctaaggatgtcacagggc

SEQ ID NO: 2629848 - DNA, 20 bp, Homo sapiens
ctaaggcgtggagctgcctg

SEQ ID NO: 2629849 - DNA, 22 bp, Homo sapiens
ctaaggcgtggagctgcctgat

SEQ ID NO: 2629850 - DNA, 17 bp, Homo sapiens
ctaaggtggattttcat

SEQ ID NO: 2629851 - DNA, 14 bp, Homo sapiens
ctaaggttctcata

SEQ ID NO: 2629852 - DNA, 14 bp, Homo sapiens
ctaagtaaaaccac

SEQ ID NO: 2629853 - DNA, 16 bp, Homo sapiens
ctaagtctttccattg

SEQ ID NO: 2629854 - DNA, 14 bp, Homo sapiens
ctaagtgaaaaggt

SEQ ID NO: 2629855 - DNA, 22 bp, Homo sapiens
ctaagtgatcctcccacctcag

SEQ ID NO: 2629856 - DNA, 23 bp, Homo sapiens
ctaagtgatcctcccacctcagc

SEQ ID NO: 2629857 - DNA, 16 bp, Homo sapiens
ctaagttatagtatat

SEQ ID NO: 2629858 - DNA, 20 bp, Homo sapiens
ctaagttatagtatatctgg

SEQ ID NO: 2629859 - DNA, 19 bp, Homo sapiens
ctaagtttcagttgatttt

SEQ ID NO: 2629860 - DNA, 13 bp, Homo sapiens
ctaataaaagcat

SEQ ID NO: 2629861 - DNA, 15 bp, Homo sapiens
ctaatacctctgtgt

SEQ ID NO: 2629862 - DNA, 17 bp, Homo sapiens
ctaatacctctgtgtgc

SEQ ID NO: 2629863 - DNA, 13 bp, Homo sapiens
ctaatagaactca

SEQ ID NO: 2629864 - DNA, 11 bp, Homo sapiens
ctaatatattt

SEQ ID NO: 2629865 - DNA, 12 bp, Homo sapiens
ctaatatatttt

SEQ ID NO: 2629866 - DNA, 18 bp, Homo sapiens
ctaatatgtaacaagcca

SEQ ID NO: 2629867 - DNA, 13 bp, Homo sapiens
ctaatattaaaaa

SEQ ID NO: 2629868 - DNA, 18 bp, Homo sapiens
ctaatattaaaaatatgg

SEQ ID NO: 2629869 - DNA, 19 bp, Homo sapiens
ctaatcagggaggtcattt

SEQ ID NO: 2629870 - DNA, 15 bp, Homo sapiens
ctaatcagtgtctca

SEQ ID NO: 2629871 - DNA, 13 bp, Homo sapiens
ctaatccaaccca

SEQ ID NO: 2629872 - DNA, 18 bp, Homo sapiens
ctaatcccgattcaccct

SEQ ID NO: 2629873 - DNA, 20 bp, Homo sapiens
ctaatccctgggcattgctt

SEQ ID NO: 2629874 - DNA, 21 bp, Homo sapiens
ctaatccctgggcattgcttt

SEQ ID NO: 2629875 - DNA, 19 bp, Homo sapiens
ctaatctattgggttcatt

SEQ ID NO: 2629876 - DNA, 18 bp, Homo sapiens
ctaatgaagggaaaggat

SEQ ID NO: 2629877 - DNA, 23 bp, Homo sapiens
ctaatgaagggaaaggatatttt

SEQ ID NO: 2629878 - DNA, 19 bp, Homo sapiens
ctaatgaatgcataaaatg

SEQ ID NO: 2629879 - DNA, 13 bp, Homo sapiens
ctaatgatgtttt

SEQ ID NO: 2629880 - DNA, 23 bp, Homo sapiens
ctaatgctgcagatttgggctgg

SEQ ID NO: 2629881 - DNA, 16 bp, Homo sapiens
ctaatgtactgcatat

SEQ ID NO: 2629882 - DNA, 19 bp, Homo sapiens
ctaatgtcttcatttcatt

SEQ ID NO: 2629883 - DNA, 22 bp, Homo sapiens
ctaatgtcttcatttcattgta

SEQ ID NO: 2629884 - DNA, 20 bp, Homo sapiens
ctaatgtttatgagccagac

SEQ ID NO: 2629885 - DNA, 14 bp, Homo sapiens
ctaattaataaatt

SEQ ID NO: 2629886 - DNA, 14 bp, Homo sapiens
ctaattcccagagt

SEQ ID NO: 2629887 - DNA, 21 bp, Homo sapiens
ctaattcccattttgcaaaat

SEQ ID NO: 2629888 - DNA, 22 bp, Homo sapiens
ctaattctttgacctgttggga

SEQ ID NO: 2629889 - DNA, 21 bp, Homo sapiens
ctaattggaagaaattcctgt

SEQ ID NO: 2629890 - DNA, 22 bp, Homo sapiens
ccagacccccaccccttcccca

SEQ ID NO: 2629891 - DNA, 14 bp, Homo sapiens
ccagacccccagca

SEQ ID NO: 2629892 - DNA, 22 bp, Homo sapiens
ccagacccccagcaaccctcct

SEQ ID NO: 2629893 - DNA, 18 bp, Homo sapiens
ccagacccctctggccag

SEQ ID NO: 2629894 - DNA, 20 bp, Homo sapiens
ccagacccctctggccagga

SEQ ID NO: 2629895 - DNA, 17 bp, Homo sapiens
ccagacccggctgcgtg

SEQ ID NO: 2629896 - DNA, 15 bp, Homo sapiens
ccagaccttctagga

SEQ ID NO: 2629897 - DNA, 19 bp, Homo sapiens
ccagaccttgttcacactc

SEQ ID NO: 2629898 - DNA, 18 bp, Homo sapiens
ccagacggttcaccagcc

SEQ ID NO: 2629899 - DNA, 22 bp, Homo sapiens
ccagactgcttccaattttctg

SEQ ID NO: 2629900 - DNA, 12 bp, Homo sapiens
ccagactgtgga

SEQ ID NO: 2629901 - DNA, 15 bp, Homo sapiens
ccagactgttagaaa

SEQ ID NO: 2629902 - DNA, 22 bp, Homo sapiens
ccagactttacatgacacagct

SEQ ID NO: 2629903 - DNA, 14 bp, Homo sapiens
ccagagaagcccct

SEQ ID NO: 2629904 - DNA, 19 bp, Homo sapiens
ccagagaagtgacagggaa

SEQ ID NO: 2629905 - DNA, 20 bp, Homo sapiens
ccagagaagtgacagggaag

SEQ ID NO: 2629906 - DNA, 19 bp, Homo sapiens
ccagagacggaagcctttt

SEQ ID NO: 2629907 - DNA, 14 bp, Homo sapiens
ccagagagagaagt

SEQ ID NO: 2629908 - DNA, 22 bp, Homo sapiens
ccagagagagaagtgcccctgc

SEQ ID NO: 2629909 - DNA, 19 bp, Homo sapiens
ccagagagggactgacacc

SEQ ID NO: 2629910 - DNA, 15 bp, Homo sapiens
ccagagagtcctctg

SEQ ID NO: 2629911 - DNA, 22 bp, Homo sapiens
ccagagcagatgcagagagcca

SEQ ID NO: 2629912 - DNA, 23 bp, Homo sapiens
ccagagcagatgcagagagccat

SEQ ID NO: 2629913 - DNA, 14 bp, Homo sapiens
ccagagcaggaagc

SEQ ID NO: 2629914 - DNA, 14 bp, Homo sapiens
ccagagcaggaggc

SEQ ID NO: 2629915 - DNA, 20 bp, Homo sapiens
ccagagcattacgtgagcca

SEQ ID NO: 2629916 - DNA, 23 bp, Homo sapiens
ccagagcattacgtgagccaggt

SEQ ID NO: 2629917 - DNA, 19 bp, Homo sapiens
ccagagccccacacggagg

SEQ ID NO: 2629918 - DNA, 21 bp, Homo sapiens
ccagagcgcccctccctagtg

SEQ ID NO: 2629919 - DNA, 21 bp, Homo sapiens
ccagaggaactgtccagagag

SEQ ID NO: 2629920 - DNA, 19 bp, Homo sapiens
ccagaggaaggggccagag

SEQ ID NO: 2629921 - DNA, 15 bp, Homo sapiens
ccagaggctgcccca

SEQ ID NO: 2629922 - DNA, 18 bp, Homo sapiens
ccagagggagtgacagag

SEQ ID NO: 2629923 - DNA, 22 bp, Homo sapiens
ccagagggagtgacagaggcag

SEQ ID NO: 2629924 - DNA, 13 bp, Homo sapiens
ccagagggcccag

SEQ ID NO: 2629925 - DNA, 18 bp, Homo sapiens
ccagagggcctgcaaggg

SEQ ID NO: 2629926 - DNA, 19 bp, Homo sapiens
ccagagggcctgcaaggga

SEQ ID NO: 2629927 - DNA, 23 bp, Homo sapiens
ccagaggggtgggttcctcttcc

SEQ ID NO: 2629928 - DNA, 21 bp, Homo sapiens
ccagaggtaacagaacagctt

SEQ ID NO: 2629929 - DNA, 22 bp, Homo sapiens
ccagaggtaacagaacagcttc

SEQ ID NO: 2629930 - DNA, 23 bp, Homo sapiens
ccagaggtaacagaacagcttca

SEQ ID NO: 2629931 - DNA, 15 bp, Homo sapiens
ccagaggtgggcagg

SEQ ID NO: 2629932 - DNA, 14 bp, Homo sapiens
ccagagtggcctgg

SEQ ID NO: 2629933 - DNA, 15 bp, Homo sapiens
ccagagtggcctggc

SEQ ID NO: 2629934 - DNA, 17 bp, Homo sapiens
ccagagtggcctggcca

SEQ ID NO: 2629935 - DNA, 13 bp, Homo sapiens
ccagagttcctgc

SEQ ID NO: 2629936 - DNA, 22 bp, Homo sapiens
ccagataaaattatagatggga

SEQ ID NO: 2629937 - DNA, 19 bp, Homo sapiens
ccagatattcaagtcacct

SEQ ID NO: 2629938 - DNA, 17 bp, Homo sapiens
ccagatcctcacaacca

SEQ ID NO: 2629939 - DNA, 14 bp, Homo sapiens
ccagatcctcttgg

SEQ ID NO: 2629940 - DNA, 15 bp, Homo sapiens
ccagatcctcttggt

SEQ ID NO: 2629941 - DNA, 22 bp, Homo sapiens
ccagatcggatctgttgcaaac

SEQ ID NO: 2629942 - DNA, 19 bp, Homo sapiens
ccagatctggtcccttgca

SEQ ID NO: 2629943 - DNA, 19 bp, Homo sapiens
ccagatgatgggggagggg

SEQ ID NO: 2629944 - DNA, 23 bp, Homo sapiens
ccagatgcaccagcccttagcag

SEQ ID NO: 2629945 - DNA, 18 bp, Homo sapiens
ccagatgccttctccaga

SEQ ID NO: 2629946 - DNA, 15 bp, Homo sapiens
ccagatgctgatgtt

SEQ ID NO: 2629947 - DNA, 19 bp, Homo sapiens
ccagatgctgatgttcagt

SEQ ID NO: 2629948 - DNA, 16 bp, Homo sapiens
ccagatggactccagc

SEQ ID NO: 2629949 - DNA, 17 bp, Homo sapiens
ccagatggactccagcc

SEQ ID NO: 2629950 - DNA, 20 bp, Homo sapiens
ccagatgggggaaagcacag

SEQ ID NO: 2629951 - DNA, 16 bp, Homo sapiens
ccagattgcaacaggc

SEQ ID NO: 2629952 - DNA, 21 bp, Homo sapiens
ccagcaaagagtgggctgcat

SEQ ID NO: 2629953 - DNA, 15 bp, Homo sapiens
ccagcaaccctccta

SEQ ID NO: 2629954 - DNA, 17 bp, Homo sapiens
ccagcaaccctcctatc

SEQ ID NO: 2629955 - DNA, 21 bp, Homo sapiens
ccagcaacttgtctttttctg

SEQ ID NO: 2629956 - DNA, 15 bp, Homo sapiens
ccagcaagtgagagc

SEQ ID NO: 2629957 - DNA, 19 bp, Homo sapiens
ccagcaagtgagagctggg

SEQ ID NO: 2629958 - DNA, 17 bp, Homo sapiens
ccagcaatatgtaaata

SEQ ID NO: 2629959 - DNA, 21 bp, Homo sapiens
ccagcaatgacatctcagggg

SEQ ID NO: 2629960 - DNA, 22 bp, Homo sapiens
ccagcaatgacatctcaggggc

SEQ ID NO: 2629961 - DNA, 19 bp, Homo sapiens
ccagcaccaacaccacggt

SEQ ID NO: 2629962 - DNA, 22 bp, Homo sapiens
ccagcaccatccgccagggccc

SEQ ID NO: 2629963 - DNA, 14 bp, Homo sapiens
ccagcactgcccaa

SEQ ID NO: 2629964 - DNA, 15 bp, Homo sapiens
ccagcactgcttgag

SEQ ID NO: 2629965 - DNA, 15 bp, Homo sapiens
ccagcacttgtatat

SEQ ID NO: 2629966 - DNA, 14 bp, Homo sapiens
ccagcactttggga

SEQ ID NO: 2629967 - DNA, 15 bp, Homo sapiens
ccagcactttgggag

SEQ ID NO: 2629968 - DNA, 17 bp, Homo sapiens
ccagcactttgggaggc

SEQ ID NO: 2629969 - DNA, 13 bp, Homo sapiens
ccagcagagcacc

SEQ ID NO: 2629970 - DNA, 19 bp, Homo sapiens
ccagcagccagctctcagc

SEQ ID NO: 2629971 - DNA, 20 bp, Homo sapiens
ccagcagccagctctcagcc

SEQ ID NO: 2629972 - DNA, 21 bp, Homo sapiens
ccagcagccagctctcagcca

SEQ ID NO: 2629973 - DNA, 15 bp, Homo sapiens
ccagcagcctggacc

SEQ ID NO: 2629974 - DNA, 20 bp, Homo sapiens
ccagcagcctggaccctgtg

SEQ ID NO: 2629975 - DNA, 24 bp, Homo sapiens
ccagcagcggaaccgcccaggatc

SEQ ID NO: 2629976 - DNA, 20 bp, Homo sapiens
ccagcagggtcttttcatct

SEQ ID NO: 2629977 - DNA, 22 bp, Homo sapiens
ccagcagggtcttttcatctgg

SEQ ID NO: 2629978 - DNA, 23 bp, Homo sapiens
ccagcagggtcttttcatctggg

SEQ ID NO: 2629979 - DNA, 18 bp, Homo sapiens
ccagcatcccttgaccag

SEQ ID NO: 2629980 - DNA, 21 bp, Homo sapiens
ccagcatcccttgaccaggcc

SEQ ID NO: 2629981 - DNA, 19 bp, Homo sapiens
ccagcatccttttctgcag

SEQ ID NO: 2629982 - DNA, 18 bp, Homo sapiens
ccagcattttactgattc

SEQ ID NO: 2629983 - DNA, 18 bp, Homo sapiens
ccagccaaaccctgtctg

SEQ ID NO: 2629984 - DNA, 13 bp, Homo sapiens
ccagccaacccct

SEQ ID NO: 2629985 - DNA, 13 bp, Homo sapiens
ccagccaccccgg

SEQ ID NO: 2629986 - DNA, 22 bp, Homo sapiens
ccagccaccccgggctctctgc

SEQ ID NO: 2629987 - DNA, 21 bp, Homo sapiens
ccagccactcgggaggctgag

SEQ ID NO: 2629988 - DNA, 13 bp, Homo sapiens
ccagccagcagcc

SEQ ID NO: 2629989 - DNA, 15 bp, Homo sapiens
ccagccaggctctgt

SEQ ID NO: 2629990 - DNA, 19 bp, Homo sapiens
ccagccagtgacctgagga

SEQ ID NO: 2629991 - DNA, 22 bp, Homo sapiens
ccagccagtgacctgaggaagc

SEQ ID NO: 2629992 - DNA, 23 bp, Homo sapiens
ccagccagtgacctgaggaagcg

SEQ ID NO: 2629993 - DNA, 15 bp, Homo sapiens
ccagccatctgccca

SEQ ID NO: 2629994 - DNA, 16 bp, Homo sapiens
ccagcccacttctgcc

SEQ ID NO: 2629995 - DNA, 21 bp, Homo sapiens
ccagcccagggttcccccagc

SEQ ID NO: 2629996 - DNA, 23 bp, Homo sapiens
ccagccccaaaactctcctctgc

SEQ ID NO: 2629997 - DNA, 14 bp, Homo sapiens
ccagccccacccag

SEQ ID NO: 2629998 - DNA, 18 bp, Homo sapiens
ccagccccacccaggagg

SEQ ID NO: 2629999 - DNA, 17 bp, Homo sapiens
ccagccccagtgcccac

SEQ ID NO: 2630000 - DNA, 18 bp, Homo sapiens
ccagccccatcctctgta

SEQ ID NO: 2630001 - DNA, 15 bp, Homo sapiens
ccagccccctttggg

SEQ ID NO: 2630002 - DNA, 21 bp, Homo sapiens
ccagcccctcccaccacagca

SEQ ID NO: 2630003 - DNA, 14 bp, Homo sapiens
ccagcccctggatg

SEQ ID NO: 2630004 - DNA, 15 bp, Homo sapiens
ccagcccctggatgc

SEQ ID NO: 2630005 - DNA, 12 bp, Homo sapiens
ccagcccctgta

SEQ ID NO: 2630006 - DNA, 20 bp, Homo sapiens
ccagcccggcctgctcccag

SEQ ID NO: 2630007 - DNA, 12 bp, Homo sapiens
ccttggctgcag

SEQ ID NO: 2630008 - DNA, 13 bp, Homo sapiens
ccttggctgcagg

SEQ ID NO: 2630009 - DNA, 20 bp, Homo sapiens
ccttggcttcaggggagtcc

SEQ ID NO: 2630010 - DNA, 14 bp, Homo sapiens
ccttgggccctttg

SEQ ID NO: 2630011 - DNA, 13 bp, Homo sapiens
ccttgggctccct

SEQ ID NO: 2630012 - DNA, 14 bp, Homo sapiens
ccttgggctgctcc

SEQ ID NO: 2630013 - DNA, 23 bp, Homo sapiens
ccttggggaatttcctctattga

SEQ ID NO: 2630014 - DNA, 16 bp, Homo sapiens
cctgcccggctgcgga

SEQ ID NO: 2630015 - DNA, 20 bp, Homo sapiens
cctgcccgtctctctcccat

SEQ ID NO: 2630016 - DNA, 19 bp, Homo sapiens
cctgccctagagcacactg

SEQ ID NO: 2630017 - DNA, 16 bp, Homo sapiens
cctgccctagctccac

SEQ ID NO: 2630018 - DNA, 14 bp, Homo sapiens
cctgccctcaggga

SEQ ID NO: 2630019 - DNA, 21 bp, Homo sapiens
cctgccctccccagagcactg

SEQ ID NO: 2630020 - DNA, 13 bp, Homo sapiens
cctgccctcccct

SEQ ID NO: 2630021 - DNA, 12 bp, Homo sapiens
cctgccctcgtg

SEQ ID NO: 2630022 - DNA, 15 bp, Homo sapiens
cctgccctcgtggcc

SEQ ID NO: 2630023 - DNA, 19 bp, Homo sapiens
cctgccctcgtggccagcc

SEQ ID NO: 2630024 - DNA, 23 bp, Homo sapiens
cctgccctcgtggccagcccggc

SEQ ID NO: 2630025 - DNA, 15 bp, Homo sapiens
cctgccctgccccca

SEQ ID NO: 2630026 - DNA, 15 bp, Homo sapiens
cctgccctggtccag

SEQ ID NO: 2630027 - DNA, 11 bp, Homo sapiens
cctgccctgtg

SEQ ID NO: 2630028 - DNA, 14 bp, Homo sapiens
cctgccctgtgggc

SEQ ID NO: 2630029 - DNA, 21 bp, Homo sapiens
cctgccctgttgtgtatagat

SEQ ID NO: 2630030 - DNA, 12 bp, Homo sapiens
cctgcctcagcc

SEQ ID NO: 2630031 - DNA, 14 bp, Homo sapiens
cctgcctcagcctc

SEQ ID NO: 2630032 - DNA, 15 bp, Homo sapiens
cctgcctcagcctcc

SEQ ID NO: 2630033 - DNA, 16 bp, Homo sapiens
cctgcctcagcctccc

SEQ ID NO: 2630034 - DNA, 16 bp, Homo sapiens
cctgcctccaccctct

SEQ ID NO: 2630035 - DNA, 16 bp, Homo sapiens
cctgcctcccttcatg

SEQ ID NO: 2630036 - DNA, 12 bp, Homo sapiens
cctgcctcctgc

SEQ ID NO: 2630037 - DNA, 22 bp, Homo sapiens
cctgcctcctttgtgaggaagc

SEQ ID NO: 2630038 - DNA, 23 bp, Homo sapiens
cctgcctcctttgtgaggaagcc

SEQ ID NO: 2630039 - DNA, 15 bp, Homo sapiens
cctgcctctgtttga

SEQ ID NO: 2630040 - DNA, 15 bp, Homo sapiens
cctgcctcttctcta

SEQ ID NO: 2630041 - DNA, 12 bp, Homo sapiens
cctgcctggcca

SEQ ID NO: 2630042 - DNA, 17 bp, Homo sapiens
cctgcctgtctgtctct

SEQ ID NO: 2630043 - DNA, 14 bp, Homo sapiens
cctgccttcctcct

SEQ ID NO: 2630044 - DNA, 16 bp, Homo sapiens
cctgccttctgtcctg

SEQ ID NO: 2630045 - DNA, 19 bp, Homo sapiens
cctgccttctgtcctggtg

SEQ ID NO: 2630046 - DNA, 22 bp, Homo sapiens
cctgccttcttctttttgctgt

SEQ ID NO: 2630047 - DNA, 23 bp, Homo sapiens
cctgccttcttctttttgctgtt

SEQ ID NO: 2630048 - DNA, 16 bp, Homo sapiens
cctgccttgaagccac

SEQ ID NO: 2630049 - DNA, 20 bp, Homo sapiens
cctgcgcccagtccttccac

SEQ ID NO: 2630050 - DNA, 17 bp, Homo sapiens
cctgcggagtgaagagg

SEQ ID NO: 2630051 - DNA, 17 bp, Homo sapiens
cctgcggcctgctggag

SEQ ID NO: 2630052 - DNA, 16 bp, Homo sapiens
cctgcggctgctgtgt

SEQ ID NO: 2630053 - DNA, 17 bp, Homo sapiens
cctgcggtgctatctcc

SEQ ID NO: 2630054 - DNA, 13 bp, Homo sapiens
cctgctccagctg

SEQ ID NO: 2630055 - DNA, 14 bp, Homo sapiens
cctgctccagctgt

SEQ ID NO: 2630056 - DNA, 22 bp, Homo sapiens
cctgctccagctgttcagctgg

SEQ ID NO: 2630057 - DNA, 12 bp, Homo sapiens
cctgctcccagc

SEQ ID NO: 2630058 - DNA, 13 bp, Homo sapiens
cctgctcccagca

SEQ ID NO: 2630059 - DNA, 23 bp, Homo sapiens
cctgctcccagcagccctaagga

SEQ ID NO: 2630060 - DNA, 19 bp, Homo sapiens
cctgctcctccctggctgc

SEQ ID NO: 2630061 - DNA, 22 bp, Homo sapiens
cctgctcctccctggctgccct

SEQ ID NO: 2630062 - DNA, 21 bp, Homo sapiens
cctgctcgatgctcacagggc

SEQ ID NO: 2630063 - DNA, 22 bp, Homo sapiens
cctgctctccgaccagacacct

SEQ ID NO: 2630064 - DNA, 19 bp, Homo sapiens
cctgctctcctcttgccac

SEQ ID NO: 2630065 - DNA, 19 bp, Homo sapiens
cctgctgagggaccagcca

SEQ ID NO: 2630066 - DNA, 11 bp, Homo sapiens
cctgctgcagt

SEQ ID NO: 2630067 - DNA, 22 bp, Homo sapiens
cctgctgcagttgccagtcacc

SEQ ID NO: 2630068 - DNA, 13 bp, Homo sapiens
cctgctgcctccc

SEQ ID NO: 2630069 - DNA, 17 bp, Homo sapiens
cctgctgcctccccaac

SEQ ID NO: 2630070 - DNA, 20 bp, Homo sapiens
cctgctgcctccccaaccct

SEQ ID NO: 2630071 - DNA, 18 bp, Homo sapiens
cctgctgctgacccagcc

SEQ ID NO: 2630072 - DNA, 15 bp, Homo sapiens
cctgctggcccctca

SEQ ID NO: 2630073 - DNA, 16 bp, Homo sapiens
cctgctggcccctcac

SEQ ID NO: 2630074 - DNA, 18 bp, Homo sapiens
cctgctggcccctcacct

SEQ ID NO: 2630075 - DNA, 17 bp, Homo sapiens
cctgctggccgcctcac

SEQ ID NO: 2630076 - DNA, 21 bp, Homo sapiens
cctgctgggtgtggcgcagca

SEQ ID NO: 2630077 - DNA, 17 bp, Homo sapiens
cctgctggtcacagcct

SEQ ID NO: 2630078 - DNA, 18 bp, Homo sapiens
cctgctggtcacagcctc

SEQ ID NO: 2630079 - DNA, 20 bp, Homo sapiens
cctgctggtcacagcctcct

SEQ ID NO: 2630080 - DNA, 19 bp, Homo sapiens
cctgctggttcagggttgg

SEQ ID NO: 2630081 - DNA, 22 bp, Homo sapiens
cctgcttgggtggagaagccat

SEQ ID NO: 2630082 - DNA, 22 bp, Homo sapiens
cctggaagacagagacctcctg

SEQ ID NO: 2630083 - DNA, 18 bp, Homo sapiens
cctggaatatataaccag

SEQ ID NO: 2630084 - DNA, 16 bp, Homo sapiens
cctggacactcagacc

SEQ ID NO: 2630085 - DNA, 17 bp, Homo sapiens
cctggacactcagacct

SEQ ID NO: 2630086 - DNA, 18 bp, Homo sapiens
cctggacatagagaggga

SEQ ID NO: 2630087 - DNA, 24 bp, Homo sapiens
cctggacatgaagattctttccca

SEQ ID NO: 2630088 - DNA, 19 bp, Homo sapiens
cctggacattttttcagtc

SEQ ID NO: 2630089 - DNA, 21 bp, Homo sapiens
cctggacctgccctgggccac

SEQ ID NO: 2630090 - DNA, 23 bp, Homo sapiens
cctggacctgcctcctgcctgcc

SEQ ID NO: 2630091 - DNA, 14 bp, Homo sapiens
cctggactgggagg

SEQ ID NO: 2630092 - DNA, 14 bp, Homo sapiens
cctggagagctaga

SEQ ID NO: 2630093 - DNA, 22 bp, Homo sapiens
cctggagagttcaatggctgct

SEQ ID NO: 2630094 - DNA, 13 bp, Homo sapiens
cctggagcaggcc

SEQ ID NO: 2630095 - DNA, 18 bp, Homo sapiens
cctggagcaggccttgcg

SEQ ID NO: 2630096 - DNA, 15 bp, Homo sapiens
cctggagccaactgc

SEQ ID NO: 2630097 - DNA, 16 bp, Homo sapiens
cctggagccagactct

SEQ ID NO: 2630098 - DNA, 11 bp, Homo sapiens
cctggagcccc

SEQ ID NO: 2630099 - DNA, 16 bp, Homo sapiens
cctggagcccctgggt

SEQ ID NO: 2630100 - DNA, 22 bp, Homo sapiens
cctggagcccctgggtgggtgg

SEQ ID NO: 2630101 - DNA, 22 bp, Homo sapiens
cctggagcgtttctagcaagtg

SEQ ID NO: 2630102 - DNA, 21 bp, Homo sapiens
cctggagggctagaacctaga

SEQ ID NO: 2630103 - DNA, 20 bp, Homo sapiens
cctggaggggctagaaccta

SEQ ID NO: 2630104 - DNA, 21 bp, Homo sapiens
cctggaggggctagaacctag

SEQ ID NO: 2630105 - DNA, 18 bp, Homo sapiens
cctggagtcatgccaagc

SEQ ID NO: 2630106 - DNA, 20 bp, Homo sapiens
cctggagtgtggctgaggag

SEQ ID NO: 2630107 - DNA, 16 bp, Homo sapiens
cctggatctaccagca

SEQ ID NO: 2630108 - DNA, 14 bp, Homo sapiens
cctggatgcagcct

SEQ ID NO: 2630109 - DNA, 19 bp, Homo sapiens
cctggatgcagcctcacag

SEQ ID NO: 2630110 - DNA, 15 bp, Homo sapiens
cctggatggggctgc

SEQ ID NO: 2630111 - DNA, 21 bp, Homo sapiens
cctggcaagctagaacctgga

SEQ ID NO: 2630112 - DNA, 22 bp, Homo sapiens
cctggcaagctagaacctggag

SEQ ID NO: 2630113 - DNA, 20 bp, Homo sapiens
cctggcacccggcccctgct

SEQ ID NO: 2630114 - DNA, 22 bp, Homo sapiens
cctggcactataatgtaagctc

SEQ ID NO: 2630115 - DNA, 17 bp, Homo sapiens
cctggcactgctgtgct

SEQ ID NO: 2630116 - DNA, 23 bp, Homo sapiens
cctggcagaactgagctcctctg

SEQ ID NO: 2630117 - DNA, 19 bp, Homo sapiens
cctggcattatgtccactg

SEQ ID NO: 2630118 - DNA, 21 bp, Homo sapiens
cctggccaccaccccccactc

SEQ ID NO: 2630119 - DNA, 13 bp, Homo sapiens
cctggccacctct

SEQ ID NO: 2630120 - DNA, 14 bp, Homo sapiens
cctggccacctctc

SEQ ID NO: 2630121 - DNA, 15 bp, Homo sapiens
cctggccacctctct

SEQ ID NO: 2630122 - DNA, 18 bp, Homo sapiens
cctggccacctctctcct

SEQ ID NO: 2630123 - DNA, 19 bp, Homo sapiens
cctggccaggagctcttca

SEQ ID NO: 2630124 - DNA, 21 bp, Homo sapiens
cctggccaggcaccccctgga

SEQ ID NO: 2630125 - DNA, 14 bp, Homo sapiens
cctggccaggcaga

SEQ ID NO: 2630126 - DNA, 14 bp, Homo sapiens
cctggccagggcct

SEQ ID NO: 2630127 - DNA, 23 bp, Homo sapiens
cctggccagggcctggaagacag

SEQ ID NO: 2630128 - DNA, 21 bp, Homo sapiens
cctggcccacagcaggtgctg

SEQ ID NO: 2630129 - DNA, 16 bp, Homo sapiens
cctggcccactgcatc

SEQ ID NO: 2630130 - DNA, 15 bp, Homo sapiens
cctggcccagcggcc

SEQ ID NO: 2630131 - DNA, 12 bp, Homo sapiens
cctggccctctg

SEQ ID NO: 2630132 - DNA, 13 bp, Homo sapiens
cctggccctctgt

SEQ ID NO: 2630133 - DNA, 15 bp, Homo sapiens
cctggccctctgtgt

SEQ ID NO: 2630134 - DNA, 15 bp, Homo sapiens
cctggccctgaggtg

SEQ ID NO: 2630135 - DNA, 20 bp, Homo sapiens
cctggccgccccctgccccc

SEQ ID NO: 2630136 - DNA, 21 bp, Homo sapiens
cctggccgccccctgcccccc

SEQ ID NO: 2630137 - DNA, 22 bp, Homo sapiens
cctggccgccccctgcccccca

SEQ ID NO: 2630138 - DNA, 19 bp, Homo sapiens
cctggccggcaaccccagt

SEQ ID NO: 2630139 - DNA, 22 bp, Homo sapiens
cctggccggcaaccccagttct

SEQ ID NO: 2630140 - DNA, 16 bp, Homo sapiens
cctggcctctgcactc

SEQ ID NO: 2630141 - DNA, 22 bp, Homo sapiens
cctggcctctgcactcccctgc

SEQ ID NO: 2630142 - DNA, 15 bp, Homo sapiens
cctggcctgagctgg

SEQ ID NO: 2630143 - DNA, 20 bp, Homo sapiens
cctggcctgagctgggatga

SEQ ID NO: 2630144 - DNA, 15 bp, Homo sapiens
cctggcctggcacac

SEQ ID NO: 2630145 - DNA, 18 bp, Homo sapiens
cctggctcccacaggcag

SEQ ID NO: 2630146 - DNA, 19 bp, Homo sapiens
cctggctcccacaggcagc

SEQ ID NO: 2630147 - DNA, 15 bp, Homo sapiens
cctggctcccatgac

SEQ ID NO: 2630148 - DNA, 11 bp, Homo sapiens
cctggctctga

SEQ ID NO: 2630149 - DNA, 20 bp, Homo sapiens
cctggctgaaggactgtgac

SEQ ID NO: 2630150 - DNA, 22 bp, Homo sapiens
cctggctgaccccaaagagcct

SEQ ID NO: 2630151 - DNA, 18 bp, Homo sapiens
cctggctgccctggccct

SEQ ID NO: 2630152 - DNA, 19 bp, Homo sapiens
cctggctgccctggccctg

SEQ ID NO: 2630153 - DNA, 20 bp, Homo sapiens
cctggctgccctggccctga

SEQ ID NO: 2630154 - DNA, 23 bp, Homo sapiens
cctggcttctggagcccttgggt

SEQ ID NO: 2630155 - DNA, 12 bp, Homo sapiens
cctgggaagggg

SEQ ID NO: 2630156 - DNA, 14 bp, Homo sapiens
cctgggaatgtatt

SEQ ID NO: 2630157 - DNA, 17 bp, Homo sapiens
cctgggacctcccctga

SEQ ID NO: 2630158 - DNA, 19 bp, Homo sapiens
cctgggacctcccctgagg

SEQ ID NO: 2630159 - DNA, 19 bp, Homo sapiens
cctgggaggaaatttgaat

SEQ ID NO: 2630160 - DNA, 23 bp, Homo sapiens
cctgggaggcggagagtacagtg

SEQ ID NO: 2630161 - DNA, 23 bp, Homo sapiens
cctgggaggtggaggttgcagtg

SEQ ID NO: 2630162 - DNA, 23 bp, Homo sapiens
cctgggatgtggctgcagcagcg

SEQ ID NO: 2630163 - DNA, 17 bp, Homo sapiens
cctgggcacctggggag

SEQ ID NO: 2630164 - DNA, 13 bp, Homo sapiens
cctgggcagaaag

SEQ ID NO: 2630165 - DNA, 19 bp, Homo sapiens
cctgggcagccaggctgcc

SEQ ID NO: 2630166 - DNA, 23 bp, Homo sapiens
cctgggccacagggcgagactcc

SEQ ID NO: 2630167 - DNA, 14 bp, Homo sapiens
cctgggccctctct

SEQ ID NO: 2630168 - DNA, 13 bp, Homo sapiens
cctgggcgccctg

SEQ ID NO: 2630169 - DNA, 14 bp, Homo sapiens
cctgggctcggagg

SEQ ID NO: 2630170 - DNA, 19 bp, Homo sapiens
cctgggctcggaggctgcc

SEQ ID NO: 2630171 - DNA, 21 bp, Homo sapiens
cctgggctcggaggctgcccc

SEQ ID NO: 2630172 - DNA, 22 bp, Homo sapiens
cctgggctctgccccagctctg

SEQ ID NO: 2630173 - DNA, 18 bp, Homo sapiens
cctgggctctgggagcag

SEQ ID NO: 2630174 - DNA, 19 bp, Homo sapiens
cctgggctctgggagcagc

SEQ ID NO: 2630175 - DNA, 22 bp, Homo sapiens
cctgggctgagagaacctcacg

SEQ ID NO: 2630176 - DNA, 15 bp, Homo sapiens
cctggggagaaagta

SEQ ID NO: 2630177 - DNA, 19 bp, Homo sapiens
cctggggagtgggacagag

SEQ ID NO: 2630178 - DNA, 22 bp, Homo sapiens
cctggggagtgggacagagtct

SEQ ID NO: 2630179 - DNA, 24 bp, Homo sapiens
cctggggagtgggacagagtctgg

SEQ ID NO: 2630180 - DNA, 22 bp, Homo sapiens
cctggggcctcggagcctcatc

SEQ ID NO: 2630181 - DNA, 18 bp, Homo sapiens
cctggggcctggacctgc

SEQ ID NO: 2630182 - DNA, 19 bp, Homo sapiens
cctggggcgggcccctcat

SEQ ID NO: 2630183 - DNA, 18 bp, Homo sapiens
cctggggctctgtgcagg

SEQ ID NO: 2630184 - DNA, 14 bp, Homo sapiens
cctgggggtgccag

SEQ ID NO: 2630185 - DNA, 16 bp, Homo sapiens
cctgggggtgccagga

SEQ ID NO: 2630186 - DNA, 22 bp, Homo sapiens
cctggggtaccaagagactcct

SEQ ID NO: 2630187 - DNA, 14 bp, Homo sapiens
cctgggtcagtctg

SEQ ID NO: 2630188 - DNA, 20 bp, Homo sapiens
cctgggtccaaataaaaact

SEQ ID NO: 2630189 - DNA, 15 bp, Homo sapiens
cctgggtctgtgtct

SEQ ID NO: 2630190 - DNA, 16 bp, Homo sapiens
cctgggtctgtgtctc

SEQ ID NO: 2630191 - DNA, 21 bp, Homo sapiens
cctgggtctgtgtctcttttc

SEQ ID NO: 2630192 - DNA, 23 bp, Homo sapiens
cctgggtgctggctgcccagacc

SEQ ID NO: 2630193 - DNA, 20 bp, Homo sapiens
cctgggtgggtggtggggag

SEQ ID NO: 2630194 - DNA, 22 bp, Homo sapiens
cctgggtgggtggtggggaggg

SEQ ID NO: 2630195 - DNA, 16 bp, Homo sapiens
cctgggtttaagggga

SEQ ID NO: 2630196 - DNA, 22 bp, Homo sapiens
cctgggttttgtattctctgag

SEQ ID NO: 2630197 - DNA, 18 bp, Homo sapiens
cctggtacccagccatct

SEQ ID NO: 2630198 - DNA, 15 bp, Homo sapiens
cctggtaccctcctg

SEQ ID NO: 2630199 - DNA, 15 bp, Homo sapiens
cctggtactcaagcc

SEQ ID NO: 2630200 - DNA, 19 bp, Homo sapiens
cctggtactcaagcccgcg

SEQ ID NO: 2630201 - DNA, 13 bp, Homo sapiens
cctggtagggcag

SEQ ID NO: 2630202 - DNA, 22 bp, Homo sapiens
cctggtcacaggactctgcctc

SEQ ID NO: 2630203 - DNA, 23 bp, Homo sapiens
cctggtcacaggactctgcctcc

SEQ ID NO: 2630204 - DNA, 16 bp, Homo sapiens
cctggtccctgggagg

SEQ ID NO: 2630205 - DNA, 23 bp, Homo sapiens
cctggtcctgagggtccccacct

SEQ ID NO: 2630206 - DNA, 19 bp, Homo sapiens
cctggtccttccaggcccc

SEQ ID NO: 2630207 - DNA, 14 bp, Homo sapiens
cctggtctctggtc

SEQ ID NO: 2630208 - DNA, 10 bp, Homo sapiens
cctggtgccc

SEQ ID NO: 2630209 - DNA, 17 bp, Homo sapiens
cctggtggacagtcctg

SEQ ID NO: 2630210 - DNA, 20 bp, Homo sapiens
cctggtggacagtcctggga

SEQ ID NO: 2630211 - DNA, 14 bp, Homo sapiens
cctggtggcagctg

SEQ ID NO: 2630212 - DNA, 15 bp, Homo sapiens
cctggtggcagctgc

SEQ ID NO: 2630213 - DNA, 20 bp, Homo sapiens
cctggtggcagtgggagctg

SEQ ID NO: 2630214 - DNA, 20 bp, Homo sapiens
cctggtgggcctcctctgtc

SEQ ID NO: 2630215 - DNA, 18 bp, Homo sapiens
cctggtgggtccaggggc

SEQ ID NO: 2630216 - DNA, 19 bp, Homo sapiens
cctggtgggtccaggggcc

SEQ ID NO: 2630217 - DNA, 21 bp, Homo sapiens
cctggtgtttctagcactggc

SEQ ID NO: 2630218 - DNA, 22 bp, Homo sapiens
cctggtgtttctagcactggcc

SEQ ID NO: 2630219 - DNA, 15 bp, Homo sapiens
cctggttctgatgat

SEQ ID NO: 2630220 - DNA, 21 bp, Homo sapiens
cctggttctgatgatgtgcct

SEQ ID NO: 2630221 - DNA, 21 bp, Homo sapiens
cctgtaacacaagccacagaa

SEQ ID NO: 2630222 - DNA, 23 bp, Homo sapiens
cctgtaacatactggcctggact

SEQ ID NO: 2630223 - DNA, 21 bp, Homo sapiens
cctgtaacctcttcagaggcc

SEQ ID NO: 2630224 - DNA, 23 bp, Homo sapiens
cctgtaatcccagcactttggga

SEQ ID NO: 2630225 - DNA, 15 bp, Homo sapiens
cctgtaatcccagct

SEQ ID NO: 2630226 - DNA, 20 bp, Homo sapiens
cctgtaatcctagcactttg

SEQ ID NO: 2630227 - DNA, 18 bp, Homo sapiens
cctgtaatttttttctta

SEQ ID NO: 2630228 - DNA, 15 bp, Homo sapiens
cctgtacaatattta

SEQ ID NO: 2630229 - DNA, 21 bp, Homo sapiens
cctgtactcaggaggctgagg

SEQ ID NO: 2630230 - DNA, 22 bp, Homo sapiens
cctgtactcaggaggctgaggg

SEQ ID NO: 2630231 - DNA, 23 bp, Homo sapiens
cctgtactcaggaggctgagggg

SEQ ID NO: 2630232 - DNA, 16 bp, Homo sapiens
cctgtactcttccgaa

SEQ ID NO: 2630233 - DNA, 18 bp, Homo sapiens
cctgtagacctagggagg

SEQ ID NO: 2630234 - DNA, 23 bp, Homo sapiens
cctgtagacctagggaggacctt

SEQ ID NO: 2630235 - DNA, 18 bp, Homo sapiens
cctgtagcatcttctgga

SEQ ID NO: 2630236 - DNA, 21 bp, Homo sapiens
cctgtagcatcttctggagtc

SEQ ID NO: 2630237 - DNA, 13 bp, Homo sapiens
cctgtagtcccag

SEQ ID NO: 2630238 - DNA, 16 bp, Homo sapiens
cctgtagtcccagcta

SEQ ID NO: 2630239 - DNA, 18 bp, Homo sapiens
cctgtagttaggaaataa

SEQ ID NO: 2630240 - DNA, 18 bp, Homo sapiens
cctgtagttgcgtggact

SEQ ID NO: 2630241 - DNA, 17 bp, Homo sapiens
cctgtatgtctccagta

SEQ ID NO: 2630242 - DNA, 18 bp, Homo sapiens
cctgtcaaacaaagccag

SEQ ID NO: 2630243 - DNA, 14 bp, Homo sapiens
cctgtcatgccccc

SEQ ID NO: 2630244 - DNA, 21 bp, Homo sapiens
cctgtcatgcccccctcaaac

SEQ ID NO: 2630245 - DNA, 22 bp, Homo sapiens
cctgtccacacccagctcagca

SEQ ID NO: 2630246 - DNA, 16 bp, Homo sapiens
cctgtccagcctgggc

SEQ ID NO: 2630247 - DNA, 11 bp, Homo sapiens
cctgtcccacc

SEQ ID NO: 2630248 - DNA, 13 bp, Homo sapiens
cctgtcccacccc

SEQ ID NO: 2630249 - DNA, 16 bp, Homo sapiens
cctgtcccatggacac

SEQ ID NO: 2630250 - DNA, 21 bp, Homo sapiens
cctgtcctcccatcccctgga

SEQ ID NO: 2630251 - DNA, 22 bp, Homo sapiens
cctgtcctcccatcccctggac

SEQ ID NO: 2630252 - DNA, 23 bp, Homo sapiens
cctgtcctcccatcccctggact

SEQ ID NO: 2630253 - DNA, 22 bp, Homo sapiens
cctgtcctgatggtcagctccc

SEQ ID NO: 2630254 - DNA, 16 bp, Homo sapiens
cctgtcctgggctggt

SEQ ID NO: 2630255 - DNA, 18 bp, Homo sapiens
cctgtcctgggctggtgg

SEQ ID NO: 2630256 - DNA, 15 bp, Homo sapiens
cctgtcgagacactt

SEQ ID NO: 2630257 - DNA, 17 bp, Homo sapiens
cctgtcggcctggtgtt

SEQ ID NO: 2630258 - DNA, 14 bp, Homo sapiens
cctgtctcagcctc

SEQ ID NO: 2630259 - DNA, 16 bp, Homo sapiens
cctgtctcagcctccc

SEQ ID NO: 2630260 - DNA, 21 bp, Homo sapiens
cctgtctcctttgcaggctca

SEQ ID NO: 2630261 - DNA, 13 bp, Homo sapiens
cctgtctctgccc

SEQ ID NO: 2630262 - DNA, 13 bp, Homo sapiens
cctgtctcttcca

SEQ ID NO: 2630263 - DNA, 14 bp, Homo sapiens
cctgtctgccagcc

SEQ ID NO: 2630264 - DNA, 19 bp, Homo sapiens
cctgtctgccagccagcag

SEQ ID NO: 2630265 - DNA, 23 bp, Homo sapiens
cctgtctgccagccagcagccag

SEQ ID NO: 2630266 - DNA, 16 bp, Homo sapiens
cctgtcttcccagggt

SEQ ID NO: 2630267 - DNA, 18 bp, Homo sapiens
cctgtcttcccagggtag

SEQ ID NO: 2630268 - DNA, 19 bp, Homo sapiens
cctgtgaaatagttcaaag

SEQ ID NO: 2630269 - DNA, 18 bp, Homo sapiens
cctgtgaagtaaggatgt

SEQ ID NO: 2630270 - DNA, 16 bp, Homo sapiens
cctgtgaccagcactg

SEQ ID NO: 2630271 - DNA, 17 bp, Homo sapiens
cctgtgatggggccctg

SEQ ID NO: 2630272 - DNA, 18 bp, Homo sapiens
cctgtgatggggccctgc

SEQ ID NO: 2630273 - DNA, 20 bp, Homo sapiens
cctgtgcatgtatgtcttgg

SEQ ID NO: 2630274 - DNA, 18 bp, Homo sapiens
cctgtgcctaacaccagc

SEQ ID NO: 2630275 - DNA, 21 bp, Homo sapiens
cctgtgcctcctcacccccag

SEQ ID NO: 2630276 - DNA, 15 bp, Homo sapiens
cctgtgcctctggga

SEQ ID NO: 2630277 - DNA, 17 bp, Homo sapiens
cctgtgcctctgggact

SEQ ID NO: 2630278 - DNA, 20 bp, Homo sapiens
cctgtgctccgtgcctccac

SEQ ID NO: 2630279 - DNA, 21 bp, Homo sapiens
cctgtgctggtgtcctgacca

SEQ ID NO: 2630280 - DNA, 19 bp, Homo sapiens
cctgtggaagggactagga

SEQ ID NO: 2630281 - DNA, 20 bp, Homo sapiens
cctgtggaagggactaggag

SEQ ID NO: 2630282 - DNA, 24 bp, Homo sapiens
cctgtggaagggactaggagcact

SEQ ID NO: 2630283 - DNA, 18 bp, Homo sapiens
cctgtggagcccgcaccc

SEQ ID NO: 2630284 - DNA, 20 bp, Homo sapiens
cctgtggatgataaaacaca

SEQ ID NO: 2630285 - DNA, 14 bp, Homo sapiens
cctgtggcaggcag

SEQ ID NO: 2630286 - DNA, 19 bp, Homo sapiens
cctgtggcaggcagcgcca

SEQ ID NO: 2630287 - DNA, 18 bp, Homo sapiens
cctgtggcatctttgcct

SEQ ID NO: 2630288 - DNA, 14 bp, Homo sapiens
cctgtggcctgtgt

SEQ ID NO: 2630289 - DNA, 18 bp, Homo sapiens
cctgtggcctgtgtccca

SEQ ID NO: 2630290 - DNA, 23 bp, Homo sapiens
cctgtggcctgtgtcccatgacc

SEQ ID NO: 2630291 - DNA, 20 bp, Homo sapiens
cctgtgggcccccaaatgga

SEQ ID NO: 2630292 - DNA, 20 bp, Homo sapiens
cctgtggggatctcaggggc

SEQ ID NO: 2630293 - DNA, 20 bp, Homo sapiens
cctgtggggatttctcccag

SEQ ID NO: 2630294 - DNA, 14 bp, Homo sapiens
cctgtgtcccatga

SEQ ID NO: 2630295 - DNA, 22 bp, Homo sapiens
cctgtgtcccatgacccacccc

SEQ ID NO: 2630296 - DNA, 23 bp, Homo sapiens
cctgtgtcccatgacccacccct

SEQ ID NO: 2630297 - DNA, 17 bp, Homo sapiens
cctgtgtcttgcaatgg

SEQ ID NO: 2630298 - DNA, 19 bp, Homo sapiens
cctgtgtcttgcaatggca

SEQ ID NO: 2630299 - DNA, 20 bp, Homo sapiens
cctgtgtgtgcgcctacagg

SEQ ID NO: 2630300 - DNA, 13 bp, Homo sapiens
cctgtgtttctag

SEQ ID NO: 2630301 - DNA, 15 bp, Homo sapiens
cctgttacccagaga

SEQ ID NO: 2630302 - DNA, 17 bp, Homo sapiens
cctgttacctactttga

SEQ ID NO: 2630303 - DNA, 18 bp, Homo sapiens
cctgttacctactttgac

SEQ ID NO: 2630304 - DNA, 22 bp, Homo sapiens
cctgttacttgaaataccagtg

SEQ ID NO: 2630305 - DNA, 18 bp, Homo sapiens
cctgttagctgttatttc

SEQ ID NO: 2630306 - DNA, 21 bp, Homo sapiens
cctgttcagctccagctcacc

SEQ ID NO: 2630307 - DNA, 17 bp, Homo sapiens
cctgttcagttacagaa

SEQ ID NO: 2630308 - DNA, 22 bp, Homo sapiens
cctgttcccctcactggatgaa

SEQ ID NO: 2630309 - DNA, 14 bp, Homo sapiens
cctgttgcacccag

SEQ ID NO: 2630310 - DNA, 22 bp, Homo sapiens
cctgttgcacccagccctggtc

SEQ ID NO: 2630311 - DNA, 17 bp, Homo sapiens
cctgttgcttacaattt

SEQ ID NO: 2630312 - DNA, 12 bp, Homo sapiens
aaaaaaaaagtt

SEQ ID NO: 2630313 - DNA, 13 bp, Homo sapiens
aaaaaaaatactt

SEQ ID NO: 2630314 - DNA, 13 bp, Homo sapiens
aaaaaaacacaaa

SEQ ID NO: 2630315 - DNA, 9 bp, Homo sapiens
aaaaaaaga

SEQ ID NO: 2630316 - DNA, 11 bp, Homo sapiens
aaaaaaagaca

SEQ ID NO: 2630317 - DNA, 13 bp, Homo sapiens
aaaaaaagacaag

SEQ ID NO: 2630318 - DNA, 12 bp, Homo sapiens
aaaaaaatgact

SEQ ID NO: 2630319 - DNA, 15 bp, Homo sapiens
aaaaaagttatatag

SEQ ID NO: 2630320 - DNA, 20 bp, Homo sapiens
aaaaaataatctatttctat

SEQ ID NO: 2630321 - DNA, 22 bp, Homo sapiens
aaaaaatgctgaacattgcata

SEQ ID NO: 2630322 - DNA, 16 bp, Homo sapiens
aaaaaatgtatatgca

SEQ ID NO: 2630323 - DNA, 14 bp, Homo sapiens
aaaaaatttaagtg

SEQ ID NO: 2630324 - DNA, 14 bp, Homo sapiens
aaaaacacaaaagt

SEQ ID NO: 2630325 - DNA, 13 bp, Homo sapiens
aaaaacacagcaa

SEQ ID NO: 2630326 - DNA, 17 bp, Homo sapiens
aaaaacagcattgcttt

SEQ ID NO: 2630327 - DNA, 14 bp, Homo sapiens
aaaaaccaaaactg

SEQ ID NO: 2630328 - DNA, 22 bp, Homo sapiens
aaaaaccttgtatatcttgttt

SEQ ID NO: 2630329 - DNA, 20 bp, Homo sapiens
aaaaactaaatctctaatat

SEQ ID NO: 2630330 - DNA, 15 bp, Homo sapiens
aaaaagaaaggaggg

SEQ ID NO: 2630331 - DNA, 19 bp, Homo sapiens
aaaaaggaaaaaattaata

SEQ ID NO: 2630332 - DNA, 19 bp, Homo sapiens
aaaaaggcatattgctttt

SEQ ID NO: 2630333 - DNA, 13 bp, Homo sapiens
aaaaagtattatt

SEQ ID NO: 2630334 - DNA, 13 bp, Homo sapiens
aaaaagtgacaca

SEQ ID NO: 2630335 - DNA, 17 bp, Homo sapiens
aaaaagtgacacagcag

SEQ ID NO: 2630336 - DNA, 23 bp, Homo sapiens
aaaaagtgacacagcagcttcac

SEQ ID NO: 2630337 - DNA, 13 bp, Homo sapiens
aaaaagtttgttt

SEQ ID NO: 2630338 - DNA, 16 bp, Homo sapiens
aaaaataataataatg

SEQ ID NO: 2630339 - DNA, 13 bp, Homo sapiens
aaaaatacaaaaa

SEQ ID NO: 2630340 - DNA, 14 bp, Homo sapiens
aaaaatataactta

SEQ ID NO: 2630341 - DNA, 16 bp, Homo sapiens
aaaaatccagaaagaa

SEQ ID NO: 2630342 - DNA, 18 bp, Homo sapiens
aaaaatctaccttctgta

SEQ ID NO: 2630343 - DNA, 22 bp, Homo sapiens
aaaaatctaccttctgtagttt

SEQ ID NO: 2630344 - DNA, 17 bp, Homo sapiens
aaaaatctcaaatttct

SEQ ID NO: 2630345 - DNA, 20 bp, Homo sapiens
aaaaatctcaaatttctaaa

SEQ ID NO: 2630346 - DNA, 14 bp, Homo sapiens
aaaaatgaaattat

SEQ ID NO: 2630347 - DNA, 12 bp, Homo sapiens
aaaaatgccttt

SEQ ID NO: 2630348 - DNA, 13 bp, Homo sapiens
aaaaatgcctttg

SEQ ID NO: 2630349 - DNA, 18 bp, Homo sapiens
aaaaatgcctttgagaca

SEQ ID NO: 2630350 - DNA, 21 bp, Homo sapiens
aaaaatgcctttgagacagtt

SEQ ID NO: 2630351 - DNA, 22 bp, Homo sapiens
aaaaatgcctttgagacagttt

SEQ ID NO: 2630352 - DNA, 24 bp, Homo sapiens
aaaaatgcctttgagacagtttct

SEQ ID NO: 2630353 - DNA, 15 bp, Homo sapiens
aaaaatgctgaacat

SEQ ID NO: 2630354 - DNA, 23 bp, Homo sapiens
aaaaatggaaacatttattcctt

SEQ ID NO: 2630355 - DNA, 22 bp, Homo sapiens
aaaaatggaacataaaatacaa

SEQ ID NO: 2630356 - DNA, 14 bp, Homo sapiens
aaaaatggctcaga

SEQ ID NO: 2630357 - DNA, 16 bp, Homo sapiens
aaaaatgggacttctt

SEQ ID NO: 2630358 - DNA, 23 bp, Homo sapiens
aaaaatgggacttcttttcacat

SEQ ID NO: 2630359 - DNA, 22 bp, Homo sapiens
aaaaatgtcttgggtaggcggg

SEQ ID NO: 2630360 - DNA, 20 bp, Homo sapiens
aaaaatgttggatttataaa

SEQ ID NO: 2630361 - DNA, 18 bp, Homo sapiens
aaaaattggttctttatt

SEQ ID NO: 2630362 - DNA, 14 bp, Homo sapiens
aaaaattgtgatca

SEQ ID NO: 2630363 - DNA, 21 bp, Homo sapiens
aaaaatttaagcattgtttgc

SEQ ID NO: 2630364 - DNA, 22 bp, Homo sapiens
aaaaatttaagcattgtttgct

SEQ ID NO: 2630365 - DNA, 22 bp, Homo sapiens
aaaaattttataaaattaagca

SEQ ID NO: 2630366 - DNA, 20 bp, Homo sapiens
aaaacacagtgtttttgtaa

SEQ ID NO: 2630367 - DNA, 13 bp, Homo sapiens
aaaacacattttt

SEQ ID NO: 2630368 - DNA, 18 bp, Homo sapiens
aaaacactgccatcttag

SEQ ID NO: 2630369 - DNA, 19 bp, Homo sapiens
aaaacactgttctctgccc

SEQ ID NO: 2630370 - DNA, 16 bp, Homo sapiens
aaaacagcattgcttt

SEQ ID NO: 2630371 - DNA, 20 bp, Homo sapiens
aaaacagcattgctttctga

SEQ ID NO: 2630372 - DNA, 21 bp, Homo sapiens
aaaacatccagatacacccaa

SEQ ID NO: 2630373 - DNA, 11 bp, Homo sapiens
aaaacatctgg

SEQ ID NO: 2630374 - DNA, 15 bp, Homo sapiens
aaaacatgctacaca

SEQ ID NO: 2630375 - DNA, 19 bp, Homo sapiens
aaaacatgtaatataaaga

SEQ ID NO: 2630376 - DNA, 19 bp, Homo sapiens
aaaacattttcacacaata

SEQ ID NO: 2630377 - DNA, 15 bp, Homo sapiens
aaaaccaatgttctc

SEQ ID NO: 2630378 - DNA, 13 bp, Homo sapiens
aaaaccacagcag

SEQ ID NO: 2630379 - DNA, 20 bp, Homo sapiens
aaaaccacagccctgtcagt

SEQ ID NO: 2630380 - DNA, 17 bp, Homo sapiens
aaaaccactagaactct

SEQ ID NO: 2630381 - DNA, 17 bp, Homo sapiens
aaaacgcatggagtgtg

SEQ ID NO: 2630382 - DNA, 18 bp, Homo sapiens
aaaacgcatggagtgtgt

SEQ ID NO: 2630383 - DNA, 15 bp, Homo sapiens
aaaacgttttattgt

SEQ ID NO: 2630384 - DNA, 16 bp, Homo sapiens
aaaacgttttattgtg

SEQ ID NO: 2630385 - DNA, 17 bp, Homo sapiens
aaaactgaagtctgaaa

SEQ ID NO: 2630386 - DNA, 21 bp, Homo sapiens
aaaactgaagtctgaaatttg

SEQ ID NO: 2630387 - DNA, 16 bp, Homo sapiens
aaaactgactccttag

SEQ ID NO: 2630388 - DNA, 20 bp, Homo sapiens
aaaactgctgactgttttct

SEQ ID NO: 2630389 - DNA, 15 bp, Homo sapiens
aaaacttcagacata

SEQ ID NO: 2630390 - DNA, 20 bp, Homo sapiens
aaaactttactaagatgaca

SEQ ID NO: 2630391 - DNA, 21 bp, Homo sapiens
aaaactttatgctaagtgaaa

SEQ ID NO: 2630392 - DNA, 11 bp, Homo sapiens
aaaactttgga

SEQ ID NO: 2630393 - DNA, 11 bp, Homo sapiens
aaaagaaaaaa

SEQ ID NO: 2630394 - DNA, 16 bp, Homo sapiens
aaaagaacagtaaaca

SEQ ID NO: 2630395 - DNA, 14 bp, Homo sapiens
tttaattgattatt

SEQ ID NO: 2630396 - DNA, 18 bp, Homo sapiens
tttaattgttaagatatg

SEQ ID NO: 2630397 - DNA, 16 bp, Homo sapiens
tttaattgttgtttct

SEQ ID NO: 2630398 - DNA, 22 bp, Homo sapiens
tttaattgttgtttctttctag

SEQ ID NO: 2630399 - DNA, 16 bp, Homo sapiens
tttaatttatttatta

SEQ ID NO: 2630400 - DNA, 19 bp, Homo sapiens
tttaatttatttattaaga

SEQ ID NO: 2630401 - DNA, 15 bp, Homo sapiens
tttacaaaaatataa

SEQ ID NO: 2630402 - DNA, 21 bp, Homo sapiens
tttacaagaaaaaatgaattt

SEQ ID NO: 2630403 - DNA, 21 bp, Homo sapiens
tttacaagcccccccttccac

SEQ ID NO: 2630404 - DNA, 21 bp, Homo sapiens
tttacaagtgtatatcagaaa

SEQ ID NO: 2630405 - DNA, 20 bp, Homo sapiens
tttacatgcaatttattaaa

SEQ ID NO: 2630406 - DNA, 12 bp, Homo sapiens
tttaccaagttt

SEQ ID NO: 2630407 - DNA, 13 bp, Homo sapiens
tttacccttggct

SEQ ID NO: 2630408 - DNA, 16 bp, Homo sapiens
tttacctgagaccagt

SEQ ID NO: 2630409 - DNA, 20 bp, Homo sapiens
tttaccttttttatacataa

SEQ ID NO: 2630410 - DNA, 18 bp, Homo sapiens
tttacgtctgggagaaat

SEQ ID NO: 2630411 - DNA, 23 bp, Homo sapiens
tttactaagatgacattgctaag

SEQ ID NO: 2630412 - DNA, 13 bp, Homo sapiens
tttactgaacaat

SEQ ID NO: 2630413 - DNA, 21 bp, Homo sapiens
tttactgagcttctctgtgaa

SEQ ID NO: 2630414 - DNA, 11 bp, Homo sapiens
tttactgccac

SEQ ID NO: 2630415 - DNA, 12 bp, Homo sapiens
tttactgccact

SEQ ID NO: 2630416 - DNA, 11 bp, Homo sapiens
tttacttaaac

SEQ ID NO: 2630417 - DNA, 16 bp, Homo sapiens
tttacttaaagattta

SEQ ID NO: 2630418 - DNA, 13 bp, Homo sapiens
tttacttcttata

SEQ ID NO: 2630419 - DNA, 15 bp, Homo sapiens
tttacttcttataca

SEQ ID NO: 2630420 - DNA, 19 bp, Homo sapiens
tttacttcttatacatttg

SEQ ID NO: 2630421 - DNA, 15 bp, Homo sapiens
tttactttgtgttca

SEQ ID NO: 2630422 - DNA, 15 bp, Homo sapiens
tttacttttaaacag

SEQ ID NO: 2630423 - DNA, 16 bp, Homo sapiens
tttacttttaaactgt

SEQ ID NO: 2630424 - DNA, 14 bp, Homo sapiens
tttagaagactcta

SEQ ID NO: 2630425 - DNA, 15 bp, Homo sapiens
tttagaagactctac

SEQ ID NO: 2630426 - DNA, 18 bp, Homo sapiens
tttagacaaatactcatg

SEQ ID NO: 2630427 - DNA, 20 bp, Homo sapiens
tttagacaaatactcatgtg

SEQ ID NO: 2630428 - DNA, 12 bp, Homo sapiens
tttagacagagt

SEQ ID NO: 2630429 - DNA, 20 bp, Homo sapiens
tttagacttaatagaaacat

SEQ ID NO: 2630430 - DNA, 18 bp, Homo sapiens
tttagagttgatactaca

SEQ ID NO: 2630431 - DNA, 13 bp, Homo sapiens
tttagataataca

SEQ ID NO: 2630432 - DNA, 13 bp, Homo sapiens
tttagatgctgat

SEQ ID NO: 2630433 - DNA, 21 bp, Homo sapiens
tttagctgatgaacttattct

SEQ ID NO: 2630434 - DNA, 23 bp, Homo sapiens
tttagctgatgaacttattctgt

SEQ ID NO: 2630435 - DNA, 15 bp, Homo sapiens
tttagggcagcttgc

SEQ ID NO: 2630436 - DNA, 14 bp, Homo sapiens
tttagggccaggca

SEQ ID NO: 2630437 - DNA, 22 bp, Homo sapiens
tttaggtttttgtttgtttcct

SEQ ID NO: 2630438 - DNA, 21 bp, Homo sapiens
tttagtagatattaccagttt

SEQ ID NO: 2630439 - DNA, 12 bp, Homo sapiens
tttagtcacttt

SEQ ID NO: 2630440 - DNA, 16 bp, Homo sapiens
tttagttacagctgtg

SEQ ID NO: 2630441 - DNA, 13 bp, Homo sapiens
tttagttatagtt

SEQ ID NO: 2630442 - DNA, 17 bp, Homo sapiens
tttagttgtatctcttt

SEQ ID NO: 2630443 - DNA, 22 bp, Homo sapiens
tttagtttctgttctgtggaaa

SEQ ID NO: 2630444 - DNA, 18 bp, Homo sapiens
tttataaatcgcttttga

SEQ ID NO: 2630445 - DNA, 19 bp, Homo sapiens
tttataaatcgcttttgat

SEQ ID NO: 2630446 - DNA, 12 bp, Homo sapiens
tttataaatgct

SEQ ID NO: 2630447 - DNA, 15 bp, Homo sapiens
tttataaatgctatt

SEQ ID NO: 2630448 - DNA, 16 bp, Homo sapiens
tttataaatgctattt

SEQ ID NO: 2630449 - DNA, 22 bp, Homo sapiens
tttataactcatcataaaataa

SEQ ID NO: 2630450 - DNA, 17 bp, Homo sapiens
tttatacaaatgtctta

SEQ ID NO: 2630451 - DNA, 15 bp, Homo sapiens
tttatacaacagtgc

SEQ ID NO: 2630452 - DNA, 17 bp, Homo sapiens
tttatacaacagtgcta

SEQ ID NO: 2630453 - DNA, 23 bp, Homo sapiens
tttatacaacagtgctaaaaatg

SEQ ID NO: 2630454 - DNA, 16 bp, Homo sapiens
tttatacaatatcatc

SEQ ID NO: 2630455 - DNA, 20 bp, Homo sapiens
tttatacataaacaagacca

SEQ ID NO: 2630456 - DNA, 15 bp, Homo sapiens
tttatacgtgtagct

SEQ ID NO: 2630457 - DNA, 16 bp, Homo sapiens
tttatactgtttactg

SEQ ID NO: 2630458 - DNA, 17 bp, Homo sapiens
tttatagctattactgt

SEQ ID NO: 2630459 - DNA, 16 bp, Homo sapiens
tttatatatttataac

SEQ ID NO: 2630460 - DNA, 21 bp, Homo sapiens
tttatatgaagaaaatcactt

SEQ ID NO: 2630461 - DNA, 20 bp, Homo sapiens
tttatatgcttactgatata

SEQ ID NO: 2630462 - DNA, 16 bp, Homo sapiens
tttatattagaagtgt

SEQ ID NO: 2630463 - DNA, 12 bp, Homo sapiens
tttatattttta

SEQ ID NO: 2630464 - DNA, 21 bp, Homo sapiens
tttatcaatcagtataattct

SEQ ID NO: 2630465 - DNA, 16 bp, Homo sapiens
tttatcacatgtatgt

SEQ ID NO: 2630466 - DNA, 14 bp, Homo sapiens
tttatcagaattct

SEQ ID NO: 2630467 - DNA, 21 bp, Homo sapiens
tttatcagtgacagagttcac

SEQ ID NO: 2630468 - DNA, 17 bp, Homo sapiens
tttatcattcaagtgta

SEQ ID NO: 2630469 - DNA, 21 bp, Homo sapiens
tttatccattcaactgaaaat

SEQ ID NO: 2630470 - DNA, 14 bp, Homo sapiens
tttatcttgtctct

SEQ ID NO: 2630471 - DNA, 18 bp, Homo sapiens
tttatctttatatgaaga

SEQ ID NO: 2630472 - DNA, 12 bp, Homo sapiens
tttatgaagaaa

SEQ ID NO: 2630473 - DNA, 18 bp, Homo sapiens
tttatgaattaaagtaat

SEQ ID NO: 2630474 - DNA, 19 bp, Homo sapiens
tttatgagccagacaaatg

SEQ ID NO: 2630475 - DNA, 14 bp, Homo sapiens
tttatgatgtatat

SEQ ID NO: 2630476 - DNA, 20 bp, Homo sapiens
tttatgcatttgcatttgct

SEQ ID NO: 2630477 - DNA, 20 bp, Homo sapiens
tttatgccttttatttctta

SEQ ID NO: 2630478 - DNA, 15 bp, Homo sapiens
tttatgctttaaaca

SEQ ID NO: 2630479 - DNA, 16 bp, Homo sapiens
tttatgctttaaacat

SEQ ID NO: 2630480 - DNA, 14 bp, Homo sapiens
tttatggcttttgt

SEQ ID NO: 2630481 - DNA, 24 bp, Homo sapiens
tttatggcttttgtgcattatcta

SEQ ID NO: 2630482 - DNA, 11 bp, Homo sapiens
tttatgtgtgt

SEQ ID NO: 2630483 - DNA, 13 bp, Homo sapiens
tttatgtgtgtgt

SEQ ID NO: 2630484 - DNA, 13 bp, Homo sapiens
tttattaaaatct

SEQ ID NO: 2630485 - DNA, 22 bp, Homo sapiens
tttattaaacagatttttacaa

SEQ ID NO: 2630486 - DNA, 12 bp, Homo sapiens
tttattaacaaa

SEQ ID NO: 2630487 - DNA, 22 bp, Homo sapiens
tttattaagatggattctcaga

SEQ ID NO: 2630488 - DNA, 13 bp, Homo sapiens
tttattatgcatg

SEQ ID NO: 2630489 - DNA, 16 bp, Homo sapiens
tttattattactgttt

SEQ ID NO: 2630490 - DNA, 17 bp, Homo sapiens
tttattcaattcctctg

SEQ ID NO: 2630491 - DNA, 19 bp, Homo sapiens
tttattccatattcatgta

SEQ ID NO: 2630492 - DNA, 14 bp, Homo sapiens
tttattgagaattt

SEQ ID NO: 2630493 - DNA, 23 bp, Homo sapiens
tttattgcatctgggtagctgta

SEQ ID NO: 2630494 - DNA, 20 bp, Homo sapiens
tttattgttaactcttgtct

SEQ ID NO: 2630495 - DNA, 22 bp, Homo sapiens
tttattgtttaaaatcatttct

SEQ ID NO: 2630496 - DNA, 14 bp, Homo sapiens
tttatttaaaagat

SEQ ID NO: 2630497 - DNA, 15 bp, Homo sapiens
tttatttaaaagatt

SEQ ID NO: 2630498 - DNA, 13 bp, Homo sapiens
tttatttcttaaa

SEQ ID NO: 2630499 - DNA, 22 bp, Homo sapiens
tttattttctggtagatagaaa

SEQ ID NO: 2630500 - DNA, 12 bp, Homo sapiens
tttatttttcat

SEQ ID NO: 2630501 - DNA, 15 bp, Homo sapiens
tttatttttgcatgg

SEQ ID NO: 2630502 - DNA, 15 bp, Homo sapiens
tttattttttacatt

SEQ ID NO: 2630503 - DNA, 12 bp, Homo sapiens
tttcaaacttta

SEQ ID NO: 2630504 - DNA, 16 bp, Homo sapiens
tttcaaactttactat

SEQ ID NO: 2630505 - DNA, 20 bp, Homo sapiens
tttcaaatagggtctaactc

SEQ ID NO: 2630506 - DNA, 16 bp, Homo sapiens
tttcaaattgagagaa

SEQ ID NO: 2630507 - DNA, 14 bp, Homo sapiens
tttcaaatttcaca

SEQ ID NO: 2630508 - DNA, 22 bp, Homo sapiens
tttcaacttggcttcctttctt

SEQ ID NO: 2630509 - DNA, 22 bp, Homo sapiens
tttcaagcctgcctaggaattc

SEQ ID NO: 2630510 - DNA, 20 bp, Homo sapiens
tttcaatgtgattctaatgt

SEQ ID NO: 2630511 - DNA, 12 bp, Homo sapiens
tttcaattaaac

SEQ ID NO: 2630512 - DNA, 17 bp, Homo sapiens
tttcaattaaacggatt

SEQ ID NO: 2630513 - DNA, 18 bp, Homo sapiens
tttcaattgcatctccca

SEQ ID NO: 2630514 - DNA, 13 bp, Homo sapiens
tttcacaaataaa

SEQ ID NO: 2630515 - DNA, 15 bp, Homo sapiens
tttcacagtttttcc

SEQ ID NO: 2630516 - DNA, 13 bp, Homo sapiens
tttcacattttcc

SEQ ID NO: 2630517 - DNA, 14 bp, Homo sapiens
tttcacattttcct

SEQ ID NO: 2630518 - DNA, 17 bp, Homo sapiens
tttcaccagatttgcta

SEQ ID NO: 2630519 - DNA, 22 bp, Homo sapiens
tttcacggtgccaggttttctg

SEQ ID NO: 2630520 - DNA, 24 bp, Homo sapiens
tttcactcttattgcccacgctgg

SEQ ID NO: 2630521 - DNA, 20 bp, Homo sapiens
tttcactgctgcaaggcctt

SEQ ID NO: 2630522 - DNA, 17 bp, Homo sapiens
tttcactggagttacat

SEQ ID NO: 2630523 - DNA, 18 bp, Homo sapiens
tttcagataactgttatt

SEQ ID NO: 2630524 - DNA, 14 bp, Homo sapiens
tttcagatataaaa

SEQ ID NO: 2630525 - DNA, 18 bp, Homo sapiens
tttcagatataaaagact

SEQ ID NO: 2630526 - DNA, 16 bp, Homo sapiens
tttcagatatatatca

SEQ ID NO: 2630527 - DNA, 12 bp, Homo sapiens
tttcagatgctt

SEQ ID NO: 2630528 - DNA, 21 bp, Homo sapiens
tttcagatgtcttctgcctgt

SEQ ID NO: 2630529 - DNA, 21 bp, Homo sapiens
tttcagcagactatgaatatt

SEQ ID NO: 2630530 - DNA, 16 bp, Homo sapiens
tttcaggatactctgt

SEQ ID NO: 2630531 - DNA, 15 bp, Homo sapiens
tttcaggtgacatgt

SEQ ID NO: 2630532 - DNA, 16 bp, Homo sapiens
tttcaggtgacatgtg

SEQ ID NO: 2630533 - DNA, 18 bp, Homo sapiens
tttcaggtgtttagttgc

SEQ ID NO: 2630534 - DNA, 21 bp, Homo sapiens
tttcagtcatataaaagctat

SEQ ID NO: 2630535 - DNA, 14 bp, Homo sapiens
tttcataagtattt

SEQ ID NO: 2630536 - DNA, 17 bp, Homo sapiens
tttcataagtatttcaa

SEQ ID NO: 2630537 - DNA, 19 bp, Homo sapiens
tttcataagtatttcaaat

SEQ ID NO: 2630538 - DNA, 21 bp, Homo sapiens
tttcatacagcattacaaatt

SEQ ID NO: 2630539 - DNA, 22 bp, Homo sapiens
tttcatatgttgctcagtctcc

SEQ ID NO: 2630540 - DNA, 12 bp, Homo sapiens
tttcatattgtg

SEQ ID NO: 2630541 - DNA, 18 bp, Homo sapiens
tgtacagacgtatgctta

SEQ ID NO: 2630542 - DNA, 11 bp, Homo sapiens
tgtacagagcc

SEQ ID NO: 2630543 - DNA, 23 bp, Homo sapiens
tgtacagcaaggagatttacaac

SEQ ID NO: 2630544 - DNA, 23 bp, Homo sapiens
tgtacagtctgtcatgaacatgt

SEQ ID NO: 2630545 - DNA, 17 bp, Homo sapiens
tgtacagtgtgtaaagt

SEQ ID NO: 2630546 - DNA, 17 bp, Homo sapiens
tgtacagttatttatgc

SEQ ID NO: 2630547 - DNA, 15 bp, Homo sapiens
tgtacagtttgctgt

SEQ ID NO: 2630548 - DNA, 14 bp, Homo sapiens
tgtacataactgaa

SEQ ID NO: 2630549 - DNA, 17 bp, Homo sapiens
tgtacataactgaaaat

SEQ ID NO: 2630550 - DNA, 21 bp, Homo sapiens
tgtacataccctggccgcccc

SEQ ID NO: 2630551 - DNA, 15 bp, Homo sapiens
tgtacatagcctata

SEQ ID NO: 2630552 - DNA, 18 bp, Homo sapiens
tgtacatagttatttatt

SEQ ID NO: 2630553 - DNA, 17 bp, Homo sapiens
tgtacatcccatgtaac

SEQ ID NO: 2630554 - DNA, 20 bp, Homo sapiens
tgtacatcccatgtaacaga

SEQ ID NO: 2630555 - DNA, 21 bp, Homo sapiens
tgtacatcccatgtaacagaa

SEQ ID NO: 2630556 - DNA, 22 bp, Homo sapiens
tgtacatcccatgtaacagaaa

SEQ ID NO: 2630557 - DNA, 17 bp, Homo sapiens
tgtacatggcagagttt

SEQ ID NO: 2630558 - DNA, 20 bp, Homo sapiens
tgtacatgtgtagcctgtgc

SEQ ID NO: 2630559 - DNA, 21 bp, Homo sapiens
tgtacatgtgtagcctgtgca

SEQ ID NO: 2630560 - DNA, 18 bp, Homo sapiens
tgtacatttccaaattca

SEQ ID NO: 2630561 - DNA, 13 bp, Homo sapiens
tgtacatttctga

SEQ ID NO: 2630562 - DNA, 12 bp, Homo sapiens
tgtaccatgtac

SEQ ID NO: 2630563 - DNA, 16 bp, Homo sapiens
tgtacccttcctacag

SEQ ID NO: 2630564 - DNA, 17 bp, Homo sapiens
tgtacctgttccttaga

SEQ ID NO: 2630565 - DNA, 15 bp, Homo sapiens
tgtaccttttaacac

SEQ ID NO: 2630566 - DNA, 22 bp, Homo sapiens
tgtaccttttaacacctgatgt

SEQ ID NO: 2630567 - DNA, 23 bp, Homo sapiens
tgtaccttttaacacctgatgtg

SEQ ID NO: 2630568 - DNA, 21 bp, Homo sapiens
tgtaccttttgaggagcccca

SEQ ID NO: 2630569 - DNA, 19 bp, Homo sapiens
tgtactgcatatgaaagga

SEQ ID NO: 2630570 - DNA, 16 bp, Homo sapiens
tgtactgtagtttttc

SEQ ID NO: 2630571 - DNA, 16 bp, Homo sapiens
tgtacttaataaattc

SEQ ID NO: 2630572 - DNA, 21 bp, Homo sapiens
tgtacttcgtcttctaatttc

SEQ ID NO: 2630573 - DNA, 22 bp, Homo sapiens
tgtacttggagtattggggtct

SEQ ID NO: 2630574 - DNA, 14 bp, Homo sapiens
tgtactttgtacaa

SEQ ID NO: 2630575 - DNA, 23 bp, Homo sapiens
tgtagaaaatttgttattttgca

SEQ ID NO: 2630576 - DNA, 17 bp, Homo sapiens
tgtagaaggagacagag

SEQ ID NO: 2630577 - DNA, 21 bp, Homo sapiens
tgtagaaggagacagagctgg

SEQ ID NO: 2630578 - DNA, 22 bp, Homo sapiens
tgtagaagtaggaagtgaaaat

SEQ ID NO: 2630579 - DNA, 18 bp, Homo sapiens
tgtagaatgtattgtacc

SEQ ID NO: 2630580 - DNA, 19 bp, Homo sapiens
tgtagaatgtattgtacct

SEQ ID NO: 2630581 - DNA, 13 bp, Homo sapiens
tgtagagtgggag

SEQ ID NO: 2630582 - DNA, 12 bp, Homo sapiens
tgtagagttaag

SEQ ID NO: 2630583 - DNA, 13 bp, Homo sapiens
tgtagagttaaga

SEQ ID NO: 2630584 - DNA, 14 bp, Homo sapiens
tgtagagttaagaa

SEQ ID NO: 2630585 - DNA, 16 bp, Homo sapiens
tgtagagttaagaagc

SEQ ID NO: 2630586 - DNA, 19 bp, Homo sapiens
tgtagagttaagaagctgt

SEQ ID NO: 2630587 - DNA, 19 bp, Homo sapiens
tgtagatattgtgaagtac

SEQ ID NO: 2630588 - DNA, 18 bp, Homo sapiens
tgtagatcagagcagcag

SEQ ID NO: 2630589 - DNA, 16 bp, Homo sapiens
tgtagatttatttcat

SEQ ID NO: 2630590 - DNA, 20 bp, Homo sapiens
tgtagcaaaacgcatggagt

SEQ ID NO: 2630591 - DNA, 11 bp, Homo sapiens
tgtagcagtga

SEQ ID NO: 2630592 - DNA, 16 bp, Homo sapiens
tgtagcatcttctgga

SEQ ID NO: 2630593 - DNA, 22 bp, Homo sapiens
tgtagcctcgccgtctgtgaat

SEQ ID NO: 2630594 - DNA, 17 bp, Homo sapiens
tgtagccttgcccggat

SEQ ID NO: 2630595 - DNA, 13 bp, Homo sapiens
tgtagctttgctc

SEQ ID NO: 2630596 - DNA, 21 bp, Homo sapiens
tgtaggaagagtagcatttca

SEQ ID NO: 2630597 - DNA, 18 bp, Homo sapiens
tgtaggaaggttaatgtt

SEQ ID NO: 2630598 - DNA, 20 bp, Homo sapiens
tgtaggaattcttttgggga

SEQ ID NO: 2630599 - DNA, 23 bp, Homo sapiens
tgtaggaattcttttggggaagt

SEQ ID NO: 2630600 - DNA, 20 bp, Homo sapiens
tgtaggccaaatttgtagtg

SEQ ID NO: 2630601 - DNA, 12 bp, Homo sapiens
tgtagggctgga

SEQ ID NO: 2630602 - DNA, 17 bp, Homo sapiens
tgtagggttataataat

SEQ ID NO: 2630603 - DNA, 15 bp, Homo sapiens
tgtaggtatcatttt

SEQ ID NO: 2630604 - DNA, 13 bp, Homo sapiens
tgtagtaaagaaa

SEQ ID NO: 2630605 - DNA, 15 bp, Homo sapiens
tgtagtataaagaaa

SEQ ID NO: 2630606 - DNA, 14 bp, Homo sapiens
tgtagtatcaaata

SEQ ID NO: 2630607 - DNA, 14 bp, Homo sapiens
tgtagtcccagcta

SEQ ID NO: 2630608 - DNA, 14 bp, Homo sapiens
tgtagtctcaggac

SEQ ID NO: 2630609 - DNA, 13 bp, Homo sapiens
tgtagttaggaaa

SEQ ID NO: 2630610 - DNA, 21 bp, Homo sapiens
tgtagttgcgtggactctgca

SEQ ID NO: 2630611 - DNA, 19 bp, Homo sapiens
tgtagtttttcttcaacat

SEQ ID NO: 2630612 - DNA, 13 bp, Homo sapiens
tgtataaaaatag

SEQ ID NO: 2630613 - DNA, 13 bp, Homo sapiens
tgtataaagaaca

SEQ ID NO: 2630614 - DNA, 19 bp, Homo sapiens
tgtataaagcaactgttat

SEQ ID NO: 2630615 - DNA, 23 bp, Homo sapiens
tgtataaagcaactgttatgaaa

SEQ ID NO: 2630616 - DNA, 14 bp, Homo sapiens
tgtataaataggag

SEQ ID NO: 2630617 - DNA, 14 bp, Homo sapiens
tgtataacaggtta

SEQ ID NO: 2630618 - DNA, 15 bp, Homo sapiens
tgtataatattttta

SEQ ID NO: 2630619 - DNA, 20 bp, Homo sapiens
tgtataattcaaagcaccaa

SEQ ID NO: 2630620 - DNA, 13 bp, Homo sapiens
tgtataattgtat

SEQ ID NO: 2630621 - DNA, 15 bp, Homo sapiens
tgtataattgtatcg

SEQ ID NO: 2630622 - DNA, 13 bp, Homo sapiens
tgtatacatgcca

SEQ ID NO: 2630623 - DNA, 18 bp, Homo sapiens
tgtatagatgcaagatat

SEQ ID NO: 2630624 - DNA, 15 bp, Homo sapiens
tgtatatacaataac

SEQ ID NO: 2630625 - DNA, 16 bp, Homo sapiens
tgtatatacaataaca

SEQ ID NO: 2630626 - DNA, 17 bp, Homo sapiens
tgtatatacaataacat

SEQ ID NO: 2630627 - DNA, 18 bp, Homo sapiens
tgtatatacaataacata

SEQ ID NO: 2630628 - DNA, 22 bp, Homo sapiens
tgtatatacatttatgaattaa

SEQ ID NO: 2630629 - DNA, 21 bp, Homo sapiens
tgtatatacgcatctataaat

SEQ ID NO: 2630630 - DNA, 17 bp, Homo sapiens
tgtatatatctgcttca

SEQ ID NO: 2630631 - DNA, 18 bp, Homo sapiens
tgtatatatttcctatat

SEQ ID NO: 2630632 - DNA, 23 bp, Homo sapiens
tgtatattatggaagattttaaa

SEQ ID NO: 2630633 - DNA, 14 bp, Homo sapiens
tgtatattatttct

SEQ ID NO: 2630634 - DNA, 15 bp, Homo sapiens
tgtatattatttcta

SEQ ID NO: 2630635 - DNA, 18 bp, Homo sapiens
tgtatatttaaaagaaag

SEQ ID NO: 2630636 - DNA, 16 bp, Homo sapiens
tgtatatttgtacaaa

SEQ ID NO: 2630637 - DNA, 18 bp, Homo sapiens
tgtatcacaaatcttaac

SEQ ID NO: 2630638 - DNA, 21 bp, Homo sapiens
tgtatcaggtgcccatccctg

SEQ ID NO: 2630639 - DNA, 21 bp, Homo sapiens
tgtatcatctggataggagcc

SEQ ID NO: 2630640 - DNA, 22 bp, Homo sapiens
tgtatccatccatggggctgat

SEQ ID NO: 2630641 - DNA, 13 bp, Homo sapiens
tgtatccattatc

SEQ ID NO: 2630642 - DNA, 14 bp, Homo sapiens
tgtatccattatca

SEQ ID NO: 2630643 - DNA, 17 bp, Homo sapiens
tgtatccattatcatgt

SEQ ID NO: 2630644 - DNA, 15 bp, Homo sapiens
tgtatcccatgagcc

SEQ ID NO: 2630645 - DNA, 12 bp, Homo sapiens
tgtatcctgggg

SEQ ID NO: 2630646 - DNA, 15 bp, Homo sapiens
tgtatcggagacagt

SEQ ID NO: 2630647 - DNA, 15 bp, Homo sapiens
tgtatcgtatagctg

SEQ ID NO: 2630648 - DNA, 16 bp, Homo sapiens
tgtatcgtatagctgt

SEQ ID NO: 2630649 - DNA, 20 bp, Homo sapiens
tgtatctacatcttttttca

SEQ ID NO: 2630650 - DNA, 19 bp, Homo sapiens
tgtatctagtgcagctgat

SEQ ID NO: 2630651 - DNA, 18 bp, Homo sapiens
tgtatctctgaagcatgt

SEQ ID NO: 2630652 - DNA, 20 bp, Homo sapiens
tgtatctgatagctctttgg

SEQ ID NO: 2630653 - DNA, 21 bp, Homo sapiens
tgtatcttgggggacagggct

SEQ ID NO: 2630654 - DNA, 22 bp, Homo sapiens
tgtatcttgggggacagggctg

SEQ ID NO: 2630655 - DNA, 14 bp, Homo sapiens
tgtatgactaaaga

SEQ ID NO: 2630656 - DNA, 21 bp, Homo sapiens
tgtatgactaaagagagaatg

SEQ ID NO: 2630657 - DNA, 17 bp, Homo sapiens
tgtatgcagctatctgg

SEQ ID NO: 2630658 - DNA, 18 bp, Homo sapiens
tgtatgccaagtgagaag

SEQ ID NO: 2630659 - DNA, 23 bp, Homo sapiens
tgtatggaaataaatgtatcata

SEQ ID NO: 2630660 - DNA, 16 bp, Homo sapiens
tgtatggaatacagtg

SEQ ID NO: 2630661 - DNA, 17 bp, Homo sapiens
tgtatggaatacagtgt

SEQ ID NO: 2630662 - DNA, 15 bp, Homo sapiens
tgtatgggcaaaaaa

SEQ ID NO: 2630663 - DNA, 17 bp, Homo sapiens
tgtatgtgcactgtcac

SEQ ID NO: 2630664 - DNA, 14 bp, Homo sapiens
tgtatgtgtaagta

SEQ ID NO: 2630665 - DNA, 15 bp, Homo sapiens
tgtatgtttacatat

SEQ ID NO: 2630666 - DNA, 22 bp, Homo sapiens
tgtatgtttgcacacttgtgtg

SEQ ID NO: 2630667 - DNA, 12 bp, Homo sapiens
tgtattaagagt

SEQ ID NO: 2630668 - DNA, 16 bp, Homo sapiens
tgtattactagaagat

SEQ ID NO: 2630669 - DNA, 19 bp, Homo sapiens
tgtattactagaagatgaa

SEQ ID NO: 2630670 - DNA, 22 bp, Homo sapiens
tgtattctctcctgtacctctt

SEQ ID NO: 2630671 - DNA, 21 bp, Homo sapiens
tgtattctctgagctgtgcag

SEQ ID NO: 2630672 - DNA, 18 bp, Homo sapiens
tgtattctttgatgttaa

SEQ ID NO: 2630673 - DNA, 19 bp, Homo sapiens
tgtattctttgatgttaac

SEQ ID NO: 2630674 - DNA, 22 bp, Homo sapiens
tgtattgaacttggaaagaaat

SEQ ID NO: 2630675 - DNA, 20 bp, Homo sapiens
tgtattgaatcatgtagtat

SEQ ID NO: 2630676 - DNA, 11 bp, Homo sapiens
tgtattgtacc

SEQ ID NO: 2630677 - DNA, 14 bp, Homo sapiens
tgtattgttcccag

SEQ ID NO: 2630678 - DNA, 19 bp, Homo sapiens
tgtattgttcccagtgaca

SEQ ID NO: 2630679 - DNA, 21 bp, Homo sapiens
tgtatttatattttgtgctat

SEQ ID NO: 2630680 - DNA, 16 bp, Homo sapiens
tgtttgcttattgttc

SEQ ID NO: 2630681 - DNA, 23 bp, Homo sapiens
tgtttgcttattgttccaagaca

SEQ ID NO: 2630682 - DNA, 15 bp, Homo sapiens
tgtttggagacattc

SEQ ID NO: 2630683 - DNA, 12 bp, Homo sapiens
tgtttggagagc

SEQ ID NO: 2630684 - DNA, 15 bp, Homo sapiens
tgtttggggatgaga

SEQ ID NO: 2630685 - DNA, 20 bp, Homo sapiens
tgtttggttctggggcccct

SEQ ID NO: 2630686 - DNA, 17 bp, Homo sapiens
tgtttgtcttctcccca

SEQ ID NO: 2630687 - DNA, 15 bp, Homo sapiens
tgtttgtgctgtggt

SEQ ID NO: 2630688 - DNA, 12 bp, Homo sapiens
tgtttgtggcct

SEQ ID NO: 2630689 - DNA, 13 bp, Homo sapiens
tgtttgtggcctc

SEQ ID NO: 2630690 - DNA, 15 bp, Homo sapiens
tgtttgtggcctcag

SEQ ID NO: 2630691 - DNA, 13 bp, Homo sapiens
tgtttgtgtgtgt

SEQ ID NO: 2630692 - DNA, 16 bp, Homo sapiens
tgtttgttgtcagctg

SEQ ID NO: 2630693 - DNA, 17 bp, Homo sapiens
tgtttgttgtcagctga

SEQ ID NO: 2630694 - DNA, 23 bp, Homo sapiens
tgttttaaaataaaaattctgaa

SEQ ID NO: 2630695 - DNA, 20 bp, Homo sapiens
tgttttaaacatagaaagtt

SEQ ID NO: 2630696 - DNA, 22 bp, Homo sapiens
tgttttaaatacgcactacatg

SEQ ID NO: 2630697 - DNA, 22 bp, Homo sapiens
tgttttaaatttatttcaaaaa

SEQ ID NO: 2630698 - DNA, 16 bp, Homo sapiens
tgttttaagaggcagg

SEQ ID NO: 2630699 - DNA, 20 bp, Homo sapiens
tgttttaagaggcagggtct

SEQ ID NO: 2630700 - DNA, 18 bp, Homo sapiens
tgttttaaggatgcttgt

SEQ ID NO: 2630701 - DNA, 14 bp, Homo sapiens
tgttttaattccat

SEQ ID NO: 2630702 - DNA, 14 bp, Homo sapiens
tgttttattcctgt

SEQ ID NO: 2630703 - DNA, 15 bp, Homo sapiens
tgttttattcctgta

SEQ ID NO: 2630704 - DNA, 18 bp, Homo sapiens
tgttttattttttattgt

SEQ ID NO: 2630705 - DNA, 15 bp, Homo sapiens
tgttttcataataaa

SEQ ID NO: 2630706 - DNA, 20 bp, Homo sapiens
tgttttcatggtgaaaatgt

SEQ ID NO: 2630707 - DNA, 17 bp, Homo sapiens
tgttttccagctcctca

SEQ ID NO: 2630708 - DNA, 20 bp, Homo sapiens
tgttttccatgagtcccctg

SEQ ID NO: 2630709 - DNA, 16 bp, Homo sapiens
tgttttccctgacctc

SEQ ID NO: 2630710 - DNA, 11 bp, Homo sapiens
tgttttcttct

SEQ ID NO: 2630711 - DNA, 17 bp, Homo sapiens
tgttttgacggatgatt

SEQ ID NO: 2630712 - DNA, 12 bp, Homo sapiens
tgttttgcactt

SEQ ID NO: 2630713 - DNA, 20 bp, Homo sapiens
tgttttggggatgagagggt

SEQ ID NO: 2630714 - DNA, 22 bp, Homo sapiens
tgttttggtatctgttctttaa

SEQ ID NO: 2630715 - DNA, 16 bp, Homo sapiens
tgttttgttctgtggt

SEQ ID NO: 2630716 - DNA, 17 bp, Homo sapiens
tgttttgttctttaaag

SEQ ID NO: 2630717 - DNA, 12 bp, Homo sapiens
tgtttttaactc

SEQ ID NO: 2630718 - DNA, 14 bp, Homo sapiens
tgtttttcatgaaa

SEQ ID NO: 2630719 - DNA, 11 bp, Homo sapiens
tgtttttcatt

SEQ ID NO: 2630720 - DNA, 16 bp, Homo sapiens
tgttttttggtctttt

SEQ ID NO: 2630721 - DNA, 19 bp, Homo sapiens
ttaaaaaaaggcattgttt

SEQ ID NO: 2630722 - DNA, 14 bp, Homo sapiens
ttaaaaaaatgaca

SEQ ID NO: 2630723 - DNA, 16 bp, Homo sapiens
ttaaaaaaatttaagt

SEQ ID NO: 2630724 - DNA, 13 bp, Homo sapiens
ttaaaaaatgtcc

SEQ ID NO: 2630725 - DNA, 16 bp, Homo sapiens
ttaaaaaatgtccatg

SEQ ID NO: 2630726 - DNA, 14 bp, Homo sapiens
ttaaaaagtcttca

SEQ ID NO: 2630727 - DNA, 18 bp, Homo sapiens
ttaaaaagtggaaaaata

SEQ ID NO: 2630728 - DNA, 23 bp, Homo sapiens
ttaaaaatatggaacttctaata

SEQ ID NO: 2630729 - DNA, 21 bp, Homo sapiens
ttaaaaatctaccttctgtag

SEQ ID NO: 2630730 - DNA, 14 bp, Homo sapiens
ttaaaaatctcaaa

SEQ ID NO: 2630731 - DNA, 15 bp, Homo sapiens
ttaaaaatctcaaat

SEQ ID NO: 2630732 - DNA, 17 bp, Homo sapiens
ttaaaaatctcaaattt

SEQ ID NO: 2630733 - DNA, 13 bp, Homo sapiens
ttaaaaatgtaaa

SEQ ID NO: 2630734 - DNA, 19 bp, Homo sapiens
ttaaaaatgtaaatattct

SEQ ID NO: 2630735 - DNA, 21 bp, Homo sapiens
ttaaaaatgttaaaatgtatt

SEQ ID NO: 2630736 - DNA, 20 bp, Homo sapiens
ttaaaacaatattgtttcta

SEQ ID NO: 2630737 - DNA, 16 bp, Homo sapiens
ttaaaactgaagtctg

SEQ ID NO: 2630738 - DNA, 20 bp, Homo sapiens
ttaaaagaaagcctcagaga

SEQ ID NO: 2630739 - DNA, 21 bp, Homo sapiens
ttaaaagaatattttaacttc

SEQ ID NO: 2630740 - DNA, 21 bp, Homo sapiens
ttaaaagaatgggcagttaca

SEQ ID NO: 2630741 - DNA, 22 bp, Homo sapiens
ttaaaagaatgggcagttacat

SEQ ID NO: 2630742 - DNA, 17 bp, Homo sapiens
ttaaaagattcattttt

SEQ ID NO: 2630743 - DNA, 22 bp, Homo sapiens
ttaaaaggatttttatctttcg

SEQ ID NO: 2630744 - DNA, 23 bp, Homo sapiens
ttaaaagggattacccaagcaaa

SEQ ID NO: 2630745 - DNA, 16 bp, Homo sapiens
ttaaaagtttcaatgt

SEQ ID NO: 2630746 - DNA, 20 bp, Homo sapiens
ttaaaataaaaattctgaat

SEQ ID NO: 2630747 - DNA, 12 bp, Homo sapiens
ttaaaataatat

SEQ ID NO: 2630748 - DNA, 19 bp, Homo sapiens
ttaaaatacacactcaaat

SEQ ID NO: 2630749 - DNA, 21 bp, Homo sapiens
ttaaaataccagccagtaaat

SEQ ID NO: 2630750 - DNA, 22 bp, Homo sapiens
ttaaaatagcaacactctatat

SEQ ID NO: 2630751 - DNA, 14 bp, Homo sapiens
ttaaaatatggcta

SEQ ID NO: 2630752 - DNA, 16 bp, Homo sapiens
ttaaaatattcctgca

SEQ ID NO: 2630753 - DNA, 13 bp, Homo sapiens
ttaaaatcctcaa

SEQ ID NO: 2630754 - DNA, 11 bp, Homo sapiens
ttaaaatctta

SEQ ID NO: 2630755 - DNA, 14 bp, Homo sapiens
ttaaaatcttaaac

SEQ ID NO: 2630756 - DNA, 13 bp, Homo sapiens
ttaaaattgtgat

SEQ ID NO: 2630757 - DNA, 14 bp, Homo sapiens
ttaaacaaaggttg

SEQ ID NO: 2630758 - DNA, 16 bp, Homo sapiens
ttaaacagatttttac

SEQ ID NO: 2630759 - DNA, 18 bp, Homo sapiens
ttaaacagtgagcctgaa

SEQ ID NO: 2630760 - DNA, 17 bp, Homo sapiens
ttaaaccgccaaggctg

SEQ ID NO: 2630761 - DNA, 21 bp, Homo sapiens
ttaaacggattattttttcag

SEQ ID NO: 2630762 - DNA, 16 bp, Homo sapiens
ttaaacgtatgcatgt

SEQ ID NO: 2630763 - DNA, 18 bp, Homo sapiens
ttaaacgtatgcatgtga

SEQ ID NO: 2630764 - DNA, 20 bp, Homo sapiens
ttaaacgtatgcatgtgaag

SEQ ID NO: 2630765 - DNA, 13 bp, Homo sapiens
ttaaactcaggga

SEQ ID NO: 2630766 - DNA, 20 bp, Homo sapiens
ttaaactcagggacagagcc

SEQ ID NO: 2630767 - DNA, 19 bp, Homo sapiens
ttaaactgtgtacataact

SEQ ID NO: 2630768 - DNA, 15 bp, Homo sapiens
ttaaacttctctgaa

SEQ ID NO: 2630769 - DNA, 20 bp, Homo sapiens
ttaaacttctctgaagggag

SEQ ID NO: 2630770 - DNA, 21 bp, Homo sapiens
ttaaagacaaagacaaattct

SEQ ID NO: 2630771 - DNA, 13 bp, Homo sapiens
ttaaagagaggtt

SEQ ID NO: 2630772 - DNA, 20 bp, Homo sapiens
ttaaagagaggttatagagt

SEQ ID NO: 2630773 - DNA, 17 bp, Homo sapiens
ttaaagatttatcaaat

SEQ ID NO: 2630774 - DNA, 21 bp, Homo sapiens
ttaaagcagagggactttgta

SEQ ID NO: 2630775 - DNA, 20 bp, Homo sapiens
ttaaagcatttactttgaat

SEQ ID NO: 2630776 - DNA, 20 bp, Homo sapiens
ttaaagcttattaaaactca

SEQ ID NO: 2630777 - DNA, 16 bp, Homo sapiens
ttaaaggaaaaaatgt

SEQ ID NO: 2630778 - DNA, 19 bp, Homo sapiens
ttaaagggtgtacttatat

SEQ ID NO: 2630779 - DNA, 17 bp, Homo sapiens
ttaaaggtgtcttcctc

SEQ ID NO: 2630780 - DNA, 18 bp, Homo sapiens
ttaaagtatgttattgca

SEQ ID NO: 2630781 - DNA, 13 bp, Homo sapiens
ttaaagtattctt

SEQ ID NO: 2630782 - DNA, 17 bp, Homo sapiens
ttaaagtgatactgaaa

SEQ ID NO: 2630783 - DNA, 15 bp, Homo sapiens
ttaaagttctgtaaa

SEQ ID NO: 2630784 - DNA, 20 bp, Homo sapiens
ttaaataaatgtcattaaaa

SEQ ID NO: 2630785 - DNA, 21 bp, Homo sapiens
ttaaataaatgtcattaaaat

SEQ ID NO: 2630786 - DNA, 18 bp, Homo sapiens
ttaaatagagtttgctat

SEQ ID NO: 2630787 - DNA, 15 bp, Homo sapiens
ttaaatataatatgc

SEQ ID NO: 2630788 - DNA, 13 bp, Homo sapiens
ttaaatataattc

SEQ ID NO: 2630789 - DNA, 17 bp, Homo sapiens
ttaaatataattctgta

SEQ ID NO: 2630790 - DNA, 18 bp, Homo sapiens
ttaaatataattctgtaa

SEQ ID NO: 2630791 - DNA, 22 bp, Homo sapiens
ttaaatatcagtagaaactcta

SEQ ID NO: 2630792 - DNA, 14 bp, Homo sapiens
ttaaatatttacat

SEQ ID NO: 2630793 - DNA, 18 bp, Homo sapiens
ttaaatatttcaagacat

SEQ ID NO: 2630794 - DNA, 22 bp, Homo sapiens
ttaaatatttcaagacattaaa

SEQ ID NO: 2630795 - DNA, 20 bp, Homo sapiens
ttaaatcccattcataactt

SEQ ID NO: 2630796 - DNA, 16 bp, Homo sapiens
ttaaatctatgaagta

SEQ ID NO: 2630797 - DNA, 12 bp, Homo sapiens
ttaaatgagaag

SEQ ID NO: 2630798 - DNA, 11 bp, Homo sapiens
ttaaatgcacc

SEQ ID NO: 2630799 - DNA, 16 bp, Homo sapiens
ttaaatgcacctggaa

SEQ ID NO: 2630800 - DNA, 17 bp, Homo sapiens
ttaaatgcacctggaat

SEQ ID NO: 2630801 - DNA, 13 bp, Homo sapiens
ttaaatgtaaaga

SEQ ID NO: 2630802 - DNA, 18 bp, Homo sapiens
ttaaatgtcttctgtatt

SEQ ID NO: 2630803 - DNA, 21 bp, Homo sapiens
ttaaattataacttaaaatat

SEQ ID NO: 2630804 - DNA, 16 bp, Homo sapiens
ttaaattcttgcaaag

SEQ ID NO: 2630805 - DNA, 16 bp, Homo sapiens
ttaaattttacccttt

SEQ ID NO: 2630806 - DNA, 22 bp, Homo sapiens
ttaacaaacatcactctgctgc

SEQ ID NO: 2630807 - DNA, 19 bp, Homo sapiens
ttaacaagctcccaggccg

SEQ ID NO: 2630808 - DNA, 17 bp, Homo sapiens
ttaacacattttgtata

SEQ ID NO: 2630809 - DNA, 15 bp, Homo sapiens
ttaacacctgatgtg

SEQ ID NO: 2630810 - DNA, 16 bp, Homo sapiens
ttaacacctgatgtgt

SEQ ID NO: 2630811 - DNA, 19 bp, Homo sapiens
ttaacacctgatgtgtaca

SEQ ID NO: 2630812 - DNA, 13 bp, Homo sapiens
ttaacactgagct

SEQ ID NO: 2630813 - DNA, 16 bp, Homo sapiens
ttaacagaaatgtaca

SEQ ID NO: 2630814 - DNA, 19 bp, Homo sapiens
ttaacagaaatgtacagca

SEQ ID NO: 2630815 - DNA, 17 bp, Homo sapiens
ttaacagtcatttaaaa

SEQ ID NO: 2630816 - DNA, 16 bp, Homo sapiens
ttaaccattaaaactg

SEQ ID NO: 2630817 - DNA, 19 bp, Homo sapiens
ttaacctcagtgtcattta

SEQ ID NO: 2630818 - DNA, 13 bp, Homo sapiens
ttaacctggtgct

SEQ ID NO: 2630819 - DNA, 17 bp, Homo sapiens
ttaacctggtgctggat

SEQ ID NO: 2630820 - DNA, 17 bp, Homo sapiens
ttaacggctccaggatt

SEQ ID NO: 2630821 - DNA, 12 bp, Homo sapiens
ttaactagaatt

SEQ ID NO: 2630822 - DNA, 15 bp, Homo sapiens
ttaactagaatttat

SEQ ID NO: 2630823 - DNA, 22 bp, Homo sapiens
ttaactcagatcactactgcag

SEQ ID NO: 2630824 - DNA, 12 bp, Homo sapiens
ttaactcagtct

SEQ ID NO: 2630825 - DNA, 13 bp, Homo sapiens
ttaactctgtctt

SEQ ID NO: 2630826 - DNA, 18 bp, Homo sapiens
ttcactataaatggtgtt

SEQ ID NO: 2630827 - DNA, 22 bp, Homo sapiens
ttcactccggtgtgcctgcagc

SEQ ID NO: 2630828 - DNA, 23 bp, Homo sapiens
ttcactccggtgtgcctgcagcc

SEQ ID NO: 2630829 - DNA, 24 bp, Homo sapiens
ttcactccggtgtgcctgcagccc

SEQ ID NO: 2630830 - DNA, 20 bp, Homo sapiens
ttcactgcatggctcccaca

SEQ ID NO: 2630831 - DNA, 23 bp, Homo sapiens
ttcactgctgcaaggcctttctg

SEQ ID NO: 2630832 - DNA, 17 bp, Homo sapiens
ttcactggagttacatt

SEQ ID NO: 2630833 - DNA, 20 bp, Homo sapiens
ttcactggccacagttgttt

SEQ ID NO: 2630834 - DNA, 13 bp, Homo sapiens
ttcactgtataaa

SEQ ID NO: 2630835 - DNA, 22 bp, Homo sapiens
ttcactgtataaataggagagg

SEQ ID NO: 2630836 - DNA, 23 bp, Homo sapiens
ttcactgtataaataggagagga

SEQ ID NO: 2630837 - DNA, 21 bp, Homo sapiens
ttcactgttgaaaattatttt

SEQ ID NO: 2630838 - DNA, 15 bp, Homo sapiens
ttcacttcatcttct

SEQ ID NO: 2630839 - DNA, 18 bp, Homo sapiens
ttcacttcatcttctcag

SEQ ID NO: 2630840 - DNA, 17 bp, Homo sapiens
ttcactttcaaaaacat

SEQ ID NO: 2630841 - DNA, 19 bp, Homo sapiens
ttcactttcacatagatgt

SEQ ID NO: 2630842 - DNA, 20 bp, Homo sapiens
ttcacttttagggagagtca

SEQ ID NO: 2630843 - DNA, 20 bp, Homo sapiens
ttcagaaagcattacatttc

SEQ ID NO: 2630844 - DNA, 18 bp, Homo sapiens
ttcagaaatgctgcctgc

SEQ ID NO: 2630845 - DNA, 11 bp, Homo sapiens
ttcagaaatgt

SEQ ID NO: 2630846 - DNA, 16 bp, Homo sapiens
ttcagaaatgtgttat

SEQ ID NO: 2630847 - DNA, 13 bp, Homo sapiens
ttcagaaattgga

SEQ ID NO: 2630848 - DNA, 17 bp, Homo sapiens
ttcagaacctcttcccc

SEQ ID NO: 2630849 - DNA, 19 bp, Homo sapiens
ttcagaacctcttccccag

SEQ ID NO: 2630850 - DNA, 12 bp, Homo sapiens
ttcagaagagat

SEQ ID NO: 2630851 - DNA, 15 bp, Homo sapiens
ttcagaatcacttct

SEQ ID NO: 2630852 - DNA, 15 bp, Homo sapiens
ttcagacaagcaaca

SEQ ID NO: 2630853 - DNA, 16 bp, Homo sapiens
ttcagacatagaatta

SEQ ID NO: 2630854 - DNA, 15 bp, Homo sapiens
ttcagagactcaggg

SEQ ID NO: 2630855 - DNA, 20 bp, Homo sapiens
ttcagagactcagggcccca

SEQ ID NO: 2630856 - DNA, 19 bp, Homo sapiens
ttcagagactcctgcaggc

SEQ ID NO: 2630857 - DNA, 15 bp, Homo sapiens
ttcagagaggccttt

SEQ ID NO: 2630858 - DNA, 17 bp, Homo sapiens
ttcagagggaaagtaaa

SEQ ID NO: 2630859 - DNA, 16 bp, Homo sapiens
ttcagatcatggcatc

SEQ ID NO: 2630860 - DNA, 15 bp, Homo sapiens
ttcagatgcttctgg

SEQ ID NO: 2630861 - DNA, 19 bp, Homo sapiens
ttcagatgcttctgggaga

SEQ ID NO: 2630862 - DNA, 23 bp, Homo sapiens
ttcagatgtcttctgcctgttat

SEQ ID NO: 2630863 - DNA, 18 bp, Homo sapiens
ttcagccaccagcccctg

SEQ ID NO: 2630864 - DNA, 12 bp, Homo sapiens
ttcagccaggag

SEQ ID NO: 2630865 - DNA, 17 bp, Homo sapiens
ttcagccaggagctggg

SEQ ID NO: 2630866 - DNA, 13 bp, Homo sapiens
ttcagcccatctc

SEQ ID NO: 2630867 - DNA, 21 bp, Homo sapiens
ttcagcctagccgacctcagc

SEQ ID NO: 2630868 - DNA, 16 bp, Homo sapiens
ttcagcgatgtatgca

SEQ ID NO: 2630869 - DNA, 18 bp, Homo sapiens
ttcagctcacacatgaga

SEQ ID NO: 2630870 - DNA, 16 bp, Homo sapiens
ttcaggaagctcaggg

SEQ ID NO: 2630871 - DNA, 20 bp, Homo sapiens
ttcaggaagctcagggcctg

SEQ ID NO: 2630872 - DNA, 12 bp, Homo sapiens
ttcaggagggat

SEQ ID NO: 2630873 - DNA, 21 bp, Homo sapiens
ttcaggatactctgtcagatg

SEQ ID NO: 2630874 - DNA, 22 bp, Homo sapiens
ttcagggaatttcaggaactag

SEQ ID NO: 2630875 - DNA, 18 bp, Homo sapiens
ttcagggcagggctctga

SEQ ID NO: 2630876 - DNA, 16 bp, Homo sapiens
ttcaggggactcagcc

SEQ ID NO: 2630877 - DNA, 14 bp, Homo sapiens
ttcagggttggccc

SEQ ID NO: 2630878 - DNA, 15 bp, Homo sapiens
ttcaggtaacaggca

SEQ ID NO: 2630879 - DNA, 14 bp, Homo sapiens
ttcaggtactaaat

SEQ ID NO: 2630880 - DNA, 20 bp, Homo sapiens
ttcaggttatcgaaataaca

SEQ ID NO: 2630881 - DNA, 21 bp, Homo sapiens
ttcaggttatcgaaataacaa

SEQ ID NO: 2630882 - DNA, 24 bp, Homo sapiens
ttcaggttatcgaaataacaatgt

SEQ ID NO: 2630883 - DNA, 19 bp, Homo sapiens
ttcaggttttgtaaagatg

SEQ ID NO: 2630884 - DNA, 20 bp, Homo sapiens
ttcagtaataaactgtgttt

SEQ ID NO: 2630885 - DNA, 22 bp, Homo sapiens
ttcagtaccctctcagctccag

SEQ ID NO: 2630886 - DNA, 16 bp, Homo sapiens
ttcagtacctggagga

SEQ ID NO: 2630887 - DNA, 17 bp, Homo sapiens
ttcagtacctggaggag

SEQ ID NO: 2630888 - DNA, 23 bp, Homo sapiens
ttcagtacctggaggaggagcag

SEQ ID NO: 2630889 - DNA, 17 bp, Homo sapiens
ttcagtattttggagaa

SEQ ID NO: 2630890 - DNA, 19 bp, Homo sapiens
ttcccatgacccaggctgg

SEQ ID NO: 2630891 - DNA, 13 bp, Homo sapiens
ttcccatgttaaa

SEQ ID NO: 2630892 - DNA, 14 bp, Homo sapiens
ttcccattcttgca

SEQ ID NO: 2630893 - DNA, 14 bp, Homo sapiens
ttcccattttgcaa

SEQ ID NO: 2630894 - DNA, 13 bp, Homo sapiens
ttcccattttgga

SEQ ID NO: 2630895 - DNA, 15 bp, Homo sapiens
ttccccaaagtctta

SEQ ID NO: 2630896 - DNA, 15 bp, Homo sapiens
ttccccaacagtgtg

SEQ ID NO: 2630897 - DNA, 14 bp, Homo sapiens
ttccccactgcctg

SEQ ID NO: 2630898 - DNA, 15 bp, Homo sapiens
ttccccatctgggtc

SEQ ID NO: 2630899 - DNA, 12 bp, Homo sapiens
ttccccatggga

SEQ ID NO: 2630900 - DNA, 23 bp, Homo sapiens
ttccccatggttttaatctgtat

SEQ ID NO: 2630901 - DNA, 16 bp, Homo sapiens
ttccccattgcctcct

SEQ ID NO: 2630902 - DNA, 17 bp, Homo sapiens
ttcccccaacctcagac

SEQ ID NO: 2630903 - DNA, 15 bp, Homo sapiens
ttcccccactgatca

SEQ ID NO: 2630904 - DNA, 12 bp, Homo sapiens
ttccccccactc

SEQ ID NO: 2630905 - DNA, 20 bp, Homo sapiens
ttccccctggccaccacccc

SEQ ID NO: 2630906 - DNA, 22 bp, Homo sapiens
ttccccctggccaccacccccc

SEQ ID NO: 2630907 - DNA, 22 bp, Homo sapiens
ttcccctagtaagtgccttcca

SEQ ID NO: 2630908 - DNA, 14 bp, Homo sapiens
ttcccctctgctgc

SEQ ID NO: 2630909 - DNA, 13 bp, Homo sapiens
ttcccctgtcctg

SEQ ID NO: 2630910 - DNA, 15 bp, Homo sapiens
ttcccctgtggggat

SEQ ID NO: 2630911 - DNA, 21 bp, Homo sapiens
ttccccttccactgagggcag

SEQ ID NO: 2630912 - DNA, 21 bp, Homo sapiens
ttccccttgcccttgccctga

SEQ ID NO: 2630913 - DNA, 21 bp, Homo sapiens
ttcccggactgcaagcagggc

SEQ ID NO: 2630914 - DNA, 16 bp, Homo sapiens
ttccctacttcctgtg

SEQ ID NO: 2630915 - DNA, 20 bp, Homo sapiens
ttccctcacctttcccatct

SEQ ID NO: 2630916 - DNA, 17 bp, Homo sapiens
ttccctcatctctcctc

SEQ ID NO: 2630917 - DNA, 15 bp, Homo sapiens
ttccctcctgctact

SEQ ID NO: 2630918 - DNA, 17 bp, Homo sapiens
ttccctctgcctgtccc

SEQ ID NO: 2630919 - DNA, 21 bp, Homo sapiens
ttccctctgcctgtccctctc

SEQ ID NO: 2630920 - DNA, 15 bp, Homo sapiens
ttccctctgctcctg

SEQ ID NO: 2630921 - DNA, 16 bp, Homo sapiens
ttccctgactcattct

SEQ ID NO: 2630922 - DNA, 16 bp, Homo sapiens
ttccctgtattttctt

SEQ ID NO: 2630923 - DNA, 11 bp, Homo sapiens
ttccctgtgct

SEQ ID NO: 2630924 - DNA, 23 bp, Homo sapiens
ttcccttgaaattttaaactata

SEQ ID NO: 2630925 - DNA, 19 bp, Homo sapiens
ttccctttgacgccatccc

SEQ ID NO: 2630926 - DNA, 21 bp, Homo sapiens
ttccctttgacgccatcccag

SEQ ID NO: 2630927 - DNA, 17 bp, Homo sapiens
ttcccttttacatactg

SEQ ID NO: 2630928 - DNA, 21 bp, Homo sapiens
ttcccttttacatactgctgt

SEQ ID NO: 2630929 - DNA, 19 bp, Homo sapiens
ttcccttttttggctgctg

SEQ ID NO: 2630930 - DNA, 20 bp, Homo sapiens
ttcccttttttggctgctga

SEQ ID NO: 2630931 - DNA, 23 bp, Homo sapiens
ttccgacaaccgatgctccagcc

SEQ ID NO: 2630932 - DNA, 19 bp, Homo sapiens
ttccgcttggagcagaggg

SEQ ID NO: 2630933 - DNA, 18 bp, Homo sapiens
ttccgtagccagctgctc

SEQ ID NO: 2630934 - DNA, 16 bp, Homo sapiens
ttcctaaatgcagtga

SEQ ID NO: 2630935 - DNA, 18 bp, Homo sapiens
ttcctaacacagcatgtg

SEQ ID NO: 2630936 - DNA, 19 bp, Homo sapiens
ttcctaataaagttctgta

SEQ ID NO: 2630937 - DNA, 17 bp, Homo sapiens
ttcctacagatagtcaa

SEQ ID NO: 2630938 - DNA, 12 bp, Homo sapiens
ttcctacagccc

SEQ ID NO: 2630939 - DNA, 20 bp, Homo sapiens
ttcctacccacacctctgcc

SEQ ID NO: 2630940 - DNA, 21 bp, Homo sapiens
ttcctacccacacctctgcca

SEQ ID NO: 2630941 - DNA, 22 bp, Homo sapiens
ttcctagaagttactgaatgca

SEQ ID NO: 2630942 - DNA, 19 bp, Homo sapiens
ttcctagcacacacttttg

SEQ ID NO: 2630943 - DNA, 18 bp, Homo sapiens
ttcctagccctctcacat

SEQ ID NO: 2630944 - DNA, 18 bp, Homo sapiens
ttcctagttttctcctcc

SEQ ID NO: 2630945 - DNA, 17 bp, Homo sapiens
ttcctattgtcattaaa

SEQ ID NO: 2630946 - DNA, 18 bp, Homo sapiens
ttcctattgtcattaaag

SEQ ID NO: 2630947 - DNA, 20 bp, Homo sapiens
ttcctattgtcattaaaggt

SEQ ID NO: 2630948 - DNA, 22 bp, Homo sapiens
ttcctatttgccatgggcttca

SEQ ID NO: 2630949 - DNA, 13 bp, Homo sapiens
ttcctcacttcca

SEQ ID NO: 2630950 - DNA, 23 bp, Homo sapiens
ttcctcagttcatccattctatt

SEQ ID NO: 2630951 - DNA, 16 bp, Homo sapiens
ttcctcattcctgaaa

SEQ ID NO: 2630952 - DNA, 23 bp, Homo sapiens
ttcctccatctccaagaatgctg

SEQ ID NO: 2630953 - DNA, 20 bp, Homo sapiens
ttcctcccaagtggtgccta

SEQ ID NO: 2630954 - DNA, 21 bp, Homo sapiens
ttcctccccattagagtcagc

SEQ ID NO: 2630955 - DNA, 14 bp, Homo sapiens
ttcctcctccccac

SEQ ID NO: 2630956 - DNA, 15 bp, Homo sapiens
ttcctcctgctcata

SEQ ID NO: 2630957 - DNA, 23 bp, Homo sapiens
ttcctcctgggccctctctgctc

SEQ ID NO: 2630958 - DNA, 18 bp, Homo sapiens
ttcctcgcagagaggcca

SEQ ID NO: 2630959 - DNA, 19 bp, Homo sapiens
ttcctctgcagctgacctc

SEQ ID NO: 2630960 - DNA, 16 bp, Homo sapiens
ttcctcttccccttgc

SEQ ID NO: 2630961 - DNA, 11 bp, Homo sapiens
ttcctgaagct

SEQ ID NO: 2630962 - DNA, 18 bp, Homo sapiens
ttcctgaatccaaactaa

SEQ ID NO: 2630963 - DNA, 16 bp, Homo sapiens
ttcctgaatgaaatat

SEQ ID NO: 2630964 - DNA, 22 bp, Homo sapiens
ttcctgacccaggccgcagctc

SEQ ID NO: 2630965 - DNA, 16 bp, Homo sapiens
ttcctgagcttggcca

SEQ ID NO: 2630966 - DNA, 15 bp, Homo sapiens
ttcctgaggctgggc

SEQ ID NO: 2630967 - DNA, 17 bp, Homo sapiens
ttcctgataataattga

SEQ ID NO: 2630968 - DNA, 21 bp, Homo sapiens
ttcctgatggcaggatggcct

SEQ ID NO: 2630969 - DNA, 18 bp, Homo sapiens
ttcctgcatttgtgaaat

SEQ ID NO: 2630970 - DNA, 12 bp, Homo sapiens
ttcctgccacca

SEQ ID NO: 2630971 - DNA, 17 bp, Homo sapiens
ttcctgccaccagtcac

SEQ ID NO: 2630972 - DNA, 18 bp, Homo sapiens
ttcctgccaccagtcact

SEQ ID NO: 2630973 - DNA, 15 bp, Homo sapiens
ttcctgcctgtctcc

SEQ ID NO: 2630974 - DNA, 17 bp, Homo sapiens
ttcctgcggagtgaaga

SEQ ID NO: 2630975 - DNA, 20 bp, Homo sapiens
ttcctgcggagtgaagaggg

SEQ ID NO: 2630976 - DNA, 19 bp, Homo sapiens
ttcctggacactcagacct

SEQ ID NO: 2630977 - DNA, 12 bp, Homo sapiens
ttcctggacatc

SEQ ID NO: 2630978 - DNA, 15 bp, Homo sapiens
ttcctggcaatagtg

SEQ ID NO: 2630979 - DNA, 22 bp, Homo sapiens
ttcctggcactgcttccagtga

SEQ ID NO: 2630980 - DNA, 14 bp, Homo sapiens
ttcctggcttctta

SEQ ID NO: 2630981 - DNA, 17 bp, Homo sapiens
ttcctgggaaatattcc

SEQ ID NO: 2630982 - DNA, 21 bp, Homo sapiens
ttcctgggaaatattccctag

SEQ ID NO: 2630983 - DNA, 17 bp, Homo sapiens
ttcctggtacccagcca

SEQ ID NO: 2630984 - DNA, 19 bp, Homo sapiens
ttagaggttttaaagtgat

SEQ ID NO: 2630985 - DNA, 20 bp, Homo sapiens
ttagaggttttaaagtgatt

SEQ ID NO: 2630986 - DNA, 16 bp, Homo sapiens
ttagagttaacaatga

SEQ ID NO: 2630987 - DNA, 14 bp, Homo sapiens
ttagagttgatact

SEQ ID NO: 2630988 - DNA, 22 bp, Homo sapiens
ttagataatacaccactacatt

SEQ ID NO: 2630989 - DNA, 13 bp, Homo sapiens
ttagatgtgattt

SEQ ID NO: 2630990 - DNA, 21 bp, Homo sapiens
ttagatgtgatttaatagtgt

SEQ ID NO: 2630991 - DNA, 18 bp, Homo sapiens
ttagcaaattctgttttt

SEQ ID NO: 2630992 - DNA, 16 bp, Homo sapiens
ttagcatgtttgctga

SEQ ID NO: 2630993 - DNA, 13 bp, Homo sapiens
ttagccacaaaat

SEQ ID NO: 2630994 - DNA, 19 bp, Homo sapiens
ttagccaggtaatgtgaat

SEQ ID NO: 2630995 - DNA, 13 bp, Homo sapiens
ttagcccccaccc

SEQ ID NO: 2630996 - DNA, 16 bp, Homo sapiens
ttagcctttgtcccag

SEQ ID NO: 2630997 - DNA, 14 bp, Homo sapiens
ttagcggagacgga

SEQ ID NO: 2630998 - DNA, 12 bp, Homo sapiens
ttagctaaagga

SEQ ID NO: 2630999 - DNA, 20 bp, Homo sapiens
ttagctccctgttcttgggt

SEQ ID NO: 2631000 - DNA, 10 bp, Homo sapiens
ttagctgagc

SEQ ID NO: 2631001 - DNA, 16 bp, Homo sapiens
ttagctgtgtgaaata

SEQ ID NO: 2631002 - DNA, 18 bp, Homo sapiens
ttagcttagacctcagcc

SEQ ID NO: 2631003 - DNA, 21 bp, Homo sapiens
ttagcttgaaggatctgtttt

SEQ ID NO: 2631004 - DNA, 16 bp, Homo sapiens
ttagctttactgtttg

SEQ ID NO: 2631005 - DNA, 16 bp, Homo sapiens
ttagctttttaattgt

SEQ ID NO: 2631006 - DNA, 18 bp, Homo sapiens
ttagctttttaattgttg

SEQ ID NO: 2631007 - DNA, 12 bp, Homo sapiens
ttaggaaataaa

SEQ ID NO: 2631008 - DNA, 15 bp, Homo sapiens
ttaggaaataaaacc

SEQ ID NO: 2631009 - DNA, 21 bp, Homo sapiens
ttaggaaataaaacctttcaa

SEQ ID NO: 2631010 - DNA, 15 bp, Homo sapiens
ttaggaagagaaacc

SEQ ID NO: 2631011 - DNA, 15 bp, Homo sapiens
ttaggcagattgaaa

SEQ ID NO: 2631012 - DNA, 23 bp, Homo sapiens
ttaggcagcagcttttaatacag

SEQ ID NO: 2631013 - DNA, 17 bp, Homo sapiens
ttagggaaaacattcca

SEQ ID NO: 2631014 - DNA, 20 bp, Homo sapiens
ttagggaaggatacaaaagc

SEQ ID NO: 2631015 - DNA, 23 bp, Homo sapiens
ttagggactcaatttctccccag

SEQ ID NO: 2631016 - DNA, 14 bp, Homo sapiens
ttagggcagcttgc

SEQ ID NO: 2631017 - DNA, 15 bp, Homo sapiens
ttagggccaggcagg

SEQ ID NO: 2631018 - DNA, 16 bp, Homo sapiens
ttaggtgtgactgaat

SEQ ID NO: 2631019 - DNA, 21 bp, Homo sapiens
ttaggtgtgactgaatttctt

SEQ ID NO: 2631020 - DNA, 15 bp, Homo sapiens
ttagtaaagaaatga

SEQ ID NO: 2631021 - DNA, 12 bp, Homo sapiens
ttagtaacatgt

SEQ ID NO: 2631022 - DNA, 23 bp, Homo sapiens
ttagtaacatgtgttaagtattt

SEQ ID NO: 2631023 - DNA, 22 bp, Homo sapiens
ttagtaatgctacgtgtgattt

SEQ ID NO: 2631024 - DNA, 13 bp, Homo sapiens
ttagtagagacag

SEQ ID NO: 2631025 - DNA, 22 bp, Homo sapiens
ttagtatttatttaatgttatg

SEQ ID NO: 2631026 - DNA, 16 bp, Homo sapiens
ttagtatttgcatatt

SEQ ID NO: 2631027 - DNA, 12 bp, Homo sapiens
ttagtctcagtt

SEQ ID NO: 2631028 - DNA, 21 bp, Homo sapiens
ttagtctcagtttgtgtgtct

SEQ ID NO: 2631029 - DNA, 22 bp, Homo sapiens
ttagtctcagtttgtgtgtctt

SEQ ID NO: 2631030 - DNA, 13 bp, Homo sapiens
ttagtcttctcat

SEQ ID NO: 2631031 - DNA, 18 bp, Homo sapiens
ttagtgatgtcatctgtc

SEQ ID NO: 2631032 - DNA, 18 bp, Homo sapiens
ttagtgtttctgtgcatg

SEQ ID NO: 2631033 - DNA, 16 bp, Homo sapiens
ttagttatagatgtct

SEQ ID NO: 2631034 - DNA, 13 bp, Homo sapiens
ttagttatagttt

SEQ ID NO: 2631035 - DNA, 18 bp, Homo sapiens
ttagttatagtttcagat

SEQ ID NO: 2631036 - DNA, 16 bp, Homo sapiens
ttagttcctcattagc

SEQ ID NO: 2631037 - DNA, 21 bp, Homo sapiens
ttagttctcactgttccctct

SEQ ID NO: 2631038 - DNA, 15 bp, Homo sapiens
ttagttgctgtatgt

SEQ ID NO: 2631039 - DNA, 15 bp, Homo sapiens
ttagtttctccaagc

SEQ ID NO: 2631040 - DNA, 20 bp, Homo sapiens
ttagtttctgttctgtggaa

SEQ ID NO: 2631041 - DNA, 22 bp, Homo sapiens
ttagtttgcagttacactaaaa

SEQ ID NO: 2631042 - DNA, 22 bp, Homo sapiens
ttagtttgtatgccaagtgaga

SEQ ID NO: 2631043 - DNA, 15 bp, Homo sapiens
ttagttttagttgca

SEQ ID NO: 2631044 - DNA, 17 bp, Homo sapiens
ttagtttttgtaattta

SEQ ID NO: 2631045 - DNA, 14 bp, Homo sapiens
ttataaatcgcttt

SEQ ID NO: 2631046 - DNA, 17 bp, Homo sapiens
ttataaatcgcttttga

SEQ ID NO: 2631047 - DNA, 11 bp, Homo sapiens
ttataaattat

SEQ ID NO: 2631048 - DNA, 14 bp, Homo sapiens
ttataaattatgtt

SEQ ID NO: 2631049 - DNA, 16 bp, Homo sapiens
ttataactcatcataa

SEQ ID NO: 2631050 - DNA, 17 bp, Homo sapiens
ttataactcatcataaa

SEQ ID NO: 2631051 - DNA, 19 bp, Homo sapiens
ttataactctgcactactc

SEQ ID NO: 2631052 - DNA, 13 bp, Homo sapiens
ttataacttaaaa

SEQ ID NO: 2631053 - DNA, 18 bp, Homo sapiens
ttataagtagcaggccaa

SEQ ID NO: 2631054 - DNA, 17 bp, Homo sapiens
ttataataaaaggaaaa

SEQ ID NO: 2631055 - DNA, 13 bp, Homo sapiens
ttataatcacttt

SEQ ID NO: 2631056 - DNA, 20 bp, Homo sapiens
ttataatcttccatacttct

SEQ ID NO: 2631057 - DNA, 13 bp, Homo sapiens
ttataatgggtaa

SEQ ID NO: 2631058 - DNA, 22 bp, Homo sapiens
ttataattgtatcagaggccta

SEQ ID NO: 2631059 - DNA, 14 bp, Homo sapiens
ttataattttccta

SEQ ID NO: 2631060 - DNA, 16 bp, Homo sapiens
ttataatttttttcaa

SEQ ID NO: 2631061 - DNA, 16 bp, Homo sapiens
ttatacaacagtgcta

SEQ ID NO: 2631062 - DNA, 21 bp, Homo sapiens
ttatacaacagtgctaaaaat

SEQ ID NO: 2631063 - DNA, 23 bp, Homo sapiens
ttatacaacagtgctaaaaatgg

SEQ ID NO: 2631064 - DNA, 16 bp, Homo sapiens
ttatactaagaaaaga

SEQ ID NO: 2631065 - DNA, 15 bp, Homo sapiens
ttatagatgtctagg

SEQ ID NO: 2631066 - DNA, 22 bp, Homo sapiens
ttgaaaagctattagccaggat

SEQ ID NO: 2631067 - DNA, 15 bp, Homo sapiens
ttgaaaattatttta

SEQ ID NO: 2631068 - DNA, 20 bp, Homo sapiens
ttgaaaattattttaaacaa

SEQ ID NO: 2631069 - DNA, 18 bp, Homo sapiens
ttgaaaattcaaaaagtg

SEQ ID NO: 2631070 - DNA, 21 bp, Homo sapiens
ttgaaaattcaaaaagtgttt

SEQ ID NO: 2631071 - DNA, 16 bp, Homo sapiens
ttgaaacaaagaaggt

SEQ ID NO: 2631072 - DNA, 23 bp, Homo sapiens
ttgaaactgagatgtgaacacat

SEQ ID NO: 2631073 - DNA, 20 bp, Homo sapiens
ttgaaagagaaccagtttca

SEQ ID NO: 2631074 - DNA, 22 bp, Homo sapiens
ttgaaagattcaggtatgttgc

SEQ ID NO: 2631075 - DNA, 15 bp, Homo sapiens
ttgaaataataaatc

SEQ ID NO: 2631076 - DNA, 20 bp, Homo sapiens
ttgaaatataggaacttaaa

SEQ ID NO: 2631077 - DNA, 15 bp, Homo sapiens
ttgaaatctgtatct

SEQ ID NO: 2631078 - DNA, 21 bp, Homo sapiens
ttgaaatgaaagtataactga

SEQ ID NO: 2631079 - DNA, 15 bp, Homo sapiens
ttgaaattgtacata

SEQ ID NO: 2631080 - DNA, 19 bp, Homo sapiens
ttgaaattgtttaagtgtt

SEQ ID NO: 2631081 - DNA, 20 bp, Homo sapiens
ttgaacactcatgctgaaag

SEQ ID NO: 2631082 - DNA, 20 bp, Homo sapiens
ttgaactcagatctgtctga

SEQ ID NO: 2631083 - DNA, 15 bp, Homo sapiens
ttgaactcctggcct

SEQ ID NO: 2631084 - DNA, 16 bp, Homo sapiens
ttgaactgataaagat

SEQ ID NO: 2631085 - DNA, 21 bp, Homo sapiens
ttgaactgatagttactgttg

SEQ ID NO: 2631086 - DNA, 18 bp, Homo sapiens
ttgaactgggtacttgtg

SEQ ID NO: 2631087 - DNA, 15 bp, Homo sapiens
ttgaagaggtgagca

SEQ ID NO: 2631088 - DNA, 22 bp, Homo sapiens
ttgaagatatcttgaaatgaaa

SEQ ID NO: 2631089 - DNA, 14 bp, Homo sapiens
ttgaagcacgtaca

SEQ ID NO: 2631090 - DNA, 18 bp, Homo sapiens
ttgaagcacgtacatttt

SEQ ID NO: 2631091 - DNA, 15 bp, Homo sapiens
ttgaagcagttgtgt

SEQ ID NO: 2631092 - DNA, 13 bp, Homo sapiens
ttgaagccactga

SEQ ID NO: 2631093 - DNA, 11 bp, Homo sapiens
ttgaaggaaac

SEQ ID NO: 2631094 - DNA, 18 bp, Homo sapiens
ttgaagtaatcccgccac

SEQ ID NO: 2631095 - DNA, 16 bp, Homo sapiens
ttgaagtaatgaattt

SEQ ID NO: 2631096 - DNA, 17 bp, Homo sapiens
ttgaagtaatgaatttt

SEQ ID NO: 2631097 - DNA, 23 bp, Homo sapiens
ttctaagaagtgaaaatctacac

SEQ ID NO: 2631098 - DNA, 16 bp, Homo sapiens
ttctaagtaaaaccac

SEQ ID NO: 2631099 - DNA, 20 bp, Homo sapiens
ttctaagtaaaaccacagca

SEQ ID NO: 2631100 - DNA, 17 bp, Homo sapiens
ttctaagtctttccatt

SEQ ID NO: 2631101 - DNA, 14 bp, Homo sapiens
ttctaatagaactc

SEQ ID NO: 2631102 - DNA, 18 bp, Homo sapiens
ttctaatagaactcagtt

SEQ ID NO: 2631103 - DNA, 17 bp, Homo sapiens
ttctaatgtcttcattt

SEQ ID NO: 2631104 - DNA, 20 bp, Homo sapiens
ttctaattaataaattattt

SEQ ID NO: 2631105 - DNA, 21 bp, Homo sapiens
ttctaatttcaaaaatataac

SEQ ID NO: 2631106 - DNA, 17 bp, Homo sapiens
ttctaattttggatgga

SEQ ID NO: 2631107 - DNA, 16 bp, Homo sapiens
ttctacatttcttaga

SEQ ID NO: 2631108 - DNA, 22 bp, Homo sapiens
ttctaccatgaacagaaaacat

SEQ ID NO: 2631109 - DNA, 15 bp, Homo sapiens
ttctaccatttcaga

SEQ ID NO: 2631110 - DNA, 12 bp, Homo sapiens
ttctacccagcg

SEQ ID NO: 2631111 - DNA, 21 bp, Homo sapiens
ttctacccagcgagccctggt

SEQ ID NO: 2631112 - DNA, 15 bp, Homo sapiens
ttctaccctagccat

SEQ ID NO: 2631113 - DNA, 21 bp, Homo sapiens
ttctaccctagccattcctgg

SEQ ID NO: 2631114 - DNA, 14 bp, Homo sapiens
ttctacctcccaga

SEQ ID NO: 2631115 - DNA, 15 bp, Homo sapiens
ttctactcatatata

SEQ ID NO: 2631116 - DNA, 18 bp, Homo sapiens
ttctactcatatatatct

SEQ ID NO: 2631117 - DNA, 21 bp, Homo sapiens
ttctactcttaagtttctcag

SEQ ID NO: 2631118 - DNA, 17 bp, Homo sapiens
ttctagaaagcctgttc

SEQ ID NO: 2631119 - DNA, 22 bp, Homo sapiens
ttctagagaagaggctggtgct

SEQ ID NO: 2631120 - DNA, 14 bp, Homo sapiens
ttctagcactggcc

SEQ ID NO: 2631121 - DNA, 18 bp, Homo sapiens
ttctagctagaaatatga

SEQ ID NO: 2631122 - DNA, 18 bp, Homo sapiens
ttctaggaagaattttaa

SEQ ID NO: 2631123 - DNA, 19 bp, Homo sapiens
ttctaggaagaattttaaa

SEQ ID NO: 2631124 - DNA, 22 bp, Homo sapiens
ttctaggctacaattttctccc

SEQ ID NO: 2631125 - DNA, 23 bp, Homo sapiens
ttctagtctcctttgcactgagg

SEQ ID NO: 2631126 - DNA, 17 bp, Homo sapiens
ttctagtggtctttgta

SEQ ID NO: 2631127 - DNA, 20 bp, Homo sapiens
ttctagtggtctttgtaaga

SEQ ID NO: 2631128 - DNA, 21 bp, Homo sapiens
ttctataagttttatgttaaa

SEQ ID NO: 2631129 - DNA, 20 bp, Homo sapiens
ttctatatgaatttaaatat

SEQ ID NO: 2631130 - DNA, 14 bp, Homo sapiens
ttctatcacatatt

SEQ ID NO: 2631131 - DNA, 17 bp, Homo sapiens
ttctatcatttttgtac

SEQ ID NO: 2631132 - DNA, 23 bp, Homo sapiens
ttctatcctacaacaagagttta

SEQ ID NO: 2631133 - DNA, 14 bp, Homo sapiens
ttctattgaaaaat

SEQ ID NO: 2631134 - DNA, 22 bp, Homo sapiens
ttctattgttactctggttctt

SEQ ID NO: 2631135 - DNA, 15 bp, Homo sapiens
ttctattgttgtaca

SEQ ID NO: 2631136 - DNA, 14 bp, Homo sapiens
ttctatttaatgga

SEQ ID NO: 2631137 - DNA, 16 bp, Homo sapiens
ttctatttgctgggct

SEQ ID NO: 2631138 - DNA, 12 bp, Homo sapiens
ttctatttggaa

SEQ ID NO: 2631139 - DNA, 13 bp, Homo sapiens
ttctattttgtaa

SEQ ID NO: 2631140 - DNA, 16 bp, Homo sapiens
ttctattttgtaaact

SEQ ID NO: 2631141 - DNA, 15 bp, Homo sapiens
ttctatttttgtaga

SEQ ID NO: 2631142 - DNA, 15 bp, Homo sapiens
ttctcaaagttttga

SEQ ID NO: 2631143 - DNA, 14 bp, Homo sapiens
ttctcaagccctgc

SEQ ID NO: 2631144 - DNA, 19 bp, Homo sapiens
ttctcagaaggcaaatgac

SEQ ID NO: 2631145 - DNA, 13 bp, Homo sapiens
ttctcagctccca

SEQ ID NO: 2631146 - DNA, 19 bp, Homo sapiens
ttctcagctcccatttcta

SEQ ID NO: 2631147 - DNA, 12 bp, Homo sapiens
ttctcagggctc

SEQ ID NO: 2631148 - DNA, 21 bp, Homo sapiens
ttctcagggtctctgctgccg

SEQ ID NO: 2631149 - DNA, 22 bp, Homo sapiens
ttctcagtcagtaattgccaaa

SEQ ID NO: 2631150 - DNA, 15 bp, Homo sapiens
ttctcagttttcata

SEQ ID NO: 2631151 - DNA, 22 bp, Homo sapiens
ttctcatagcattaactaatct

SEQ ID NO: 2631152 - DNA, 20 bp, Homo sapiens
ttctcataggaaaagtacat

SEQ ID NO: 2631153 - DNA, 15 bp, Homo sapiens
ttctcatcctgcagg

SEQ ID NO: 2631154 - DNA, 18 bp, Homo sapiens
ttctcattccaacagtga

SEQ ID NO: 2631155 - DNA, 16 bp, Homo sapiens
ttctccacctgccagg

SEQ ID NO: 2631156 - DNA, 19 bp, Homo sapiens
ttctccagacccaccacac

SEQ ID NO: 2631157 - DNA, 14 bp, Homo sapiens
ttctccagccagca

SEQ ID NO: 2631158 - DNA, 15 bp, Homo sapiens
ttctccagctgggct

SEQ ID NO: 2631159 - DNA, 14 bp, Homo sapiens
ttctccattgtaaa

SEQ ID NO: 2631160 - DNA, 11 bp, Homo sapiens
ttctcctcccc

SEQ ID NO: 2631161 - DNA, 15 bp, Homo sapiens
ttctccttagtcttc

SEQ ID NO: 2631162 - DNA, 23 bp, Homo sapiens
ttctctaaatgaggggcctcagg

SEQ ID NO: 2631163 - DNA, 19 bp, Homo sapiens
ttctctaagagaacaatgt

SEQ ID NO: 2631164 - DNA, 20 bp, Homo sapiens
ttctctaagttccactgagc

SEQ ID NO: 2631165 - DNA, 20 bp, Homo sapiens
ttctctacagacttctccag

SEQ ID NO: 2631166 - DNA, 19 bp, Homo sapiens
ttctctagctggtggtttc

SEQ ID NO: 2631167 - DNA, 15 bp, Homo sapiens
ttctctagtttgatt

SEQ ID NO: 2631168 - DNA, 21 bp, Homo sapiens
ttctctagtttgattaaattc

SEQ ID NO: 2631169 - DNA, 13 bp, Homo sapiens
ttctctccagccc

SEQ ID NO: 2631170 - DNA, 16 bp, Homo sapiens
ttctctccagcccctg

SEQ ID NO: 2631171 - DNA, 18 bp, Homo sapiens
ttctctcctgtacctctt

SEQ ID NO: 2631172 - DNA, 17 bp, Homo sapiens
ttctctcggctccccat

SEQ ID NO: 2631173 - DNA, 23 bp, Homo sapiens
ttctctgaagagtgggtttcaca

SEQ ID NO: 2631174 - DNA, 12 bp, Homo sapiens
ttctctgccctc

SEQ ID NO: 2631175 - DNA, 17 bp, Homo sapiens
ttctctgtagggaactc

SEQ ID NO: 2631176 - DNA, 14 bp, Homo sapiens
ttctctgtatagta

SEQ ID NO: 2631177 - DNA, 13 bp, Homo sapiens
ttctctgtctcat

SEQ ID NO: 2631178 - DNA, 20 bp, Homo sapiens
ttctctgtgaacgatttaga

SEQ ID NO: 2631179 - DNA, 18 bp, Homo sapiens
ttctctgtgtttgttcct

SEQ ID NO: 2631180 - DNA, 15 bp, Homo sapiens
ttctcttgggctgag

SEQ ID NO: 2631181 - DNA, 13 bp, Homo sapiens
ttctctttcaaag

SEQ ID NO: 2631182 - DNA, 14 bp, Homo sapiens
ttctctttctctcc

SEQ ID NO: 2631183 - DNA, 15 bp, Homo sapiens
ttctgaaaatataac

SEQ ID NO: 2631184 - DNA, 16 bp, Homo sapiens
ttctgaactcaaactg

SEQ ID NO: 2631185 - DNA, 22 bp, Homo sapiens
ttctgaactcaaactgaggaat

SEQ ID NO: 2631186 - DNA, 18 bp, Homo sapiens
ttctgaatgctgctactt

SEQ ID NO: 2631187 - DNA, 22 bp, Homo sapiens
ttctgacattaacagttttcca

SEQ ID NO: 2631188 - DNA, 17 bp, Homo sapiens
ttctgaccacagcatca

SEQ ID NO: 2631189 - DNA, 14 bp, Homo sapiens
ttctgaccatttca

SEQ ID NO: 2631190 - DNA, 14 bp, Homo sapiens
ttctgacccatgct

SEQ ID NO: 2631191 - DNA, 20 bp, Homo sapiens
ttctgacccatgctgccctg

SEQ ID NO: 2631192 - DNA, 18 bp, Homo sapiens
ttctgaccctgcttcaaa

SEQ ID NO: 2631193 - DNA, 22 bp, Homo sapiens
ttctgacttcatagatttcctt

SEQ ID NO: 2631194 - DNA, 21 bp, Homo sapiens
ttctgagaaagactattcaaa

SEQ ID NO: 2631195 - DNA, 19 bp, Homo sapiens
ttctgagcccgggctgcct

SEQ ID NO: 2631196 - DNA, 23 bp, Homo sapiens
ttctgagctatttcatctatttt

SEQ ID NO: 2631197 - DNA, 14 bp, Homo sapiens
ttctgagtgttttt

SEQ ID NO: 2631198 - DNA, 16 bp, Homo sapiens
ttctgagtttcattct

SEQ ID NO: 2631199 - DNA, 15 bp, Homo sapiens
ttctgattagaaatg

SEQ ID NO: 2631200 - DNA, 16 bp, Homo sapiens
ttgcagacaggcaagc

SEQ ID NO: 2631201 - DNA, 22 bp, Homo sapiens
ttgcagacaggcaagcacctcc

SEQ ID NO: 2631202 - DNA, 14 bp, Homo sapiens
ttgcagagacagga

SEQ ID NO: 2631203 - DNA, 19 bp, Homo sapiens
ttgcagatgacaaaaattc

SEQ ID NO: 2631204 - DNA, 20 bp, Homo sapiens
ttgcagtagagtcatctcca

SEQ ID NO: 2631205 - DNA, 20 bp, Homo sapiens
ttgcagtttatcattcaagt

SEQ ID NO: 2631206 - DNA, 19 bp, Homo sapiens
ttgcataacaattcctcta

SEQ ID NO: 2631207 - DNA, 20 bp, Homo sapiens
ttgcataataagctaaagag

SEQ ID NO: 2631208 - DNA, 18 bp, Homo sapiens
ttgcatagattccctgag

SEQ ID NO: 2631209 - DNA, 23 bp, Homo sapiens
ttgcatagtaccaatcattttaa

SEQ ID NO: 2631210 - DNA, 14 bp, Homo sapiens
ttgcatataactta

SEQ ID NO: 2631211 - DNA, 14 bp, Homo sapiens
ttgcatatatacat

SEQ ID NO: 2631212 - DNA, 14 bp, Homo sapiens
ttgcatatgtatga

SEQ ID NO: 2631213 - DNA, 18 bp, Homo sapiens
ttgcatctgggtagctgt

SEQ ID NO: 2631214 - DNA, 19 bp, Homo sapiens
ttgcatctgggtagctgta

SEQ ID NO: 2631215 - DNA, 14 bp, Homo sapiens
ttgcatgaggctag

SEQ ID NO: 2631216 - DNA, 17 bp, Homo sapiens
ttgcatgggctaatgaa

SEQ ID NO: 2631217 - DNA, 18 bp, Homo sapiens
ttgcatgggctaatgaag

SEQ ID NO: 2631218 - DNA, 15 bp, Homo sapiens
ttgcatgtgactctg

SEQ ID NO: 2631219 - DNA, 16 bp, Homo sapiens
ttgcatgtgactctga

SEQ ID NO: 2631220 - DNA, 17 bp, Homo sapiens
ttgcatgtgactctgaa

SEQ ID NO: 2631221 - DNA, 19 bp, Homo sapiens
ttgcatgttccactaaccc

SEQ ID NO: 2631222 - DNA, 12 bp, Homo sapiens
ttgcattcaaat

SEQ ID NO: 2631223 - DNA, 15 bp, Homo sapiens
ttgcatttaaaacag

SEQ ID NO: 2631224 - DNA, 19 bp, Homo sapiens
ttgggctggaacagattca

SEQ ID NO: 2631225 - DNA, 19 bp, Homo sapiens
ttggggacatctctttgaa

SEQ ID NO: 2631226 - DNA, 21 bp, Homo sapiens
ttggggcgaggcagaggacag

SEQ ID NO: 2631227 - DNA, 15 bp, Homo sapiens
ttggggcttattttt

SEQ ID NO: 2631228 - DNA, 16 bp, Homo sapiens
ttggggcttgactttt

SEQ ID NO: 2631229 - DNA, 14 bp, Homo sapiens
ttgggggctggtgc

SEQ ID NO: 2631230 - DNA, 16 bp, Homo sapiens
ttgggggctggtgcca

SEQ ID NO: 2631231 - DNA, 22 bp, Homo sapiens
ttggggggctgaggtgggagga

SEQ ID NO: 2631232 - DNA, 23 bp, Homo sapiens
ttggggggggcccgcctggcaga

SEQ ID NO: 2631233 - DNA, 17 bp, Homo sapiens
ttggggtacccactgct

SEQ ID NO: 2631234 - DNA, 22 bp, Homo sapiens
ttggggtacccactgctctggt

SEQ ID NO: 2631235 - DNA, 21 bp, Homo sapiens
ttggggtagctagaggaacca

SEQ ID NO: 2631236 - DNA, 16 bp, Homo sapiens
ttggggttgtgttgtc

SEQ ID NO: 2631237 - DNA, 18 bp, Homo sapiens
ttgggtacctattttcat

SEQ ID NO: 2631238 - DNA, 17 bp, Homo sapiens
ttgggtggagaagccat

SEQ ID NO: 2631239 - DNA, 18 bp, Homo sapiens
ttgggtggagaagccatt

SEQ ID NO: 2631240 - DNA, 16 bp, Homo sapiens
ttgggtggatgcctgg

SEQ ID NO: 2631241 - DNA, 19 bp, Homo sapiens
ttgggtgtaacaggtctcc

SEQ ID NO: 2631242 - DNA, 22 bp, Homo sapiens
ttgggttcaagcgattcttctg

SEQ ID NO: 2631243 - DNA, 22 bp, Homo sapiens
ttggtactactagatgtcttta

SEQ ID NO: 2631244 - DNA, 16 bp, Homo sapiens
ttggtatcaagaaagt

SEQ ID NO: 2631245 - DNA, 17 bp, Homo sapiens
ttggtatcaagaaagtc

SEQ ID NO: 2631246 - DNA, 22 bp, Homo sapiens
ttggtcccccttccatggactt

SEQ ID NO: 2631247 - DNA, 13 bp, Homo sapiens
ttggtctgtgtga

SEQ ID NO: 2631248 - DNA, 15 bp, Homo sapiens
ttggtcttatttatt

SEQ ID NO: 2631249 - DNA, 21 bp, Homo sapiens
ttggtgcaacccttacccctt

SEQ ID NO: 2631250 - DNA, 15 bp, Homo sapiens
ttggtgcacagtgat

SEQ ID NO: 2631251 - DNA, 18 bp, Homo sapiens
ttggtgcacagtgatttt

SEQ ID NO: 2631252 - DNA, 22 bp, Homo sapiens
ttggtgcttacacatctcagac

SEQ ID NO: 2631253 - DNA, 16 bp, Homo sapiens
ttggtggagataaaga

SEQ ID NO: 2631254 - DNA, 15 bp, Homo sapiens
ttggttcataaatga

SEQ ID NO: 2631255 - DNA, 14 bp, Homo sapiens
ttggttctggggcc

SEQ ID NO: 2631256 - DNA, 22 bp, Homo sapiens
ttggttcttggtagagattcat

SEQ ID NO: 2631257 - DNA, 20 bp, Homo sapiens
ttggttgaaaataaaaagat

SEQ ID NO: 2631258 - DNA, 12 bp, Homo sapiens
ttggttgtcaat

SEQ ID NO: 2631259 - DNA, 15 bp, Homo sapiens
ttggttttgactgga

SEQ ID NO: 2631260 - DNA, 17 bp, Homo sapiens
ttgtaaaaaaaaatgcc

SEQ ID NO: 2631261 - DNA, 21 bp, Homo sapiens
ttgtaaaaacagcattgcttt

SEQ ID NO: 2631262 - DNA, 21 bp, Homo sapiens
ttgtaaaagaacagtaaacat

SEQ ID NO: 2631263 - DNA, 11 bp, Homo sapiens
ttgtaaataca

SEQ ID NO: 2631264 - DNA, 12 bp, Homo sapiens
ttgtaaatacac

SEQ ID NO: 2631265 - DNA, 17 bp, Homo sapiens
ttgtaaatagctcaggt

SEQ ID NO: 2631266 - DNA, 12 bp, Homo sapiens
ttgtaaatattt

SEQ ID NO: 2631267 - DNA, 16 bp, Homo sapiens
ttgtaaatatttatgt

SEQ ID NO: 2631268 - DNA, 16 bp, Homo sapiens
ttgtaaattaactttt

SEQ ID NO: 2631269 - DNA, 15 bp, Homo sapiens
ttgtaacctcagctc

SEQ ID NO: 2631270 - DNA, 14 bp, Homo sapiens
ttgtaagaaatact

SEQ ID NO: 2631271 - DNA, 17 bp, Homo sapiens
ttgtaagaaatactgta

SEQ ID NO: 2631272 - DNA, 21 bp, Homo sapiens
ttgtaagacaaaggttttcct

SEQ ID NO: 2631273 - DNA, 19 bp, Homo sapiens
ttgtaagacaatccatgta

SEQ ID NO: 2631274 - DNA, 19 bp, Homo sapiens
ttgtaagagtgtagaagca

SEQ ID NO: 2631275 - DNA, 21 bp, Homo sapiens
ttgtaagagtgtagaagcatt

SEQ ID NO: 2631276 - DNA, 22 bp, Homo sapiens
ttgtaagagtgtagaagcattc

SEQ ID NO: 2631277 - DNA, 17 bp, Homo sapiens
ttgtaagatgctgggtt

SEQ ID NO: 2631278 - DNA, 13 bp, Homo sapiens
ttgtaagtttcag

SEQ ID NO: 2631279 - DNA, 16 bp, Homo sapiens
ttgtaagtttcaggtg

SEQ ID NO: 2631280 - DNA, 17 bp, Homo sapiens
ttgtaagtttcaggtga

SEQ ID NO: 2631281 - DNA, 17 bp, Homo sapiens
ttgtaattgcttacatt

SEQ ID NO: 2631282 - DNA, 18 bp, Homo sapiens
ttgtaattgcttacattt

SEQ ID NO: 2631283 - DNA, 23 bp, Homo sapiens
ttgtaatttaaacaggcccagca

SEQ ID NO: 2631284 - DNA, 16 bp, Homo sapiens
ttgtacaaaaaaaaag

SEQ ID NO: 2631285 - DNA, 14 bp, Homo sapiens
ttgtacaaaataaa

SEQ ID NO: 2631286 - DNA, 19 bp, Homo sapiens
ttgtacacaccttatattt

SEQ ID NO: 2631287 - DNA, 11 bp, Homo sapiens
ttgtacacttt

SEQ ID NO: 2631288 - DNA, 13 bp, Homo sapiens
ttgtacacttttt

SEQ ID NO: 2631289 - DNA, 15 bp, Homo sapiens
ttgtacacttttttg

SEQ ID NO: 2631290 - DNA, 21 bp, Homo sapiens
ttgtacagacgtatgcttatt

SEQ ID NO: 2631291 - DNA, 15 bp, Homo sapiens
ttgtacagtttgctg

SEQ ID NO: 2631292 - DNA, 17 bp, Homo sapiens
ttgtacagtttgctgta

SEQ ID NO: 2631293 - DNA, 20 bp, Homo sapiens
ttgtacagtttgctgtacta

SEQ ID NO: 2631294 - DNA, 20 bp, Homo sapiens
ttgtacatttatgatttaat

SEQ ID NO: 2631295 - DNA, 16 bp, Homo sapiens
ttgtaccgcaatgtga

SEQ ID NO: 2631296 - DNA, 11 bp, Homo sapiens
ttgtacctctc

SEQ ID NO: 2631297 - DNA, 12 bp, Homo sapiens
ttgtactgtaaa

SEQ ID NO: 2631298 - DNA, 22 bp, Homo sapiens
ttgtagaagtaggaagtgaaaa

SEQ ID NO: 2631299 - DNA, 14 bp, Homo sapiens
ttgtagagccaggg

SEQ ID NO: 2631300 - DNA, 17 bp, Homo sapiens
ttgtagtttacctcttt

SEQ ID NO: 2631301 - DNA, 12 bp, Homo sapiens
ttgtataaattt

SEQ ID NO: 2631302 - DNA, 19 bp, Homo sapiens
ttgtataaatttatttact

SEQ ID NO: 2631303 - DNA, 14 bp, Homo sapiens
ttgtataacaggtt

SEQ ID NO: 2631304 - DNA, 15 bp, Homo sapiens
ttgtataacaggtta

SEQ ID NO: 2631305 - DNA, 21 bp, Homo sapiens
ttgtataagattagaatgaaa

SEQ ID NO: 2631306 - DNA, 12 bp, Homo sapiens
ttgtataattgt

SEQ ID NO: 2631307 - DNA, 15 bp, Homo sapiens
ttgtatagtaaagtg

SEQ ID NO: 2631308 - DNA, 16 bp, Homo sapiens
ttgtatattgtcagat

SEQ ID NO: 2631309 - DNA, 16 bp, Homo sapiens
ttgtatcacaaatctt

SEQ ID NO: 2631310 - DNA, 19 bp, Homo sapiens
ttgtatcacaaatcttaac

SEQ ID NO: 2631311 - DNA, 17 bp, Homo sapiens
ttgtatcgtatagctgt

SEQ ID NO: 2631312 - DNA, 20 bp, Homo sapiens
ttgtatcgtatagctgtatt

SEQ ID NO: 2631313 - DNA, 13 bp, Homo sapiens
ttgtatctagtgc

SEQ ID NO: 2631314 - DNA, 18 bp, Homo sapiens
ttgtatctagtgcagctg

SEQ ID NO: 2631315 - DNA, 21 bp, Homo sapiens
ttgtatctctgaagcatgttt

SEQ ID NO: 2631316 - DNA, 20 bp, Homo sapiens
ttgtatgatcctaatgaatg

SEQ ID NO: 2631317 - DNA, 14 bp, Homo sapiens
ttgtatgatgtgtt

SEQ ID NO: 2631318 - DNA, 20 bp, Homo sapiens
ttgtatgatgtgttgtgata

SEQ ID NO: 2631319 - DNA, 22 bp, Homo sapiens
ttgtatgcctttaaatctgtga

SEQ ID NO: 2631320 - DNA, 23 bp, Homo sapiens
ttgtatgcctttaaatctgtgat

SEQ ID NO: 2631321 - DNA, 16 bp, Homo sapiens
ttgtattctctcctgt

SEQ ID NO: 2631322 - DNA, 21 bp, Homo sapiens
ttgtattctctcctgtacctc

SEQ ID NO: 2631323 - DNA, 14 bp, Homo sapiens
ttgtattctctgag

SEQ ID NO: 2631324 - DNA, 20 bp, Homo sapiens
ttgtattctctgagctgtgc

SEQ ID NO: 2631325 - DNA, 22 bp, Homo sapiens
ttgtattctctgagctgtgcag

SEQ ID NO: 2631326 - DNA, 17 bp, Homo sapiens
ttgtattctttgatgtt

SEQ ID NO: 2631327 - DNA, 19 bp, Homo sapiens
ttgtattctttgatgttaa

SEQ ID NO: 2631328 - DNA, 16 bp, Homo sapiens
ttgtattgtttcaatt

SEQ ID NO: 2631329 - DNA, 14 bp, Homo sapiens
ttgtattttaactc

SEQ ID NO: 2631330 - DNA, 23 bp, Homo sapiens
ttgtattttccaagtgtgcatat

SEQ ID NO: 2631331 - DNA, 14 bp, Homo sapiens
ttgtcaatattaaa

SEQ ID NO: 2631332 - DNA, 18 bp, Homo sapiens
ttgtcaatattaaataca

SEQ ID NO: 2631333 - DNA, 19 bp, Homo sapiens
ttgtcaatattaaatacag

SEQ ID NO: 2631334 - DNA, 22 bp, Homo sapiens
ttgtcacatgaaacatttgcaa

SEQ ID NO: 2631335 - DNA, 12 bp, Homo sapiens
ttgtcagacttt

SEQ ID NO: 2631336 - DNA, 20 bp, Homo sapiens
ttgtcagactttaaagaata

SEQ ID NO: 2631337 - DNA, 13 bp, Homo sapiens
ttgtcagagctgg

SEQ ID NO: 2631338 - DNA, 15 bp, Homo sapiens
ttgtcagtgacagta

SEQ ID NO: 2631339 - DNA, 12 bp, Homo sapiens
ttgtcattaaag

SEQ ID NO: 2631340 - DNA, 15 bp, Homo sapiens
ttgtcattgctgttg

SEQ ID NO: 2631341 - DNA, 14 bp, Homo sapiens
ttgtccacccacct

SEQ ID NO: 2631342 - DNA, 15 bp, Homo sapiens
ttgtccccacactcc

SEQ ID NO: 2631343 - DNA, 18 bp, Homo sapiens
ttgtccccaccgcagaca

SEQ ID NO: 2631344 - DNA, 20 bp, Homo sapiens
ttgtccccaccgcagacagg

SEQ ID NO: 2631345 - DNA, 15 bp, Homo sapiens
ttgtccccgaccctt

SEQ ID NO: 2631346 - DNA, 18 bp, Homo sapiens
ttgtccctgaagagaagg

SEQ ID NO: 2631347 - DNA, 13 bp, Homo sapiens
ttgtcctcccctt

SEQ ID NO: 2631348 - DNA, 15 bp, Homo sapiens
ttgtcctttcccttc

SEQ ID NO: 2631349 - DNA, 16 bp, Homo sapiens
ttgtctatttttgtct

SEQ ID NO: 2631350 - DNA, 15 bp, Homo sapiens
ttgtcttaaaaagtg

SEQ ID NO: 2631351 - DNA, 15 bp, Homo sapiens
ttgtcttatatatat

SEQ ID NO: 2631352 - DNA, 15 bp, Homo sapiens
ttgtcttctccccag

SEQ ID NO: 2631353 - DNA, 13 bp, Homo sapiens
ttgtctttcagga

SEQ ID NO: 2631354 - DNA, 15 bp, Homo sapiens
ttgtctttggaccct

SEQ ID NO: 2631355 - DNA, 23 bp, Homo sapiens
ttgtgaaatgaaaacatgtaata

SEQ ID NO: 2631356 - DNA, 19 bp, Homo sapiens
ttgtgaactcagccaagca

SEQ ID NO: 2631357 - DNA, 22 bp, Homo sapiens
ttgtgaactcagccaagcacag

SEQ ID NO: 2631358 - DNA, 23 bp, Homo sapiens
ttgtgaactcagccaagcacagt

SEQ ID NO: 2631359 - DNA, 15 bp, Homo sapiens
ttgtgactatataga

SEQ ID NO: 2631360 - DNA, 19 bp, Homo sapiens
ttgtgactatatagagatg

SEQ ID NO: 2631361 - DNA, 21 bp, Homo sapiens
ttgtgactatatagagatgtt

SEQ ID NO: 2631362 - DNA, 22 bp, Homo sapiens
ttgtgactatatagagatgttt

SEQ ID NO: 2631363 - DNA, 13 bp, Homo sapiens
ttgtgaggaagcc

SEQ ID NO: 2631364 - DNA, 20 bp, Homo sapiens
ttgtgaggcccatggttgag

SEQ ID NO: 2631365 - DNA, 22 bp, Homo sapiens
ttgtgataagttctagttgctt

SEQ ID NO: 2631366 - DNA, 20 bp, Homo sapiens
ttgtgatacaatgctgtgcc

SEQ ID NO: 2631367 - DNA, 22 bp, Homo sapiens
ttgtgccaatatgtattgtaaa

SEQ ID NO: 2631368 - DNA, 17 bp, Homo sapiens
ttgtgcccactgtctct

SEQ ID NO: 2631369 - DNA, 15 bp, Homo sapiens
ttgtgcctggctcag

SEQ ID NO: 2631370 - DNA, 16 bp, Homo sapiens
ttgtgccttttatagc

SEQ ID NO: 2631371 - DNA, 18 bp, Homo sapiens
ttgtggaaagcctctgct

SEQ ID NO: 2631372 - DNA, 21 bp, Homo sapiens
ttgtggaattgggagcttggg

SEQ ID NO: 2631373 - DNA, 16 bp, Homo sapiens
ttgtggacatttaaga

SEQ ID NO: 2631374 - DNA, 22 bp, Homo sapiens
ttgtggaggagctcaggacact

SEQ ID NO: 2631375 - DNA, 14 bp, Homo sapiens
ttgtggatgtcttc

SEQ ID NO: 2631376 - DNA, 11 bp, Homo sapiens
ttgtggcctca

SEQ ID NO: 2631377 - DNA, 12 bp, Homo sapiens
ttgtggcctcag

SEQ ID NO: 2631378 - DNA, 15 bp, Homo sapiens
ttgtggctgtcagca

SEQ ID NO: 2631379 - DNA, 17 bp, Homo sapiens
ttgtggggatgatgaaa

SEQ ID NO: 2631380 - DNA, 13 bp, Homo sapiens
ttgtggttaatct

SEQ ID NO: 2631381 - DNA, 14 bp, Homo sapiens
ttgtggtttatgtc

SEQ ID NO: 2631382 - DNA, 23 bp, Homo sapiens
ttgtgtatccattatcatgtgta

SEQ ID NO: 2631383 - DNA, 21 bp, Homo sapiens
ttgtgtatttaacagggaggg

SEQ ID NO: 2631384 - DNA, 21 bp, Homo sapiens
ttgtgtcaatgggcaatgaca

SEQ ID NO: 2631385 - DNA, 14 bp, Homo sapiens
ttgtgtctgtacac

SEQ ID NO: 2631386 - DNA, 19 bp, Homo sapiens
ttgtgtgtcttaattatta

SEQ ID NO: 2631387 - DNA, 10 bp, Homo sapiens
ttgtgtgtgt

SEQ ID NO: 2631388 - DNA, 20 bp, Homo sapiens
ttgtgttactaagtttttat

SEQ ID NO: 2631389 - DNA, 11 bp, Homo sapiens
ttgtgttgtca

SEQ ID NO: 2631390 - DNA, 17 bp, Homo sapiens
ttgtgtttttaatttat

SEQ ID NO: 2631391 - DNA, 16 bp, Homo sapiens
ttgttaaaataactag

SEQ ID NO: 2631392 - DNA, 14 bp, Homo sapiens
ttgttaaatattta

SEQ ID NO: 2631393 - DNA, 17 bp, Homo sapiens
ttgttaatgaaaatgtc

SEQ ID NO: 2631394 - DNA, 17 bp, Homo sapiens
ttgttaatggtgcaaat

SEQ ID NO: 2631395 - DNA, 22 bp, Homo sapiens
ttgttactctggttctttgttt

SEQ ID NO: 2631396 - DNA, 19 bp, Homo sapiens
ttgttagtatgaggcattt

SEQ ID NO: 2631397 - DNA, 14 bp, Homo sapiens
ttgttatttataac

SEQ ID NO: 2631398 - DNA, 17 bp, Homo sapiens
ttgttccaagacattgt

SEQ ID NO: 2631399 - DNA, 21 bp, Homo sapiens
ttgttccacaagttaaataaa

SEQ ID NO: 2631400 - DNA, 19 bp, Homo sapiens
ttgttctggctcttccagg

SEQ ID NO: 2631401 - DNA, 23 bp, Homo sapiens
ttgttctgtggttttcccctccc

SEQ ID NO: 2631402 - DNA, 14 bp, Homo sapiens
ttgttctttaaagt

SEQ ID NO: 2631403 - DNA, 15 bp, Homo sapiens
ttgttctttgttctt

SEQ ID NO: 2631404 - DNA, 21 bp, Homo sapiens
ttgttgacagttctgaagaat

SEQ ID NO: 2631405 - DNA, 17 bp, Homo sapiens
ttgttgacttattttct

SEQ ID NO: 2631406 - DNA, 13 bp, Homo sapiens
ttgttggaatgaa

SEQ ID NO: 2631407 - DNA, 12 bp, Homo sapiens
ttgttggcctcc

SEQ ID NO: 2631408 - DNA, 21 bp, Homo sapiens
ttgttgttaatgaaaatgtca

SEQ ID NO: 2631409 - DNA, 16 bp, Homo sapiens
ttgttgtttttaagat

SEQ ID NO: 2631410 - DNA, 18 bp, Homo sapiens
ttgtttaaaatcatttct

SEQ ID NO: 2631411 - DNA, 22 bp, Homo sapiens
ttgtttacagcactactctgtg

SEQ ID NO: 2631412 - DNA, 18 bp, Homo sapiens
ttgtttacttaaagattt

SEQ ID NO: 2631413 - DNA, 21 bp, Homo sapiens
ttgtttagaaagaatattcat

SEQ ID NO: 2631414 - DNA, 15 bp, Homo sapiens
ttgtttagaagaagt

SEQ ID NO: 2631415 - DNA, 18 bp, Homo sapiens
ttgtttagaagaagtgtg

SEQ ID NO: 2631416 - DNA, 20 bp, Homo sapiens
ttgtttattctttttaaagt

SEQ ID NO: 2631417 - DNA, 14 bp, Homo sapiens
ttgtttctacctcc

SEQ ID NO: 2631418 - DNA, 16 bp, Homo sapiens
ttgtttctacctccca

SEQ ID NO: 2631419 - DNA, 13 bp, Homo sapiens
ttgtttcttccaa

SEQ ID NO: 2631420 - DNA, 21 bp, Homo sapiens
ttgtttgaaacaaagaaggtt

SEQ ID NO: 2631421 - DNA, 16 bp, Homo sapiens
ttgtttgctatcttaa

SEQ ID NO: 2631422 - DNA, 13 bp, Homo sapiens
ttgtttgcttatt

SEQ ID NO: 2631423 - DNA, 20 bp, Homo sapiens
ttgtttggggatgagaaagg

SEQ ID NO: 2631424 - DNA, 13 bp, Homo sapiens
ttgtttgtttcaa

SEQ ID NO: 2631425 - DNA, 21 bp, Homo sapiens
ttgtttgtttctccccctggg

SEQ ID NO: 2631426 - DNA, 23 bp, Homo sapiens
ttgttttgatgtttgtggcctca

SEQ ID NO: 2631427 - DNA, 15 bp, Homo sapiens
ttgttttgcactttt

SEQ ID NO: 2631428 - DNA, 16 bp, Homo sapiens
ttgttttgttttttgg

SEQ ID NO: 2631429 - DNA, 12 bp, Homo sapiens
ttgtttttatga

SEQ ID NO: 2631430 - DNA, 21 bp, Homo sapiens
ttgtttttccttgtatttaaa

SEQ ID NO: 2631431 - DNA, 18 bp, Homo sapiens
tttaaaaaaatttaagtg

SEQ ID NO: 2631432 - DNA, 15 bp, Homo sapiens
tttaaaaagtcttca

SEQ ID NO: 2631433 - DNA, 15 bp, Homo sapiens
tttaaaaatcataaa

SEQ ID NO: 2631434 - DNA, 11 bp, Homo sapiens
tttaaaaatga

SEQ ID NO: 2631435 - DNA, 12 bp, Homo sapiens
tttaaaaatgca

SEQ ID NO: 2631436 - DNA, 14 bp, Homo sapiens
tttaaaacatgtaa

SEQ ID NO: 2631437 - DNA, 14 bp, Homo sapiens
tttaaaacccattt

SEQ ID NO: 2631438 - DNA, 11 bp, Homo sapiens
tttaaaacttg

SEQ ID NO: 2631439 - DNA, 14 bp, Homo sapiens
tttaaaagacactg

SEQ ID NO: 2631440 - DNA, 16 bp, Homo sapiens
tttaaaagattcattt

SEQ ID NO: 2631441 - DNA, 15 bp, Homo sapiens
tttaaaagttattaa

SEQ ID NO: 2631442 - DNA, 14 bp, Homo sapiens
tttaaaatgattag

SEQ ID NO: 2631443 - DNA, 19 bp, Homo sapiens
tttaaaatttaagtatctt

SEQ ID NO: 2631444 - DNA, 17 bp, Homo sapiens
tttaaaattttatctct

SEQ ID NO: 2631445 - DNA, 14 bp, Homo sapiens
tttaaacacctcct

SEQ ID NO: 2631446 - DNA, 21 bp, Homo sapiens
tttaaacaggcccagcattgc

SEQ ID NO: 2631447 - DNA, 16 bp, Homo sapiens
tttaaacatagaaagt

SEQ ID NO: 2631448 - DNA, 21 bp, Homo sapiens
tttaaacccattttagtcact

SEQ ID NO: 2631449 - DNA, 18 bp, Homo sapiens
tttaaagaagaaacgtct

SEQ ID NO: 2631450 - DNA, 16 bp, Homo sapiens
tttaaaggggcagaaa

SEQ ID NO: 2631451 - DNA, 22 bp, Homo sapiens
tttaaaggggcagaaaaactct

SEQ ID NO: 2631452 - DNA, 20 bp, Homo sapiens
tttaaagtgtttctgttatt

SEQ ID NO: 2631453 - DNA, 20 bp, Homo sapiens
tttaaatacagtcttccatt

SEQ ID NO: 2631454 - DNA, 18 bp, Homo sapiens
tttaaatataattctgta

SEQ ID NO: 2631455 - DNA, 11 bp, Homo sapiens
tttaaatgcac

SEQ ID NO: 2631456 - DNA, 18 bp, Homo sapiens
tttaaatgtaaagatatt

SEQ ID NO: 2631457 - DNA, 22 bp, Homo sapiens
tttaaattttaccctttagact

SEQ ID NO: 2631458 - DNA, 23 bp, Homo sapiens
tttaacaataactactgtgttcc

SEQ ID NO: 2631459 - DNA, 19 bp, Homo sapiens
tttaacacaagtcctgtga

SEQ ID NO: 2631460 - DNA, 13 bp, Homo sapiens
tttaacagaaatg

SEQ ID NO: 2631461 - DNA, 15 bp, Homo sapiens
tttaacagaaatgta

SEQ ID NO: 2631462 - DNA, 18 bp, Homo sapiens
tttaacagaaatgtacag

SEQ ID NO: 2631463 - DNA, 18 bp, Homo sapiens
tttaacaggaagatctta

SEQ ID NO: 2631464 - DNA, 15 bp, Homo sapiens
tttaacagtcattta

SEQ ID NO: 2631465 - DNA, 17 bp, Homo sapiens
tttaacagtcatttaaa

SEQ ID NO: 2631466 - DNA, 20 bp, Homo sapiens
tttaaccattaaaactgaag

SEQ ID NO: 2631467 - DNA, 16 bp, Homo sapiens
tttaacctatgatatt

SEQ ID NO: 2631468 - DNA, 17 bp, Homo sapiens
tttaactagaatttatt

SEQ ID NO: 2631469 - DNA, 18 bp, Homo sapiens
tttaactcagatcactac

SEQ ID NO: 2631470 - DNA, 13 bp, Homo sapiens
tttaactctgtct

SEQ ID NO: 2631471 - DNA, 14 bp, Homo sapiens
tttaactctgtctt

SEQ ID NO: 2631472 - DNA, 17 bp, Homo sapiens
tttaactctgtcttcac

SEQ ID NO: 2631473 - DNA, 14 bp, Homo sapiens
tttaactgccttgt

SEQ ID NO: 2631474 - DNA, 18 bp, Homo sapiens
tttaagacagtctttggg

SEQ ID NO: 2631475 - DNA, 14 bp, Homo sapiens
tttaagaggcaggg

SEQ ID NO: 2631476 - DNA, 20 bp, Homo sapiens
tttaagataatagtttacat

SEQ ID NO: 2631477 - DNA, 14 bp, Homo sapiens
tttaagataattat

SEQ ID NO: 2631478 - DNA, 14 bp, Homo sapiens
tttaagatttttct

SEQ ID NO: 2631479 - DNA, 20 bp, Homo sapiens
tttaagcagctcttgctaat

SEQ ID NO: 2631480 - DNA, 19 bp, Homo sapiens
tttaagcctcatatttaaa

SEQ ID NO: 2631481 - DNA, 13 bp, Homo sapiens
tttaagctgtttc

SEQ ID NO: 2631482 - DNA, 12 bp, Homo sapiens
tttaaggaatat

SEQ ID NO: 2631483 - DNA, 19 bp, Homo sapiens
tttaaggatgcttgtacat

SEQ ID NO: 2631484 - DNA, 13 bp, Homo sapiens
tttaagtatttag

SEQ ID NO: 2631485 - DNA, 14 bp, Homo sapiens
tttaagtgtaactg

SEQ ID NO: 2631486 - DNA, 21 bp, Homo sapiens
tttaagttgtttgcatgtgaa

SEQ ID NO: 2631487 - DNA, 16 bp, Homo sapiens
tttaataaaataattc

SEQ ID NO: 2631488 - DNA, 20 bp, Homo sapiens
tttaataaaataattctaaa

SEQ ID NO: 2631489 - DNA, 13 bp, Homo sapiens
tttaataaacttt

SEQ ID NO: 2631490 - DNA, 18 bp, Homo sapiens
tttaataacattacctta

SEQ ID NO: 2631491 - DNA, 14 bp, Homo sapiens
tttaatacagggta

SEQ ID NO: 2631492 - DNA, 12 bp, Homo sapiens
tttaatagtgtt

SEQ ID NO: 2631493 - DNA, 18 bp, Homo sapiens
tttaatagtgttaatcaa

SEQ ID NO: 2631494 - DNA, 22 bp, Homo sapiens
tttaatagtgttaatcaattta

SEQ ID NO: 2631495 - DNA, 24 bp, Homo sapiens
tttaatcatgaaattacttatcat

SEQ ID NO: 2631496 - DNA, 21 bp, Homo sapiens
tttaatgaaagactgtacaaa

SEQ ID NO: 2631497 - DNA, 14 bp, Homo sapiens
tttaatgagataat

SEQ ID NO: 2631498 - DNA, 17 bp, Homo sapiens
tttaatgtgctgtgtaa

SEQ ID NO: 2631499 - DNA, 21 bp, Homo sapiens
tttaatgtgctgtgtaaagtt

SEQ ID NO: 2631500 - DNA, 15 bp, Homo sapiens
tttaattaaatgctc

SEQ ID NO: 2631501 - DNA, 23 bp, Homo sapiens
tttaattcatgtttcttaaatgg

SEQ ID NO: 2631502 - DNA, 16 bp, Homo sapiens
tttaattccaatatga

SEQ ID NO: 2631503 - DNA, 11 bp, Homo sapiens
tttaattccat

SEQ ID NO: 2631504 - DNA, 17 bp, Homo sapiens
tggtgctcagttgtaga

SEQ ID NO: 2631505 - DNA, 21 bp, Homo sapiens
tggtgctcagttgtagaatgt

SEQ ID NO: 2631506 - DNA, 13 bp, Homo sapiens
tggtgctgacctc

SEQ ID NO: 2631507 - DNA, 14 bp, Homo sapiens
tggggcgaggcaga

SEQ ID NO: 2631508 - DNA, 17 bp, Homo sapiens
tggggcgaggcagagga

SEQ ID NO: 2631509 - DNA, 18 bp, Homo sapiens
tggggcgaggcagaggac

SEQ ID NO: 2631510 - DNA, 17 bp, Homo sapiens
tggggcgggaaagccag

SEQ ID NO: 2631511 - DNA, 14 bp, Homo sapiens
tggggcgtggggag

SEQ ID NO: 2631512 - DNA, 23 bp, Homo sapiens
tggggctcctttctccagccagc

SEQ ID NO: 2631513 - DNA, 15 bp, Homo sapiens
tggggctctgtgcag

SEQ ID NO: 2631514 - DNA, 20 bp, Homo sapiens
tggggctgaaggttgaagag

SEQ ID NO: 2631515 - DNA, 23 bp, Homo sapiens
tggggctgcaccggctggcctgg

SEQ ID NO: 2631516 - DNA, 15 bp, Homo sapiens
tgggggaaagcacag

SEQ ID NO: 2631517 - DNA, 15 bp, Homo sapiens
tggccggtctgcaag

SEQ ID NO: 2631518 - DNA, 22 bp, Homo sapiens
tggccggtctgcaagtcagagg

SEQ ID NO: 2631519 - DNA, 19 bp, Homo sapiens
tggccgtgggcctggggta

SEQ ID NO: 2631520 - DNA, 14 bp, Homo sapiens
tggccgttatctgg

SEQ ID NO: 2631521 - DNA, 17 bp, Homo sapiens
tggcctatgcacatatg

SEQ ID NO: 2631522 - DNA, 21 bp, Homo sapiens
tggcctattatattaaaatat

SEQ ID NO: 2631523 - DNA, 13 bp, Homo sapiens
tggcctcaaccct

SEQ ID NO: 2631524 - DNA, 17 bp, Homo sapiens
tggcctcaaccctccct

SEQ ID NO: 2631525 - DNA, 19 bp, Homo sapiens
tggcctcaaccctccctca

SEQ ID NO: 2631526 - DNA, 21 bp, Homo sapiens
tggcctcaaccctccctcagc

SEQ ID NO: 2631527 - DNA, 13 bp, Homo sapiens
tggcctcagctgc

SEQ ID NO: 2631528 - DNA, 16 bp, Homo sapiens
tggcctcagctgcctc

SEQ ID NO: 2631529 - DNA, 22 bp, Homo sapiens
tggcctcccaactcaccccagc

SEQ ID NO: 2631530 - DNA, 15 bp, Homo sapiens
tggcctcccacccga

SEQ ID NO: 2631531 - DNA, 15 bp, Homo sapiens
tggcctcccctgctg

SEQ ID NO: 2631532 - DNA, 12 bp, Homo sapiens
tggcctccggcc

SEQ ID NO: 2631533 - DNA, 15 bp, Homo sapiens
tggcctccggcctcc

SEQ ID NO: 2631534 - DNA, 19 bp, Homo sapiens
tggcctcctcccttagctc

SEQ ID NO: 2631535 - DNA, 15 bp, Homo sapiens
tggcctctgcactcc

SEQ ID NO: 2631536 - DNA, 18 bp, Homo sapiens
tggcctctgcactcccct

SEQ ID NO: 2631537 - DNA, 20 bp, Homo sapiens
tggcctctgcactcccctgc

SEQ ID NO: 2631538 - DNA, 13 bp, Homo sapiens
tggcctggactgt

SEQ ID NO: 2631539 - DNA, 22 bp, Homo sapiens
tggcctggaggtggggttggga

SEQ ID NO: 2631540 - DNA, 16 bp, Homo sapiens
tggcctggcacacatc

SEQ ID NO: 2631541 - DNA, 13 bp, Homo sapiens
tggcctggccggc

SEQ ID NO: 2631542 - DNA, 13 bp, Homo sapiens
tggcctgggagag

SEQ ID NO: 2631543 - DNA, 12 bp, Homo sapiens
tggcctgtctca

SEQ ID NO: 2631544 - DNA, 22 bp, Homo sapiens
tggcctgtgtcccatgacccac

SEQ ID NO: 2631545 - DNA, 13 bp, Homo sapiens
tggcctgttctgt

SEQ ID NO: 2631546 - DNA, 14 bp, Homo sapiens
tggccttcctgccc

SEQ ID NO: 2631547 - DNA, 12 bp, Homo sapiens
tggcgcagccaa

SEQ ID NO: 2631548 - DNA, 17 bp, Homo sapiens
tggcgggcgcctgtagt

SEQ ID NO: 2631549 - DNA, 20 bp, Homo sapiens
tggcgtagaagtttttgtac

SEQ ID NO: 2631550 - DNA, 15 bp, Homo sapiens
tggcgtctgtcttca

SEQ ID NO: 2631551 - DNA, 15 bp, Homo sapiens
tggctaagagtgtcc

SEQ ID NO: 2631552 - DNA, 18 bp, Homo sapiens
tggctaagcaaaatgtga

SEQ ID NO: 2631553 - DNA, 15 bp, Homo sapiens
tggctaattcccaga

SEQ ID NO: 2631554 - DNA, 21 bp, Homo sapiens
tggctagaggccagccccacc

SEQ ID NO: 2631555 - DNA, 21 bp, Homo sapiens
tggctagagtcctcactccca

SEQ ID NO: 2631556 - DNA, 17 bp, Homo sapiens
tggctagtgtctatcag

SEQ ID NO: 2631557 - DNA, 23 bp, Homo sapiens
tggctataggtgctacaaaaaca

SEQ ID NO: 2631558 - DNA, 14 bp, Homo sapiens
tggctatgcatttg

SEQ ID NO: 2631559 - DNA, 14 bp, Homo sapiens
tggctatggccacc

SEQ ID NO: 2631560 - DNA, 18 bp, Homo sapiens
tggctcaagtcctctttt

SEQ ID NO: 2631561 - DNA, 15 bp, Homo sapiens
tggctcacccaagca

SEQ ID NO: 2631562 - DNA, 18 bp, Homo sapiens
tggctcactatggtgcca

SEQ ID NO: 2631563 - DNA, 22 bp, Homo sapiens
tggctcaggtggggtcactctg

SEQ ID NO: 2631564 - DNA, 18 bp, Homo sapiens
tggctccaaaccctcgag

SEQ ID NO: 2631565 - DNA, 15 bp, Homo sapiens
tggctccagaaatgt

SEQ ID NO: 2631566 - DNA, 21 bp, Homo sapiens
tggctccagcaccatccgcca

SEQ ID NO: 2631567 - DNA, 23 bp, Homo sapiens
tggctccagtctgctgccctcca

SEQ ID NO: 2631568 - DNA, 16 bp, Homo sapiens
tggctcccacaggagt

SEQ ID NO: 2631569 - DNA, 17 bp, Homo sapiens
tggctcccacaggcagc

SEQ ID NO: 2631570 - DNA, 18 bp, Homo sapiens
tggctcccacaggcagct

SEQ ID NO: 2631571 - DNA, 14 bp, Homo sapiens
tggctcccctctat

SEQ ID NO: 2631572 - DNA, 21 bp, Homo sapiens
tggctcccctctatttagcat

SEQ ID NO: 2631573 - DNA, 23 bp, Homo sapiens
tggctcccctctatttagcatga

SEQ ID NO: 2631574 - DNA, 16 bp, Homo sapiens
tggctcctatctgtgt

SEQ ID NO: 2631575 - DNA, 18 bp, Homo sapiens
tggctcctatctgtgttt

SEQ ID NO: 2631576 - DNA, 20 bp, Homo sapiens
tggctcctgaggggcatctg

SEQ ID NO: 2631577 - DNA, 17 bp, Homo sapiens
tggctccttcccatcgc

SEQ ID NO: 2631578 - DNA, 16 bp, Homo sapiens
tggctctcagaaggta

SEQ ID NO: 2631579 - DNA, 19 bp, Homo sapiens
tggctctcattgacttcct

SEQ ID NO: 2631580 - DNA, 15 bp, Homo sapiens
tggctctccaagtgc

SEQ ID NO: 2631581 - DNA, 16 bp, Homo sapiens
tggctcttccaggctg

SEQ ID NO: 2631582 - DNA, 19 bp, Homo sapiens
tggctcttccaggctggga

SEQ ID NO: 2631583 - DNA, 19 bp, Homo sapiens
tggctctttggagatcaag

SEQ ID NO: 2631584 - DNA, 15 bp, Homo sapiens
tggctgaaccctgtg

SEQ ID NO: 2631585 - DNA, 13 bp, Homo sapiens
tggctgaaggact

SEQ ID NO: 2631586 - DNA, 22 bp, Homo sapiens
tggctgaccccaaagagcctgg

SEQ ID NO: 2631587 - DNA, 13 bp, Homo sapiens
tggctgagccctg

SEQ ID NO: 2631588 - DNA, 17 bp, Homo sapiens
tggctgaggaggcctcc

SEQ ID NO: 2631589 - DNA, 23 bp, Homo sapiens
tggctgaggaggcctccatctca

SEQ ID NO: 2631590 - DNA, 12 bp, Homo sapiens
tggctgcaaagg

SEQ ID NO: 2631591 - DNA, 12 bp, Homo sapiens
tggctgcagcag

SEQ ID NO: 2631592 - DNA, 12 bp, Homo sapiens
tggctgcatgcg

SEQ ID NO: 2631593 - DNA, 21 bp, Homo sapiens
tggctgcccagacccctctgg

SEQ ID NO: 2631594 - DNA, 23 bp, Homo sapiens
tggctgcccagacccctctggcc

SEQ ID NO: 2631595 - DNA, 17 bp, Homo sapiens
tggctgccccaacctgc

SEQ ID NO: 2631596 - DNA, 14 bp, Homo sapiens
tggctgccctggcc

SEQ ID NO: 2631597 - DNA, 13 bp, Homo sapiens
tggctgctagcac

SEQ ID NO: 2631598 - DNA, 22 bp, Homo sapiens
tggctgctgaagctgcctgctt

SEQ ID NO: 2631599 - DNA, 14 bp, Homo sapiens
tggctgctgcccag

SEQ ID NO: 2631600 - DNA, 22 bp, Homo sapiens
tggctggatgaaattttctaga

SEQ ID NO: 2631601 - DNA, 15 bp, Homo sapiens
tggctggccactgca

SEQ ID NO: 2631602 - DNA, 13 bp, Homo sapiens
tggctggctgcag

SEQ ID NO: 2631603 - DNA, 23 bp, Homo sapiens
tggctgggaactcacctggggct

SEQ ID NO: 2631604 - DNA, 21 bp, Homo sapiens
tggctgggaactgcagacctg

SEQ ID NO: 2631605 - DNA, 15 bp, Homo sapiens
tggctgggcccagaa

SEQ ID NO: 2631606 - DNA, 16 bp, Homo sapiens
tggctgggcccagaag

SEQ ID NO: 2631607 - DNA, 17 bp, Homo sapiens
tggctgggggcaggagg

SEQ ID NO: 2631608 - DNA, 12 bp, Homo sapiens
tggctgggggcc

SEQ ID NO: 2631609 - DNA, 15 bp, Homo sapiens
tggctgggggcctca

SEQ ID NO: 2631610 - DNA, 16 bp, Homo sapiens
tggctgggggcctcag

SEQ ID NO: 2631611 - DNA, 22 bp, Homo sapiens
tggctggtaacagttcatgttt

SEQ ID NO: 2631612 - DNA, 17 bp, Homo sapiens
tggctgtcagcaggaag

SEQ ID NO: 2631613 - DNA, 18 bp, Homo sapiens
tggctgtgcctctgcctg

SEQ ID NO: 2631614 - DNA, 19 bp, Homo sapiens
tggctgtgcctctgcctgt

SEQ ID NO: 2631615 - DNA, 23 bp, Homo sapiens
tggctgttggctgggggcctcag

SEQ ID NO: 2631616 - DNA, 17 bp, Homo sapiens
tggcttaaaacaacact

SEQ ID NO: 2631617 - DNA, 15 bp, Homo sapiens
tggcttaatgcttct

SEQ ID NO: 2631618 - DNA, 20 bp, Homo sapiens
tggcttaatgcttctttcat

SEQ ID NO: 2631619 - DNA, 18 bp, Homo sapiens
tggcttcattagagcagg

SEQ ID NO: 2631620 - DNA, 22 bp, Homo sapiens
tggcttccagaaaaccccagca

SEQ ID NO: 2631621 - DNA, 23 bp, Homo sapiens
tggcttccagaaaaccccagcat

SEQ ID NO: 2631622 - DNA, 16 bp, Homo sapiens
tggcttccatgatggt

SEQ ID NO: 2631623 - DNA, 21 bp, Homo sapiens
tggcttcctcctccctcctgc

SEQ ID NO: 2631624 - DNA, 13 bp, Homo sapiens
tggcttcctcctg

SEQ ID NO: 2631625 - DNA, 14 bp, Homo sapiens
tggcttcctttctt

SEQ ID NO: 2631626 - DNA, 14 bp, Homo sapiens
tggcttctccaggg

SEQ ID NO: 2631627 - DNA, 20 bp, Homo sapiens
tggcttgtgtgtttcacttt

SEQ ID NO: 2631628 - DNA, 12 bp, Homo sapiens
tggctttcccgg

SEQ ID NO: 2631629 - DNA, 20 bp, Homo sapiens
tggcttttattaatgcactt

SEQ ID NO: 2631630 - DNA, 22 bp, Homo sapiens
tggcttttattaatgcactttc

SEQ ID NO: 2631631 - DNA, 14 bp, Homo sapiens
tggcttttgtgcat

SEQ ID NO: 2631632 - DNA, 23 bp, Homo sapiens
tgggaaaataccccatcattcat

SEQ ID NO: 2631633 - DNA, 21 bp, Homo sapiens
tgggaaagcattgtaaatgtg

SEQ ID NO: 2631634 - DNA, 16 bp, Homo sapiens
tgggaaagccacctct

SEQ ID NO: 2631635 - DNA, 19 bp, Homo sapiens
tgggaaatgagaaggcagc

SEQ ID NO: 2631636 - DNA, 20 bp, Homo sapiens
tgggaaatgagaaggcagcc

SEQ ID NO: 2631637 - DNA, 15 bp, Homo sapiens
tgggaaatggcttga

SEQ ID NO: 2631638 - DNA, 21 bp, Homo sapiens
tgggaacccccctcccaccca

SEQ ID NO: 2631639 - DNA, 15 bp, Homo sapiens
tggattatttaataa

SEQ ID NO: 2631640 - DNA, 17 bp, Homo sapiens
tggattatttaataaca

SEQ ID NO: 2631641 - DNA, 13 bp, Homo sapiens
tggattctcagat

SEQ ID NO: 2631642 - DNA, 20 bp, Homo sapiens
tggattggagatagggaaag

SEQ ID NO: 2631643 - DNA, 16 bp, Homo sapiens
tggattggattattta

SEQ ID NO: 2631644 - DNA, 17 bp, Homo sapiens
tggattggtgtaaaagg

SEQ ID NO: 2631645 - DNA, 13 bp, Homo sapiens
tggattgtccccg

SEQ ID NO: 2631646 - DNA, 14 bp, Homo sapiens
tggatttataaatg

SEQ ID NO: 2631647 - DNA, 17 bp, Homo sapiens
tggatttgtttaaaagg

SEQ ID NO: 2631648 - DNA, 20 bp, Homo sapiens
tggattttctattgttactc

SEQ ID NO: 2631649 - DNA, 13 bp, Homo sapiens
tggcaaagacaga

SEQ ID NO: 2631650 - DNA, 21 bp, Homo sapiens
tggcaaagccttcattgcctt

SEQ ID NO: 2631651 - DNA, 17 bp, Homo sapiens
tggcaaattaacttgag

SEQ ID NO: 2631652 - DNA, 20 bp, Homo sapiens
tggcaaattaacttgagttt

SEQ ID NO: 2631653 - DNA, 15 bp, Homo sapiens
tggcaaggctgtgct

SEQ ID NO: 2631654 - DNA, 16 bp, Homo sapiens
tggcaaggctgtgctc

SEQ ID NO: 2631655 - DNA, 20 bp, Homo sapiens
tggcaatagtgggccctccg

SEQ ID NO: 2631656 - DNA, 15 bp, Homo sapiens
tggcaattttgtaac

SEQ ID NO: 2631657 - DNA, 14 bp, Homo sapiens
tggcacagaaacac

SEQ ID NO: 2631658 - DNA, 15 bp, Homo sapiens
tggcacatcctatgc

SEQ ID NO: 2631659 - DNA, 18 bp, Homo sapiens
tggcacatcctatgcaat

SEQ ID NO: 2631660 - DNA, 19 bp, Homo sapiens
tggcacatcctatgcaata

SEQ ID NO: 2631661 - DNA, 23 bp, Homo sapiens
tggcacatcctatgcaatatatc

SEQ ID NO: 2631662 - DNA, 14 bp, Homo sapiens
tggcaccagaggct

SEQ ID NO: 2631663 - DNA, 15 bp, Homo sapiens
tggcacccggcccct

SEQ ID NO: 2631664 - DNA, 18 bp, Homo sapiens
tggcacccggcccctgct

SEQ ID NO: 2631665 - DNA, 16 bp, Homo sapiens
tggcaccgccttctct

SEQ ID NO: 2631666 - DNA, 20 bp, Homo sapiens
tggcacggtggctcaggcct

SEQ ID NO: 2631667 - DNA, 22 bp, Homo sapiens
tggcactaacgttgagcccctg

SEQ ID NO: 2631668 - DNA, 22 bp, Homo sapiens
tggcactgagatatttattgtt

SEQ ID NO: 2631669 - DNA, 13 bp, Homo sapiens
tggcactgagccc

SEQ ID NO: 2631670 - DNA, 19 bp, Homo sapiens
tggcactgcatacaatctg

SEQ ID NO: 2631671 - DNA, 13 bp, Homo sapiens
tggcactgccatg

SEQ ID NO: 2631672 - DNA, 15 bp, Homo sapiens
tggcactggatgcag

SEQ ID NO: 2631673 - DNA, 13 bp, Homo sapiens
tggcagaagacac

SEQ ID NO: 2631674 - DNA, 14 bp, Homo sapiens
tggcagaagacacc

SEQ ID NO: 2631675 - DNA, 18 bp, Homo sapiens
tggcagaagacaccagag

SEQ ID NO: 2631676 - DNA, 22 bp, Homo sapiens
tggcagaagacaccagagcaga

SEQ ID NO: 2631677 - DNA, 23 bp, Homo sapiens
tggcagaagacaccagagcagat

SEQ ID NO: 2631678 - DNA, 20 bp, Homo sapiens
tggcagaataatctttgggt

SEQ ID NO: 2631679 - DNA, 22 bp, Homo sapiens
tggcagagcttggactggatgc

SEQ ID NO: 2631680 - DNA, 22 bp, Homo sapiens
tggcagagtttgtgtgttgtct

SEQ ID NO: 2631681 - DNA, 13 bp, Homo sapiens
tggcagccttggc

SEQ ID NO: 2631682 - DNA, 13 bp, Homo sapiens
tggcagctcagag

SEQ ID NO: 2631683 - DNA, 14 bp, Homo sapiens
tggcagctcagaga

SEQ ID NO: 2631684 - DNA, 16 bp, Homo sapiens
tggcagctcagagagg

SEQ ID NO: 2631685 - DNA, 12 bp, Homo sapiens
tggcagctctcc

SEQ ID NO: 2631686 - DNA, 14 bp, Homo sapiens
tggcagctctccag

SEQ ID NO: 2631687 - DNA, 15 bp, Homo sapiens
tggcagctctccagt

SEQ ID NO: 2631688 - DNA, 19 bp, Homo sapiens
tggcagctgcggtccaccc

SEQ ID NO: 2631689 - DNA, 19 bp, Homo sapiens
tggcaggagttggaagtgt

SEQ ID NO: 2631690 - DNA, 19 bp, Homo sapiens
tggcaggatggcctggcca

SEQ ID NO: 2631691 - DNA, 15 bp, Homo sapiens
tggcaggcagcgcca

SEQ ID NO: 2631692 - DNA, 19 bp, Homo sapiens
tggcaggcagcgccaagca

SEQ ID NO: 2631693 - DNA, 14 bp, Homo sapiens
tggcagggcctagc

SEQ ID NO: 2631694 - DNA, 19 bp, Homo sapiens
tggcagggcctagctgcta

SEQ ID NO: 2631695 - DNA, 12 bp, Homo sapiens
tggcagggctca

SEQ ID NO: 2631696 - DNA, 14 bp, Homo sapiens
tggcagggctcagg

SEQ ID NO: 2631697 - DNA, 17 bp, Homo sapiens
tggcagggctcaggatt

SEQ ID NO: 2631698 - DNA, 15 bp, Homo sapiens
tggcaggtgcagccc

SEQ ID NO: 2631699 - DNA, 13 bp, Homo sapiens
tggcagtctatat

SEQ ID NO: 2631700 - DNA, 19 bp, Homo sapiens
tggcagtctatatgtttgt

SEQ ID NO: 2631701 - DNA, 22 bp, Homo sapiens
tggcagtctgaatttttaaaac

SEQ ID NO: 2631702 - DNA, 13 bp, Homo sapiens
tggcagtgggagc

SEQ ID NO: 2631703 - DNA, 15 bp, Homo sapiens
tggcagtgggagctg

SEQ ID NO: 2631704 - DNA, 19 bp, Homo sapiens
tggcagtgggagctgcctg

SEQ ID NO: 2631705 - DNA, 19 bp, Homo sapiens
tggcatagcccagacacag

SEQ ID NO: 2631706 - DNA, 18 bp, Homo sapiens
tggcatcacagggcagag

SEQ ID NO: 2631707 - DNA, 15 bp, Homo sapiens
tggcatcagctggcg

SEQ ID NO: 2631708 - DNA, 18 bp, Homo sapiens
tggcatcagctggcgtca

SEQ ID NO: 2631709 - DNA, 19 bp, Homo sapiens
tggcatcccagtggcctca

SEQ ID NO: 2631710 - DNA, 13 bp, Homo sapiens
tggcatcctgtga

SEQ ID NO: 2631711 - DNA, 20 bp, Homo sapiens
tggcatctttgccttgggct

SEQ ID NO: 2631712 - DNA, 15 bp, Homo sapiens
tggcatgccttccag

SEQ ID NO: 2631713 - DNA, 19 bp, Homo sapiens
tggcatgccttccagcacc

SEQ ID NO: 2631714 - DNA, 14 bp, Homo sapiens
tggcatgtggcctg

SEQ ID NO: 2631715 - DNA, 15 bp, Homo sapiens
tggcatgtggcctgt

SEQ ID NO: 2631716 - DNA, 16 bp, Homo sapiens
tggcatgtggcctgtg

SEQ ID NO: 2631717 - DNA, 17 bp, Homo sapiens
tggcattagaattattt

SEQ ID NO: 2631718 - DNA, 19 bp, Homo sapiens
tggcattgtccctgtgcct

SEQ ID NO: 2631719 - DNA, 14 bp, Homo sapiens
tggccaaagtgtta

SEQ ID NO: 2631720 - DNA, 12 bp, Homo sapiens
tggccaccaggc

SEQ ID NO: 2631721 - DNA, 13 bp, Homo sapiens
tggccaccaggct

SEQ ID NO: 2631722 - DNA, 14 bp, Homo sapiens
tggccaccaggctg

SEQ ID NO: 2631723 - DNA, 20 bp, Homo sapiens
tggccaccaggctggcgcag

SEQ ID NO: 2631724 - DNA, 20 bp, Homo sapiens
tggccacctctctcctttgc

SEQ ID NO: 2631725 - DNA, 22 bp, Homo sapiens
tggccacctgaggtgggcccag

SEQ ID NO: 2631726 - DNA, 16 bp, Homo sapiens
tggccaccttttcagc

SEQ ID NO: 2631727 - DNA, 13 bp, Homo sapiens
tggccactcagct

SEQ ID NO: 2631728 - DNA, 22 bp, Homo sapiens
tggccactcagcttcctaccca

SEQ ID NO: 2631729 - DNA, 19 bp, Homo sapiens
tggccactgcacagagctc

SEQ ID NO: 2631730 - DNA, 13 bp, Homo sapiens
tggccagagagcc

SEQ ID NO: 2631731 - DNA, 18 bp, Homo sapiens
tggccagatgcaccagcc

SEQ ID NO: 2631732 - DNA, 21 bp, Homo sapiens
tggccagatgcaccagccctt

SEQ ID NO: 2631733 - DNA, 11 bp, Homo sapiens
tggccagcccg

SEQ ID NO: 2631734 - DNA, 14 bp, Homo sapiens
tggccagcccggct

SEQ ID NO: 2631735 - DNA, 16 bp, Homo sapiens
tggccagcctggatct

SEQ ID NO: 2631736 - DNA, 16 bp, Homo sapiens
tggccaggcagatctg

SEQ ID NO: 2631737 - DNA, 19 bp, Homo sapiens
tggccaggcctcttggcag

SEQ ID NO: 2631738 - DNA, 15 bp, Homo sapiens
tggccaggctggtct

SEQ ID NO: 2631739 - DNA, 17 bp, Homo sapiens
tggccaggctggtctca

SEQ ID NO: 2631740 - DNA, 12 bp, Homo sapiens
tggccagggtga

SEQ ID NO: 2631741 - DNA, 13 bp, Homo sapiens
tggccagggtgag

SEQ ID NO: 2631742 - DNA, 14 bp, Homo sapiens
tggccagtgtctgt

SEQ ID NO: 2631743 - DNA, 23 bp, Homo sapiens
tggccagtgtgacaaggattgct

SEQ ID NO: 2631744 - DNA, 16 bp, Homo sapiens
tggccatctccacccc

SEQ ID NO: 2631745 - DNA, 14 bp, Homo sapiens
tggccatctctgga

SEQ ID NO: 2631746 - DNA, 17 bp, Homo sapiens
tggccatctctggatgc

SEQ ID NO: 2631747 - DNA, 16 bp, Homo sapiens
tggccatttagccacc

SEQ ID NO: 2631748 - DNA, 19 bp, Homo sapiens
tggcccaaaacgtcttatt

SEQ ID NO: 2631749 - DNA, 19 bp, Homo sapiens
tggcccaagtggcagagct

SEQ ID NO: 2631750 - DNA, 13 bp, Homo sapiens
tggcccacgcact

SEQ ID NO: 2631751 - DNA, 13 bp, Homo sapiens
tggcccagccctg

SEQ ID NO: 2631752 - DNA, 17 bp, Homo sapiens
tggcccagccctgctgg

SEQ ID NO: 2631753 - DNA, 20 bp, Homo sapiens
tggcccagccctgctggccg

SEQ ID NO: 2631754 - DNA, 17 bp, Homo sapiens
tggcccagccggcctct

SEQ ID NO: 2631755 - DNA, 15 bp, Homo sapiens
tgctgtgtaaagtta

SEQ ID NO: 2631756 - DNA, 13 bp, Homo sapiens
tgctgtgtgcctt

SEQ ID NO: 2631757 - DNA, 21 bp, Homo sapiens
tgctgtgtttgagctctgcag

SEQ ID NO: 2631758 - DNA, 17 bp, Homo sapiens
tgctgttgatgttttgt

SEQ ID NO: 2631759 - DNA, 12 bp, Homo sapiens
tgctgttgattg

SEQ ID NO: 2631760 - DNA, 17 bp, Homo sapiens
tgctgttgattgctaaa

SEQ ID NO: 2631761 - DNA, 18 bp, Homo sapiens
tgctgttgattgctaaat

SEQ ID NO: 2631762 - DNA, 20 bp, Homo sapiens
tgctgttgattgctaaatgt

SEQ ID NO: 2631763 - DNA, 13 bp, Homo sapiens
tgctgttgtttct

SEQ ID NO: 2631764 - DNA, 14 bp, Homo sapiens
tgctgtttcctttt

SEQ ID NO: 2631765 - DNA, 18 bp, Homo sapiens
tgctgttttgatttgtac

SEQ ID NO: 2631766 - DNA, 17 bp, Homo sapiens
tgcttaaaaatcattga

SEQ ID NO: 2631767 - DNA, 14 bp, Homo sapiens
tgcttaacttcaca

SEQ ID NO: 2631768 - DNA, 17 bp, Homo sapiens
tgcttaacttcacatat

SEQ ID NO: 2631769 - DNA, 18 bp, Homo sapiens
tgcttacaattccctgct

SEQ ID NO: 2631770 - DNA, 13 bp, Homo sapiens
tgcttacaatttt

SEQ ID NO: 2631771 - DNA, 23 bp, Homo sapiens
tgcttacaatttttttaattttg

SEQ ID NO: 2631772 - DNA, 17 bp, Homo sapiens
tgcttacacatctcaga

SEQ ID NO: 2631773 - DNA, 12 bp, Homo sapiens
tgcttacatttt

SEQ ID NO: 2631774 - DNA, 14 bp, Homo sapiens
tgcttacattttta

SEQ ID NO: 2631775 - DNA, 14 bp, Homo sapiens
tgcttactttggaa

SEQ ID NO: 2631776 - DNA, 14 bp, Homo sapiens
tgcttagcctcctg

SEQ ID NO: 2631777 - DNA, 15 bp, Homo sapiens
tgcttagtaatgcta

SEQ ID NO: 2631778 - DNA, 20 bp, Homo sapiens
tgcttagtccaattccttgc

SEQ ID NO: 2631779 - DNA, 20 bp, Homo sapiens
tgcttagtgtacttggagta

SEQ ID NO: 2631780 - DNA, 13 bp, Homo sapiens
tgcttatacactt

SEQ ID NO: 2631781 - DNA, 21 bp, Homo sapiens
tgcttatgacatcacttgtac

SEQ ID NO: 2631782 - DNA, 14 bp, Homo sapiens
tgcttattgttcca

SEQ ID NO: 2631783 - DNA, 15 bp, Homo sapiens
tgcttattgttccaa

SEQ ID NO: 2631784 - DNA, 17 bp, Homo sapiens
tgcttattttaaaattt

SEQ ID NO: 2631785 - DNA, 21 bp, Homo sapiens
tgcttcaaaaacattcttaca

SEQ ID NO: 2631786 - DNA, 12 bp, Homo sapiens
tgcttcagcctg

SEQ ID NO: 2631787 - DNA, 22 bp, Homo sapiens
tgcttcagcctgaggctgagac

SEQ ID NO: 2631788 - DNA, 16 bp, Homo sapiens
tgcttcagtggagaat

SEQ ID NO: 2631789 - DNA, 20 bp, Homo sapiens
tgcttcataaatgaagcagc

SEQ ID NO: 2631790 - DNA, 17 bp, Homo sapiens
tgcttcatgctcagccc

SEQ ID NO: 2631791 - DNA, 15 bp, Homo sapiens
tgcttccaattttct

SEQ ID NO: 2631792 - DNA, 18 bp, Homo sapiens
tgcttccagtgaggctct

SEQ ID NO: 2631793 - DNA, 16 bp, Homo sapiens
tgcttcccatcctacc

SEQ ID NO: 2631794 - DNA, 13 bp, Homo sapiens
tgcttccctctgc

SEQ ID NO: 2631795 - DNA, 20 bp, Homo sapiens
tgcttccctctgcctgtccc

SEQ ID NO: 2631796 - DNA, 21 bp, Homo sapiens
tgcttccctctgcctgtccct

SEQ ID NO: 2631797 - DNA, 22 bp, Homo sapiens
tgcttcctagaagttactgaat

SEQ ID NO: 2631798 - DNA, 13 bp, Homo sapiens
tgcttcgggccct

SEQ ID NO: 2631799 - DNA, 18 bp, Homo sapiens
tgcttcgggcccttccca

SEQ ID NO: 2631800 - DNA, 13 bp, Homo sapiens
tgcttcttcagag

SEQ ID NO: 2631801 - DNA, 14 bp, Homo sapiens
tgcttcttctcagg

SEQ ID NO: 2631802 - DNA, 16 bp, Homo sapiens
tgcttcttctcaggca

SEQ ID NO: 2631803 - DNA, 17 bp, Homo sapiens
tgcttgaaaaatgtgca

SEQ ID NO: 2631804 - DNA, 12 bp, Homo sapiens
tgcttgattttt

SEQ ID NO: 2631805 - DNA, 22 bp, Homo sapiens
tgcttgcactttgtaacatgtt

SEQ ID NO: 2631806 - DNA, 19 bp, Homo sapiens
tgcttgcagtagattttct

SEQ ID NO: 2631807 - DNA, 14 bp, Homo sapiens
tgcttgcctagggc

SEQ ID NO: 2631808 - DNA, 19 bp, Homo sapiens
tgcttgcctgcgttttgga

SEQ ID NO: 2631809 - DNA, 19 bp, Homo sapiens
tgcttggccttgggcttca

SEQ ID NO: 2631810 - DNA, 18 bp, Homo sapiens
tgcttgggtggagaagcc

SEQ ID NO: 2631811 - DNA, 20 bp, Homo sapiens
tgcttgggtggagaagccat

SEQ ID NO: 2631812 - DNA, 21 bp, Homo sapiens
tgcttgggtggagaagccatt

SEQ ID NO: 2631813 - DNA, 12 bp, Homo sapiens
tgcttgtacata

SEQ ID NO: 2631814 - DNA, 14 bp, Homo sapiens
tgcttgttggattt

SEQ ID NO: 2631815 - DNA, 12 bp, Homo sapiens
tgctttaaacat

SEQ ID NO: 2631816 - DNA, 18 bp, Homo sapiens
tgctttaatatcatcagt

SEQ ID NO: 2631817 - DNA, 22 bp, Homo sapiens
tgctttagcttgaaaaggtgac

SEQ ID NO: 2631818 - DNA, 15 bp, Homo sapiens
tgctttatgccttct

SEQ ID NO: 2631819 - DNA, 14 bp, Homo sapiens
tgctttcccctgtg

SEQ ID NO: 2631820 - DNA, 13 bp, Homo sapiens
tgctttctgaaat

SEQ ID NO: 2631821 - DNA, 22 bp, Homo sapiens
tgctttctttcgtttgtttgtt

SEQ ID NO: 2631822 - DNA, 22 bp, Homo sapiens
tgctttgactcacctgttactt

SEQ ID NO: 2631823 - DNA, 14 bp, Homo sapiens
tgctttgtgaacaa

SEQ ID NO: 2631824 - DNA, 17 bp, Homo sapiens
tgctttgtgatttttgt

SEQ ID NO: 2631825 - DNA, 16 bp, Homo sapiens
tgcttttcactgctgc

SEQ ID NO: 2631826 - DNA, 22 bp, Homo sapiens
tgcttttcactgctgcaaggcc

SEQ ID NO: 2631827 - DNA, 22 bp, Homo sapiens
tgcttttccttggggcaggcag

SEQ ID NO: 2631828 - DNA, 14 bp, Homo sapiens
tgcttttggtctgt

SEQ ID NO: 2631829 - DNA, 20 bp, Homo sapiens
tgcttttgtctatgggactc

SEQ ID NO: 2631830 - DNA, 23 bp, Homo sapiens
tgctttttaatattgatatgctt

SEQ ID NO: 2631831 - DNA, 15 bp, Homo sapiens
tgctttttcaccaga

SEQ ID NO: 2631832 - DNA, 20 bp, Homo sapiens
tgctttttgaggtggcactt

SEQ ID NO: 2631833 - DNA, 21 bp, Homo sapiens
tgctttttgaggtggcacttt

SEQ ID NO: 2631834 - DNA, 12 bp, Homo sapiens
tggaaaaatatt

SEQ ID NO: 2631835 - DNA, 13 bp, Homo sapiens
tggaaaaatccag

SEQ ID NO: 2631836 - DNA, 18 bp, Homo sapiens
tggaaaaatccagaaaga

SEQ ID NO: 2631837 - DNA, 16 bp, Homo sapiens
tggaaaagaggagttt

SEQ ID NO: 2631838 - DNA, 20 bp, Homo sapiens
tggaaaaggaagactagagg

SEQ ID NO: 2631839 - DNA, 17 bp, Homo sapiens
tggaaacctgaaaaaaa

SEQ ID NO: 2631840 - DNA, 16 bp, Homo sapiens
tggaaactgaatgctc

SEQ ID NO: 2631841 - DNA, 21 bp, Homo sapiens
tggaaactggatgaggtcata

SEQ ID NO: 2631842 - DNA, 16 bp, Homo sapiens
tggaaagaatctaata

SEQ ID NO: 2631843 - DNA, 23 bp, Homo sapiens
tggaaagacagcttctcatcctg

SEQ ID NO: 2631844 - DNA, 20 bp, Homo sapiens
tggaaagcatcacctcaggc

SEQ ID NO: 2631845 - DNA, 21 bp, Homo sapiens
tggaaaggctcagtctcagga

SEQ ID NO: 2631846 - DNA, 17 bp, Homo sapiens
tggaaaggggggagctg

SEQ ID NO: 2631847 - DNA, 23 bp, Homo sapiens
tggaaagggtgctgcttccctct

SEQ ID NO: 2631848 - DNA, 20 bp, Homo sapiens
tggaaagtgaatttgaatga

SEQ ID NO: 2631849 - DNA, 17 bp, Homo sapiens
tggaaagtgtaaagcat

SEQ ID NO: 2631850 - DNA, 15 bp, Homo sapiens
tggaaataaatgtat

SEQ ID NO: 2631851 - DNA, 18 bp, Homo sapiens
tggaaatacagttgttgg

SEQ ID NO: 2631852 - DNA, 16 bp, Homo sapiens
tggaaatgctgggctg

SEQ ID NO: 2631853 - DNA, 20 bp, Homo sapiens
tggaaatgctgggctgacgg

SEQ ID NO: 2631854 - DNA, 15 bp, Homo sapiens
tgctcacaccccatt

SEQ ID NO: 2631855 - DNA, 12 bp, Homo sapiens
tgctcacctggg

SEQ ID NO: 2631856 - DNA, 17 bp, Homo sapiens
tgctcagaccagctctt

SEQ ID NO: 2631857 - DNA, 13 bp, Homo sapiens
tgctcagccctga

SEQ ID NO: 2631858 - DNA, 17 bp, Homo sapiens
tgctcagccctgactgg

SEQ ID NO: 2631859 - DNA, 22 bp, Homo sapiens
tgctcagccctgactggtgcta

SEQ ID NO: 2631860 - DNA, 17 bp, Homo sapiens
tgctcagttgtagaatg

SEQ ID NO: 2631861 - DNA, 17 bp, Homo sapiens
tgctcatcattctctgt

SEQ ID NO: 2631862 - DNA, 23 bp, Homo sapiens
tgctcatcattctctgtctcatc

SEQ ID NO: 2631863 - DNA, 15 bp, Homo sapiens
tgctccaccacatcc

SEQ ID NO: 2631864 - DNA, 16 bp, Homo sapiens
tgctccacccttggcc

SEQ ID NO: 2631865 - DNA, 19 bp, Homo sapiens
tgctccacccttggcctgt

SEQ ID NO: 2631866 - DNA, 22 bp, Homo sapiens
tgctccacccttggcctgtctc

SEQ ID NO: 2631867 - DNA, 22 bp, Homo sapiens
tgctccagccaacccctgtgga

SEQ ID NO: 2631868 - DNA, 15 bp, Homo sapiens
tgctccagcctggct

SEQ ID NO: 2631869 - DNA, 16 bp, Homo sapiens
tgctccagcctggctc

SEQ ID NO: 2631870 - DNA, 16 bp, Homo sapiens
tgctccagctgttcag

SEQ ID NO: 2631871 - DNA, 14 bp, Homo sapiens
tgctccaggcaggc

SEQ ID NO: 2631872 - DNA, 23 bp, Homo sapiens
tgctccagtcaacaaactatttc

SEQ ID NO: 2631873 - DNA, 13 bp, Homo sapiens
tgctcccagcagc

SEQ ID NO: 2631874 - DNA, 17 bp, Homo sapiens
tgctcccagcagcccta

SEQ ID NO: 2631875 - DNA, 13 bp, Homo sapiens
tgctcccccatcc

SEQ ID NO: 2631876 - DNA, 15 bp, Homo sapiens
tgctcccccatcctc

SEQ ID NO: 2631877 - DNA, 18 bp, Homo sapiens
tgctcccccatcctcccc

SEQ ID NO: 2631878 - DNA, 21 bp, Homo sapiens
tgctcccccatcctccccttc

SEQ ID NO: 2631879 - DNA, 22 bp, Homo sapiens
tgctcccccatcctccccttcc

SEQ ID NO: 2631880 - DNA, 13 bp, Homo sapiens
tgctccctcccct

SEQ ID NO: 2631881 - DNA, 14 bp, Homo sapiens
tgctccctcccctg

SEQ ID NO: 2631882 - DNA, 15 bp, Homo sapiens
tgctccctcccctgc

SEQ ID NO: 2631883 - DNA, 18 bp, Homo sapiens
tgctccctcccctgccct

SEQ ID NO: 2631884 - DNA, 15 bp, Homo sapiens
tgctccgtgcctcca

SEQ ID NO: 2631885 - DNA, 16 bp, Homo sapiens
tgctccgtgcctccac

SEQ ID NO: 2631886 - DNA, 20 bp, Homo sapiens
tgctccgtgcctccaccacc

SEQ ID NO: 2631887 - DNA, 12 bp, Homo sapiens
tgctcctccctg

SEQ ID NO: 2631888 - DNA, 14 bp, Homo sapiens
tgctcctctcccca

SEQ ID NO: 2631889 - DNA, 19 bp, Homo sapiens
tgctcctctccccagcaag

SEQ ID NO: 2631890 - DNA, 21 bp, Homo sapiens
tgctcctggagcctttgaata

SEQ ID NO: 2631891 - DNA, 19 bp, Homo sapiens
tgctccttccaacaggagc

SEQ ID NO: 2631892 - DNA, 19 bp, Homo sapiens
tgctctccaagtctcagtg

SEQ ID NO: 2631893 - DNA, 20 bp, Homo sapiens
tgctctcccctgccctgctg

SEQ ID NO: 2631894 - DNA, 12 bp, Homo sapiens
tgctctcctctt

SEQ ID NO: 2631895 - DNA, 16 bp, Homo sapiens
tgctctcctcttgcca

SEQ ID NO: 2631896 - DNA, 12 bp, Homo sapiens
tgctctcctttc

SEQ ID NO: 2631897 - DNA, 16 bp, Homo sapiens
tgctctgaggcttcca

SEQ ID NO: 2631898 - DNA, 19 bp, Homo sapiens
tgctctgatcatccactgt

SEQ ID NO: 2631899 - DNA, 22 bp, Homo sapiens
tgctctgatcatccactgtgcc

SEQ ID NO: 2631900 - DNA, 13 bp, Homo sapiens
tgctctgatccct

SEQ ID NO: 2631901 - DNA, 16 bp, Homo sapiens
tgctctgcaggcacct

SEQ ID NO: 2631902 - DNA, 20 bp, Homo sapiens
tgctctgcaggcaccttagt

SEQ ID NO: 2631903 - DNA, 15 bp, Homo sapiens
tgctctgcatgttac

SEQ ID NO: 2631904 - DNA, 14 bp, Homo sapiens
tgctctgctgacag

SEQ ID NO: 2631905 - DNA, 15 bp, Homo sapiens
tgctctgctgacaga

SEQ ID NO: 2631906 - DNA, 16 bp, Homo sapiens
tgctctgctgacagac

SEQ ID NO: 2631907 - DNA, 13 bp, Homo sapiens
tgctcttctgtgg

SEQ ID NO: 2631908 - DNA, 14 bp, Homo sapiens
tgctcttctttaga

SEQ ID NO: 2631909 - DNA, 16 bp, Homo sapiens
tgctgaaaccaagggg

SEQ ID NO: 2631910 - DNA, 20 bp, Homo sapiens
tgctgaaagcccaagtaggg

SEQ ID NO: 2631911 - DNA, 16 bp, Homo sapiens
tgctgaacaccttgtg

SEQ ID NO: 2631912 - DNA, 21 bp, Homo sapiens
tgctgaacaccttgtggaagc

SEQ ID NO: 2631913 - DNA, 21 bp, Homo sapiens
tgctgaaggctcgagcatgcc

SEQ ID NO: 2631914 - DNA, 22 bp, Homo sapiens
tgctgaaggtggggattgccca

SEQ ID NO: 2631915 - DNA, 18 bp, Homo sapiens
tgctgaatacagaggcaa

SEQ ID NO: 2631916 - DNA, 18 bp, Homo sapiens
tgctgaatatacagcagg

SEQ ID NO: 2631917 - DNA, 15 bp, Homo sapiens
tgctgaccctcctgt

SEQ ID NO: 2631918 - DNA, 16 bp, Homo sapiens
tgctgactgttttctc

SEQ ID NO: 2631919 - DNA, 17 bp, Homo sapiens
tgctgactgttttctct

SEQ ID NO: 2631920 - DNA, 21 bp, Homo sapiens
tgctgactgttttctcttgag

SEQ ID NO: 2631921 - DNA, 16 bp, Homo sapiens
tgctgagtctgaaggc

SEQ ID NO: 2631922 - DNA, 17 bp, Homo sapiens
tgctgagtctgaaggct

SEQ ID NO: 2631923 - DNA, 16 bp, Homo sapiens
tgctgatgttcagtgt

SEQ ID NO: 2631924 - DNA, 17 bp, Homo sapiens
tgctgatgttcagtgta

SEQ ID NO: 2631925 - DNA, 20 bp, Homo sapiens
tgctgatgttcagtgtaatt

SEQ ID NO: 2631926 - DNA, 17 bp, Homo sapiens
tgctgattctcccgttc

SEQ ID NO: 2631927 - DNA, 13 bp, Homo sapiens
tgctgcaaggcct

SEQ ID NO: 2631928 - DNA, 15 bp, Homo sapiens
tgctgcagttgccag

SEQ ID NO: 2631929 - DNA, 19 bp, Homo sapiens
tgctgcatttaaaagatac

SEQ ID NO: 2631930 - DNA, 15 bp, Homo sapiens
tgctgccatccaggt

SEQ ID NO: 2631931 - DNA, 21 bp, Homo sapiens
tgctgccatccaggttcagct

SEQ ID NO: 2631932 - DNA, 22 bp, Homo sapiens
tgctgccatccaggttcagctt

SEQ ID NO: 2631933 - DNA, 16 bp, Homo sapiens
tgctgcccaggcccag

SEQ ID NO: 2631934 - DNA, 21 bp, Homo sapiens
tgctgcccatgccaccgcttc

SEQ ID NO: 2631935 - DNA, 21 bp, Homo sapiens
tgctgccccatcagtgctccc

SEQ ID NO: 2631936 - DNA, 17 bp, Homo sapiens
tgctgcccgtcttcagc

SEQ ID NO: 2631937 - DNA, 20 bp, Homo sapiens
tgctgcccgtcttcagccta

SEQ ID NO: 2631938 - DNA, 22 bp, Homo sapiens
tgctgcccgtcttcagcctagc

SEQ ID NO: 2631939 - DNA, 12 bp, Homo sapiens
tgctgccctgcc

SEQ ID NO: 2631940 - DNA, 21 bp, Homo sapiens
tgctgccctgcccacctggcc

SEQ ID NO: 2631941 - DNA, 13 bp, Homo sapiens
tgctgccctgtga

SEQ ID NO: 2631942 - DNA, 20 bp, Homo sapiens
tgctgccgcctcccagcctg

SEQ ID NO: 2631943 - DNA, 20 bp, Homo sapiens
tgcccacctggcctctgcac

SEQ ID NO: 2631944 - DNA, 17 bp, Homo sapiens
tgcccagaataagttat

SEQ ID NO: 2631945 - DNA, 15 bp, Homo sapiens
tgcccagaccacacg

SEQ ID NO: 2631946 - DNA, 11 bp, Homo sapiens
tgcccagcccc

SEQ ID NO: 2631947 - DNA, 20 bp, Homo sapiens
tgcccagccccttctgaccc

SEQ ID NO: 2631948 - DNA, 20 bp, Homo sapiens
tgcccagcccggaccttggc

SEQ ID NO: 2631949 - DNA, 20 bp, Homo sapiens
tgcccagctagctgcagagc

SEQ ID NO: 2631950 - DNA, 13 bp, Homo sapiens
tgcccagcttggg

SEQ ID NO: 2631951 - DNA, 21 bp, Homo sapiens
tgcccagcttgggcccagctg

SEQ ID NO: 2631952 - DNA, 17 bp, Homo sapiens
tgcccaggcaggtcttg

SEQ ID NO: 2631953 - DNA, 18 bp, Homo sapiens
tgcccaggcccctgccac

SEQ ID NO: 2631954 - DNA, 20 bp, Homo sapiens
tgcccaggctggcgtgcagt

SEQ ID NO: 2631955 - DNA, 11 bp, Homo sapiens
tgcccagggct

SEQ ID NO: 2631956 - DNA, 16 bp, Homo sapiens
tgcccagggctcagcc

SEQ ID NO: 2631957 - DNA, 17 bp, Homo sapiens
tgcccagggctcagcct

SEQ ID NO: 2631958 - DNA, 20 bp, Homo sapiens
tgcccagggctcagcctggt

SEQ ID NO: 2631959 - DNA, 16 bp, Homo sapiens
tgcccaggggagccct

SEQ ID NO: 2631960 - DNA, 20 bp, Homo sapiens
tgcccaggggcccacaggga

SEQ ID NO: 2631961 - DNA, 15 bp, Homo sapiens
tgcccaggggtgccc

SEQ ID NO: 2631962 - DNA, 16 bp, Homo sapiens
tgcccaggggtgcccc

SEQ ID NO: 2631963 - DNA, 20 bp, Homo sapiens
tgcccaggggtgccccctcc

SEQ ID NO: 2631964 - DNA, 17 bp, Homo sapiens
tgcccagtttctgcctc

SEQ ID NO: 2631965 - DNA, 16 bp, Homo sapiens
tgccccaacctgctga

SEQ ID NO: 2631966 - DNA, 20 bp, Homo sapiens
tgccccacccctccccatta

SEQ ID NO: 2631967 - DNA, 13 bp, Homo sapiens
tgccccagagctg

SEQ ID NO: 2631968 - DNA, 15 bp, Homo sapiens
tgccccatgcctgtc

SEQ ID NO: 2631969 - DNA, 16 bp, Homo sapiens
tgcccccagctggccc

SEQ ID NO: 2631970 - DNA, 14 bp, Homo sapiens
tgcccccagggcac

SEQ ID NO: 2631971 - DNA, 13 bp, Homo sapiens
tgccccccacccc

SEQ ID NO: 2631972 - DNA, 18 bp, Homo sapiens
tgccccccaccccagcct

SEQ ID NO: 2631973 - DNA, 20 bp, Homo sapiens
tgcccccctcaaacctcctc

SEQ ID NO: 2631974 - DNA, 18 bp, Homo sapiens
tgcccccggccccctggt

SEQ ID NO: 2631975 - DNA, 14 bp, Homo sapiens
tgccccctcctctc

SEQ ID NO: 2631976 - DNA, 20 bp, Homo sapiens
tgccccctcctctcccatcc

SEQ ID NO: 2631977 - DNA, 21 bp, Homo sapiens
tgccccctcctctcccatccc

SEQ ID NO: 2631978 - DNA, 18 bp, Homo sapiens
tgccccctgaaacttatt

SEQ ID NO: 2631979 - DNA, 13 bp, Homo sapiens
tgccccctggtgg

SEQ ID NO: 2631980 - DNA, 18 bp, Homo sapiens
tgcccccttctcccacac

SEQ ID NO: 2631981 - DNA, 19 bp, Homo sapiens
tgcccccttctcccacact

SEQ ID NO: 2631982 - DNA, 13 bp, Homo sapiens
tgccccgcccagc

SEQ ID NO: 2631983 - DNA, 21 bp, Homo sapiens
tgccccggccccggccccagc

SEQ ID NO: 2631984 - DNA, 18 bp, Homo sapiens
tgccccgtcaccatctca

SEQ ID NO: 2631985 - DNA, 20 bp, Homo sapiens
tgccccgtcaccatctcagg

SEQ ID NO: 2631986 - DNA, 22 bp, Homo sapiens
tgccccgtccacggctctaggt

SEQ ID NO: 2631987 - DNA, 12 bp, Homo sapiens
tgcccctcccag

SEQ ID NO: 2631988 - DNA, 12 bp, Homo sapiens
tgcccctccccc

SEQ ID NO: 2631989 - DNA, 13 bp, Homo sapiens
tgcccctgctgcc

SEQ ID NO: 2631990 - DNA, 18 bp, Homo sapiens
tgcccctgttctcttcca

SEQ ID NO: 2631991 - DNA, 19 bp, Homo sapiens
tgccccttcccatctcttc

SEQ ID NO: 2631992 - DNA, 19 bp, Homo sapiens
tgcccgagctggtgcatta

SEQ ID NO: 2631993 - DNA, 12 bp, Homo sapiens
tgcccggctgcg

SEQ ID NO: 2631994 - DNA, 21 bp, Homo sapiens
tgcccgggaaggtcaccagca

SEQ ID NO: 2631995 - DNA, 19 bp, Homo sapiens
tgcccgtctctctcccatg

SEQ ID NO: 2631996 - DNA, 23 bp, Homo sapiens
tgcccgtctctctcccatggagc

SEQ ID NO: 2631997 - DNA, 17 bp, Homo sapiens
tgccctaaagtgtattt

SEQ ID NO: 2631998 - DNA, 13 bp, Homo sapiens
tgccctagctcca

SEQ ID NO: 2631999 - DNA, 12 bp, Homo sapiens
tgccctcagggg

SEQ ID NO: 2632000 - DNA, 21 bp, Homo sapiens
tgccctcatggcccctctgac

SEQ ID NO: 2632001 - DNA, 23 bp, Homo sapiens
tgccctcatggcccctctgacct

SEQ ID NO: 2632002 - DNA, 13 bp, Homo sapiens
tgccctccatccc

SEQ ID NO: 2632003 - DNA, 15 bp, Homo sapiens
tgccctcccatcccg

SEQ ID NO: 2632004 - DNA, 17 bp, Homo sapiens
tgccctccccagagcac

SEQ ID NO: 2632005 - DNA, 19 bp, Homo sapiens
tgccctccccagagcactg

SEQ ID NO: 2632006 - DNA, 19 bp, Homo sapiens
tgccctcgggcgagtcact

SEQ ID NO: 2632007 - DNA, 20 bp, Homo sapiens
tgccctcgggcgagtcactg

SEQ ID NO: 2632008 - DNA, 23 bp, Homo sapiens
tgccctcgggcgagtcactgcct

SEQ ID NO: 2632009 - DNA, 14 bp, Homo sapiens
tgccctgacctccc

SEQ ID NO: 2632010 - DNA, 21 bp, Homo sapiens
tgccctgacctcccagcccta

SEQ ID NO: 2632011 - DNA, 14 bp, Homo sapiens
tgccctgcccacct

SEQ ID NO: 2632012 - DNA, 17 bp, Homo sapiens
tgccctgcctgagggcc

SEQ ID NO: 2632013 - DNA, 11 bp, Homo sapiens
tgccctgctgc

SEQ ID NO: 2632014 - DNA, 13 bp, Homo sapiens
tgccctggccctg

SEQ ID NO: 2632015 - DNA, 17 bp, Homo sapiens
tgccctggccctgaggt

SEQ ID NO: 2632016 - DNA, 13 bp, Homo sapiens
tgccctgggccac

SEQ ID NO: 2632017 - DNA, 15 bp, Homo sapiens
tcaacatgttactga

SEQ ID NO: 2632018 - DNA, 19 bp, Homo sapiens
tcaacatgttactgaccag

SEQ ID NO: 2632019 - DNA, 22 bp, Homo sapiens
tcaacatgttactgaccagcaa

SEQ ID NO: 2632020 - DNA, 14 bp, Homo sapiens
tcaacatttctcaa

SEQ ID NO: 2632021 - DNA, 14 bp, Homo sapiens
tcaaccagcagatg

SEQ ID NO: 2632022 - DNA, 15 bp, Homo sapiens
tcaacccaggagcat

SEQ ID NO: 2632023 - DNA, 23 bp, Homo sapiens
tcaacccaggagcatccacctcc

SEQ ID NO: 2632024 - DNA, 20 bp, Homo sapiens
tcaaccccaccacttctttt

SEQ ID NO: 2632025 - DNA, 21 bp, Homo sapiens
tcgcaccactgtgtatttaac

SEQ ID NO: 2632026 - DNA, 18 bp, Homo sapiens
tcgcacctaccatcaggg

SEQ ID NO: 2632027 - DNA, 14 bp, Homo sapiens
tcgcagagaggcca

SEQ ID NO: 2632028 - DNA, 21 bp, Homo sapiens
tcgcagagaggccaggtgcag

SEQ ID NO: 2632029 - DNA, 20 bp, Homo sapiens
tcgcatcaaaagacaattct

SEQ ID NO: 2632030 - DNA, 15 bp, Homo sapiens
tcgcatttgtcaatg

SEQ ID NO: 2632031 - DNA, 17 bp, Homo sapiens
tcgcccaaagccagaca

SEQ ID NO: 2632032 - DNA, 11 bp, Homo sapiens
tcgcccaggag

SEQ ID NO: 2632033 - DNA, 19 bp, Homo sapiens
tcgcccagtctggaatgca

SEQ ID NO: 2632034 - DNA, 23 bp, Homo sapiens
tcgcccagtctggaatgcagtgg

SEQ ID NO: 2632035 - DNA, 15 bp, Homo sapiens
tcgccccagatcacc

SEQ ID NO: 2632036 - DNA, 20 bp, Homo sapiens
tcgcccgcccactgtcctgg

SEQ ID NO: 2632037 - DNA, 23 bp, Homo sapiens
tcgcccgcccactgtcctgggcg

SEQ ID NO: 2632038 - DNA, 14 bp, Homo sapiens
tcgccctcccaggc

SEQ ID NO: 2632039 - DNA, 20 bp, Homo sapiens
tcgcggcggagctggccccg

SEQ ID NO: 2632040 - DNA, 15 bp, Homo sapiens
tcgctctgctggcct

SEQ ID NO: 2632041 - DNA, 17 bp, Homo sapiens
tcgctctgctggcctgg

SEQ ID NO: 2632042 - DNA, 21 bp, Homo sapiens
tcgctctgctggcctggccgg

SEQ ID NO: 2632043 - DNA, 23 bp, Homo sapiens
tcgctctgctggcctggccggca

SEQ ID NO: 2632044 - DNA, 18 bp, Homo sapiens
tcgctctgtcacccaggc

SEQ ID NO: 2632045 - DNA, 19 bp, Homo sapiens
tcgctgatatatgtgtttt

SEQ ID NO: 2632046 - DNA, 22 bp, Homo sapiens
tcgctgatatatgtgtttttca

SEQ ID NO: 2632047 - DNA, 20 bp, Homo sapiens
tcgctggactctcagtctct

SEQ ID NO: 2632048 - DNA, 16 bp, Homo sapiens
tcgctgtcacaggcgg

SEQ ID NO: 2632049 - DNA, 16 bp, Homo sapiens
tcgcttcatgtaacta

SEQ ID NO: 2632050 - DNA, 19 bp, Homo sapiens
tcgctttattggctgagat

SEQ ID NO: 2632051 - DNA, 21 bp, Homo sapiens
tcggaaaccttggtgtagttg

SEQ ID NO: 2632052 - DNA, 19 bp, Homo sapiens
tcggactaagcctacctgc

SEQ ID NO: 2632053 - DNA, 14 bp, Homo sapiens
tcggaggcttggga

SEQ ID NO: 2632054 - DNA, 19 bp, Homo sapiens
tcggcctctaaccccaggc

SEQ ID NO: 2632055 - DNA, 21 bp, Homo sapiens
tcggcctctaaccccaggccc

SEQ ID NO: 2632056 - DNA, 12 bp, Homo sapiens
tcggctccctgg

SEQ ID NO: 2632057 - DNA, 15 bp, Homo sapiens
tcgggaagagaggag

SEQ ID NO: 2632058 - DNA, 16 bp, Homo sapiens
tcgggaagagaggagt

SEQ ID NO: 2632059 - DNA, 20 bp, Homo sapiens
tcgggaagagaggagttcaa

SEQ ID NO: 2632060 - DNA, 24 bp, Homo sapiens
tcgggaagagaggagttcaatgat

SEQ ID NO: 2632061 - DNA, 20 bp, Homo sapiens
tcgggacacctgccctgccc

SEQ ID NO: 2632062 - DNA, 13 bp, Homo sapiens
tcgggagcagtgt

SEQ ID NO: 2632063 - DNA, 16 bp, Homo sapiens
tcgggagcagtgtctt

SEQ ID NO: 2632064 - DNA, 15 bp, Homo sapiens
tcgggcccagccccc

SEQ ID NO: 2632065 - DNA, 13 bp, Homo sapiens
tcgggcccttccc

SEQ ID NO: 2632066 - DNA, 16 bp, Homo sapiens
tcggggcatgctgggg

SEQ ID NO: 2632067 - DNA, 22 bp, Homo sapiens
tcggtggagactatcagcccaa

SEQ ID NO: 2632068 - DNA, 21 bp, Homo sapiens
tcgtataacacaatatgaata

SEQ ID NO: 2632069 - DNA, 23 bp, Homo sapiens
tcgtcactgcttaacttcacata

SEQ ID NO: 2632070 - DNA, 18 bp, Homo sapiens
tcgtgaaaccctgtctct

SEQ ID NO: 2632071 - DNA, 17 bp, Homo sapiens
tcgtgaagtatactgta

SEQ ID NO: 2632072 - DNA, 13 bp, Homo sapiens
tcgtgacaacact

SEQ ID NO: 2632073 - DNA, 19 bp, Homo sapiens
tcgtgcagcatatgaggat

SEQ ID NO: 2632074 - DNA, 20 bp, Homo sapiens
tcgtgcattggaagacccca

SEQ ID NO: 2632075 - DNA, 18 bp, Homo sapiens
tcgtgctaaattttcagt

SEQ ID NO: 2632076 - DNA, 24 bp, Homo sapiens
tcgtggaaagggtgctgcttccct

SEQ ID NO: 2632077 - DNA, 15 bp, Homo sapiens
tcgtggccagcccgg

SEQ ID NO: 2632078 - DNA, 17 bp, Homo sapiens
tcgtggccagcccggct

SEQ ID NO: 2632079 - DNA, 21 bp, Homo sapiens
tgcaccactgcactccagcct

SEQ ID NO: 2632080 - DNA, 23 bp, Homo sapiens
tgcaccattgcgctctagcctgg

SEQ ID NO: 2632081 - DNA, 14 bp, Homo sapiens
tgcacccagccctg

SEQ ID NO: 2632082 - DNA, 15 bp, Homo sapiens
tgcacccagccctgg

SEQ ID NO: 2632083 - DNA, 15 bp, Homo sapiens
tgcacccccctgggc

SEQ ID NO: 2632084 - DNA, 16 bp, Homo sapiens
tgcacccccctgggct

SEQ ID NO: 2632085 - DNA, 14 bp, Homo sapiens
tgcacccctcccat

SEQ ID NO: 2632086 - DNA, 15 bp, Homo sapiens
tgcacccctcccatt

SEQ ID NO: 2632087 - DNA, 14 bp, Homo sapiens
tgcaccctccaccc

SEQ ID NO: 2632088 - DNA, 17 bp, Homo sapiens
tgcaccctccaccctgt

SEQ ID NO: 2632089 - DNA, 14 bp, Homo sapiens
tgcaccctccgcct

SEQ ID NO: 2632090 - DNA, 16 bp, Homo sapiens
tgcaccctccgccttc

SEQ ID NO: 2632091 - DNA, 15 bp, Homo sapiens
tgcaccctggggcct

SEQ ID NO: 2632092 - DNA, 16 bp, Homo sapiens
tgcaccggctggcctg

SEQ ID NO: 2632093 - DNA, 19 bp, Homo sapiens
tgcaccggctggcctggcc

SEQ ID NO: 2632094 - DNA, 14 bp, Homo sapiens
tgcaccgggccaca

SEQ ID NO: 2632095 - DNA, 17 bp, Homo sapiens
tgcaccgggccacagag

SEQ ID NO: 2632096 - DNA, 18 bp, Homo sapiens
tgcacctgccagcctggc

SEQ ID NO: 2632097 - DNA, 19 bp, Homo sapiens
tgcacctgccagcctggct

SEQ ID NO: 2632098 - DNA, 22 bp, Homo sapiens
tgcacctgccagcctggcttct

SEQ ID NO: 2632099 - DNA, 22 bp, Homo sapiens
tgcacctggaatatataaccag

SEQ ID NO: 2632100 - DNA, 17 bp, Homo sapiens
tgcacctgtactcagga

SEQ ID NO: 2632101 - DNA, 20 bp, Homo sapiens
tgcacctgtactcaggaggc

SEQ ID NO: 2632102 - DNA, 15 bp, Homo sapiens
tgcaccttgtgtctg

SEQ ID NO: 2632103 - DNA, 16 bp, Homo sapiens
tgcaccttgtgtctgt

SEQ ID NO: 2632104 - DNA, 15 bp, Homo sapiens
tgcacgcccatgtgt

SEQ ID NO: 2632105 - DNA, 19 bp, Homo sapiens
tgcacgcccatgtgtgagt

SEQ ID NO: 2632106 - DNA, 14 bp, Homo sapiens
tgcacggctgctga

SEQ ID NO: 2632107 - DNA, 16 bp, Homo sapiens
tgcacgtggagagctg

SEQ ID NO: 2632108 - DNA, 20 bp, Homo sapiens
tgcacgtggagagctggtgc

SEQ ID NO: 2632109 - DNA, 16 bp, Homo sapiens
tgcacgtggcatgtgg

SEQ ID NO: 2632110 - DNA, 15 bp, Homo sapiens
tgcacgttatggtgt

SEQ ID NO: 2632111 - DNA, 14 bp, Homo sapiens
tgcactcagctctt

SEQ ID NO: 2632112 - DNA, 16 bp, Homo sapiens
tgcactccagcctggg

SEQ ID NO: 2632113 - DNA, 18 bp, Homo sapiens
tgcactccagcctgggcg

SEQ ID NO: 2632114 - DNA, 21 bp, Homo sapiens
tgcactgacattgttggccaa

SEQ ID NO: 2632115 - DNA, 12 bp, Homo sapiens
tgcactgagggc

SEQ ID NO: 2632116 - DNA, 19 bp, Homo sapiens
tgcactgagggccacacta

SEQ ID NO: 2632117 - DNA, 16 bp, Homo sapiens
tgcactggggagcccg

SEQ ID NO: 2632118 - DNA, 16 bp, Homo sapiens
tgcactgtatgctgga

SEQ ID NO: 2632119 - DNA, 19 bp, Homo sapiens
tgcactgtcactttgctct

SEQ ID NO: 2632120 - DNA, 22 bp, Homo sapiens
tgcactgtcactttgctctggg

SEQ ID NO: 2632121 - DNA, 16 bp, Homo sapiens
tgcacttgcagactct

SEQ ID NO: 2632122 - DNA, 12 bp, Homo sapiens
tgcactttgttc

SEQ ID NO: 2632123 - DNA, 19 bp, Homo sapiens
tgcactttgttctggctct

SEQ ID NO: 2632124 - DNA, 14 bp, Homo sapiens
tgcagaagacagta

SEQ ID NO: 2632125 - DNA, 15 bp, Homo sapiens
tgcagaaggccaaga

SEQ ID NO: 2632126 - DNA, 13 bp, Homo sapiens
tgcagacaggcaa

SEQ ID NO: 2632127 - DNA, 18 bp, Homo sapiens
taatagacaatttattat

SEQ ID NO: 2632128 - DNA, 19 bp, Homo sapiens
taatagcgggttactttca

SEQ ID NO: 2632129 - DNA, 18 bp, Homo sapiens
taatagcttttattgtat

SEQ ID NO: 2632130 - DNA, 15 bp, Homo sapiens
taatagtgttaatca

SEQ ID NO: 2632131 - DNA, 19 bp, Homo sapiens
taatataaagttggatgcg

SEQ ID NO: 2632132 - DNA, 22 bp, Homo sapiens
taatataagaagctttcagtat

SEQ ID NO: 2632133 - DNA, 17 bp, Homo sapiens
taatatattttctgttt

SEQ ID NO: 2632134 - DNA, 21 bp, Homo sapiens
taatatattttctgttttctt

SEQ ID NO: 2632135 - DNA, 16 bp, Homo sapiens
taatatgctgccaaat

SEQ ID NO: 2632136 - DNA, 18 bp, Homo sapiens
taatatgctgccaaattt

SEQ ID NO: 2632137 - DNA, 16 bp, Homo sapiens
taatattaaatatatg

SEQ ID NO: 2632138 - DNA, 13 bp, Homo sapiens
taatatttaaaca

SEQ ID NO: 2632139 - DNA, 21 bp, Homo sapiens
taatatttaaacagcagtgtt

SEQ ID NO: 2632140 - DNA, 16 bp, Homo sapiens
taatatttatatattt

SEQ ID NO: 2632141 - DNA, 21 bp, Homo sapiens
taatatttatgtctatttaag

SEQ ID NO: 2632142 - DNA, 14 bp, Homo sapiens
taatatttttaatt

SEQ ID NO: 2632143 - DNA, 21 bp, Homo sapiens
taatcaactgggctgaacact

SEQ ID NO: 2632144 - DNA, 18 bp, Homo sapiens
taatcaatgtttcttcta

SEQ ID NO: 2632145 - DNA, 17 bp, Homo sapiens
taatcacttttttccac

SEQ ID NO: 2632146 - DNA, 19 bp, Homo sapiens
taatcacttttttccacat

SEQ ID NO: 2632147 - DNA, 20 bp, Homo sapiens
taatcagcaagaatttgatc

SEQ ID NO: 2632148 - DNA, 19 bp, Homo sapiens
taatcagggaggtcatttt

SEQ ID NO: 2632149 - DNA, 11 bp, Homo sapiens
taatcagtgtc

SEQ ID NO: 2632150 - DNA, 15 bp, Homo sapiens
taatcagtgtctcac

SEQ ID NO: 2632151 - DNA, 16 bp, Homo sapiens
taatcagtgtctcaca

SEQ ID NO: 2632152 - DNA, 20 bp, Homo sapiens
taatcatataataaatgtac

SEQ ID NO: 2632153 - DNA, 17 bp, Homo sapiens
taatcatccaatgctca

SEQ ID NO: 2632154 - DNA, 13 bp, Homo sapiens
taatcatgaaatt

SEQ ID NO: 2632155 - DNA, 17 bp, Homo sapiens
taatcatgaaattactt

SEQ ID NO: 2632156 - DNA, 18 bp, Homo sapiens
taatcatgaaattactta

SEQ ID NO: 2632157 - DNA, 21 bp, Homo sapiens
taatcatgaaattacttatca

SEQ ID NO: 2632158 - DNA, 19 bp, Homo sapiens
taatcatttcttgggccct

SEQ ID NO: 2632159 - DNA, 22 bp, Homo sapiens
taatcatttcttgggccctcct

SEQ ID NO: 2632160 - DNA, 14 bp, Homo sapiens
taatccagaataac

SEQ ID NO: 2632161 - DNA, 19 bp, Homo sapiens
taatcccagctacttggga

SEQ ID NO: 2632162 - DNA, 17 bp, Homo sapiens
taatcccgattcaccct

SEQ ID NO: 2632163 - DNA, 14 bp, Homo sapiens
taatccctgggcat

SEQ ID NO: 2632164 - DNA, 20 bp, Homo sapiens
taatccctgggcattgcttt

SEQ ID NO: 2632165 - DNA, 21 bp, Homo sapiens
taatccgaatctctttttgct

SEQ ID NO: 2632166 - DNA, 15 bp, Homo sapiens
gtggacagtcctggg

SEQ ID NO: 2632167 - DNA, 22 bp, Homo sapiens
gtggacccagggatgacatgtc

SEQ ID NO: 2632168 - DNA, 14 bp, Homo sapiens
gtggaccttcctgc

SEQ ID NO: 2632169 - DNA, 18 bp, Homo sapiens
gtggactctttggtggct

SEQ ID NO: 2632170 - DNA, 23 bp, Homo sapiens
gtggactctttggtggctttgca

SEQ ID NO: 2632171 - DNA, 16 bp, Homo sapiens
gtggactggcccctgg

SEQ ID NO: 2632172 - DNA, 16 bp, Homo sapiens
gtggactttccacccc

SEQ ID NO: 2632173 - DNA, 23 bp, Homo sapiens
gtggagaaataaaaatacctctt

SEQ ID NO: 2632174 - DNA, 22 bp, Homo sapiens
gtggagaaattccttgattcac

SEQ ID NO: 2632175 - DNA, 14 bp, Homo sapiens
gtggagaagccatt

SEQ ID NO: 2632176 - DNA, 15 bp, Homo sapiens
gtggagaagccattg

SEQ ID NO: 2632177 - DNA, 18 bp, Homo sapiens
gtggagaagccattgtct

SEQ ID NO: 2632178 - DNA, 13 bp, Homo sapiens
gtggagacagggc

SEQ ID NO: 2632179 - DNA, 12 bp, Homo sapiens
gtggagagctgg

SEQ ID NO: 2632180 - DNA, 16 bp, Homo sapiens
gtggagagctggtgcc

SEQ ID NO: 2632181 - DNA, 17 bp, Homo sapiens
gtggagagctggtgccc

SEQ ID NO: 2632182 - DNA, 16 bp, Homo sapiens
gtggagatgtcttcgt

SEQ ID NO: 2632183 - DNA, 18 bp, Homo sapiens
gtggagatgtcttcgtac

SEQ ID NO: 2632184 - DNA, 18 bp, Homo sapiens
gtggagcaaagtgagggc

SEQ ID NO: 2632185 - DNA, 16 bp, Homo sapiens
gtggagcatgggcctg

SEQ ID NO: 2632186 - DNA, 13 bp, Homo sapiens
gtggaggaaggat

SEQ ID NO: 2632187 - DNA, 19 bp, Homo sapiens
gtggaggaaggattgtaaa

SEQ ID NO: 2632188 - DNA, 20 bp, Homo sapiens
gtggaggaaggattgtaaaa

SEQ ID NO: 2632189 - DNA, 14 bp, Homo sapiens
gtggaggaggcctg

SEQ ID NO: 2632190 - DNA, 22 bp, Homo sapiens
gtggaggtgtcaggctgctggc

SEQ ID NO: 2632191 - DNA, 15 bp, Homo sapiens
gtggagtggggcagt

SEQ ID NO: 2632192 - DNA, 17 bp, Homo sapiens
gtggatctccaaggacc

SEQ ID NO: 2632193 - DNA, 16 bp, Homo sapiens
gtggatgcctggtggc

SEQ ID NO: 2632194 - DNA, 21 bp, Homo sapiens
gtggatgcctggtggcagctg

SEQ ID NO: 2632195 - DNA, 13 bp, Homo sapiens
gtggattgagggt

SEQ ID NO: 2632196 - DNA, 19 bp, Homo sapiens
gtggatttaacagaaatgt

SEQ ID NO: 2632197 - DNA, 20 bp, Homo sapiens
gtggatttaacagaaatgta

SEQ ID NO: 2632198 - DNA, 15 bp, Homo sapiens
gtggcaaggctgtgc

SEQ ID NO: 2632199 - DNA, 20 bp, Homo sapiens
gtggcaccagcgaagggagt

SEQ ID NO: 2632200 - DNA, 15 bp, Homo sapiens
gtttggaatgcttct

SEQ ID NO: 2632201 - DNA, 17 bp, Homo sapiens
gtttggaccccagctgg

SEQ ID NO: 2632202 - DNA, 15 bp, Homo sapiens
taaatgttgaaagat

SEQ ID NO: 2632203 - DNA, 20 bp, Homo sapiens
taaatgttgaaagatcaaaa

SEQ ID NO: 2632204 - DNA, 18 bp, Homo sapiens
taaatgtttttctatgta

SEQ ID NO: 2632205 - DNA, 12 bp, Homo sapiens
taaattaacttt

SEQ ID NO: 2632206 - DNA, 19 bp, Homo sapiens
taaattaacttttataaac

SEQ ID NO: 2632207 - DNA, 21 bp, Homo sapiens
taaattaacttttataaactt

SEQ ID NO: 2632208 - DNA, 12 bp, Homo sapiens
taaattaagaca

SEQ ID NO: 2632209 - DNA, 15 bp, Homo sapiens
taaattaagacatgc

SEQ ID NO: 2632210 - DNA, 14 bp, Homo sapiens
taaattaggaataa

SEQ ID NO: 2632211 - DNA, 22 bp, Homo sapiens
taaattataacttaaaatattt

SEQ ID NO: 2632212 - DNA, 20 bp, Homo sapiens
taaattatgggaatcaagat

SEQ ID NO: 2632213 - DNA, 14 bp, Homo sapiens
taaattatgtttat

SEQ ID NO: 2632214 - DNA, 15 bp, Homo sapiens
taaattatgtttata

SEQ ID NO: 2632215 - DNA, 17 bp, Homo sapiens
taaattatgtttatata

SEQ ID NO: 2632216 - DNA, 19 bp, Homo sapiens
taaattatgtttatataaa

SEQ ID NO: 2632217 - DNA, 20 bp, Homo sapiens
taaattatgtttatataaat

SEQ ID NO: 2632218 - DNA, 20 bp, Homo sapiens
taaattcaaccactgtaaaa

SEQ ID NO: 2632219 - DNA, 18 bp, Homo sapiens
taaattcagatatatttt

SEQ ID NO: 2632220 - DNA, 20 bp, Homo sapiens
taaattcagatatatttttc

SEQ ID NO: 2632221 - DNA, 17 bp, Homo sapiens
taaattcttgcaaagta

SEQ ID NO: 2632222 - DNA, 18 bp, Homo sapiens
taaattcttgcaaagtat

SEQ ID NO: 2632223 - DNA, 12 bp, Homo sapiens
taaattgaataa

SEQ ID NO: 2632224 - DNA, 16 bp, Homo sapiens
taaattgaataatggt

SEQ ID NO: 2632225 - DNA, 13 bp, Homo sapiens
taaatttatgtga

SEQ ID NO: 2632226 - DNA, 14 bp, Homo sapiens
taaatttatttact

SEQ ID NO: 2632227 - DNA, 15 bp, Homo sapiens
taaatttatttcaaa

SEQ ID NO: 2632228 - DNA, 17 bp, Homo sapiens
taaatttccccaacagt

SEQ ID NO: 2632229 - DNA, 18 bp, Homo sapiens
taaatttccccaacagtg

SEQ ID NO: 2632230 - DNA, 22 bp, Homo sapiens
taaatttccccaacagtgtgaa

SEQ ID NO: 2632231 - DNA, 23 bp, Homo sapiens
taaatttccccaacagtgtgaag

SEQ ID NO: 2632232 - DNA, 12 bp, Homo sapiens
taaatttgtaag

SEQ ID NO: 2632233 - DNA, 13 bp, Homo sapiens
taaatttgtaagt

SEQ ID NO: 2632234 - DNA, 23 bp, Homo sapiens
taaatttgtaagtttcaggtgac

SEQ ID NO: 2632235 - DNA, 22 bp, Homo sapiens
taacaaacatcactctgctgct

SEQ ID NO: 2632236 - DNA, 13 bp, Homo sapiens
taacaactaggga

SEQ ID NO: 2632237 - DNA, 22 bp, Homo sapiens
taacaactatgatttggaaaat

SEQ ID NO: 2632238 - DNA, 16 bp, Homo sapiens
taacaaggtccaagat

SEQ ID NO: 2632239 - DNA, 13 bp, Homo sapiens
taacaatgatata

SEQ ID NO: 2632240 - DNA, 22 bp, Homo sapiens
taacaatgatatatggataatg

SEQ ID NO: 2632241 - DNA, 16 bp, Homo sapiens
taacaatgttaaggaa

SEQ ID NO: 2632242 - DNA, 13 bp, Homo sapiens
taacaattcctct

SEQ ID NO: 2632243 - DNA, 15 bp, Homo sapiens
taacaattgtgaagt

SEQ ID NO: 2632244 - DNA, 21 bp, Homo sapiens
taacaatttcctttatattta

SEQ ID NO: 2632245 - DNA, 14 bp, Homo sapiens
taacaatttctgtc

SEQ ID NO: 2632246 - DNA, 16 bp, Homo sapiens
taacacaagccacaga

SEQ ID NO: 2632247 - DNA, 17 bp, Homo sapiens
taacacacagctcccat

SEQ ID NO: 2632248 - DNA, 14 bp, Homo sapiens
taacacatgtcctt

SEQ ID NO: 2632249 - DNA, 16 bp, Homo sapiens
taacactataaaggtt

SEQ ID NO: 2632250 - DNA, 15 bp, Homo sapiens
taacactggccccta

SEQ ID NO: 2632251 - DNA, 15 bp, Homo sapiens
taacagaaatgtaca

SEQ ID NO: 2632252 - DNA, 14 bp, Homo sapiens
taacagaacagctt

SEQ ID NO: 2632253 - DNA, 19 bp, Homo sapiens
taacagaacagcttcaggt

SEQ ID NO: 2632254 - DNA, 21 bp, Homo sapiens
taacagaacagcttcaggtta

SEQ ID NO: 2632255 - DNA, 19 bp, Homo sapiens
taacagccaggagtgttaa

SEQ ID NO: 2632256 - DNA, 13 bp, Homo sapiens
taacaggtctcct

SEQ ID NO: 2632257 - DNA, 15 bp, Homo sapiens
taacagtcatttaaa

SEQ ID NO: 2632258 - DNA, 18 bp, Homo sapiens
taacagtcatttaaaaaa

SEQ ID NO: 2632259 - DNA, 21 bp, Homo sapiens
taacagtcctaactggtatag

SEQ ID NO: 2632260 - DNA, 18 bp, Homo sapiens
taacagttcatgtttgct

SEQ ID NO: 2632261 - DNA, 14 bp, Homo sapiens
taacatatttacta

SEQ ID NO: 2632262 - DNA, 23 bp, Homo sapiens
taacatcctttctattgaaaaat

SEQ ID NO: 2632263 - DNA, 19 bp, Homo sapiens
taacatgtaattaagtact

SEQ ID NO: 2632264 - DNA, 22 bp, Homo sapiens
taacatgtgttaagtattttca

SEQ ID NO: 2632265 - DNA, 17 bp, Homo sapiens
taacattaccttactgt

SEQ ID NO: 2632266 - DNA, 20 bp, Homo sapiens
taacattgggaaatcttata

SEQ ID NO: 2632267 - DNA, 17 bp, Homo sapiens
taaccaaaaagaccaga

SEQ ID NO: 2632268 - DNA, 19 bp, Homo sapiens
taaccacaaagcacagttt

SEQ ID NO: 2632269 - DNA, 15 bp, Homo sapiens
taaccacggaaaaga

SEQ ID NO: 2632270 - DNA, 14 bp, Homo sapiens
taaccagcagaaat

SEQ ID NO: 2632271 - DNA, 16 bp, Homo sapiens
taaccagcagaaatgc

SEQ ID NO: 2632272 - DNA, 12 bp, Homo sapiens
taaccccaggcc

SEQ ID NO: 2632273 - DNA, 13 bp, Homo sapiens
taaccccaggccc

SEQ ID NO: 2632274 - DNA, 18 bp, Homo sapiens
taaccctcccatggcacc

SEQ ID NO: 2632275 - DNA, 15 bp, Homo sapiens
taacctcagctctgg

SEQ ID NO: 2632276 - DNA, 14 bp, Homo sapiens
taacctcatcttct

SEQ ID NO: 2632277 - DNA, 15 bp, Homo sapiens
taacctggtgctgga

SEQ ID NO: 2632278 - DNA, 17 bp, Homo sapiens
taacgaccacagggtct

SEQ ID NO: 2632279 - DNA, 20 bp, Homo sapiens
taacgccctatttttgcaat

SEQ ID NO: 2632280 - DNA, 18 bp, Homo sapiens
taacgttgctgtgggaac

SEQ ID NO: 2632281 - DNA, 15 bp, Homo sapiens
taactaaaaggtatg

SEQ ID NO: 2632282 - DNA, 22 bp, Homo sapiens
taactaatctattgggttcatt

SEQ ID NO: 2632283 - DNA, 23 bp, Homo sapiens
taactaatctattgggttcatta

SEQ ID NO: 2632284 - DNA, 14 bp, Homo sapiens
taactactgtgttc

SEQ ID NO: 2632285 - DNA, 15 bp, Homo sapiens
taactagaatttatt

SEQ ID NO: 2632286 - DNA, 18 bp, Homo sapiens
taactagagcagccctgg

SEQ ID NO: 2632287 - DNA, 15 bp, Homo sapiens
taactagcaccaggg

SEQ ID NO: 2632288 - DNA, 23 bp, Homo sapiens
taactatagtccagctttgttct

SEQ ID NO: 2632289 - DNA, 17 bp, Homo sapiens
taactattgcccaggtt

SEQ ID NO: 2632290 - DNA, 22 bp, Homo sapiens
taactcaatattttccatgaaa

SEQ ID NO: 2632291 - DNA, 20 bp, Homo sapiens
taactcagatcactactgca

SEQ ID NO: 2632292 - DNA, 21 bp, Homo sapiens
taactcagatcactactgcag

SEQ ID NO: 2632293 - DNA, 19 bp, Homo sapiens
taactccagtgatgttctt

SEQ ID NO: 2632294 - DNA, 21 bp, Homo sapiens
taactctgcactactcctctg

SEQ ID NO: 2632295 - DNA, 16 bp, Homo sapiens
taactcttgtctattt

SEQ ID NO: 2632296 - DNA, 21 bp, Homo sapiens
taactgaaaatgtgctatact

SEQ ID NO: 2632297 - DNA, 13 bp, Homo sapiens
taactgacaactt

SEQ ID NO: 2632298 - DNA, 23 bp, Homo sapiens
taactggcagttttccattggtt

SEQ ID NO: 2632299 - DNA, 16 bp, Homo sapiens
taactgttatttataa

SEQ ID NO: 2632300 - DNA, 17 bp, Homo sapiens
taactgttatttataat

SEQ ID NO: 2632301 - DNA, 16 bp, Homo sapiens
taacttaaaatatttt

SEQ ID NO: 2632302 - DNA, 17 bp, Homo sapiens
taacttacccttaggga

SEQ ID NO: 2632303 - DNA, 14 bp, Homo sapiens
taacttcaccatat

SEQ ID NO: 2632304 - DNA, 22 bp, Homo sapiens
taacttgagagtagatggtttg

SEQ ID NO: 2632305 - DNA, 15 bp, Homo sapiens
taacttgagttttat

SEQ ID NO: 2632306 - DNA, 16 bp, Homo sapiens
taactttaagtttcag

SEQ ID NO: 2632307 - DNA, 18 bp, Homo sapiens
taactttatgtgtaaata

SEQ ID NO: 2632308 - DNA, 13 bp, Homo sapiens
taactttcagaag

SEQ ID NO: 2632309 - DNA, 22 bp, Homo sapiens
taactttgcttgcagtagattt

SEQ ID NO: 2632310 - DNA, 24 bp, Homo sapiens
taactttgcttgcagtagattttc

SEQ ID NO: 2632311 - DNA, 17 bp, Homo sapiens
taacttttataaacttt

SEQ ID NO: 2632312 - DNA, 19 bp, Homo sapiens
taacttttataaactttac

SEQ ID NO: 2632313 - DNA, 20 bp, Homo sapiens
taacttttgtaaatacacat

SEQ ID NO: 2632314 - DNA, 20 bp, Homo sapiens
taagaaaaaataacacacat

SEQ ID NO: 2632315 - DNA, 16 bp, Homo sapiens
taagaaaaaggatgca

SEQ ID NO: 2632316 - DNA, 14 bp, Homo sapiens
taagaaaagagata

SEQ ID NO: 2632317 - DNA, 22 bp, Homo sapiens
taagaaaagagatattttaaaa

SEQ ID NO: 2632318 - DNA, 21 bp, Homo sapiens
taagaaaagatacgactttat

SEQ ID NO: 2632319 - DNA, 16 bp, Homo sapiens
taagaaaagatgtaga

SEQ ID NO: 2632320 - DNA, 18 bp, Homo sapiens
taagaaacccagactgaa

SEQ ID NO: 2632321 - DNA, 19 bp, Homo sapiens
taagaaataaaactgttaa

SEQ ID NO: 2632322 - DNA, 22 bp, Homo sapiens
taagaaataaaactgttaaagt

SEQ ID NO: 2632323 - DNA, 18 bp, Homo sapiens
taagaaatactgtacaat

SEQ ID NO: 2632324 - DNA, 24 bp, Homo sapiens
taagaaatctagtatttcatgctg

SEQ ID NO: 2632325 - DNA, 13 bp, Homo sapiens
taagaagaaacta

SEQ ID NO: 2632326 - DNA, 14 bp, Homo sapiens
taagaagacatgaa

SEQ ID NO: 2632327 - DNA, 21 bp, Homo sapiens
taagaagctgttgtacattta

SEQ ID NO: 2632328 - DNA, 19 bp, Homo sapiens
taagaagggatggattcca

SEQ ID NO: 2632329 - DNA, 18 bp, Homo sapiens
taagaagtgaaaatctac

SEQ ID NO: 2632330 - DNA, 23 bp, Homo sapiens
taagaatgctggttttcctaaat

SEQ ID NO: 2632331 - DNA, 12 bp, Homo sapiens
taagacataacg

SEQ ID NO: 2632332 - DNA, 20 bp, Homo sapiens
taagacataacgtttttcct

SEQ ID NO: 2632333 - DNA, 21 bp, Homo sapiens
taagacataacgtttttcctt

SEQ ID NO: 2632334 - DNA, 21 bp, Homo sapiens
taagacatgcactatgaggaa

SEQ ID NO: 2632335 - DNA, 20 bp, Homo sapiens
taagacggatttatttttcc

SEQ ID NO: 2632336 - DNA, 15 bp, Homo sapiens
taagacgtgtttgtg

SEQ ID NO: 2632337 - DNA, 19 bp, Homo sapiens
taagactgtaatgaatcta

SEQ ID NO: 2632338 - DNA, 15 bp, Homo sapiens
taagactttgggata

SEQ ID NO: 2632339 - DNA, 22 bp, Homo sapiens
taagagcaccttcctcacttcc

SEQ ID NO: 2632340 - DNA, 14 bp, Homo sapiens
taagagctggtgtc

SEQ ID NO: 2632341 - DNA, 12 bp, Homo sapiens
taagagggaggg

SEQ ID NO: 2632342 - DNA, 23 bp, Homo sapiens
taagagggagggagggctccaga

SEQ ID NO: 2632343 - DNA, 20 bp, Homo sapiens
taagagggcacacactgtgt

SEQ ID NO: 2632344 - DNA, 18 bp, Homo sapiens
taagagtgaaaattgtct

SEQ ID NO: 2632345 - DNA, 17 bp, Homo sapiens
taagataaatgtgctga

SEQ ID NO: 2632346 - DNA, 12 bp, Homo sapiens
taagataataat

SEQ ID NO: 2632347 - DNA, 14 bp, Homo sapiens
taagataataatat

SEQ ID NO: 2632348 - DNA, 23 bp, Homo sapiens
taagataatagtttacatgtagt

SEQ ID NO: 2632349 - DNA, 19 bp, Homo sapiens
taagatatgggacattttt

SEQ ID NO: 2632350 - DNA, 14 bp, Homo sapiens
taagatatttttca

SEQ ID NO: 2632351 - DNA, 12 bp, Homo sapiens
taagatgctggg

SEQ ID NO: 2632352 - DNA, 15 bp, Homo sapiens
taaaatcttttctat

SEQ ID NO: 2632353 - DNA, 20 bp, Homo sapiens
taaaatgaggttcaactgtt

SEQ ID NO: 2632354 - DNA, 15 bp, Homo sapiens
taaaatgattgtaaa

SEQ ID NO: 2632355 - DNA, 17 bp, Homo sapiens
taaaatgcaacatgtgt

SEQ ID NO: 2632356 - DNA, 20 bp, Homo sapiens
taaaatgcaacatgtgtact

SEQ ID NO: 2632357 - DNA, 19 bp, Homo sapiens
taaaatgtgatttttctga

SEQ ID NO: 2632358 - DNA, 17 bp, Homo sapiens
taaaatgttcacttttg

SEQ ID NO: 2632359 - DNA, 14 bp, Homo sapiens
taaaatgttgaata

SEQ ID NO: 2632360 - DNA, 14 bp, Homo sapiens
taaaattaaagcta

SEQ ID NO: 2632361 - DNA, 19 bp, Homo sapiens
taaaattaaagctgaaaac

SEQ ID NO: 2632362 - DNA, 19 bp, Homo sapiens
taaaattatagatgggaat

SEQ ID NO: 2632363 - DNA, 14 bp, Homo sapiens
taaaattattcctt

SEQ ID NO: 2632364 - DNA, 21 bp, Homo sapiens
taaaattattttggattttgt

SEQ ID NO: 2632365 - DNA, 12 bp, Homo sapiens
taaaattccact

SEQ ID NO: 2632366 - DNA, 17 bp, Homo sapiens
taaaatttaagtatctt

SEQ ID NO: 2632367 - DNA, 23 bp, Homo sapiens
taaaatttattgcttgatacttt

SEQ ID NO: 2632368 - DNA, 16 bp, Homo sapiens
taaaatttgccctccc

SEQ ID NO: 2632369 - DNA, 23 bp, Homo sapiens
taaaattttttttcatgttttaa

SEQ ID NO: 2632370 - DNA, 18 bp, Homo sapiens
taaacaaaatagaagctg

SEQ ID NO: 2632371 - DNA, 23 bp, Homo sapiens
taaacaaaatagaagctgtagta

SEQ ID NO: 2632372 - DNA, 12 bp, Homo sapiens
taaacaaatgta

SEQ ID NO: 2632373 - DNA, 20 bp, Homo sapiens
taaacaagaatcagtctatc

SEQ ID NO: 2632374 - DNA, 19 bp, Homo sapiens
taaacaagaccacgtttct

SEQ ID NO: 2632375 - DNA, 21 bp, Homo sapiens
taaacaagaccacgtttctaa

SEQ ID NO: 2632376 - DNA, 23 bp, Homo sapiens
taaacaagaccacgtttctaaag

SEQ ID NO: 2632377 - DNA, 22 bp, Homo sapiens
taaacacccatgaatcaaagac

SEQ ID NO: 2632378 - DNA, 15 bp, Homo sapiens
taaacatcacacaca

SEQ ID NO: 2632379 - DNA, 17 bp, Homo sapiens
taaacatccttcaagaa

SEQ ID NO: 2632380 - DNA, 18 bp, Homo sapiens
taaacatggttacaatca

SEQ ID NO: 2632381 - DNA, 16 bp, Homo sapiens
taaaccaaaaactgaa

SEQ ID NO: 2632382 - DNA, 19 bp, Homo sapiens
taaaccaaggctagaacca

SEQ ID NO: 2632383 - DNA, 21 bp, Homo sapiens
taaaccacaaggctgttgcat

SEQ ID NO: 2632384 - DNA, 22 bp, Homo sapiens
taaaccaccagtgcccaaagtc

SEQ ID NO: 2632385 - DNA, 22 bp, Homo sapiens
taaacgatttaattctcttgaa

SEQ ID NO: 2632386 - DNA, 15 bp, Homo sapiens
taaacggattatttt

SEQ ID NO: 2632387 - DNA, 21 bp, Homo sapiens
taaacggattattttttcaga

SEQ ID NO: 2632388 - DNA, 22 bp, Homo sapiens
taaacggattattttttcagac

SEQ ID NO: 2632389 - DNA, 17 bp, Homo sapiens
taaacgtgatgatcagc

SEQ ID NO: 2632390 - DNA, 22 bp, Homo sapiens
taaacgtgatgatcagctgttt

SEQ ID NO: 2632391 - DNA, 17 bp, Homo sapiens
taaactatcagtttgtc

SEQ ID NO: 2632392 - DNA, 20 bp, Homo sapiens
taaactcaaaacttaacata

SEQ ID NO: 2632393 - DNA, 19 bp, Homo sapiens
taaactcaaaatatttgta

SEQ ID NO: 2632394 - DNA, 21 bp, Homo sapiens
taaactcaaaatatttgtaca

SEQ ID NO: 2632395 - DNA, 22 bp, Homo sapiens
taaactctaaacattaatcaat

SEQ ID NO: 2632396 - DNA, 16 bp, Homo sapiens
taaactgcattagaaa

SEQ ID NO: 2632397 - DNA, 20 bp, Homo sapiens
taaactgtgtggactgtgat

SEQ ID NO: 2632398 - DNA, 12 bp, Homo sapiens
taaactgtgttt

SEQ ID NO: 2632399 - DNA, 20 bp, Homo sapiens
taaacttcatggtcatgggt

SEQ ID NO: 2632400 - DNA, 22 bp, Homo sapiens
taaacttggtttttaaaaaact

SEQ ID NO: 2632401 - DNA, 20 bp, Homo sapiens
taaactttacccaaaaacta

SEQ ID NO: 2632402 - DNA, 12 bp, Homo sapiens
taaactttcaca

SEQ ID NO: 2632403 - DNA, 17 bp, Homo sapiens
taaacttttttttgaga

SEQ ID NO: 2632404 - DNA, 17 bp, Homo sapiens
taaagaaaaagtcatcc

SEQ ID NO: 2632405 - DNA, 19 bp, Homo sapiens
taaagaaaatatctgaaat

SEQ ID NO: 2632406 - DNA, 16 bp, Homo sapiens
taaagaaagagagaaa

SEQ ID NO: 2632407 - DNA, 20 bp, Homo sapiens
taaagaaagagagaaaataa

SEQ ID NO: 2632408 - DNA, 16 bp, Homo sapiens
taaagaaattgcaata

SEQ ID NO: 2632409 - DNA, 20 bp, Homo sapiens
taaagacaaagacaaattct

SEQ ID NO: 2632410 - DNA, 10 bp, Homo sapiens
taaagacaga

SEQ ID NO: 2632411 - DNA, 12 bp, Homo sapiens
taaagagagaat

SEQ ID NO: 2632412 - DNA, 13 bp, Homo sapiens
taaagagaggtta

SEQ ID NO: 2632413 - DNA, 17 bp, Homo sapiens
taaagaggctgaaagag

SEQ ID NO: 2632414 - DNA, 20 bp, Homo sapiens
taaagaggctgaaagaggcc

SEQ ID NO: 2632415 - DNA, 18 bp, Homo sapiens
taaagagttagtttgagt

SEQ ID NO: 2632416 - DNA, 22 bp, Homo sapiens
taaagatatttttatctttata

SEQ ID NO: 2632417 - DNA, 21 bp, Homo sapiens
taaagatgcaaggaccaggac

SEQ ID NO: 2632418 - DNA, 16 bp, Homo sapiens
taaagcagcgtttcta

SEQ ID NO: 2632419 - DNA, 17 bp, Homo sapiens
taaagcagcgtttctat

SEQ ID NO: 2632420 - DNA, 13 bp, Homo sapiens
taaagcagtggac

SEQ ID NO: 2632421 - DNA, 19 bp, Homo sapiens
taaagcagtggacaccagg

SEQ ID NO: 2632422 - DNA, 23 bp, Homo sapiens
taaagcattcaatttattcaaga

SEQ ID NO: 2632423 - DNA, 12 bp, Homo sapiens
taaagcattcca

SEQ ID NO: 2632424 - DNA, 16 bp, Homo sapiens
taaagcattccaacaa

SEQ ID NO: 2632425 - DNA, 14 bp, Homo sapiens
taaagctgaaaact

SEQ ID NO: 2632426 - DNA, 23 bp, Homo sapiens
taaagctgcctgtagttaggaaa

SEQ ID NO: 2632427 - DNA, 19 bp, Homo sapiens
taaagcttgcaacaaaatt

SEQ ID NO: 2632428 - DNA, 13 bp, Homo sapiens
taaaggaaatgat

SEQ ID NO: 2632429 - DNA, 16 bp, Homo sapiens
taaaggaaatgattga

SEQ ID NO: 2632430 - DNA, 21 bp, Homo sapiens
taaaggctacctttgtattct

SEQ ID NO: 2632431 - DNA, 21 bp, Homo sapiens
taaagggaaaggattcatgtg

SEQ ID NO: 2632432 - DNA, 21 bp, Homo sapiens
taaaggtggtatgtgtgtgta

SEQ ID NO: 2632433 - DNA, 20 bp, Homo sapiens
taaaggtgtcttcctcccaa

SEQ ID NO: 2632434 - DNA, 14 bp, Homo sapiens
taaagtaaagctaa

SEQ ID NO: 2632435 - DNA, 14 bp, Homo sapiens
taaagtatatattt

SEQ ID NO: 2632436 - DNA, 14 bp, Homo sapiens
taaagtattcttct

SEQ ID NO: 2632437 - DNA, 19 bp, Homo sapiens
taaagtcgagcttttctaa

SEQ ID NO: 2632438 - DNA, 20 bp, Homo sapiens
taaagtcgagcttttctaaa

SEQ ID NO: 2632439 - DNA, 16 bp, Homo sapiens
taaagtgatatttccc

SEQ ID NO: 2632440 - DNA, 22 bp, Homo sapiens
taaagtgattaaacgtgcagac

SEQ ID NO: 2632441 - DNA, 20 bp, Homo sapiens
taaagtgtatttttttacta

SEQ ID NO: 2632442 - DNA, 20 bp, Homo sapiens
taaagtgtggtcccaacagg

SEQ ID NO: 2632443 - DNA, 17 bp, Homo sapiens
taaagtgtttctgttat

SEQ ID NO: 2632444 - DNA, 18 bp, Homo sapiens
taaagtgtttctgttatt

SEQ ID NO: 2632445 - DNA, 16 bp, Homo sapiens
taaagttactttgtca

SEQ ID NO: 2632446 - DNA, 20 bp, Homo sapiens
taaagttgaagctaagattt

SEQ ID NO: 2632447 - DNA, 13 bp, Homo sapiens
taaagtttctcag

SEQ ID NO: 2632448 - DNA, 14 bp, Homo sapiens
taaataaaaatgga

SEQ ID NO: 2632449 - DNA, 14 bp, Homo sapiens
taaataaaagcagc

SEQ ID NO: 2632450 - DNA, 19 bp, Homo sapiens
taaataaaagcagcatctg

SEQ ID NO: 2632451 - DNA, 17 bp, Homo sapiens
taaataaaagtgatcaa

SEQ ID NO: 2632452 - DNA, 13 bp, Homo sapiens
taaataaaatttg

SEQ ID NO: 2632453 - DNA, 20 bp, Homo sapiens
taaataaagtatcatgcatt

SEQ ID NO: 2632454 - DNA, 16 bp, Homo sapiens
taaataaatcattaat

SEQ ID NO: 2632455 - DNA, 22 bp, Homo sapiens
taaataaatgaagtatttctca

SEQ ID NO: 2632456 - DNA, 13 bp, Homo sapiens
taaataacttttt

SEQ ID NO: 2632457 - DNA, 21 bp, Homo sapiens
taaataagaaacaactctttg

SEQ ID NO: 2632458 - DNA, 23 bp, Homo sapiens
taaatacaccacctcactcctgt

SEQ ID NO: 2632459 - DNA, 16 bp, Homo sapiens
taaatacagacactaa

SEQ ID NO: 2632460 - DNA, 17 bp, Homo sapiens
taaatacagtcttccat

SEQ ID NO: 2632461 - DNA, 20 bp, Homo sapiens
taaatacagtcttccatttg

SEQ ID NO: 2632462 - DNA, 22 bp, Homo sapiens
taaatacagtcttccatttgca

SEQ ID NO: 2632463 - DNA, 18 bp, Homo sapiens
taaatagagtatatgcac

SEQ ID NO: 2632464 - DNA, 19 bp, Homo sapiens
taaatagtaaaaataaaat

SEQ ID NO: 2632465 - DNA, 20 bp, Homo sapiens
taaatagtaaaaataaaatt

SEQ ID NO: 2632466 - DNA, 15 bp, Homo sapiens
taaatataattctgt

SEQ ID NO: 2632467 - DNA, 16 bp, Homo sapiens
taaatataattctgta

SEQ ID NO: 2632468 - DNA, 19 bp, Homo sapiens
taaatataattctgtaaat

SEQ ID NO: 2632469 - DNA, 22 bp, Homo sapiens
taaatatctgtacttcttcgat

SEQ ID NO: 2632470 - DNA, 19 bp, Homo sapiens
taaatatgaagctcacctg

SEQ ID NO: 2632471 - DNA, 13 bp, Homo sapiens
taaatatgcagtg

SEQ ID NO: 2632472 - DNA, 16 bp, Homo sapiens
taaatatgcagtgata

SEQ ID NO: 2632473 - DNA, 19 bp, Homo sapiens
taaatatgcctctcctttg

SEQ ID NO: 2632474 - DNA, 18 bp, Homo sapiens
taaatatgttagcaaaga

SEQ ID NO: 2632475 - DNA, 15 bp, Homo sapiens
taaatattctatatg

SEQ ID NO: 2632476 - DNA, 19 bp, Homo sapiens
taaatattctatatgaatt

SEQ ID NO: 2632477 - DNA, 11 bp, Homo sapiens
taaatatttac

SEQ ID NO: 2632478 - DNA, 15 bp, Homo sapiens
taaatatttccttaa

SEQ ID NO: 2632479 - DNA, 15 bp, Homo sapiens
taaatcccattcata

SEQ ID NO: 2632480 - DNA, 23 bp, Homo sapiens
taaatcccattcataactttcat

SEQ ID NO: 2632481 - DNA, 19 bp, Homo sapiens
taaatcctttttctttata

SEQ ID NO: 2632482 - DNA, 19 bp, Homo sapiens
taaatctatgaagtatata

SEQ ID NO: 2632483 - DNA, 20 bp, Homo sapiens
taaatctccaaaataaaact

SEQ ID NO: 2632484 - DNA, 22 bp, Homo sapiens
taaatctccaaaataaaacttt

SEQ ID NO: 2632485 - DNA, 18 bp, Homo sapiens
taaatctctaatatggca

SEQ ID NO: 2632486 - DNA, 13 bp, Homo sapiens
taaatctgtgatg

SEQ ID NO: 2632487 - DNA, 18 bp, Homo sapiens
taaatctgttgccaagct

SEQ ID NO: 2632488 - DNA, 23 bp, Homo sapiens
taaatgaagcagctttaaacaaa

SEQ ID NO: 2632489 - DNA, 15 bp, Homo sapiens
taaatgcaatatgta

SEQ ID NO: 2632490 - DNA, 22 bp, Homo sapiens
taaatgcagcgaaccaatattt

SEQ ID NO: 2632491 - DNA, 10 bp, Homo sapiens
taaatgcata

SEQ ID NO: 2632492 - DNA, 15 bp, Homo sapiens
taaatgcccagcccc

SEQ ID NO: 2632493 - DNA, 13 bp, Homo sapiens
taaatgctatttt

SEQ ID NO: 2632494 - DNA, 14 bp, Homo sapiens
taaatgggggtgca

SEQ ID NO: 2632495 - DNA, 17 bp, Homo sapiens
taaatggtcgcccagga

SEQ ID NO: 2632496 - DNA, 17 bp, Homo sapiens
taaatggtgtacataat

SEQ ID NO: 2632497 - DNA, 21 bp, Homo sapiens
taaatggtgtacataatgtat

SEQ ID NO: 2632498 - DNA, 17 bp, Homo sapiens
taaatgtaacagtctga

SEQ ID NO: 2632499 - DNA, 16 bp, Homo sapiens
taaatgtaggtatgaa

SEQ ID NO: 2632500 - DNA, 20 bp, Homo sapiens
taaatgtctagttgtaacac

SEQ ID NO: 2632501 - DNA, 13 bp, Homo sapiens
gtttggagacatt

SEQ ID NO: 2632502 - DNA, 23 bp, Homo sapiens
gtttggagacattcctgggcaca

SEQ ID NO: 2632503 - DNA, 18 bp, Homo sapiens
gtttggggatgagaaagg

SEQ ID NO: 2632504 - DNA, 16 bp, Homo sapiens
gtttggggcgaggcag

SEQ ID NO: 2632505 - DNA, 23 bp, Homo sapiens
gtttggtctgggacttccttgct

SEQ ID NO: 2632506 - DNA, 14 bp, Homo sapiens
gtttggttctgggg

SEQ ID NO: 2632507 - DNA, 14 bp, Homo sapiens
gtttgtatgtataa

SEQ ID NO: 2632508 - DNA, 20 bp, Homo sapiens
gtttgtatgtgtgtagacaa

SEQ ID NO: 2632509 - DNA, 15 bp, Homo sapiens
gtttgtcttctcccc

SEQ ID NO: 2632510 - DNA, 13 bp, Homo sapiens
gtttgtgtgtctt

SEQ ID NO: 2632511 - DNA, 14 bp, Homo sapiens
gtttgtgtgtctta

SEQ ID NO: 2632512 - DNA, 18 bp, Homo sapiens
gtttgtttctccccctgg

SEQ ID NO: 2632513 - DNA, 19 bp, Homo sapiens
gttttaaacatagaaagtt

SEQ ID NO: 2632514 - DNA, 15 bp, Homo sapiens
gttttaaagtgatta

SEQ ID NO: 2632515 - DNA, 14 bp, Homo sapiens
gttttaacaaaaac

SEQ ID NO: 2632516 - DNA, 18 bp, Homo sapiens
gttttaaggatgcttgta

SEQ ID NO: 2632517 - DNA, 22 bp, Homo sapiens
gttttaaggatgcttgtacata

SEQ ID NO: 2632518 - DNA, 13 bp, Homo sapiens
gttttaattccat

SEQ ID NO: 2632519 - DNA, 16 bp, Homo sapiens
gttttactgcagcttt

SEQ ID NO: 2632520 - DNA, 19 bp, Homo sapiens
gttttagagttaacaatga

SEQ ID NO: 2632521 - DNA, 23 bp, Homo sapiens
gttttatactgtacttaataaat

SEQ ID NO: 2632522 - DNA, 20 bp, Homo sapiens
gttttatcacatgtatgttt

SEQ ID NO: 2632523 - DNA, 22 bp, Homo sapiens
gttttatcatgacatgttatat

SEQ ID NO: 2632524 - DNA, 21 bp, Homo sapiens
gttttattttttattgttttc

SEQ ID NO: 2632525 - DNA, 19 bp, Homo sapiens
gttttcagaacctcttccc

SEQ ID NO: 2632526 - DNA, 16 bp, Homo sapiens
gttttcagtgtacatg

SEQ ID NO: 2632527 - DNA, 22 bp, Homo sapiens
gttttcataataaaactttaaa

SEQ ID NO: 2632528 - DNA, 14 bp, Homo sapiens
gttttcatcaagac

SEQ ID NO: 2632529 - DNA, 23 bp, Homo sapiens
gttttcatggtgaaaatgtactg

SEQ ID NO: 2632530 - DNA, 16 bp, Homo sapiens
gttttcattatctcaa

SEQ ID NO: 2632531 - DNA, 20 bp, Homo sapiens
gttttccaggtttaagctgt

SEQ ID NO: 2632532 - DNA, 20 bp, Homo sapiens
gttttccatgagtcccctgt

SEQ ID NO: 2632533 - DNA, 21 bp, Homo sapiens
gttttctcctcccaggaactg

SEQ ID NO: 2632534 - DNA, 15 bp, Homo sapiens
gttttctgagaaaga

SEQ ID NO: 2632535 - DNA, 17 bp, Homo sapiens
gttttctgagaaagact

SEQ ID NO: 2632536 - DNA, 22 bp, Homo sapiens
gttttctgagaaagactattca

SEQ ID NO: 2632537 - DNA, 23 bp, Homo sapiens
gttttctgagaaagactattcaa

SEQ ID NO: 2632538 - DNA, 15 bp, Homo sapiens
gttttctgagcccgg

SEQ ID NO: 2632539 - DNA, 19 bp, Homo sapiens
gttttctgagcccgggctg

SEQ ID NO: 2632540 - DNA, 16 bp, Homo sapiens
gttttctgggtgtcca

SEQ ID NO: 2632541 - DNA, 19 bp, Homo sapiens
gttttctgttctttctggc

SEQ ID NO: 2632542 - DNA, 14 bp, Homo sapiens
gttttgaaaagcta

SEQ ID NO: 2632543 - DNA, 21 bp, Homo sapiens
gttttgatgtttgtggcctca

SEQ ID NO: 2632544 - DNA, 22 bp, Homo sapiens
gttttgatgtttgtggcctcag

SEQ ID NO: 2632545 - DNA, 13 bp, Homo sapiens
gttttgcactttt

SEQ ID NO: 2632546 - DNA, 16 bp, Homo sapiens
gttttgccatgttggc

SEQ ID NO: 2632547 - DNA, 16 bp, Homo sapiens
gttttgctgtttcctt

SEQ ID NO: 2632548 - DNA, 16 bp, Homo sapiens
gttttggggactcatt

SEQ ID NO: 2632549 - DNA, 17 bp, Homo sapiens
gttttggtggttttagt

SEQ ID NO: 2632550 - DNA, 16 bp, Homo sapiens
gttttggttgctttaa

SEQ ID NO: 2632551 - DNA, 17 bp, Homo sapiens
gttttgtaagatgctgg

SEQ ID NO: 2632552 - DNA, 18 bp, Homo sapiens
gttttgtaagatgctggg

SEQ ID NO: 2632553 - DNA, 23 bp, Homo sapiens
gttttgtaagatgctgggttggt

SEQ ID NO: 2632554 - DNA, 24 bp, Homo sapiens
gttttgtcaaactgtagaaatgat

SEQ ID NO: 2632555 - DNA, 15 bp, Homo sapiens
gttttgttctttaaa

SEQ ID NO: 2632556 - DNA, 17 bp, Homo sapiens
gttttgttttaaaatta

SEQ ID NO: 2632557 - DNA, 13 bp, Homo sapiens
gtttttaagctgt

SEQ ID NO: 2632558 - DNA, 15 bp, Homo sapiens
gtttttaagctgttt

SEQ ID NO: 2632559 - DNA, 19 bp, Homo sapiens
gtttttaagctgtttccat

SEQ ID NO: 2632560 - DNA, 21 bp, Homo sapiens
gtttttaagggtttgtggaaa

SEQ ID NO: 2632561 - DNA, 21 bp, Homo sapiens
gtttttacctaccacagtgtc

SEQ ID NO: 2632562 - DNA, 16 bp, Homo sapiens
gtttttactacagttg

SEQ ID NO: 2632563 - DNA, 12 bp, Homo sapiens
gtttttcaatta

SEQ ID NO: 2632564 - DNA, 14 bp, Homo sapiens
gtttttcaattaaa

SEQ ID NO: 2632565 - DNA, 15 bp, Homo sapiens
gtttttcaattaaac

SEQ ID NO: 2632566 - DNA, 23 bp, Homo sapiens
gtttttcaattaaacggattatt

SEQ ID NO: 2632567 - DNA, 12 bp, Homo sapiens
gtttttcacatt

SEQ ID NO: 2632568 - DNA, 14 bp, Homo sapiens
gtttttcacatttt

SEQ ID NO: 2632569 - DNA, 18 bp, Homo sapiens
gtttttccactactgcta

SEQ ID NO: 2632570 - DNA, 19 bp, Homo sapiens
gtttttcctgttcttaaga

SEQ ID NO: 2632571 - DNA, 18 bp, Homo sapiens
gtttttctaggcctgggg

SEQ ID NO: 2632572 - DNA, 14 bp, Homo sapiens
gtttttctgccagg

SEQ ID NO: 2632573 - DNA, 12 bp, Homo sapiens
gtttttcttcaa

SEQ ID NO: 2632574 - DNA, 23 bp, Homo sapiens
gtttttcttcaacatcaatgttc

SEQ ID NO: 2632575 - DNA, 15 bp, Homo sapiens
gtttttgtaaagtgt

SEQ ID NO: 2632576 - DNA, 16 bp, Homo sapiens
gtttttgtaaagtgtg

SEQ ID NO: 2632577 - DNA, 16 bp, Homo sapiens
gtttttgtcttaaaaa

SEQ ID NO: 2632578 - DNA, 19 bp, Homo sapiens
gttttttagatcaaatact

SEQ ID NO: 2632579 - DNA, 21 bp, Homo sapiens
gttttttcctgagcttggcca

SEQ ID NO: 2632580 - DNA, 12 bp, Homo sapiens
gttttttgaaaa

SEQ ID NO: 2632581 - DNA, 16 bp, Homo sapiens
taaaaaaaaaaaagta

SEQ ID NO: 2632582 - DNA, 22 bp, Homo sapiens
taaaaaaaaaaaccaaaactgt

SEQ ID NO: 2632583 - DNA, 21 bp, Homo sapiens
taaaaaaaaacctgagcccca

SEQ ID NO: 2632584 - DNA, 14 bp, Homo sapiens
taaaaaaaaaggca

SEQ ID NO: 2632585 - DNA, 18 bp, Homo sapiens
taaaaaaaaatgcctttg

SEQ ID NO: 2632586 - DNA, 14 bp, Homo sapiens
taaaaaaaagaaaa

SEQ ID NO: 2632587 - DNA, 15 bp, Homo sapiens
taaaaaaaagaaaaa

SEQ ID NO: 2632588 - DNA, 17 bp, Homo sapiens
taaaaaaaagaaaaaag

SEQ ID NO: 2632589 - DNA, 21 bp, Homo sapiens
taaaaaaacaatcatttgctt

SEQ ID NO: 2632590 - DNA, 13 bp, Homo sapiens
taaaaaaatgaca

SEQ ID NO: 2632591 - DNA, 20 bp, Homo sapiens
taaaaaactgctgactgttt

SEQ ID NO: 2632592 - DNA, 17 bp, Homo sapiens
taaaaaataatctattt

SEQ ID NO: 2632593 - DNA, 14 bp, Homo sapiens
taaaaaccaagaag

SEQ ID NO: 2632594 - DNA, 17 bp, Homo sapiens
taaaaactgactcctta

SEQ ID NO: 2632595 - DNA, 17 bp, Homo sapiens
taaaaagaaaagataaa

SEQ ID NO: 2632596 - DNA, 23 bp, Homo sapiens
taaaaagaaaagataaagatgat

SEQ ID NO: 2632597 - DNA, 16 bp, Homo sapiens
taaaaagaaacaagat

SEQ ID NO: 2632598 - DNA, 19 bp, Homo sapiens
taaaaagaaacaagatgct

SEQ ID NO: 2632599 - DNA, 20 bp, Homo sapiens
taaaaaggaatccactccca

SEQ ID NO: 2632600 - DNA, 19 bp, Homo sapiens
taaaaaggcacctataaaa

SEQ ID NO: 2632601 - DNA, 20 bp, Homo sapiens
taaaaagggcagggcatctc

SEQ ID NO: 2632602 - DNA, 16 bp, Homo sapiens
taaaaagtatatgtta

SEQ ID NO: 2632603 - DNA, 15 bp, Homo sapiens
taaaaagtgacacag

SEQ ID NO: 2632604 - DNA, 17 bp, Homo sapiens
taaaaatcattgattgt

SEQ ID NO: 2632605 - DNA, 23 bp, Homo sapiens
taaaaatctcaaatttctaaatc

SEQ ID NO: 2632606 - DNA, 14 bp, Homo sapiens
taaaaatgaaattt

SEQ ID NO: 2632607 - DNA, 15 bp, Homo sapiens
taaaaatgaggtact

SEQ ID NO: 2632608 - DNA, 20 bp, Homo sapiens
taaaaatgcaaatcctatgt

SEQ ID NO: 2632609 - DNA, 19 bp, Homo sapiens
taaaaatgggacttctttt

SEQ ID NO: 2632610 - DNA, 21 bp, Homo sapiens
taaaaatgtaaatattctata

SEQ ID NO: 2632611 - DNA, 17 bp, Homo sapiens
taaaaattctgaatgta

SEQ ID NO: 2632612 - DNA, 17 bp, Homo sapiens
taaaaattgtgatcaga

SEQ ID NO: 2632613 - DNA, 23 bp, Homo sapiens
taaaaattgtttcaaaataaaaa

SEQ ID NO: 2632614 - DNA, 17 bp, Homo sapiens
taaaacagacactggca

SEQ ID NO: 2632615 - DNA, 18 bp, Homo sapiens
taaaacagacactggcat

SEQ ID NO: 2632616 - DNA, 14 bp, Homo sapiens
taaaacatgtaata

SEQ ID NO: 2632617 - DNA, 17 bp, Homo sapiens
taaaacattttcacaca

SEQ ID NO: 2632618 - DNA, 14 bp, Homo sapiens
taaaaccacagcag

SEQ ID NO: 2632619 - DNA, 13 bp, Homo sapiens
taaaacccaagtg

SEQ ID NO: 2632620 - DNA, 15 bp, Homo sapiens
taaaacctgtcaatg

SEQ ID NO: 2632621 - DNA, 16 bp, Homo sapiens
taaaactgaagtctga

SEQ ID NO: 2632622 - DNA, 17 bp, Homo sapiens
taaaactgttaaagtct

SEQ ID NO: 2632623 - DNA, 14 bp, Homo sapiens
taaaactttgctgc

SEQ ID NO: 2632624 - DNA, 22 bp, Homo sapiens
taaaagaaaataaaaaaaagaa

SEQ ID NO: 2632625 - DNA, 13 bp, Homo sapiens
taaaagaatattt

SEQ ID NO: 2632626 - DNA, 21 bp, Homo sapiens
taaaagaatgggcagttacat

SEQ ID NO: 2632627 - DNA, 12 bp, Homo sapiens
taaaagacaaat

SEQ ID NO: 2632628 - DNA, 17 bp, Homo sapiens
taaaagagatttcaaga

SEQ ID NO: 2632629 - DNA, 18 bp, Homo sapiens
taaaagaggtttttctta

SEQ ID NO: 2632630 - DNA, 23 bp, Homo sapiens
taaaagataacaagatctttcag

SEQ ID NO: 2632631 - DNA, 20 bp, Homo sapiens
taaaagatacagttactcag

SEQ ID NO: 2632632 - DNA, 16 bp, Homo sapiens
taaaaggaaaagcaaa

SEQ ID NO: 2632633 - DNA, 12 bp, Homo sapiens
taaaaggagcca

SEQ ID NO: 2632634 - DNA, 19 bp, Homo sapiens
taaaaggcaaatgtgtaca

SEQ ID NO: 2632635 - DNA, 18 bp, Homo sapiens
taaaaggccaaacctctg

SEQ ID NO: 2632636 - DNA, 20 bp, Homo sapiens
taaaaggccaaacctctgtt

SEQ ID NO: 2632637 - DNA, 20 bp, Homo sapiens
taaaagggctctttagccag

SEQ ID NO: 2632638 - DNA, 12 bp, Homo sapiens
taaaagtaaaca

SEQ ID NO: 2632639 - DNA, 20 bp, Homo sapiens
taaaagtacatgttaaactt

SEQ ID NO: 2632640 - DNA, 17 bp, Homo sapiens
taaaagttattaatatt

SEQ ID NO: 2632641 - DNA, 17 bp, Homo sapiens
taaaataaaataaaaat

SEQ ID NO: 2632642 - DNA, 13 bp, Homo sapiens
taaaataaagtat

SEQ ID NO: 2632643 - DNA, 17 bp, Homo sapiens
taaaataaagtatatat

SEQ ID NO: 2632644 - DNA, 15 bp, Homo sapiens
taaaataattctaaa

SEQ ID NO: 2632645 - DNA, 17 bp, Homo sapiens
taaaataattctaaagg

SEQ ID NO: 2632646 - DNA, 22 bp, Homo sapiens
taaaataccagccagtaaatgg

SEQ ID NO: 2632647 - DNA, 23 bp, Homo sapiens
taaaatagccacttaccttcaat

SEQ ID NO: 2632648 - DNA, 14 bp, Homo sapiens
taaaatattttgaa

SEQ ID NO: 2632649 - DNA, 18 bp, Homo sapiens
taaaatcatgtacatttc

SEQ ID NO: 2632650 - DNA, 13 bp, Homo sapiens
taaaatcatttct

SEQ ID NO: 2632651 - DNA, 13 bp, Homo sapiens
taaaatcttaaac

SEQ ID NO: 2632652 - DNA, 14 bp, Homo sapiens
tcactggatgaaga

SEQ ID NO: 2632653 - DNA, 19 bp, Homo sapiens
tcactggatgaagattctc

SEQ ID NO: 2632654 - DNA, 14 bp, Homo sapiens
tcactggctctcca

SEQ ID NO: 2632655 - DNA, 22 bp, Homo sapiens
tcactggctctccaagtgccag

SEQ ID NO: 2632656 - DNA, 16 bp, Homo sapiens
tcactggggtcctggg

SEQ ID NO: 2632657 - DNA, 11 bp, Homo sapiens
tcactgggtgg

SEQ ID NO: 2632658 - DNA, 23 bp, Homo sapiens
tcactgtaagactcattccctag

SEQ ID NO: 2632659 - DNA, 20 bp, Homo sapiens
tcactgtagaatgatttcat

SEQ ID NO: 2632660 - DNA, 21 bp, Homo sapiens
tcactgtagaatgatttcatg

SEQ ID NO: 2632661 - DNA, 14 bp, Homo sapiens
tcactgtataaata

SEQ ID NO: 2632662 - DNA, 16 bp, Homo sapiens
tcactgtataaatagg

SEQ ID NO: 2632663 - DNA, 15 bp, Homo sapiens
tcactgtctgagagt

SEQ ID NO: 2632664 - DNA, 18 bp, Homo sapiens
tcactgtgggaaggccag

SEQ ID NO: 2632665 - DNA, 16 bp, Homo sapiens
tcactgtggtgtctgt

SEQ ID NO: 2632666 - DNA, 21 bp, Homo sapiens
tcactgttccctctgctcctg

SEQ ID NO: 2632667 - DNA, 22 bp, Homo sapiens
tcactgttctattcatctcaag

SEQ ID NO: 2632668 - DNA, 15 bp, Homo sapiens
tcactgttgaaaatt

SEQ ID NO: 2632669 - DNA, 18 bp, Homo sapiens
tcactgttgaaaattatt

SEQ ID NO: 2632670 - DNA, 14 bp, Homo sapiens
tcactgttgcccag

SEQ ID NO: 2632671 - DNA, 16 bp, Homo sapiens
tcactgttgcccaggc

SEQ ID NO: 2632672 - DNA, 18 bp, Homo sapiens
tcactgttgcccaggctg

SEQ ID NO: 2632673 - DNA, 19 bp, Homo sapiens
tcactgttgcccaggctgg

SEQ ID NO: 2632674 - DNA, 16 bp, Homo sapiens
tcacttactgtttctg

SEQ ID NO: 2632675 - DNA, 21 bp, Homo sapiens
tcacttaggaaatggctttgt

SEQ ID NO: 2632676 - DNA, 17 bp, Homo sapiens
tcacttatatgttctaa

SEQ ID NO: 2632677 - DNA, 15 bp, Homo sapiens
tcacttcaccctgga

SEQ ID NO: 2632678 - DNA, 19 bp, Homo sapiens
tcacttcatcttctcagct

SEQ ID NO: 2632679 - DNA, 18 bp, Homo sapiens
tcacttccatacagctct

SEQ ID NO: 2632680 - DNA, 13 bp, Homo sapiens
tcacttgaatgtg

SEQ ID NO: 2632681 - DNA, 22 bp, Homo sapiens
tcacttgaggtcaggagttcct

SEQ ID NO: 2632682 - DNA, 19 bp, Homo sapiens
tcacttgtgccaacactca

SEQ ID NO: 2632683 - DNA, 21 bp, Homo sapiens
tcacttgtgccaacactcaag

SEQ ID NO: 2632684 - DNA, 18 bp, Homo sapiens
tcactttaattctcatgt

SEQ ID NO: 2632685 - DNA, 19 bp, Homo sapiens
tcactttcacatagatgtc

SEQ ID NO: 2632686 - DNA, 14 bp, Homo sapiens
tcactttgctctgg

SEQ ID NO: 2632687 - DNA, 15 bp, Homo sapiens
tcactttgctctggg

SEQ ID NO: 2632688 - DNA, 12 bp, Homo sapiens
tcacttttcctc

SEQ ID NO: 2632689 - DNA, 19 bp, Homo sapiens
tcactttttttttccaaaa

SEQ ID NO: 2632690 - DNA, 14 bp, Homo sapiens
tcagaaaagggaag

SEQ ID NO: 2632691 - DNA, 19 bp, Homo sapiens
tcagaaacaccctcacact

SEQ ID NO: 2632692 - DNA, 22 bp, Homo sapiens
tcagaaacaccctcacactggg

SEQ ID NO: 2632693 - DNA, 17 bp, Homo sapiens
tcagaaagcattacatt

SEQ ID NO: 2632694 - DNA, 16 bp, Homo sapiens
tcagaaatgctgcctg

SEQ ID NO: 2632695 - DNA, 19 bp, Homo sapiens
tcagaaatgctgcctgcct

SEQ ID NO: 2632696 - DNA, 18 bp, Homo sapiens
tcagaaatgtacaacttt

SEQ ID NO: 2632697 - DNA, 15 bp, Homo sapiens
tcagaaatgtgttat

SEQ ID NO: 2632698 - DNA, 16 bp, Homo sapiens
tcagaaattggaacag

SEQ ID NO: 2632699 - DNA, 22 bp, Homo sapiens
tcagaaggcaaatgactttgga

SEQ ID NO: 2632700 - DNA, 12 bp, Homo sapiens
tcagaaggctct

SEQ ID NO: 2632701 - DNA, 12 bp, Homo sapiens
tcagaagggagg

SEQ ID NO: 2632702 - DNA, 15 bp, Homo sapiens
tcagaaggggagggg

SEQ ID NO: 2632703 - DNA, 17 bp, Homo sapiens
tcagaagtttggcaata

SEQ ID NO: 2632704 - DNA, 20 bp, Homo sapiens
tcagaattctcagaatctca

SEQ ID NO: 2632705 - DNA, 18 bp, Homo sapiens
tcagacagaacccctaca

SEQ ID NO: 2632706 - DNA, 13 bp, Homo sapiens
tcagacagctgcc

SEQ ID NO: 2632707 - DNA, 15 bp, Homo sapiens
tcagacagctgcctg

SEQ ID NO: 2632708 - DNA, 16 bp, Homo sapiens
tcagacagctgcctgg

SEQ ID NO: 2632709 - DNA, 19 bp, Homo sapiens
tcagacagctgcctgggat

SEQ ID NO: 2632710 - DNA, 19 bp, Homo sapiens
tcagacatagaattaacac

SEQ ID NO: 2632711 - DNA, 22 bp, Homo sapiens
tcagacatagaattaacacatg

SEQ ID NO: 2632712 - DNA, 22 bp, Homo sapiens
tcagacatccatgtttgtaaaa

SEQ ID NO: 2632713 - DNA, 21 bp, Homo sapiens
tcagaccttggatcagatgaa

SEQ ID NO: 2632714 - DNA, 14 bp, Homo sapiens
tcagactggctggc

SEQ ID NO: 2632715 - DNA, 15 bp, Homo sapiens
tcagacttaccagga

SEQ ID NO: 2632716 - DNA, 12 bp, Homo sapiens
tcagagaatttc

SEQ ID NO: 2632717 - DNA, 23 bp, Homo sapiens
tcagagaatttctaccatttcag

SEQ ID NO: 2632718 - DNA, 14 bp, Homo sapiens
tcagagactcaggg

SEQ ID NO: 2632719 - DNA, 20 bp, Homo sapiens
tcagagactcagggccccag

SEQ ID NO: 2632720 - DNA, 22 bp, Homo sapiens
tcagagactcctgcaggcagcc

SEQ ID NO: 2632721 - DNA, 23 bp, Homo sapiens
tcagagactcctgcaggcagcca

SEQ ID NO: 2632722 - DNA, 22 bp, Homo sapiens
tcagagagcgagcgctacccac

SEQ ID NO: 2632723 - DNA, 13 bp, Homo sapiens
tcagagagctggt

SEQ ID NO: 2632724 - DNA, 16 bp, Homo sapiens
tcagagagggtgggag

SEQ ID NO: 2632725 - DNA, 16 bp, Homo sapiens
tcagagcaaatttggg

SEQ ID NO: 2632726 - DNA, 21 bp, Homo sapiens
tcagagcagcagtgaaaacaa

SEQ ID NO: 2632727 - DNA, 13 bp, Homo sapiens
tcagagcctgcag

SEQ ID NO: 2632728 - DNA, 18 bp, Homo sapiens
tcagaggatggccagtgt

SEQ ID NO: 2632729 - DNA, 16 bp, Homo sapiens
tcagagtccaggcccc

SEQ ID NO: 2632730 - DNA, 13 bp, Homo sapiens
tcagataactgtt

SEQ ID NO: 2632731 - DNA, 22 bp, Homo sapiens
tcagataactgttatttataat

SEQ ID NO: 2632732 - DNA, 14 bp, Homo sapiens
tcagatacaatgta

SEQ ID NO: 2632733 - DNA, 18 bp, Homo sapiens
tcagatatatatcatatt

SEQ ID NO: 2632734 - DNA, 21 bp, Homo sapiens
tcagatattttttcagaaata

SEQ ID NO: 2632735 - DNA, 16 bp, Homo sapiens
tcagatcactactgca

SEQ ID NO: 2632736 - DNA, 13 bp, Homo sapiens
tcagatcatggca

SEQ ID NO: 2632737 - DNA, 16 bp, Homo sapiens
tcagatccttgtttca

SEQ ID NO: 2632738 - DNA, 17 bp, Homo sapiens
tcagatccttgtttcaa

SEQ ID NO: 2632739 - DNA, 13 bp, Homo sapiens
tcagatctgtctg

SEQ ID NO: 2632740 - DNA, 22 bp, Homo sapiens
tcagatggaaccgcaggaagct

SEQ ID NO: 2632741 - DNA, 15 bp, Homo sapiens
tcagatgggaagaca

SEQ ID NO: 2632742 - DNA, 14 bp, Homo sapiens
tcagatgtcttctg

SEQ ID NO: 2632743 - DNA, 16 bp, Homo sapiens
tcagatgtcttctgcc

SEQ ID NO: 2632744 - DNA, 21 bp, Homo sapiens
tcagatgtcttctgcctgtta

SEQ ID NO: 2632745 - DNA, 22 bp, Homo sapiens
tcagattcccagagcaaaataa

SEQ ID NO: 2632746 - DNA, 14 bp, Homo sapiens
tcagattgcatgtg

SEQ ID NO: 2632747 - DNA, 15 bp, Homo sapiens
tcagattgcatgtga

SEQ ID NO: 2632748 - DNA, 19 bp, Homo sapiens
tcagattgcatgtgactct

SEQ ID NO: 2632749 - DNA, 21 bp, Homo sapiens
tcagattgcatgtgactctga

SEQ ID NO: 2632750 - DNA, 12 bp, Homo sapiens
tcagatttgaac

SEQ ID NO: 2632751 - DNA, 17 bp, Homo sapiens
tcagatttgccttattg

SEQ ID NO: 2632752 - DNA, 22 bp, Homo sapiens
tcagatttgccttattggcagc

SEQ ID NO: 2632753 - DNA, 15 bp, Homo sapiens
tcagcaaaagatgct

SEQ ID NO: 2632754 - DNA, 12 bp, Homo sapiens
tcagcaccaccc

SEQ ID NO: 2632755 - DNA, 13 bp, Homo sapiens
tcagcaccaccct

SEQ ID NO: 2632756 - DNA, 17 bp, Homo sapiens
tcagcacccctgtctct

SEQ ID NO: 2632757 - DNA, 14 bp, Homo sapiens
tcagcaccccttcc

SEQ ID NO: 2632758 - DNA, 15 bp, Homo sapiens
tcagcaccccttcca

SEQ ID NO: 2632759 - DNA, 16 bp, Homo sapiens
tcagcacgatttctgt

SEQ ID NO: 2632760 - DNA, 17 bp, Homo sapiens
tcagcatcctggcaccc

SEQ ID NO: 2632761 - DNA, 18 bp, Homo sapiens
tcagcatcctggcacccg

SEQ ID NO: 2632762 - DNA, 16 bp, Homo sapiens
tcagcatgtctattca

SEQ ID NO: 2632763 - DNA, 14 bp, Homo sapiens
tcagccaaatgtaa

SEQ ID NO: 2632764 - DNA, 14 bp, Homo sapiens
tcagccaagcacag

SEQ ID NO: 2632765 - DNA, 12 bp, Homo sapiens
tcagccaggagc

SEQ ID NO: 2632766 - DNA, 12 bp, Homo sapiens
tcagccagggcc

SEQ ID NO: 2632767 - DNA, 13 bp, Homo sapiens
tcagccagggcca

SEQ ID NO: 2632768 - DNA, 18 bp, Homo sapiens
tcagccagggccaggggt

SEQ ID NO: 2632769 - DNA, 18 bp, Homo sapiens
tcagccatcaacaagagt

SEQ ID NO: 2632770 - DNA, 18 bp, Homo sapiens
tcagcccacccccctcat

SEQ ID NO: 2632771 - DNA, 16 bp, Homo sapiens
tcagcccatatttcat

SEQ ID NO: 2632772 - DNA, 22 bp, Homo sapiens
tcagcccctcttgccccccacc

SEQ ID NO: 2632773 - DNA, 19 bp, Homo sapiens
tcagccgagccgggcctgg

SEQ ID NO: 2632774 - DNA, 20 bp, Homo sapiens
tcagccgagccgggcctggg

SEQ ID NO: 2632775 - DNA, 22 bp, Homo sapiens
tcagccgagccgggcctggggc

SEQ ID NO: 2632776 - DNA, 22 bp, Homo sapiens
tcagcctagccgacctcagcct

SEQ ID NO: 2632777 - DNA, 12 bp, Homo sapiens
tcagcctcccga

SEQ ID NO: 2632778 - DNA, 20 bp, Homo sapiens
tcagcctcccgaatagctgg

SEQ ID NO: 2632779 - DNA, 22 bp, Homo sapiens
tcagcctcccgaatagctggga

SEQ ID NO: 2632780 - DNA, 18 bp, Homo sapiens
tcagcctcccgagtagct

SEQ ID NO: 2632781 - DNA, 21 bp, Homo sapiens
tcagcctcccgagtagctggg

SEQ ID NO: 2632782 - DNA, 20 bp, Homo sapiens
tcagcctccggagtagctgg

SEQ ID NO: 2632783 - DNA, 16 bp, Homo sapiens
tcagcctctctcccag

SEQ ID NO: 2632784 - DNA, 18 bp, Homo sapiens
tcagcctctctcccagtc

SEQ ID NO: 2632785 - DNA, 21 bp, Homo sapiens
tcagcctctctcccagtctac

SEQ ID NO: 2632786 - DNA, 12 bp, Homo sapiens
tcagtggcagct

SEQ ID NO: 2632787 - DNA, 17 bp, Homo sapiens
tcagtggcttcatctgt

SEQ ID NO: 2632788 - DNA, 20 bp, Homo sapiens
tcagtggcttcatctgtcaa

SEQ ID NO: 2632789 - DNA, 23 bp, Homo sapiens
tcagtgtaaatagttactccagt

SEQ ID NO: 2632790 - DNA, 16 bp, Homo sapiens
tcagtgtaagccctgc

SEQ ID NO: 2632791 - DNA, 19 bp, Homo sapiens
tcagtgtaatttctttgcc

SEQ ID NO: 2632792 - DNA, 20 bp, Homo sapiens
tcagtgtacatggaataaca

SEQ ID NO: 2632793 - DNA, 19 bp, Homo sapiens
tcagtgtcctcttgctcaa

SEQ ID NO: 2632794 - DNA, 14 bp, Homo sapiens
tcagtgtctcacac

SEQ ID NO: 2632795 - DNA, 20 bp, Homo sapiens
tcagtgttccctttcctact

SEQ ID NO: 2632796 - DNA, 22 bp, Homo sapiens
tcagtgtttgggtcacccctcc

SEQ ID NO: 2632797 - DNA, 13 bp, Homo sapiens
tcagttacagaaa

SEQ ID NO: 2632798 - DNA, 15 bp, Homo sapiens
tcagttacagaaagt

SEQ ID NO: 2632799 - DNA, 16 bp, Homo sapiens
tcagttcccagaatca

SEQ ID NO: 2632800 - DNA, 17 bp, Homo sapiens
tcagttcccttggcctc

SEQ ID NO: 2632801 - DNA, 18 bp, Homo sapiens
tcagttcccttggcctca

SEQ ID NO: 2632802 - DNA, 22 bp, Homo sapiens
tcagttcccttggcctcagaat

SEQ ID NO: 2632803 - DNA, 19 bp, Homo sapiens
tcagttctagtctctctgg

SEQ ID NO: 2632804 - DNA, 20 bp, Homo sapiens
tcagttctagtctctctggg

SEQ ID NO: 2632805 - DNA, 17 bp, Homo sapiens
tcagttgcaataatact

SEQ ID NO: 2632806 - DNA, 16 bp, Homo sapiens
tcagtttcctggtctg

SEQ ID NO: 2632807 - DNA, 12 bp, Homo sapiens
tcataaaataaa

SEQ ID NO: 2632808 - DNA, 16 bp, Homo sapiens
tcataaaataaagtat

SEQ ID NO: 2632809 - DNA, 16 bp, Homo sapiens
tcataaaccttaagta

SEQ ID NO: 2632810 - DNA, 13 bp, Homo sapiens
tcataaactgtgt

SEQ ID NO: 2632811 - DNA, 14 bp, Homo sapiens
tcataaactgtgtg

SEQ ID NO: 2632812 - DNA, 12 bp, Homo sapiens
tcataaatgaag

SEQ ID NO: 2632813 - DNA, 18 bp, Homo sapiens
tatatatctgctgtccag

SEQ ID NO: 2632814 - DNA, 19 bp, Homo sapiens
tatatatctgcttcagtgg

SEQ ID NO: 2632815 - DNA, 21 bp, Homo sapiens
tatatatctgcttcagtggag

SEQ ID NO: 2632816 - DNA, 14 bp, Homo sapiens
tatatatgtgtatg

SEQ ID NO: 2632817 - DNA, 14 bp, Homo sapiens
tatatatgtgtgtg

SEQ ID NO: 2632818 - DNA, 18 bp, Homo sapiens
tatatatgtgtgtttaaa

SEQ ID NO: 2632819 - DNA, 13 bp, Homo sapiens
tatatatttataa

SEQ ID NO: 2632820 - DNA, 15 bp, Homo sapiens
tatatatttataact

SEQ ID NO: 2632821 - DNA, 20 bp, Homo sapiens
tatatatttttggttgtcaa

SEQ ID NO: 2632822 - DNA, 22 bp, Homo sapiens
tatatcaacagatagttgtgtt

SEQ ID NO: 2632823 - DNA, 19 bp, Homo sapiens
tatatcacatgttttctct

SEQ ID NO: 2632824 - DNA, 15 bp, Homo sapiens
tatatcagcctgagt

SEQ ID NO: 2632825 - DNA, 21 bp, Homo sapiens
tatatctatatataattctgt

SEQ ID NO: 2632826 - DNA, 17 bp, Homo sapiens
tatatctatatgtactt

SEQ ID NO: 2632827 - DNA, 19 bp, Homo sapiens
tatatgaagaaaatcactt

SEQ ID NO: 2632828 - DNA, 22 bp, Homo sapiens
tatatgaatttaaatataattc

SEQ ID NO: 2632829 - DNA, 13 bp, Homo sapiens
tatatgatggggg

SEQ ID NO: 2632830 - DNA, 16 bp, Homo sapiens
tatatgccatgatgga

SEQ ID NO: 2632831 - DNA, 14 bp, Homo sapiens
tatatgcttactga

SEQ ID NO: 2632832 - DNA, 17 bp, Homo sapiens
tatatggcctcaagatc

SEQ ID NO: 2632833 - DNA, 13 bp, Homo sapiens
tatatgtacttgt

SEQ ID NO: 2632834 - DNA, 18 bp, Homo sapiens
tatatgtgaacatttatc

SEQ ID NO: 2632835 - DNA, 14 bp, Homo sapiens
tatatgtgtatgta

SEQ ID NO: 2632836 - DNA, 22 bp, Homo sapiens
tatatgtgtgtttaaataaagt

SEQ ID NO: 2632837 - DNA, 14 bp, Homo sapiens
tatatgttcactgt

SEQ ID NO: 2632838 - DNA, 19 bp, Homo sapiens
tatatgttttaagaggcag

SEQ ID NO: 2632839 - DNA, 15 bp, Homo sapiens
tatattaaaataagc

SEQ ID NO: 2632840 - DNA, 14 bp, Homo sapiens
tatattatcatgca

SEQ ID NO: 2632841 - DNA, 23 bp, Homo sapiens
tatattatttctaggaagaattt

SEQ ID NO: 2632842 - DNA, 19 bp, Homo sapiens
tatattccatatattagca

SEQ ID NO: 2632843 - DNA, 19 bp, Homo sapiens
tatattggtaacatccttt

SEQ ID NO: 2632844 - DNA, 21 bp, Homo sapiens
tatattggtaacatcctttct

SEQ ID NO: 2632845 - DNA, 12 bp, Homo sapiens
tatattgtaaga

SEQ ID NO: 2632846 - DNA, 22 bp, Homo sapiens
tatattgtaagaaatactgtac

SEQ ID NO: 2632847 - DNA, 14 bp, Homo sapiens
tatatttaaaagaa

SEQ ID NO: 2632848 - DNA, 24 bp, Homo sapiens
tatatttacagtgaaaatgtaagc

SEQ ID NO: 2632849 - DNA, 15 bp, Homo sapiens
tatatttataactca

SEQ ID NO: 2632850 - DNA, 14 bp, Homo sapiens
tatattttaatttg

SEQ ID NO: 2632851 - DNA, 13 bp, Homo sapiens
tatatttttatat

SEQ ID NO: 2632852 - DNA, 20 bp, Homo sapiens
tatatttttatatttagtta

SEQ ID NO: 2632853 - DNA, 15 bp, Homo sapiens
tatatttttcacagt

SEQ ID NO: 2632854 - DNA, 13 bp, Homo sapiens
tatcaaactgaag

SEQ ID NO: 2632855 - DNA, 21 bp, Homo sapiens
tatcaaatattagatgtgatt

SEQ ID NO: 2632856 - DNA, 15 bp, Homo sapiens
tatcaatagtcaaga

SEQ ID NO: 2632857 - DNA, 17 bp, Homo sapiens
tatcaatccttgttcag

SEQ ID NO: 2632858 - DNA, 14 bp, Homo sapiens
tatcacaaatctta

SEQ ID NO: 2632859 - DNA, 16 bp, Homo sapiens
tatcacaaatcttaac

SEQ ID NO: 2632860 - DNA, 16 bp, Homo sapiens
tatcacatgtatgttt

SEQ ID NO: 2632861 - DNA, 13 bp, Homo sapiens
tatcacattattt

SEQ ID NO: 2632862 - DNA, 17 bp, Homo sapiens
tatcaccagctgcctct

SEQ ID NO: 2632863 - DNA, 19 bp, Homo sapiens
tatcacccagaagaaaata

SEQ ID NO: 2632864 - DNA, 22 bp, Homo sapiens
tatcacccagaagaaaatagtg

SEQ ID NO: 2632865 - DNA, 23 bp, Homo sapiens
tatcaccgtgggctccctgactg

SEQ ID NO: 2632866 - DNA, 15 bp, Homo sapiens
tatcacctcccctcc

SEQ ID NO: 2632867 - DNA, 18 bp, Homo sapiens
tatcagacactctggctg

SEQ ID NO: 2632868 - DNA, 19 bp, Homo sapiens
tatcagcctgagtctcctg

SEQ ID NO: 2632869 - DNA, 20 bp, Homo sapiens
tatcagcggccccttgactc

SEQ ID NO: 2632870 - DNA, 20 bp, Homo sapiens
tatcaggacccagaggaagg

SEQ ID NO: 2632871 - DNA, 15 bp, Homo sapiens
tatcaggtctcccac

SEQ ID NO: 2632872 - DNA, 23 bp, Homo sapiens
tatcaggtgcccatccctggaag

SEQ ID NO: 2632873 - DNA, 17 bp, Homo sapiens
tatcagtgacagagttc

SEQ ID NO: 2632874 - DNA, 22 bp, Homo sapiens
tatcagtgacagagttcactat

SEQ ID NO: 2632875 - DNA, 21 bp, Homo sapiens
tatcagttgagcttcatatac

SEQ ID NO: 2632876 - DNA, 14 bp, Homo sapiens
tatcatagaaatgt

SEQ ID NO: 2632877 - DNA, 15 bp, Homo sapiens
tatcatagaaatgta

SEQ ID NO: 2632878 - DNA, 23 bp, Homo sapiens
tatcatagaaatgtaacttttgt

SEQ ID NO: 2632879 - DNA, 15 bp, Homo sapiens
tatcatattggtatt

SEQ ID NO: 2632880 - DNA, 15 bp, Homo sapiens
tatcatcagtattga

SEQ ID NO: 2632881 - DNA, 22 bp, Homo sapiens
tatcatcagtattgaagcattt

SEQ ID NO: 2632882 - DNA, 11 bp, Homo sapiens
tatcatgaagc

SEQ ID NO: 2632883 - DNA, 13 bp, Homo sapiens
tatcatgacatgt

SEQ ID NO: 2632884 - DNA, 18 bp, Homo sapiens
tatcatgcccctgtactc

SEQ ID NO: 2632885 - DNA, 11 bp, Homo sapiens
tatcatgtgta

SEQ ID NO: 2632886 - DNA, 13 bp, Homo sapiens
tatcatgtgtaat

SEQ ID NO: 2632887 - DNA, 17 bp, Homo sapiens
tatcatgtgtaatcaat

SEQ ID NO: 2632888 - DNA, 22 bp, Homo sapiens
tatcatgtgtaatcaataaacg

SEQ ID NO: 2632889 - DNA, 13 bp, Homo sapiens
tatcattcaagtg

SEQ ID NO: 2632890 - DNA, 22 bp, Homo sapiens
tatcattcaagtgtaaaatatt

SEQ ID NO: 2632891 - DNA, 20 bp, Homo sapiens
tatcatttattttttacatt

SEQ ID NO: 2632892 - DNA, 17 bp, Homo sapiens
tatcattttagaagact

SEQ ID NO: 2632893 - DNA, 21 bp, Homo sapiens
tatcattttctgcatttaacc

SEQ ID NO: 2632894 - DNA, 21 bp, Homo sapiens
tatccacagaaacattttcat

SEQ ID NO: 2632895 - DNA, 13 bp, Homo sapiens
tatccaccacctc

SEQ ID NO: 2632896 - DNA, 15 bp, Homo sapiens
tatccaccacctccc

SEQ ID NO: 2632897 - DNA, 15 bp, Homo sapiens
tatccactttgcaca

SEQ ID NO: 2632898 - DNA, 11 bp, Homo sapiens
tatccagtcta

SEQ ID NO: 2632899 - DNA, 13 bp, Homo sapiens
tatccatgtactg

SEQ ID NO: 2632900 - DNA, 18 bp, Homo sapiens
tatccatgtactgtagtt

SEQ ID NO: 2632901 - DNA, 14 bp, Homo sapiens
tatccattatcatg

SEQ ID NO: 2632902 - DNA, 14 bp, Homo sapiens
tatcccagaaatta

SEQ ID NO: 2632903 - DNA, 21 bp, Homo sapiens
tatcccccccctgtatagtta

SEQ ID NO: 2632904 - DNA, 16 bp, Homo sapiens
tatcccctcccagtca

SEQ ID NO: 2632905 - DNA, 14 bp, Homo sapiens
tatcccttcctttt

SEQ ID NO: 2632906 - DNA, 12 bp, Homo sapiens
tatcctccaggt

SEQ ID NO: 2632907 - DNA, 13 bp, Homo sapiens
tatcctccaggtt

SEQ ID NO: 2632908 - DNA, 14 bp, Homo sapiens
tatcctctgatctc

SEQ ID NO: 2632909 - DNA, 13 bp, Homo sapiens
tatcctgagccat

SEQ ID NO: 2632910 - DNA, 18 bp, Homo sapiens
tatcctgccaaaatcatt

SEQ ID NO: 2632911 - DNA, 14 bp, Homo sapiens
tatcgaaataacaa

SEQ ID NO: 2632912 - DNA, 16 bp, Homo sapiens
tatcgatctcttattt

SEQ ID NO: 2632913 - DNA, 20 bp, Homo sapiens
tatcgcaccactgtgtattt

SEQ ID NO: 2632914 - DNA, 15 bp, Homo sapiens
tatcggaagcagtgc

SEQ ID NO: 2632915 - DNA, 16 bp, Homo sapiens
tatcgggaacagtgtt

SEQ ID NO: 2632916 - DNA, 14 bp, Homo sapiens
tatcgggagcagtg

SEQ ID NO: 2632917 - DNA, 16 bp, Homo sapiens
tatcgtcactgcttaa

SEQ ID NO: 2632918 - DNA, 20 bp, Homo sapiens
tatctaatacctctgtgtgc

SEQ ID NO: 2632919 - DNA, 16 bp, Homo sapiens
tatctacatctttttt

SEQ ID NO: 2632920 - DNA, 15 bp, Homo sapiens
tatctagatactgta

SEQ ID NO: 2632921 - DNA, 14 bp, Homo sapiens
tacatgcagcccat

SEQ ID NO: 2632922 - DNA, 17 bp, Homo sapiens
tacatgcagcccatgcc

SEQ ID NO: 2632923 - DNA, 14 bp, Homo sapiens
tacatgcatacttc

SEQ ID NO: 2632924 - DNA, 22 bp, Homo sapiens
tacatgcattgagctctctcat

SEQ ID NO: 2632925 - DNA, 14 bp, Homo sapiens
tacatgcatttgag

SEQ ID NO: 2632926 - DNA, 14 bp, Homo sapiens
tacatgccagtgac

SEQ ID NO: 2632927 - DNA, 12 bp, Homo sapiens
tacatgctgcta

SEQ ID NO: 2632928 - DNA, 15 bp, Homo sapiens
tacatgctttgtgaa

SEQ ID NO: 2632929 - DNA, 16 bp, Homo sapiens
tacatgctttgtgaac

SEQ ID NO: 2632930 - DNA, 18 bp, Homo sapiens
tacatggaataacatgta

SEQ ID NO: 2632931 - DNA, 22 bp, Homo sapiens
tacatggaataacatgtaatta

SEQ ID NO: 2632932 - DNA, 19 bp, Homo sapiens
tacatgtaaaacattatct

SEQ ID NO: 2632933 - DNA, 14 bp, Homo sapiens
tacatgtggtttat

SEQ ID NO: 2632934 - DNA, 16 bp, Homo sapiens
tacatgtgtagcctgt

SEQ ID NO: 2632935 - DNA, 18 bp, Homo sapiens
tacatgtgtagcctgtgc

SEQ ID NO: 2632936 - DNA, 15 bp, Homo sapiens
tacattaatgttaat

SEQ ID NO: 2632937 - DNA, 20 bp, Homo sapiens
tacattaatgttaattcagc

SEQ ID NO: 2632938 - DNA, 21 bp, Homo sapiens
tacattagtcattcaataaat

SEQ ID NO: 2632939 - DNA, 15 bp, Homo sapiens
tacattcaatgttta

SEQ ID NO: 2632940 - DNA, 17 bp, Homo sapiens
tacattgtcatttatat

SEQ ID NO: 2632941 - DNA, 18 bp, Homo sapiens
tacattgtcatttatata

SEQ ID NO: 2632942 - DNA, 15 bp, Homo sapiens
tacatttaatacagc

SEQ ID NO: 2632943 - DNA, 19 bp, Homo sapiens
tacatttataatgtttgct

SEQ ID NO: 2632944 - DNA, 16 bp, Homo sapiens
tacatttatgatttaa

SEQ ID NO: 2632945 - DNA, 20 bp, Homo sapiens
tacatttatgatttaataaa

SEQ ID NO: 2632946 - DNA, 18 bp, Homo sapiens
tacatttctcctttgata

SEQ ID NO: 2632947 - DNA, 14 bp, Homo sapiens
tacatttttaagtg

SEQ ID NO: 2632948 - DNA, 17 bp, Homo sapiens
taccaaaattatttcag

SEQ ID NO: 2632949 - DNA, 18 bp, Homo sapiens
taccaaaattatttcaga

SEQ ID NO: 2632950 - DNA, 18 bp, Homo sapiens
taccaaaccgccagcgaa

SEQ ID NO: 2632951 - DNA, 16 bp, Homo sapiens
taccaacacgagcagg

SEQ ID NO: 2632952 - DNA, 17 bp, Homo sapiens
taccaactttctgtaaa

SEQ ID NO: 2632953 - DNA, 19 bp, Homo sapiens
taccaactttctgtaaact

SEQ ID NO: 2632954 - DNA, 21 bp, Homo sapiens
taccaagtttcaggtattaag

SEQ ID NO: 2632955 - DNA, 20 bp, Homo sapiens
taccaatcattttaattatt

SEQ ID NO: 2632956 - DNA, 13 bp, Homo sapiens
taccaatgcatgc

SEQ ID NO: 2632957 - DNA, 14 bp, Homo sapiens
taccaatgcatgca

SEQ ID NO: 2632958 - DNA, 13 bp, Homo sapiens
taccaatgctgca

SEQ ID NO: 2632959 - DNA, 19 bp, Homo sapiens
taccaatgcttttatcaaa

SEQ ID NO: 2632960 - DNA, 17 bp, Homo sapiens
taccaccccttcctgtc

SEQ ID NO: 2632961 - DNA, 17 bp, Homo sapiens
taccacttttgttcttg

SEQ ID NO: 2632962 - DNA, 23 bp, Homo sapiens
taccagactgtgtattcattgaa

SEQ ID NO: 2632963 - DNA, 12 bp, Homo sapiens
taccagcagagc

SEQ ID NO: 2632964 - DNA, 13 bp, Homo sapiens
taccagcagagca

SEQ ID NO: 2632965 - DNA, 22 bp, Homo sapiens
taccagcagagcaccttagaca

SEQ ID NO: 2632966 - DNA, 15 bp, Homo sapiens
taccagcgaggaggc

SEQ ID NO: 2632967 - DNA, 19 bp, Homo sapiens
taccagggactgaggggag

SEQ ID NO: 2632968 - DNA, 16 bp, Homo sapiens
taccagtgaaccaaag

SEQ ID NO: 2632969 - DNA, 18 bp, Homo sapiens
taccagtgaaccaaagag

SEQ ID NO: 2632970 - DNA, 15 bp, Homo sapiens
taccataatgtattt

SEQ ID NO: 2632971 - DNA, 17 bp, Homo sapiens
taccatcccctgtagag

SEQ ID NO: 2632972 - DNA, 14 bp, Homo sapiens
taccatgaacagaa

SEQ ID NO: 2632973 - DNA, 20 bp, Homo sapiens
taccatgaacagaaaacatt

SEQ ID NO: 2632974 - DNA, 22 bp, Homo sapiens
taccatgagaagagggcctgtg

SEQ ID NO: 2632975 - DNA, 14 bp, Homo sapiens
taccatgtcactgt

SEQ ID NO: 2632976 - DNA, 15 bp, Homo sapiens
taccatgtcactgtg

SEQ ID NO: 2632977 - DNA, 16 bp, Homo sapiens
taccatgtcactgtgg

SEQ ID NO: 2632978 - DNA, 23 bp, Homo sapiens
taccattttggggtacccactgc

SEQ ID NO: 2632979 - DNA, 22 bp, Homo sapiens
tcatgttttccattgtttgaaa

SEQ ID NO: 2632980 - DNA, 15 bp, Homo sapiens
tcatgttttgtgact

SEQ ID NO: 2632981 - DNA, 13 bp, Homo sapiens
tcattaatgacac

SEQ ID NO: 2632982 - DNA, 19 bp, Homo sapiens
tcattaatgacacttgtcc

SEQ ID NO: 2632983 - DNA, 22 bp, Homo sapiens
tcattaatgacacttgtcccca

SEQ ID NO: 2632984 - DNA, 16 bp, Homo sapiens
tcattacttttgaagt

SEQ ID NO: 2632985 - DNA, 12 bp, Homo sapiens
tcattagagcag

SEQ ID NO: 2632986 - DNA, 13 bp, Homo sapiens
tcattagagcagg

SEQ ID NO: 2632987 - DNA, 16 bp, Homo sapiens
tcattaggtgtgactg

SEQ ID NO: 2632988 - DNA, 17 bp, Homo sapiens
tcattatagatccccca

SEQ ID NO: 2632989 - DNA, 18 bp, Homo sapiens
tcattatagatcccccag

SEQ ID NO: 2632990 - DNA, 13 bp, Homo sapiens
tcattatgtaaaa

SEQ ID NO: 2632991 - DNA, 18 bp, Homo sapiens
tcattattggaattaacc

SEQ ID NO: 2632992 - DNA, 21 bp, Homo sapiens
tcattattggaattaacctgg

SEQ ID NO: 2632993 - DNA, 16 bp, Homo sapiens
tcattatttgcagaga

SEQ ID NO: 2632994 - DNA, 16 bp, Homo sapiens
tcattcaaaagttgaa

SEQ ID NO: 2632995 - DNA, 22 bp, Homo sapiens
tcattcaaaagttgaaattaac

SEQ ID NO: 2632996 - DNA, 15 bp, Homo sapiens
tcattcatgctactg

SEQ ID NO: 2632997 - DNA, 16 bp, Homo sapiens
tcattcatttattcat

SEQ ID NO: 2632998 - DNA, 17 bp, Homo sapiens
tcattccaacagtgagt

SEQ ID NO: 2632999 - DNA, 21 bp, Homo sapiens
tcattccaacttcccagttca

SEQ ID NO: 2633000 - DNA, 14 bp, Homo sapiens
tcattccattctgg

SEQ ID NO: 2633001 - DNA, 21 bp, Homo sapiens
tcattcctgaaagaaacagtt

SEQ ID NO: 2633002 - DNA, 13 bp, Homo sapiens
tcattcctgcctg

SEQ ID NO: 2633003 - DNA, 23 bp, Homo sapiens
tcattccttgagaaaaacaatga

SEQ ID NO: 2633004 - DNA, 13 bp, Homo sapiens
tcattctcctgcc

SEQ ID NO: 2633005 - DNA, 14 bp, Homo sapiens
tcattctcctgcct

SEQ ID NO: 2633006 - DNA, 12 bp, Homo sapiens
tcattcttctgt

SEQ ID NO: 2633007 - DNA, 18 bp, Homo sapiens
tcattgatatgaaaaata

SEQ ID NO: 2633008 - DNA, 18 bp, Homo sapiens
tcattgcccccagggcac

SEQ ID NO: 2633009 - DNA, 20 bp, Homo sapiens
tcattgccttaactggagcc

SEQ ID NO: 2633010 - DNA, 19 bp, Homo sapiens
tcattgtaatgttactgat

SEQ ID NO: 2633011 - DNA, 15 bp, Homo sapiens
tcatttaaaatgatt

SEQ ID NO: 2633012 - DNA, 13 bp, Homo sapiens
tcatttactgtgg

SEQ ID NO: 2633013 - DNA, 12 bp, Homo sapiens
tcatttagaact

SEQ ID NO: 2633014 - DNA, 22 bp, Homo sapiens
tcatttagaacttgcagctgat

SEQ ID NO: 2633015 - DNA, 22 bp, Homo sapiens
tcatttatatagattataactt

SEQ ID NO: 2633016 - DNA, 16 bp, Homo sapiens
tatgtggaagtgtggg

SEQ ID NO: 2633017 - DNA, 18 bp, Homo sapiens
tatgtgggggtctgtgtg

SEQ ID NO: 2633018 - DNA, 19 bp, Homo sapiens
tatgtggtttccacgatga

SEQ ID NO: 2633019 - DNA, 14 bp, Homo sapiens
tatgtgtaaataca

SEQ ID NO: 2633020 - DNA, 15 bp, Homo sapiens
tatgtgtgaggagct

SEQ ID NO: 2633021 - DNA, 12 bp, Homo sapiens
tatgtgtgtatg

SEQ ID NO: 2633022 - DNA, 21 bp, Homo sapiens
tatgtgtgtatgggtgtgtgt

SEQ ID NO: 2633023 - DNA, 19 bp, Homo sapiens
tatgtgtgtgtatgtttgc

SEQ ID NO: 2633024 - DNA, 20 bp, Homo sapiens
tatgtgtgtttaaataaagt

SEQ ID NO: 2633025 - DNA, 21 bp, Homo sapiens
tatgtgtgtttaaataaagta

SEQ ID NO: 2633026 - DNA, 20 bp, Homo sapiens
tatgttaacctcagtgtcat

SEQ ID NO: 2633027 - DNA, 22 bp, Homo sapiens
tatgttaacctcagtgtcattt

SEQ ID NO: 2633028 - DNA, 15 bp, Homo sapiens
tatgttaagttactt

SEQ ID NO: 2633029 - DNA, 17 bp, Homo sapiens
tatgttgctcagtctcc

SEQ ID NO: 2633030 - DNA, 21 bp, Homo sapiens
tatgttgtccaattgttgaca

SEQ ID NO: 2633031 - DNA, 16 bp, Homo sapiens
tatgttgtgttctaat

SEQ ID NO: 2633032 - DNA, 22 bp, Homo sapiens
tatgtttgtataatgaatgaga

SEQ ID NO: 2633033 - DNA, 14 bp, Homo sapiens
tatgttttagcatg

SEQ ID NO: 2633034 - DNA, 18 bp, Homo sapiens
tatgttttagcatgtgtt

SEQ ID NO: 2633035 - DNA, 20 bp, Homo sapiens
tatgttttggtatctgttct

SEQ ID NO: 2633036 - DNA, 14 bp, Homo sapiens
tatgtttttgaagg

SEQ ID NO: 2633037 - DNA, 17 bp, Homo sapiens
tatgttttttagatcaa

SEQ ID NO: 2633038 - DNA, 19 bp, Homo sapiens
tatgttttttagatcaaat

SEQ ID NO: 2633039 - DNA, 22 bp, Homo sapiens
tatgttttttttctgctggaaa

SEQ ID NO: 2633040 - DNA, 22 bp, Homo sapiens
tattaaaaatatggaacttcta

SEQ ID NO: 2633041 - DNA, 20 bp, Homo sapiens
tccctagtgacccggaggcc

SEQ ID NO: 2633042 - DNA, 19 bp, Homo sapiens
tccctatctttgccaccct

SEQ ID NO: 2633043 - DNA, 18 bp, Homo sapiens
tccctatgtatttgcagt

SEQ ID NO: 2633044 - DNA, 18 bp, Homo sapiens
tccctattagagaagaga

SEQ ID NO: 2633045 - DNA, 21 bp, Homo sapiens
tccctattttttttctgttat

SEQ ID NO: 2633046 - DNA, 17 bp, Homo sapiens
tccctcacccacccaca

SEQ ID NO: 2633047 - DNA, 17 bp, Homo sapiens
tccctcaccctgagccc

SEQ ID NO: 2633048 - DNA, 19 bp, Homo sapiens
tccctcaccctgagcccct

SEQ ID NO: 2633049 - DNA, 20 bp, Homo sapiens
tccctcaccctgagcccctt

SEQ ID NO: 2633050 - DNA, 21 bp, Homo sapiens
tccctcatctgtccctccggg

SEQ ID NO: 2633051 - DNA, 23 bp, Homo sapiens
tccctcattccaccttcccatgc

SEQ ID NO: 2633052 - DNA, 12 bp, Homo sapiens
tccctccccctt

SEQ ID NO: 2633053 - DNA, 16 bp, Homo sapiens
tccctcccctgccctg

SEQ ID NO: 2633054 - DNA, 22 bp, Homo sapiens
tccctcccctggggacagcaag

SEQ ID NO: 2633055 - DNA, 20 bp, Homo sapiens
tccctcccggcatgggaaag

SEQ ID NO: 2633056 - DNA, 15 bp, Homo sapiens
tccctccgggacctg

SEQ ID NO: 2633057 - DNA, 13 bp, Homo sapiens
tccctcctcacct

SEQ ID NO: 2633058 - DNA, 17 bp, Homo sapiens
tccctcctcacctctgg

SEQ ID NO: 2633059 - DNA, 21 bp, Homo sapiens
tccctcctgccgactcctggg

SEQ ID NO: 2633060 - DNA, 19 bp, Homo sapiens
tccctcgctgcacaaatac

SEQ ID NO: 2633061 - DNA, 22 bp, Homo sapiens
tccctcgctgcacaaatactcc

SEQ ID NO: 2633062 - DNA, 20 bp, Homo sapiens
tccctctcaggcatgcctgt

SEQ ID NO: 2633063 - DNA, 12 bp, Homo sapiens
tccctctcggaa

SEQ ID NO: 2633064 - DNA, 22 bp, Homo sapiens
tccctctcggaaggctggctgg

SEQ ID NO: 2633065 - DNA, 17 bp, Homo sapiens
tccctctctctgactct

SEQ ID NO: 2633066 - DNA, 12 bp, Homo sapiens
tccctctctctt

SEQ ID NO: 2633067 - DNA, 23 bp, Homo sapiens
tccctctctcttctgctccaccc

SEQ ID NO: 2633068 - DNA, 13 bp, Homo sapiens
tccctctgacctg

SEQ ID NO: 2633069 - DNA, 18 bp, Homo sapiens
tccctctgacctgcaggc

SEQ ID NO: 2633070 - DNA, 21 bp, Homo sapiens
tccctctgcctgaaccttcca

SEQ ID NO: 2633071 - DNA, 18 bp, Homo sapiens
tccctctgcctgtccctc

SEQ ID NO: 2633072 - DNA, 20 bp, Homo sapiens
tccctctgcctgtccctctc

SEQ ID NO: 2633073 - DNA, 13 bp, Homo sapiens
tccctcttggtct

SEQ ID NO: 2633074 - DNA, 15 bp, Homo sapiens
tccctgaaccatccc

SEQ ID NO: 2633075 - DNA, 11 bp, Homo sapiens
tccctgaaggc

SEQ ID NO: 2633076 - DNA, 14 bp, Homo sapiens
tccctgactcattc

SEQ ID NO: 2633077 - DNA, 16 bp, Homo sapiens
tccctgactcattctg

SEQ ID NO: 2633078 - DNA, 14 bp, Homo sapiens
tccctgactgggag

SEQ ID NO: 2633079 - DNA, 23 bp, Homo sapiens
tccctgcctctcatcaactgaat

SEQ ID NO: 2633080 - DNA, 23 bp, Homo sapiens
tccctgctaggggttttaggtct

SEQ ID NO: 2633081 - DNA, 21 bp, Homo sapiens
tccctggagtgtggctgagga

SEQ ID NO: 2633082 - DNA, 18 bp, Homo sapiens
tccctggcctgttctgtt

SEQ ID NO: 2633083 - DNA, 16 bp, Homo sapiens
tccctggctctcagaa

SEQ ID NO: 2633084 - DNA, 18 bp, Homo sapiens
tccctggctctcagaagg

SEQ ID NO: 2633085 - DNA, 20 bp, Homo sapiens
tccctggctctcagaaggta

SEQ ID NO: 2633086 - DNA, 19 bp, Homo sapiens
tccctggctgccctggccc

SEQ ID NO: 2633087 - DNA, 12 bp, Homo sapiens
tccctgggcatt

SEQ ID NO: 2633088 - DNA, 13 bp, Homo sapiens
tccctggtccctt

SEQ ID NO: 2633089 - DNA, 14 bp, Homo sapiens
tccctggtcccttg

SEQ ID NO: 2633090 - DNA, 17 bp, Homo sapiens
tccctggtggcagctca

SEQ ID NO: 2633091 - DNA, 19 bp, Homo sapiens
tccctggtggcagctcacc

SEQ ID NO: 2633092 - DNA, 23 bp, Homo sapiens
tccctggtggcagctcacctctc

SEQ ID NO: 2633093 - DNA, 16 bp, Homo sapiens
tccctggttctgatga

SEQ ID NO: 2633094 - DNA, 22 bp, Homo sapiens
tccctgtattttctttctctac

SEQ ID NO: 2633095 - DNA, 14 bp, Homo sapiens
tccctgttgaagct

SEQ ID NO: 2633096 - DNA, 14 bp, Homo sapiens
tccctgtttaatat

SEQ ID NO: 2633097 - DNA, 15 bp, Homo sapiens
tccctgttttctgag

SEQ ID NO: 2633098 - DNA, 20 bp, Homo sapiens
tcccttcagtaccctctcag

SEQ ID NO: 2633099 - DNA, 17 bp, Homo sapiens
tcccttcatgcatggaa

SEQ ID NO: 2633100 - DNA, 18 bp, Homo sapiens
tcccttcatgcatggaaa

SEQ ID NO: 2633101 - DNA, 13 bp, Homo sapiens
tcccttcccacct

SEQ ID NO: 2633102 - DNA, 16 bp, Homo sapiens
tcccttcccacctctc

SEQ ID NO: 2633103 - DNA, 22 bp, Homo sapiens
tcccttcccatgacccaggctg

SEQ ID NO: 2633104 - DNA, 21 bp, Homo sapiens
tcccttcccctccctggctcc

SEQ ID NO: 2633105 - DNA, 20 bp, Homo sapiens
tcccttctacctgccactca

SEQ ID NO: 2633106 - DNA, 22 bp, Homo sapiens
tcccttctccatctctctggcc

SEQ ID NO: 2633107 - DNA, 20 bp, Homo sapiens
tcccttctctgtagggaact

SEQ ID NO: 2633108 - DNA, 17 bp, Homo sapiens
tcccttctttttcttct

SEQ ID NO: 2633109 - DNA, 14 bp, Homo sapiens
tcccttgagccctc

SEQ ID NO: 2633110 - DNA, 23 bp, Homo sapiens
tcccttgaggaaacaacagcttt

SEQ ID NO: 2633111 - DNA, 23 bp, Homo sapiens
tcccttggaaacctgccctgcct

SEQ ID NO: 2633112 - DNA, 19 bp, Homo sapiens
tcccttggattgtccccga

SEQ ID NO: 2633113 - DNA, 14 bp, Homo sapiens
tcccttggcctcag

SEQ ID NO: 2633114 - DNA, 16 bp, Homo sapiens
tcccttggcctcagaa

SEQ ID NO: 2633115 - DNA, 14 bp, Homo sapiens
tcccttgggctccc

SEQ ID NO: 2633116 - DNA, 14 bp, Homo sapiens
tcccttgttctcta

SEQ ID NO: 2633117 - DNA, 19 bp, Homo sapiens
tccctttccttccatccct

SEQ ID NO: 2633118 - DNA, 16 bp, Homo sapiens
tccctttcttggccag

SEQ ID NO: 2633119 - DNA, 21 bp, Homo sapiens
tccctttcttggccagttatc

SEQ ID NO: 2633120 - DNA, 15 bp, Homo sapiens
tccctttgaaatgaa

SEQ ID NO: 2633121 - DNA, 18 bp, Homo sapiens
tccctttgacgccatccc

SEQ ID NO: 2633122 - DNA, 19 bp, Homo sapiens
tcctccttggtgcctggcc

SEQ ID NO: 2633123 - DNA, 18 bp, Homo sapiens
tcctctactaacaatcag

SEQ ID NO: 2633124 - DNA, 18 bp, Homo sapiens
tcctctacttaatgagat

SEQ ID NO: 2633125 - DNA, 15 bp, Homo sapiens
tcctctagctgtggg

SEQ ID NO: 2633126 - DNA, 18 bp, Homo sapiens
tcctctcactaaacttta

SEQ ID NO: 2633127 - DNA, 20 bp, Homo sapiens
tcctctcccatccccctgcc

SEQ ID NO: 2633128 - DNA, 11 bp, Homo sapiens
tcctctcccct

SEQ ID NO: 2633129 - DNA, 12 bp, Homo sapiens
tcctctcctgga

SEQ ID NO: 2633130 - DNA, 15 bp, Homo sapiens
tcctctcctggagga

SEQ ID NO: 2633131 - DNA, 17 bp, Homo sapiens
tcctctgactcagggct

SEQ ID NO: 2633132 - DNA, 18 bp, Homo sapiens
tcctctgcagctgacctc

SEQ ID NO: 2633133 - DNA, 15 bp, Homo sapiens
tcctctgcagtgcct

SEQ ID NO: 2633134 - DNA, 18 bp, Homo sapiens
tcctctgcagtgccttgg

SEQ ID NO: 2633135 - DNA, 14 bp, Homo sapiens
tcctctgctgctgg

SEQ ID NO: 2633136 - DNA, 16 bp, Homo sapiens
tcctctgctgctggct

SEQ ID NO: 2633137 - DNA, 13 bp, Homo sapiens
tcctctgtacaga

SEQ ID NO: 2633138 - DNA, 15 bp, Homo sapiens
tcctctgtacagagc

SEQ ID NO: 2633139 - DNA, 22 bp, Homo sapiens
tcctctgtccaggcactgctgc

SEQ ID NO: 2633140 - DNA, 14 bp, Homo sapiens
tcctctgtccaggg

SEQ ID NO: 2633141 - DNA, 23 bp, Homo sapiens
tcctctgtccagggccctgagct

SEQ ID NO: 2633142 - DNA, 14 bp, Homo sapiens
tcctctgtctgccc

SEQ ID NO: 2633143 - DNA, 19 bp, Homo sapiens
tcctctgtgaccaatgtct

SEQ ID NO: 2633144 - DNA, 20 bp, Homo sapiens
tcctcttaaaaaataaaaac

SEQ ID NO: 2633145 - DNA, 18 bp, Homo sapiens
tcctcttccccttgccct

SEQ ID NO: 2633146 - DNA, 15 bp, Homo sapiens
tcctcttcctctgag

SEQ ID NO: 2633147 - DNA, 17 bp, Homo sapiens
tcctcttctgcatcttg

SEQ ID NO: 2633148 - DNA, 19 bp, Homo sapiens
tcctcttgccactgcctct

SEQ ID NO: 2633149 - DNA, 22 bp, Homo sapiens
tcctctttggtctacactgtgc

SEQ ID NO: 2633150 - DNA, 23 bp, Homo sapiens
tcctctttggtctacactgtgct

SEQ ID NO: 2633151 - DNA, 14 bp, Homo sapiens
tcctgaagaggcgg

SEQ ID NO: 2633152 - DNA, 19 bp, Homo sapiens
tcctgaagaggcgggccag

SEQ ID NO: 2633153 - DNA, 23 bp, Homo sapiens
tcctgaagaggcgggccagccag

SEQ ID NO: 2633154 - DNA, 14 bp, Homo sapiens
tcctgaatgaaata

SEQ ID NO: 2633155 - DNA, 21 bp, Homo sapiens
tcctgaatttattattgttct

SEQ ID NO: 2633156 - DNA, 12 bp, Homo sapiens
tcctgacccagg

SEQ ID NO: 2633157 - DNA, 14 bp, Homo sapiens
tcctgacctgaggc

SEQ ID NO: 2633158 - DNA, 16 bp, Homo sapiens
tcctgacctgaggctc

SEQ ID NO: 2633159 - DNA, 17 bp, Homo sapiens
tcctgagacccctggcc

SEQ ID NO: 2633160 - DNA, 19 bp, Homo sapiens
tcctgagacccctggcctc

SEQ ID NO: 2633161 - DNA, 21 bp, Homo sapiens
tcctgagacccctggcctccg

SEQ ID NO: 2633162 - DNA, 23 bp, Homo sapiens
tcctgagccagtgtcaggaggaa

SEQ ID NO: 2633163 - DNA, 12 bp, Homo sapiens
tcctgagcttgg

SEQ ID NO: 2633164 - DNA, 16 bp, Homo sapiens
tcctgagcttggccag

SEQ ID NO: 2633165 - DNA, 16 bp, Homo sapiens
tcctgaggacagctgt

SEQ ID NO: 2633166 - DNA, 19 bp, Homo sapiens
tcctgaggctgggctccct

SEQ ID NO: 2633167 - DNA, 19 bp, Homo sapiens
tcctgaggggcatctgccc

SEQ ID NO: 2633168 - DNA, 20 bp, Homo sapiens
tcctgaggggcatctgcccc

SEQ ID NO: 2633169 - DNA, 22 bp, Homo sapiens
tcctgaggggcatctgcccctc

SEQ ID NO: 2633170 - DNA, 19 bp, Homo sapiens
tcctgagggtccccacctg

SEQ ID NO: 2633171 - DNA, 22 bp, Homo sapiens
tcctgagggtccccacctggga

SEQ ID NO: 2633172 - DNA, 17 bp, Homo sapiens
tcctgataataattgat

SEQ ID NO: 2633173 - DNA, 18 bp, Homo sapiens
tcctgataataattgatc

SEQ ID NO: 2633174 - DNA, 19 bp, Homo sapiens
tcctgataataattgatca

SEQ ID NO: 2633175 - DNA, 18 bp, Homo sapiens
tcctgatggtacaggaaa

SEQ ID NO: 2633176 - DNA, 23 bp, Homo sapiens
tcctgatggtacaggaaagctca

SEQ ID NO: 2633177 - DNA, 13 bp, Homo sapiens
tcctgcaggcagc

SEQ ID NO: 2633178 - DNA, 15 bp, Homo sapiens
tcctgcaggcagcca

SEQ ID NO: 2633179 - DNA, 21 bp, Homo sapiens
tcctgcagtctggctgagccc

SEQ ID NO: 2633180 - DNA, 11 bp, Homo sapiens
tcctgccaaaa

SEQ ID NO: 2633181 - DNA, 17 bp, Homo sapiens
tcctgccaccagtcact

SEQ ID NO: 2633182 - DNA, 13 bp, Homo sapiens
tcctgccaggcat

SEQ ID NO: 2633183 - DNA, 14 bp, Homo sapiens
tcctgccaggcatg

SEQ ID NO: 2633184 - DNA, 17 bp, Homo sapiens
tcctgccccctgaaact

SEQ ID NO: 2633185 - DNA, 17 bp, Homo sapiens
tcctgcccctgagccca

SEQ ID NO: 2633186 - DNA, 14 bp, Homo sapiens
tcctgcccctgttc

SEQ ID NO: 2633187 - DNA, 16 bp, Homo sapiens
tcctgcccctgttctc

SEQ ID NO: 2633188 - DNA, 15 bp, Homo sapiens
tcctgccgactcctg

SEQ ID NO: 2633189 - DNA, 13 bp, Homo sapiens
tcctgcctcagcc

SEQ ID NO: 2633190 - DNA, 21 bp, Homo sapiens
tcctgcctcgaactggctgca

SEQ ID NO: 2633191 - DNA, 20 bp, Homo sapiens
tcctgcctgcccctctcccg

SEQ ID NO: 2633192 - DNA, 12 bp, Homo sapiens
tcctgcctggcc

SEQ ID NO: 2633193 - DNA, 13 bp, Homo sapiens
tcctgcctggcca

SEQ ID NO: 2633194 - DNA, 20 bp, Homo sapiens
tcctgcctgtctcctttgca

SEQ ID NO: 2633195 - DNA, 14 bp, Homo sapiens
tcctgccttctgtc

SEQ ID NO: 2633196 - DNA, 23 bp, Homo sapiens
tcctgccttctgtcctggtgtca

SEQ ID NO: 2633197 - DNA, 21 bp, Homo sapiens
tcctgcggagtgaagaggggc

SEQ ID NO: 2633198 - DNA, 22 bp, Homo sapiens
tcctgcggagtgaagaggggca

SEQ ID NO: 2633199 - DNA, 13 bp, Homo sapiens
tcctgctgcagtt

SEQ ID NO: 2633200 - DNA, 21 bp, Homo sapiens
tccagcttctggtactctcct

SEQ ID NO: 2633201 - DNA, 19 bp, Homo sapiens
tccagcttgtggagcccca

SEQ ID NO: 2633202 - DNA, 12 bp, Homo sapiens
tccaggagcagc

SEQ ID NO: 2633203 - DNA, 13 bp, Homo sapiens
tccaggagcagcc

SEQ ID NO: 2633204 - DNA, 15 bp, Homo sapiens
tccaggagcagccac

SEQ ID NO: 2633205 - DNA, 18 bp, Homo sapiens
tccaggagcagccacatt

SEQ ID NO: 2633206 - DNA, 15 bp, Homo sapiens
tccaggagcctgtgc

SEQ ID NO: 2633207 - DNA, 15 bp, Homo sapiens
tccaggcacccttct

SEQ ID NO: 2633208 - DNA, 19 bp, Homo sapiens
tccaggcacccttctttcc

SEQ ID NO: 2633209 - DNA, 23 bp, Homo sapiens
tccaggcacccttctttcctctt

SEQ ID NO: 2633210 - DNA, 14 bp, Homo sapiens
tccaggcaggctaa

SEQ ID NO: 2633211 - DNA, 17 bp, Homo sapiens
tccaggccatggaggca

SEQ ID NO: 2633212 - DNA, 21 bp, Homo sapiens
tccaggccccaaaaccacagc

SEQ ID NO: 2633213 - DNA, 22 bp, Homo sapiens
tccaggctctttggggtcagcc

SEQ ID NO: 2633214 - DNA, 18 bp, Homo sapiens
tccaggctgggagagcct

SEQ ID NO: 2633215 - DNA, 21 bp, Homo sapiens
tccaggctgggagagccttcc

SEQ ID NO: 2633216 - DNA, 14 bp, Homo sapiens
tccagggaagctgg

SEQ ID NO: 2633217 - DNA, 18 bp, Homo sapiens
tccagggaagctggccga

SEQ ID NO: 2633218 - DNA, 23 bp, Homo sapiens
tccagggaagctggccgagggtc

SEQ ID NO: 2633219 - DNA, 18 bp, Homo sapiens
tccagggagtcccctccc

SEQ ID NO: 2633220 - DNA, 17 bp, Homo sapiens
tccagggccctgagctc

SEQ ID NO: 2633221 - DNA, 17 bp, Homo sapiens
tccaggggatgggaggt

SEQ ID NO: 2633222 - DNA, 17 bp, Homo sapiens
tccaggggcccctccag

SEQ ID NO: 2633223 - DNA, 18 bp, Homo sapiens
tccaggggcccctccagc

SEQ ID NO: 2633224 - DNA, 23 bp, Homo sapiens
tccaggggtgggacaccctgtga

SEQ ID NO: 2633225 - DNA, 14 bp, Homo sapiens
tccaggtttttcaa

SEQ ID NO: 2633226 - DNA, 21 bp, Homo sapiens
tccaggtttttcaattaaacg

SEQ ID NO: 2633227 - DNA, 23 bp, Homo sapiens
tccaggtttttcaattaaacgga

SEQ ID NO: 2633228 - DNA, 16 bp, Homo sapiens
tccagtccaaggaaac

SEQ ID NO: 2633229 - DNA, 17 bp, Homo sapiens
tccagtccaatctcatg

SEQ ID NO: 2633230 - DNA, 13 bp, Homo sapiens
tccagtctgctgc

SEQ ID NO: 2633231 - DNA, 19 bp, Homo sapiens
tccagtctgctgccctcca

SEQ ID NO: 2633232 - DNA, 15 bp, Homo sapiens
tccagtcttcctgac

SEQ ID NO: 2633233 - DNA, 18 bp, Homo sapiens
tccagtgagcttatcatg

SEQ ID NO: 2633234 - DNA, 14 bp, Homo sapiens
tccagtgcaattgt

SEQ ID NO: 2633235 - DNA, 19 bp, Homo sapiens
tccagtgccaacaatccta

SEQ ID NO: 2633236 - DNA, 14 bp, Homo sapiens
tccagtgccagcaa

SEQ ID NO: 2633237 - DNA, 17 bp, Homo sapiens
tccagtgccagcaatga

SEQ ID NO: 2633238 - DNA, 19 bp, Homo sapiens
tccagtggtgaagaaaact

SEQ ID NO: 2633239 - DNA, 14 bp, Homo sapiens
tccagttagttctc

SEQ ID NO: 2633240 - DNA, 19 bp, Homo sapiens
tccagttcatgagaatcta

SEQ ID NO: 2633241 - DNA, 13 bp, Homo sapiens
tccataaagaagc

SEQ ID NO: 2633242 - DNA, 20 bp, Homo sapiens
tccataaagaagcaataaag

SEQ ID NO: 2633243 - DNA, 21 bp, Homo sapiens
tccataatctggactcctctg

SEQ ID NO: 2633244 - DNA, 12 bp, Homo sapiens
tccataatgtat

SEQ ID NO: 2633245 - DNA, 14 bp, Homo sapiens
tccatagagagcaa

SEQ ID NO: 2633246 - DNA, 17 bp, Homo sapiens
tccatagagagcaagac

SEQ ID NO: 2633247 - DNA, 20 bp, Homo sapiens
tccatatattagcatttagt

SEQ ID NO: 2633248 - DNA, 13 bp, Homo sapiens
tccatatggattt

SEQ ID NO: 2633249 - DNA, 18 bp, Homo sapiens
tccatatggattttctat

SEQ ID NO: 2633250 - DNA, 14 bp, Homo sapiens
tccatcaggccact

SEQ ID NO: 2633251 - DNA, 22 bp, Homo sapiens
tccatccctaccccctaagagc

SEQ ID NO: 2633252 - DNA, 20 bp, Homo sapiens
tccatccttgagtcaaaaaa

SEQ ID NO: 2633253 - DNA, 16 bp, Homo sapiens
tccatctctctggccc

SEQ ID NO: 2633254 - DNA, 15 bp, Homo sapiens
tccatgaaaacgttt

SEQ ID NO: 2633255 - DNA, 15 bp, Homo sapiens
tccatgaaaatgcaa

SEQ ID NO: 2633256 - DNA, 21 bp, Homo sapiens
tccatgaagaccacatccaca

SEQ ID NO: 2633257 - DNA, 22 bp, Homo sapiens
tccatgaagatgtagaggagaa

SEQ ID NO: 2633258 - DNA, 13 bp, Homo sapiens
tccatgaatgtat

SEQ ID NO: 2633259 - DNA, 16 bp, Homo sapiens
tccatgagtcccctgt

SEQ ID NO: 2633260 - DNA, 23 bp, Homo sapiens
tccatgagttttttctcttgggc

SEQ ID NO: 2633261 - DNA, 15 bp, Homo sapiens
tccatgatggagtca

SEQ ID NO: 2633262 - DNA, 16 bp, Homo sapiens
tccatgcctgagggtg

SEQ ID NO: 2633263 - DNA, 19 bp, Homo sapiens
tccatgcgtgtttctgact

SEQ ID NO: 2633264 - DNA, 15 bp, Homo sapiens
tccatggaatgcttg

SEQ ID NO: 2633265 - DNA, 14 bp, Homo sapiens
tccatggactttgt

SEQ ID NO: 2633266 - DNA, 20 bp, Homo sapiens
tccatggccctgcaaaagga

SEQ ID NO: 2633267 - DNA, 22 bp, Homo sapiens
tccatgggcagagcccaaggga

SEQ ID NO: 2633268 - DNA, 14 bp, Homo sapiens
tccatgtactgtag

SEQ ID NO: 2633269 - DNA, 19 bp, Homo sapiens
tccatgtcgcctctgcatt

SEQ ID NO: 2633270 - DNA, 13 bp, Homo sapiens
tccatgtggagaa

SEQ ID NO: 2633271 - DNA, 22 bp, Homo sapiens
tccatgtggagaaaggagtgaa

SEQ ID NO: 2633272 - DNA, 17 bp, Homo sapiens
tccatgtgtggactcaa

SEQ ID NO: 2633273 - DNA, 19 bp, Homo sapiens
tccatgtttgtaaaactac

SEQ ID NO: 2633274 - DNA, 16 bp, Homo sapiens
tccattatcatgtgta

SEQ ID NO: 2633275 - DNA, 17 bp, Homo sapiens
tccattatcatgtgtaa

SEQ ID NO: 2633276 - DNA, 14 bp, Homo sapiens
tccattctggaagt

SEQ ID NO: 2633277 - DNA, 23 bp, Homo sapiens
tccattgtaaaccacaaggctgt

SEQ ID NO: 2633278 - DNA, 21 bp, Homo sapiens
tccattgtttgaaacaaagaa

SEQ ID NO: 2633279 - DNA, 23 bp, Homo sapiens
tccatttcatctatttctgagaa

SEQ ID NO: 2633280 - DNA, 22 bp, Homo sapiens
tcccaaagccttgtgtctacag

SEQ ID NO: 2633281 - DNA, 13 bp, Homo sapiens
tcccaaagtgctg

SEQ ID NO: 2633282 - DNA, 14 bp, Homo sapiens
tcccaaagtgctgg

SEQ ID NO: 2633283 - DNA, 20 bp, Homo sapiens
tcccaaagtgctgggattac

SEQ ID NO: 2633284 - DNA, 18 bp, Homo sapiens
tcccaacaggaggacaat

SEQ ID NO: 2633285 - DNA, 19 bp, Homo sapiens
tcccaacaggaggacaatt

SEQ ID NO: 2633286 - DNA, 14 bp, Homo sapiens
tcccaactcacccc

SEQ ID NO: 2633287 - DNA, 17 bp, Homo sapiens
tcccaactcaccccagc

SEQ ID NO: 2633288 - DNA, 17 bp, Homo sapiens
tcccaagctctgctcct

SEQ ID NO: 2633289 - DNA, 14 bp, Homo sapiens
tcccaagctgggcc

SEQ ID NO: 2633290 - DNA, 15 bp, Homo sapiens
tcccaagctgggccc

SEQ ID NO: 2633291 - DNA, 19 bp, Homo sapiens
tcccaagctgggccccagc

SEQ ID NO: 2633292 - DNA, 13 bp, Homo sapiens
tcccaaggaaagc

SEQ ID NO: 2633293 - DNA, 18 bp, Homo sapiens
tcccaaggctctgagcaa

SEQ ID NO: 2633294 - DNA, 14 bp, Homo sapiens
tcccaagtctacag

SEQ ID NO: 2633295 - DNA, 17 bp, Homo sapiens
tcccaagtgccagtctt

SEQ ID NO: 2633296 - DNA, 21 bp, Homo sapiens
gtgaactgtgagggtaaaggc

SEQ ID NO: 2633297 - DNA, 20 bp, Homo sapiens
gtgaacttggggaacaaggg

SEQ ID NO: 2633298 - DNA, 14 bp, Homo sapiens
gtgaactttttgta

SEQ ID NO: 2633299 - DNA, 14 bp, Homo sapiens
gtgaaggcttctct

SEQ ID NO: 2633300 - DNA, 20 bp, Homo sapiens
gtgaaggtcctgctattact

SEQ ID NO: 2633301 - DNA, 16 bp, Homo sapiens
gtgaagtccttcacct

SEQ ID NO: 2633302 - DNA, 14 bp, Homo sapiens
gtgaatcagagcac

SEQ ID NO: 2633303 - DNA, 14 bp, Homo sapiens
gtgaatggattgga

SEQ ID NO: 2633304 - DNA, 23 bp, Homo sapiens
gtgaattgcctgcagagagaagc

SEQ ID NO: 2633305 - DNA, 19 bp, Homo sapiens
gtgaattgtgaccaagtta

SEQ ID NO: 2633306 - DNA, 13 bp, Homo sapiens
gtgaatttgaatg

SEQ ID NO: 2633307 - DNA, 20 bp, Homo sapiens
gtgacaaggattgctactgt

SEQ ID NO: 2633308 - DNA, 17 bp, Homo sapiens
gtgacaaggccccagag

SEQ ID NO: 2633309 - DNA, 12 bp, Homo sapiens
gtgacaataaaa

SEQ ID NO: 2633310 - DNA, 14 bp, Homo sapiens
gtgacaataaaaca

SEQ ID NO: 2633311 - DNA, 22 bp, Homo sapiens
gtgacacagcagcttcaccaga

SEQ ID NO: 2633312 - DNA, 23 bp, Homo sapiens
gtgacaccagcctttctcccagg

SEQ ID NO: 2633313 - DNA, 18 bp, Homo sapiens
gtgacacttcagagagct

SEQ ID NO: 2633314 - DNA, 20 bp, Homo sapiens
gtgacacttcagagagctgg

SEQ ID NO: 2633315 - DNA, 14 bp, Homo sapiens
gtgacagaggcagc

SEQ ID NO: 2633316 - DNA, 15 bp, Homo sapiens
gtgacagaggcagcc

SEQ ID NO: 2633317 - DNA, 18 bp, Homo sapiens
gtgacagaggcagcccca

SEQ ID NO: 2633318 - DNA, 20 bp, Homo sapiens
gtgacagagtgagactctgt

SEQ ID NO: 2633319 - DNA, 16 bp, Homo sapiens
gtgacaggcagcagag

SEQ ID NO: 2633320 - DNA, 16 bp, Homo sapiens
gtgacagggaagctac

SEQ ID NO: 2633321 - DNA, 18 bp, Homo sapiens
gtgacagggaagctacag

SEQ ID NO: 2633322 - DNA, 19 bp, Homo sapiens
gtgacagggaagctacagg

SEQ ID NO: 2633323 - DNA, 15 bp, Homo sapiens
gtgacagtgcctggg

SEQ ID NO: 2633324 - DNA, 17 bp, Homo sapiens
gtgacagtgcctgggaa

SEQ ID NO: 2633325 - DNA, 23 bp, Homo sapiens
gtgacagtgcctgggaatgtatt

SEQ ID NO: 2633326 - DNA, 22 bp, Homo sapiens
gtgacatgtgaaacctttttta

SEQ ID NO: 2633327 - DNA, 15 bp, Homo sapiens
gtgaccaatgtcttg

SEQ ID NO: 2633328 - DNA, 14 bp, Homo sapiens
gtgaccaggggtga

SEQ ID NO: 2633329 - DNA, 14 bp, Homo sapiens
gtgacccaatgatt

SEQ ID NO: 2633330 - DNA, 19 bp, Homo sapiens
gtgacctgaagttcaccat

SEQ ID NO: 2633331 - DNA, 20 bp, Homo sapiens
gtgaccttagtgtttctgtg

SEQ ID NO: 2633332 - DNA, 15 bp, Homo sapiens
gtgaccttctgggaa

SEQ ID NO: 2633333 - DNA, 18 bp, Homo sapiens
gtgacgctgaataaatgt

SEQ ID NO: 2633334 - DNA, 19 bp, Homo sapiens
gtgacgctgaataaatgtc

SEQ ID NO: 2633335 - DNA, 19 bp, Homo sapiens
gtgactaattgtataacag

SEQ ID NO: 2633336 - DNA, 21 bp, Homo sapiens
gtgactaattgtataacaggt

SEQ ID NO: 2633337 - DNA, 23 bp, Homo sapiens
gtgactaattgtataacaggtta

SEQ ID NO: 2633338 - DNA, 20 bp, Homo sapiens
gtgactatatagagatgttt

SEQ ID NO: 2633339 - DNA, 21 bp, Homo sapiens
gtgactatggagctgagcagg

SEQ ID NO: 2633340 - DNA, 12 bp, Homo sapiens
gtgactccagga

SEQ ID NO: 2633341 - DNA, 15 bp, Homo sapiens
gtgactgtatataaa

SEQ ID NO: 2633342 - DNA, 18 bp, Homo sapiens
gtgactttggctgcatgc

SEQ ID NO: 2633343 - DNA, 14 bp, Homo sapiens
gtgagaataagaga

SEQ ID NO: 2633344 - DNA, 20 bp, Homo sapiens
gtgagacagtccagcctgga

SEQ ID NO: 2633345 - DNA, 16 bp, Homo sapiens
gtgagacagtgggaaa

SEQ ID NO: 2633346 - DNA, 14 bp, Homo sapiens
gtgagacccccaca

SEQ ID NO: 2633347 - DNA, 16 bp, Homo sapiens
gtgagaccctgtctct

SEQ ID NO: 2633348 - DNA, 23 bp, Homo sapiens
gtgagagggcatgcgcacaaggc

SEQ ID NO: 2633349 - DNA, 16 bp, Homo sapiens
gtgagaggggaacaga

SEQ ID NO: 2633350 - DNA, 18 bp, Homo sapiens
gtgagatgcagctggaaa

SEQ ID NO: 2633351 - DNA, 19 bp, Homo sapiens
gtgagcagaagtggagctg

SEQ ID NO: 2633352 - DNA, 13 bp, Homo sapiens
gtgagccactgca

SEQ ID NO: 2633353 - DNA, 20 bp, Homo sapiens
gtgagccaggtaatgaggga

SEQ ID NO: 2633354 - DNA, 18 bp, Homo sapiens
gtgaggaaggcaggaaga

SEQ ID NO: 2633355 - DNA, 17 bp, Homo sapiens
gtgaggagctgctggct

SEQ ID NO: 2633356 - DNA, 14 bp, Homo sapiens
gtgaggccagggca

SEQ ID NO: 2633357 - DNA, 14 bp, Homo sapiens
gtgaggcctggcca

SEQ ID NO: 2633358 - DNA, 16 bp, Homo sapiens
gtgaggctctgccctt

SEQ ID NO: 2633359 - DNA, 18 bp, Homo sapiens
gtgagggtttctgagctg

SEQ ID NO: 2633360 - DNA, 19 bp, Homo sapiens
gtgagtcaccaagcccagt

SEQ ID NO: 2633361 - DNA, 16 bp, Homo sapiens
gtgagtcttggcggca

SEQ ID NO: 2633362 - DNA, 22 bp, Homo sapiens
gtgagtcttggcggcagcagcc

SEQ ID NO: 2633363 - DNA, 15 bp, Homo sapiens
gtgagtgtggctccc

SEQ ID NO: 2633364 - DNA, 22 bp, Homo sapiens
gtgagtgtgtccaagtgtgtgt

SEQ ID NO: 2633365 - DNA, 20 bp, Homo sapiens
gtgagtttagtaaggctgtg

SEQ ID NO: 2633366 - DNA, 14 bp, Homo sapiens
gtgataaactttgc

SEQ ID NO: 2633367 - DNA, 19 bp, Homo sapiens
gtgatatggcagaagacac

SEQ ID NO: 2633368 - DNA, 13 bp, Homo sapiens
gtgatcaaagcca

SEQ ID NO: 2633369 - DNA, 16 bp, Homo sapiens
gtgatcaataaaatgt

SEQ ID NO: 2633370 - DNA, 17 bp, Homo sapiens
gtgatcaattaaatgta

SEQ ID NO: 2633371 - DNA, 17 bp, Homo sapiens
gtgatcacagcagcttc

SEQ ID NO: 2633372 - DNA, 15 bp, Homo sapiens
gtgatccacccacct

SEQ ID NO: 2633373 - DNA, 24 bp, Homo sapiens
gtgatccacccacctcagcctccc

SEQ ID NO: 2633374 - DNA, 18 bp, Homo sapiens
gtgatcctcccacctcag

SEQ ID NO: 2633375 - DNA, 19 bp, Homo sapiens
gtgatccttttatgttatt

SEQ ID NO: 2633376 - DNA, 12 bp, Homo sapiens
gtgatctccata

SEQ ID NO: 2633377 - DNA, 15 bp, Homo sapiens
gtgatctgaacagaa

SEQ ID NO: 2633378 - DNA, 15 bp, Homo sapiens
gtgatgccacacaga

SEQ ID NO: 2633379 - DNA, 19 bp, Homo sapiens
gtgatgccacacagagtgg

SEQ ID NO: 2633380 - DNA, 13 bp, Homo sapiens
gtgatgcctccct

SEQ ID NO: 2633381 - DNA, 13 bp, Homo sapiens
gtgatgcggcaga

SEQ ID NO: 2633382 - DNA, 16 bp, Homo sapiens
gtgatgctcaggcttg

SEQ ID NO: 2633383 - DNA, 17 bp, Homo sapiens
gtgatgggaaagcattg

SEQ ID NO: 2633384 - DNA, 18 bp, Homo sapiens
gtgatggggccctgcctc

SEQ ID NO: 2633385 - DNA, 18 bp, Homo sapiens
gtgattaaacgtgcagac

SEQ ID NO: 2633386 - DNA, 11 bp, Homo sapiens
gtgattaccag

SEQ ID NO: 2633387 - DNA, 16 bp, Homo sapiens
gtgattaccagggact

SEQ ID NO: 2633388 - DNA, 14 bp, Homo sapiens
gtgattcaatctgt

SEQ ID NO: 2633389 - DNA, 21 bp, Homo sapiens
gtgattcaatctgtaaactgt

SEQ ID NO: 2633390 - DNA, 13 bp, Homo sapiens
gtgattctcctgc

SEQ ID NO: 2633391 - DNA, 14 bp, Homo sapiens
gtgattctcctgcc

SEQ ID NO: 2633392 - DNA, 19 bp, Homo sapiens
gtgattctcctgcctcagc

SEQ ID NO: 2633393 - DNA, 22 bp, Homo sapiens
gtgattctcctgcctcagcctc

SEQ ID NO: 2633394 - DNA, 23 bp, Homo sapiens
gtgattctcctgcctcagcctcc

SEQ ID NO: 2633395 - DNA, 16 bp, Homo sapiens
gtatatatgtgtgttt

SEQ ID NO: 2633396 - DNA, 14 bp, Homo sapiens
gtatatattcccaa

SEQ ID NO: 2633397 - DNA, 14 bp, Homo sapiens
gtatatcagaaaag

SEQ ID NO: 2633398 - DNA, 16 bp, Homo sapiens
gtatatgtatgtgtgt

SEQ ID NO: 2633399 - DNA, 15 bp, Homo sapiens
gtatattatttctag

SEQ ID NO: 2633400 - DNA, 14 bp, Homo sapiens
gtatattcatttca

SEQ ID NO: 2633401 - DNA, 14 bp, Homo sapiens
gtatatttgtacaa

SEQ ID NO: 2633402 - DNA, 21 bp, Homo sapiens
gtatattttgggaatcttttc

SEQ ID NO: 2633403 - DNA, 21 bp, Homo sapiens
gtatcaaatattagatgtgat

SEQ ID NO: 2633404 - DNA, 15 bp, Homo sapiens
gtatcagaggcctat

SEQ ID NO: 2633405 - DNA, 16 bp, Homo sapiens
gtatcaggtgctgcca

SEQ ID NO: 2633406 - DNA, 12 bp, Homo sapiens
gtatcatagaaa

SEQ ID NO: 2633407 - DNA, 19 bp, Homo sapiens
gtatcccaactcctataat

SEQ ID NO: 2633408 - DNA, 20 bp, Homo sapiens
gtatcccccccctgtatagt

SEQ ID NO: 2633409 - DNA, 17 bp, Homo sapiens
gtatcctccaggttttt

SEQ ID NO: 2633410 - DNA, 20 bp, Homo sapiens
gtatcctccaggtttttcaa

SEQ ID NO: 2633411 - DNA, 23 bp, Homo sapiens
gtatcctccaggtttttcaatta

SEQ ID NO: 2633412 - DNA, 13 bp, Homo sapiens
gtatcctggggct

SEQ ID NO: 2633413 - DNA, 20 bp, Homo sapiens
gtatcctgtgacatgtaaca

SEQ ID NO: 2633414 - DNA, 16 bp, Homo sapiens
gtatcgtaaccagcca

SEQ ID NO: 2633415 - DNA, 16 bp, Homo sapiens
gtatcgtatagctgta

SEQ ID NO: 2633416 - DNA, 20 bp, Homo sapiens
gtatctagacccatcttctt

SEQ ID NO: 2633417 - DNA, 17 bp, Homo sapiens
gtatctagtgcagctga

SEQ ID NO: 2633418 - DNA, 19 bp, Homo sapiens
gtatctctgaagcatgttt

SEQ ID NO: 2633419 - DNA, 20 bp, Homo sapiens
gtatctctgaagcatgtttc

SEQ ID NO: 2633420 - DNA, 19 bp, Homo sapiens
gtatctggtgactttcctc

SEQ ID NO: 2633421 - DNA, 21 bp, Homo sapiens
gtatcttgggggacagggctg

SEQ ID NO: 2633422 - DNA, 16 bp, Homo sapiens
gtatcttttttcaaaa

SEQ ID NO: 2633423 - DNA, 14 bp, Homo sapiens
gtatgactaaagag

SEQ ID NO: 2633424 - DNA, 18 bp, Homo sapiens
gtatgactaaagagagaa

SEQ ID NO: 2633425 - DNA, 13 bp, Homo sapiens
gtatgaggcattt

SEQ ID NO: 2633426 - DNA, 20 bp, Homo sapiens
gtatgaggcatttgtttgaa

SEQ ID NO: 2633427 - DNA, 20 bp, Homo sapiens
gtatgatcacggctcactgc

SEQ ID NO: 2633428 - DNA, 21 bp, Homo sapiens
gtatgatcacggctcactgca

SEQ ID NO: 2633429 - DNA, 22 bp, Homo sapiens
gtatgatcacggctcactgcag

SEQ ID NO: 2633430 - DNA, 12 bp, Homo sapiens
gtatgcatgtga

SEQ ID NO: 2633431 - DNA, 17 bp, Homo sapiens
gtatgcatgtgaagaaa

SEQ ID NO: 2633432 - DNA, 18 bp, Homo sapiens
gtatgcatgtgaagaaag

SEQ ID NO: 2633433 - DNA, 22 bp, Homo sapiens
gtatgcctttaaatctgtgatg

SEQ ID NO: 2633434 - DNA, 13 bp, Homo sapiens
gtatggagctcag

SEQ ID NO: 2633435 - DNA, 14 bp, Homo sapiens
gtatgggcaaaaaa

SEQ ID NO: 2633436 - DNA, 15 bp, Homo sapiens
gtatggttgacacta

SEQ ID NO: 2633437 - DNA, 11 bp, Homo sapiens
gtatgtataat

SEQ ID NO: 2633438 - DNA, 13 bp, Homo sapiens
gtatgtctccagt

SEQ ID NO: 2633439 - DNA, 15 bp, Homo sapiens
gtatgtggaagtgtg

SEQ ID NO: 2633440 - DNA, 21 bp, Homo sapiens
gtatgtggaagtgtgggtctg

SEQ ID NO: 2633441 - DNA, 19 bp, Homo sapiens
gtatgtgggggtctgtgtg

SEQ ID NO: 2633442 - DNA, 16 bp, Homo sapiens
gtatgtgtttgtgtgt

SEQ ID NO: 2633443 - DNA, 14 bp, Homo sapiens
gtatgtttgcacac

SEQ ID NO: 2633444 - DNA, 14 bp, Homo sapiens
gtatgttttagcat

SEQ ID NO: 2633445 - DNA, 13 bp, Homo sapiens
gtattaaagacag

SEQ ID NO: 2633446 - DNA, 16 bp, Homo sapiens
gtattaagaatgaaat

SEQ ID NO: 2633447 - DNA, 14 bp, Homo sapiens
gtattaatattcat

SEQ ID NO: 2633448 - DNA, 13 bp, Homo sapiens
gtattacactgta

SEQ ID NO: 2633449 - DNA, 14 bp, Homo sapiens
gtattacttctgct

SEQ ID NO: 2633450 - DNA, 15 bp, Homo sapiens
gtattacttctgcta

SEQ ID NO: 2633451 - DNA, 21 bp, Homo sapiens
gtattatgtactctactgata

SEQ ID NO: 2633452 - DNA, 14 bp, Homo sapiens
gtattattttccaa

SEQ ID NO: 2633453 - DNA, 19 bp, Homo sapiens
gtattcccattagaccaag

SEQ ID NO: 2633454 - DNA, 22 bp, Homo sapiens
gtattcgtgcagcatatgagga

SEQ ID NO: 2633455 - DNA, 18 bp, Homo sapiens
gtattctagttttgtcaa

SEQ ID NO: 2633456 - DNA, 11 bp, Homo sapiens
gtattctctga

SEQ ID NO: 2633457 - DNA, 12 bp, Homo sapiens
gtattctctgag

SEQ ID NO: 2633458 - DNA, 17 bp, Homo sapiens
gtattgaagcattttat

SEQ ID NO: 2633459 - DNA, 22 bp, Homo sapiens
gtattgaagcattttataaatc

SEQ ID NO: 2633460 - DNA, 14 bp, Homo sapiens
gtattgaatcatgt

SEQ ID NO: 2633461 - DNA, 12 bp, Homo sapiens
gtattggcctgg

SEQ ID NO: 2633462 - DNA, 22 bp, Homo sapiens
gtattggctagaggttcaaaga

SEQ ID NO: 2633463 - DNA, 17 bp, Homo sapiens
gtattgtaaacatgtgt

SEQ ID NO: 2633464 - DNA, 20 bp, Homo sapiens
gtattgtaccttttaacacc

SEQ ID NO: 2633465 - DNA, 14 bp, Homo sapiens
gtattgttcccagt

SEQ ID NO: 2633466 - DNA, 13 bp, Homo sapiens
gtatttatatatt

SEQ ID NO: 2633467 - DNA, 17 bp, Homo sapiens
gtatttatatatttata

SEQ ID NO: 2633468 - DNA, 21 bp, Homo sapiens
gtatttattccatattcatgt

SEQ ID NO: 2633469 - DNA, 14 bp, Homo sapiens
gtatttatttaaaa

SEQ ID NO: 2633470 - DNA, 17 bp, Homo sapiens
gtatttattttcctccc

SEQ ID NO: 2633471 - DNA, 22 bp, Homo sapiens
gtatttattttcctccccagca

SEQ ID NO: 2633472 - DNA, 16 bp, Homo sapiens
gtatttccagtgcaat

SEQ ID NO: 2633473 - DNA, 14 bp, Homo sapiens
gtatttgaaactga

SEQ ID NO: 2633474 - DNA, 13 bp, Homo sapiens
gtatttgcagttc

SEQ ID NO: 2633475 - DNA, 20 bp, Homo sapiens
gtatttgtgactaattgtat

SEQ ID NO: 2633476 - DNA, 21 bp, Homo sapiens
gtatttgtgactaattgtata

SEQ ID NO: 2633477 - DNA, 17 bp, Homo sapiens
gtccagccctggctgaa

SEQ ID NO: 2633478 - DNA, 23 bp, Homo sapiens
gtccagggaagagaaagtgattt

SEQ ID NO: 2633479 - DNA, 13 bp, Homo sapiens
gtccagggaagct

SEQ ID NO: 2633480 - DNA, 15 bp, Homo sapiens
gtccagggccctgag

SEQ ID NO: 2633481 - DNA, 16 bp, Homo sapiens
gtccagtctcttctgc

SEQ ID NO: 2633482 - DNA, 14 bp, Homo sapiens
gtccagttcccaga

SEQ ID NO: 2633483 - DNA, 19 bp, Homo sapiens
gtccagttcccagaaggca

SEQ ID NO: 2633484 - DNA, 20 bp, Homo sapiens
gtccatggaatgcttgaaaa

SEQ ID NO: 2633485 - DNA, 21 bp, Homo sapiens
gtccatggaatgcttgaaaaa

SEQ ID NO: 2633486 - DNA, 23 bp, Homo sapiens
gtccatgggcagagcccaaggga

SEQ ID NO: 2633487 - DNA, 14 bp, Homo sapiens
gtccatgtgtgtgc

SEQ ID NO: 2633488 - DNA, 16 bp, Homo sapiens
gtccattgtccaatcc

SEQ ID NO: 2633489 - DNA, 23 bp, Homo sapiens
gtcccaacaggaggacaattcat

SEQ ID NO: 2633490 - DNA, 13 bp, Homo sapiens
gtcccaagctggg

SEQ ID NO: 2633491 - DNA, 20 bp, Homo sapiens
gtcccaccatgcagtgcccc

SEQ ID NO: 2633492 - DNA, 15 bp, Homo sapiens
gtcccacccccaccc

SEQ ID NO: 2633493 - DNA, 21 bp, Homo sapiens
gtcccacctcttctcttcctg

SEQ ID NO: 2633494 - DNA, 17 bp, Homo sapiens
gtcccaccttggctgca

SEQ ID NO: 2633495 - DNA, 20 bp, Homo sapiens
gtcccacgaatttgctgggg

SEQ ID NO: 2633496 - DNA, 12 bp, Homo sapiens
gtcccactcaag

SEQ ID NO: 2633497 - DNA, 16 bp, Homo sapiens
gtcccactcaagccaa

SEQ ID NO: 2633498 - DNA, 14 bp, Homo sapiens
gtcccactcagtcc

SEQ ID NO: 2633499 - DNA, 11 bp, Homo sapiens
gtcccactgcc

SEQ ID NO: 2633500 - DNA, 18 bp, Homo sapiens
gtcccactgcctcaggtt

SEQ ID NO: 2633501 - DNA, 19 bp, Homo sapiens
gtcccacttggcatcagct

SEQ ID NO: 2633502 - DNA, 20 bp, Homo sapiens
gtcccagaatgcctcctgca

SEQ ID NO: 2633503 - DNA, 16 bp, Homo sapiens
gtcccagagcaggagg

SEQ ID NO: 2633504 - DNA, 22 bp, Homo sapiens
gtcccagagcaggaggcccctg

SEQ ID NO: 2633505 - DNA, 22 bp, Homo sapiens
gtcccagctactcagaagcctg

SEQ ID NO: 2633506 - DNA, 12 bp, Homo sapiens
gtcccaggcaga

SEQ ID NO: 2633507 - DNA, 17 bp, Homo sapiens
gtcccaggttatctggg

SEQ ID NO: 2633508 - DNA, 11 bp, Homo sapiens
gtcccagtggg

SEQ ID NO: 2633509 - DNA, 18 bp, Homo sapiens
gtcccagtgggaggcgcg

SEQ ID NO: 2633510 - DNA, 18 bp, Homo sapiens
gtcccagtgggaggggca

SEQ ID NO: 2633511 - DNA, 21 bp, Homo sapiens
gtcccagtgggaggggcaggc

SEQ ID NO: 2633512 - DNA, 18 bp, Homo sapiens
gtcccataggcccagtga

SEQ ID NO: 2633513 - DNA, 17 bp, Homo sapiens
gtcccatccaggcagtc

SEQ ID NO: 2633514 - DNA, 17 bp, Homo sapiens
gtcccatgacccacccc

SEQ ID NO: 2633515 - DNA, 19 bp, Homo sapiens
gtcccatgacccacccctg

SEQ ID NO: 2633516 - DNA, 22 bp, Homo sapiens
gtcccatggacactccagtgcc

SEQ ID NO: 2633517 - DNA, 13 bp, Homo sapiens
gtcccatgtggtg

SEQ ID NO: 2633518 - DNA, 22 bp, Homo sapiens
gtccccaccgcagacaggacca

SEQ ID NO: 2633519 - DNA, 15 bp, Homo sapiens
gtccccacctgggac

SEQ ID NO: 2633520 - DNA, 12 bp, Homo sapiens
gtcccccagctc

SEQ ID NO: 2633521 - DNA, 13 bp, Homo sapiens
gtcccccagctct

SEQ ID NO: 2633522 - DNA, 16 bp, Homo sapiens
gtcccccagctctggt

SEQ ID NO: 2633523 - DNA, 22 bp, Homo sapiens
gtcccccatccccatcctccag

SEQ ID NO: 2633524 - DNA, 13 bp, Homo sapiens
gtccccctgacaa

SEQ ID NO: 2633525 - DNA, 16 bp, Homo sapiens
gtcccccttccatgga

SEQ ID NO: 2633526 - DNA, 12 bp, Homo sapiens
gtcccctcacct

SEQ ID NO: 2633527 - DNA, 12 bp, Homo sapiens
gtcccctcccat

SEQ ID NO: 2633528 - DNA, 15 bp, Homo sapiens
gtcccctcccatctg

SEQ ID NO: 2633529 - DNA, 17 bp, Homo sapiens
gtcccctcccatctggg

SEQ ID NO: 2633530 - DNA, 16 bp, Homo sapiens
gtcccctccccggccc

SEQ ID NO: 2633531 - DNA, 18 bp, Homo sapiens
gtcccctgtttgtttctg

SEQ ID NO: 2633532 - DNA, 22 bp, Homo sapiens
gtcccctgtttgtttctgaaag

SEQ ID NO: 2633533 - DNA, 23 bp, Homo sapiens
gtccccttttcttttctacccta

SEQ ID NO: 2633534 - DNA, 19 bp, Homo sapiens
gtcccggggtcctgtggca

SEQ ID NO: 2633535 - DNA, 17 bp, Homo sapiens
gtccctaaagaaaaaaa

SEQ ID NO: 2633536 - DNA, 15 bp, Homo sapiens
gtccctatgcatatc

SEQ ID NO: 2633537 - DNA, 16 bp, Homo sapiens
gtccctcccccttgtc

SEQ ID NO: 2633538 - DNA, 21 bp, Homo sapiens
gtccctcctgggatctgctcg

SEQ ID NO: 2633539 - DNA, 15 bp, Homo sapiens
gtccctggtaataag

SEQ ID NO: 2633540 - DNA, 18 bp, Homo sapiens
gtccctggtggcagctca

SEQ ID NO: 2633541 - DNA, 17 bp, Homo sapiens
gtccctgttttctgagc

SEQ ID NO: 2633542 - DNA, 22 bp, Homo sapiens
gtcccttccacacccccacccc

SEQ ID NO: 2633543 - DNA, 12 bp, Homo sapiens
gtcccttcccct

SEQ ID NO: 2633544 - DNA, 13 bp, Homo sapiens
gtcccttgcagct

SEQ ID NO: 2633545 - DNA, 23 bp, Homo sapiens
gtccctttcgacttgcatttttg

SEQ ID NO: 2633546 - DNA, 22 bp, Homo sapiens
gtccgaaagggacttggaagct

SEQ ID NO: 2633547 - DNA, 21 bp, Homo sapiens
gtccgccctgctcctccctgg

SEQ ID NO: 2633548 - DNA, 23 bp, Homo sapiens
gtccgccctgctcctccctggct

SEQ ID NO: 2633549 - DNA, 23 bp, Homo sapiens
gtccgcgcgccagcacagaaaca

SEQ ID NO: 2633550 - DNA, 13 bp, Homo sapiens
gtcctacccaccc

SEQ ID NO: 2633551 - DNA, 16 bp, Homo sapiens
gtcctacccaccctcc

SEQ ID NO: 2633552 - DNA, 13 bp, Homo sapiens
gtcctactctgtg

SEQ ID NO: 2633553 - DNA, 18 bp, Homo sapiens
gtcctagccactcaggag

SEQ ID NO: 2633554 - DNA, 20 bp, Homo sapiens
gtcctagctgcacagggcag

SEQ ID NO: 2633555 - DNA, 22 bp, Homo sapiens
gtcctaggccacaccatctcct

SEQ ID NO: 2633556 - DNA, 17 bp, Homo sapiens
ggtgggctgagccctgg

SEQ ID NO: 2633557 - DNA, 18 bp, Homo sapiens
ggtgggctgagccctggc

SEQ ID NO: 2633558 - DNA, 14 bp, Homo sapiens
ggtgggcttcccag

SEQ ID NO: 2633559 - DNA, 20 bp, Homo sapiens
ggtgggtccaggggcccctc

SEQ ID NO: 2633560 - DNA, 19 bp, Homo sapiens
ggtggtcactggaactcag

SEQ ID NO: 2633561 - DNA, 19 bp, Homo sapiens
ggtggtcctgactcaacat

SEQ ID NO: 2633562 - DNA, 17 bp, Homo sapiens
ggtggtcctgagacctg

SEQ ID NO: 2633563 - DNA, 16 bp, Homo sapiens
ggtggtctgcaggcag

SEQ ID NO: 2633564 - DNA, 17 bp, Homo sapiens
ggtggtctgcaggcagg

SEQ ID NO: 2633565 - DNA, 15 bp, Homo sapiens
ggtggtgacctctgc

SEQ ID NO: 2633566 - DNA, 20 bp, Homo sapiens
ggtggtgctgggactgagcc

SEQ ID NO: 2633567 - DNA, 17 bp, Homo sapiens
ggtggtggcactgagcc

SEQ ID NO: 2633568 - DNA, 13 bp, Homo sapiens
ggtggtggggagg

SEQ ID NO: 2633569 - DNA, 14 bp, Homo sapiens
ggtggtggggaggg

SEQ ID NO: 2633570 - DNA, 18 bp, Homo sapiens
ggtgtaataagacataac

SEQ ID NO: 2633571 - DNA, 22 bp, Homo sapiens
ggtgtatttattttcctcccca

SEQ ID NO: 2633572 - DNA, 15 bp, Homo sapiens
ggtgtcacttactgt

SEQ ID NO: 2633573 - DNA, 20 bp, Homo sapiens
ggtgtcaggctgctggcgcc

SEQ ID NO: 2633574 - DNA, 20 bp, Homo sapiens
ggtgtgaaagtcagatgccc

SEQ ID NO: 2633575 - DNA, 16 bp, Homo sapiens
ggtgtgaccactgcag

SEQ ID NO: 2633576 - DNA, 15 bp, Homo sapiens
ggtgtgacctgaggg

SEQ ID NO: 2633577 - DNA, 18 bp, Homo sapiens
ggtgtgagtcaccaagcc

SEQ ID NO: 2633578 - DNA, 15 bp, Homo sapiens
ggtgtgatcgtctga

SEQ ID NO: 2633579 - DNA, 13 bp, Homo sapiens
ggtgtgcctgcag

SEQ ID NO: 2633580 - DNA, 14 bp, Homo sapiens
ggtgtgcctgcagc

SEQ ID NO: 2633581 - DNA, 23 bp, Homo sapiens
ggtgtggagaagcggctggcagc

SEQ ID NO: 2633582 - DNA, 12 bp, Homo sapiens
ggtgtggctcct

SEQ ID NO: 2633583 - DNA, 12 bp, Homo sapiens
ggtgtgtctgct

SEQ ID NO: 2633584 - DNA, 19 bp, Homo sapiens
ggtgtgttccaactgcccc

SEQ ID NO: 2633585 - DNA, 15 bp, Homo sapiens
ggtgttgtatgcctt

SEQ ID NO: 2633586 - DNA, 23 bp, Homo sapiens
ggtgtttctccctctcactgtct

SEQ ID NO: 2633587 - DNA, 21 bp, Homo sapiens
ggttaagcattaccactcagg

SEQ ID NO: 2633588 - DNA, 23 bp, Homo sapiens
ggttaagtctgttttatgacttc

SEQ ID NO: 2633589 - DNA, 13 bp, Homo sapiens
ggttacaacagat

SEQ ID NO: 2633590 - DNA, 20 bp, Homo sapiens
ggttaggagttcgagaccag

SEQ ID NO: 2633591 - DNA, 15 bp, Homo sapiens
ggttatctgtcccag

SEQ ID NO: 2633592 - DNA, 20 bp, Homo sapiens
ggttattgaaaatatgatgt

SEQ ID NO: 2633593 - DNA, 13 bp, Homo sapiens
ggttatttctctg

SEQ ID NO: 2633594 - DNA, 19 bp, Homo sapiens
ggttattttagtttctgtt

SEQ ID NO: 2633595 - DNA, 23 bp, Homo sapiens
ggttattttagtttctgttctgt

SEQ ID NO: 2633596 - DNA, 21 bp, Homo sapiens
ggttcaagcgattcttctgct

SEQ ID NO: 2633597 - DNA, 21 bp, Homo sapiens
ggttcacgcctgtaatcccag

SEQ ID NO: 2633598 - DNA, 22 bp, Homo sapiens
ggttcagggttggcccctgccc

SEQ ID NO: 2633599 - DNA, 21 bp, Homo sapiens
ggttcataggtcactggctct

SEQ ID NO: 2633600 - DNA, 18 bp, Homo sapiens
ggttcattattggaatta

SEQ ID NO: 2633601 - DNA, 23 bp, Homo sapiens
ggttcatttcaaatacatctttg

SEQ ID NO: 2633602 - DNA, 15 bp, Homo sapiens
ggttccatgcctgag

SEQ ID NO: 2633603 - DNA, 14 bp, Homo sapiens
ggttcccccagccc

SEQ ID NO: 2633604 - DNA, 16 bp, Homo sapiens
ggttcttagtgtcact

SEQ ID NO: 2633605 - DNA, 17 bp, Homo sapiens
ggttcttggtagagatt

SEQ ID NO: 2633606 - DNA, 22 bp, Homo sapiens
ggttcttgtattaagaatgaaa

SEQ ID NO: 2633607 - DNA, 17 bp, Homo sapiens
ggttctttcttcctctg

SEQ ID NO: 2633608 - DNA, 15 bp, Homo sapiens
ggttctttggaagga

SEQ ID NO: 2633609 - DNA, 18 bp, Homo sapiens
ggttgaggggctcctgga

SEQ ID NO: 2633610 - DNA, 21 bp, Homo sapiens
ggttgaggtccagccctggct

SEQ ID NO: 2633611 - DNA, 18 bp, Homo sapiens
ggttgcagtgagccaaga

SEQ ID NO: 2633612 - DNA, 16 bp, Homo sapiens
ggttgcggggggaggg

SEQ ID NO: 2633613 - DNA, 16 bp, Homo sapiens
ggttgctggttgctgt

SEQ ID NO: 2633614 - DNA, 21 bp, Homo sapiens
ggttggaagctagctcccctc

SEQ ID NO: 2633615 - DNA, 15 bp, Homo sapiens
ggttggctgggccca

SEQ ID NO: 2633616 - DNA, 19 bp, Homo sapiens
ggttggctgggcccagaag

SEQ ID NO: 2633617 - DNA, 23 bp, Homo sapiens
ggttgggattgggggctggtgcc

SEQ ID NO: 2633618 - DNA, 17 bp, Homo sapiens
ggttgggcccagatctg

SEQ ID NO: 2633619 - DNA, 19 bp, Homo sapiens
ggttggtcctcttgcctcc

SEQ ID NO: 2633620 - DNA, 15 bp, Homo sapiens
ggttgtattctttga

SEQ ID NO: 2633621 - DNA, 16 bp, Homo sapiens
ggttgtattctttgat

SEQ ID NO: 2633622 - DNA, 20 bp, Homo sapiens
ggttgtattctttgatgtta

SEQ ID NO: 2633623 - DNA, 10 bp, Homo sapiens
ggttgtcaat

SEQ ID NO: 2633624 - DNA, 14 bp, Homo sapiens
ggttgtgaggcctg

SEQ ID NO: 2633625 - DNA, 19 bp, Homo sapiens
ggtttaaacttctctgaag

SEQ ID NO: 2633626 - DNA, 17 bp, Homo sapiens
ggtttaactcagatcac

SEQ ID NO: 2633627 - DNA, 22 bp, Homo sapiens
ggtttacattcatctcattcca

SEQ ID NO: 2633628 - DNA, 16 bp, Homo sapiens
ggtttagaaagcttgc

SEQ ID NO: 2633629 - DNA, 17 bp, Homo sapiens
ggtttcgtttctgtata

SEQ ID NO: 2633630 - DNA, 17 bp, Homo sapiens
ggtttgaagcctggaac

SEQ ID NO: 2633631 - DNA, 15 bp, Homo sapiens
ggtttggaatgcttc

SEQ ID NO: 2633632 - DNA, 12 bp, Homo sapiens
ggtttggacccc

SEQ ID NO: 2633633 - DNA, 20 bp, Homo sapiens
ggtttggaccccagctggga

SEQ ID NO: 2633634 - DNA, 17 bp, Homo sapiens
ggtttggcgggccaagg

SEQ ID NO: 2633635 - DNA, 19 bp, Homo sapiens
ggtttgtgtttgagtttta

SEQ ID NO: 2633636 - DNA, 22 bp, Homo sapiens
ggtttgtttagaagaagtgtgt

SEQ ID NO: 2633637 - DNA, 12 bp, Homo sapiens
ggttttaatgta

SEQ ID NO: 2633638 - DNA, 19 bp, Homo sapiens
ggttttattgtttaaaatc

SEQ ID NO: 2633639 - DNA, 14 bp, Homo sapiens
ggttttctggatgg

SEQ ID NO: 2633640 - DNA, 15 bp, Homo sapiens
ggttttctgggtgtc

SEQ ID NO: 2633641 - DNA, 15 bp, Homo sapiens
ggttttctgttcttt

SEQ ID NO: 2633642 - DNA, 20 bp, Homo sapiens
ggttttgtaagatgctgggt

SEQ ID NO: 2633643 - DNA, 16 bp, Homo sapiens
ggtttttaaaacccag

SEQ ID NO: 2633644 - DNA, 14 bp, Homo sapiens
ggttttttaatata

SEQ ID NO: 2633645 - DNA, 21 bp, Homo sapiens
ggtttttttgtactttgtaca

SEQ ID NO: 2633646 - DNA, 13 bp, Homo sapiens
gtaaaaaaaaatg

SEQ ID NO: 2633647 - DNA, 19 bp, Homo sapiens
gtaaaaaaaaatgcctttg

SEQ ID NO: 2633648 - DNA, 20 bp, Homo sapiens
gtaaaaaaaaatgcctttga

SEQ ID NO: 2633649 - DNA, 21 bp, Homo sapiens
gtaaaaacagcattgctttct

SEQ ID NO: 2633650 - DNA, 16 bp, Homo sapiens
gtaaaaccacagcagt

SEQ ID NO: 2633651 - DNA, 23 bp, Homo sapiens
gtaaaaccacagcagttgaaaag

SEQ ID NO: 2633652 - DNA, 17 bp, Homo sapiens
gtaaaagataacaagat

SEQ ID NO: 2633653 - DNA, 22 bp, Homo sapiens
gtaaaaggccaaacctctgttc

SEQ ID NO: 2633654 - DNA, 17 bp, Homo sapiens
gtaaaaggtattaaatt

SEQ ID NO: 2633655 - DNA, 18 bp, Homo sapiens
gtaaaatattttgaatca

SEQ ID NO: 2633656 - DNA, 14 bp, Homo sapiens
ggtactctcctaga

SEQ ID NO: 2633657 - DNA, 16 bp, Homo sapiens
ggtactctcctagaga

SEQ ID NO: 2633658 - DNA, 22 bp, Homo sapiens
ggtacttttatgatgtatattt

SEQ ID NO: 2633659 - DNA, 23 bp, Homo sapiens
ggtacttttatgatgtatattta

SEQ ID NO: 2633660 - DNA, 18 bp, Homo sapiens
ggtagatcacgagatcaa

SEQ ID NO: 2633661 - DNA, 14 bp, Homo sapiens
ggtagcagctggac

SEQ ID NO: 2633662 - DNA, 16 bp, Homo sapiens
ggtagccatcatggat

SEQ ID NO: 2633663 - DNA, 14 bp, Homo sapiens
ggtagcttttccct

SEQ ID NO: 2633664 - DNA, 13 bp, Homo sapiens
ggtaggtggcaca

SEQ ID NO: 2633665 - DNA, 19 bp, Homo sapiens
ggtagttagtagcatgttg

SEQ ID NO: 2633666 - DNA, 17 bp, Homo sapiens
ggtataatggttgactg

SEQ ID NO: 2633667 - DNA, 13 bp, Homo sapiens
ggtatattcattt

SEQ ID NO: 2633668 - DNA, 12 bp, Homo sapiens
ggtatctccagg

SEQ ID NO: 2633669 - DNA, 13 bp, Homo sapiens
ggtatctccagga

SEQ ID NO: 2633670 - DNA, 16 bp, Homo sapiens
ggtatctccaggattg

SEQ ID NO: 2633671 - DNA, 23 bp, Homo sapiens
ggtatctccaggattgaagagca

SEQ ID NO: 2633672 - DNA, 16 bp, Homo sapiens
ggtatctgttctttaa

SEQ ID NO: 2633673 - DNA, 22 bp, Homo sapiens
ggtatgatcacggctcactgca

SEQ ID NO: 2633674 - DNA, 18 bp, Homo sapiens
ggtattccttttgtgtac

SEQ ID NO: 2633675 - DNA, 19 bp, Homo sapiens
ggtattccttttgtgtaca

SEQ ID NO: 2633676 - DNA, 14 bp, Homo sapiens
ggtatttataatat

SEQ ID NO: 2633677 - DNA, 20 bp, Homo sapiens
ggtattttcccccttttctg

SEQ ID NO: 2633678 - DNA, 19 bp, Homo sapiens
ggtcaacatggtgaaaccc

SEQ ID NO: 2633679 - DNA, 17 bp, Homo sapiens
ggtcaatcctgtgggtg

SEQ ID NO: 2633680 - DNA, 22 bp, Homo sapiens
ggtcacaaatcctaaaagaagc

SEQ ID NO: 2633681 - DNA, 17 bp, Homo sapiens
ggtcacattcaggaaga

SEQ ID NO: 2633682 - DNA, 13 bp, Homo sapiens
ggtcactcctggg

SEQ ID NO: 2633683 - DNA, 12 bp, Homo sapiens
ggtcactctggc

SEQ ID NO: 2633684 - DNA, 22 bp, Homo sapiens
ggtcactcttcctgcaaggact

SEQ ID NO: 2633685 - DNA, 12 bp, Homo sapiens
ggtcactgctgt

SEQ ID NO: 2633686 - DNA, 13 bp, Homo sapiens
ggtcactgctgtc

SEQ ID NO: 2633687 - DNA, 18 bp, Homo sapiens
ggtcactggctctccaag

SEQ ID NO: 2633688 - DNA, 11 bp, Homo sapiens
ggtcagagcct

SEQ ID NO: 2633689 - DNA, 13 bp, Homo sapiens
ggagatggagttc

SEQ ID NO: 2633690 - DNA, 18 bp, Homo sapiens
ggagatgggccttttgga

SEQ ID NO: 2633691 - DNA, 16 bp, Homo sapiens
ggagatgtagcaaaac

SEQ ID NO: 2633692 - DNA, 14 bp, Homo sapiens
ggagatgtcttcgt

SEQ ID NO: 2633693 - DNA, 14 bp, Homo sapiens
ggagattcagactg

SEQ ID NO: 2633694 - DNA, 19 bp, Homo sapiens
ggagattttaggtgttgat

SEQ ID NO: 2633695 - DNA, 14 bp, Homo sapiens
ggagcaaaggctga

SEQ ID NO: 2633696 - DNA, 17 bp, Homo sapiens
ggagcaaagtgagggcc

SEQ ID NO: 2633697 - DNA, 16 bp, Homo sapiens
ggagcaaatgtttctg

SEQ ID NO: 2633698 - DNA, 15 bp, Homo sapiens
ggagcactggagtgc

SEQ ID NO: 2633699 - DNA, 12 bp, Homo sapiens
ggagcagaactg

SEQ ID NO: 2633700 - DNA, 23 bp, Homo sapiens
ggagcagaatcagtattgggagc

SEQ ID NO: 2633701 - DNA, 15 bp, Homo sapiens
ggagcagaccacccc

SEQ ID NO: 2633702 - DNA, 12 bp, Homo sapiens
ggagcagagggg

SEQ ID NO: 2633703 - DNA, 13 bp, Homo sapiens
ggagcagccacat

SEQ ID NO: 2633704 - DNA, 13 bp, Homo sapiens
ggagcagcctcag

SEQ ID NO: 2633705 - DNA, 18 bp, Homo sapiens
ggagcagtgcaggcacag

SEQ ID NO: 2633706 - DNA, 18 bp, Homo sapiens
ggagcagtgtcttccata

SEQ ID NO: 2633707 - DNA, 17 bp, Homo sapiens
ggagcatccacctcctt

SEQ ID NO: 2633708 - DNA, 18 bp, Homo sapiens
ggagcatccacctccttc

SEQ ID NO: 2633709 - DNA, 19 bp, Homo sapiens
ggagcatccacctccttct

SEQ ID NO: 2633710 - DNA, 17 bp, Homo sapiens
ggagcatggctgtgagg

SEQ ID NO: 2633711 - DNA, 20 bp, Homo sapiens
ggagccaacagaagcttcca

SEQ ID NO: 2633712 - DNA, 15 bp, Homo sapiens
ggagccaactgctgc

SEQ ID NO: 2633713 - DNA, 18 bp, Homo sapiens
ggagccactaactagagc

SEQ ID NO: 2633714 - DNA, 19 bp, Homo sapiens
ggagccactcctctgactc

SEQ ID NO: 2633715 - DNA, 16 bp, Homo sapiens
ggagccccagccccct

SEQ ID NO: 2633716 - DNA, 16 bp, Homo sapiens
ggagccccattcctgg

SEQ ID NO: 2633717 - DNA, 17 bp, Homo sapiens
ggagccccattcctggg

SEQ ID NO: 2633718 - DNA, 13 bp, Homo sapiens
ggagcccccgccc

SEQ ID NO: 2633719 - DNA, 20 bp, Homo sapiens
ggagcccccgccccgcccca

SEQ ID NO: 2633720 - DNA, 13 bp, Homo sapiens
ggagcccctgggt

SEQ ID NO: 2633721 - DNA, 21 bp, Homo sapiens
ggagcccgcacccccaccctt

SEQ ID NO: 2633722 - DNA, 13 bp, Homo sapiens
ggagcccttgggt

SEQ ID NO: 2633723 - DNA, 13 bp, Homo sapiens
ggagccgctggca

SEQ ID NO: 2633724 - DNA, 20 bp, Homo sapiens
ggagccgctggcagaaggga

SEQ ID NO: 2633725 - DNA, 18 bp, Homo sapiens
ggagccgggtctgcctct

SEQ ID NO: 2633726 - DNA, 19 bp, Homo sapiens
ggagcctcatccgaggcag

SEQ ID NO: 2633727 - DNA, 22 bp, Homo sapiens
ggagcctgcaaactcactgctc

SEQ ID NO: 2633728 - DNA, 12 bp, Homo sapiens
ggagcctggtgc

SEQ ID NO: 2633729 - DNA, 15 bp, Homo sapiens
ggagcgcacctgccc

SEQ ID NO: 2633730 - DNA, 21 bp, Homo sapiens
ggagcgcacctgccccctggt

SEQ ID NO: 2633731 - DNA, 16 bp, Homo sapiens
ggagcgggacctgtgg

SEQ ID NO: 2633732 - DNA, 18 bp, Homo sapiens
ggagctaacactggcccc

SEQ ID NO: 2633733 - DNA, 19 bp, Homo sapiens
ggagctaacactggcccct

SEQ ID NO: 2633734 - DNA, 22 bp, Homo sapiens
ggagctatcaggaacagctatg

SEQ ID NO: 2633735 - DNA, 23 bp, Homo sapiens
ggagctcactgtggtgtctgtgt

SEQ ID NO: 2633736 - DNA, 13 bp, Homo sapiens
ggagctcctctcc

SEQ ID NO: 2633737 - DNA, 19 bp, Homo sapiens
ggagctcctctcctggagg

SEQ ID NO: 2633738 - DNA, 16 bp, Homo sapiens
ggagctgagtggggga

SEQ ID NO: 2633739 - DNA, 21 bp, Homo sapiens
ggagctgcctgttcagctcca

SEQ ID NO: 2633740 - DNA, 22 bp, Homo sapiens
ggagctgcctgttcagctccag

SEQ ID NO: 2633741 - DNA, 23 bp, Homo sapiens
ggagctgctggcttgcagtgcgc

SEQ ID NO: 2633742 - DNA, 18 bp, Homo sapiens
ggagctggccccgccgcc

SEQ ID NO: 2633743 - DNA, 20 bp, Homo sapiens
ggagctggccccgccgcctg

SEQ ID NO: 2633744 - DNA, 21 bp, Homo sapiens
ggagctggccgtgggcctggg

SEQ ID NO: 2633745 - DNA, 19 bp, Homo sapiens
ggagctgggcagaaggcca

SEQ ID NO: 2633746 - DNA, 12 bp, Homo sapiens
ggaggaagagaa

SEQ ID NO: 2633747 - DNA, 19 bp, Homo sapiens
ggaggaaggaaacccagct

SEQ ID NO: 2633748 - DNA, 11 bp, Homo sapiens
ggaggaaggat

SEQ ID NO: 2633749 - DNA, 21 bp, Homo sapiens
ggaggaatcgaggaaccagag

SEQ ID NO: 2633750 - DNA, 23 bp, Homo sapiens
ggaggaatcgaggaaccagagcc

SEQ ID NO: 2633751 - DNA, 21 bp, Homo sapiens
ggaggactagaacctggaggg

SEQ ID NO: 2633752 - DNA, 17 bp, Homo sapiens
ggaggagcaaaggctga

SEQ ID NO: 2633753 - DNA, 17 bp, Homo sapiens
ggaggagcagtgcaggc

SEQ ID NO: 2633754 - DNA, 14 bp, Homo sapiens
ggaggaggccacct

SEQ ID NO: 2633755 - DNA, 15 bp, Homo sapiens
ggaggaggccacctc

SEQ ID NO: 2633756 - DNA, 22 bp, Homo sapiens
ggaggaggccacctctccaagg

SEQ ID NO: 2633757 - DNA, 12 bp, Homo sapiens
ggaggaggcctg

SEQ ID NO: 2633758 - DNA, 20 bp, Homo sapiens
ggaggaggtggcagccctgt

SEQ ID NO: 2633759 - DNA, 17 bp, Homo sapiens
ggaggatctcttgagcc

SEQ ID NO: 2633760 - DNA, 15 bp, Homo sapiens
ggaggatgttctggg

SEQ ID NO: 2633761 - DNA, 18 bp, Homo sapiens
ggaggatgttctgggaca

SEQ ID NO: 2633762 - DNA, 17 bp, Homo sapiens
ggaggattctatgaggc

SEQ ID NO: 2633763 - DNA, 23 bp, Homo sapiens
ggaggcaagaggggtggagactg

SEQ ID NO: 2633764 - DNA, 20 bp, Homo sapiens
ggaggccaaggtgggaggat

SEQ ID NO: 2633765 - DNA, 11 bp, Homo sapiens
ggaggccagcc

SEQ ID NO: 2633766 - DNA, 13 bp, Homo sapiens
ggaggccagccag

SEQ ID NO: 2633767 - DNA, 17 bp, Homo sapiens
ggaggccattgtgtgag

SEQ ID NO: 2633768 - DNA, 18 bp, Homo sapiens
ggaggcccctggcccagc

SEQ ID NO: 2633769 - DNA, 22 bp, Homo sapiens
ggaggcccctggcccagcggcc

SEQ ID NO: 2633770 - DNA, 17 bp, Homo sapiens
ggaggcccgtccggcag

SEQ ID NO: 2633771 - DNA, 14 bp, Homo sapiens
ggaggcctgggggc

SEQ ID NO: 2633772 - DNA, 15 bp, Homo sapiens
ggaggctccagaggg

SEQ ID NO: 2633773 - DNA, 16 bp, Homo sapiens
ggaggctccagagggc

SEQ ID NO: 2633774 - DNA, 13 bp, Homo sapiens
ggaggctgaggcg

SEQ ID NO: 2633775 - DNA, 12 bp, Homo sapiens
ggaggctgcccc

SEQ ID NO: 2633776 - DNA, 13 bp, Homo sapiens
ggaggctggcagg

SEQ ID NO: 2633777 - DNA, 17 bp, Homo sapiens
ggaggcttgtcagagct

SEQ ID NO: 2633778 - DNA, 16 bp, Homo sapiens
ggagggagcagacagg

SEQ ID NO: 2633779 - DNA, 21 bp, Homo sapiens
ggagggatgctgcctgagtca

SEQ ID NO: 2633780 - DNA, 23 bp, Homo sapiens
ggagggcaagggccatgctgaag

SEQ ID NO: 2633781 - DNA, 13 bp, Homo sapiens
ggagggcagcagg

SEQ ID NO: 2633782 - DNA, 16 bp, Homo sapiens
ggagggcagcagggct

SEQ ID NO: 2633783 - DNA, 19 bp, Homo sapiens
ggagggctagaactggaga

SEQ ID NO: 2633784 - DNA, 12 bp, Homo sapiens
ggagggctccag

SEQ ID NO: 2633785 - DNA, 14 bp, Homo sapiens
ggagggctccagac

SEQ ID NO: 2633786 - DNA, 17 bp, Homo sapiens
ggagggctccagacaca

SEQ ID NO: 2633787 - DNA, 16 bp, Homo sapiens
ggagggctggaatctg

SEQ ID NO: 2633788 - DNA, 21 bp, Homo sapiens
ggaggggactatttatgaagg

SEQ ID NO: 2633789 - DNA, 18 bp, Homo sapiens
ggagggggtttgggggct

SEQ ID NO: 2633790 - DNA, 15 bp, Homo sapiens
ggaggggtgtggctc

SEQ ID NO: 2633791 - DNA, 15 bp, Homo sapiens
ggagggtggcaggtg

SEQ ID NO: 2633792 - DNA, 23 bp, Homo sapiens
ggaggtcacattcaggaagatga

SEQ ID NO: 2633793 - DNA, 22 bp, Homo sapiens
ggaggtgcttaagcagaagcat

SEQ ID NO: 2633794 - DNA, 20 bp, Homo sapiens
ggaggtggaggttgcagtga

SEQ ID NO: 2633795 - DNA, 23 bp, Homo sapiens
ggaggtgggatcctccaggtgca

SEQ ID NO: 2633796 - DNA, 19 bp, Homo sapiens
ggaggttaaggctgaggaa

SEQ ID NO: 2633797 - DNA, 12 bp, Homo sapiens
ggaggttgataa

SEQ ID NO: 2633798 - DNA, 14 bp, Homo sapiens
ggagtcagagagaa

SEQ ID NO: 2633799 - DNA, 23 bp, Homo sapiens
ggagtcatctcaaccatcccctc

SEQ ID NO: 2633800 - DNA, 21 bp, Homo sapiens
ggagtcccctccccggcccta

SEQ ID NO: 2633801 - DNA, 23 bp, Homo sapiens
ggagtcccctccccggccctacc

SEQ ID NO: 2633802 - DNA, 15 bp, Homo sapiens
ggagtcccgtcagga

SEQ ID NO: 2633803 - DNA, 14 bp, Homo sapiens
ggagtctgaagcag

SEQ ID NO: 2633804 - DNA, 15 bp, Homo sapiens
ggagtctgaagcaga

SEQ ID NO: 2633805 - DNA, 21 bp, Homo sapiens
ggagtgaaacctttagggcag

SEQ ID NO: 2633806 - DNA, 16 bp, Homo sapiens
ggagtgaagaggggca

SEQ ID NO: 2633807 - DNA, 20 bp, Homo sapiens
ggagtgaagaggggcagccc

SEQ ID NO: 2633808 - DNA, 22 bp, Homo sapiens
ggagtgaagaggggcagccctt

SEQ ID NO: 2633809 - DNA, 17 bp, Homo sapiens
ggagtgacagaggcagc

SEQ ID NO: 2633810 - DNA, 21 bp, Homo sapiens
ggagtgacagaggcagcccca

SEQ ID NO: 2633811 - DNA, 21 bp, Homo sapiens
ggagtgaggaaggcaggaaga

SEQ ID NO: 2633812 - DNA, 21 bp, Homo sapiens
ggagtgagtgtggctcccctc

SEQ ID NO: 2633813 - DNA, 14 bp, Homo sapiens
ggagtgcagtgagc

SEQ ID NO: 2633814 - DNA, 13 bp, Homo sapiens
ggagtggagtgga

SEQ ID NO: 2633815 - DNA, 12 bp, Homo sapiens
ggagtgggacag

SEQ ID NO: 2633816 - DNA, 16 bp, Homo sapiens
ggagtggggcagtaga

SEQ ID NO: 2633817 - DNA, 22 bp, Homo sapiens
ggagtgtgtaatttaaaattgt

SEQ ID NO: 2633818 - DNA, 19 bp, Homo sapiens
ggagtgtgtattgttccca

SEQ ID NO: 2633819 - DNA, 15 bp, Homo sapiens
ggagttagaggccag

SEQ ID NO: 2633820 - DNA, 16 bp, Homo sapiens
ggagttagaggccagc

SEQ ID NO: 2633821 - DNA, 18 bp, Homo sapiens
ggagttagaggccagcct

SEQ ID NO: 2633822 - DNA, 14 bp, Homo sapiens
ggagttcaatgatc

SEQ ID NO: 2633823 - DNA, 17 bp, Homo sapiens
ggagttcaatgatctag

SEQ ID NO: 2633824 - DNA, 20 bp, Homo sapiens
ggagttcagtggtgtgatct

SEQ ID NO: 2633825 - DNA, 19 bp, Homo sapiens
ggagttccatgaagaccac

SEQ ID NO: 2633826 - DNA, 16 bp, Homo sapiens
ggagtttctttcctgc

SEQ ID NO: 2633827 - DNA, 20 bp, Homo sapiens
ggagtttttgtttggagagc

SEQ ID NO: 2633828 - DNA, 14 bp, Homo sapiens
ggataaaatgaggt

SEQ ID NO: 2633829 - DNA, 15 bp, Homo sapiens
ggataaagccactga

SEQ ID NO: 2633830 - DNA, 21 bp, Homo sapiens
ggatacgcatcagacagatgg

SEQ ID NO: 2633831 - DNA, 18 bp, Homo sapiens
ggatactctgtcagatgg

SEQ ID NO: 2633832 - DNA, 16 bp, Homo sapiens
ggatactgcccggggc

SEQ ID NO: 2633833 - DNA, 13 bp, Homo sapiens
ggatagcattttt

SEQ ID NO: 2633834 - DNA, 23 bp, Homo sapiens
gctcagcaaaagatgcttctcac

SEQ ID NO: 2633835 - DNA, 11 bp, Homo sapiens
gctcagcagct

SEQ ID NO: 2633836 - DNA, 16 bp, Homo sapiens
gctcagccctgactgg

SEQ ID NO: 2633837 - DNA, 19 bp, Homo sapiens
gctcagccctgactggtgc

SEQ ID NO: 2633838 - DNA, 20 bp, Homo sapiens
gctcagccctgactggtgct

SEQ ID NO: 2633839 - DNA, 11 bp, Homo sapiens
gctcagcctgg

SEQ ID NO: 2633840 - DNA, 14 bp, Homo sapiens
gctcagcctggtgg

SEQ ID NO: 2633841 - DNA, 19 bp, Homo sapiens
gctcagcctggtgggcctc

SEQ ID NO: 2633842 - DNA, 20 bp, Homo sapiens
gctcagcctggtgggcctcc

SEQ ID NO: 2633843 - DNA, 15 bp, Homo sapiens
gctcagcggggacag

SEQ ID NO: 2633844 - DNA, 16 bp, Homo sapiens
gctcagcggggacagc

SEQ ID NO: 2633845 - DNA, 21 bp, Homo sapiens
gctcagcggggacagctcctt

SEQ ID NO: 2633846 - DNA, 20 bp, Homo sapiens
gctcagctactgatttttgt

SEQ ID NO: 2633847 - DNA, 11 bp, Homo sapiens
gctcaggaaaa

SEQ ID NO: 2633848 - DNA, 16 bp, Homo sapiens
gctcaggaccaggcaa

SEQ ID NO: 2633849 - DNA, 15 bp, Homo sapiens
gctcaggaggcttgg

SEQ ID NO: 2633850 - DNA, 22 bp, Homo sapiens
gctcaggcgatccacctgtctc

SEQ ID NO: 2633851 - DNA, 16 bp, Homo sapiens
gctcagggcctggctc

SEQ ID NO: 2633852 - DNA, 20 bp, Homo sapiens
gctcagggcctggctcaggt

SEQ ID NO: 2633853 - DNA, 22 bp, Homo sapiens
gctcaggtggggtcactctggc

SEQ ID NO: 2633854 - DNA, 23 bp, Homo sapiens
gctcaggtggggtcactctggca

SEQ ID NO: 2633855 - DNA, 16 bp, Homo sapiens
gctcagtaatttgagg

SEQ ID NO: 2633856 - DNA, 23 bp, Homo sapiens
gctcagtcccatcagagagcgag

SEQ ID NO: 2633857 - DNA, 21 bp, Homo sapiens
gctcagtctcaggagcatggg

SEQ ID NO: 2633858 - DNA, 16 bp, Homo sapiens
gctcagttcagaatca

SEQ ID NO: 2633859 - DNA, 17 bp, Homo sapiens
gctcagttgtagaatgt

SEQ ID NO: 2633860 - DNA, 19 bp, Homo sapiens
gctcatatggggctgggag

SEQ ID NO: 2633861 - DNA, 18 bp, Homo sapiens
gctcatattttgtatata

SEQ ID NO: 2633862 - DNA, 18 bp, Homo sapiens
gctcatcattctctgtct

SEQ ID NO: 2633863 - DNA, 20 bp, Homo sapiens
gctcatcattctctgtctca

SEQ ID NO: 2633864 - DNA, 15 bp, Homo sapiens
gctccaagctcccag

SEQ ID NO: 2633865 - DNA, 18 bp, Homo sapiens
gctccaagctcccaggca

SEQ ID NO: 2633866 - DNA, 16 bp, Homo sapiens
gctccacaccctctcc

SEQ ID NO: 2633867 - DNA, 21 bp, Homo sapiens
gctccacaccctctcccagga

SEQ ID NO: 2633868 - DNA, 22 bp, Homo sapiens
gctccacccttggcctgtctca

SEQ ID NO: 2633869 - DNA, 23 bp, Homo sapiens
gctccacccttggcctgtctcat

SEQ ID NO: 2633870 - DNA, 19 bp, Homo sapiens
gctccacgtctgcgccgcc

SEQ ID NO: 2633871 - DNA, 18 bp, Homo sapiens
gctccactgtcaccctcc

SEQ ID NO: 2633872 - DNA, 18 bp, Homo sapiens
gctccagacacatgtcca

SEQ ID NO: 2633873 - DNA, 15 bp, Homo sapiens
gctccagacccccag

SEQ ID NO: 2633874 - DNA, 23 bp, Homo sapiens
gctccagacccccagcaaccctc

SEQ ID NO: 2633875 - DNA, 21 bp, Homo sapiens
gctccagagggcactctgctt

SEQ ID NO: 2633876 - DNA, 13 bp, Homo sapiens
gctccagctcacc

SEQ ID NO: 2633877 - DNA, 17 bp, Homo sapiens
gctccagctcaccagcc

SEQ ID NO: 2633878 - DNA, 20 bp, Homo sapiens
gctccagctcaccagcccca

SEQ ID NO: 2633879 - DNA, 17 bp, Homo sapiens
gctccaggagcagccac

SEQ ID NO: 2633880 - DNA, 18 bp, Homo sapiens
gctccaggagcagccaca

SEQ ID NO: 2633881 - DNA, 13 bp, Homo sapiens
gctccaggctcct

SEQ ID NO: 2633882 - DNA, 23 bp, Homo sapiens
gctccaggctcctttagcgccca

SEQ ID NO: 2633883 - DNA, 21 bp, Homo sapiens
gctccaggtggctctgaggtg

SEQ ID NO: 2633884 - DNA, 21 bp, Homo sapiens
gctccagtcaacaaactattt

SEQ ID NO: 2633885 - DNA, 21 bp, Homo sapiens
gctccagtctgctgccctcca

SEQ ID NO: 2633886 - DNA, 12 bp, Homo sapiens
gctcccaaggga

SEQ ID NO: 2633887 - DNA, 23 bp, Homo sapiens
gctcccaagggatggtgccctgt

SEQ ID NO: 2633888 - DNA, 14 bp, Homo sapiens
gctcccacaggcag

SEQ ID NO: 2633889 - DNA, 15 bp, Homo sapiens
gctcccacaggcagc

SEQ ID NO: 2633890 - DNA, 16 bp, Homo sapiens
gctcccacaggcagct

SEQ ID NO: 2633891 - DNA, 20 bp, Homo sapiens
gctcccaggcattccccagg

SEQ ID NO: 2633892 - DNA, 12 bp, Homo sapiens
gctcccaggccg

SEQ ID NO: 2633893 - DNA, 19 bp, Homo sapiens
gctccccactgcctactgc

SEQ ID NO: 2633894 - DNA, 15 bp, Homo sapiens
gctccccagcccagg

SEQ ID NO: 2633895 - DNA, 16 bp, Homo sapiens
gctccccagccctggc

SEQ ID NO: 2633896 - DNA, 18 bp, Homo sapiens
gctccccagccctggctc

SEQ ID NO: 2633897 - DNA, 20 bp, Homo sapiens
gctccccagccctggctctg

SEQ ID NO: 2633898 - DNA, 21 bp, Homo sapiens
gctccccagccctggctctgc

SEQ ID NO: 2633899 - DNA, 22 bp, Homo sapiens
gctccccagccctggctctgca

SEQ ID NO: 2633900 - DNA, 12 bp, Homo sapiens
gctccccatgtg

SEQ ID NO: 2633901 - DNA, 14 bp, Homo sapiens
gctccccatgtgtc

SEQ ID NO: 2633902 - DNA, 18 bp, Homo sapiens
gctcccctcggagaagag

SEQ ID NO: 2633903 - DNA, 19 bp, Homo sapiens
gctcccctctatttagcat

SEQ ID NO: 2633904 - DNA, 21 bp, Homo sapiens
gctcccctctatttagcatga

SEQ ID NO: 2633905 - DNA, 12 bp, Homo sapiens
gctcccgcccgt

SEQ ID NO: 2633906 - DNA, 15 bp, Homo sapiens
gctccctaccacctc

SEQ ID NO: 2633907 - DNA, 16 bp, Homo sapiens
gctccctcccatccct

SEQ ID NO: 2633908 - DNA, 17 bp, Homo sapiens
gctccctcccctgccct

SEQ ID NO: 2633909 - DNA, 23 bp, Homo sapiens
gctccctcccctgccctggtcca

SEQ ID NO: 2633910 - DNA, 16 bp, Homo sapiens
gctccctgactgggag

SEQ ID NO: 2633911 - DNA, 21 bp, Homo sapiens
gctccctgtaacctcttcaga

SEQ ID NO: 2633912 - DNA, 15 bp, Homo sapiens
gctcccttcccacct

SEQ ID NO: 2633913 - DNA, 15 bp, Homo sapiens
gctcccttctctgta

SEQ ID NO: 2633914 - DNA, 21 bp, Homo sapiens
gctccgctttctacccagcga

SEQ ID NO: 2633915 - DNA, 23 bp, Homo sapiens
gctccgtccaggagcctgtgcct

SEQ ID NO: 2633916 - DNA, 22 bp, Homo sapiens
gctccgtgagtgaaccatcatt

SEQ ID NO: 2633917 - DNA, 23 bp, Homo sapiens
gctcctaacccttatcaccagct

SEQ ID NO: 2633918 - DNA, 15 bp, Homo sapiens
gctcctaagcttcaa

SEQ ID NO: 2633919 - DNA, 21 bp, Homo sapiens
gctcctcatccagggctctga

SEQ ID NO: 2633920 - DNA, 17 bp, Homo sapiens
gctcctccctctgaggc

SEQ ID NO: 2633921 - DNA, 19 bp, Homo sapiens
gctcctccctctgaggctg

SEQ ID NO: 2633922 - DNA, 21 bp, Homo sapiens
gctcctccctctgaggctgta

SEQ ID NO: 2633923 - DNA, 13 bp, Homo sapiens
gctcctccctggc

SEQ ID NO: 2633924 - DNA, 16 bp, Homo sapiens
gctcctccctggctgc

SEQ ID NO: 2633925 - DNA, 18 bp, Homo sapiens
gctcctccctggctgccc

SEQ ID NO: 2633926 - DNA, 18 bp, Homo sapiens
gctcctcgagggcaggga

SEQ ID NO: 2633927 - DNA, 14 bp, Homo sapiens
gctcctctccaggc

SEQ ID NO: 2633928 - DNA, 22 bp, Homo sapiens
gctcctctccaggcacccttct

SEQ ID NO: 2633929 - DNA, 14 bp, Homo sapiens
ggaaaggctccagg

SEQ ID NO: 2633930 - DNA, 21 bp, Homo sapiens
ggaaaggctccaggagcagcc

SEQ ID NO: 2633931 - DNA, 14 bp, Homo sapiens
ggaaaggggggagc

SEQ ID NO: 2633932 - DNA, 15 bp, Homo sapiens
ggaaagggtgctgct

SEQ ID NO: 2633933 - DNA, 18 bp, Homo sapiens
ggaaataaaacctttcaa

SEQ ID NO: 2633934 - DNA, 16 bp, Homo sapiens
ggaaataccagttctg

SEQ ID NO: 2633935 - DNA, 17 bp, Homo sapiens
ggaaatattgctggggt

SEQ ID NO: 2633936 - DNA, 15 bp, Homo sapiens
ggaaatatttatttt

SEQ ID NO: 2633937 - DNA, 16 bp, Homo sapiens
ggaaatcaaatatgca

SEQ ID NO: 2633938 - DNA, 17 bp, Homo sapiens
ggaaatcaaatatgcaa

SEQ ID NO: 2633939 - DNA, 18 bp, Homo sapiens
ggaaatctcaccccatcc

SEQ ID NO: 2633940 - DNA, 14 bp, Homo sapiens
ggaaatgggcagag

SEQ ID NO: 2633941 - DNA, 17 bp, Homo sapiens
ggaaatgggcagagcag

SEQ ID NO: 2633942 - DNA, 23 bp, Homo sapiens
ggaaattgagattagagggaggt

SEQ ID NO: 2633943 - DNA, 19 bp, Homo sapiens
ggaacagaaggatgaatga

SEQ ID NO: 2633944 - DNA, 19 bp, Homo sapiens
ggaacagaatgttttactg

SEQ ID NO: 2633945 - DNA, 19 bp, Homo sapiens
ggaacagactggaagcaca

SEQ ID NO: 2633946 - DNA, 23 bp, Homo sapiens
ggaacaggctcagatctcatggg

SEQ ID NO: 2633947 - DNA, 18 bp, Homo sapiens
ggaacagtgtttcccata

SEQ ID NO: 2633948 - DNA, 15 bp, Homo sapiens
ggaacatcatcaagg

SEQ ID NO: 2633949 - DNA, 13 bp, Homo sapiens
ggaaccagagcca

SEQ ID NO: 2633950 - DNA, 13 bp, Homo sapiens
ggaaccagggaga

SEQ ID NO: 2633951 - DNA, 24 bp, Homo sapiens
ggaacccttacagtaggagcccag

SEQ ID NO: 2633952 - DNA, 16 bp, Homo sapiens
ggaaccgcaggaagct

SEQ ID NO: 2633953 - DNA, 20 bp, Homo sapiens
ggaacggtaaatttctgtgg

SEQ ID NO: 2633954 - DNA, 22 bp, Homo sapiens
ggaactagagggatacactgaa

SEQ ID NO: 2633955 - DNA, 21 bp, Homo sapiens
ggaactcattcctgcctgtct

SEQ ID NO: 2633956 - DNA, 22 bp, Homo sapiens
ggaactcccagcaacacaagct

SEQ ID NO: 2633957 - DNA, 21 bp, Homo sapiens
ggaactgcagacctgtcctcc

SEQ ID NO: 2633958 - DNA, 16 bp, Homo sapiens
ggaactgtccagagag

SEQ ID NO: 2633959 - DNA, 16 bp, Homo sapiens
ggaagaagagggagag

SEQ ID NO: 2633960 - DNA, 14 bp, Homo sapiens
ggaagacaatgtga

SEQ ID NO: 2633961 - DNA, 23 bp, Homo sapiens
ggaagaccccacccaagcttggc

SEQ ID NO: 2633962 - DNA, 17 bp, Homo sapiens
ggaagagaggagttcaa

SEQ ID NO: 2633963 - DNA, 19 bp, Homo sapiens
ggaagagaggagttcaatg

SEQ ID NO: 2633964 - DNA, 23 bp, Homo sapiens
ggaagagaggagttcaatgatct

SEQ ID NO: 2633965 - DNA, 15 bp, Homo sapiens
ggaagagcaggcaca

SEQ ID NO: 2633966 - DNA, 14 bp, Homo sapiens
ggaagaggggacag

SEQ ID NO: 2633967 - DNA, 20 bp, Homo sapiens
ggaagaggggacaggtccct

SEQ ID NO: 2633968 - DNA, 15 bp, Homo sapiens
ggaagagtgtactgg

SEQ ID NO: 2633969 - DNA, 16 bp, Homo sapiens
ggaagagtgtactggg

SEQ ID NO: 2633970 - DNA, 23 bp, Homo sapiens
ggaagatcttaaattttgtgata

SEQ ID NO: 2633971 - DNA, 18 bp, Homo sapiens
ggaagattttaaattcac

SEQ ID NO: 2633972 - DNA, 17 bp, Homo sapiens
ggaagcacagcttcatt

SEQ ID NO: 2633973 - DNA, 13 bp, Homo sapiens
ggaagcaccccat

SEQ ID NO: 2633974 - DNA, 15 bp, Homo sapiens
ggaagcaccccatgc

SEQ ID NO: 2633975 - DNA, 22 bp, Homo sapiens
ggaagcaccccatgccaaagct

SEQ ID NO: 2633976 - DNA, 20 bp, Homo sapiens
ggaagcattcagagagcagc

SEQ ID NO: 2633977 - DNA, 16 bp, Homo sapiens
ggaagccggcggccca

SEQ ID NO: 2633978 - DNA, 20 bp, Homo sapiens
ggaagcgcgagggcctcaaa

SEQ ID NO: 2633979 - DNA, 22 bp, Homo sapiens
ggaagcggaggttgcagggagc

SEQ ID NO: 2633980 - DNA, 21 bp, Homo sapiens
ggaagctacaggttacaacag

SEQ ID NO: 2633981 - DNA, 17 bp, Homo sapiens
ggaagctagctcccctc

SEQ ID NO: 2633982 - DNA, 22 bp, Homo sapiens
ggaagctagctcccctcctctc

SEQ ID NO: 2633983 - DNA, 22 bp, Homo sapiens
ggaagctcagggcctggctcag

SEQ ID NO: 2633984 - DNA, 13 bp, Homo sapiens
ggaagcttccagt

SEQ ID NO: 2633985 - DNA, 16 bp, Homo sapiens
ggaaggaactctggct

SEQ ID NO: 2633986 - DNA, 15 bp, Homo sapiens
ggaaggagagcctgc

SEQ ID NO: 2633987 - DNA, 16 bp, Homo sapiens
ggaaggagagcctgct

SEQ ID NO: 2633988 - DNA, 17 bp, Homo sapiens
ggaaggagagcctgctg

SEQ ID NO: 2633989 - DNA, 20 bp, Homo sapiens
ggaaggagggttagggaggg

SEQ ID NO: 2633990 - DNA, 15 bp, Homo sapiens
ggaagggaccaaggc

SEQ ID NO: 2633991 - DNA, 16 bp, Homo sapiens
ggaagggaccaaggca

SEQ ID NO: 2633992 - DNA, 16 bp, Homo sapiens
ggaagggactaggagc

SEQ ID NO: 2633993 - DNA, 17 bp, Homo sapiens
ggaaggggccagaggct

SEQ ID NO: 2633994 - DNA, 18 bp, Homo sapiens
ggaaggggcccgtgggag

SEQ ID NO: 2633995 - DNA, 21 bp, Homo sapiens
ggaaggggcccgtgggagtca

SEQ ID NO: 2633996 - DNA, 18 bp, Homo sapiens
ggaagggtttgtggctgg

SEQ ID NO: 2633997 - DNA, 21 bp, Homo sapiens
ggaagtccccaggccccagga

SEQ ID NO: 2633998 - DNA, 23 bp, Homo sapiens
ggaagtccccaggccccaggaag

SEQ ID NO: 2633999 - DNA, 14 bp, Homo sapiens
ggaagtcctctggg

SEQ ID NO: 2634000 - DNA, 23 bp, Homo sapiens
ggaagtgaagagggagaagggat

SEQ ID NO: 2634001 - DNA, 19 bp, Homo sapiens
ggaagtgacaaggccccag

SEQ ID NO: 2634002 - DNA, 16 bp, Homo sapiens
ggaagtgaggaagcca

SEQ ID NO: 2634003 - DNA, 12 bp, Homo sapiens
ggaagtgtgggt

SEQ ID NO: 2634004 - DNA, 22 bp, Homo sapiens
ggaagtgtgggtctgtgtgtgt

SEQ ID NO: 2634005 - DNA, 14 bp, Homo sapiens
ggaataaaatacta

SEQ ID NO: 2634006 - DNA, 15 bp, Homo sapiens
ggaataatagaagaa

SEQ ID NO: 2634007 - DNA, 21 bp, Homo sapiens
ggaataattatttatttaata

SEQ ID NO: 2634008 - DNA, 19 bp, Homo sapiens
ggaatacctgtccccctga

SEQ ID NO: 2634009 - DNA, 20 bp, Homo sapiens
ggaatagtatcctccaggtt

SEQ ID NO: 2634010 - DNA, 17 bp, Homo sapiens
ggaatagttgagcccca

SEQ ID NO: 2634011 - DNA, 20 bp, Homo sapiens
ggaatagttgagccccaagt

SEQ ID NO: 2634012 - DNA, 17 bp, Homo sapiens
ggaatatgggagaaata

SEQ ID NO: 2634013 - DNA, 22 bp, Homo sapiens
ggaatattcccctatctctaga

SEQ ID NO: 2634014 - DNA, 19 bp, Homo sapiens
ggaatcaagagctgccctc

SEQ ID NO: 2634015 - DNA, 23 bp, Homo sapiens
ggaatcaagagctgccctccttg

SEQ ID NO: 2634016 - DNA, 22 bp, Homo sapiens
ggaatcaagatgtcagactggc

SEQ ID NO: 2634017 - DNA, 15 bp, Homo sapiens
ggaatcactcttgtg

SEQ ID NO: 2634018 - DNA, 16 bp, Homo sapiens
ggaatcagcaagaaga

SEQ ID NO: 2634019 - DNA, 19 bp, Homo sapiens
ggaatccactcccaggcag

SEQ ID NO: 2634020 - DNA, 16 bp, Homo sapiens
ggaatccagacccggc

SEQ ID NO: 2634021 - DNA, 20 bp, Homo sapiens
ggaatcgaggaaccagagcc

SEQ ID NO: 2634022 - DNA, 19 bp, Homo sapiens
gggatgactaaaatattta

SEQ ID NO: 2634023 - DNA, 17 bp, Homo sapiens
gggatgactagaggcag

SEQ ID NO: 2634024 - DNA, 15 bp, Homo sapiens
gggatgactgtgatt

SEQ ID NO: 2634025 - DNA, 16 bp, Homo sapiens
gggatgagaagagggg

SEQ ID NO: 2634026 - DNA, 12 bp, Homo sapiens
gggatgggaggt

SEQ ID NO: 2634027 - DNA, 20 bp, Homo sapiens
gggatgtggctgcagcagcg

SEQ ID NO: 2634028 - DNA, 14 bp, Homo sapiens
gggatgtgggaggg

SEQ ID NO: 2634029 - DNA, 13 bp, Homo sapiens
gggatgttctggc

SEQ ID NO: 2634030 - DNA, 20 bp, Homo sapiens
gggattacaggcgtgagcca

SEQ ID NO: 2634031 - DNA, 15 bp, Homo sapiens
gggattacccaagca

SEQ ID NO: 2634032 - DNA, 16 bp, Homo sapiens
gggattacccaagcaa

SEQ ID NO: 2634033 - DNA, 13 bp, Homo sapiens
gggattcctgacc

SEQ ID NO: 2634034 - DNA, 16 bp, Homo sapiens
gggattcctgacccag

SEQ ID NO: 2634035 - DNA, 20 bp, Homo sapiens
atgagctccagacccccagc

SEQ ID NO: 2634036 - DNA, 15 bp, Homo sapiens
ggcacgggcccgtga

SEQ ID NO: 2634037 - DNA, 19 bp, Homo sapiens
ggcactcagaagacactga

SEQ ID NO: 2634038 - DNA, 20 bp, Homo sapiens
ggcactcagaagacactgat

SEQ ID NO: 2634039 - DNA, 22 bp, Homo sapiens
ggcactctgttatttagactca

SEQ ID NO: 2634040 - DNA, 17 bp, Homo sapiens
ggcactgagatatttat

SEQ ID NO: 2634041 - DNA, 23 bp, Homo sapiens
ggcactgagcccccccaacactg

SEQ ID NO: 2634042 - DNA, 14 bp, Homo sapiens
ggcactgctgtgct

SEQ ID NO: 2634043 - DNA, 22 bp, Homo sapiens
ggcactgcttccagtgaggctc

SEQ ID NO: 2634044 - DNA, 15 bp, Homo sapiens
ggcacttcacagagt

SEQ ID NO: 2634045 - DNA, 21 bp, Homo sapiens
ggcacttcacagagtgtgctg

SEQ ID NO: 2634046 - DNA, 22 bp, Homo sapiens
ggcagaaaggttctgcccggga

SEQ ID NO: 2634047 - DNA, 14 bp, Homo sapiens
ggcagaacactaac

SEQ ID NO: 2634048 - DNA, 14 bp, Homo sapiens
ggcagaactgagct

SEQ ID NO: 2634049 - DNA, 21 bp, Homo sapiens
ggcagaactgagctcctctgg

SEQ ID NO: 2634050 - DNA, 14 bp, Homo sapiens
ggcagacagcagct

SEQ ID NO: 2634051 - DNA, 17 bp, Homo sapiens
ggcagacagcagctcag

SEQ ID NO: 2634052 - DNA, 19 bp, Homo sapiens
ggcagacagcagctcaggc

SEQ ID NO: 2634053 - DNA, 18 bp, Homo sapiens
ggcagagaaagaagagac

SEQ ID NO: 2634054 - DNA, 15 bp, Homo sapiens
ggcagagcagagacc

SEQ ID NO: 2634055 - DNA, 16 bp, Homo sapiens
ggcagagcagagacca

SEQ ID NO: 2634056 - DNA, 20 bp, Homo sapiens
ggcagagcagagaccatccc

SEQ ID NO: 2634057 - DNA, 16 bp, Homo sapiens
ggcagagccgggaagc

SEQ ID NO: 2634058 - DNA, 21 bp, Homo sapiens
ggcagagcttggactggatgc

SEQ ID NO: 2634059 - DNA, 16 bp, Homo sapiens
ggctgggggcctcagt

SEQ ID NO: 2634060 - DNA, 19 bp, Homo sapiens
ggctgggggcctcagtgcc

SEQ ID NO: 2634061 - DNA, 19 bp, Homo sapiens
ggctgggtggcaccagcag

SEQ ID NO: 2634062 - DNA, 20 bp, Homo sapiens
gccctcgtggccagcccggc

SEQ ID NO: 2634063 - DNA, 13 bp, Homo sapiens
gccctctacccct

SEQ ID NO: 2634064 - DNA, 12 bp, Homo sapiens
gccctctgccca

SEQ ID NO: 2634065 - DNA, 18 bp, Homo sapiens
gccctctgcccactccct

SEQ ID NO: 2634066 - DNA, 19 bp, Homo sapiens
gccctctgcccactccctg

SEQ ID NO: 2634067 - DNA, 11 bp, Homo sapiens
gccctcttcca

SEQ ID NO: 2634068 - DNA, 17 bp, Homo sapiens
gccctgacattggagcc

SEQ ID NO: 2634069 - DNA, 13 bp, Homo sapiens
gccctgacctccc

SEQ ID NO: 2634070 - DNA, 16 bp, Homo sapiens
gccctgacctcccagc

SEQ ID NO: 2634071 - DNA, 13 bp, Homo sapiens
gccctgagctcgg

SEQ ID NO: 2634072 - DNA, 16 bp, Homo sapiens
gccctgagctttctgc

SEQ ID NO: 2634073 - DNA, 13 bp, Homo sapiens
gccctgaggtgtg

SEQ ID NO: 2634074 - DNA, 21 bp, Homo sapiens
gccctgaggtgtgggggctgc

SEQ ID NO: 2634075 - DNA, 23 bp, Homo sapiens
gccctgaggtgtgggggctgcag

SEQ ID NO: 2634076 - DNA, 22 bp, Homo sapiens
gccctgagtaatcgcttaaaga

SEQ ID NO: 2634077 - DNA, 14 bp, Homo sapiens
gccctgcaaaagga

SEQ ID NO: 2634078 - DNA, 17 bp, Homo sapiens
gccctgcacctgtgcag

SEQ ID NO: 2634079 - DNA, 14 bp, Homo sapiens
gccctgcccacctg

SEQ ID NO: 2634080 - DNA, 16 bp, Homo sapiens
gccctgccctagctcc

SEQ ID NO: 2634081 - DNA, 13 bp, Homo sapiens
gccctgcctcctt

SEQ ID NO: 2634082 - DNA, 22 bp, Homo sapiens
gccctgcctcctttgtgaggaa

SEQ ID NO: 2634083 - DNA, 15 bp, Homo sapiens
gccctgcctctgttt

SEQ ID NO: 2634084 - DNA, 19 bp, Homo sapiens
gccctgcctgagggcccct

SEQ ID NO: 2634085 - DNA, 23 bp, Homo sapiens
gccctgcctgagggcccctctgc

SEQ ID NO: 2634086 - DNA, 15 bp, Homo sapiens
gccctgctcctccct

SEQ ID NO: 2634087 - DNA, 21 bp, Homo sapiens
gccctgctcctccctggctgc

SEQ ID NO: 2634088 - DNA, 23 bp, Homo sapiens
gccctgctcctccctggctgccc

SEQ ID NO: 2634089 - DNA, 11 bp, Homo sapiens
gccctgctggc

SEQ ID NO: 2634090 - DNA, 14 bp, Homo sapiens
gccctgctggccgc

SEQ ID NO: 2634091 - DNA, 18 bp, Homo sapiens
gccctgctggccgcctca

SEQ ID NO: 2634092 - DNA, 23 bp, Homo sapiens
gccctgctggccgcctcaccccc

SEQ ID NO: 2634093 - DNA, 20 bp, Homo sapiens
gccctggaagccggcggccc

SEQ ID NO: 2634094 - DNA, 18 bp, Homo sapiens
gccctggagccaactgct

SEQ ID NO: 2634095 - DNA, 17 bp, Homo sapiens
gccctggccctgaggtg

SEQ ID NO: 2634096 - DNA, 14 bp, Homo sapiens
gccctggctctgca

SEQ ID NO: 2634097 - DNA, 14 bp, Homo sapiens
gccctggctgaagg

SEQ ID NO: 2634098 - DNA, 18 bp, Homo sapiens
gccctggctgaaggactg

SEQ ID NO: 2634099 - DNA, 20 bp, Homo sapiens
gccctggctgaaggactgtg

SEQ ID NO: 2634100 - DNA, 21 bp, Homo sapiens
gccctgggctcggaggctgcc

SEQ ID NO: 2634101 - DNA, 23 bp, Homo sapiens
gccctgggctcggaggctgcccc

SEQ ID NO: 2634102 - DNA, 13 bp, Homo sapiens
gccctggtccagg

SEQ ID NO: 2634103 - DNA, 16 bp, Homo sapiens
gccctggtccagggaa

SEQ ID NO: 2634104 - DNA, 17 bp, Homo sapiens
gccctggtctcagcagc

SEQ ID NO: 2634105 - DNA, 17 bp, Homo sapiens
gccctggtggcagtggg

SEQ ID NO: 2634106 - DNA, 18 bp, Homo sapiens
gccctggtggcagtggga

SEQ ID NO: 2634107 - DNA, 21 bp, Homo sapiens
gccctggtggcagtgggagct

SEQ ID NO: 2634108 - DNA, 22 bp, Homo sapiens
gccctggtggcagtgggagctg

SEQ ID NO: 2634109 - DNA, 23 bp, Homo sapiens
gccctggtggcagtgggagctgc

SEQ ID NO: 2634110 - DNA, 15 bp, Homo sapiens
gccctgtcagtgcag

SEQ ID NO: 2634111 - DNA, 17 bp, Homo sapiens
gccctgtcgagacactt

SEQ ID NO: 2634112 - DNA, 16 bp, Homo sapiens
gccctgtggaagggac

SEQ ID NO: 2634113 - DNA, 14 bp, Homo sapiens
gccctgttaaaaga

SEQ ID NO: 2634114 - DNA, 17 bp, Homo sapiens
gccctgttgtgtataga

SEQ ID NO: 2634115 - DNA, 13 bp, Homo sapiens
gcccttaccttcc

SEQ ID NO: 2634116 - DNA, 14 bp, Homo sapiens
gcccttaccttccc

SEQ ID NO: 2634117 - DNA, 16 bp, Homo sapiens
gcccttcacagtgttt

SEQ ID NO: 2634118 - DNA, 20 bp, Homo sapiens
gcccttcactgcctttgctc

SEQ ID NO: 2634119 - DNA, 12 bp, Homo sapiens
gcccttccatgt

SEQ ID NO: 2634120 - DNA, 12 bp, Homo sapiens
gcccttcccact

SEQ ID NO: 2634121 - DNA, 12 bp, Homo sapiens
gcccttccctgt

SEQ ID NO: 2634122 - DNA, 13 bp, Homo sapiens
gcccttccctgtc

SEQ ID NO: 2634123 - DNA, 14 bp, Homo sapiens
gcccttctctccag

SEQ ID NO: 2634124 - DNA, 22 bp, Homo sapiens
gcccttgagctccccaaaaacc

SEQ ID NO: 2634125 - DNA, 19 bp, Homo sapiens
gcccttgcagttcagcacc

SEQ ID NO: 2634126 - DNA, 20 bp, Homo sapiens
gcccttgcagttcagcacca

SEQ ID NO: 2634127 - DNA, 16 bp, Homo sapiens
gcccttgccctgacct

SEQ ID NO: 2634128 - DNA, 21 bp, Homo sapiens
gcccttgccctgacctcccag

SEQ ID NO: 2634129 - DNA, 21 bp, Homo sapiens
gcccttgtcccactcaagcca

SEQ ID NO: 2634130 - DNA, 12 bp, Homo sapiens
gccgaagctctg

SEQ ID NO: 2634131 - DNA, 14 bp, Homo sapiens
gccgaagctctggc

SEQ ID NO: 2634132 - DNA, 19 bp, Homo sapiens
gccgaagctctggctgaac

SEQ ID NO: 2634133 - DNA, 20 bp, Homo sapiens
gccgaatcccctccctgtca

SEQ ID NO: 2634134 - DNA, 17 bp, Homo sapiens
gccgaccagagccccac

SEQ ID NO: 2634135 - DNA, 14 bp, Homo sapiens
gccgacctcagcct

SEQ ID NO: 2634136 - DNA, 22 bp, Homo sapiens
gccgactgcacagcggcccctg

SEQ ID NO: 2634137 - DNA, 14 bp, Homo sapiens
gccgagaagcaaga

SEQ ID NO: 2634138 - DNA, 19 bp, Homo sapiens
gccgagatcacgccactgc

SEQ ID NO: 2634139 - DNA, 22 bp, Homo sapiens
gccgagatcacgccactgcact

SEQ ID NO: 2634140 - DNA, 18 bp, Homo sapiens
gccgagattgcaccactg

SEQ ID NO: 2634141 - DNA, 15 bp, Homo sapiens
gccgagccgggcctg

SEQ ID NO: 2634142 - DNA, 16 bp, Homo sapiens
gccgagccgggcctgg

SEQ ID NO: 2634143 - DNA, 16 bp, Homo sapiens
gccgagggtcctggct

SEQ ID NO: 2634144 - DNA, 20 bp, Homo sapiens
gccgagggtcctggctcctg

SEQ ID NO: 2634145 - DNA, 21 bp, Homo sapiens
gccgcaaaccacactggactc

SEQ ID NO: 2634146 - DNA, 16 bp, Homo sapiens
gccgcaatacaggaac

SEQ ID NO: 2634147 - DNA, 17 bp, Homo sapiens
gccgcagcctccctctg

SEQ ID NO: 2634148 - DNA, 14 bp, Homo sapiens
gccgcagctcttgc

SEQ ID NO: 2634149 - DNA, 14 bp, Homo sapiens
gccgcctcccagcc

SEQ ID NO: 2634150 - DNA, 18 bp, Homo sapiens
gccgctagatgggcatgg

SEQ ID NO: 2634151 - DNA, 15 bp, Homo sapiens
gccggagtcagtgcc

SEQ ID NO: 2634152 - DNA, 19 bp, Homo sapiens
gccggagtccactcccagt

SEQ ID NO: 2634153 - DNA, 11 bp, Homo sapiens
gccggcaaccc

SEQ ID NO: 2634154 - DNA, 18 bp, Homo sapiens
gccggcaaccccagttct

SEQ ID NO: 2634155 - DNA, 23 bp, Homo sapiens
gccggcaaccccagttctgctcc

SEQ ID NO: 2634156 - DNA, 22 bp, Homo sapiens
gccggcacccacaagtgccact

SEQ ID NO: 2634157 - DNA, 13 bp, Homo sapiens
gccggccctgggg

SEQ ID NO: 2634158 - DNA, 17 bp, Homo sapiens
gccggcggcccaagccc

SEQ ID NO: 2634159 - DNA, 19 bp, Homo sapiens
gccggcttcatgccagcta

SEQ ID NO: 2634160 - DNA, 19 bp, Homo sapiens
gccgggaccccgagcctgg

SEQ ID NO: 2634161 - DNA, 18 bp, Homo sapiens
gccggtctgcaagtcaga

SEQ ID NO: 2634162 - DNA, 17 bp, Homo sapiens
gccggtgagaataagag

SEQ ID NO: 2634163 - DNA, 14 bp, Homo sapiens
gccgtaccccaccc

SEQ ID NO: 2634164 - DNA, 16 bp, Homo sapiens
gccgtaccccaccctc

SEQ ID NO: 2634165 - DNA, 18 bp, Homo sapiens
gccgtaccccaccctcag

SEQ ID NO: 2634166 - DNA, 22 bp, Homo sapiens
gccgtaccccaccctcagcacc

SEQ ID NO: 2634167 - DNA, 14 bp, Homo sapiens
gccgtcctcccggg

SEQ ID NO: 2634168 - DNA, 18 bp, Homo sapiens
gccgtctacctgaggggc

SEQ ID NO: 2634169 - DNA, 20 bp, Homo sapiens
gccgtcttcactcgcccccg

SEQ ID NO: 2634170 - DNA, 22 bp, Homo sapiens
gccgtcttcactcgcccccggg

SEQ ID NO: 2634171 - DNA, 20 bp, Homo sapiens
gccgtgagttctcagggctc

SEQ ID NO: 2634172 - DNA, 21 bp, Homo sapiens
gccgtgagttctcagggctcc

SEQ ID NO: 2634173 - DNA, 15 bp, Homo sapiens
gccgtgcccaggggc

SEQ ID NO: 2634174 - DNA, 19 bp, Homo sapiens
gccgttgatgttggctggg

SEQ ID NO: 2634175 - DNA, 13 bp, Homo sapiens
gccgttgtttact

SEQ ID NO: 2634176 - DNA, 15 bp, Homo sapiens
gcctaaaagtaaaca

SEQ ID NO: 2634177 - DNA, 16 bp, Homo sapiens
gcctaatccctgggca

SEQ ID NO: 2634178 - DNA, 22 bp, Homo sapiens
gcctaatccctgggcattgctt

SEQ ID NO: 2634179 - DNA, 23 bp, Homo sapiens
gcctaatccctgggcattgcttt

SEQ ID NO: 2634180 - DNA, 17 bp, Homo sapiens
gcctacaggagtgagca

SEQ ID NO: 2634181 - DNA, 19 bp, Homo sapiens
gcctacatgctttgtgaac

SEQ ID NO: 2634182 - DNA, 17 bp, Homo sapiens
gcctagccgacctcagc

SEQ ID NO: 2634183 - DNA, 18 bp, Homo sapiens
gcctagccgacctcagcc

SEQ ID NO: 2634184 - DNA, 20 bp, Homo sapiens
gcctagccgacctcagcctt

SEQ ID NO: 2634185 - DNA, 14 bp, Homo sapiens
gcctagctgctaca

SEQ ID NO: 2634186 - DNA, 22 bp, Homo sapiens
gcctagctgctacaaagaagac

SEQ ID NO: 2634187 - DNA, 17 bp, Homo sapiens
gcctaggaattcccagc

SEQ ID NO: 2634188 - DNA, 11 bp, Homo sapiens
gcctaggagat

SEQ ID NO: 2634189 - DNA, 18 bp, Homo sapiens
gcctaggagatatctgag

SEQ ID NO: 2634190 - DNA, 15 bp, Homo sapiens
gcctaggtgacagag

SEQ ID NO: 2634191 - DNA, 17 bp, Homo sapiens
gcctagttcatccaatc

SEQ ID NO: 2634192 - DNA, 21 bp, Homo sapiens
gcctagttcatccaatcctca

SEQ ID NO: 2634193 - DNA, 22 bp, Homo sapiens
gcctatattttttgttaaatga

SEQ ID NO: 2634194 - DNA, 15 bp, Homo sapiens
gcctatgatcccagc

SEQ ID NO: 2634195 - DNA, 14 bp, Homo sapiens
gcctatgcacatat

SEQ ID NO: 2634196 - DNA, 23 bp, Homo sapiens
gcctatgcacatatggactctgc

SEQ ID NO: 2634197 - DNA, 15 bp, Homo sapiens
gcctattcccacacc

SEQ ID NO: 2634198 - DNA, 14 bp, Homo sapiens
gcctcaacctcctg

SEQ ID NO: 2634199 - DNA, 18 bp, Homo sapiens
gcctcaacctcctgggct

SEQ ID NO: 2634200 - DNA, 16 bp, Homo sapiens
gcctcaagtcactccc

SEQ ID NO: 2634201 - DNA, 19 bp, Homo sapiens
gcctcaagtgattctcctg

SEQ ID NO: 2634202 - DNA, 21 bp, Homo sapiens
gcctcaagtgattctcctgcc

SEQ ID NO: 2634203 - DNA, 17 bp, Homo sapiens
gcctcaataagccttgt

SEQ ID NO: 2634204 - DNA, 16 bp, Homo sapiens
gcctcaccccctcggg

SEQ ID NO: 2634205 - DNA, 22 bp, Homo sapiens
gcctcaccccctcgggtctcct

SEQ ID NO: 2634206 - DNA, 22 bp, Homo sapiens
gcctcaccttggggcttgactt

SEQ ID NO: 2634207 - DNA, 16 bp, Homo sapiens
gcctcacttgaatgtg

SEQ ID NO: 2634208 - DNA, 18 bp, Homo sapiens
gcctcacttgaatgtgtc

SEQ ID NO: 2634209 - DNA, 20 bp, Homo sapiens
gcctcacttgaatgtgtcac

SEQ ID NO: 2634210 - DNA, 15 bp, Homo sapiens
gcctcagcatcctgg

SEQ ID NO: 2634211 - DNA, 16 bp, Homo sapiens
gcctcagcatcctggc

SEQ ID NO: 2634212 - DNA, 21 bp, Homo sapiens
gcctcagcatcctggcacccg

SEQ ID NO: 2634213 - DNA, 23 bp, Homo sapiens
gcctggctccaaaccctcgaggc

SEQ ID NO: 2634214 - DNA, 19 bp, Homo sapiens
gcctggctcccacaggcag

SEQ ID NO: 2634215 - DNA, 15 bp, Homo sapiens
gcctggcttctggag

SEQ ID NO: 2634216 - DNA, 17 bp, Homo sapiens
gcctggcttctggagcc

SEQ ID NO: 2634217 - DNA, 23 bp, Homo sapiens
gcctggcttctggagcccttggg

SEQ ID NO: 2634218 - DNA, 23 bp, Homo sapiens
gcctgggaatgtattattctgca

SEQ ID NO: 2634219 - DNA, 14 bp, Homo sapiens
gcctgggatccctc

SEQ ID NO: 2634220 - DNA, 18 bp, Homo sapiens
gcctgggatccctcatcc

SEQ ID NO: 2634221 - DNA, 23 bp, Homo sapiens
gcctgggatccctcatcctcata

SEQ ID NO: 2634222 - DNA, 20 bp, Homo sapiens
gcctgggcaacacagcgaga

SEQ ID NO: 2634223 - DNA, 19 bp, Homo sapiens
gcctgggcagcatagcaag

SEQ ID NO: 2634224 - DNA, 23 bp, Homo sapiens
gcctgggtctgtgtctcttttct

SEQ ID NO: 2634225 - DNA, 14 bp, Homo sapiens
gcctggtccctggg

SEQ ID NO: 2634226 - DNA, 15 bp, Homo sapiens
gcctggtccctggga

SEQ ID NO: 2634227 - DNA, 16 bp, Homo sapiens
gcctggtccctgggag

SEQ ID NO: 2634228 - DNA, 18 bp, Homo sapiens
gcctggtggcagctgcgg

SEQ ID NO: 2634229 - DNA, 21 bp, Homo sapiens
gcctggtggcagctgcggtcc

SEQ ID NO: 2634230 - DNA, 15 bp, Homo sapiens
gcctggtgggcctcc

SEQ ID NO: 2634231 - DNA, 20 bp, Homo sapiens
gcctgtaatcccagcacttt

SEQ ID NO: 2634232 - DNA, 16 bp, Homo sapiens
gcctgtaatcccagct

SEQ ID NO: 2634233 - DNA, 20 bp, Homo sapiens
gcctgtaatcctagcacttt

SEQ ID NO: 2634234 - DNA, 17 bp, Homo sapiens
gcctgtccagcctgggc

SEQ ID NO: 2634235 - DNA, 16 bp, Homo sapiens
gcctgtcctgggctgg

SEQ ID NO: 2634236 - DNA, 18 bp, Homo sapiens
gcctgtctcatccccagg

SEQ ID NO: 2634237 - DNA, 22 bp, Homo sapiens
gcctgtctcctttgcaggctca

SEQ ID NO: 2634238 - DNA, 13 bp, Homo sapiens
gcctgtctcttcc

SEQ ID NO: 2634239 - DNA, 14 bp, Homo sapiens
gcctgtctcttcca

SEQ ID NO: 2634240 - DNA, 14 bp, Homo sapiens
gcctgtctgtctct

SEQ ID NO: 2634241 - DNA, 23 bp, Homo sapiens
gcctgtgaggtgcagagtgccca

SEQ ID NO: 2634242 - DNA, 24 bp, Homo sapiens
gcctgtgaggtgcagagtgcccag

SEQ ID NO: 2634243 - DNA, 12 bp, Homo sapiens
gcctgtgcagtg

SEQ ID NO: 2634244 - DNA, 19 bp, Homo sapiens
gcctgtgcatgtatgtctt

SEQ ID NO: 2634245 - DNA, 16 bp, Homo sapiens
gcctgtgcctctggga

SEQ ID NO: 2634246 - DNA, 17 bp, Homo sapiens
gcctgtgcctctgggac

SEQ ID NO: 2634247 - DNA, 14 bp, Homo sapiens
gcctgtgctgcccg

SEQ ID NO: 2634248 - DNA, 23 bp, Homo sapiens
gcctgtgctgcccgtcttcagcc

SEQ ID NO: 2634249 - DNA, 14 bp, Homo sapiens
gcctgtggcctgtg

SEQ ID NO: 2634250 - DNA, 18 bp, Homo sapiens
gcctgtggcctgtgtccc

SEQ ID NO: 2634251 - DNA, 21 bp, Homo sapiens
gcctgtgtcccatgacccacc

SEQ ID NO: 2634252 - DNA, 23 bp, Homo sapiens
gcctgtgtcccatgacccacccc

SEQ ID NO: 2634253 - DNA, 11 bp, Homo sapiens
gcctgttcagt

SEQ ID NO: 2634254 - DNA, 12 bp, Homo sapiens
gcctgttcagtt

SEQ ID NO: 2634255 - DNA, 21 bp, Homo sapiens
gcctgttcagttacagaaagt

SEQ ID NO: 2634256 - DNA, 22 bp, Homo sapiens
gcctgttcagttacagaaagtg

SEQ ID NO: 2634257 - DNA, 19 bp, Homo sapiens
gcctgttggacccgctctg

SEQ ID NO: 2634258 - DNA, 21 bp, Homo sapiens
gcctgttggacccgctctgga

SEQ ID NO: 2634259 - DNA, 20 bp, Homo sapiens
gcctgttttagaaggttctc

SEQ ID NO: 2634260 - DNA, 16 bp, Homo sapiens
gccttaaagaaagtcg

SEQ ID NO: 2634261 - DNA, 18 bp, Homo sapiens
gccttagaagtcacacag

SEQ ID NO: 2634262 - DNA, 15 bp, Homo sapiens
gccttagcatgtttg

SEQ ID NO: 2634263 - DNA, 19 bp, Homo sapiens
gccttatcaagtgtcttcc

SEQ ID NO: 2634264 - DNA, 13 bp, Homo sapiens
gccttatcctctg

SEQ ID NO: 2634265 - DNA, 17 bp, Homo sapiens
gccttatcctctgatct

SEQ ID NO: 2634266 - DNA, 12 bp, Homo sapiens
gccttattaaag

SEQ ID NO: 2634267 - DNA, 17 bp, Homo sapiens
gccttcagaaccatcca

SEQ ID NO: 2634268 - DNA, 13 bp, Homo sapiens
gccttcattacct

SEQ ID NO: 2634269 - DNA, 15 bp, Homo sapiens
gccttccaggggtgg

SEQ ID NO: 2634270 - DNA, 16 bp, Homo sapiens
gccttccataattatg

SEQ ID NO: 2634271 - DNA, 18 bp, Homo sapiens
gccttccatgtcggcctc

SEQ ID NO: 2634272 - DNA, 14 bp, Homo sapiens
gccttccccagcct

SEQ ID NO: 2634273 - DNA, 17 bp, Homo sapiens
gccttccccagcctctt

SEQ ID NO: 2634274 - DNA, 18 bp, Homo sapiens
gccttccccttgcccagg

SEQ ID NO: 2634275 - DNA, 20 bp, Homo sapiens
gccttccgtaacccaactct

SEQ ID NO: 2634276 - DNA, 17 bp, Homo sapiens
gccttcctcctgggccc

SEQ ID NO: 2634277 - DNA, 22 bp, Homo sapiens
gccttcctcctgggccctctct

SEQ ID NO: 2634278 - DNA, 13 bp, Homo sapiens
gccttcctctgca

SEQ ID NO: 2634279 - DNA, 16 bp, Homo sapiens
gccttcctctgcagct

SEQ ID NO: 2634280 - DNA, 17 bp, Homo sapiens
gccttcctctgcagctg

SEQ ID NO: 2634281 - DNA, 20 bp, Homo sapiens
gccttcctctgcagctgacc

SEQ ID NO: 2634282 - DNA, 19 bp, Homo sapiens
gccttcctgccctacagag

SEQ ID NO: 2634283 - DNA, 16 bp, Homo sapiens
gccttctctgaaggac

SEQ ID NO: 2634284 - DNA, 15 bp, Homo sapiens
gccttcttcacccag

SEQ ID NO: 2634285 - DNA, 17 bp, Homo sapiens
gccttcttcacccagct

SEQ ID NO: 2634286 - DNA, 11 bp, Homo sapiens
gccttcttctt

SEQ ID NO: 2634287 - DNA, 14 bp, Homo sapiens
gccttgaactttga

SEQ ID NO: 2634288 - DNA, 22 bp, Homo sapiens
gccttgaatatcccctcccagt

SEQ ID NO: 2634289 - DNA, 16 bp, Homo sapiens
gccttgaccattctcc

SEQ ID NO: 2634290 - DNA, 17 bp, Homo sapiens
gccttgaccattctcca

SEQ ID NO: 2634291 - DNA, 21 bp, Homo sapiens
gccttggagggtcccaagctg

SEQ ID NO: 2634292 - DNA, 18 bp, Homo sapiens
gccttggggaatttcctc

SEQ ID NO: 2634293 - DNA, 23 bp, Homo sapiens
gccttgtcccctgcctgtgcctg

SEQ ID NO: 2634294 - DNA, 12 bp, Homo sapiens
gccttgtgtaca

SEQ ID NO: 2634295 - DNA, 19 bp, Homo sapiens
gcctttaaatctgtgatga

SEQ ID NO: 2634296 - DNA, 13 bp, Homo sapiens
gcctttctgtgtg

SEQ ID NO: 2634297 - DNA, 20 bp, Homo sapiens
gcctttgagacagtttctta

SEQ ID NO: 2634298 - DNA, 23 bp, Homo sapiens
gcctttgagcccacaaagcctta

SEQ ID NO: 2634299 - DNA, 17 bp, Homo sapiens
gcctttgatcaggtggg

SEQ ID NO: 2634300 - DNA, 15 bp, Homo sapiens
gcctttgcctccccg

SEQ ID NO: 2634301 - DNA, 13 bp, Homo sapiens
gccttttccctct

SEQ ID NO: 2634302 - DNA, 14 bp, Homo sapiens
gccttttctagccc

SEQ ID NO: 2634303 - DNA, 14 bp, Homo sapiens
gccttttgcacccc

SEQ ID NO: 2634304 - DNA, 17 bp, Homo sapiens
gccttttgcacccctcc

SEQ ID NO: 2634305 - DNA, 14 bp, Homo sapiens
gcgaatcatttgtt

SEQ ID NO: 2634306 - DNA, 13 bp, Homo sapiens
gcgacaaagatga

SEQ ID NO: 2634307 - DNA, 23 bp, Homo sapiens
gcgacagagcgagagtctgtctc

SEQ ID NO: 2634308 - DNA, 13 bp, Homo sapiens
gcgaccgccccct

SEQ ID NO: 2634309 - DNA, 15 bp, Homo sapiens
gcgaccgccccctcc

SEQ ID NO: 2634310 - DNA, 23 bp, Homo sapiens
gcgacctctccatcttcagcttc

SEQ ID NO: 2634311 - DNA, 23 bp, Homo sapiens
gcgagatggggtggggtggagaa

SEQ ID NO: 2634312 - DNA, 15 bp, Homo sapiens
gcgagccctggtggc

SEQ ID NO: 2634313 - DNA, 17 bp, Homo sapiens
gcgagccctggtggcag

SEQ ID NO: 2634314 - DNA, 16 bp, Homo sapiens
gcgaggcagaggacag

SEQ ID NO: 2634315 - DNA, 22 bp, Homo sapiens
gcgagtatgtgtttgtgtgtgt

SEQ ID NO: 2634316 - DNA, 15 bp, Homo sapiens
gcgagtgccaggact

SEQ ID NO: 2634317 - DNA, 17 bp, Homo sapiens
gcgagttgtggaaagcc

SEQ ID NO: 2634318 - DNA, 17 bp, Homo sapiens
gcgatccacctgtctca

SEQ ID NO: 2634319 - DNA, 21 bp, Homo sapiens
gcgatccacctgtctcagcct

SEQ ID NO: 2634320 - DNA, 15 bp, Homo sapiens
gcgatggtctcagaa

SEQ ID NO: 2634321 - DNA, 17 bp, Homo sapiens
gcgattcttctgcttca

SEQ ID NO: 2634322 - DNA, 23 bp, Homo sapiens
gcgattcttctgcttcagcctcc

SEQ ID NO: 2634323 - DNA, 20 bp, Homo sapiens
gcgcagcatattcaggaagc

SEQ ID NO: 2634324 - DNA, 15 bp, Homo sapiens
gcgcagtgcctctgg

SEQ ID NO: 2634325 - DNA, 17 bp, Homo sapiens
ctgtctctagccacttt

SEQ ID NO: 2634326 - DNA, 18 bp, Homo sapiens
ctgtctctgcctccctca

SEQ ID NO: 2634327 - DNA, 17 bp, Homo sapiens
ctgtctgatctgtgctt

SEQ ID NO: 2634328 - DNA, 17 bp, Homo sapiens
ctgtctgccagccagca

SEQ ID NO: 2634329 - DNA, 14 bp, Homo sapiens
ctgtctgtacctaa

SEQ ID NO: 2634330 - DNA, 19 bp, Homo sapiens
ctgtctgtagagggccctg

SEQ ID NO: 2634331 - DNA, 16 bp, Homo sapiens
ctgtctgttacactgg

SEQ ID NO: 2634332 - DNA, 18 bp, Homo sapiens
ctgtctgttacactggag

SEQ ID NO: 2634333 - DNA, 17 bp, Homo sapiens
ctgtcttcaacagctcc

SEQ ID NO: 2634334 - DNA, 14 bp, Homo sapiens
ctgtcttcaagggc

SEQ ID NO: 2634335 - DNA, 22 bp, Homo sapiens
ctgtcttcatagcagattttaa

SEQ ID NO: 2634336 - DNA, 12 bp, Homo sapiens
ctgtcttcccag

SEQ ID NO: 2634337 - DNA, 14 bp, Homo sapiens
ctgtcttcccaggg

SEQ ID NO: 2634338 - DNA, 16 bp, Homo sapiens
ctgtcttcccagggta

SEQ ID NO: 2634339 - DNA, 18 bp, Homo sapiens
ctgtcttcccagggtagc

SEQ ID NO: 2634340 - DNA, 16 bp, Homo sapiens
ctgtctttcagataca

SEQ ID NO: 2634341 - DNA, 20 bp, Homo sapiens
ctgtctttcagatacatggt

SEQ ID NO: 2634342 - DNA, 16 bp, Homo sapiens
ctgtgaacgatttaga

SEQ ID NO: 2634343 - DNA, 18 bp, Homo sapiens
ctgtgaacgatttagaaa

SEQ ID NO: 2634344 - DNA, 14 bp, Homo sapiens
ctgtgaacttgggg

SEQ ID NO: 2634345 - DNA, 22 bp, Homo sapiens
ctgtgaacttggggaacaaggg

SEQ ID NO: 2634346 - DNA, 16 bp, Homo sapiens
ctgtgacaggcagcag

SEQ ID NO: 2634347 - DNA, 17 bp, Homo sapiens
ctgtgacaggcagcaga

SEQ ID NO: 2634348 - DNA, 18 bp, Homo sapiens
ctgtgacaggcagcagag

SEQ ID NO: 2634349 - DNA, 15 bp, Homo sapiens
ctgtgaccaatgtct

SEQ ID NO: 2634350 - DNA, 16 bp, Homo sapiens
ctgtgacctgccccgc

SEQ ID NO: 2634351 - DNA, 15 bp, Homo sapiens
ctgtgacctgtgggg

SEQ ID NO: 2634352 - DNA, 12 bp, Homo sapiens
ctgtgagacagt

SEQ ID NO: 2634353 - DNA, 16 bp, Homo sapiens
ctgtgagacccccaca

SEQ ID NO: 2634354 - DNA, 21 bp, Homo sapiens
ctgtgagattttgcttttcca

SEQ ID NO: 2634355 - DNA, 15 bp, Homo sapiens
ctgtgagcaagaagt

SEQ ID NO: 2634356 - DNA, 15 bp, Homo sapiens
ctgtgaggcccctgg

SEQ ID NO: 2634357 - DNA, 19 bp, Homo sapiens
ctgtgaggggctctctcat

SEQ ID NO: 2634358 - DNA, 14 bp, Homo sapiens
ctgtgatgccacac

SEQ ID NO: 2634359 - DNA, 16 bp, Homo sapiens
ctgtgatgccacacag

SEQ ID NO: 2634360 - DNA, 17 bp, Homo sapiens
ctgtgatgccacacaga

SEQ ID NO: 2634361 - DNA, 18 bp, Homo sapiens
ctgtgatgctttgaagta

SEQ ID NO: 2634362 - DNA, 19 bp, Homo sapiens
ctgtgatggggccctgcct

SEQ ID NO: 2634363 - DNA, 21 bp, Homo sapiens
ctgtgatggggccctgcctcc

SEQ ID NO: 2634364 - DNA, 16 bp, Homo sapiens
ctgtgcaaatccttga

SEQ ID NO: 2634365 - DNA, 18 bp, Homo sapiens
ctgtgcacatctgtgtct

SEQ ID NO: 2634366 - DNA, 19 bp, Homo sapiens
ctgtgcacatctgtgtctt

SEQ ID NO: 2634367 - DNA, 20 bp, Homo sapiens
ctgtgcacatctgtgtcttg

SEQ ID NO: 2634368 - DNA, 14 bp, Homo sapiens
ctgtgcatgggtga

SEQ ID NO: 2634369 - DNA, 20 bp, Homo sapiens
ctgtgcatgggtgaagggag

SEQ ID NO: 2634370 - DNA, 17 bp, Homo sapiens
ctgtgcatggtggcacc

SEQ ID NO: 2634371 - DNA, 18 bp, Homo sapiens
ctgtgccacccaccaggg

SEQ ID NO: 2634372 - DNA, 16 bp, Homo sapiens
ctgtgccatgtgccag

SEQ ID NO: 2634373 - DNA, 18 bp, Homo sapiens
ctgtgccatgtgccaggt

SEQ ID NO: 2634374 - DNA, 14 bp, Homo sapiens
ctgtgcccaagttg

SEQ ID NO: 2634375 - DNA, 22 bp, Homo sapiens
ctgtgcccacatcccaggcttc

SEQ ID NO: 2634376 - DNA, 21 bp, Homo sapiens
ctgtgccccatgcctgtccag

SEQ ID NO: 2634377 - DNA, 16 bp, Homo sapiens
ctgtgccctggtggag

SEQ ID NO: 2634378 - DNA, 18 bp, Homo sapiens
ctgtgcctaacaccagcg

SEQ ID NO: 2634379 - DNA, 11 bp, Homo sapiens
ctgtgcctctg

SEQ ID NO: 2634380 - DNA, 16 bp, Homo sapiens
ctgtgcctctgcctgt

SEQ ID NO: 2634381 - DNA, 17 bp, Homo sapiens
ctgtgcctctgcctgtc

SEQ ID NO: 2634382 - DNA, 14 bp, Homo sapiens
ctgtgcgctgacaa

SEQ ID NO: 2634383 - DNA, 16 bp, Homo sapiens
ctgtgcgtgaaacaca

SEQ ID NO: 2634384 - DNA, 18 bp, Homo sapiens
ctgtgctaataacagtgc

SEQ ID NO: 2634385 - DNA, 22 bp, Homo sapiens
ctgtgctccctggttctgatga

SEQ ID NO: 2634386 - DNA, 17 bp, Homo sapiens
ctgtgctctggacaggc

SEQ ID NO: 2634387 - DNA, 14 bp, Homo sapiens
ctgtgctgaccctc

SEQ ID NO: 2634388 - DNA, 17 bp, Homo sapiens
ctgtgctgaccctcctg

SEQ ID NO: 2634389 - DNA, 18 bp, Homo sapiens
ctgtgctgaccctcctgt

SEQ ID NO: 2634390 - DNA, 11 bp, Homo sapiens
ctgtgctgccc

SEQ ID NO: 2634391 - DNA, 17 bp, Homo sapiens
ctgtgctgccctgccca

SEQ ID NO: 2634392 - DNA, 18 bp, Homo sapiens
ctgtgctgccctgcccac

SEQ ID NO: 2634393 - DNA, 21 bp, Homo sapiens
ctgtgctgccctgcccacctg

SEQ ID NO: 2634394 - DNA, 13 bp, Homo sapiens
ctgtgctggagcc

SEQ ID NO: 2634395 - DNA, 21 bp, Homo sapiens
ctgtgctggagccactaacta

SEQ ID NO: 2634396 - DNA, 21 bp, Homo sapiens
ctgtgctgtggaagcaacagg

SEQ ID NO: 2634397 - DNA, 17 bp, Homo sapiens
ctgtgcttcgggccctt

SEQ ID NO: 2634398 - DNA, 17 bp, Homo sapiens
ctgtgctttccagctca

SEQ ID NO: 2634399 - DNA, 22 bp, Homo sapiens
ctgtgctttccagctcaccccc

SEQ ID NO: 2634400 - DNA, 21 bp, Homo sapiens
ctgtgctttgactcacctgtt

SEQ ID NO: 2634401 - DNA, 19 bp, Homo sapiens
ctgtggaaaagaaacacgc

SEQ ID NO: 2634402 - DNA, 22 bp, Homo sapiens
ctgtggaaaagaaacacgcact

SEQ ID NO: 2634403 - DNA, 16 bp, Homo sapiens
ctgtggaaagtgtaaa

SEQ ID NO: 2634404 - DNA, 18 bp, Homo sapiens
ctgtggaaagtgtaaagc

SEQ ID NO: 2634405 - DNA, 13 bp, Homo sapiens
ctgtggagaaata

SEQ ID NO: 2634406 - DNA, 15 bp, Homo sapiens
ctgtggagcccgcac

SEQ ID NO: 2634407 - DNA, 15 bp, Homo sapiens
ctgtggaggaaggat

SEQ ID NO: 2634408 - DNA, 23 bp, Homo sapiens
ctgtggcaggcagcgccaagcaa

SEQ ID NO: 2634409 - DNA, 17 bp, Homo sapiens
ctgtggcatctttgcct

SEQ ID NO: 2634410 - DNA, 23 bp, Homo sapiens
ctgtggccagcttgttatttata

SEQ ID NO: 2634411 - DNA, 16 bp, Homo sapiens
ctgtggcctgggcaag

SEQ ID NO: 2634412 - DNA, 17 bp, Homo sapiens
ctgtggcctgtgtccca

SEQ ID NO: 2634413 - DNA, 19 bp, Homo sapiens
ctgtggctttcagcctctg

SEQ ID NO: 2634414 - DNA, 16 bp, Homo sapiens
ctgtgggaaggccagc

SEQ ID NO: 2634415 - DNA, 14 bp, Homo sapiens
ctgtgggatgggat

SEQ ID NO: 2634416 - DNA, 14 bp, Homo sapiens
ctgtgggcccccaa

SEQ ID NO: 2634417 - DNA, 15 bp, Homo sapiens
ctgtgggctggcagt

SEQ ID NO: 2634418 - DNA, 17 bp, Homo sapiens
ctgtggggatttctccc

SEQ ID NO: 2634419 - DNA, 22 bp, Homo sapiens
ctgtggggctggtagctcaggt

SEQ ID NO: 2634420 - DNA, 24 bp, Homo sapiens
ctgtgggggtgagggtcccatgtg

SEQ ID NO: 2634421 - DNA, 23 bp, Homo sapiens
ctgtggtagtactcctgcaaaat

SEQ ID NO: 2634422 - DNA, 14 bp, Homo sapiens
ctgtggtgtgtccc

SEQ ID NO: 2634423 - DNA, 15 bp, Homo sapiens
ctgtggtgtgtcccc

SEQ ID NO: 2634424 - DNA, 13 bp, Homo sapiens
ctgtgtaaagtta

SEQ ID NO: 2634425 - DNA, 21 bp, Homo sapiens
ctgtgtacagaattctgctac

SEQ ID NO: 2634426 - DNA, 19 bp, Homo sapiens
ctgtgtacataactgaaaa

SEQ ID NO: 2634427 - DNA, 15 bp, Homo sapiens
ctgtgtattccaaga

SEQ ID NO: 2634428 - DNA, 22 bp, Homo sapiens
ctgtgtcaggtggggcagcttg

SEQ ID NO: 2634429 - DNA, 19 bp, Homo sapiens
ctgtgtcccatgacccacc

SEQ ID NO: 2634430 - DNA, 15 bp, Homo sapiens
ctgtgtccttccctg

SEQ ID NO: 2634431 - DNA, 16 bp, Homo sapiens
ctgtgtccttccctgc

SEQ ID NO: 2634432 - DNA, 17 bp, Homo sapiens
ctgtgtctcttttctct

SEQ ID NO: 2634433 - DNA, 20 bp, Homo sapiens
ctgtgtcttgcaatggcagc

SEQ ID NO: 2634434 - DNA, 15 bp, Homo sapiens
ctgtgtgatgaactt

SEQ ID NO: 2634435 - DNA, 18 bp, Homo sapiens
ctgtgtgatgaactttct

SEQ ID NO: 2634436 - DNA, 14 bp, Homo sapiens
ctgtgtgccttcgc

SEQ ID NO: 2634437 - DNA, 18 bp, Homo sapiens
ctgtgtggactgtgatgc

SEQ ID NO: 2634438 - DNA, 21 bp, Homo sapiens
ctgtgttcgactcagcctcag

SEQ ID NO: 2634439 - DNA, 20 bp, Homo sapiens
ctgtgttgcgtgtcgtgggt

SEQ ID NO: 2634440 - DNA, 20 bp, Homo sapiens
ctgtgtttgagctctgcagc

SEQ ID NO: 2634441 - DNA, 22 bp, Homo sapiens
ctgtgtttgagctctgcagccc

SEQ ID NO: 2634442 - DNA, 15 bp, Homo sapiens
ctgtgtttttgaaat

SEQ ID NO: 2634443 - DNA, 19 bp, Homo sapiens
ctgttaaaagatgaaaata

SEQ ID NO: 2634444 - DNA, 21 bp, Homo sapiens
ctgttaaaagatgaaaatatt

SEQ ID NO: 2634445 - DNA, 18 bp, Homo sapiens
ctgttaaattgctgtgta

SEQ ID NO: 2634446 - DNA, 20 bp, Homo sapiens
ctgttaaattgctgtgtatc

SEQ ID NO: 2634447 - DNA, 22 bp, Homo sapiens
ctgttaaattgctgtgtatctg

SEQ ID NO: 2634448 - DNA, 19 bp, Homo sapiens
ctgttaccatgtcactgtg

SEQ ID NO: 2634449 - DNA, 20 bp, Homo sapiens
ctgttaccatgtcactgtgg

SEQ ID NO: 2634450 - DNA, 20 bp, Homo sapiens
ctgttacctgatcaatgaca

SEQ ID NO: 2634451 - DNA, 21 bp, Homo sapiens
ctgttacctgatcaatgacag

SEQ ID NO: 2634452 - DNA, 15 bp, Homo sapiens
ctgttagctgttatt

SEQ ID NO: 2634453 - DNA, 16 bp, Homo sapiens
ctgttagctgttattt

SEQ ID NO: 2634454 - DNA, 16 bp, Homo sapiens
ctgttatttagactca

SEQ ID NO: 2634455 - DNA, 22 bp, Homo sapiens
ctgttcacagccagactggcac

SEQ ID NO: 2634456 - DNA, 13 bp, Homo sapiens
ctgttcagctcca

SEQ ID NO: 2634457 - DNA, 16 bp, Homo sapiens
ctgttcagctccagct

SEQ ID NO: 2634458 - DNA, 12 bp, Homo sapiens
ctgttcagctgg

SEQ ID NO: 2634459 - DNA, 20 bp, Homo sapiens
ctgttcagtgtcccgggccc

SEQ ID NO: 2634460 - DNA, 13 bp, Homo sapiens
ctgttcagttaca

SEQ ID NO: 2634461 - DNA, 21 bp, Homo sapiens
ctgttcagttacagaaagtgg

SEQ ID NO: 2634462 - DNA, 18 bp, Homo sapiens
ctgttcccaaattttcta

SEQ ID NO: 2634463 - DNA, 17 bp, Homo sapiens
ctgttcccacctgctgg

SEQ ID NO: 2634464 - DNA, 12 bp, Homo sapiens
ctgttccccctg

SEQ ID NO: 2634465 - DNA, 12 bp, Homo sapiens
ctgttcccctca

SEQ ID NO: 2634466 - DNA, 22 bp, Homo sapiens
ctgttcccctcactggatgaaa

SEQ ID NO: 2634467 - DNA, 20 bp, Homo sapiens
ctgttccctctgctcctgga

SEQ ID NO: 2634468 - DNA, 15 bp, Homo sapiens
ctgttccttagacct

SEQ ID NO: 2634469 - DNA, 15 bp, Homo sapiens
ctgttctctgccctc

SEQ ID NO: 2634470 - DNA, 17 bp, Homo sapiens
ctgttctctgccctcca

SEQ ID NO: 2634471 - DNA, 19 bp, Homo sapiens
ctgttctctgccctccaag

SEQ ID NO: 2634472 - DNA, 20 bp, Homo sapiens
ctgttctgtggaaagtgtaa

SEQ ID NO: 2634473 - DNA, 21 bp, Homo sapiens
ctgttctgtggaaagtgtaaa

SEQ ID NO: 2634474 - DNA, 17 bp, Homo sapiens
ctgttctgttttgcctg

SEQ ID NO: 2634475 - DNA, 12 bp, Homo sapiens
ctgttcttgaag

SEQ ID NO: 2634476 - DNA, 19 bp, Homo sapiens
gccccagatcaccagcccg

SEQ ID NO: 2634477 - DNA, 11 bp, Homo sapiens
gccccagccag

SEQ ID NO: 2634478 - DNA, 12 bp, Homo sapiens
gccccagccaga

SEQ ID NO: 2634479 - DNA, 20 bp, Homo sapiens
gccccagccagagttcctgc

SEQ ID NO: 2634480 - DNA, 20 bp, Homo sapiens
gccccaggcaggctgtgcgc

SEQ ID NO: 2634481 - DNA, 20 bp, Homo sapiens
gccccagtcagcctctctcc

SEQ ID NO: 2634482 - DNA, 14 bp, Homo sapiens
gccccagtgccaag

SEQ ID NO: 2634483 - DNA, 16 bp, Homo sapiens
gccccatcagctccag

SEQ ID NO: 2634484 - DNA, 14 bp, Homo sapiens
gccccatcagtgct

SEQ ID NO: 2634485 - DNA, 20 bp, Homo sapiens
gccccatgcctgtccagcct

SEQ ID NO: 2634486 - DNA, 15 bp, Homo sapiens
gccccattcctggga

SEQ ID NO: 2634487 - DNA, 21 bp, Homo sapiens
gccccattctgcctgcccagg

SEQ ID NO: 2634488 - DNA, 17 bp, Homo sapiens
gcccccacccacttccc

SEQ ID NO: 2634489 - DNA, 18 bp, Homo sapiens
gcccccagagcgcccctc

SEQ ID NO: 2634490 - DNA, 12 bp, Homo sapiens
gcccccagctgg

SEQ ID NO: 2634491 - DNA, 14 bp, Homo sapiens
gcccccagctggcc

SEQ ID NO: 2634492 - DNA, 22 bp, Homo sapiens
gcccccagggcacttcacagag

SEQ ID NO: 2634493 - DNA, 14 bp, Homo sapiens
gccccccaccccag

SEQ ID NO: 2634494 - DNA, 16 bp, Homo sapiens
gccccccagcctctgg

SEQ ID NO: 2634495 - DNA, 13 bp, Homo sapiens
gcccccccttcca

SEQ ID NO: 2634496 - DNA, 14 bp, Homo sapiens
gcccccctcaaacc

SEQ ID NO: 2634497 - DNA, 16 bp, Homo sapiens
gcccccgcccccggcg

SEQ ID NO: 2634498 - DNA, 16 bp, Homo sapiens
gccccctcctctagct

SEQ ID NO: 2634499 - DNA, 21 bp, Homo sapiens
gccccctcctctagctgtggg

SEQ ID NO: 2634500 - DNA, 15 bp, Homo sapiens
gccccctcctctccc

SEQ ID NO: 2634501 - DNA, 18 bp, Homo sapiens
gccccctgaaacttattt

SEQ ID NO: 2634502 - DNA, 14 bp, Homo sapiens
gccccctgcccccc

SEQ ID NO: 2634503 - DNA, 12 bp, Homo sapiens
gccccctgccct

SEQ ID NO: 2634504 - DNA, 15 bp, Homo sapiens
gccccctgctggctc

SEQ ID NO: 2634505 - DNA, 20 bp, Homo sapiens
gccccctgctggctcttctg

SEQ ID NO: 2634506 - DNA, 21 bp, Homo sapiens
gccccctggtggacagtcctg

SEQ ID NO: 2634507 - DNA, 16 bp, Homo sapiens
gcccccttctcccaca

SEQ ID NO: 2634508 - DNA, 23 bp, Homo sapiens
gccccctttcagatgtcttctgc

SEQ ID NO: 2634509 - DNA, 21 bp, Homo sapiens
gccccctttgggcccagggac

SEQ ID NO: 2634510 - DNA, 18 bp, Homo sapiens
gccccgaggacccagacc

SEQ ID NO: 2634511 - DNA, 19 bp, Homo sapiens
gccccgaggacccagaccc

SEQ ID NO: 2634512 - DNA, 21 bp, Homo sapiens
gccccgaggacccagacccag

SEQ ID NO: 2634513 - DNA, 18 bp, Homo sapiens
gccccgaggccttctctg

SEQ ID NO: 2634514 - DNA, 22 bp, Homo sapiens
gccccgaggccttctctgaagg

SEQ ID NO: 2634515 - DNA, 15 bp, Homo sapiens
gccccgccccacatt

SEQ ID NO: 2634516 - DNA, 13 bp, Homo sapiens
gccccgccgcctg

SEQ ID NO: 2634517 - DNA, 14 bp, Homo sapiens
gccccggccccagc

SEQ ID NO: 2634518 - DNA, 16 bp, Homo sapiens
gccccggccccagcca

SEQ ID NO: 2634519 - DNA, 13 bp, Homo sapiens
gccccggccccgg

SEQ ID NO: 2634520 - DNA, 17 bp, Homo sapiens
gccccgggacttggagg

SEQ ID NO: 2634521 - DNA, 15 bp, Homo sapiens
gccccgtcaccatct

SEQ ID NO: 2634522 - DNA, 20 bp, Homo sapiens
gccccgtcaccatctcaggc

SEQ ID NO: 2634523 - DNA, 22 bp, Homo sapiens
gccccgtcaccatctcaggcca

SEQ ID NO: 2634524 - DNA, 23 bp, Homo sapiens
gccccgtcaccatctcaggccac

SEQ ID NO: 2634525 - DNA, 17 bp, Homo sapiens
gccccgtggggttcctc

SEQ ID NO: 2634526 - DNA, 17 bp, Homo sapiens
gcccctagaatcagcct

SEQ ID NO: 2634527 - DNA, 22 bp, Homo sapiens
gcccctagcttagagcctccct

SEQ ID NO: 2634528 - DNA, 14 bp, Homo sapiens
gcccctcacctggg

SEQ ID NO: 2634529 - DNA, 18 bp, Homo sapiens
gcccctcagggtccctgg

SEQ ID NO: 2634530 - DNA, 21 bp, Homo sapiens
gcccctcatctgctcagcagc

SEQ ID NO: 2634531 - DNA, 12 bp, Homo sapiens
gcccctccagct

SEQ ID NO: 2634532 - DNA, 13 bp, Homo sapiens
gcccctccagctt

SEQ ID NO: 2634533 - DNA, 18 bp, Homo sapiens
gcccctcccacagcgctg

SEQ ID NO: 2634534 - DNA, 14 bp, Homo sapiens
gcccctcccaccac

SEQ ID NO: 2634535 - DNA, 21 bp, Homo sapiens
gcccctcccccaacccccacc

SEQ ID NO: 2634536 - DNA, 22 bp, Homo sapiens
gcccctcccccaacccccaccc

SEQ ID NO: 2634537 - DNA, 11 bp, Homo sapiens
gcccctctgcc

SEQ ID NO: 2634538 - DNA, 12 bp, Homo sapiens
gcccctctgccc

SEQ ID NO: 2634539 - DNA, 15 bp, Homo sapiens
gcccctctgcccagc

SEQ ID NO: 2634540 - DNA, 21 bp, Homo sapiens
gcccctctgcccagcttgggc

SEQ ID NO: 2634541 - DNA, 22 bp, Homo sapiens
gcccctgagacaaatggaggcc

SEQ ID NO: 2634542 - DNA, 14 bp, Homo sapiens
gcccctgcatcccc

SEQ ID NO: 2634543 - DNA, 17 bp, Homo sapiens
gcccctgccaccctggg

SEQ ID NO: 2634544 - DNA, 15 bp, Homo sapiens
gcccctgcccggctg

SEQ ID NO: 2634545 - DNA, 22 bp, Homo sapiens
gcccctgctggttcagggttgg

SEQ ID NO: 2634546 - DNA, 19 bp, Homo sapiens
gcccctggacaagcagagg

SEQ ID NO: 2634547 - DNA, 15 bp, Homo sapiens
gcccctggatgcagc

SEQ ID NO: 2634548 - DNA, 18 bp, Homo sapiens
gcccctggatgcagcctc

SEQ ID NO: 2634549 - DNA, 13 bp, Homo sapiens
gcccctggcccag

SEQ ID NO: 2634550 - DNA, 18 bp, Homo sapiens
gcccctggcccagcggcc

SEQ ID NO: 2634551 - DNA, 21 bp, Homo sapiens
gcccctgggtcagtctggtgg

SEQ ID NO: 2634552 - DNA, 23 bp, Homo sapiens
gccccttcacttctgaccacact

SEQ ID NO: 2634553 - DNA, 15 bp, Homo sapiens
gccccttcccatctc

SEQ ID NO: 2634554 - DNA, 15 bp, Homo sapiens
gccccttccccatgg

SEQ ID NO: 2634555 - DNA, 19 bp, Homo sapiens
gccccttctgacccatgct

SEQ ID NO: 2634556 - DNA, 20 bp, Homo sapiens
gccccttgctctcccctgcc

SEQ ID NO: 2634557 - DNA, 16 bp, Homo sapiens
gcccctttttactccc

SEQ ID NO: 2634558 - DNA, 13 bp, Homo sapiens
gcccgacttgctg

SEQ ID NO: 2634559 - DNA, 23 bp, Homo sapiens
gcccgacttgctgttttgttctg

SEQ ID NO: 2634560 - DNA, 15 bp, Homo sapiens
gcccgagctggtgca

SEQ ID NO: 2634561 - DNA, 17 bp, Homo sapiens
gcccgcatgcggcccag

SEQ ID NO: 2634562 - DNA, 15 bp, Homo sapiens
gcccgcccactgtcc

SEQ ID NO: 2634563 - DNA, 18 bp, Homo sapiens
gcccgcccactgtcctgg

SEQ ID NO: 2634564 - DNA, 19 bp, Homo sapiens
gcccgcccactgtcctggg

SEQ ID NO: 2634565 - DNA, 20 bp, Homo sapiens
gcccgcccactgtcctgggc

SEQ ID NO: 2634566 - DNA, 16 bp, Homo sapiens
gcccgcctgccagtcc

SEQ ID NO: 2634567 - DNA, 14 bp, Homo sapiens
gcccgcctggcaga

SEQ ID NO: 2634568 - DNA, 23 bp, Homo sapiens
gcccgcgccctcgcccccgcccc

SEQ ID NO: 2634569 - DNA, 13 bp, Homo sapiens
gcccgctgggctg

SEQ ID NO: 2634570 - DNA, 14 bp, Homo sapiens
gcccgctgggctga

SEQ ID NO: 2634571 - DNA, 17 bp, Homo sapiens
gcccgctgggctgagcc

SEQ ID NO: 2634572 - DNA, 14 bp, Homo sapiens
gcccggaccttggc

SEQ ID NO: 2634573 - DNA, 19 bp, Homo sapiens
gcccggagattggacggcc

SEQ ID NO: 2634574 - DNA, 22 bp, Homo sapiens
gcccggagattggacggcctga

SEQ ID NO: 2634575 - DNA, 15 bp, Homo sapiens
gcccggattctggga

SEQ ID NO: 2634576 - DNA, 16 bp, Homo sapiens
gcccggattctgggag

SEQ ID NO: 2634577 - DNA, 17 bp, Homo sapiens
gcccggattctgggagg

SEQ ID NO: 2634578 - DNA, 14 bp, Homo sapiens
gcccggcctgctcc

SEQ ID NO: 2634579 - DNA, 16 bp, Homo sapiens
gcccggctccaggctc

SEQ ID NO: 2634580 - DNA, 14 bp, Homo sapiens
gcccggctggtttt

SEQ ID NO: 2634581 - DNA, 20 bp, Homo sapiens
gcccgggaaggtcaccagca

SEQ ID NO: 2634582 - DNA, 14 bp, Homo sapiens
gcccgggctctgcc

SEQ ID NO: 2634583 - DNA, 15 bp, Homo sapiens
gcccgggctctgcct

SEQ ID NO: 2634584 - DNA, 19 bp, Homo sapiens
gcccgggctctgcctccca

SEQ ID NO: 2634585 - DNA, 12 bp, Homo sapiens
gcccgggctgcc

SEQ ID NO: 2634586 - DNA, 13 bp, Homo sapiens
gcccgggctgcct

SEQ ID NO: 2634587 - DNA, 16 bp, Homo sapiens
gcccgggctgcctggg

SEQ ID NO: 2634588 - DNA, 14 bp, Homo sapiens
gcccggggcagctg

SEQ ID NO: 2634589 - DNA, 18 bp, Homo sapiens
gcccggggcagctgccag

SEQ ID NO: 2634590 - DNA, 22 bp, Homo sapiens
gcccggggcagctgccagagaa

SEQ ID NO: 2634591 - DNA, 14 bp, Homo sapiens
gcccgtctcagtgt

SEQ ID NO: 2634592 - DNA, 13 bp, Homo sapiens
gcccgtctctctc

SEQ ID NO: 2634593 - DNA, 16 bp, Homo sapiens
gcccgtcttcagccta

SEQ ID NO: 2634594 - DNA, 18 bp, Homo sapiens
gcccgtcttcagcctagc

SEQ ID NO: 2634595 - DNA, 13 bp, Homo sapiens
gcccgtgtggccc

SEQ ID NO: 2634596 - DNA, 15 bp, Homo sapiens
gcccgtgtggcccct

SEQ ID NO: 2634597 - DNA, 18 bp, Homo sapiens
gcccgtgtggccccttca

SEQ ID NO: 2634598 - DNA, 21 bp, Homo sapiens
gccctaacctctgagtcacca

SEQ ID NO: 2634599 - DNA, 15 bp, Homo sapiens
gccctaaggatctct

SEQ ID NO: 2634600 - DNA, 15 bp, Homo sapiens
gccctacaccttgag

SEQ ID NO: 2634601 - DNA, 21 bp, Homo sapiens
gccctacagaggtctctgccg

SEQ ID NO: 2634602 - DNA, 21 bp, Homo sapiens
gccctaccagcgcccgctggg

SEQ ID NO: 2634603 - DNA, 13 bp, Homo sapiens
gccctagagcctg

SEQ ID NO: 2634604 - DNA, 14 bp, Homo sapiens
gccctagagcctgc

SEQ ID NO: 2634605 - DNA, 18 bp, Homo sapiens
gccctagagcctgcctgg

SEQ ID NO: 2634606 - DNA, 20 bp, Homo sapiens
gccctagagcctgcctggag

SEQ ID NO: 2634607 - DNA, 17 bp, Homo sapiens
gccctatttttgcaatg

SEQ ID NO: 2634608 - DNA, 13 bp, Homo sapiens
gccctcacccctg

SEQ ID NO: 2634609 - DNA, 12 bp, Homo sapiens
gccctcatcccg

SEQ ID NO: 2634610 - DNA, 22 bp, Homo sapiens
gccctcatggcccctctgacct

SEQ ID NO: 2634611 - DNA, 21 bp, Homo sapiens
gccctccaagaccttctcctt

SEQ ID NO: 2634612 - DNA, 14 bp, Homo sapiens
gccctccacagccg

SEQ ID NO: 2634613 - DNA, 21 bp, Homo sapiens
gccctccacgccggctcttcc

SEQ ID NO: 2634614 - DNA, 12 bp, Homo sapiens
gccctcccaggc

SEQ ID NO: 2634615 - DNA, 14 bp, Homo sapiens
gccctcccatcccg

SEQ ID NO: 2634616 - DNA, 17 bp, Homo sapiens
gccctccccagagcact

SEQ ID NO: 2634617 - DNA, 18 bp, Homo sapiens
gccctccgacagccccct

SEQ ID NO: 2634618 - DNA, 19 bp, Homo sapiens
gccctcctaccctgcgccc

SEQ ID NO: 2634619 - DNA, 23 bp, Homo sapiens
gccctcctgaaacttacacacaa

SEQ ID NO: 2634620 - DNA, 15 bp, Homo sapiens
gccctcgctgccagc

SEQ ID NO: 2634621 - DNA, 17 bp, Homo sapiens
gccctcgctgccagctc

SEQ ID NO: 2634622 - DNA, 16 bp, Homo sapiens
gccctcgggcccagcc

SEQ ID NO: 2634623 - DNA, 17 bp, Homo sapiens
gccctcgggcccagccc

SEQ ID NO: 2634624 - DNA, 22 bp, Homo sapiens
gccctcgggcccagcccccaca

SEQ ID NO: 2634625 - DNA, 18 bp, Homo sapiens
gccctcgggcgagtcact

SEQ ID NO: 2634626 - DNA, 14 bp, Homo sapiens
gccctcgtggccag

SEQ ID NO: 2634627 - DNA, 17 bp, Homo sapiens
gccctcgtggccagccc

SEQ ID NO: 2634628 - DNA, 14 bp, Homo sapiens
gccatccaggttca

SEQ ID NO: 2634629 - DNA, 19 bp, Homo sapiens
gccatccaggttcagcttg

SEQ ID NO: 2634630 - DNA, 15 bp, Homo sapiens
gccatcccagcccca

SEQ ID NO: 2634631 - DNA, 19 bp, Homo sapiens
gccatccggcccccagagc

SEQ ID NO: 2634632 - DNA, 12 bp, Homo sapiens
gccatcctgtcc

SEQ ID NO: 2634633 - DNA, 18 bp, Homo sapiens
gccatcgccgggactcca

SEQ ID NO: 2634634 - DNA, 15 bp, Homo sapiens
gccatctctggatgc

SEQ ID NO: 2634635 - DNA, 16 bp, Homo sapiens
gccatcttggtaaatt

SEQ ID NO: 2634636 - DNA, 16 bp, Homo sapiens
gccatgagctccagac

SEQ ID NO: 2634637 - DNA, 19 bp, Homo sapiens
gccatgagctccagacccc

SEQ ID NO: 2634638 - DNA, 22 bp, Homo sapiens
gccatgagctccagacccccag

SEQ ID NO: 2634639 - DNA, 22 bp, Homo sapiens
gccatgatggaaatatttattt

SEQ ID NO: 2634640 - DNA, 21 bp, Homo sapiens
gccatgatggtgctgacctct

SEQ ID NO: 2634641 - DNA, 22 bp, Homo sapiens
gccatgatgtggagtggggcag

SEQ ID NO: 2634642 - DNA, 20 bp, Homo sapiens
gccatgattcgcccaaagcc

SEQ ID NO: 2634643 - DNA, 14 bp, Homo sapiens
gccatgctcctggc

SEQ ID NO: 2634644 - DNA, 23 bp, Homo sapiens
gccatggactctacactgtgaac

SEQ ID NO: 2634645 - DNA, 15 bp, Homo sapiens
gccatggagagctgg

SEQ ID NO: 2634646 - DNA, 20 bp, Homo sapiens
gccatggagagctggagcct

SEQ ID NO: 2634647 - DNA, 22 bp, Homo sapiens
gccatggcgtgtccctctcgga

SEQ ID NO: 2634648 - DNA, 17 bp, Homo sapiens
gccatgggaccaaacct

SEQ ID NO: 2634649 - DNA, 15 bp, Homo sapiens
gccatgggcctcctg

SEQ ID NO: 2634650 - DNA, 18 bp, Homo sapiens
gccatgtagaagctgcat

SEQ ID NO: 2634651 - DNA, 15 bp, Homo sapiens
gccatgtgaagaggg

SEQ ID NO: 2634652 - DNA, 14 bp, Homo sapiens
gccatgtgccaggt

SEQ ID NO: 2634653 - DNA, 16 bp, Homo sapiens
gccatgttggccaggc

SEQ ID NO: 2634654 - DNA, 17 bp, Homo sapiens
gccatgttggccaggct

SEQ ID NO: 2634655 - DNA, 13 bp, Homo sapiens
gccattaccatgg

SEQ ID NO: 2634656 - DNA, 22 bp, Homo sapiens
gccattatccctgaatccccct

SEQ ID NO: 2634657 - DNA, 21 bp, Homo sapiens
gccattcacttcataatccag

SEQ ID NO: 2634658 - DNA, 16 bp, Homo sapiens
gccattctcaagccct

SEQ ID NO: 2634659 - DNA, 15 bp, Homo sapiens
gccattgcactccag

SEQ ID NO: 2634660 - DNA, 14 bp, Homo sapiens
gccattttgtgaat

SEQ ID NO: 2634661 - DNA, 19 bp, Homo sapiens
gccattttgtgaatggatt

SEQ ID NO: 2634662 - DNA, 13 bp, Homo sapiens
gcccaaccctgtc

SEQ ID NO: 2634663 - DNA, 14 bp, Homo sapiens
gcccaaccctgtct

SEQ ID NO: 2634664 - DNA, 16 bp, Homo sapiens
gcccaaccctgtctgt

SEQ ID NO: 2634665 - DNA, 15 bp, Homo sapiens
gcccaacccttcccc

SEQ ID NO: 2634666 - DNA, 14 bp, Homo sapiens
gcccaacctcctga

SEQ ID NO: 2634667 - DNA, 15 bp, Homo sapiens
gcccaaggcggcccc

SEQ ID NO: 2634668 - DNA, 17 bp, Homo sapiens
gcccaaggcggcccctc

SEQ ID NO: 2634669 - DNA, 23 bp, Homo sapiens
gcccaagggaaagaaaaggaagg

SEQ ID NO: 2634670 - DNA, 14 bp, Homo sapiens
gcccaagtccctgt

SEQ ID NO: 2634671 - DNA, 15 bp, Homo sapiens
gcccaagtccctgtt

SEQ ID NO: 2634672 - DNA, 12 bp, Homo sapiens
gcccaatattat

SEQ ID NO: 2634673 - DNA, 18 bp, Homo sapiens
gcccaatattataatttt

SEQ ID NO: 2634674 - DNA, 23 bp, Homo sapiens
gcccacacccagctactttaaca

SEQ ID NO: 2634675 - DNA, 16 bp, Homo sapiens
gcccacagcaggtgct

SEQ ID NO: 2634676 - DNA, 13 bp, Homo sapiens
gcccacaggatca

SEQ ID NO: 2634677 - DNA, 19 bp, Homo sapiens
gcccacaggatcagtctga

SEQ ID NO: 2634678 - DNA, 15 bp, Homo sapiens
gcccacatcccaggc

SEQ ID NO: 2634679 - DNA, 14 bp, Homo sapiens
gcccaccagtgact

SEQ ID NO: 2634680 - DNA, 18 bp, Homo sapiens
gcccaccccgctctgcat

SEQ ID NO: 2634681 - DNA, 19 bp, Homo sapiens
gcccacccgtggagatggg

SEQ ID NO: 2634682 - DNA, 14 bp, Homo sapiens
gcccaccctcctgt

SEQ ID NO: 2634683 - DNA, 20 bp, Homo sapiens
gcccaccctcctgtcttccc

SEQ ID NO: 2634684 - DNA, 22 bp, Homo sapiens
gcccaccctcctgtcttcccag

SEQ ID NO: 2634685 - DNA, 13 bp, Homo sapiens
gcccacctgccca

SEQ ID NO: 2634686 - DNA, 14 bp, Homo sapiens
gcccacctgcccat

SEQ ID NO: 2634687 - DNA, 17 bp, Homo sapiens
gcccacctggccacctg

SEQ ID NO: 2634688 - DNA, 18 bp, Homo sapiens
gcccacctggccacctga

SEQ ID NO: 2634689 - DNA, 19 bp, Homo sapiens
gcccacctggccacctgag

SEQ ID NO: 2634690 - DNA, 15 bp, Homo sapiens
gcccaccttggctca

SEQ ID NO: 2634691 - DNA, 17 bp, Homo sapiens
gcccaccttggctcaag

SEQ ID NO: 2634692 - DNA, 16 bp, Homo sapiens
gcccacgcccccactg

SEQ ID NO: 2634693 - DNA, 17 bp, Homo sapiens
gcccacgcccccactgg

SEQ ID NO: 2634694 - DNA, 17 bp, Homo sapiens
gcccacgctggagtgca

SEQ ID NO: 2634695 - DNA, 15 bp, Homo sapiens
gcccacgtagggcgg

SEQ ID NO: 2634696 - DNA, 13 bp, Homo sapiens
gcccactccctgc

SEQ ID NO: 2634697 - DNA, 14 bp, Homo sapiens
gcccactccctgca

SEQ ID NO: 2634698 - DNA, 19 bp, Homo sapiens
gcccactgcccaccccctc

SEQ ID NO: 2634699 - DNA, 20 bp, Homo sapiens
gcccactgcccaccccctca

SEQ ID NO: 2634700 - DNA, 23 bp, Homo sapiens
gcccactgcccaccccctcaagc

SEQ ID NO: 2634701 - DNA, 17 bp, Homo sapiens
gcccactgtcctgggcg

SEQ ID NO: 2634702 - DNA, 20 bp, Homo sapiens
gcccagaataagttattgca

SEQ ID NO: 2634703 - DNA, 21 bp, Homo sapiens
gcccagacacagaagaggctg

SEQ ID NO: 2634704 - DNA, 15 bp, Homo sapiens
gcccagagaagccaa

SEQ ID NO: 2634705 - DNA, 15 bp, Homo sapiens
gcccagagagggtgg

SEQ ID NO: 2634706 - DNA, 13 bp, Homo sapiens
gcccagagggccc

SEQ ID NO: 2634707 - DNA, 18 bp, Homo sapiens
gcccagagggcctgcaag

SEQ ID NO: 2634708 - DNA, 16 bp, Homo sapiens
gcccagatcagctcct

SEQ ID NO: 2634709 - DNA, 20 bp, Homo sapiens
gcccagcactgcttgaggaa

SEQ ID NO: 2634710 - DNA, 21 bp, Homo sapiens
gcccagcactgcttgaggaaa

SEQ ID NO: 2634711 - DNA, 20 bp, Homo sapiens
gcccagccaaaccctgtctg

SEQ ID NO: 2634712 - DNA, 9 bp, Homo sapiens
gcccagccc

SEQ ID NO: 2634713 - DNA, 23 bp, Homo sapiens
gcccagcccccacagtgctgtct

SEQ ID NO: 2634714 - DNA, 16 bp, Homo sapiens
gcccagccccttctga

SEQ ID NO: 2634715 - DNA, 17 bp, Homo sapiens
gcccagccccttctgac

SEQ ID NO: 2634716 - DNA, 24 bp, Homo sapiens
gcccagccccttctgacccatgct

SEQ ID NO: 2634717 - DNA, 13 bp, Homo sapiens
gcccagcccggct

SEQ ID NO: 2634718 - DNA, 22 bp, Homo sapiens
gcccagccggcctctctggcct

SEQ ID NO: 2634719 - DNA, 18 bp, Homo sapiens
gcccagcggcccctccca

SEQ ID NO: 2634720 - DNA, 20 bp, Homo sapiens
gcccagcggcccctcccaca

SEQ ID NO: 2634721 - DNA, 24 bp, Homo sapiens
gcccagctgcacctgccagcctgg

SEQ ID NO: 2634722 - DNA, 13 bp, Homo sapiens
gcccagctgggct

SEQ ID NO: 2634723 - DNA, 15 bp, Homo sapiens
gcccagctgggctct

SEQ ID NO: 2634724 - DNA, 18 bp, Homo sapiens
gcccagctgggctctgcc

SEQ ID NO: 2634725 - DNA, 21 bp, Homo sapiens
gcccagctgggctctgccacc

SEQ ID NO: 2634726 - DNA, 17 bp, Homo sapiens
gcccagcttgggcccag

SEQ ID NO: 2634727 - DNA, 22 bp, Homo sapiens
gcccagcttgggcccagctggg

SEQ ID NO: 2634728 - DNA, 16 bp, Homo sapiens
gcccaggaaaggctcc

SEQ ID NO: 2634729 - DNA, 20 bp, Homo sapiens
gcccaggaaaggctccagga

SEQ ID NO: 2634730 - DNA, 23 bp, Homo sapiens
gcccaggaaaggctccaggagca

SEQ ID NO: 2634731 - DNA, 24 bp, Homo sapiens
gcccaggaaaggctccaggagcag

SEQ ID NO: 2634732 - DNA, 14 bp, Homo sapiens
gcccaggcaggcca

SEQ ID NO: 2634733 - DNA, 13 bp, Homo sapiens
gcccaggcccctg

SEQ ID NO: 2634734 - DNA, 21 bp, Homo sapiens
gcccaggcccctgccaccctg

SEQ ID NO: 2634735 - DNA, 13 bp, Homo sapiens
gcccaggcccctt

SEQ ID NO: 2634736 - DNA, 21 bp, Homo sapiens
gcccaggccggggtggagcat

SEQ ID NO: 2634737 - DNA, 17 bp, Homo sapiens
gcccaggcctgcctgtt

SEQ ID NO: 2634738 - DNA, 19 bp, Homo sapiens
gcccaggctggcgtgcagt

SEQ ID NO: 2634739 - DNA, 22 bp, Homo sapiens
gcccaggctggcgtgcagtggt

SEQ ID NO: 2634740 - DNA, 19 bp, Homo sapiens
gcccagggccactctgcct

SEQ ID NO: 2634741 - DNA, 22 bp, Homo sapiens
gcccagggccactctgcctctg

SEQ ID NO: 2634742 - DNA, 12 bp, Homo sapiens
gcccagggctca

SEQ ID NO: 2634743 - DNA, 15 bp, Homo sapiens
gcccaggggagccct

SEQ ID NO: 2634744 - DNA, 20 bp, Homo sapiens
gcccaggggtgccccctcct

SEQ ID NO: 2634745 - DNA, 16 bp, Homo sapiens
gcccagggttccccca

SEQ ID NO: 2634746 - DNA, 17 bp, Homo sapiens
gcccagggttcccccag

SEQ ID NO: 2634747 - DNA, 23 bp, Homo sapiens
gcccaggtttctggtctctaggc

SEQ ID NO: 2634748 - DNA, 17 bp, Homo sapiens
gcccagtcctggcctgg

SEQ ID NO: 2634749 - DNA, 21 bp, Homo sapiens
gcccagtcctggcctggcttc

SEQ ID NO: 2634750 - DNA, 15 bp, Homo sapiens
gcccagtccttccac

SEQ ID NO: 2634751 - DNA, 17 bp, Homo sapiens
gcccagtccttccacct

SEQ ID NO: 2634752 - DNA, 13 bp, Homo sapiens
gcccagtggctgc

SEQ ID NO: 2634753 - DNA, 22 bp, Homo sapiens
gcccagttgggtggatgcctgg

SEQ ID NO: 2634754 - DNA, 15 bp, Homo sapiens
gcccagtttctgcct

SEQ ID NO: 2634755 - DNA, 17 bp, Homo sapiens
gcccagtttctgcctct

SEQ ID NO: 2634756 - DNA, 22 bp, Homo sapiens
gcccatcacagggttgggccca

SEQ ID NO: 2634757 - DNA, 20 bp, Homo sapiens
gcccatgtgtgagtgtgtgc

SEQ ID NO: 2634758 - DNA, 17 bp, Homo sapiens
gcccatgtgttccctct

SEQ ID NO: 2634759 - DNA, 19 bp, Homo sapiens
gcccatttcaattctcaaa

SEQ ID NO: 2634760 - DNA, 16 bp, Homo sapiens
gccccaaaaccacagc

SEQ ID NO: 2634761 - DNA, 23 bp, Homo sapiens
gccccaaaaccacagccctgtca

SEQ ID NO: 2634762 - DNA, 18 bp, Homo sapiens
gccccaaaactctcctct

SEQ ID NO: 2634763 - DNA, 20 bp, Homo sapiens
gccccaaaactctcctctgc

SEQ ID NO: 2634764 - DNA, 13 bp, Homo sapiens
gccccaacctgct

SEQ ID NO: 2634765 - DNA, 15 bp, Homo sapiens
gccccaacctgctga

SEQ ID NO: 2634766 - DNA, 19 bp, Homo sapiens
gccccaagtcctgaagagg

SEQ ID NO: 2634767 - DNA, 22 bp, Homo sapiens
gccccacactggggtgccgcct

SEQ ID NO: 2634768 - DNA, 12 bp, Homo sapiens
gccccacccagg

SEQ ID NO: 2634769 - DNA, 17 bp, Homo sapiens
gccccagagactcagag

SEQ ID NO: 2634770 - DNA, 14 bp, Homo sapiens
gccccagagctgtt

SEQ ID NO: 2634771 - DNA, 12 bp, Homo sapiens
gccccagaggcc

SEQ ID NO: 2634772 - DNA, 19 bp, Homo sapiens
gccccagataccagcccct

SEQ ID NO: 2634773 - DNA, 21 bp, Homo sapiens
ctggttttgtaagatgctggg

SEQ ID NO: 2634774 - DNA, 22 bp, Homo sapiens
ctggttttgtaagatgctgggt

SEQ ID NO: 2634775 - DNA, 14 bp, Homo sapiens
ctggtttttcagtt

SEQ ID NO: 2634776 - DNA, 15 bp, Homo sapiens
ctgtaaaatgaaatt

SEQ ID NO: 2634777 - DNA, 16 bp, Homo sapiens
ctgtaaaatgaaatta

SEQ ID NO: 2634778 - DNA, 17 bp, Homo sapiens
ctgtaaagaaagagaga

SEQ ID NO: 2634779 - DNA, 18 bp, Homo sapiens
ctgtaaagaaagagagaa

SEQ ID NO: 2634780 - DNA, 21 bp, Homo sapiens
ctgtaaagaaagagagaaaat

SEQ ID NO: 2634781 - DNA, 23 bp, Homo sapiens
ctgtaaagaaagagagaaaataa

SEQ ID NO: 2634782 - DNA, 17 bp, Homo sapiens
ctgtaaatggtgtacat

SEQ ID NO: 2634783 - DNA, 20 bp, Homo sapiens
ctgtaacacaagccacagaa

SEQ ID NO: 2634784 - DNA, 21 bp, Homo sapiens
ctgtaacacaagccacagaag

SEQ ID NO: 2634785 - DNA, 19 bp, Homo sapiens
ctgtaacatactggcctgg

SEQ ID NO: 2634786 - DNA, 15 bp, Homo sapiens
ctgtaacctcttcag

SEQ ID NO: 2634787 - DNA, 17 bp, Homo sapiens
ctgtaagaagagactgg

SEQ ID NO: 2634788 - DNA, 22 bp, Homo sapiens
ctgtaagaagagactgggaaga

SEQ ID NO: 2634789 - DNA, 23 bp, Homo sapiens
ctgtaagaagagactgggaagat

SEQ ID NO: 2634790 - DNA, 21 bp, Homo sapiens
ctgtaagactcattccctaga

SEQ ID NO: 2634791 - DNA, 14 bp, Homo sapiens
ctgtaagctgaagt

SEQ ID NO: 2634792 - DNA, 19 bp, Homo sapiens
ctgtaatcatataataaat

SEQ ID NO: 2634793 - DNA, 14 bp, Homo sapiens
ctgtaatcccagca

SEQ ID NO: 2634794 - DNA, 20 bp, Homo sapiens
ctgtaatcccagcactttgg

SEQ ID NO: 2634795 - DNA, 20 bp, Homo sapiens
ctgtaatctcgtttcaaaaa

SEQ ID NO: 2634796 - DNA, 21 bp, Homo sapiens
ctgtaatgaatctaagcagca

SEQ ID NO: 2634797 - DNA, 13 bp, Homo sapiens
ctgtaatttagtt

SEQ ID NO: 2634798 - DNA, 14 bp, Homo sapiens
ctgtaatttgtgat

SEQ ID NO: 2634799 - DNA, 20 bp, Homo sapiens
ctgtaatttttttcttatat

SEQ ID NO: 2634800 - DNA, 15 bp, Homo sapiens
ctgtacaaagtagaa

SEQ ID NO: 2634801 - DNA, 16 bp, Homo sapiens
ctgtacacgtgtcctg

SEQ ID NO: 2634802 - DNA, 18 bp, Homo sapiens
ctgtacacgtgtcctgta

SEQ ID NO: 2634803 - DNA, 23 bp, Homo sapiens
ctgtacagagcccacgcccccac

SEQ ID NO: 2634804 - DNA, 19 bp, Homo sapiens
ctgtacatagcctatattt

SEQ ID NO: 2634805 - DNA, 20 bp, Homo sapiens
ctgtacatatttgagactag

SEQ ID NO: 2634806 - DNA, 20 bp, Homo sapiens
ctgtacatgaaaacacattt

SEQ ID NO: 2634807 - DNA, 23 bp, Homo sapiens
ctgtacatgaaaacacatttttc

SEQ ID NO: 2634808 - DNA, 23 bp, Homo sapiens
ctgtaccttttgaggagccccag

SEQ ID NO: 2634809 - DNA, 18 bp, Homo sapiens
ctgtacgtctgacaggca

SEQ ID NO: 2634810 - DNA, 19 bp, Homo sapiens
ctgtacgtctgacaggcaa

SEQ ID NO: 2634811 - DNA, 21 bp, Homo sapiens
ctgtactagagatctggtttt

SEQ ID NO: 2634812 - DNA, 13 bp, Homo sapiens
ctgtactcaggag

SEQ ID NO: 2634813 - DNA, 20 bp, Homo sapiens
ctgtactgatttttgtaaga

SEQ ID NO: 2634814 - DNA, 17 bp, Homo sapiens
ctgtactgttctgtgtc

SEQ ID NO: 2634815 - DNA, 20 bp, Homo sapiens
ctgtactgttctgtgtcttt

SEQ ID NO: 2634816 - DNA, 16 bp, Homo sapiens
ctgtacttaataaatt

SEQ ID NO: 2634817 - DNA, 15 bp, Homo sapiens
ctgtacttcaagtta

SEQ ID NO: 2634818 - DNA, 22 bp, Homo sapiens
ctgtagacctagggaggacctt

SEQ ID NO: 2634819 - DNA, 16 bp, Homo sapiens
ctgtagagggccctgg

SEQ ID NO: 2634820 - DNA, 13 bp, Homo sapiens
ctgtagattctgt

SEQ ID NO: 2634821 - DNA, 20 bp, Homo sapiens
ctgtagattctgtggaacaa

SEQ ID NO: 2634822 - DNA, 18 bp, Homo sapiens
ctgtagcttgttccctgt

SEQ ID NO: 2634823 - DNA, 19 bp, Homo sapiens
ctgtaggactcgcagtcag

SEQ ID NO: 2634824 - DNA, 17 bp, Homo sapiens
ctgtagggctggaccta

SEQ ID NO: 2634825 - DNA, 19 bp, Homo sapiens
ctgtagtaaactatttatc

SEQ ID NO: 2634826 - DNA, 21 bp, Homo sapiens
ctgtagtagccctttctgtgt

SEQ ID NO: 2634827 - DNA, 15 bp, Homo sapiens
ctgtagtcccagcca

SEQ ID NO: 2634828 - DNA, 18 bp, Homo sapiens
ctgtagtcccagccactc

SEQ ID NO: 2634829 - DNA, 22 bp, Homo sapiens
ctgtagtcccagctactcagga

SEQ ID NO: 2634830 - DNA, 23 bp, Homo sapiens
ctgtagtcccagctactcaggag

SEQ ID NO: 2634831 - DNA, 22 bp, Homo sapiens
ctgtagtcctagccactcagga

SEQ ID NO: 2634832 - DNA, 14 bp, Homo sapiens
ctgtagtctcagga

SEQ ID NO: 2634833 - DNA, 18 bp, Homo sapiens
ctgtagtgagatagcatt

SEQ ID NO: 2634834 - DNA, 23 bp, Homo sapiens
ctgtagttttatcacatgtatgt

SEQ ID NO: 2634835 - DNA, 16 bp, Homo sapiens
ctgtataaataggaga

SEQ ID NO: 2634836 - DNA, 16 bp, Homo sapiens
ctgtatagttaggata

SEQ ID NO: 2634837 - DNA, 21 bp, Homo sapiens
ctgtatagttaggatagcatt

SEQ ID NO: 2634838 - DNA, 16 bp, Homo sapiens
ctgtatataaaggaaa

SEQ ID NO: 2634839 - DNA, 18 bp, Homo sapiens
ctgtatatacaataacat

SEQ ID NO: 2634840 - DNA, 18 bp, Homo sapiens
ctgtatcccatgagcctc

SEQ ID NO: 2634841 - DNA, 23 bp, Homo sapiens
ctgtatcccatgagcctcagcat

SEQ ID NO: 2634842 - DNA, 20 bp, Homo sapiens
ctgtatgtctcgtggtagga

SEQ ID NO: 2634843 - DNA, 15 bp, Homo sapiens
ctgtattaagccact

SEQ ID NO: 2634844 - DNA, 21 bp, Homo sapiens
ctgtattgaatcatgtagtat

SEQ ID NO: 2634845 - DNA, 14 bp, Homo sapiens
ctgtatttaatttt

SEQ ID NO: 2634846 - DNA, 23 bp, Homo sapiens
ctgtatttatgtgtgaggagctg

SEQ ID NO: 2634847 - DNA, 22 bp, Homo sapiens
ctgtatttgccggtgcctagga

SEQ ID NO: 2634848 - DNA, 14 bp, Homo sapiens
ctgtatttgtatct

SEQ ID NO: 2634849 - DNA, 23 bp, Homo sapiens
ctgtatttgtatctctgaagcat

SEQ ID NO: 2634850 - DNA, 15 bp, Homo sapiens
ctgtatttgtgacta

SEQ ID NO: 2634851 - DNA, 19 bp, Homo sapiens
ctgtatttgtgactaattg

SEQ ID NO: 2634852 - DNA, 21 bp, Homo sapiens
ctgtatttgtgactaattgta

SEQ ID NO: 2634853 - DNA, 17 bp, Homo sapiens
ctgtcaaacaaagccag

SEQ ID NO: 2634854 - DNA, 19 bp, Homo sapiens
ctgtcaatttccctgactc

SEQ ID NO: 2634855 - DNA, 13 bp, Homo sapiens
ctgtcacaccagc

SEQ ID NO: 2634856 - DNA, 15 bp, Homo sapiens
ctgtcacaccagcca

SEQ ID NO: 2634857 - DNA, 16 bp, Homo sapiens
ctgtcacaccagccat

SEQ ID NO: 2634858 - DNA, 16 bp, Homo sapiens
ctgtcactgcaggcac

SEQ ID NO: 2634859 - DNA, 14 bp, Homo sapiens
ctgtcactttgctc

SEQ ID NO: 2634860 - DNA, 22 bp, Homo sapiens
ctgtcagatgggaagacatgaa

SEQ ID NO: 2634861 - DNA, 22 bp, Homo sapiens
ctgtcagccgggccctgagtaa

SEQ ID NO: 2634862 - DNA, 19 bp, Homo sapiens
ctgtcataagaatgaataa

SEQ ID NO: 2634863 - DNA, 20 bp, Homo sapiens
ctgtcatgaacatgttcctg

SEQ ID NO: 2634864 - DNA, 17 bp, Homo sapiens
ctgtcatttgagcaggg

SEQ ID NO: 2634865 - DNA, 23 bp, Homo sapiens
ctgtcatttgagcagggctcagc

SEQ ID NO: 2634866 - DNA, 15 bp, Homo sapiens
ctgtccaaactgcct

SEQ ID NO: 2634867 - DNA, 15 bp, Homo sapiens
ctgtccacacccagc

SEQ ID NO: 2634868 - DNA, 13 bp, Homo sapiens
ctgtccagacagc

SEQ ID NO: 2634869 - DNA, 15 bp, Homo sapiens
ctgtccagacagcct

SEQ ID NO: 2634870 - DNA, 16 bp, Homo sapiens
ctgtccagacagcctg

SEQ ID NO: 2634871 - DNA, 17 bp, Homo sapiens
ctgtccagacagcctgt

SEQ ID NO: 2634872 - DNA, 18 bp, Homo sapiens
ctgtccagagagagaagt

SEQ ID NO: 2634873 - DNA, 13 bp, Homo sapiens
ctgtccagcctgg

SEQ ID NO: 2634874 - DNA, 23 bp, Homo sapiens
ctgtccaggcactgctgcccagc

SEQ ID NO: 2634875 - DNA, 19 bp, Homo sapiens
ctgtccagggccctgagct

SEQ ID NO: 2634876 - DNA, 22 bp, Homo sapiens
ctgtccagggccctgagctcgg

SEQ ID NO: 2634877 - DNA, 14 bp, Homo sapiens
ctgtccagttccca

SEQ ID NO: 2634878 - DNA, 13 bp, Homo sapiens
ctgtcccacctct

SEQ ID NO: 2634879 - DNA, 17 bp, Homo sapiens
ctgtcccatggacactc

SEQ ID NO: 2634880 - DNA, 13 bp, Homo sapiens
ctgtcccccagct

SEQ ID NO: 2634881 - DNA, 17 bp, Homo sapiens
ctgtcccccagctctgg

SEQ ID NO: 2634882 - DNA, 14 bp, Homo sapiens
ctgtccccctgaca

SEQ ID NO: 2634883 - DNA, 21 bp, Homo sapiens
ctgtcccggggtcctgtggca

SEQ ID NO: 2634884 - DNA, 12 bp, Homo sapiens
ctgtccctcact

SEQ ID NO: 2634885 - DNA, 15 bp, Homo sapiens
ctgtccctccccctt

SEQ ID NO: 2634886 - DNA, 12 bp, Homo sapiens
ctgtccctccgg

SEQ ID NO: 2634887 - DNA, 18 bp, Homo sapiens
ctgtcctactctgtgtca

SEQ ID NO: 2634888 - DNA, 18 bp, Homo sapiens
ctgtcctcccatcccctg

SEQ ID NO: 2634889 - DNA, 21 bp, Homo sapiens
ctgtcctgatggtcagctccc

SEQ ID NO: 2634890 - DNA, 22 bp, Homo sapiens
ctgtcctgatggtcagctccct

SEQ ID NO: 2634891 - DNA, 19 bp, Homo sapiens
ctgtcctgggcgccctgga

SEQ ID NO: 2634892 - DNA, 14 bp, Homo sapiens
ctgtcctgggctgg

SEQ ID NO: 2634893 - DNA, 18 bp, Homo sapiens
ctgtcctgggctggtggc

SEQ ID NO: 2634894 - DNA, 18 bp, Homo sapiens
ctgtcctgtgtagtgatt

SEQ ID NO: 2634895 - DNA, 19 bp, Homo sapiens
ctgtccttacccatctgca

SEQ ID NO: 2634896 - DNA, 17 bp, Homo sapiens
ctgtccttcagatggaa

SEQ ID NO: 2634897 - DNA, 16 bp, Homo sapiens
ctgtccttgcacactc

SEQ ID NO: 2634898 - DNA, 13 bp, Homo sapiens
ctgtcgagacact

SEQ ID NO: 2634899 - DNA, 15 bp, Homo sapiens
ctgtcgcccagtctg

SEQ ID NO: 2634900 - DNA, 16 bp, Homo sapiens
ctgtcgcccagtctgg

SEQ ID NO: 2634901 - DNA, 17 bp, Homo sapiens
ctgtcgccttagcatgt

SEQ ID NO: 2634902 - DNA, 12 bp, Homo sapiens
ctgtctagagta

SEQ ID NO: 2634903 - DNA, 23 bp, Homo sapiens
ctgtctcaaaaaaacacaaaagt

SEQ ID NO: 2634904 - DNA, 14 bp, Homo sapiens
ctgtctcagcctcc

SEQ ID NO: 2634905 - DNA, 16 bp, Homo sapiens
ctgtctcagtttcact

SEQ ID NO: 2634906 - DNA, 20 bp, Homo sapiens
ctgtctcatccatcatcatg

SEQ ID NO: 2634907 - DNA, 14 bp, Homo sapiens
ctgtctcatcccca

SEQ ID NO: 2634908 - DNA, 17 bp, Homo sapiens
ctgtctcatccccaggg

SEQ ID NO: 2634909 - DNA, 13 bp, Homo sapiens
ctgtctccagacc

SEQ ID NO: 2634910 - DNA, 16 bp, Homo sapiens
ctgtctccagaccccc

SEQ ID NO: 2634911 - DNA, 18 bp, Homo sapiens
ctgtctccagacccccac

SEQ ID NO: 2634912 - DNA, 20 bp, Homo sapiens
ctgtctccatggccctgcaa

SEQ ID NO: 2634913 - DNA, 18 bp, Homo sapiens
ctgtctccatgtttgatg

SEQ ID NO: 2634914 - DNA, 22 bp, Homo sapiens
ctggaaaggctcagtctcagga

SEQ ID NO: 2634915 - DNA, 17 bp, Homo sapiens
ctggaactcagtgtgac

SEQ ID NO: 2634916 - DNA, 13 bp, Homo sapiens
ctggaagagagga

SEQ ID NO: 2634917 - DNA, 12 bp, Homo sapiens
ctggaagcacat

SEQ ID NO: 2634918 - DNA, 17 bp, Homo sapiens
ctggaagccagctttcc

SEQ ID NO: 2634919 - DNA, 18 bp, Homo sapiens
ctggaagccggcggccca

SEQ ID NO: 2634920 - DNA, 19 bp, Homo sapiens
ctggaaggggcccgtggga

SEQ ID NO: 2634921 - DNA, 18 bp, Homo sapiens
ctggaagtgactttggct

SEQ ID NO: 2634922 - DNA, 20 bp, Homo sapiens
ctggaatctggagagctaga

SEQ ID NO: 2634923 - DNA, 14 bp, Homo sapiens
ctggaatgcagtgg

SEQ ID NO: 2634924 - DNA, 15 bp, Homo sapiens
ctggaatgcagtggt

SEQ ID NO: 2634925 - DNA, 21 bp, Homo sapiens
ctggaatttgcaagtcatggc

SEQ ID NO: 2634926 - DNA, 23 bp, Homo sapiens
ctggaatttgcaagtcatggctg

SEQ ID NO: 2634927 - DNA, 16 bp, Homo sapiens
ctggacactcagacct

SEQ ID NO: 2634928 - DNA, 17 bp, Homo sapiens
ctggacaggcatgttct

SEQ ID NO: 2634929 - DNA, 17 bp, Homo sapiens
ctggacatagagaggga

SEQ ID NO: 2634930 - DNA, 18 bp, Homo sapiens
ctggacatagagagggag

SEQ ID NO: 2634931 - DNA, 23 bp, Homo sapiens
ctggacatgaagattctttccca

SEQ ID NO: 2634932 - DNA, 14 bp, Homo sapiens
ctggaccactgggc

SEQ ID NO: 2634933 - DNA, 17 bp, Homo sapiens
ctggaccccatctgtga

SEQ ID NO: 2634934 - DNA, 19 bp, Homo sapiens
ctggaccccatctgtgaat

SEQ ID NO: 2634935 - DNA, 12 bp, Homo sapiens
ctggacctgcct

SEQ ID NO: 2634936 - DNA, 20 bp, Homo sapiens
ctggacctgcctcctgcctg

SEQ ID NO: 2634937 - DNA, 21 bp, Homo sapiens
ctggacctgcctcctgcctgc

SEQ ID NO: 2634938 - DNA, 16 bp, Homo sapiens
ctggaccttgaactgg

SEQ ID NO: 2634939 - DNA, 15 bp, Homo sapiens
ctggacggcattcct

SEQ ID NO: 2634940 - DNA, 17 bp, Homo sapiens
ctggacggcattcctgc

SEQ ID NO: 2634941 - DNA, 19 bp, Homo sapiens
ctggacggcattcctgctt

SEQ ID NO: 2634942 - DNA, 21 bp, Homo sapiens
ctggactagagggacctctcc

SEQ ID NO: 2634943 - DNA, 13 bp, Homo sapiens
ctggactcaggat

SEQ ID NO: 2634944 - DNA, 19 bp, Homo sapiens
ctggactcaggatgcccag

SEQ ID NO: 2634945 - DNA, 17 bp, Homo sapiens
ctggactcctctgtcca

SEQ ID NO: 2634946 - DNA, 18 bp, Homo sapiens
ctggactcctctgtccag

SEQ ID NO: 2634947 - DNA, 20 bp, Homo sapiens
ctggactctcagtctctgag

SEQ ID NO: 2634948 - DNA, 23 bp, Homo sapiens
ctggactctcagtctctgagcag

SEQ ID NO: 2634949 - DNA, 16 bp, Homo sapiens
ctggactgaagcctgc

SEQ ID NO: 2634950 - DNA, 14 bp, Homo sapiens
ctggactgggaggt

SEQ ID NO: 2634951 - DNA, 13 bp, Homo sapiens
ctggacttgagct

SEQ ID NO: 2634952 - DNA, 20 bp, Homo sapiens
ctggacttgagcttggcagc

SEQ ID NO: 2634953 - DNA, 19 bp, Homo sapiens
ctggagaactagaacctgg

SEQ ID NO: 2634954 - DNA, 23 bp, Homo sapiens
ctggagaactagaacctggaggg

SEQ ID NO: 2634955 - DNA, 13 bp, Homo sapiens
ctggagaagctga

SEQ ID NO: 2634956 - DNA, 22 bp, Homo sapiens
ctggagaagtcttagacttgaa

SEQ ID NO: 2634957 - DNA, 20 bp, Homo sapiens
ctggagaccatgcagagcgc

SEQ ID NO: 2634958 - DNA, 18 bp, Homo sapiens
ctggagactcctaggcag

SEQ ID NO: 2634959 - DNA, 19 bp, Homo sapiens
ctggagagccagaacctgg

SEQ ID NO: 2634960 - DNA, 23 bp, Homo sapiens
ctggagagccagaacctggaggg

SEQ ID NO: 2634961 - DNA, 13 bp, Homo sapiens
ctggagagctaga

SEQ ID NO: 2634962 - DNA, 19 bp, Homo sapiens
ctggagagctagaacctgg

SEQ ID NO: 2634963 - DNA, 20 bp, Homo sapiens
ctggagagctagaacctgga

SEQ ID NO: 2634964 - DNA, 23 bp, Homo sapiens
ctggagagctagaacctggaggg

SEQ ID NO: 2634965 - DNA, 23 bp, Homo sapiens
ctggagaggagggatgctgcctg

SEQ ID NO: 2634966 - DNA, 21 bp, Homo sapiens
ctggagaggttataggtcact

SEQ ID NO: 2634967 - DNA, 15 bp, Homo sapiens
ctggagcagaccacc

SEQ ID NO: 2634968 - DNA, 22 bp, Homo sapiens
ctggagcagaccaccccgcctg

SEQ ID NO: 2634969 - DNA, 18 bp, Homo sapiens
ctggagccaactgctgct

SEQ ID NO: 2634970 - DNA, 16 bp, Homo sapiens
ctggagccaagtccag

SEQ ID NO: 2634971 - DNA, 19 bp, Homo sapiens
ctggagccaagtccagatt

SEQ ID NO: 2634972 - DNA, 15 bp, Homo sapiens
ctggagccactaact

SEQ ID NO: 2634973 - DNA, 16 bp, Homo sapiens
ctggagccactaacta

SEQ ID NO: 2634974 - DNA, 12 bp, Homo sapiens
ctggagcccagg

SEQ ID NO: 2634975 - DNA, 14 bp, Homo sapiens
ctggagcccaggga

SEQ ID NO: 2634976 - DNA, 14 bp, Homo sapiens
ctggagcccctggg

SEQ ID NO: 2634977 - DNA, 16 bp, Homo sapiens
ctggagcccctgggtg

SEQ ID NO: 2634978 - DNA, 15 bp, Homo sapiens
ctggagcccttgggt

SEQ ID NO: 2634979 - DNA, 13 bp, Homo sapiens
ctggagctctgcc

SEQ ID NO: 2634980 - DNA, 19 bp, Homo sapiens
ctggaggactagaacctgg

SEQ ID NO: 2634981 - DNA, 19 bp, Homo sapiens
ctggagggaatgaacctgg

SEQ ID NO: 2634982 - DNA, 22 bp, Homo sapiens
ctggagggaatgaacctggagg

SEQ ID NO: 2634983 - DNA, 19 bp, Homo sapiens
ctggagggctagaacctgg

SEQ ID NO: 2634984 - DNA, 21 bp, Homo sapiens
ctggagggctagaacctggag

SEQ ID NO: 2634985 - DNA, 22 bp, Homo sapiens
ctggagggctagaacctggcag

SEQ ID NO: 2634986 - DNA, 22 bp, Homo sapiens
ctggagggctagaatctggaga

SEQ ID NO: 2634987 - DNA, 19 bp, Homo sapiens
ctggagggctggaatctgg

SEQ ID NO: 2634988 - DNA, 20 bp, Homo sapiens
ctggagggctggaatctgga

SEQ ID NO: 2634989 - DNA, 20 bp, Homo sapiens
ctggaggtaaggcctttgag

SEQ ID NO: 2634990 - DNA, 15 bp, Homo sapiens
ctggaggttgataac

SEQ ID NO: 2634991 - DNA, 21 bp, Homo sapiens
ctggaggttgataactttgct

SEQ ID NO: 2634992 - DNA, 12 bp, Homo sapiens
ctggaggtttgt

SEQ ID NO: 2634993 - DNA, 14 bp, Homo sapiens
ctggagtgcagtga

SEQ ID NO: 2634994 - DNA, 16 bp, Homo sapiens
ctggagtgcagtgagc

SEQ ID NO: 2634995 - DNA, 20 bp, Homo sapiens
ctggagtgcagtgagccgag

SEQ ID NO: 2634996 - DNA, 22 bp, Homo sapiens
ctggagtgtggctgaggaggcc

SEQ ID NO: 2634997 - DNA, 22 bp, Homo sapiens
ctggagtttttgtttggagagc

SEQ ID NO: 2634998 - DNA, 23 bp, Homo sapiens
ctggagtttttgtttggagagca

SEQ ID NO: 2634999 - DNA, 16 bp, Homo sapiens
ctggataaagccactg

SEQ ID NO: 2635000 - DNA, 17 bp, Homo sapiens
ctggataaagccactga

SEQ ID NO: 2635001 - DNA, 13 bp, Homo sapiens
ctggatattttca

SEQ ID NO: 2635002 - DNA, 16 bp, Homo sapiens
ctggatcacagctgct

SEQ ID NO: 2635003 - DNA, 22 bp, Homo sapiens
ctggatcacagctgctttctgt

SEQ ID NO: 2635004 - DNA, 19 bp, Homo sapiens
ctggatccatcaggccact

SEQ ID NO: 2635005 - DNA, 19 bp, Homo sapiens
ctggatcctagccttatcc

SEQ ID NO: 2635006 - DNA, 16 bp, Homo sapiens
ctggatgcagcctcac

SEQ ID NO: 2635007 - DNA, 20 bp, Homo sapiens
ctggatgggctgcagcagag

SEQ ID NO: 2635008 - DNA, 15 bp, Homo sapiens
ctggatggggctgca

SEQ ID NO: 2635009 - DNA, 15 bp, Homo sapiens
ctggatgtctgccaa

SEQ ID NO: 2635010 - DNA, 22 bp, Homo sapiens
ctggcaaacatgaaaaatcggc

SEQ ID NO: 2635011 - DNA, 12 bp, Homo sapiens
ctggcaaaggcc

SEQ ID NO: 2635012 - DNA, 18 bp, Homo sapiens
ctggcaaagggagcagaa

SEQ ID NO: 2635013 - DNA, 22 bp, Homo sapiens
ctggcaaagggagcagaactga

SEQ ID NO: 2635014 - DNA, 14 bp, Homo sapiens
ctggcaacatcttt

SEQ ID NO: 2635015 - DNA, 17 bp, Homo sapiens
ctggcaacatctttatc

SEQ ID NO: 2635016 - DNA, 14 bp, Homo sapiens
ctggcaagaatgtg

SEQ ID NO: 2635017 - DNA, 16 bp, Homo sapiens
ctggcaaggacacaga

SEQ ID NO: 2635018 - DNA, 19 bp, Homo sapiens
ctggcaatagtgtgttctg

SEQ ID NO: 2635019 - DNA, 21 bp, Homo sapiens
ctggcacacagtaggtgctca

SEQ ID NO: 2635020 - DNA, 19 bp, Homo sapiens
ctggcacagttttctgaga

SEQ ID NO: 2635021 - DNA, 22 bp, Homo sapiens
ctggcacccggcccctgctggt

SEQ ID NO: 2635022 - DNA, 17 bp, Homo sapiens
ctctggcttccaggtat

SEQ ID NO: 2635023 - DNA, 19 bp, Homo sapiens
ctctgggaaataagagaga

SEQ ID NO: 2635024 - DNA, 20 bp, Homo sapiens
ctctgggaaatgagaaggca

SEQ ID NO: 2635025 - DNA, 23 bp, Homo sapiens
ctctgggcaggacctcagagtcc

SEQ ID NO: 2635026 - DNA, 14 bp, Homo sapiens
ctctggggactccg

SEQ ID NO: 2635027 - DNA, 15 bp, Homo sapiens
ctctggtccatagag

SEQ ID NO: 2635028 - DNA, 18 bp, Homo sapiens
ctctggtccatagagagc

SEQ ID NO: 2635029 - DNA, 22 bp, Homo sapiens
ctctggtttggggcgaggcaga

SEQ ID NO: 2635030 - DNA, 16 bp, Homo sapiens
ctctgtacagagccca

SEQ ID NO: 2635031 - DNA, 22 bp, Homo sapiens
ctctgtagggaactctggggtc

SEQ ID NO: 2635032 - DNA, 22 bp, Homo sapiens
ctctgtcccacttggcatcagc

SEQ ID NO: 2635033 - DNA, 14 bp, Homo sapiens
ctctgtctcatgtg

SEQ ID NO: 2635034 - DNA, 17 bp, Homo sapiens
ctctgtctgcccttcac

SEQ ID NO: 2635035 - DNA, 18 bp, Homo sapiens
ctctgtgaccaatgtctt

SEQ ID NO: 2635036 - DNA, 15 bp, Homo sapiens
ctctgtgacctgccc

SEQ ID NO: 2635037 - DNA, 21 bp, Homo sapiens
ctctgtgagcatcacagtttt

SEQ ID NO: 2635038 - DNA, 20 bp, Homo sapiens
ctctgtgcccccatcaccct

SEQ ID NO: 2635039 - DNA, 21 bp, Homo sapiens
ctctgtgctgaccctcctgtt

SEQ ID NO: 2635040 - DNA, 22 bp, Homo sapiens
ctctgtgcttttaaatgcataa

SEQ ID NO: 2635041 - DNA, 17 bp, Homo sapiens
ctctgtgggctggcagt

SEQ ID NO: 2635042 - DNA, 15 bp, Homo sapiens
ctctgtgtcaggtgg

SEQ ID NO: 2635043 - DNA, 19 bp, Homo sapiens
ctctgtgtcaggtggggca

SEQ ID NO: 2635044 - DNA, 20 bp, Homo sapiens
ctctgtgtcaggtggggcag

SEQ ID NO: 2635045 - DNA, 17 bp, Homo sapiens
ctctgtgtccttccctg

SEQ ID NO: 2635046 - DNA, 17 bp, Homo sapiens
ctctgtgtgcacaaata

SEQ ID NO: 2635047 - DNA, 14 bp, Homo sapiens
ctctgttcagtgta

SEQ ID NO: 2635048 - DNA, 22 bp, Homo sapiens
ctctgttgtcctccccttgggc

SEQ ID NO: 2635049 - DNA, 17 bp, Homo sapiens
ctcttaaaaaataaaaa

SEQ ID NO: 2635050 - DNA, 18 bp, Homo sapiens
ctcttaaaaaataaaaac

SEQ ID NO: 2635051 - DNA, 13 bp, Homo sapiens
ctcttaaaaccca

SEQ ID NO: 2635052 - DNA, 20 bp, Homo sapiens
ctcttaaagaaaacccaccc

SEQ ID NO: 2635053 - DNA, 13 bp, Homo sapiens
ctcttaagccatc

SEQ ID NO: 2635054 - DNA, 21 bp, Homo sapiens
ctcttaagccatcttggtaaa

SEQ ID NO: 2635055 - DNA, 14 bp, Homo sapiens
ctcttaagtttctc

SEQ ID NO: 2635056 - DNA, 18 bp, Homo sapiens
ctcttaagtttctcagct

SEQ ID NO: 2635057 - DNA, 22 bp, Homo sapiens
ctcttacgcccaacccttcccc

SEQ ID NO: 2635058 - DNA, 18 bp, Homo sapiens
ctcttagacttctgcttt

SEQ ID NO: 2635059 - DNA, 17 bp, Homo sapiens
ctcttatagaatattta

SEQ ID NO: 2635060 - DNA, 18 bp, Homo sapiens
ctcttatagaatatttat

SEQ ID NO: 2635061 - DNA, 21 bp, Homo sapiens
ctcttatctcagtcatgcata

SEQ ID NO: 2635062 - DNA, 14 bp, Homo sapiens
ctcttatgggctgg

SEQ ID NO: 2635063 - DNA, 15 bp, Homo sapiens
ctcttattttacaat

SEQ ID NO: 2635064 - DNA, 16 bp, Homo sapiens
ctcttcaactgaccag

SEQ ID NO: 2635065 - DNA, 20 bp, Homo sapiens
ctcttcaactgaccagcctc

SEQ ID NO: 2635066 - DNA, 14 bp, Homo sapiens
ctcttcaatctctt

SEQ ID NO: 2635067 - DNA, 18 bp, Homo sapiens
ctcttcaccccccactca

SEQ ID NO: 2635068 - DNA, 13 bp, Homo sapiens
ctcttcagaggcc

SEQ ID NO: 2635069 - DNA, 19 bp, Homo sapiens
ctcttcagatctctaactt

SEQ ID NO: 2635070 - DNA, 14 bp, Homo sapiens
ctcttcaggcctcc

SEQ ID NO: 2635071 - DNA, 17 bp, Homo sapiens
ctgcagggggtgtgtct

SEQ ID NO: 2635072 - DNA, 20 bp, Homo sapiens
ctgcagggggtgtgtctgct

SEQ ID NO: 2635073 - DNA, 23 bp, Homo sapiens
ctgcagggggtgtgtctgctcag

SEQ ID NO: 2635074 - DNA, 16 bp, Homo sapiens
ctgcagggtggtgctg

SEQ ID NO: 2635075 - DNA, 19 bp, Homo sapiens
ctgcagggtggtgctggga

SEQ ID NO: 2635076 - DNA, 14 bp, Homo sapiens
ctgcaggtgctgct

SEQ ID NO: 2635077 - DNA, 20 bp, Homo sapiens
ctgcaggttcttcttcctga

SEQ ID NO: 2635078 - DNA, 21 bp, Homo sapiens
ctgcaggttcttcttcctgaa

SEQ ID NO: 2635079 - DNA, 16 bp, Homo sapiens
ctgcagtagtctctgt

SEQ ID NO: 2635080 - DNA, 23 bp, Homo sapiens
ctgcagtagtctctgtgctttga

SEQ ID NO: 2635081 - DNA, 16 bp, Homo sapiens
ctgcagtatgaaaata

SEQ ID NO: 2635082 - DNA, 22 bp, Homo sapiens
ctgcagtcacttcgtgggatct

SEQ ID NO: 2635083 - DNA, 17 bp, Homo sapiens
ctgcagtctggctgagc

SEQ ID NO: 2635084 - DNA, 21 bp, Homo sapiens
ctgcagtctggctgagccctg

SEQ ID NO: 2635085 - DNA, 17 bp, Homo sapiens
ctgcagttgccagtcac

SEQ ID NO: 2635086 - DNA, 19 bp, Homo sapiens
ctgcagttgccagtcaccc

SEQ ID NO: 2635087 - DNA, 19 bp, Homo sapiens
ctgcagtttgagacaggag

SEQ ID NO: 2635088 - DNA, 20 bp, Homo sapiens
ctgcatcagctgctgaaaca

SEQ ID NO: 2635089 - DNA, 23 bp, Homo sapiens
ctgcatcctccaagaatctatct

SEQ ID NO: 2635090 - DNA, 21 bp, Homo sapiens
ctgcatctgggattcccacca

SEQ ID NO: 2635091 - DNA, 20 bp, Homo sapiens
ctgcatgcctggtctttcct

SEQ ID NO: 2635092 - DNA, 23 bp, Homo sapiens
ctgcatgcctggtctttcctctg

SEQ ID NO: 2635093 - DNA, 14 bp, Homo sapiens
ctgcatgcggccca

SEQ ID NO: 2635094 - DNA, 19 bp, Homo sapiens
ctgcatgctgggttctgca

SEQ ID NO: 2635095 - DNA, 13 bp, Homo sapiens
ctgcatgttacat

SEQ ID NO: 2635096 - DNA, 15 bp, Homo sapiens
ctgcatgtttgtgat

SEQ ID NO: 2635097 - DNA, 14 bp, Homo sapiens
ctgcattctttctg

SEQ ID NO: 2635098 - DNA, 16 bp, Homo sapiens
ctgcattctttctgta

SEQ ID NO: 2635099 - DNA, 20 bp, Homo sapiens
ctgcatttaaaagatacagt

SEQ ID NO: 2635100 - DNA, 22 bp, Homo sapiens
ctgcatttaaaagatacagtta

SEQ ID NO: 2635101 - DNA, 14 bp, Homo sapiens
ctgcatttctgagt

SEQ ID NO: 2635102 - DNA, 15 bp, Homo sapiens
ctgcatttgtgaaat

SEQ ID NO: 2635103 - DNA, 17 bp, Homo sapiens
ctgcatttgtgaaatga

SEQ ID NO: 2635104 - DNA, 22 bp, Homo sapiens
ctgcatttgtgaaatgatggtg

SEQ ID NO: 2635105 - DNA, 19 bp, Homo sapiens
ctgcattttattctggatg

SEQ ID NO: 2635106 - DNA, 14 bp, Homo sapiens
ctgcattttgctat

SEQ ID NO: 2635107 - DNA, 21 bp, Homo sapiens
ctgccaaagggaaatatcatt

SEQ ID NO: 2635108 - DNA, 22 bp, Homo sapiens
ctgccaacttcttcagagctga

SEQ ID NO: 2635109 - DNA, 15 bp, Homo sapiens
ctgccaaggccagag

SEQ ID NO: 2635110 - DNA, 23 bp, Homo sapiens
ctgccaaggccagagtggcctgg

SEQ ID NO: 2635111 - DNA, 12 bp, Homo sapiens
ctgccaccagtc

SEQ ID NO: 2635112 - DNA, 14 bp, Homo sapiens
ctgccaccagtcac

SEQ ID NO: 2635113 - DNA, 14 bp, Homo sapiens
ctgccaccatcctg

SEQ ID NO: 2635114 - DNA, 17 bp, Homo sapiens
ctgccaccatcctgctg

SEQ ID NO: 2635115 - DNA, 19 bp, Homo sapiens
ctgccaccatcctgctgct

SEQ ID NO: 2635116 - DNA, 15 bp, Homo sapiens
ctgccaccctacctg

SEQ ID NO: 2635117 - DNA, 15 bp, Homo sapiens
ctgccaccctgggga

SEQ ID NO: 2635118 - DNA, 21 bp, Homo sapiens
ctgccaccctggggagaaagt

SEQ ID NO: 2635119 - DNA, 20 bp, Homo sapiens
ctgccactcacacagccagg

SEQ ID NO: 2635120 - DNA, 19 bp, Homo sapiens
ctgccactttggtacatgg

SEQ ID NO: 2635121 - DNA, 11 bp, Homo sapiens
ctgccagagaa

SEQ ID NO: 2635122 - DNA, 20 bp, Homo sapiens
ctgccagagaagcatcggag

SEQ ID NO: 2635123 - DNA, 22 bp, Homo sapiens
ctgccagatgctgatgttcagt

SEQ ID NO: 2635124 - DNA, 23 bp, Homo sapiens
ctgccagatgctgatgttcagtg

SEQ ID NO: 2635125 - DNA, 15 bp, Homo sapiens
ctgccagccagcagc

SEQ ID NO: 2635126 - DNA, 18 bp, Homo sapiens
ctgccagccagcagccag

SEQ ID NO: 2635127 - DNA, 19 bp, Homo sapiens
ctgccagccagcagccagc

SEQ ID NO: 2635128 - DNA, 17 bp, Homo sapiens
ctgccagctctgtatca

SEQ ID NO: 2635129 - DNA, 12 bp, Homo sapiens
ctgccagggaca

SEQ ID NO: 2635130 - DNA, 18 bp, Homo sapiens
ctgccagggagacagagc

SEQ ID NO: 2635131 - DNA, 13 bp, Homo sapiens
ctgccagggcagg

SEQ ID NO: 2635132 - DNA, 17 bp, Homo sapiens
ctgccagtccccctgcc

SEQ ID NO: 2635133 - DNA, 20 bp, Homo sapiens
ctgccagtccccctgcccca

SEQ ID NO: 2635134 - DNA, 21 bp, Homo sapiens
ctgccagtccccctgccccag

SEQ ID NO: 2635135 - DNA, 18 bp, Homo sapiens
ctgccagtcctagctgca

SEQ ID NO: 2635136 - DNA, 18 bp, Homo sapiens
ctgccagtctcactgtgg

SEQ ID NO: 2635137 - DNA, 15 bp, Homo sapiens
ctgccagtgtggaac

SEQ ID NO: 2635138 - DNA, 12 bp, Homo sapiens
ctgccatccagg

SEQ ID NO: 2635139 - DNA, 16 bp, Homo sapiens
ctgccatccaggttca

SEQ ID NO: 2635140 - DNA, 15 bp, Homo sapiens
ctgccatcctcccaa

SEQ ID NO: 2635141 - DNA, 15 bp, Homo sapiens
ctgccatgccagctt

SEQ ID NO: 2635142 - DNA, 14 bp, Homo sapiens
ctgccatggcgtgt

SEQ ID NO: 2635143 - DNA, 21 bp, Homo sapiens
ctgcccaatatgcagttctgc

SEQ ID NO: 2635144 - DNA, 16 bp, Homo sapiens
ctgcccaattggagga

SEQ ID NO: 2635145 - DNA, 21 bp, Homo sapiens
ctgcccaattttgcagggagc

SEQ ID NO: 2635146 - DNA, 12 bp, Homo sapiens
ctgcccaccccc

SEQ ID NO: 2635147 - DNA, 13 bp, Homo sapiens
ctgcccaccccct

SEQ ID NO: 2635148 - DNA, 19 bp, Homo sapiens
ctgcccacctggcctctgc

SEQ ID NO: 2635149 - DNA, 16 bp, Homo sapiens
ctgcccactccctgca

SEQ ID NO: 2635150 - DNA, 17 bp, Homo sapiens
ctgcccagcttgggccc

SEQ ID NO: 2635151 - DNA, 19 bp, Homo sapiens
ctgcccagcttgggcccag

SEQ ID NO: 2635152 - DNA, 21 bp, Homo sapiens
ctgcccagcttgggcccagct

SEQ ID NO: 2635153 - DNA, 18 bp, Homo sapiens
ctgcccaggcccctgcca

SEQ ID NO: 2635154 - DNA, 13 bp, Homo sapiens
ctgcccaggggtg

SEQ ID NO: 2635155 - DNA, 18 bp, Homo sapiens
ctgcccaggggtgccccc

SEQ ID NO: 2635156 - DNA, 20 bp, Homo sapiens
ctgcccaggggtgccccctc

SEQ ID NO: 2635157 - DNA, 20 bp, Homo sapiens
ctgcccatctgggaaaatac

SEQ ID NO: 2635158 - DNA, 18 bp, Homo sapiens
ctgcccatgccaccgctt

SEQ ID NO: 2635159 - DNA, 21 bp, Homo sapiens
ctgccccaaacaaatatgcaa

SEQ ID NO: 2635160 - DNA, 23 bp, Homo sapiens
ctgccccacccctccccattagc

SEQ ID NO: 2635161 - DNA, 19 bp, Homo sapiens
ctgccccccagcctctggc

SEQ ID NO: 2635162 - DNA, 16 bp, Homo sapiens
ctgccccctgaaactt

SEQ ID NO: 2635163 - DNA, 17 bp, Homo sapiens
ctgccccctgaaactta

SEQ ID NO: 2635164 - DNA, 15 bp, Homo sapiens
ctgccccctgctggc

SEQ ID NO: 2635165 - DNA, 14 bp, Homo sapiens
ctgccccctggtgg

SEQ ID NO: 2635166 - DNA, 17 bp, Homo sapiens
ctgcccccttctcccac

SEQ ID NO: 2635167 - DNA, 13 bp, Homo sapiens
ctgcccctcccag

SEQ ID NO: 2635168 - DNA, 16 bp, Homo sapiens
ctgcccctcccagaac

SEQ ID NO: 2635169 - DNA, 13 bp, Homo sapiens
ctgcccctccccc

SEQ ID NO: 2635170 - DNA, 14 bp, Homo sapiens
ctgcccctgccccg

SEQ ID NO: 2635171 - DNA, 16 bp, Homo sapiens
ctgcccctggctctga

SEQ ID NO: 2635172 - DNA, 13 bp, Homo sapiens
ctgcccgagctgg

SEQ ID NO: 2635173 - DNA, 16 bp, Homo sapiens
ctgcccgagctggtgc

SEQ ID NO: 2635174 - DNA, 20 bp, Homo sapiens
ctgcccggcagggtcctaga

SEQ ID NO: 2635175 - DNA, 13 bp, Homo sapiens
ctgcccggggcag

SEQ ID NO: 2635176 - DNA, 16 bp, Homo sapiens
ctgcccggggcagctg

SEQ ID NO: 2635177 - DNA, 18 bp, Homo sapiens
ctgcccgtctctctccca

SEQ ID NO: 2635178 - DNA, 19 bp, Homo sapiens
ctgcccgtctctctcccat

SEQ ID NO: 2635179 - DNA, 22 bp, Homo sapiens
ctgcccgtctctctcccatgga

SEQ ID NO: 2635180 - DNA, 15 bp, Homo sapiens
ctgcccgtcttcagc

SEQ ID NO: 2635181 - DNA, 16 bp, Homo sapiens
ctgcccgtcttcagcc

SEQ ID NO: 2635182 - DNA, 17 bp, Homo sapiens
ctgcccgtcttcagcct

SEQ ID NO: 2635183 - DNA, 18 bp, Homo sapiens
ctgcccgtcttcagccta

SEQ ID NO: 2635184 - DNA, 18 bp, Homo sapiens
ctgccctacagaggtctc

SEQ ID NO: 2635185 - DNA, 19 bp, Homo sapiens
ctgccctagagcacactgt

SEQ ID NO: 2635186 - DNA, 15 bp, Homo sapiens
ctgccctagctccac

SEQ ID NO: 2635187 - DNA, 20 bp, Homo sapiens
ctgccctccttgtccaccca

SEQ ID NO: 2635188 - DNA, 17 bp, Homo sapiens
ctgccctcgtggccagc

SEQ ID NO: 2635189 - DNA, 18 bp, Homo sapiens
ctgccctcgtggccagcc

SEQ ID NO: 2635190 - DNA, 19 bp, Homo sapiens
ctgccctcgtggccagccc

SEQ ID NO: 2635191 - DNA, 22 bp, Homo sapiens
ctgccctcgtggccagcccggc

SEQ ID NO: 2635192 - DNA, 23 bp, Homo sapiens
ctgccctcgtggccagcccggct

SEQ ID NO: 2635193 - DNA, 13 bp, Homo sapiens
ctgccctgccact

SEQ ID NO: 2635194 - DNA, 17 bp, Homo sapiens
ctgccctgcccacctgg

SEQ ID NO: 2635195 - DNA, 20 bp, Homo sapiens
ctgccctgcccacctggcct

SEQ ID NO: 2635196 - DNA, 13 bp, Homo sapiens
ctgccctgcctga

SEQ ID NO: 2635197 - DNA, 13 bp, Homo sapiens
ctgccctggccct

SEQ ID NO: 2635198 - DNA, 15 bp, Homo sapiens
ctgccctggccctga

SEQ ID NO: 2635199 - DNA, 17 bp, Homo sapiens
ctgccctggccctgagg

SEQ ID NO: 2635200 - DNA, 22 bp, Homo sapiens
ctgccctggccctgaggtgtgg

SEQ ID NO: 2635201 - DNA, 15 bp, Homo sapiens
ctgccctgtgggccc

SEQ ID NO: 2635202 - DNA, 16 bp, Homo sapiens
ctgccctgtgggcccc

SEQ ID NO: 2635203 - DNA, 18 bp, Homo sapiens
ctgccctgtgggccccca

SEQ ID NO: 2635204 - DNA, 17 bp, Homo sapiens
ctgcccttcaccccagt

SEQ ID NO: 2635205 - DNA, 15 bp, Homo sapiens
ctgcccttgtcccac

SEQ ID NO: 2635206 - DNA, 13 bp, Homo sapiens
ctgccgaccagag

SEQ ID NO: 2635207 - DNA, 23 bp, Homo sapiens
ctgccgaccgaggctggagctgg

SEQ ID NO: 2635208 - DNA, 14 bp, Homo sapiens
ctgccgactcctgg

SEQ ID NO: 2635209 - DNA, 18 bp, Homo sapiens
ctgccgcaatacaggaac

SEQ ID NO: 2635210 - DNA, 16 bp, Homo sapiens
ctgccgccccacccag

SEQ ID NO: 2635211 - DNA, 16 bp, Homo sapiens
ctgccgcctcccagcc

SEQ ID NO: 2635212 - DNA, 18 bp, Homo sapiens
ctgccgcctcccagcctg

SEQ ID NO: 2635213 - DNA, 15 bp, Homo sapiens
ctgccggccctgggg

SEQ ID NO: 2635214 - DNA, 16 bp, Homo sapiens
ctgccggccctggggc

SEQ ID NO: 2635215 - DNA, 21 bp, Homo sapiens
ctgccggccctggggctaggc

SEQ ID NO: 2635216 - DNA, 22 bp, Homo sapiens
ctgccggctctttccttgctca

SEQ ID NO: 2635217 - DNA, 21 bp, Homo sapiens
ctgccgggttctagtctcctt

SEQ ID NO: 2635218 - DNA, 15 bp, Homo sapiens
ctgcctactgcatcg

SEQ ID NO: 2635219 - DNA, 13 bp, Homo sapiens
ctgcctcaggttc

SEQ ID NO: 2635220 - DNA, 18 bp, Homo sapiens
ctgcctcaggttcctatg

SEQ ID NO: 2635221 - DNA, 12 bp, Homo sapiens
ctgcctccaccc

SEQ ID NO: 2635222 - DNA, 21 bp, Homo sapiens
ctgaggtctcttgagggagct

SEQ ID NO: 2635223 - DNA, 14 bp, Homo sapiens
ctgaggtgggccca

SEQ ID NO: 2635224 - DNA, 13 bp, Homo sapiens
ctgaggtgtgggg

SEQ ID NO: 2635225 - DNA, 21 bp, Homo sapiens
ctgagtacgttgtgcatttgg

SEQ ID NO: 2635226 - DNA, 20 bp, Homo sapiens
ctgagtcacccatgaagaca

SEQ ID NO: 2635227 - DNA, 22 bp, Homo sapiens
ctgagtcaccctacctgtgcct

SEQ ID NO: 2635228 - DNA, 21 bp, Homo sapiens
ctgagtccttaaacagggcat

SEQ ID NO: 2635229 - DNA, 18 bp, Homo sapiens
ctgagtcgtacagaaagc

SEQ ID NO: 2635230 - DNA, 19 bp, Homo sapiens
ctgagtcgtacagaaagct

SEQ ID NO: 2635231 - DNA, 20 bp, Homo sapiens
ctgagtcgtacagaaagctg

SEQ ID NO: 2635232 - DNA, 15 bp, Homo sapiens
ctgagtctcctgtgc

SEQ ID NO: 2635233 - DNA, 13 bp, Homo sapiens
ctgagtctgaagg

SEQ ID NO: 2635234 - DNA, 22 bp, Homo sapiens
ctgagtggactggagtggagca

SEQ ID NO: 2635235 - DNA, 13 bp, Homo sapiens
ctgataaagatga

SEQ ID NO: 2635236 - DNA, 12 bp, Homo sapiens
ctgatacctcaa

SEQ ID NO: 2635237 - DNA, 15 bp, Homo sapiens
ctgatagctctttgg

SEQ ID NO: 2635238 - DNA, 17 bp, Homo sapiens
ctgataggccaagtttg

SEQ ID NO: 2635239 - DNA, 17 bp, Homo sapiens
ctgatagttactgttgt

SEQ ID NO: 2635240 - DNA, 21 bp, Homo sapiens
ctgatatatgtgtttttcaca

SEQ ID NO: 2635241 - DNA, 22 bp, Homo sapiens
ctgatatatgtgtttttcacat

SEQ ID NO: 2635242 - DNA, 18 bp, Homo sapiens
ctgatatgatttaaaaca

SEQ ID NO: 2635243 - DNA, 22 bp, Homo sapiens
ctgatatttccctcccctgggg

SEQ ID NO: 2635244 - DNA, 17 bp, Homo sapiens
ctgatcaatgacagagc

SEQ ID NO: 2635245 - DNA, 12 bp, Homo sapiens
ctgatcatgcat

SEQ ID NO: 2635246 - DNA, 14 bp, Homo sapiens
ctgatcatgcattg

SEQ ID NO: 2635247 - DNA, 13 bp, Homo sapiens
ctgatccagagca

SEQ ID NO: 2635248 - DNA, 21 bp, Homo sapiens
ctgatccagagcacagatctg

SEQ ID NO: 2635249 - DNA, 13 bp, Homo sapiens
ctgatccctctac

SEQ ID NO: 2635250 - DNA, 14 bp, Homo sapiens
ctgatcgtgacgct

SEQ ID NO: 2635251 - DNA, 22 bp, Homo sapiens
ctgatcgtgacgctgaataaat

SEQ ID NO: 2635252 - DNA, 19 bp, Homo sapiens
ctgatcgtgctaaattttc

SEQ ID NO: 2635253 - DNA, 13 bp, Homo sapiens
ctgatctccatgg

SEQ ID NO: 2635254 - DNA, 22 bp, Homo sapiens
ctgatctccatggcttcctcct

SEQ ID NO: 2635255 - DNA, 13 bp, Homo sapiens
ctgatctgtgctt

SEQ ID NO: 2635256 - DNA, 17 bp, Homo sapiens
ctgatctgtgctttcca

SEQ ID NO: 2635257 - DNA, 18 bp, Homo sapiens
ctgatctgtgctttccag

SEQ ID NO: 2635258 - DNA, 20 bp, Homo sapiens
ctgatctgtgctttccagct

SEQ ID NO: 2635259 - DNA, 20 bp, Homo sapiens
ctgatgaacttattctgtag

SEQ ID NO: 2635260 - DNA, 16 bp, Homo sapiens
ctgatgacagagcgag

SEQ ID NO: 2635261 - DNA, 17 bp, Homo sapiens
ctgatgatgtgcctggg

SEQ ID NO: 2635262 - DNA, 20 bp, Homo sapiens
ctgatgatttgtttttgtat

SEQ ID NO: 2635263 - DNA, 15 bp, Homo sapiens
ctgatgctccctccc

SEQ ID NO: 2635264 - DNA, 16 bp, Homo sapiens
ctgatgcttcttcaga

SEQ ID NO: 2635265 - DNA, 17 bp, Homo sapiens
ctgatgcttcttcagag

SEQ ID NO: 2635266 - DNA, 18 bp, Homo sapiens
ctgatgcttcttcagaga

SEQ ID NO: 2635267 - DNA, 19 bp, Homo sapiens
ctgatgcttcttcagagac

SEQ ID NO: 2635268 - DNA, 14 bp, Homo sapiens
ctgatggacaagga

SEQ ID NO: 2635269 - DNA, 19 bp, Homo sapiens
ctgatggcaggatggcctg

SEQ ID NO: 2635270 - DNA, 18 bp, Homo sapiens
ctgatggcttctccaggg

SEQ ID NO: 2635271 - DNA, 15 bp, Homo sapiens
ctgatggtcagctcc

SEQ ID NO: 2635272 - DNA, 19 bp, Homo sapiens
ctgatggtcagctcccttc

SEQ ID NO: 2635273 - DNA, 13 bp, Homo sapiens
ctgatgtgtacat

SEQ ID NO: 2635274 - DNA, 15 bp, Homo sapiens
ctgatgttcagtgta

SEQ ID NO: 2635275 - DNA, 13 bp, Homo sapiens
ctgatgttcctag

SEQ ID NO: 2635276 - DNA, 20 bp, Homo sapiens
ctgatgttcctagtgaaaga

SEQ ID NO: 2635277 - DNA, 23 bp, Homo sapiens
ctgattagaaatgaccaatatta

SEQ ID NO: 2635278 - DNA, 22 bp, Homo sapiens
ctgattcataataaatatctgt

SEQ ID NO: 2635279 - DNA, 17 bp, Homo sapiens
ctgattcccaagctctg

SEQ ID NO: 2635280 - DNA, 19 bp, Homo sapiens
ctgattcccaagctctgct

SEQ ID NO: 2635281 - DNA, 22 bp, Homo sapiens
ctgattcccaagctctgctcct

SEQ ID NO: 2635282 - DNA, 14 bp, Homo sapiens
ctgattctcagggt

SEQ ID NO: 2635283 - DNA, 15 bp, Homo sapiens
ctgattctcagggtc

SEQ ID NO: 2635284 - DNA, 17 bp, Homo sapiens
ctgattctcagggtctc

SEQ ID NO: 2635285 - DNA, 16 bp, Homo sapiens
ctgattggctcaccca

SEQ ID NO: 2635286 - DNA, 18 bp, Homo sapiens
ctgattgtaacgttgctg

SEQ ID NO: 2635287 - DNA, 21 bp, Homo sapiens
ctgattgtaacgttgctgtgg

SEQ ID NO: 2635288 - DNA, 17 bp, Homo sapiens
ctgattgtttcattgcg

SEQ ID NO: 2635289 - DNA, 13 bp, Homo sapiens
ctgatttcacaac

SEQ ID NO: 2635290 - DNA, 12 bp, Homo sapiens
ctgatttcagga

SEQ ID NO: 2635291 - DNA, 14 bp, Homo sapiens
ctgatttggaaaaa

SEQ ID NO: 2635292 - DNA, 17 bp, Homo sapiens
ctgattttaacaataac

SEQ ID NO: 2635293 - DNA, 15 bp, Homo sapiens
ctgattttttttcct

SEQ ID NO: 2635294 - DNA, 13 bp, Homo sapiens
ctgcaaaatttta

SEQ ID NO: 2635295 - DNA, 18 bp, Homo sapiens
ctgcaaacctgacccctg

SEQ ID NO: 2635296 - DNA, 22 bp, Homo sapiens
ctgcaaaggactgttttttcct

SEQ ID NO: 2635297 - DNA, 20 bp, Homo sapiens
ctgcaacctccgcctcttgg

SEQ ID NO: 2635298 - DNA, 22 bp, Homo sapiens
ctgcaacctccgcctcttgggt

SEQ ID NO: 2635299 - DNA, 15 bp, Homo sapiens
ctgcaacctgttgat

SEQ ID NO: 2635300 - DNA, 17 bp, Homo sapiens
ctgcaacggcttagact

SEQ ID NO: 2635301 - DNA, 15 bp, Homo sapiens
ctgcaacttctgcct

SEQ ID NO: 2635302 - DNA, 20 bp, Homo sapiens
ctgcaactttaagcagctct

SEQ ID NO: 2635303 - DNA, 20 bp, Homo sapiens
ctgcaagaattgaagcagga

SEQ ID NO: 2635304 - DNA, 19 bp, Homo sapiens
ctgcaagattctgaaacat

SEQ ID NO: 2635305 - DNA, 13 bp, Homo sapiens
ctgcaaggccttt

SEQ ID NO: 2635306 - DNA, 20 bp, Homo sapiens
ctgcaaggcctttctgtgtg

SEQ ID NO: 2635307 - DNA, 12 bp, Homo sapiens
ctgcaagtcaga

SEQ ID NO: 2635308 - DNA, 14 bp, Homo sapiens
ctgcaagtcagagg

SEQ ID NO: 2635309 - DNA, 21 bp, Homo sapiens
ctgcaagtcagaggatggcca

SEQ ID NO: 2635310 - DNA, 23 bp, Homo sapiens
ctgcaatcctgtctttctgagca

SEQ ID NO: 2635311 - DNA, 18 bp, Homo sapiens
ctgcaatgtgggcagaga

SEQ ID NO: 2635312 - DNA, 15 bp, Homo sapiens
ctgcaatgttttcct

SEQ ID NO: 2635313 - DNA, 16 bp, Homo sapiens
ctgcaattcccctctg

SEQ ID NO: 2635314 - DNA, 20 bp, Homo sapiens
ctgcaattcccctctgctgc

SEQ ID NO: 2635315 - DNA, 15 bp, Homo sapiens
ctgcaattgcttagg

SEQ ID NO: 2635316 - DNA, 16 bp, Homo sapiens
ctgcaattgcttagga

SEQ ID NO: 2635317 - DNA, 21 bp, Homo sapiens
ctgcacaaagcccttccatgt

SEQ ID NO: 2635318 - DNA, 14 bp, Homo sapiens
ctgcacaagctgca

SEQ ID NO: 2635319 - DNA, 16 bp, Homo sapiens
ctgcacaagctgcacc

SEQ ID NO: 2635320 - DNA, 22 bp, Homo sapiens
ctgcacaataaaaatgtttaac

SEQ ID NO: 2635321 - DNA, 20 bp, Homo sapiens
ctgcacagagctctccagct

SEQ ID NO: 2635322 - DNA, 21 bp, Homo sapiens
ctgcacagagctctccagctc

SEQ ID NO: 2635323 - DNA, 19 bp, Homo sapiens
ctgcacagcggcccctgca

SEQ ID NO: 2635324 - DNA, 14 bp, Homo sapiens
ctgcacatgtcttg

SEQ ID NO: 2635325 - DNA, 21 bp, Homo sapiens
ctgcacatgtcttgtacatgt

SEQ ID NO: 2635326 - DNA, 21 bp, Homo sapiens
ctgcacattaaggagaaatct

SEQ ID NO: 2635327 - DNA, 15 bp, Homo sapiens
ctgcacccccctggg

SEQ ID NO: 2635328 - DNA, 14 bp, Homo sapiens
ctgcaccctcaggc

SEQ ID NO: 2635329 - DNA, 18 bp, Homo sapiens
ctgcaccctccaccctgt

SEQ ID NO: 2635330 - DNA, 18 bp, Homo sapiens
ctgcaccggctggcctgg

SEQ ID NO: 2635331 - DNA, 15 bp, Homo sapiens
ctgcaccgggccaca

SEQ ID NO: 2635332 - DNA, 20 bp, Homo sapiens
ctgcaccgggccacagagaa

SEQ ID NO: 2635333 - DNA, 23 bp, Homo sapiens
ctgcaccgggccacagagaaagt

SEQ ID NO: 2635334 - DNA, 14 bp, Homo sapiens
ctgcacctgtgcag

SEQ ID NO: 2635335 - DNA, 16 bp, Homo sapiens
ctgcactatagcctag

SEQ ID NO: 2635336 - DNA, 20 bp, Homo sapiens
ctgcactatagcctaggtga

SEQ ID NO: 2635337 - DNA, 22 bp, Homo sapiens
ctgcactatagcctaggtgaca

SEQ ID NO: 2635338 - DNA, 23 bp, Homo sapiens
ctgcactatagcctaggtgacag

SEQ ID NO: 2635339 - DNA, 14 bp, Homo sapiens
ctgcactcaagctt

SEQ ID NO: 2635340 - DNA, 14 bp, Homo sapiens
ctgcactccagcct

SEQ ID NO: 2635341 - DNA, 18 bp, Homo sapiens
ctgcactccagcctgggc

SEQ ID NO: 2635342 - DNA, 20 bp, Homo sapiens
ctgcactcccctgctgggtg

SEQ ID NO: 2635343 - DNA, 16 bp, Homo sapiens
ctgcactggagtccag

SEQ ID NO: 2635344 - DNA, 16 bp, Homo sapiens
ctgcactggggagccc

SEQ ID NO: 2635345 - DNA, 22 bp, Homo sapiens
ctgcactggggagcccgtctca

SEQ ID NO: 2635346 - DNA, 14 bp, Homo sapiens
ctgcacttgcagac

SEQ ID NO: 2635347 - DNA, 18 bp, Homo sapiens
ctgcacttgcagactcta

SEQ ID NO: 2635348 - DNA, 13 bp, Homo sapiens
ctgcagaagacag

SEQ ID NO: 2635349 - DNA, 23 bp, Homo sapiens
ctgcagaagacagtatggcagct

SEQ ID NO: 2635350 - DNA, 19 bp, Homo sapiens
ctgcagaaggccaagaatc

SEQ ID NO: 2635351 - DNA, 19 bp, Homo sapiens
ctgcagaggggctttctgg

SEQ ID NO: 2635352 - DNA, 20 bp, Homo sapiens
ctgcagaggggctttctgga

SEQ ID NO: 2635353 - DNA, 22 bp, Homo sapiens
ctgcagaggggctttctggaga

SEQ ID NO: 2635354 - DNA, 23 bp, Homo sapiens
ctgcagatttgggctggaacaga

SEQ ID NO: 2635355 - DNA, 18 bp, Homo sapiens
ctgcagcagaggcactgg

SEQ ID NO: 2635356 - DNA, 11 bp, Homo sapiens
ctgcagcatga

SEQ ID NO: 2635357 - DNA, 22 bp, Homo sapiens
ctgcagcatgacctgtgaccag

SEQ ID NO: 2635358 - DNA, 22 bp, Homo sapiens
ctgcagcatgttgctgaggagt

SEQ ID NO: 2635359 - DNA, 16 bp, Homo sapiens
ctgcagcccagggacc

SEQ ID NO: 2635360 - DNA, 24 bp, Homo sapiens
ctgcagcctcaacctcctgggcta

SEQ ID NO: 2635361 - DNA, 18 bp, Homo sapiens
ctgcagcctccttctcct

SEQ ID NO: 2635362 - DNA, 12 bp, Homo sapiens
ctgcagctgacc

SEQ ID NO: 2635363 - DNA, 21 bp, Homo sapiens
ctgcagctgacctctgttgtc

SEQ ID NO: 2635364 - DNA, 17 bp, Homo sapiens
ctgcagctgttttagtt

SEQ ID NO: 2635365 - DNA, 12 bp, Homo sapiens
ctgcagctttac

SEQ ID NO: 2635366 - DNA, 16 bp, Homo sapiens
ctgcaggagttaaaaa

SEQ ID NO: 2635367 - DNA, 20 bp, Homo sapiens
ctgcaggcaccttagtggct

SEQ ID NO: 2635368 - DNA, 19 bp, Homo sapiens
ctgcaggcagccaggccac

SEQ ID NO: 2635369 - DNA, 17 bp, Homo sapiens
ctgcaggcatcacagct

SEQ ID NO: 2635370 - DNA, 22 bp, Homo sapiens
ctgcaggccaagagcagaggca

SEQ ID NO: 2635371 - DNA, 24 bp, Homo sapiens
ctgcaggccaagagcagaggcagc

SEQ ID NO: 2635372 - DNA, 19 bp, Homo sapiens
ctgaccaatattgtacagt

SEQ ID NO: 2635373 - DNA, 18 bp, Homo sapiens
ctgaccacacttcctgtc

SEQ ID NO: 2635374 - DNA, 20 bp, Homo sapiens
ctgaccacacttcctgtcca

SEQ ID NO: 2635375 - DNA, 12 bp, Homo sapiens
ctgaccaccctc

SEQ ID NO: 2635376 - DNA, 16 bp, Homo sapiens
ctgaccaccctcccct

SEQ ID NO: 2635377 - DNA, 16 bp, Homo sapiens
ctgaccatccactcta

SEQ ID NO: 2635378 - DNA, 13 bp, Homo sapiens
ctgacccaggccg

SEQ ID NO: 2635379 - DNA, 15 bp, Homo sapiens
ctgacccaggccgca

SEQ ID NO: 2635380 - DNA, 16 bp, Homo sapiens
ctgacccaggccgcag

SEQ ID NO: 2635381 - DNA, 18 bp, Homo sapiens
ctgacccaggccgcagct

SEQ ID NO: 2635382 - DNA, 19 bp, Homo sapiens
ctgacccaggccgcagctc

SEQ ID NO: 2635383 - DNA, 21 bp, Homo sapiens
ctgacccaggccgcagctctt

SEQ ID NO: 2635384 - DNA, 14 bp, Homo sapiens
ctgacccatgctgc

SEQ ID NO: 2635385 - DNA, 16 bp, Homo sapiens
ctgacccatgctgccc

SEQ ID NO: 2635386 - DNA, 17 bp, Homo sapiens
ctgacccatgctgccct

SEQ ID NO: 2635387 - DNA, 18 bp, Homo sapiens
ctgacccatgctgccctg

SEQ ID NO: 2635388 - DNA, 20 bp, Homo sapiens
ctgacccatgctgccctgtg

SEQ ID NO: 2635389 - DNA, 21 bp, Homo sapiens
ctgacccatgctgccctgtga

SEQ ID NO: 2635390 - DNA, 13 bp, Homo sapiens
ctgacccctgctc

SEQ ID NO: 2635391 - DNA, 23 bp, Homo sapiens
ctgaccctgcttcaaatatttcc

SEQ ID NO: 2635392 - DNA, 11 bp, Homo sapiens
ctgacctccca

SEQ ID NO: 2635393 - DNA, 13 bp, Homo sapiens
ctgacctcccagc

SEQ ID NO: 2635394 - DNA, 14 bp, Homo sapiens
ctgacctcccagcc

SEQ ID NO: 2635395 - DNA, 16 bp, Homo sapiens
ctgacctcccagccct

SEQ ID NO: 2635396 - DNA, 12 bp, Homo sapiens
ctgacctctggt

SEQ ID NO: 2635397 - DNA, 13 bp, Homo sapiens
ctgacctgaggct

SEQ ID NO: 2635398 - DNA, 18 bp, Homo sapiens
ctgacctgtcatgccccc

SEQ ID NO: 2635399 - DNA, 16 bp, Homo sapiens
ctgaccttcctcgcag

SEQ ID NO: 2635400 - DNA, 22 bp, Homo sapiens
ctgaccttcctcgcagagaggc

SEQ ID NO: 2635401 - DNA, 23 bp, Homo sapiens
ctgaccttcctcgcagagaggcc

SEQ ID NO: 2635402 - DNA, 22 bp, Homo sapiens
ctgacggaagccaacttggctt

SEQ ID NO: 2635403 - DNA, 18 bp, Homo sapiens
ctgacggtgcagtctggg

SEQ ID NO: 2635404 - DNA, 20 bp, Homo sapiens
ctgacgtgccttttgcaccc

SEQ ID NO: 2635405 - DNA, 22 bp, Homo sapiens
ctgacgtgccttttgcacccct

SEQ ID NO: 2635406 - DNA, 14 bp, Homo sapiens
ctgactcacaagaa

SEQ ID NO: 2635407 - DNA, 15 bp, Homo sapiens
ctgactcacaagaag

SEQ ID NO: 2635408 - DNA, 16 bp, Homo sapiens
ctgactcacaagaaga

SEQ ID NO: 2635409 - DNA, 16 bp, Homo sapiens
ctgactcattctgaag

SEQ ID NO: 2635410 - DNA, 13 bp, Homo sapiens
ctgactccttaga

SEQ ID NO: 2635411 - DNA, 21 bp, Homo sapiens
ctgactcgtctgactgtgtgt

SEQ ID NO: 2635412 - DNA, 16 bp, Homo sapiens
ctgactctctgtgacc

SEQ ID NO: 2635413 - DNA, 19 bp, Homo sapiens
ctgactctgccccctgctg

SEQ ID NO: 2635414 - DNA, 18 bp, Homo sapiens
ctgactgttttctcttga

SEQ ID NO: 2635415 - DNA, 13 bp, Homo sapiens
ctgacttctaagt

SEQ ID NO: 2635416 - DNA, 21 bp, Homo sapiens
ctgacttggggagatggagtt

SEQ ID NO: 2635417 - DNA, 22 bp, Homo sapiens
ctgagaaagactattcaaacag

SEQ ID NO: 2635418 - DNA, 23 bp, Homo sapiens
ctgagaaagactattcaaacagt

SEQ ID NO: 2635419 - DNA, 11 bp, Homo sapiens
ctgagaacact

SEQ ID NO: 2635420 - DNA, 23 bp, Homo sapiens
ctgagaaccctgcgtggggacag

SEQ ID NO: 2635421 - DNA, 17 bp, Homo sapiens
ctgagaagattgtgaat

SEQ ID NO: 2635422 - DNA, 15 bp, Homo sapiens
ctgagaataagaaag

SEQ ID NO: 2635423 - DNA, 23 bp, Homo sapiens
ctgagaatataatactgtatttg

SEQ ID NO: 2635424 - DNA, 16 bp, Homo sapiens
ctgagaattccaagga

SEQ ID NO: 2635425 - DNA, 16 bp, Homo sapiens
ctgagacagcccgggc

SEQ ID NO: 2635426 - DNA, 17 bp, Homo sapiens
ctgagacagcccgggct

SEQ ID NO: 2635427 - DNA, 21 bp, Homo sapiens
ctgagacagcccgggctctgc

SEQ ID NO: 2635428 - DNA, 13 bp, Homo sapiens
ctgagacaggaga

SEQ ID NO: 2635429 - DNA, 17 bp, Homo sapiens
ctgagacccctggcctc

SEQ ID NO: 2635430 - DNA, 23 bp, Homo sapiens
ctgagactccggggagcgcccgc

SEQ ID NO: 2635431 - DNA, 14 bp, Homo sapiens
ctgagagccccagc

SEQ ID NO: 2635432 - DNA, 21 bp, Homo sapiens
ctgagaggacttttctttgtg

SEQ ID NO: 2635433 - DNA, 13 bp, Homo sapiens
ctgagagtctgca

SEQ ID NO: 2635434 - DNA, 14 bp, Homo sapiens
ctgagagtttagtt

SEQ ID NO: 2635435 - DNA, 12 bp, Homo sapiens
ctgagatatgaa

SEQ ID NO: 2635436 - DNA, 15 bp, Homo sapiens
ctgagatatgaacat

SEQ ID NO: 2635437 - DNA, 21 bp, Homo sapiens
ctgagatatgaacatattgtt

SEQ ID NO: 2635438 - DNA, 21 bp, Homo sapiens
ctgagatcaaaacggttttac

SEQ ID NO: 2635439 - DNA, 20 bp, Homo sapiens
ctgagatgtgaacacatcag

SEQ ID NO: 2635440 - DNA, 21 bp, Homo sapiens
ctgagatgtgaacacatcagc

SEQ ID NO: 2635441 - DNA, 12 bp, Homo sapiens
ctgagcaaagca

SEQ ID NO: 2635442 - DNA, 24 bp, Homo sapiens
ctgagcaacagagtgagaccctgt

SEQ ID NO: 2635443 - DNA, 12 bp, Homo sapiens
ctgagcaagagc

SEQ ID NO: 2635444 - DNA, 16 bp, Homo sapiens
ctgagcaagagctggc

SEQ ID NO: 2635445 - DNA, 20 bp, Homo sapiens
ctgagcaagagctggcaaag

SEQ ID NO: 2635446 - DNA, 16 bp, Homo sapiens
ctgagcacctgcttca

SEQ ID NO: 2635447 - DNA, 17 bp, Homo sapiens
ctgagcacctgcttcat

SEQ ID NO: 2635448 - DNA, 13 bp, Homo sapiens
ctgagcagggaga

SEQ ID NO: 2635449 - DNA, 12 bp, Homo sapiens
ctgagcaggtgt

SEQ ID NO: 2635450 - DNA, 22 bp, Homo sapiens
ctgagccagttcagtacctgga

SEQ ID NO: 2635451 - DNA, 23 bp, Homo sapiens
ctgagccagttcagtacctggag

SEQ ID NO: 2635452 - DNA, 19 bp, Homo sapiens
ctgagcccgggctgcctgg

SEQ ID NO: 2635453 - DNA, 16 bp, Homo sapiens
ctgagccctcaaagtg

SEQ ID NO: 2635454 - DNA, 11 bp, Homo sapiens
ctgagccctgg

SEQ ID NO: 2635455 - DNA, 13 bp, Homo sapiens
ctgagcctctcac

SEQ ID NO: 2635456 - DNA, 22 bp, Homo sapiens
ctgagcctctcacctgtactct

SEQ ID NO: 2635457 - DNA, 20 bp, Homo sapiens
ctgagcgaggagatgctcct

SEQ ID NO: 2635458 - DNA, 19 bp, Homo sapiens
ctgagcggatgcatctggg

SEQ ID NO: 2635459 - DNA, 23 bp, Homo sapiens
ctgagcgtgctttccaaaaccca

SEQ ID NO: 2635460 - DNA, 22 bp, Homo sapiens
ctgagctccatgtgccccctct

SEQ ID NO: 2635461 - DNA, 14 bp, Homo sapiens
ctgagctcctctgg

SEQ ID NO: 2635462 - DNA, 12 bp, Homo sapiens
ctgagctgggat

SEQ ID NO: 2635463 - DNA, 13 bp, Homo sapiens
ctgagctgtgcag

SEQ ID NO: 2635464 - DNA, 15 bp, Homo sapiens
ctgagcttggccaga

SEQ ID NO: 2635465 - DNA, 12 bp, Homo sapiens
ctgagctttgca

SEQ ID NO: 2635466 - DNA, 20 bp, Homo sapiens
ctgaggaaaggccagctggc

SEQ ID NO: 2635467 - DNA, 22 bp, Homo sapiens
ctgaggaaaggccagctggcag

SEQ ID NO: 2635468 - DNA, 22 bp, Homo sapiens
ctgaggaacccttacagtagga

SEQ ID NO: 2635469 - DNA, 14 bp, Homo sapiens
ctgaggaatccaga

SEQ ID NO: 2635470 - DNA, 20 bp, Homo sapiens
ctgaggaatccagacccggc

SEQ ID NO: 2635471 - DNA, 23 bp, Homo sapiens
ctgaggaatccagacccggctgc

SEQ ID NO: 2635472 - DNA, 15 bp, Homo sapiens
ctgaggacagctgtc

SEQ ID NO: 2635473 - DNA, 16 bp, Homo sapiens
ctgaggacagctgtcc

SEQ ID NO: 2635474 - DNA, 11 bp, Homo sapiens
ctgaggagaaa

SEQ ID NO: 2635475 - DNA, 14 bp, Homo sapiens
ctgaggaggcctcc

SEQ ID NO: 2635476 - DNA, 16 bp, Homo sapiens
ctgaggaggcctccat

SEQ ID NO: 2635477 - DNA, 15 bp, Homo sapiens
ctgaggatgagctgg

SEQ ID NO: 2635478 - DNA, 22 bp, Homo sapiens
ctgaggatttaagggatggaaa

SEQ ID NO: 2635479 - DNA, 12 bp, Homo sapiens
ctgaggcaagag

SEQ ID NO: 2635480 - DNA, 16 bp, Homo sapiens
ctgaggcagacagcag

SEQ ID NO: 2635481 - DNA, 17 bp, Homo sapiens
ctgaggcagacagcagc

SEQ ID NO: 2635482 - DNA, 23 bp, Homo sapiens
ctgaggcagcagtgtgaggccag

SEQ ID NO: 2635483 - DNA, 24 bp, Homo sapiens
ctgaggcagcagtgtgaggccagg

SEQ ID NO: 2635484 - DNA, 15 bp, Homo sapiens
ctgaggcaggaggat

SEQ ID NO: 2635485 - DNA, 14 bp, Homo sapiens
ctgaggcagggaag

SEQ ID NO: 2635486 - DNA, 16 bp, Homo sapiens
ctgaggcagggaagtc

SEQ ID NO: 2635487 - DNA, 21 bp, Homo sapiens
ctgaggcagggaagtccccag

SEQ ID NO: 2635488 - DNA, 22 bp, Homo sapiens
ctgaggcagggaagtccccagg

SEQ ID NO: 2635489 - DNA, 14 bp, Homo sapiens
ctgaggcccagagg

SEQ ID NO: 2635490 - DNA, 19 bp, Homo sapiens
ctgaggcccagagggcctg

SEQ ID NO: 2635491 - DNA, 20 bp, Homo sapiens
ctgaggcccttctctccagc

SEQ ID NO: 2635492 - DNA, 22 bp, Homo sapiens
ctgaggcccttctctccagccc

SEQ ID NO: 2635493 - DNA, 23 bp, Homo sapiens
ctgaggcccttctctccagcccc

SEQ ID NO: 2635494 - DNA, 24 bp, Homo sapiens
ctgaggcccttctctccagcccct

SEQ ID NO: 2635495 - DNA, 20 bp, Homo sapiens
ctgaggctcctgtgctactt

SEQ ID NO: 2635496 - DNA, 22 bp, Homo sapiens
ctgaggctctgacccagtgaga

SEQ ID NO: 2635497 - DNA, 20 bp, Homo sapiens
ctgaggctctttctgggcca

SEQ ID NO: 2635498 - DNA, 21 bp, Homo sapiens
ctgaggctggatcctagcctt

SEQ ID NO: 2635499 - DNA, 17 bp, Homo sapiens
ctgaggctgggctccct

SEQ ID NO: 2635500 - DNA, 11 bp, Homo sapiens
ctgaggctgta

SEQ ID NO: 2635501 - DNA, 14 bp, Homo sapiens
ctgaggctgtagga

SEQ ID NO: 2635502 - DNA, 16 bp, Homo sapiens
ctgagggaccaactgg

SEQ ID NO: 2635503 - DNA, 15 bp, Homo sapiens
ctgagggaccagcca

SEQ ID NO: 2635504 - DNA, 18 bp, Homo sapiens
ctgagggaccagccaaga

SEQ ID NO: 2635505 - DNA, 16 bp, Homo sapiens
ctgagggactctgaag

SEQ ID NO: 2635506 - DNA, 22 bp, Homo sapiens
ctgagggactctgaagcctctg

SEQ ID NO: 2635507 - DNA, 23 bp, Homo sapiens
ctgagggactctgaagcctctgg

SEQ ID NO: 2635508 - DNA, 13 bp, Homo sapiens
ctgagggagcctg

SEQ ID NO: 2635509 - DNA, 23 bp, Homo sapiens
ctgagggaggaggccacctctcc

SEQ ID NO: 2635510 - DNA, 16 bp, Homo sapiens
ctgagggcagtcgata

SEQ ID NO: 2635511 - DNA, 14 bp, Homo sapiens
ctgagggccacact

SEQ ID NO: 2635512 - DNA, 13 bp, Homo sapiens
ctgagggcccctc

SEQ ID NO: 2635513 - DNA, 21 bp, Homo sapiens
ctgagggcccctctgcccagc

SEQ ID NO: 2635514 - DNA, 16 bp, Homo sapiens
ctgagggcttcctttg

SEQ ID NO: 2635515 - DNA, 21 bp, Homo sapiens
ctgaggggaggatcactggag

SEQ ID NO: 2635516 - DNA, 17 bp, Homo sapiens
ctgaggggcatctgccc

SEQ ID NO: 2635517 - DNA, 18 bp, Homo sapiens
ctgaggggcatctgcccc

SEQ ID NO: 2635518 - DNA, 19 bp, Homo sapiens
ctgaggggcatctgcccct

SEQ ID NO: 2635519 - DNA, 16 bp, Homo sapiens
ctgaggggggccgtgc

SEQ ID NO: 2635520 - DNA, 23 bp, Homo sapiens
ctgaggggggccgtgcccagggg

SEQ ID NO: 2635521 - DNA, 19 bp, Homo sapiens
ctgagggtccccacctggg

SEQ ID NO: 2635522 - DNA, 17 bp, Homo sapiens
ctcttcaggcctccctc

SEQ ID NO: 2635523 - DNA, 18 bp, Homo sapiens
ctcttcaggcctccctct

SEQ ID NO: 2635524 - DNA, 12 bp, Homo sapiens
ctcttcccctct

SEQ ID NO: 2635525 - DNA, 16 bp, Homo sapiens
ctcttcccctctcaga

SEQ ID NO: 2635526 - DNA, 12 bp, Homo sapiens
ctcttcctaccc

SEQ ID NO: 2635527 - DNA, 22 bp, Homo sapiens
ctcttcctacccaaccactcaa

SEQ ID NO: 2635528 - DNA, 15 bp, Homo sapiens
ctcttctcaagtgcc

SEQ ID NO: 2635529 - DNA, 20 bp, Homo sapiens
ctcttctgacgtgccttttg

SEQ ID NO: 2635530 - DNA, 18 bp, Homo sapiens
ctcttctgagctatttca

SEQ ID NO: 2635531 - DNA, 16 bp, Homo sapiens
ctcttctgcatcttgg

SEQ ID NO: 2635532 - DNA, 20 bp, Homo sapiens
ctcttctgctccacccttgg

SEQ ID NO: 2635533 - DNA, 17 bp, Homo sapiens
ctcttcttcttcagaag

SEQ ID NO: 2635534 - DNA, 18 bp, Homo sapiens
ctcttcttgaacactcat

SEQ ID NO: 2635535 - DNA, 23 bp, Homo sapiens
ctcttcttgaacactcatgctga

SEQ ID NO: 2635536 - DNA, 22 bp, Homo sapiens
ctcttgaaatataggaacttaa

SEQ ID NO: 2635537 - DNA, 13 bp, Homo sapiens
ctcttgacctcag

SEQ ID NO: 2635538 - DNA, 15 bp, Homo sapiens
ctcttgacctcaggt

SEQ ID NO: 2635539 - DNA, 20 bp, Homo sapiens
ctcttgagatcttggtcctg

SEQ ID NO: 2635540 - DNA, 17 bp, Homo sapiens
ctcttgagccttgaact

SEQ ID NO: 2635541 - DNA, 23 bp, Homo sapiens
ctcttgatacccccctctgtctt

SEQ ID NO: 2635542 - DNA, 20 bp, Homo sapiens
ctcttgcaatccacaatctg

SEQ ID NO: 2635543 - DNA, 12 bp, Homo sapiens
ctcttgcacccg

SEQ ID NO: 2635544 - DNA, 15 bp, Homo sapiens
ctcttgcacccgcct

SEQ ID NO: 2635545 - DNA, 20 bp, Homo sapiens
ctcttgcacccgcctctccc

SEQ ID NO: 2635546 - DNA, 22 bp, Homo sapiens
ctcttgccactgcctcttcctc

SEQ ID NO: 2635547 - DNA, 20 bp, Homo sapiens
ctcttgccccccaccccagc

SEQ ID NO: 2635548 - DNA, 19 bp, Homo sapiens
ctcttgcccttccctgtcc

SEQ ID NO: 2635549 - DNA, 22 bp, Homo sapiens
ctcttgctaatcagtgtctcac

SEQ ID NO: 2635550 - DNA, 20 bp, Homo sapiens
ctcttgctcaaaaatctgtt

SEQ ID NO: 2635551 - DNA, 17 bp, Homo sapiens
ctcttggacctctgctc

SEQ ID NO: 2635552 - DNA, 19 bp, Homo sapiens
ctcttgggaaatatgtcaa

SEQ ID NO: 2635553 - DNA, 19 bp, Homo sapiens
ctcttgggttcaagtgatt

SEQ ID NO: 2635554 - DNA, 16 bp, Homo sapiens
ctcttggtcctgctgc

SEQ ID NO: 2635555 - DNA, 19 bp, Homo sapiens
ctcttggtcctgctgcagt

SEQ ID NO: 2635556 - DNA, 15 bp, Homo sapiens
ctcttggtcttccca

SEQ ID NO: 2635557 - DNA, 20 bp, Homo sapiens
ctcttggtttccttccttgg

SEQ ID NO: 2635558 - DNA, 21 bp, Homo sapiens
ctctttaagagttagtttctt

SEQ ID NO: 2635559 - DNA, 21 bp, Homo sapiens
ctctttaatgtcacaggcagg

SEQ ID NO: 2635560 - DNA, 10 bp, Homo sapiens
ctctttgaga

SEQ ID NO: 2635561 - DNA, 15 bp, Homo sapiens
ctctttggacactca

SEQ ID NO: 2635562 - DNA, 15 bp, Homo sapiens
ctctttggcagtcta

SEQ ID NO: 2635563 - DNA, 19 bp, Homo sapiens
ctctttggtctacactgtg

SEQ ID NO: 2635564 - DNA, 23 bp, Homo sapiens
ctctttggtctacactgtgctga

SEQ ID NO: 2635565 - DNA, 14 bp, Homo sapiens
ctctttgtctaaaa

SEQ ID NO: 2635566 - DNA, 21 bp, Homo sapiens
ctctttgtctaaaacaataaa

SEQ ID NO: 2635567 - DNA, 22 bp, Homo sapiens
ctctttgtctaaaacaataaaa

SEQ ID NO: 2635568 - DNA, 14 bp, Homo sapiens
ctcttttcaaaaca

SEQ ID NO: 2635569 - DNA, 20 bp, Homo sapiens
ctcttttgaatccatgcttg

SEQ ID NO: 2635570 - DNA, 20 bp, Homo sapiens
ctctttttagggccaggcag

SEQ ID NO: 2635571 - DNA, 21 bp, Homo sapiens
ctgaaaaaacacctagcttta

SEQ ID NO: 2635572 - DNA, 21 bp, Homo sapiens
ctgaaaaatggtaattgttgc

SEQ ID NO: 2635573 - DNA, 17 bp, Homo sapiens
ctgaaaacactgtgcac

SEQ ID NO: 2635574 - DNA, 18 bp, Homo sapiens
ctgaaaagactcagtgtt

SEQ ID NO: 2635575 - DNA, 19 bp, Homo sapiens
ctgaaaagactcagtgttc

SEQ ID NO: 2635576 - DNA, 20 bp, Homo sapiens
ctgaaaatcgagtttttcct

SEQ ID NO: 2635577 - DNA, 18 bp, Homo sapiens
ctgaaaatggtattttcc

SEQ ID NO: 2635578 - DNA, 13 bp, Homo sapiens
ctgaaaatgtgct

SEQ ID NO: 2635579 - DNA, 14 bp, Homo sapiens
ctgaaagaaacagt

SEQ ID NO: 2635580 - DNA, 16 bp, Homo sapiens
ctgaaagaaacagtta

SEQ ID NO: 2635581 - DNA, 21 bp, Homo sapiens
ctgaaagaaacagttaacttt

SEQ ID NO: 2635582 - DNA, 15 bp, Homo sapiens
ctgaaagacaatata

SEQ ID NO: 2635583 - DNA, 23 bp, Homo sapiens
ctgaaagccatttgttggggcag

SEQ ID NO: 2635584 - DNA, 19 bp, Homo sapiens
ctgaaagtgaaagtccaga

SEQ ID NO: 2635585 - DNA, 18 bp, Homo sapiens
ctgaaatatacacacagc

SEQ ID NO: 2635586 - DNA, 19 bp, Homo sapiens
ctgaaatatacacacagca

SEQ ID NO: 2635587 - DNA, 19 bp, Homo sapiens
ctgaaatctcagaattcct

SEQ ID NO: 2635588 - DNA, 13 bp, Homo sapiens
ctgaaatgaagat

SEQ ID NO: 2635589 - DNA, 13 bp, Homo sapiens
ctgaaatttcaga

SEQ ID NO: 2635590 - DNA, 19 bp, Homo sapiens
ctgaacacttttgttgtaa

SEQ ID NO: 2635591 - DNA, 20 bp, Homo sapiens
ctgaacacttttgttgtaaa

SEQ ID NO: 2635592 - DNA, 15 bp, Homo sapiens
ctgaacattccagag

SEQ ID NO: 2635593 - DNA, 14 bp, Homo sapiens
ctgaacattgcata

SEQ ID NO: 2635594 - DNA, 13 bp, Homo sapiens
ctgaaccctgtgc

SEQ ID NO: 2635595 - DNA, 18 bp, Homo sapiens
ctgaaccctgtgctggtg

SEQ ID NO: 2635596 - DNA, 17 bp, Homo sapiens
ctgaaccggctttacca

SEQ ID NO: 2635597 - DNA, 16 bp, Homo sapiens
ctgaaccttccatctc

SEQ ID NO: 2635598 - DNA, 15 bp, Homo sapiens
ctgaactcaaactga

SEQ ID NO: 2635599 - DNA, 20 bp, Homo sapiens
ctgaagagctattatataaa

SEQ ID NO: 2635600 - DNA, 16 bp, Homo sapiens
ctgaagaggcgggcca

SEQ ID NO: 2635601 - DNA, 19 bp, Homo sapiens
ctgaagaggcgggccagcc

SEQ ID NO: 2635602 - DNA, 20 bp, Homo sapiens
ctgaagagtgggtttcacaa

SEQ ID NO: 2635603 - DNA, 17 bp, Homo sapiens
ctgaagatgatcatttg

SEQ ID NO: 2635604 - DNA, 16 bp, Homo sapiens
ctgaagatgcagctca

SEQ ID NO: 2635605 - DNA, 20 bp, Homo sapiens
ctgaagatggcatcctgtga

SEQ ID NO: 2635606 - DNA, 14 bp, Homo sapiens
ctgaagcctctggg

SEQ ID NO: 2635607 - DNA, 20 bp, Homo sapiens
ctgaagctgacgaacttcca

SEQ ID NO: 2635608 - DNA, 15 bp, Homo sapiens
ctgaagctgcctgct

SEQ ID NO: 2635609 - DNA, 18 bp, Homo sapiens
ctgaagctgcctgctttt

SEQ ID NO: 2635610 - DNA, 12 bp, Homo sapiens
ctgaaggactgt

SEQ ID NO: 2635611 - DNA, 23 bp, Homo sapiens
ctgaaggactgtgacaggcagca

SEQ ID NO: 2635612 - DNA, 12 bp, Homo sapiens
ctgaaggagccc

SEQ ID NO: 2635613 - DNA, 21 bp, Homo sapiens
ctgaaggagccccattcctgg

SEQ ID NO: 2635614 - DNA, 13 bp, Homo sapiens
ctgaaggccccgc

SEQ ID NO: 2635615 - DNA, 15 bp, Homo sapiens
ctgaaggttgaagag

SEQ ID NO: 2635616 - DNA, 16 bp, Homo sapiens
ctgaagtcacacagtg

SEQ ID NO: 2635617 - DNA, 17 bp, Homo sapiens
ctgaagtcacacagtga

SEQ ID NO: 2635618 - DNA, 19 bp, Homo sapiens
ctgaagtcacacagtgagt

SEQ ID NO: 2635619 - DNA, 22 bp, Homo sapiens
ctgaagtcccagatacttgggg

SEQ ID NO: 2635620 - DNA, 13 bp, Homo sapiens
ctgaagtctgaaa

SEQ ID NO: 2635621 - DNA, 19 bp, Homo sapiens
ctgaagtgagcacagccta

SEQ ID NO: 2635622 - DNA, 21 bp, Homo sapiens
ctgaagtgagcacagcctagg

SEQ ID NO: 2635623 - DNA, 16 bp, Homo sapiens
ctgaagtgcatccaaa

SEQ ID NO: 2635624 - DNA, 18 bp, Homo sapiens
ctgaagtgcatccaaagg

SEQ ID NO: 2635625 - DNA, 23 bp, Homo sapiens
ctgaagtggactctttggtggct

SEQ ID NO: 2635626 - DNA, 14 bp, Homo sapiens
ctgaagttcaccat

SEQ ID NO: 2635627 - DNA, 17 bp, Homo sapiens
ctgaagttcagctgcat

SEQ ID NO: 2635628 - DNA, 15 bp, Homo sapiens
ctgaataaatgtctt

SEQ ID NO: 2635629 - DNA, 20 bp, Homo sapiens
ctgaataacatttgtgtggt

SEQ ID NO: 2635630 - DNA, 18 bp, Homo sapiens
ctgaatacattctgcttt

SEQ ID NO: 2635631 - DNA, 20 bp, Homo sapiens
ctgaatatttatatttcact

SEQ ID NO: 2635632 - DNA, 20 bp, Homo sapiens
ctgaatccaaactaatccat

SEQ ID NO: 2635633 - DNA, 18 bp, Homo sapiens
ctgaatgaaacccccaca

SEQ ID NO: 2635634 - DNA, 20 bp, Homo sapiens
ctgaatgaaacccccacaca

SEQ ID NO: 2635635 - DNA, 21 bp, Homo sapiens
ctgaatgaaacccccacacac

SEQ ID NO: 2635636 - DNA, 22 bp, Homo sapiens
ctgaatgaaccttctggcctcc

SEQ ID NO: 2635637 - DNA, 20 bp, Homo sapiens
ctgaatgaggtcagcatgtc

SEQ ID NO: 2635638 - DNA, 22 bp, Homo sapiens
ctgaatgcctcaatgtgaccag

SEQ ID NO: 2635639 - DNA, 23 bp, Homo sapiens
ctgaatgcctcaatgtgaccagg

SEQ ID NO: 2635640 - DNA, 17 bp, Homo sapiens
ctgaatgctctgtgcga

SEQ ID NO: 2635641 - DNA, 22 bp, Homo sapiens
ctgaatggttccatgcctgagg

SEQ ID NO: 2635642 - DNA, 19 bp, Homo sapiens
ctgaatggttttcaaaata

SEQ ID NO: 2635643 - DNA, 14 bp, Homo sapiens
ctgaatgttctgac

SEQ ID NO: 2635644 - DNA, 17 bp, Homo sapiens
ctgaatgttctgacatt

SEQ ID NO: 2635645 - DNA, 20 bp, Homo sapiens
ctgaatgttctgacattaac

SEQ ID NO: 2635646 - DNA, 19 bp, Homo sapiens
ctgaatgttgggactgcta

SEQ ID NO: 2635647 - DNA, 20 bp, Homo sapiens
ctgaattaatgacagagcca

SEQ ID NO: 2635648 - DNA, 21 bp, Homo sapiens
ctgaattaatgacagagccag

SEQ ID NO: 2635649 - DNA, 22 bp, Homo sapiens
ctgaattaatgacagagccagt

SEQ ID NO: 2635650 - DNA, 17 bp, Homo sapiens
ctgaattctatttgctg

SEQ ID NO: 2635651 - DNA, 12 bp, Homo sapiens
ctgaatttcttt

SEQ ID NO: 2635652 - DNA, 13 bp, Homo sapiens
ctgacacacagct

SEQ ID NO: 2635653 - DNA, 17 bp, Homo sapiens
ctgacacacagctctgt

SEQ ID NO: 2635654 - DNA, 20 bp, Homo sapiens
ctgacacacagctctgtcct

SEQ ID NO: 2635655 - DNA, 21 bp, Homo sapiens
ctgacacacagctctgtcctg

SEQ ID NO: 2635656 - DNA, 17 bp, Homo sapiens
ctgacagacacaggccc

SEQ ID NO: 2635657 - DNA, 19 bp, Homo sapiens
ctgacagacacaggcccgg

SEQ ID NO: 2635658 - DNA, 18 bp, Homo sapiens
ctgacagatgtcagccga

SEQ ID NO: 2635659 - DNA, 12 bp, Homo sapiens
ctgacagcctcc

SEQ ID NO: 2635660 - DNA, 17 bp, Homo sapiens
ctgacagcctcccaccc

SEQ ID NO: 2635661 - DNA, 20 bp, Homo sapiens
ctgacagcctcccaccccca

SEQ ID NO: 2635662 - DNA, 16 bp, Homo sapiens
ctgacaggcaatgctg

SEQ ID NO: 2635663 - DNA, 17 bp, Homo sapiens
ctgacaggcaatgctgg

SEQ ID NO: 2635664 - DNA, 18 bp, Homo sapiens
ctgacaggcaatgctggc

SEQ ID NO: 2635665 - DNA, 15 bp, Homo sapiens
ctgacaggcagcctg

SEQ ID NO: 2635666 - DNA, 14 bp, Homo sapiens
ctgacatccccact

SEQ ID NO: 2635667 - DNA, 16 bp, Homo sapiens
ctgacatctctgcaat

SEQ ID NO: 2635668 - DNA, 21 bp, Homo sapiens
ctgacatcttagtatttgcat

SEQ ID NO: 2635669 - DNA, 19 bp, Homo sapiens
ctgaccaacagttccttca

SEQ ID NO: 2635670 - DNA, 15 bp, Homo sapiens
ctgaccaatattgta

SEQ ID NO: 2635671 - DNA, 15 bp, Homo sapiens
ctccctctcactgtc

SEQ ID NO: 2635672 - DNA, 13 bp, Homo sapiens
ctccctctgacct

SEQ ID NO: 2635673 - DNA, 21 bp, Homo sapiens
ctccctctgacctgcaggcca

SEQ ID NO: 2635674 - DNA, 16 bp, Homo sapiens
ctccctctgaggctgt

SEQ ID NO: 2635675 - DNA, 14 bp, Homo sapiens
ctccctctggatca

SEQ ID NO: 2635676 - DNA, 18 bp, Homo sapiens
ctccctggagccagactc

SEQ ID NO: 2635677 - DNA, 11 bp, Homo sapiens
ctccctggagt

SEQ ID NO: 2635678 - DNA, 12 bp, Homo sapiens
ctccctggagtg

SEQ ID NO: 2635679 - DNA, 23 bp, Homo sapiens
ctccctggagtgtggctgaggag

SEQ ID NO: 2635680 - DNA, 12 bp, Homo sapiens
ctccctggccct

SEQ ID NO: 2635681 - DNA, 21 bp, Homo sapiens
ctccctggcctgttctgtttt

SEQ ID NO: 2635682 - DNA, 14 bp, Homo sapiens
ctccctggctccca

SEQ ID NO: 2635683 - DNA, 15 bp, Homo sapiens
ctccctggctctcag

SEQ ID NO: 2635684 - DNA, 18 bp, Homo sapiens
ctccctggctctcagaag

SEQ ID NO: 2635685 - DNA, 11 bp, Homo sapiens
ctccctgggtt

SEQ ID NO: 2635686 - DNA, 14 bp, Homo sapiens
ctccctgggttcag

SEQ ID NO: 2635687 - DNA, 15 bp, Homo sapiens
ctcccttcccacctc

SEQ ID NO: 2635688 - DNA, 15 bp, Homo sapiens
ctcccttctacctgc

SEQ ID NO: 2635689 - DNA, 18 bp, Homo sapiens
ctcccttctacctgccac

SEQ ID NO: 2635690 - DNA, 18 bp, Homo sapiens
ctcccttggaaacctgcc

SEQ ID NO: 2635691 - DNA, 22 bp, Homo sapiens
ctcccttggaaacctgccctgc

SEQ ID NO: 2635692 - DNA, 21 bp, Homo sapiens
ctcccttggtggcaagagccc

SEQ ID NO: 2635693 - DNA, 13 bp, Homo sapiens
ctccgaggccagt

SEQ ID NO: 2635694 - DNA, 16 bp, Homo sapiens
ctccgatccttcctcc

SEQ ID NO: 2635695 - DNA, 19 bp, Homo sapiens
ctccgccttcactccggtg

SEQ ID NO: 2635696 - DNA, 21 bp, Homo sapiens
ctccgctttctacccagcgag

SEQ ID NO: 2635697 - DNA, 16 bp, Homo sapiens
ctccggatcgaggcct

SEQ ID NO: 2635698 - DNA, 14 bp, Homo sapiens
ctccggcctcccct

SEQ ID NO: 2635699 - DNA, 15 bp, Homo sapiens
ctccgggacctggtg

SEQ ID NO: 2635700 - DNA, 14 bp, Homo sapiens
ctccgtatttcaga

SEQ ID NO: 2635701 - DNA, 16 bp, Homo sapiens
ctccgtgcctccacca

SEQ ID NO: 2635702 - DNA, 16 bp, Homo sapiens
ctcctacacctaactc

SEQ ID NO: 2635703 - DNA, 18 bp, Homo sapiens
ctcctagagaacgcagcc

SEQ ID NO: 2635704 - DNA, 18 bp, Homo sapiens
ctcctagagacagaagca

SEQ ID NO: 2635705 - DNA, 14 bp, Homo sapiens
ctcctatctgtgtt

SEQ ID NO: 2635706 - DNA, 15 bp, Homo sapiens
ctcctcacccccagc

SEQ ID NO: 2635707 - DNA, 17 bp, Homo sapiens
ctcctcacccccagctt

SEQ ID NO: 2635708 - DNA, 21 bp, Homo sapiens
ctcctcacctctggactggct

SEQ ID NO: 2635709 - DNA, 18 bp, Homo sapiens
ctcctcagggttgaggtc

SEQ ID NO: 2635710 - DNA, 12 bp, Homo sapiens
ctcctcatcccg

SEQ ID NO: 2635711 - DNA, 11 bp, Homo sapiens
ctcctcatgta

SEQ ID NO: 2635712 - DNA, 20 bp, Homo sapiens
ctcctcatgtacataccctg

SEQ ID NO: 2635713 - DNA, 12 bp, Homo sapiens
ctcctcccagga

SEQ ID NO: 2635714 - DNA, 17 bp, Homo sapiens
ctcctccctggctgccc

SEQ ID NO: 2635715 - DNA, 21 bp, Homo sapiens
ctcctccctggctgccctggc

SEQ ID NO: 2635716 - DNA, 14 bp, Homo sapiens
ctcctcccttagct

SEQ ID NO: 2635717 - DNA, 15 bp, Homo sapiens
ctcctcccttagctc

SEQ ID NO: 2635718 - DNA, 21 bp, Homo sapiens
ctcctcgagggcagggacttt

SEQ ID NO: 2635719 - DNA, 15 bp, Homo sapiens
ctcctcgcaagctgg

SEQ ID NO: 2635720 - DNA, 16 bp, Homo sapiens
ctcctcgcaagctggg

SEQ ID NO: 2635721 - DNA, 17 bp, Homo sapiens
ctcctcgcaagctgggt

SEQ ID NO: 2635722 - DNA, 11 bp, Homo sapiens
ctcctctccag

SEQ ID NO: 2635723 - DNA, 12 bp, Homo sapiens
ctcctctccagg

SEQ ID NO: 2635724 - DNA, 15 bp, Homo sapiens
ctcctctccaggcac

SEQ ID NO: 2635725 - DNA, 15 bp, Homo sapiens
ctcctctcccatccc

SEQ ID NO: 2635726 - DNA, 18 bp, Homo sapiens
ctcctctcccctaccact

SEQ ID NO: 2635727 - DNA, 13 bp, Homo sapiens
ctcctctgactca

SEQ ID NO: 2635728 - DNA, 20 bp, Homo sapiens
ctcctctgactcagggctcc

SEQ ID NO: 2635729 - DNA, 14 bp, Homo sapiens
ctcctctgctgctg

SEQ ID NO: 2635730 - DNA, 16 bp, Homo sapiens
ctcctctgctgctggc

SEQ ID NO: 2635731 - DNA, 18 bp, Homo sapiens
ctcctctgctgctggctg

SEQ ID NO: 2635732 - DNA, 12 bp, Homo sapiens
ctcctctgggca

SEQ ID NO: 2635733 - DNA, 17 bp, Homo sapiens
ctcctctgtccagggcc

SEQ ID NO: 2635734 - DNA, 12 bp, Homo sapiens
ctcctctgtgaa

SEQ ID NO: 2635735 - DNA, 18 bp, Homo sapiens
ctcctctgtgaagcattc

SEQ ID NO: 2635736 - DNA, 13 bp, Homo sapiens
ctcctctgtgacc

SEQ ID NO: 2635737 - DNA, 23 bp, Homo sapiens
ctcctcttaaaaaataaaaactg

SEQ ID NO: 2635738 - DNA, 19 bp, Homo sapiens
ctcctcttgccactgcctc

SEQ ID NO: 2635739 - DNA, 15 bp, Homo sapiens
ctcctgacctgaggc

SEQ ID NO: 2635740 - DNA, 16 bp, Homo sapiens
ctcctgacctgaggct

SEQ ID NO: 2635741 - DNA, 16 bp, Homo sapiens
ctcctgacctgtcacc

SEQ ID NO: 2635742 - DNA, 20 bp, Homo sapiens
ctcctgagaaaaaaggttcc

SEQ ID NO: 2635743 - DNA, 19 bp, Homo sapiens
ctcctgagacccctggcct

SEQ ID NO: 2635744 - DNA, 14 bp, Homo sapiens
ctcctgaggacagc

SEQ ID NO: 2635745 - DNA, 18 bp, Homo sapiens
ctcctgaggacagctgtc

SEQ ID NO: 2635746 - DNA, 21 bp, Homo sapiens
ctcctgaggggcatctgcccc

SEQ ID NO: 2635747 - DNA, 14 bp, Homo sapiens
ctcctgcaggcagc

SEQ ID NO: 2635748 - DNA, 15 bp, Homo sapiens
ctcctgcaggcagcc

SEQ ID NO: 2635749 - DNA, 17 bp, Homo sapiens
ctcctgcaggcagccag

SEQ ID NO: 2635750 - DNA, 20 bp, Homo sapiens
ctcctgcaggcagccaggcc

SEQ ID NO: 2635751 - DNA, 21 bp, Homo sapiens
ctcctgcaggcagccaggcca

SEQ ID NO: 2635752 - DNA, 22 bp, Homo sapiens
ctcctgcaggcagccaggccac

SEQ ID NO: 2635753 - DNA, 14 bp, Homo sapiens
ctcctgcccacctg

SEQ ID NO: 2635754 - DNA, 17 bp, Homo sapiens
ctcctgccgactcctgg

SEQ ID NO: 2635755 - DNA, 13 bp, Homo sapiens
ctcctgcctcagc

SEQ ID NO: 2635756 - DNA, 15 bp, Homo sapiens
ctcctgcctcagcct

SEQ ID NO: 2635757 - DNA, 16 bp, Homo sapiens
ctcctgcctcagcctc

SEQ ID NO: 2635758 - DNA, 21 bp, Homo sapiens
ctcctgcctcagcctcctgag

SEQ ID NO: 2635759 - DNA, 20 bp, Homo sapiens
ctcctgcctcgaactggctg

SEQ ID NO: 2635760 - DNA, 22 bp, Homo sapiens
ctcctgcctcgaactggctgca

SEQ ID NO: 2635761 - DNA, 17 bp, Homo sapiens
ctcctgcctgcccctct

SEQ ID NO: 2635762 - DNA, 15 bp, Homo sapiens
ctcctgcctgtagca

SEQ ID NO: 2635763 - DNA, 17 bp, Homo sapiens
ctcctggaaaggctcag

SEQ ID NO: 2635764 - DNA, 19 bp, Homo sapiens
ctcctggaaaggctcagtc

SEQ ID NO: 2635765 - DNA, 24 bp, Homo sapiens
ctcctggaaaggctcagtctcagg

SEQ ID NO: 2635766 - DNA, 18 bp, Homo sapiens
ctcctggacattttttca

SEQ ID NO: 2635767 - DNA, 19 bp, Homo sapiens
ctcctggagcctttgaata

SEQ ID NO: 2635768 - DNA, 10 bp, Homo sapiens
ctcctggagg

SEQ ID NO: 2635769 - DNA, 16 bp, Homo sapiens
ctcctgggatctgctc

SEQ ID NO: 2635770 - DNA, 22 bp, Homo sapiens
ctcctgggcccctcatctgctc

SEQ ID NO: 2635771 - DNA, 14 bp, Homo sapiens
ctcctgggccctct

SEQ ID NO: 2635772 - DNA, 22 bp, Homo sapiens
ctcctgggggttctttcttcct

SEQ ID NO: 2635773 - DNA, 23 bp, Homo sapiens
ctcctgggggttctttcttcctc

SEQ ID NO: 2635774 - DNA, 22 bp, Homo sapiens
ctcctgggttgagctgttgcct

SEQ ID NO: 2635775 - DNA, 22 bp, Homo sapiens
ctcctgtaacatactggcctgg

SEQ ID NO: 2635776 - DNA, 16 bp, Homo sapiens
ctcctgtacctcttga

SEQ ID NO: 2635777 - DNA, 20 bp, Homo sapiens
ctcctgtcctcccatcccct

SEQ ID NO: 2635778 - DNA, 19 bp, Homo sapiens
ctcctgtctgccagccagc

SEQ ID NO: 2635779 - DNA, 23 bp, Homo sapiens
ctcctgtctgccagccagcagcc

SEQ ID NO: 2635780 - DNA, 21 bp, Homo sapiens
ctcctgtgcccacatcccagg

SEQ ID NO: 2635781 - DNA, 14 bp, Homo sapiens
ctcctgtgtacagg

SEQ ID NO: 2635782 - DNA, 15 bp, Homo sapiens
ctcctgtgtcttgca

SEQ ID NO: 2635783 - DNA, 19 bp, Homo sapiens
ctcctgtgtgtgcgcctac

SEQ ID NO: 2635784 - DNA, 21 bp, Homo sapiens
ctcctgtgtgtgcgcctacag

SEQ ID NO: 2635785 - DNA, 24 bp, Homo sapiens
ctcctgtgtgtgcgcctacaggag

SEQ ID NO: 2635786 - DNA, 19 bp, Homo sapiens
ctcctgttgcacccagccc

SEQ ID NO: 2635787 - DNA, 20 bp, Homo sapiens
ctcctgttgcacccagccct

SEQ ID NO: 2635788 - DNA, 20 bp, Homo sapiens
ctccttagagacatcaaaat

SEQ ID NO: 2635789 - DNA, 17 bp, Homo sapiens
ctccttagtcttctcat

SEQ ID NO: 2635790 - DNA, 19 bp, Homo sapiens
ctccttagtcttctcatag

SEQ ID NO: 2635791 - DNA, 16 bp, Homo sapiens
ctccttcacctttgtc

SEQ ID NO: 2635792 - DNA, 13 bp, Homo sapiens
ctctccctggccc

SEQ ID NO: 2635793 - DNA, 12 bp, Homo sapiens
ctctccctgttg

SEQ ID NO: 2635794 - DNA, 15 bp, Homo sapiens
ctctcctcctgccca

SEQ ID NO: 2635795 - DNA, 15 bp, Homo sapiens
ctctcctcttgccac

SEQ ID NO: 2635796 - DNA, 13 bp, Homo sapiens
ctctcctgtacct

SEQ ID NO: 2635797 - DNA, 14 bp, Homo sapiens
ctctcctgtacctc

SEQ ID NO: 2635798 - DNA, 15 bp, Homo sapiens
ctctcctgtacctct

SEQ ID NO: 2635799 - DNA, 18 bp, Homo sapiens
ctctcctgtacctcttga

SEQ ID NO: 2635800 - DNA, 22 bp, Homo sapiens
ctctcctgtacctcttgagcct

SEQ ID NO: 2635801 - DNA, 18 bp, Homo sapiens
ctctcctgtactttttcc

SEQ ID NO: 2635802 - DNA, 14 bp, Homo sapiens
ctctcctttctttt

SEQ ID NO: 2635803 - DNA, 16 bp, Homo sapiens
ctctcctttctttttc

SEQ ID NO: 2635804 - DNA, 15 bp, Homo sapiens
ctctcctttgtatat

SEQ ID NO: 2635805 - DNA, 18 bp, Homo sapiens
ctctcgcacctttccaaa

SEQ ID NO: 2635806 - DNA, 22 bp, Homo sapiens
ctctcggaaggctggctgggca

SEQ ID NO: 2635807 - DNA, 15 bp, Homo sapiens
ctctcggctccccat

SEQ ID NO: 2635808 - DNA, 16 bp, Homo sapiens
ctctcggctccccatg

SEQ ID NO: 2635809 - DNA, 19 bp, Homo sapiens
ctctctactcctacctcag

SEQ ID NO: 2635810 - DNA, 20 bp, Homo sapiens
ctctctactcctacctcagc

SEQ ID NO: 2635811 - DNA, 14 bp, Homo sapiens
ctctctcactcctt

SEQ ID NO: 2635812 - DNA, 15 bp, Homo sapiens
ctctctcactccttg

SEQ ID NO: 2635813 - DNA, 12 bp, Homo sapiens
ctctctcccagt

SEQ ID NO: 2635814 - DNA, 13 bp, Homo sapiens
ctctctcccagtc

SEQ ID NO: 2635815 - DNA, 19 bp, Homo sapiens
ctctctcccagtctaccca

SEQ ID NO: 2635816 - DNA, 14 bp, Homo sapiens
ctctctcccatgga

SEQ ID NO: 2635817 - DNA, 13 bp, Homo sapiens
ctctctgctgtac

SEQ ID NO: 2635818 - DNA, 14 bp, Homo sapiens
ctctctggcctccc

SEQ ID NO: 2635819 - DNA, 19 bp, Homo sapiens
ctctctggcctcccacccg

SEQ ID NO: 2635820 - DNA, 20 bp, Homo sapiens
ctctctggcctcccacccga

SEQ ID NO: 2635821 - DNA, 19 bp, Homo sapiens
ctctctgtgggctggcagt

SEQ ID NO: 2635822 - DNA, 18 bp, Homo sapiens
ctctcttatagaatattt

SEQ ID NO: 2635823 - DNA, 23 bp, Homo sapiens
ctctcttatagaatatttattac

SEQ ID NO: 2635824 - DNA, 14 bp, Homo sapiens
ctctcttctgctcc

SEQ ID NO: 2635825 - DNA, 15 bp, Homo sapiens
ctctcttctgctcca

SEQ ID NO: 2635826 - DNA, 17 bp, Homo sapiens
ctctcttctgctccacc

SEQ ID NO: 2635827 - DNA, 13 bp, Homo sapiens
ctctcttgcaccc

SEQ ID NO: 2635828 - DNA, 16 bp, Homo sapiens
ctctcttgcacccgcc

SEQ ID NO: 2635829 - DNA, 15 bp, Homo sapiens
ctctcttggtttcct

SEQ ID NO: 2635830 - DNA, 23 bp, Homo sapiens
ctctgaagagtgggtttcacaag

SEQ ID NO: 2635831 - DNA, 17 bp, Homo sapiens
ctctgaagcatgtttca

SEQ ID NO: 2635832 - DNA, 17 bp, Homo sapiens
ctctgaagcctctggga

SEQ ID NO: 2635833 - DNA, 13 bp, Homo sapiens
ctccagccaaccc

SEQ ID NO: 2635834 - DNA, 18 bp, Homo sapiens
ctccagccaacccctgtg

SEQ ID NO: 2635835 - DNA, 13 bp, Homo sapiens
ctccagccagcaa

SEQ ID NO: 2635836 - DNA, 20 bp, Homo sapiens
ctccagccagccagctcatt

SEQ ID NO: 2635837 - DNA, 13 bp, Homo sapiens
ctccagcccctgg

SEQ ID NO: 2635838 - DNA, 17 bp, Homo sapiens
ctccagcccctggatgc

SEQ ID NO: 2635839 - DNA, 20 bp, Homo sapiens
ctccagcccctggatgcagc

SEQ ID NO: 2635840 - DNA, 13 bp, Homo sapiens
ctccagcctgagc

SEQ ID NO: 2635841 - DNA, 17 bp, Homo sapiens
ctccagcctgcctggca

SEQ ID NO: 2635842 - DNA, 19 bp, Homo sapiens
ctccagcctgcctggcagg

SEQ ID NO: 2635843 - DNA, 14 bp, Homo sapiens
ctccagctcaccag

SEQ ID NO: 2635844 - DNA, 19 bp, Homo sapiens
ctccagctcaccagcccca

SEQ ID NO: 2635845 - DNA, 14 bp, Homo sapiens
ctccagctccaaga

SEQ ID NO: 2635846 - DNA, 20 bp, Homo sapiens
ctccagcttctggtactctc

SEQ ID NO: 2635847 - DNA, 22 bp, Homo sapiens
ctccagcttctggtactctcct

SEQ ID NO: 2635848 - DNA, 19 bp, Homo sapiens
ctccagcttgtggagcccc

SEQ ID NO: 2635849 - DNA, 21 bp, Homo sapiens
ctccagcttgtggagccccac

SEQ ID NO: 2635850 - DNA, 11 bp, Homo sapiens
ctccaggagca

SEQ ID NO: 2635851 - DNA, 13 bp, Homo sapiens
ctccaggagcagc

SEQ ID NO: 2635852 - DNA, 14 bp, Homo sapiens
ctccaggagcagcc

SEQ ID NO: 2635853 - DNA, 15 bp, Homo sapiens
ctccaggagcagcca

SEQ ID NO: 2635854 - DNA, 19 bp, Homo sapiens
ctccaggattgaagagcat

SEQ ID NO: 2635855 - DNA, 11 bp, Homo sapiens
ctccaggcagg

SEQ ID NO: 2635856 - DNA, 20 bp, Homo sapiens
ctccaggccacatggggctg

SEQ ID NO: 2635857 - DNA, 14 bp, Homo sapiens
ctccaggcgccggc

SEQ ID NO: 2635858 - DNA, 15 bp, Homo sapiens
ctccaggctccttta

SEQ ID NO: 2635859 - DNA, 23 bp, Homo sapiens
ctccaggctcctttagcgcccag

SEQ ID NO: 2635860 - DNA, 20 bp, Homo sapiens
ctccaggctgtatcccatga

SEQ ID NO: 2635861 - DNA, 21 bp, Homo sapiens
ctccagggagtcccctccccg

SEQ ID NO: 2635862 - DNA, 22 bp, Homo sapiens
ctccaggtcctctacttaatga

SEQ ID NO: 2635863 - DNA, 18 bp, Homo sapiens
ctccaggtctcacgggca

SEQ ID NO: 2635864 - DNA, 20 bp, Homo sapiens
ctccaggtgcacaagctcca

SEQ ID NO: 2635865 - DNA, 23 bp, Homo sapiens
ctccaggtgcacaagctccaagc

SEQ ID NO: 2635866 - DNA, 14 bp, Homo sapiens
ctccaggtggctct

SEQ ID NO: 2635867 - DNA, 17 bp, Homo sapiens
ctccaggtggctctgag

SEQ ID NO: 2635868 - DNA, 17 bp, Homo sapiens
ctccaggtttttcaatt

SEQ ID NO: 2635869 - DNA, 21 bp, Homo sapiens
ctccaggtttttcaattaaac

SEQ ID NO: 2635870 - DNA, 20 bp, Homo sapiens
ctccagtattcttgtcaaaa

SEQ ID NO: 2635871 - DNA, 15 bp, Homo sapiens
ctccagtcaggaggc

SEQ ID NO: 2635872 - DNA, 16 bp, Homo sapiens
ctccagtccaaggaaa

SEQ ID NO: 2635873 - DNA, 12 bp, Homo sapiens
ctccagtctgct

SEQ ID NO: 2635874 - DNA, 17 bp, Homo sapiens
ctccagtctgctgccct

SEQ ID NO: 2635875 - DNA, 21 bp, Homo sapiens
ctccagtctgctgccctccat

SEQ ID NO: 2635876 - DNA, 18 bp, Homo sapiens
ctccagtgccagcaatga

SEQ ID NO: 2635877 - DNA, 20 bp, Homo sapiens
ctccatcgctgtcatctcag

SEQ ID NO: 2635878 - DNA, 22 bp, Homo sapiens
ctccatctccaagaatgctgaa

SEQ ID NO: 2635879 - DNA, 13 bp, Homo sapiens
ctccatctccact

SEQ ID NO: 2635880 - DNA, 16 bp, Homo sapiens
ctccatctctctggcc

SEQ ID NO: 2635881 - DNA, 13 bp, Homo sapiens
ctccatgagcacc

SEQ ID NO: 2635882 - DNA, 15 bp, Homo sapiens
ctccatgctgcctcc

SEQ ID NO: 2635883 - DNA, 16 bp, Homo sapiens
ctccatgctgcctcca

SEQ ID NO: 2635884 - DNA, 16 bp, Homo sapiens
ctccatggcttcctcc

SEQ ID NO: 2635885 - DNA, 15 bp, Homo sapiens
ctccattccagtctc

SEQ ID NO: 2635886 - DNA, 20 bp, Homo sapiens
ctccattctgaccatttcag

SEQ ID NO: 2635887 - DNA, 17 bp, Homo sapiens
ctccattggtgttgaca

SEQ ID NO: 2635888 - DNA, 15 bp, Homo sapiens
ctccatttagttctt

SEQ ID NO: 2635889 - DNA, 17 bp, Homo sapiens
ctcccaaagtgctggga

SEQ ID NO: 2635890 - DNA, 14 bp, Homo sapiens
ctcccaactcaccc

SEQ ID NO: 2635891 - DNA, 16 bp, Homo sapiens
ctcccaactcacccca

SEQ ID NO: 2635892 - DNA, 18 bp, Homo sapiens
ctcccaagggatggtgcc

SEQ ID NO: 2635893 - DNA, 17 bp, Homo sapiens
ctcccaagtggtgccta

SEQ ID NO: 2635894 - DNA, 18 bp, Homo sapiens
ctcccacaggcagcttta

SEQ ID NO: 2635895 - DNA, 13 bp, Homo sapiens
ctcccacccaccg

SEQ ID NO: 2635896 - DNA, 20 bp, Homo sapiens
ctcccacccccatctctccc

SEQ ID NO: 2635897 - DNA, 21 bp, Homo sapiens
ctcccacccgatgctgctttc

SEQ ID NO: 2635898 - DNA, 23 bp, Homo sapiens
ctcccacctccccctcccccttc

SEQ ID NO: 2635899 - DNA, 16 bp, Homo sapiens
ctcccagaacacactc

SEQ ID NO: 2635900 - DNA, 16 bp, Homo sapiens
ctcccagccctatgga

SEQ ID NO: 2635901 - DNA, 18 bp, Homo sapiens
ctcccagccctatggatg

SEQ ID NO: 2635902 - DNA, 15 bp, Homo sapiens
ctcccagctctagac

SEQ ID NO: 2635903 - DNA, 23 bp, Homo sapiens
ctcccagctctagacaaccctgc

SEQ ID NO: 2635904 - DNA, 18 bp, Homo sapiens
ctcccaggaactgggcca

SEQ ID NO: 2635905 - DNA, 15 bp, Homo sapiens
ctcccaggcattccc

SEQ ID NO: 2635906 - DNA, 20 bp, Homo sapiens
ctcccaggcattccccagga

SEQ ID NO: 2635907 - DNA, 17 bp, Homo sapiens
ctcccaggccaggctcc

SEQ ID NO: 2635908 - DNA, 21 bp, Homo sapiens
ctcccaggccaggctccttcc

SEQ ID NO: 2635909 - DNA, 22 bp, Homo sapiens
ctcccaggccaggctccttcct

SEQ ID NO: 2635910 - DNA, 19 bp, Homo sapiens
ctcccagggccagggccct

SEQ ID NO: 2635911 - DNA, 20 bp, Homo sapiens
ctcccagtccaaatgtcctc

SEQ ID NO: 2635912 - DNA, 19 bp, Homo sapiens
ctcccagtctacccagaga

SEQ ID NO: 2635913 - DNA, 12 bp, Homo sapiens
ctcccatccccc

SEQ ID NO: 2635914 - DNA, 16 bp, Homo sapiens
ctcccatccccctgcc

SEQ ID NO: 2635915 - DNA, 15 bp, Homo sapiens
ctcccatcccctgga

SEQ ID NO: 2635916 - DNA, 16 bp, Homo sapiens
ctcccatcccctggac

SEQ ID NO: 2635917 - DNA, 11 bp, Homo sapiens
ctcccatctgg

SEQ ID NO: 2635918 - DNA, 11 bp, Homo sapiens
ctcccatctgt

SEQ ID NO: 2635919 - DNA, 14 bp, Homo sapiens
ctcccatctgtgaa

SEQ ID NO: 2635920 - DNA, 18 bp, Homo sapiens
ctcccatctgtgaaagga

SEQ ID NO: 2635921 - DNA, 16 bp, Homo sapiens
ctcccatggagcccca

SEQ ID NO: 2635922 - DNA, 14 bp, Homo sapiens
ctcccatggcacct

SEQ ID NO: 2635923 - DNA, 16 bp, Homo sapiens
ctcccatttctactct

SEQ ID NO: 2635924 - DNA, 12 bp, Homo sapiens
ctccccaaaaac

SEQ ID NO: 2635925 - DNA, 12 bp, Homo sapiens
ctccccaaccct

SEQ ID NO: 2635926 - DNA, 20 bp, Homo sapiens
ctccccaaccctgcccctgc

SEQ ID NO: 2635927 - DNA, 21 bp, Homo sapiens
ctccccaccttcaattcctgg

SEQ ID NO: 2635928 - DNA, 12 bp, Homo sapiens
ctccccactcta

SEQ ID NO: 2635929 - DNA, 16 bp, Homo sapiens
ctccccactgcctact

SEQ ID NO: 2635930 - DNA, 15 bp, Homo sapiens
ctccccagagcactg

SEQ ID NO: 2635931 - DNA, 16 bp, Homo sapiens
ctccccagagcactgg

SEQ ID NO: 2635932 - DNA, 20 bp, Homo sapiens
ctccccagagttccccatgc

SEQ ID NO: 2635933 - DNA, 20 bp, Homo sapiens
ctccccagcaagtgagagct

SEQ ID NO: 2635934 - DNA, 21 bp, Homo sapiens
ctccccagcaagtgagagctg

SEQ ID NO: 2635935 - DNA, 16 bp, Homo sapiens
ctccccagcaggtggg

SEQ ID NO: 2635936 - DNA, 13 bp, Homo sapiens
ctccccagcccag

SEQ ID NO: 2635937 - DNA, 13 bp, Homo sapiens
ctccccagccctg

SEQ ID NO: 2635938 - DNA, 16 bp, Homo sapiens
ctccccagccctggct

SEQ ID NO: 2635939 - DNA, 15 bp, Homo sapiens
ctccccaggccaggc

SEQ ID NO: 2635940 - DNA, 17 bp, Homo sapiens
ctccccaggccaggcca

SEQ ID NO: 2635941 - DNA, 18 bp, Homo sapiens
ctccccatgtgtcctggt

SEQ ID NO: 2635942 - DNA, 21 bp, Homo sapiens
ctccccatgtgtcctggttcc

SEQ ID NO: 2635943 - DNA, 21 bp, Homo sapiens
ctccccattagagtcagcctt

SEQ ID NO: 2635944 - DNA, 21 bp, Homo sapiens
ctcccccaacccccaccccac

SEQ ID NO: 2635945 - DNA, 23 bp, Homo sapiens
ctcccccaacccccaccccacac

SEQ ID NO: 2635946 - DNA, 15 bp, Homo sapiens
ctcccccagccccat

SEQ ID NO: 2635947 - DNA, 15 bp, Homo sapiens
ctcccccatcctccc

SEQ ID NO: 2635948 - DNA, 17 bp, Homo sapiens
ctcccccccccctccaa

SEQ ID NO: 2635949 - DNA, 12 bp, Homo sapiens
ctcccccgccac

SEQ ID NO: 2635950 - DNA, 23 bp, Homo sapiens
ctccccctgggctctgccccagc

SEQ ID NO: 2635951 - DNA, 13 bp, Homo sapiens
ctccccggcccta

SEQ ID NO: 2635952 - DNA, 14 bp, Homo sapiens
ctccccggctcgag

SEQ ID NO: 2635953 - DNA, 20 bp, Homo sapiens
ctcccctcaaagtctgcaac

SEQ ID NO: 2635954 - DNA, 12 bp, Homo sapiens
ctcccctcctct

SEQ ID NO: 2635955 - DNA, 16 bp, Homo sapiens
ctcccctcctctcccc

SEQ ID NO: 2635956 - DNA, 17 bp, Homo sapiens
ctcccctcctctcccct

SEQ ID NO: 2635957 - DNA, 15 bp, Homo sapiens
ctcccctccttgcct

SEQ ID NO: 2635958 - DNA, 16 bp, Homo sapiens
ctcccctccttgcctc

SEQ ID NO: 2635959 - DNA, 22 bp, Homo sapiens
ctcccctccttgcctcctgtgt

SEQ ID NO: 2635960 - DNA, 12 bp, Homo sapiens
ctcccctctctt

SEQ ID NO: 2635961 - DNA, 15 bp, Homo sapiens
ctcccctctcttgca

SEQ ID NO: 2635962 - DNA, 21 bp, Homo sapiens
ctcccctgcactggagtccag

SEQ ID NO: 2635963 - DNA, 21 bp, Homo sapiens
ctcccctgccagggcagggcc

SEQ ID NO: 2635964 - DNA, 12 bp, Homo sapiens
ctcccctgccct

SEQ ID NO: 2635965 - DNA, 13 bp, Homo sapiens
ctcccctgccctg

SEQ ID NO: 2635966 - DNA, 14 bp, Homo sapiens
ctcccctgccctgg

SEQ ID NO: 2635967 - DNA, 12 bp, Homo sapiens
ctcccctgctgg

SEQ ID NO: 2635968 - DNA, 13 bp, Homo sapiens
ctcccctgctggg

SEQ ID NO: 2635969 - DNA, 21 bp, Homo sapiens
ctcccctgctgggtgtggcgc

SEQ ID NO: 2635970 - DNA, 23 bp, Homo sapiens
ctcccctgctgggtgtggcgcag

SEQ ID NO: 2635971 - DNA, 15 bp, Homo sapiens
ctccccttccctgca

SEQ ID NO: 2635972 - DNA, 16 bp, Homo sapiens
ctccccttccctgcaa

SEQ ID NO: 2635973 - DNA, 14 bp, Homo sapiens
ctccccttgagctg

SEQ ID NO: 2635974 - DNA, 18 bp, Homo sapiens
ctccccttgggcggctga

SEQ ID NO: 2635975 - DNA, 20 bp, Homo sapiens
ctcccgaatagctgggacta

SEQ ID NO: 2635976 - DNA, 15 bp, Homo sapiens
ctcccgctgctgctg

SEQ ID NO: 2635977 - DNA, 19 bp, Homo sapiens
ctcccggaggttgggtggg

SEQ ID NO: 2635978 - DNA, 19 bp, Homo sapiens
ctcccggcatgggaaagcc

SEQ ID NO: 2635979 - DNA, 15 bp, Homo sapiens
ctccctaccacctcc

SEQ ID NO: 2635980 - DNA, 15 bp, Homo sapiens
ctccctcaccctgag

SEQ ID NO: 2635981 - DNA, 23 bp, Homo sapiens
ctccctcagtgccctcattttat

SEQ ID NO: 2635982 - DNA, 18 bp, Homo sapiens
ctccctcccctgccattt

SEQ ID NO: 2635983 - DNA, 21 bp, Homo sapiens
ctccctccgatccttcctccc

SEQ ID NO: 2635984 - DNA, 14 bp, Homo sapiens
ctccctcctcacct

SEQ ID NO: 2635985 - DNA, 19 bp, Homo sapiens
cgagccatgatgtggagtg

SEQ ID NO: 2635986 - DNA, 14 bp, Homo sapiens
cgagccgggcctgg

SEQ ID NO: 2635987 - DNA, 15 bp, Homo sapiens
cgagccgggcctggg

SEQ ID NO: 2635988 - DNA, 20 bp, Homo sapiens
cgagcctctgtcactgcagg

SEQ ID NO: 2635989 - DNA, 13 bp, Homo sapiens
cgagcctggctcc

SEQ ID NO: 2635990 - DNA, 18 bp, Homo sapiens
cgagcgctttctggaaaa

SEQ ID NO: 2635991 - DNA, 23 bp, Homo sapiens
cgagcgctttctggaaaagagga

SEQ ID NO: 2635992 - DNA, 19 bp, Homo sapiens
cgagctcgtgtatcctggg

SEQ ID NO: 2635993 - DNA, 22 bp, Homo sapiens
cgagctcgtgtatcctggggct

SEQ ID NO: 2635994 - DNA, 15 bp, Homo sapiens
cgagctgggggccat

SEQ ID NO: 2635995 - DNA, 23 bp, Homo sapiens
cgagctgggggccatgagctcca

SEQ ID NO: 2635996 - DNA, 14 bp, Homo sapiens
cgaggaaccagagc

SEQ ID NO: 2635997 - DNA, 16 bp, Homo sapiens
cgaggaaccagagcca

SEQ ID NO: 2635998 - DNA, 13 bp, Homo sapiens
cgaggacagggag

SEQ ID NO: 2635999 - DNA, 21 bp, Homo sapiens
cgaggacatgaaactccacct

SEQ ID NO: 2636000 - DNA, 18 bp, Homo sapiens
cgaggactgtatttgtga

SEQ ID NO: 2636001 - DNA, 20 bp, Homo sapiens
cgaggactgtatttgtgact

SEQ ID NO: 2636002 - DNA, 19 bp, Homo sapiens
cgaggaggctccagagggc

SEQ ID NO: 2636003 - DNA, 17 bp, Homo sapiens
cgaggaggtaatgaatt

SEQ ID NO: 2636004 - DNA, 11 bp, Homo sapiens
cgaggccagta

SEQ ID NO: 2636005 - DNA, 16 bp, Homo sapiens
cgaggctggagctggc

SEQ ID NO: 2636006 - DNA, 21 bp, Homo sapiens
cgagggcagggaccacaccct

SEQ ID NO: 2636007 - DNA, 17 bp, Homo sapiens
cgaggggcgggacccag

SEQ ID NO: 2636008 - DNA, 15 bp, Homo sapiens
cgagggtcctggctc

SEQ ID NO: 2636009 - DNA, 14 bp, Homo sapiens
cgaggtagagtttg

SEQ ID NO: 2636010 - DNA, 15 bp, Homo sapiens
cgagtcactgcctct

SEQ ID NO: 2636011 - DNA, 14 bp, Homo sapiens
cgagtgccaggact

SEQ ID NO: 2636012 - DNA, 20 bp, Homo sapiens
cgatccacctgtctcagcct

SEQ ID NO: 2636013 - DNA, 13 bp, Homo sapiens
cgatccttcctcc

SEQ ID NO: 2636014 - DNA, 19 bp, Homo sapiens
cgatcgcggcggagctggc

SEQ ID NO: 2636015 - DNA, 21 bp, Homo sapiens
cgatgaatttggagactctgt

SEQ ID NO: 2636016 - DNA, 15 bp, Homo sapiens
cgatgcaatgaacac

SEQ ID NO: 2636017 - DNA, 14 bp, Homo sapiens
cgatgctccagcca

SEQ ID NO: 2636018 - DNA, 12 bp, Homo sapiens
cgatgctgcttt

SEQ ID NO: 2636019 - DNA, 18 bp, Homo sapiens
cgatggatatatgttttt

SEQ ID NO: 2636020 - DNA, 11 bp, Homo sapiens
cgattctggat

SEQ ID NO: 2636021 - DNA, 14 bp, Homo sapiens
cgatttaattctct

SEQ ID NO: 2636022 - DNA, 18 bp, Homo sapiens
cgatttaattctcttgaa

SEQ ID NO: 2636023 - DNA, 20 bp, Homo sapiens
cgatttctgtttagataata

SEQ ID NO: 2636024 - DNA, 19 bp, Homo sapiens
cgcaaagggctgaaagcca

SEQ ID NO: 2636025 - DNA, 22 bp, Homo sapiens
cgcaagagccatgtagaagctg

SEQ ID NO: 2636026 - DNA, 15 bp, Homo sapiens
cgcacagtctctctc

SEQ ID NO: 2636027 - DNA, 19 bp, Homo sapiens
cgcacctaccatcagggac

SEQ ID NO: 2636028 - DNA, 16 bp, Homo sapiens
cgcacctcccatccta

SEQ ID NO: 2636029 - DNA, 16 bp, Homo sapiens
cgcacctgccccctgg

SEQ ID NO: 2636030 - DNA, 17 bp, Homo sapiens
cgcactccatgagcacc

SEQ ID NO: 2636031 - DNA, 17 bp, Homo sapiens
cgcactttcctcctggc

SEQ ID NO: 2636032 - DNA, 13 bp, Homo sapiens
cgcagacaggacc

SEQ ID NO: 2636033 - DNA, 14 bp, Homo sapiens
cgcagacaggacca

SEQ ID NO: 2636034 - DNA, 15 bp, Homo sapiens
cgcagacaggaccag

SEQ ID NO: 2636035 - DNA, 19 bp, Homo sapiens
cgcagcatattcaggaagc

SEQ ID NO: 2636036 - DNA, 20 bp, Homo sapiens
cgcagcatattcaggaagct

SEQ ID NO: 2636037 - DNA, 17 bp, Homo sapiens
cgcagccctagagcctg

SEQ ID NO: 2636038 - DNA, 18 bp, Homo sapiens
cgcagccctagagcctgc

SEQ ID NO: 2636039 - DNA, 20 bp, Homo sapiens
cgcagccctagagcctgcct

SEQ ID NO: 2636040 - DNA, 22 bp, Homo sapiens
cgcagccctagagcctgcctgg

SEQ ID NO: 2636041 - DNA, 16 bp, Homo sapiens
cgcagcctccctctga

SEQ ID NO: 2636042 - DNA, 18 bp, Homo sapiens
cgcagctcttgcccttcc

SEQ ID NO: 2636043 - DNA, 19 bp, Homo sapiens
cgcagtcgtcgcacagtct

SEQ ID NO: 2636044 - DNA, 19 bp, Homo sapiens
cgcagtgcttctctacaga

SEQ ID NO: 2636045 - DNA, 14 bp, Homo sapiens
cgcatcaaaagaca

SEQ ID NO: 2636046 - DNA, 15 bp, Homo sapiens
cgcatgccctcaatc

SEQ ID NO: 2636047 - DNA, 20 bp, Homo sapiens
cgcattctcatggagaagtt

SEQ ID NO: 2636048 - DNA, 14 bp, Homo sapiens
cctattcccacacc

SEQ ID NO: 2636049 - DNA, 11 bp, Homo sapiens
cctattctcac

SEQ ID NO: 2636050 - DNA, 15 bp, Homo sapiens
cctattctcaccagg

SEQ ID NO: 2636051 - DNA, 16 bp, Homo sapiens
cctattctcaccagga

SEQ ID NO: 2636052 - DNA, 12 bp, Homo sapiens
cctattgtgatt

SEQ ID NO: 2636053 - DNA, 17 bp, Homo sapiens
cctattgtgatttgact

SEQ ID NO: 2636054 - DNA, 18 bp, Homo sapiens
cctattgtgatttgactg

SEQ ID NO: 2636055 - DNA, 19 bp, Homo sapiens
cctattttgaaaaattcct

SEQ ID NO: 2636056 - DNA, 21 bp, Homo sapiens
cctattttgaaaaattcctat

SEQ ID NO: 2636057 - DNA, 13 bp, Homo sapiens
cctcaaacactgc

SEQ ID NO: 2636058 - DNA, 13 bp, Homo sapiens
cctcaaacctcct

SEQ ID NO: 2636059 - DNA, 16 bp, Homo sapiens
cctcaaatgacccaaa

SEQ ID NO: 2636060 - DNA, 16 bp, Homo sapiens
cctcaacaagggagag

SEQ ID NO: 2636061 - DNA, 18 bp, Homo sapiens
cctcaacaagggagagac

SEQ ID NO: 2636062 - DNA, 21 bp, Homo sapiens
cctcaacaagggagagacctc

SEQ ID NO: 2636063 - DNA, 16 bp, Homo sapiens
cctcaacacctctgca

SEQ ID NO: 2636064 - DNA, 21 bp, Homo sapiens
cctcaaccctccctcagcccc

SEQ ID NO: 2636065 - DNA, 22 bp, Homo sapiens
cctcaaccctccctcagcccct

SEQ ID NO: 2636066 - DNA, 14 bp, Homo sapiens
cctcaacctgtgat

SEQ ID NO: 2636067 - DNA, 14 bp, Homo sapiens
cctcaactgcctac

SEQ ID NO: 2636068 - DNA, 18 bp, Homo sapiens
cctcaagccaatcccctc

SEQ ID NO: 2636069 - DNA, 19 bp, Homo sapiens
cctcaaggacttgaaagca

SEQ ID NO: 2636070 - DNA, 22 bp, Homo sapiens
cctcaaggacttgaaagcatcc

SEQ ID NO: 2636071 - DNA, 23 bp, Homo sapiens
cctcaagtgattctcctgcctca

SEQ ID NO: 2636072 - DNA, 16 bp, Homo sapiens
cctcaataagccttgt

SEQ ID NO: 2636073 - DNA, 13 bp, Homo sapiens
cctcaatccagct

SEQ ID NO: 2636074 - DNA, 18 bp, Homo sapiens
cctcaatccagctatgtt

SEQ ID NO: 2636075 - DNA, 11 bp, Homo sapiens
cctcacacagc

SEQ ID NO: 2636076 - DNA, 12 bp, Homo sapiens
cctcacactggg

SEQ ID NO: 2636077 - DNA, 15 bp, Homo sapiens
cctcacagcacagag

SEQ ID NO: 2636078 - DNA, 19 bp, Homo sapiens
cctcacagcacagagaaga

SEQ ID NO: 2636079 - DNA, 20 bp, Homo sapiens
cctcacagtccttaccagca

SEQ ID NO: 2636080 - DNA, 19 bp, Homo sapiens
cctcacccccagctttgct

SEQ ID NO: 2636081 - DNA, 17 bp, Homo sapiens
cctcacccctgccctgg

SEQ ID NO: 2636082 - DNA, 18 bp, Homo sapiens
cctcaccctgagcccctt

SEQ ID NO: 2636083 - DNA, 18 bp, Homo sapiens
cctcaccgagtgggggca

SEQ ID NO: 2636084 - DNA, 12 bp, Homo sapiens
cctcacctctgg

SEQ ID NO: 2636085 - DNA, 22 bp, Homo sapiens
cctcacctgggcacctggggag

SEQ ID NO: 2636086 - DNA, 20 bp, Homo sapiens
cctcactcccttcccataag

SEQ ID NO: 2636087 - DNA, 22 bp, Homo sapiens
cctcactcccttctacctgcca

SEQ ID NO: 2636088 - DNA, 17 bp, Homo sapiens
cctcactctggcctcag

SEQ ID NO: 2636089 - DNA, 20 bp, Homo sapiens
cctcactgaaaacatctgga

SEQ ID NO: 2636090 - DNA, 17 bp, Homo sapiens
cctcactgaatgcctca

SEQ ID NO: 2636091 - DNA, 14 bp, Homo sapiens
cctcactggatgaa

SEQ ID NO: 2636092 - DNA, 14 bp, Homo sapiens
cctcactgggtggg

SEQ ID NO: 2636093 - DNA, 16 bp, Homo sapiens
cctcactgttgaattt

SEQ ID NO: 2636094 - DNA, 21 bp, Homo sapiens
cctcacttccatacagctcta

SEQ ID NO: 2636095 - DNA, 14 bp, Homo sapiens
cctcacttgaatgt

SEQ ID NO: 2636096 - DNA, 19 bp, Homo sapiens
cctcagaaacactggggct

SEQ ID NO: 2636097 - DNA, 19 bp, Homo sapiens
cctcagacttaccaggaag

SEQ ID NO: 2636098 - DNA, 19 bp, Homo sapiens
cctcagagtccaggcccca

SEQ ID NO: 2636099 - DNA, 19 bp, Homo sapiens
cctcagcacccctgtctct

SEQ ID NO: 2636100 - DNA, 14 bp, Homo sapiens
cctcagcacccctt

SEQ ID NO: 2636101 - DNA, 16 bp, Homo sapiens
cctcagcccctcttgc

SEQ ID NO: 2636102 - DNA, 18 bp, Homo sapiens
cctcagcccctcttgccc

SEQ ID NO: 2636103 - DNA, 23 bp, Homo sapiens
cctcagccgactgcacagcggcc

SEQ ID NO: 2636104 - DNA, 14 bp, Homo sapiens
cctcagcctagacc

SEQ ID NO: 2636105 - DNA, 16 bp, Homo sapiens
cctcagcctagaccct

SEQ ID NO: 2636106 - DNA, 11 bp, Homo sapiens
cctcagcctcc

SEQ ID NO: 2636107 - DNA, 22 bp, Homo sapiens
cctcagcctcccaaagtgctgg

SEQ ID NO: 2636108 - DNA, 14 bp, Homo sapiens
cctcagcctcctga

SEQ ID NO: 2636109 - DNA, 16 bp, Homo sapiens
cctcagcctgtgctgc

SEQ ID NO: 2636110 - DNA, 11 bp, Homo sapiens
cctcagctctg

SEQ ID NO: 2636111 - DNA, 17 bp, Homo sapiens
cctcagctgcctcactt

SEQ ID NO: 2636112 - DNA, 19 bp, Homo sapiens
cctcagctgcctcacttcc

SEQ ID NO: 2636113 - DNA, 18 bp, Homo sapiens
cctcaggactgcaacagg

SEQ ID NO: 2636114 - DNA, 14 bp, Homo sapiens
cctcaggcagctca

SEQ ID NO: 2636115 - DNA, 18 bp, Homo sapiens
cctcaggcataggcctgg

SEQ ID NO: 2636116 - DNA, 21 bp, Homo sapiens
cctcaggccaggtgcagtggc

SEQ ID NO: 2636117 - DNA, 20 bp, Homo sapiens
cctcagggtccctggtggca

SEQ ID NO: 2636118 - DNA, 19 bp, Homo sapiens
cctcaggtgatccacccac

SEQ ID NO: 2636119 - DNA, 16 bp, Homo sapiens
cctcaggttgctggtt

SEQ ID NO: 2636120 - DNA, 17 bp, Homo sapiens
cctcaggttgctggttg

SEQ ID NO: 2636121 - DNA, 16 bp, Homo sapiens
cctcagtggactttcc

SEQ ID NO: 2636122 - DNA, 15 bp, Homo sapiens
cctcagttcccttgg

SEQ ID NO: 2636123 - DNA, 20 bp, Homo sapiens
cctcagttcccttggcctca

SEQ ID NO: 2636124 - DNA, 22 bp, Homo sapiens
cctcagttcccttggcctcaga

SEQ ID NO: 2636125 - DNA, 14 bp, Homo sapiens
cctcatcaccaacg

SEQ ID NO: 2636126 - DNA, 14 bp, Homo sapiens
cctcatcaggatga

SEQ ID NO: 2636127 - DNA, 20 bp, Homo sapiens
cctcatcccgagcacctcca

SEQ ID NO: 2636128 - DNA, 13 bp, Homo sapiens
cctcatcctcata

SEQ ID NO: 2636129 - DNA, 20 bp, Homo sapiens
cctcatctgggggagtggaa

SEQ ID NO: 2636130 - DNA, 15 bp, Homo sapiens
cctcatctgtccctc

SEQ ID NO: 2636131 - DNA, 17 bp, Homo sapiens
cctcatctgtccctccg

SEQ ID NO: 2636132 - DNA, 22 bp, Homo sapiens
cctcatggcccctctgacctgc

SEQ ID NO: 2636133 - DNA, 19 bp, Homo sapiens
cctcatggtgggttcaggg

SEQ ID NO: 2636134 - DNA, 15 bp, Homo sapiens
cctcatgtccactgg

SEQ ID NO: 2636135 - DNA, 20 bp, Homo sapiens
cctcatgtccactggttctt

SEQ ID NO: 2636136 - DNA, 13 bp, Homo sapiens
cctcatgttctta

SEQ ID NO: 2636137 - DNA, 15 bp, Homo sapiens
cctcattaatgacac

SEQ ID NO: 2636138 - DNA, 18 bp, Homo sapiens
cctcattagcattttgct

SEQ ID NO: 2636139 - DNA, 19 bp, Homo sapiens
cctcattgacaagaactga

SEQ ID NO: 2636140 - DNA, 16 bp, Homo sapiens
cctcatttatccctca

SEQ ID NO: 2636141 - DNA, 16 bp, Homo sapiens
cctccaaaggccccct

SEQ ID NO: 2636142 - DNA, 17 bp, Homo sapiens
cctccaaaggcccccta

SEQ ID NO: 2636143 - DNA, 19 bp, Homo sapiens
cctccaagaccttctcctt

SEQ ID NO: 2636144 - DNA, 16 bp, Homo sapiens
cctccacagccgcagc

SEQ ID NO: 2636145 - DNA, 17 bp, Homo sapiens
cctccacagccgcagcc

SEQ ID NO: 2636146 - DNA, 11 bp, Homo sapiens
cctccacagct

SEQ ID NO: 2636147 - DNA, 12 bp, Homo sapiens
cctccacagctt

SEQ ID NO: 2636148 - DNA, 17 bp, Homo sapiens
cctccacagttcagtgg

SEQ ID NO: 2636149 - DNA, 15 bp, Homo sapiens
cctccacatcctcca

SEQ ID NO: 2636150 - DNA, 14 bp, Homo sapiens
cctccaccaccact

SEQ ID NO: 2636151 - DNA, 18 bp, Homo sapiens
cctccaccaccactggcc

SEQ ID NO: 2636152 - DNA, 19 bp, Homo sapiens
cctccaccaccactggcca

SEQ ID NO: 2636153 - DNA, 21 bp, Homo sapiens
cctccaccaccactggccacc

SEQ ID NO: 2636154 - DNA, 22 bp, Homo sapiens
cctccaccctctgagctttgca

SEQ ID NO: 2636155 - DNA, 11 bp, Homo sapiens
cctccaccctg

SEQ ID NO: 2636156 - DNA, 15 bp, Homo sapiens
cctccaccctgtccc

SEQ ID NO: 2636157 - DNA, 21 bp, Homo sapiens
cctccaccctgtcccccagct

SEQ ID NO: 2636158 - DNA, 23 bp, Homo sapiens
cctccacctcttcaccccccact

SEQ ID NO: 2636159 - DNA, 18 bp, Homo sapiens
cctccacgttctgctcat

SEQ ID NO: 2636160 - DNA, 18 bp, Homo sapiens
cctccagaagcctctggc

SEQ ID NO: 2636161 - DNA, 22 bp, Homo sapiens
cctccagaagcctctggctaga

SEQ ID NO: 2636162 - DNA, 12 bp, Homo sapiens
cctccagcttct

SEQ ID NO: 2636163 - DNA, 22 bp, Homo sapiens
cctccagcttgtggagccccac

SEQ ID NO: 2636164 - DNA, 12 bp, Homo sapiens
cctccaggtgca

SEQ ID NO: 2636165 - DNA, 21 bp, Homo sapiens
cctccaggtgcacaagctcca

SEQ ID NO: 2636166 - DNA, 22 bp, Homo sapiens
cctccaggtgcacaagctccaa

SEQ ID NO: 2636167 - DNA, 22 bp, Homo sapiens
cctccaggtttttcaattaaac

SEQ ID NO: 2636168 - DNA, 23 bp, Homo sapiens
cctccagtccaaggaaaccacag

SEQ ID NO: 2636169 - DNA, 19 bp, Homo sapiens
cctccatctccaagaatgc

SEQ ID NO: 2636170 - DNA, 19 bp, Homo sapiens
cctccatgactgcacagta

SEQ ID NO: 2636171 - DNA, 11 bp, Homo sapiens
cctccatggga

SEQ ID NO: 2636172 - DNA, 16 bp, Homo sapiens
cctcccaaagtgctgg

SEQ ID NO: 2636173 - DNA, 17 bp, Homo sapiens
cctcccaaagtgctggg

SEQ ID NO: 2636174 - DNA, 21 bp, Homo sapiens
cctcccacccccttctctgct

SEQ ID NO: 2636175 - DNA, 19 bp, Homo sapiens
cctcccacccgatgctgct

SEQ ID NO: 2636176 - DNA, 17 bp, Homo sapiens
cctcccacctcagcctc

SEQ ID NO: 2636177 - DNA, 13 bp, Homo sapiens
ccctcgggcccag

SEQ ID NO: 2636178 - DNA, 14 bp, Homo sapiens
ccctcgggcccagc

SEQ ID NO: 2636179 - DNA, 19 bp, Homo sapiens
ccctcgggcccagccccca

SEQ ID NO: 2636180 - DNA, 18 bp, Homo sapiens
ccctcgggtctcctcact

SEQ ID NO: 2636181 - DNA, 21 bp, Homo sapiens
ccctcgggtctcctcactccc

SEQ ID NO: 2636182 - DNA, 17 bp, Homo sapiens
ccctcgtggccagcccg

SEQ ID NO: 2636183 - DNA, 21 bp, Homo sapiens
ccctctacagagcttccctga

SEQ ID NO: 2636184 - DNA, 19 bp, Homo sapiens
ccctctagaaatttttcag

SEQ ID NO: 2636185 - DNA, 15 bp, Homo sapiens
ccctctatttagcat

SEQ ID NO: 2636186 - DNA, 12 bp, Homo sapiens
ccctctcagagc

SEQ ID NO: 2636187 - DNA, 21 bp, Homo sapiens
ccctctcagagctacttgggc

SEQ ID NO: 2636188 - DNA, 21 bp, Homo sapiens
ccctctcccccccccctccaa

SEQ ID NO: 2636189 - DNA, 13 bp, Homo sapiens
ccctctctcctcc

SEQ ID NO: 2636190 - DNA, 13 bp, Homo sapiens
ccctctctctgac

SEQ ID NO: 2636191 - DNA, 13 bp, Homo sapiens
ccctctctcttct

SEQ ID NO: 2636192 - DNA, 17 bp, Homo sapiens
ccctctctcttctgctc

SEQ ID NO: 2636193 - DNA, 23 bp, Homo sapiens
ccctctctcttctgctccaccct

SEQ ID NO: 2636194 - DNA, 12 bp, Homo sapiens
ccctctctgcat

SEQ ID NO: 2636195 - DNA, 15 bp, Homo sapiens
ccctctctgctctgc

SEQ ID NO: 2636196 - DNA, 18 bp, Homo sapiens
ccctctcttgcacccgcc

SEQ ID NO: 2636197 - DNA, 19 bp, Homo sapiens
ccctctgaatggtccaggg

SEQ ID NO: 2636198 - DNA, 19 bp, Homo sapiens
ccctctgacctgcactggg

SEQ ID NO: 2636199 - DNA, 11 bp, Homo sapiens
ccctctgccca

SEQ ID NO: 2636200 - DNA, 15 bp, Homo sapiens
ccctctgcccactcc

SEQ ID NO: 2636201 - DNA, 18 bp, Homo sapiens
ccctctgcccactccctg

SEQ ID NO: 2636202 - DNA, 19 bp, Homo sapiens
ccctctgcccagcttgggc

SEQ ID NO: 2636203 - DNA, 16 bp, Homo sapiens
ccctctgcctgtccct

SEQ ID NO: 2636204 - DNA, 14 bp, Homo sapiens
ccctctgctgctgt

SEQ ID NO: 2636205 - DNA, 15 bp, Homo sapiens
ccctctgctgctgtc

SEQ ID NO: 2636206 - DNA, 22 bp, Homo sapiens
ccctctggaggggtgtggctcc

SEQ ID NO: 2636207 - DNA, 15 bp, Homo sapiens
ccctcttctcaagtg

SEQ ID NO: 2636208 - DNA, 22 bp, Homo sapiens
ccctcttgccccccaccccagc

SEQ ID NO: 2636209 - DNA, 17 bp, Homo sapiens
ccctctttggctcccct

SEQ ID NO: 2636210 - DNA, 19 bp, Homo sapiens
ccctctttggctcccctgt

SEQ ID NO: 2636211 - DNA, 21 bp, Homo sapiens
ccctctttggctcccctgtac

SEQ ID NO: 2636212 - DNA, 23 bp, Homo sapiens
ccctgaaaatgtttttctgccag

SEQ ID NO: 2636213 - DNA, 14 bp, Homo sapiens
ccctgaaacttatt

SEQ ID NO: 2636214 - DNA, 18 bp, Homo sapiens
ccctgaaagccctgagct

SEQ ID NO: 2636215 - DNA, 12 bp, Homo sapiens
ccctgaaggccc

SEQ ID NO: 2636216 - DNA, 13 bp, Homo sapiens
ccctgaaggcccc

SEQ ID NO: 2636217 - DNA, 21 bp, Homo sapiens
ccctgaatcccccttgccacc

SEQ ID NO: 2636218 - DNA, 14 bp, Homo sapiens
ccctgacaacactc

SEQ ID NO: 2636219 - DNA, 16 bp, Homo sapiens
ccctgacaacactcat

SEQ ID NO: 2636220 - DNA, 22 bp, Homo sapiens
ccctgacaacactcattgacct

SEQ ID NO: 2636221 - DNA, 16 bp, Homo sapiens
ccctgacctcccagcc

SEQ ID NO: 2636222 - DNA, 19 bp, Homo sapiens
ccctgacctcccagcccta

SEQ ID NO: 2636223 - DNA, 22 bp, Homo sapiens
ccctgacctcccagccctatgg

SEQ ID NO: 2636224 - DNA, 15 bp, Homo sapiens
ccctgactcattctg

SEQ ID NO: 2636225 - DNA, 17 bp, Homo sapiens
ccctgactctctgtgac

SEQ ID NO: 2636226 - DNA, 17 bp, Homo sapiens
ccctgagccccttcctt

SEQ ID NO: 2636227 - DNA, 22 bp, Homo sapiens
ccctgagctcggtggacccagg

SEQ ID NO: 2636228 - DNA, 13 bp, Homo sapiens
ccctgagctgagg

SEQ ID NO: 2636229 - DNA, 14 bp, Homo sapiens
ccctgagctgaggg

SEQ ID NO: 2636230 - DNA, 16 bp, Homo sapiens
ccctgagctttctgct

SEQ ID NO: 2636231 - DNA, 14 bp, Homo sapiens
ccctgaggagccag

SEQ ID NO: 2636232 - DNA, 13 bp, Homo sapiens
ccctgaggcccag

SEQ ID NO: 2636233 - DNA, 20 bp, Homo sapiens
ccctgaggcccagagggcct

SEQ ID NO: 2636234 - DNA, 12 bp, Homo sapiens
ccctgaggctca

SEQ ID NO: 2636235 - DNA, 17 bp, Homo sapiens
ccctgaggggtccctga

SEQ ID NO: 2636236 - DNA, 18 bp, Homo sapiens
ccctgaggtgaaagggag

SEQ ID NO: 2636237 - DNA, 20 bp, Homo sapiens
ccctgaggtgaaagggagct

SEQ ID NO: 2636238 - DNA, 20 bp, Homo sapiens
ccctgaggtgtgggggctgc

SEQ ID NO: 2636239 - DNA, 21 bp, Homo sapiens
ccctgaggtgtgggggctgca

SEQ ID NO: 2636240 - DNA, 20 bp, Homo sapiens
ccctgagtggatctccaagg

SEQ ID NO: 2636241 - DNA, 15 bp, Homo sapiens
ccctgatcctgtgaa

SEQ ID NO: 2636242 - DNA, 21 bp, Homo sapiens
ccctgatctgacatccccact

SEQ ID NO: 2636243 - DNA, 19 bp, Homo sapiens
ccctgattacaccagcctc

SEQ ID NO: 2636244 - DNA, 18 bp, Homo sapiens
ccctgcaaaaggactctc

SEQ ID NO: 2636245 - DNA, 16 bp, Homo sapiens
ccctgcaacctgattg

SEQ ID NO: 2636246 - DNA, 21 bp, Homo sapiens
ccctgcattctttctgtattg

SEQ ID NO: 2636247 - DNA, 18 bp, Homo sapiens
ccctgccaccctggggag

SEQ ID NO: 2636248 - DNA, 20 bp, Homo sapiens
ccctgcccacctggcctctg

SEQ ID NO: 2636249 - DNA, 22 bp, Homo sapiens
ccctgcccacctggcctctgca

SEQ ID NO: 2636250 - DNA, 14 bp, Homo sapiens
ccctgcccccacca

SEQ ID NO: 2636251 - DNA, 14 bp, Homo sapiens
ccctgcccggctgc

SEQ ID NO: 2636252 - DNA, 13 bp, Homo sapiens
ccctgccctggga

SEQ ID NO: 2636253 - DNA, 12 bp, Homo sapiens
ccctgccctggt

SEQ ID NO: 2636254 - DNA, 14 bp, Homo sapiens
ccctgccctggtcc

SEQ ID NO: 2636255 - DNA, 15 bp, Homo sapiens
ccctgccctggtcca

SEQ ID NO: 2636256 - DNA, 12 bp, Homo sapiens
ccctgccctgtg

SEQ ID NO: 2636257 - DNA, 16 bp, Homo sapiens
ccctgccctgtgggcc

SEQ ID NO: 2636258 - DNA, 20 bp, Homo sapiens
ccctgccctgtgggccccca

SEQ ID NO: 2636259 - DNA, 16 bp, Homo sapiens
ccctgcctccaccctc

SEQ ID NO: 2636260 - DNA, 11 bp, Homo sapiens
ccctgcctcct

SEQ ID NO: 2636261 - DNA, 23 bp, Homo sapiens
ccctgcctcctttgtgaggaagc

SEQ ID NO: 2636262 - DNA, 13 bp, Homo sapiens
ccctgcctctgtt

SEQ ID NO: 2636263 - DNA, 19 bp, Homo sapiens
ccctgcctgagggcccctc

SEQ ID NO: 2636264 - DNA, 21 bp, Homo sapiens
ccctgcctgagggcccctctg

SEQ ID NO: 2636265 - DNA, 23 bp, Homo sapiens
ccctgcctggggcgggcccctca

SEQ ID NO: 2636266 - DNA, 17 bp, Homo sapiens
ccctgcgaaggggccct

SEQ ID NO: 2636267 - DNA, 19 bp, Homo sapiens
ccctgcgaaggggccctgg

SEQ ID NO: 2636268 - DNA, 22 bp, Homo sapiens
ccctgcggccccgtctgtggct

SEQ ID NO: 2636269 - DNA, 15 bp, Homo sapiens
ccctgcgtggggaca

SEQ ID NO: 2636270 - DNA, 18 bp, Homo sapiens
ccctgctcctccctggct

SEQ ID NO: 2636271 - DNA, 20 bp, Homo sapiens
ccctgctgccgcctcccagc

SEQ ID NO: 2636272 - DNA, 18 bp, Homo sapiens
ccctgctggccgcctcac

SEQ ID NO: 2636273 - DNA, 14 bp, Homo sapiens
ccctgctggctctt

SEQ ID NO: 2636274 - DNA, 15 bp, Homo sapiens
ccctgctggctcttc

SEQ ID NO: 2636275 - DNA, 20 bp, Homo sapiens
ccctgctggctcttctgccc

SEQ ID NO: 2636276 - DNA, 21 bp, Homo sapiens
ccctgctgggtgtggcgcagc

SEQ ID NO: 2636277 - DNA, 22 bp, Homo sapiens
ccctgctgggtgtggcgcagca

SEQ ID NO: 2636278 - DNA, 18 bp, Homo sapiens
ccctggaagccggcggcc

SEQ ID NO: 2636279 - DNA, 13 bp, Homo sapiens
ccctggactggga

SEQ ID NO: 2636280 - DNA, 23 bp, Homo sapiens
ccctggagagttcaatggctgct

SEQ ID NO: 2636281 - DNA, 21 bp, Homo sapiens
ccctggagccaactgctgctt

SEQ ID NO: 2636282 - DNA, 13 bp, Homo sapiens
ccctggagccaga

SEQ ID NO: 2636283 - DNA, 12 bp, Homo sapiens
ccctggagccca

SEQ ID NO: 2636284 - DNA, 20 bp, Homo sapiens
ccctggagtgtggctgagga

SEQ ID NO: 2636285 - DNA, 21 bp, Homo sapiens
ccctggagtgtggctgaggag

SEQ ID NO: 2636286 - DNA, 23 bp, Homo sapiens
ccctggatcagtcctttgatcag

SEQ ID NO: 2636287 - DNA, 13 bp, Homo sapiens
ccctggatgcagc

SEQ ID NO: 2636288 - DNA, 21 bp, Homo sapiens
ccctggatgcagcctcacagt

SEQ ID NO: 2636289 - DNA, 23 bp, Homo sapiens
ccctggcattatgtccactgtgt

SEQ ID NO: 2636290 - DNA, 15 bp, Homo sapiens
ccctggccgccccct

SEQ ID NO: 2636291 - DNA, 15 bp, Homo sapiens
ccctggcctgttctg

SEQ ID NO: 2636292 - DNA, 17 bp, Homo sapiens
ccctggcctttcatatt

SEQ ID NO: 2636293 - DNA, 15 bp, Homo sapiens
ccctggctgaaggac

SEQ ID NO: 2636294 - DNA, 13 bp, Homo sapiens
ccctggctgccct

SEQ ID NO: 2636295 - DNA, 16 bp, Homo sapiens
ccctggctgccctggc

SEQ ID NO: 2636296 - DNA, 19 bp, Homo sapiens
ccctggctgccctggccct

SEQ ID NO: 2636297 - DNA, 13 bp, Homo sapiens
ccctgggctctgc

SEQ ID NO: 2636298 - DNA, 15 bp, Homo sapiens
ccctgggctctgccc

SEQ ID NO: 2636299 - DNA, 17 bp, Homo sapiens
ccctggggacagcaagg

SEQ ID NO: 2636300 - DNA, 14 bp, Homo sapiens
ccctggggcctgga

SEQ ID NO: 2636301 - DNA, 17 bp, Homo sapiens
ccctggggcctggacct

SEQ ID NO: 2636302 - DNA, 18 bp, Homo sapiens
ccctggggcctggacctg

SEQ ID NO: 2636303 - DNA, 22 bp, Homo sapiens
ccctgggtgggtggtggggagg

SEQ ID NO: 2636304 - DNA, 23 bp, Homo sapiens
ccctggtaataagtactgtgtac

SEQ ID NO: 2636305 - DNA, 15 bp, Homo sapiens
ccctggtcctgaggg

SEQ ID NO: 2636306 - DNA, 13 bp, Homo sapiens
ccctggtctcagc

SEQ ID NO: 2636307 - DNA, 20 bp, Homo sapiens
ccctggtctcagcagcgacc

SEQ ID NO: 2636308 - DNA, 13 bp, Homo sapiens
ccctggtctctgg

SEQ ID NO: 2636309 - DNA, 15 bp, Homo sapiens
ccctggtctctggtc

SEQ ID NO: 2636310 - DNA, 17 bp, Homo sapiens
ccctggtggacagtcct

SEQ ID NO: 2636311 - DNA, 23 bp, Homo sapiens
ccctggtggagaaagcactgacc

SEQ ID NO: 2636312 - DNA, 14 bp, Homo sapiens
ccctggtggcagct

SEQ ID NO: 2636313 - DNA, 17 bp, Homo sapiens
ccctggtggcagctcac

SEQ ID NO: 2636314 - DNA, 15 bp, Homo sapiens
ccctggtggcagtgg

SEQ ID NO: 2636315 - DNA, 12 bp, Homo sapiens
ccctggtgtttc

SEQ ID NO: 2636316 - DNA, 21 bp, Homo sapiens
ccctggtgtttctagcactgg

SEQ ID NO: 2636317 - DNA, 23 bp, Homo sapiens
ccccagttctgctcctctccagg

SEQ ID NO: 2636318 - DNA, 16 bp, Homo sapiens
ccccatcccacaccct

SEQ ID NO: 2636319 - DNA, 16 bp, Homo sapiens
ccccatctctccctcc

SEQ ID NO: 2636320 - DNA, 19 bp, Homo sapiens
ccccatctctccctcccct

SEQ ID NO: 2636321 - DNA, 19 bp, Homo sapiens
ccccatctgggtccttgca

SEQ ID NO: 2636322 - DNA, 22 bp, Homo sapiens
ccccatgccaaagctagggtgg

SEQ ID NO: 2636323 - DNA, 18 bp, Homo sapiens
ccccatgcctgtccagcc

SEQ ID NO: 2636324 - DNA, 19 bp, Homo sapiens
ccccatgcctgtccagcct

SEQ ID NO: 2636325 - DNA, 24 bp, Homo sapiens
ccccatgcctgtccagcctgggca

SEQ ID NO: 2636326 - DNA, 15 bp, Homo sapiens
ccccatgctggaggt

SEQ ID NO: 2636327 - DNA, 14 bp, Homo sapiens
ccccatgctgttga

SEQ ID NO: 2636328 - DNA, 14 bp, Homo sapiens
ccccatgtgtcctg

SEQ ID NO: 2636329 - DNA, 18 bp, Homo sapiens
ccccatgtgtcctggttc

SEQ ID NO: 2636330 - DNA, 17 bp, Homo sapiens
ccccattagctttcaat

SEQ ID NO: 2636331 - DNA, 23 bp, Homo sapiens
ccccattagctttcaattccgta

SEQ ID NO: 2636332 - DNA, 14 bp, Homo sapiens
ccccattctgcctg

SEQ ID NO: 2636333 - DNA, 21 bp, Homo sapiens
ccccattctgcctgcccaggc

SEQ ID NO: 2636334 - DNA, 17 bp, Homo sapiens
ccccatttctatttatt

SEQ ID NO: 2636335 - DNA, 20 bp, Homo sapiens
ccccatttctatttatttac

SEQ ID NO: 2636336 - DNA, 16 bp, Homo sapiens
cccccaacactgtgcc

SEQ ID NO: 2636337 - DNA, 22 bp, Homo sapiens
cccccaacactgtgccctggtg

SEQ ID NO: 2636338 - DNA, 13 bp, Homo sapiens
cccccaagcctgc

SEQ ID NO: 2636339 - DNA, 11 bp, Homo sapiens
cccccacacac

SEQ ID NO: 2636340 - DNA, 15 bp, Homo sapiens
cccccaccactagga

SEQ ID NO: 2636341 - DNA, 11 bp, Homo sapiens
cccccactggt

SEQ ID NO: 2636342 - DNA, 15 bp, Homo sapiens
cccccagaacctgtc

SEQ ID NO: 2636343 - DNA, 16 bp, Homo sapiens
cccccagcaaccctcc

SEQ ID NO: 2636344 - DNA, 12 bp, Homo sapiens
cccccagctggc

SEQ ID NO: 2636345 - DNA, 20 bp, Homo sapiens
cccccaggggaaagatgagc

SEQ ID NO: 2636346 - DNA, 23 bp, Homo sapiens
cccccatccccatcctccagctt

SEQ ID NO: 2636347 - DNA, 13 bp, Homo sapiens
ccccccttccact

SEQ ID NO: 2636348 - DNA, 15 bp, Homo sapiens
cccccgagctggggg

SEQ ID NO: 2636349 - DNA, 12 bp, Homo sapiens
cccccgccccct

SEQ ID NO: 2636350 - DNA, 13 bp, Homo sapiens
cccccgccccctg

SEQ ID NO: 2636351 - DNA, 13 bp, Homo sapiens
cccccggccccct

SEQ ID NO: 2636352 - DNA, 14 bp, Homo sapiens
cccccggccccctg

SEQ ID NO: 2636353 - DNA, 14 bp, Homo sapiens
ccccctcctctccc

SEQ ID NO: 2636354 - DNA, 22 bp, Homo sapiens
ccccctcgggtctcctcactcc

SEQ ID NO: 2636355 - DNA, 13 bp, Homo sapiens
ccccctctgccgc

SEQ ID NO: 2636356 - DNA, 16 bp, Homo sapiens
ccccctctgtcttgtg

SEQ ID NO: 2636357 - DNA, 12 bp, Homo sapiens
ccccctgccctc

SEQ ID NO: 2636358 - DNA, 16 bp, Homo sapiens
ccccctgccctcgtgg

SEQ ID NO: 2636359 - DNA, 12 bp, Homo sapiens
ccccctgctggc

SEQ ID NO: 2636360 - DNA, 11 bp, Homo sapiens
ccccctgggct

SEQ ID NO: 2636361 - DNA, 12 bp, Homo sapiens
ccccctgtgcag

SEQ ID NO: 2636362 - DNA, 14 bp, Homo sapiens
cccccttctcccac

SEQ ID NO: 2636363 - DNA, 17 bp, Homo sapiens
cccccttctcccacact

SEQ ID NO: 2636364 - DNA, 17 bp, Homo sapiens
ccccctttcagatgtct

SEQ ID NO: 2636365 - DNA, 20 bp, Homo sapiens
ccccctttcctggacactca

SEQ ID NO: 2636366 - DNA, 16 bp, Homo sapiens
ccccctttgggcccag

SEQ ID NO: 2636367 - DNA, 23 bp, Homo sapiens
ccccgacccttgccgtctacctg

SEQ ID NO: 2636368 - DNA, 13 bp, Homo sapiens
ccccgccccacat

SEQ ID NO: 2636369 - DNA, 14 bp, Homo sapiens
ccccgcttctgcct

SEQ ID NO: 2636370 - DNA, 14 bp, Homo sapiens
ccccggagttcagt

SEQ ID NO: 2636371 - DNA, 14 bp, Homo sapiens
ccccggccacctgc

SEQ ID NO: 2636372 - DNA, 13 bp, Homo sapiens
ccccggccctacc

SEQ ID NO: 2636373 - DNA, 21 bp, Homo sapiens
ccccggccctgggctcggagg

SEQ ID NO: 2636374 - DNA, 18 bp, Homo sapiens
ccccgggctctctgctgt

SEQ ID NO: 2636375 - DNA, 14 bp, Homo sapiens
ccccgtctctacta

SEQ ID NO: 2636376 - DNA, 18 bp, Homo sapiens
cccctagtaagtgccttc

SEQ ID NO: 2636377 - DNA, 19 bp, Homo sapiens
cccctagtaagtgccttcc

SEQ ID NO: 2636378 - DNA, 12 bp, Homo sapiens
cccctcacctcc

SEQ ID NO: 2636379 - DNA, 13 bp, Homo sapiens
cccctcaccttgc

SEQ ID NO: 2636380 - DNA, 14 bp, Homo sapiens
cccctcaccttgca

SEQ ID NO: 2636381 - DNA, 15 bp, Homo sapiens
cccctcaggactgca

SEQ ID NO: 2636382 - DNA, 16 bp, Homo sapiens
cccctcagggtccctg

SEQ ID NO: 2636383 - DNA, 18 bp, Homo sapiens
cccctcagggtccctggt

SEQ ID NO: 2636384 - DNA, 15 bp, Homo sapiens
cccctccaatcctgc

SEQ ID NO: 2636385 - DNA, 14 bp, Homo sapiens
cccctccactgtca

SEQ ID NO: 2636386 - DNA, 11 bp, Homo sapiens
cccctccagct

SEQ ID NO: 2636387 - DNA, 22 bp, Homo sapiens
cccctccagcttgtggagcccc

SEQ ID NO: 2636388 - DNA, 13 bp, Homo sapiens
cccctcccagaac

SEQ ID NO: 2636389 - DNA, 13 bp, Homo sapiens
cccctcccatctg

SEQ ID NO: 2636390 - DNA, 18 bp, Homo sapiens
cccctcccccaaccccca

SEQ ID NO: 2636391 - DNA, 14 bp, Homo sapiens
cccctcccccttct

SEQ ID NO: 2636392 - DNA, 14 bp, Homo sapiens
cccctccctgcttc

SEQ ID NO: 2636393 - DNA, 12 bp, Homo sapiens
cccctccctggc

SEQ ID NO: 2636394 - DNA, 17 bp, Homo sapiens
cccctccctggcctgtt

SEQ ID NO: 2636395 - DNA, 14 bp, Homo sapiens
cccctccctggctc

SEQ ID NO: 2636396 - DNA, 13 bp, Homo sapiens
cccctcctccctt

SEQ ID NO: 2636397 - DNA, 19 bp, Homo sapiens
cccctcctctagctgtggg

SEQ ID NO: 2636398 - DNA, 21 bp, Homo sapiens
cccctcctctagctgtggggg

SEQ ID NO: 2636399 - DNA, 13 bp, Homo sapiens
cccctcctctccc

SEQ ID NO: 2636400 - DNA, 15 bp, Homo sapiens
cccctcctctcccat

SEQ ID NO: 2636401 - DNA, 18 bp, Homo sapiens
cccctcctctcccatccc

SEQ ID NO: 2636402 - DNA, 18 bp, Homo sapiens
cccctccttgcctcctgt

SEQ ID NO: 2636403 - DNA, 21 bp, Homo sapiens
cccctcgcttggacggctggg

SEQ ID NO: 2636404 - DNA, 19 bp, Homo sapiens
cccctctctgcatctgacc

SEQ ID NO: 2636405 - DNA, 15 bp, Homo sapiens
cccctctgacctgca

SEQ ID NO: 2636406 - DNA, 18 bp, Homo sapiens
cccctctgacctgcactg

SEQ ID NO: 2636407 - DNA, 15 bp, Homo sapiens
cccctctgcccagct

SEQ ID NO: 2636408 - DNA, 16 bp, Homo sapiens
cccctctggccaggat

SEQ ID NO: 2636409 - DNA, 13 bp, Homo sapiens
cccctgaaactta

SEQ ID NO: 2636410 - DNA, 17 bp, Homo sapiens
cccctgaaacttatttt

SEQ ID NO: 2636411 - DNA, 16 bp, Homo sapiens
cccctgccaccctggg

SEQ ID NO: 2636412 - DNA, 14 bp, Homo sapiens
cccctgcccatctg

SEQ ID NO: 2636413 - DNA, 15 bp, Homo sapiens
cccctgccccgtcac

SEQ ID NO: 2636414 - DNA, 13 bp, Homo sapiens
cccctgccctcgt

SEQ ID NO: 2636415 - DNA, 19 bp, Homo sapiens
cccctgccctcgtggccag

SEQ ID NO: 2636416 - DNA, 13 bp, Homo sapiens
cccctgccctggg

SEQ ID NO: 2636417 - DNA, 11 bp, Homo sapiens
cccctgcctcc

SEQ ID NO: 2636418 - DNA, 15 bp, Homo sapiens
cccctgcctccaccc

SEQ ID NO: 2636419 - DNA, 12 bp, Homo sapiens
cccctgctgcct

SEQ ID NO: 2636420 - DNA, 14 bp, Homo sapiens
cccctgctggctct

SEQ ID NO: 2636421 - DNA, 22 bp, Homo sapiens
cccctgctggctcttctgccca

SEQ ID NO: 2636422 - DNA, 17 bp, Homo sapiens
cccctgctgggtgtggc

SEQ ID NO: 2636423 - DNA, 13 bp, Homo sapiens
cccctgctggttc

SEQ ID NO: 2636424 - DNA, 20 bp, Homo sapiens
cccctgctggttcagggttg

SEQ ID NO: 2636425 - DNA, 15 bp, Homo sapiens
cccctggactgggag

SEQ ID NO: 2636426 - DNA, 19 bp, Homo sapiens
cccctggatgcagcctcac

SEQ ID NO: 2636427 - DNA, 13 bp, Homo sapiens
cccctggcccagc

SEQ ID NO: 2636428 - DNA, 14 bp, Homo sapiens
cccctggcccagcg

SEQ ID NO: 2636429 - DNA, 15 bp, Homo sapiens
cccctggcccagcgg

SEQ ID NO: 2636430 - DNA, 17 bp, Homo sapiens
cccctggcccagcggcc

SEQ ID NO: 2636431 - DNA, 21 bp, Homo sapiens
cccctgggtgggtggtgggga

SEQ ID NO: 2636432 - DNA, 15 bp, Homo sapiens
cccctggtctctggt

SEQ ID NO: 2636433 - DNA, 14 bp, Homo sapiens
cccctgtactccag

SEQ ID NO: 2636434 - DNA, 12 bp, Homo sapiens
cccctgtcctga

SEQ ID NO: 2636435 - DNA, 19 bp, Homo sapiens
cccctgtgctccgtgcctc

SEQ ID NO: 2636436 - DNA, 12 bp, Homo sapiens
cccctgtgggga

SEQ ID NO: 2636437 - DNA, 24 bp, Homo sapiens
cccctgtggggatctcaggggctg

SEQ ID NO: 2636438 - DNA, 16 bp, Homo sapiens
ccccttatccaggact

SEQ ID NO: 2636439 - DNA, 19 bp, Homo sapiens
ccaggggtgggacaccctg

SEQ ID NO: 2636440 - DNA, 19 bp, Homo sapiens
ccagggtagcccgcctgcc

SEQ ID NO: 2636441 - DNA, 21 bp, Homo sapiens
ccagggtagcccgcctgccag

SEQ ID NO: 2636442 - DNA, 22 bp, Homo sapiens
ccagggtagcccgcctgccagt

SEQ ID NO: 2636443 - DNA, 14 bp, Homo sapiens
ccagggtcttccct

SEQ ID NO: 2636444 - DNA, 15 bp, Homo sapiens
ccagggttcccccag

SEQ ID NO: 2636445 - DNA, 18 bp, Homo sapiens
ccagggttgaccccagag

SEQ ID NO: 2636446 - DNA, 17 bp, Homo sapiens
ccagggtttcgagaagc

SEQ ID NO: 2636447 - DNA, 14 bp, Homo sapiens
ccaggtcctctgat

SEQ ID NO: 2636448 - DNA, 22 bp, Homo sapiens
ccaggtcctctgatacccagag

SEQ ID NO: 2636449 - DNA, 12 bp, Homo sapiens
ccaggtgccagt

SEQ ID NO: 2636450 - DNA, 17 bp, Homo sapiens
ccaggtgccagttatgg

SEQ ID NO: 2636451 - DNA, 14 bp, Homo sapiens
ccaggtgccttgga

SEQ ID NO: 2636452 - DNA, 22 bp, Homo sapiens
ccaggttctatttggaatttat

SEQ ID NO: 2636453 - DNA, 16 bp, Homo sapiens
ccaggttgaaagacct

SEQ ID NO: 2636454 - DNA, 17 bp, Homo sapiens
ccaggtttctggtctct

SEQ ID NO: 2636455 - DNA, 22 bp, Homo sapiens
ccaggtttctggtctctaggct

SEQ ID NO: 2636456 - DNA, 16 bp, Homo sapiens
ccaggttttctgggtg

SEQ ID NO: 2636457 - DNA, 22 bp, Homo sapiens
ccaggtttttcaattaaacgga

SEQ ID NO: 2636458 - DNA, 23 bp, Homo sapiens
ccaggtttttcaattaaacggat

SEQ ID NO: 2636459 - DNA, 18 bp, Homo sapiens
ccagtaagggaaatagaa

SEQ ID NO: 2636460 - DNA, 18 bp, Homo sapiens
ccagtacctcctgtctct

SEQ ID NO: 2636461 - DNA, 14 bp, Homo sapiens
ccagtattcttgtc

SEQ ID NO: 2636462 - DNA, 14 bp, Homo sapiens
ccagtcagcctctc

SEQ ID NO: 2636463 - DNA, 15 bp, Homo sapiens
ccagtcagcctctct

SEQ ID NO: 2636464 - DNA, 22 bp, Homo sapiens
ccagtcagcctctctcccagtc

SEQ ID NO: 2636465 - DNA, 18 bp, Homo sapiens
ccagtccaaatgtcctcc

SEQ ID NO: 2636466 - DNA, 18 bp, Homo sapiens
ccagtccccctgccccag

SEQ ID NO: 2636467 - DNA, 18 bp, Homo sapiens
ccagtcctagctgcacag

SEQ ID NO: 2636468 - DNA, 13 bp, Homo sapiens
ccagtcctggcct

SEQ ID NO: 2636469 - DNA, 13 bp, Homo sapiens
ccagtccttccac

SEQ ID NO: 2636470 - DNA, 16 bp, Homo sapiens
ccagtctgctgccctc

SEQ ID NO: 2636471 - DNA, 17 bp, Homo sapiens
ccagtctgctgccctcc

SEQ ID NO: 2636472 - DNA, 18 bp, Homo sapiens
ccagtctgctgccctcca

SEQ ID NO: 2636473 - DNA, 20 bp, Homo sapiens
ccagtctggaatgcagtggt

SEQ ID NO: 2636474 - DNA, 17 bp, Homo sapiens
ccagtcttcctgacact

SEQ ID NO: 2636475 - DNA, 12 bp, Homo sapiens
ccagtcttgtgt

SEQ ID NO: 2636476 - DNA, 11 bp, Homo sapiens
ccagtgacact

SEQ ID NO: 2636477 - DNA, 24 bp, Homo sapiens
ccagtgacacttcagagagctggt

SEQ ID NO: 2636478 - DNA, 18 bp, Homo sapiens
ccagtgacctgctgggta

SEQ ID NO: 2636479 - DNA, 13 bp, Homo sapiens
ccagtgactccag

SEQ ID NO: 2636480 - DNA, 13 bp, Homo sapiens
ccagtgagatgca

SEQ ID NO: 2636481 - DNA, 21 bp, Homo sapiens
ccagtgagatgcattcttggt

SEQ ID NO: 2636482 - DNA, 13 bp, Homo sapiens
ccagtgaggctct

SEQ ID NO: 2636483 - DNA, 14 bp, Homo sapiens
ccagtgcaacagca

SEQ ID NO: 2636484 - DNA, 18 bp, Homo sapiens
ccagtgcaacagcactgg

SEQ ID NO: 2636485 - DNA, 19 bp, Homo sapiens
ccagtgcccaaagtctgtg

SEQ ID NO: 2636486 - DNA, 14 bp, Homo sapiens
ccagtgcggcaggt

SEQ ID NO: 2636487 - DNA, 15 bp, Homo sapiens
ccagtggccactcag

SEQ ID NO: 2636488 - DNA, 16 bp, Homo sapiens
ccagtggccactcagc

SEQ ID NO: 2636489 - DNA, 17 bp, Homo sapiens
ccagtggcctcaaccct

SEQ ID NO: 2636490 - DNA, 23 bp, Homo sapiens
ccagtggcctcaaccctccctca

SEQ ID NO: 2636491 - DNA, 13 bp, Homo sapiens
ccagtggctgctg

SEQ ID NO: 2636492 - DNA, 17 bp, Homo sapiens
ccagtggctgctgccca

SEQ ID NO: 2636493 - DNA, 13 bp, Homo sapiens
ccagtgggaagat

SEQ ID NO: 2636494 - DNA, 12 bp, Homo sapiens
ccagtgggaggg

SEQ ID NO: 2636495 - DNA, 18 bp, Homo sapiens
ccagtgggaggggcaggc

SEQ ID NO: 2636496 - DNA, 14 bp, Homo sapiens
ccagtggttgctgt

SEQ ID NO: 2636497 - DNA, 23 bp, Homo sapiens
ccagtgtgacaaggattgctact

SEQ ID NO: 2636498 - DNA, 22 bp, Homo sapiens
ccagtgtgggaatgcggcaaga

SEQ ID NO: 2636499 - DNA, 19 bp, Homo sapiens
ccagttcaatctcccgctg

SEQ ID NO: 2636500 - DNA, 17 bp, Homo sapiens
ccagttcagtacctgga

SEQ ID NO: 2636501 - DNA, 19 bp, Homo sapiens
ccagttcagtacctggagg

SEQ ID NO: 2636502 - DNA, 22 bp, Homo sapiens
ccagttcctttcaatggtttgc

SEQ ID NO: 2636503 - DNA, 13 bp, Homo sapiens
ccagttctgctcc

SEQ ID NO: 2636504 - DNA, 16 bp, Homo sapiens
ccagttctgctcctct

SEQ ID NO: 2636505 - DNA, 21 bp, Homo sapiens
ccagttctgctcctctccagg

SEQ ID NO: 2636506 - DNA, 22 bp, Homo sapiens
ccagttggagcagatgcctccc

SEQ ID NO: 2636507 - DNA, 18 bp, Homo sapiens
ccagttgggagcactgga

SEQ ID NO: 2636508 - DNA, 19 bp, Homo sapiens
ccagttgggagcactggag

SEQ ID NO: 2636509 - DNA, 17 bp, Homo sapiens
ccagttgggtggatgcc

SEQ ID NO: 2636510 - DNA, 16 bp, Homo sapiens
ccataaacttcatggt

SEQ ID NO: 2636511 - DNA, 20 bp, Homo sapiens
cccagtttctgcctctgagg

SEQ ID NO: 2636512 - DNA, 16 bp, Homo sapiens
cccatatttcatcgtg

SEQ ID NO: 2636513 - DNA, 22 bp, Homo sapiens
cccatcacagggttgggcccag

SEQ ID NO: 2636514 - DNA, 18 bp, Homo sapiens
cccatcagctccagctgc

SEQ ID NO: 2636515 - DNA, 22 bp, Homo sapiens
cccatcagtgctccctcacatg

SEQ ID NO: 2636516 - DNA, 14 bp, Homo sapiens
cccatccagttcat

SEQ ID NO: 2636517 - DNA, 21 bp, Homo sapiens
cccatcccctggactgggagg

SEQ ID NO: 2636518 - DNA, 15 bp, Homo sapiens
cccatccctccccag

SEQ ID NO: 2636519 - DNA, 16 bp, Homo sapiens
cccatccctccccagt

SEQ ID NO: 2636520 - DNA, 12 bp, Homo sapiens
cccatcctaccc

SEQ ID NO: 2636521 - DNA, 13 bp, Homo sapiens
cccatcctaccct

SEQ ID NO: 2636522 - DNA, 22 bp, Homo sapiens
cccatcctatcagcctgtctct

SEQ ID NO: 2636523 - DNA, 14 bp, Homo sapiens
cccatcctccagct

SEQ ID NO: 2636524 - DNA, 16 bp, Homo sapiens
cccatcctccagcttc

SEQ ID NO: 2636525 - DNA, 19 bp, Homo sapiens
cccatcctccagcttctgg

SEQ ID NO: 2636526 - DNA, 18 bp, Homo sapiens
cccatcctccccttccct

SEQ ID NO: 2636527 - DNA, 20 bp, Homo sapiens
cccatcctctgtacagagcc

SEQ ID NO: 2636528 - DNA, 21 bp, Homo sapiens
cccatcctctgtacagagccc

SEQ ID NO: 2636529 - DNA, 22 bp, Homo sapiens
cccatcctctgtacagagccca

SEQ ID NO: 2636530 - DNA, 13 bp, Homo sapiens
cccatctcacaca

SEQ ID NO: 2636531 - DNA, 18 bp, Homo sapiens
cccatctcacacatgagc

SEQ ID NO: 2636532 - DNA, 13 bp, Homo sapiens
cccatctccccct

SEQ ID NO: 2636533 - DNA, 17 bp, Homo sapiens
cccatctgcagggcccc

SEQ ID NO: 2636534 - DNA, 22 bp, Homo sapiens
cccatctgggtccttgcacccc

SEQ ID NO: 2636535 - DNA, 20 bp, Homo sapiens
cccatctgtgaaaggaaaga

SEQ ID NO: 2636536 - DNA, 16 bp, Homo sapiens
cccatctgtgaataag

SEQ ID NO: 2636537 - DNA, 19 bp, Homo sapiens
cccatgaccatactgaggg

SEQ ID NO: 2636538 - DNA, 13 bp, Homo sapiens
cccatgacccacc

SEQ ID NO: 2636539 - DNA, 22 bp, Homo sapiens
cccatgacccacccctgtgctc

SEQ ID NO: 2636540 - DNA, 18 bp, Homo sapiens
cccatgacccaggctggg

SEQ ID NO: 2636541 - DNA, 20 bp, Homo sapiens
cccatgagcctcagcatcct

SEQ ID NO: 2636542 - DNA, 12 bp, Homo sapiens
cccatgctgccc

SEQ ID NO: 2636543 - DNA, 14 bp, Homo sapiens
cccatgctgttgat

SEQ ID NO: 2636544 - DNA, 19 bp, Homo sapiens
cccatgctgttgattgcta

SEQ ID NO: 2636545 - DNA, 14 bp, Homo sapiens
cccatggagcccca

SEQ ID NO: 2636546 - DNA, 14 bp, Homo sapiens
cccatgggctctga

SEQ ID NO: 2636547 - DNA, 16 bp, Homo sapiens
cccatgggctctgaca

SEQ ID NO: 2636548 - DNA, 14 bp, Homo sapiens
cccatgtgtgagtg

SEQ ID NO: 2636549 - DNA, 15 bp, Homo sapiens
cccatgtttctctgg

SEQ ID NO: 2636550 - DNA, 18 bp, Homo sapiens
cccattagaccaagcttg

SEQ ID NO: 2636551 - DNA, 21 bp, Homo sapiens
cccattcattccattctggaa

SEQ ID NO: 2636552 - DNA, 18 bp, Homo sapiens
cccattctacacagagca

SEQ ID NO: 2636553 - DNA, 21 bp, Homo sapiens
cccattctgcctccattctga

SEQ ID NO: 2636554 - DNA, 13 bp, Homo sapiens
cccattctgcctg

SEQ ID NO: 2636555 - DNA, 20 bp, Homo sapiens
cccattctgcctgcccaggc

SEQ ID NO: 2636556 - DNA, 22 bp, Homo sapiens
cccattctgcctgcccaggccc

SEQ ID NO: 2636557 - DNA, 23 bp, Homo sapiens
cccattgtggtcacaggaagtag

SEQ ID NO: 2636558 - DNA, 13 bp, Homo sapiens
cccatttcagctg

SEQ ID NO: 2636559 - DNA, 22 bp, Homo sapiens
cccatttctactcttaagtttc

SEQ ID NO: 2636560 - DNA, 20 bp, Homo sapiens
cccatttctagaacatccct

SEQ ID NO: 2636561 - DNA, 15 bp, Homo sapiens
cccatttctatttat

SEQ ID NO: 2636562 - DNA, 15 bp, Homo sapiens
cccatttctcactga

SEQ ID NO: 2636563 - DNA, 18 bp, Homo sapiens
cccattttgagtgactcg

SEQ ID NO: 2636564 - DNA, 22 bp, Homo sapiens
cccattttggaagttttcagga

SEQ ID NO: 2636565 - DNA, 20 bp, Homo sapiens
cccatttttatatcgatctc

SEQ ID NO: 2636566 - DNA, 16 bp, Homo sapiens
ccccaaaaccacagcc

SEQ ID NO: 2636567 - DNA, 21 bp, Homo sapiens
ccccaaaactctcctctgctg

SEQ ID NO: 2636568 - DNA, 14 bp, Homo sapiens
ccccaaagagcctg

SEQ ID NO: 2636569 - DNA, 22 bp, Homo sapiens
ccccaaagagcctggagaagct

SEQ ID NO: 2636570 - DNA, 12 bp, Homo sapiens
ccccaaagcccc

SEQ ID NO: 2636571 - DNA, 17 bp, Homo sapiens
ccccaaataagaaggga

SEQ ID NO: 2636572 - DNA, 18 bp, Homo sapiens
ccccaaataagaagggat

SEQ ID NO: 2636573 - DNA, 21 bp, Homo sapiens
ccccaaatggaaatgggcaga

SEQ ID NO: 2636574 - DNA, 18 bp, Homo sapiens
ccccaacactgtgccctg

SEQ ID NO: 2636575 - DNA, 21 bp, Homo sapiens
ccccaacactgtgccctggtg

SEQ ID NO: 2636576 - DNA, 12 bp, Homo sapiens
ccccaacagtgt

SEQ ID NO: 2636577 - DNA, 14 bp, Homo sapiens
ccccaacctgctga

SEQ ID NO: 2636578 - DNA, 13 bp, Homo sapiens
ccccaaggctgcg

SEQ ID NO: 2636579 - DNA, 13 bp, Homo sapiens
ccccaatcccagc

SEQ ID NO: 2636580 - DNA, 14 bp, Homo sapiens
ccccacacacacac

SEQ ID NO: 2636581 - DNA, 15 bp, Homo sapiens
ccccacactcactcc

SEQ ID NO: 2636582 - DNA, 17 bp, Homo sapiens
ccccaccacttctttta

SEQ ID NO: 2636583 - DNA, 19 bp, Homo sapiens
ccccacccaagcttggcag

SEQ ID NO: 2636584 - DNA, 20 bp, Homo sapiens
ccccacccaagggcctggcc

SEQ ID NO: 2636585 - DNA, 14 bp, Homo sapiens
ccccaccccacact

SEQ ID NO: 2636586 - DNA, 16 bp, Homo sapiens
ccccacccccagctca

SEQ ID NO: 2636587 - DNA, 17 bp, Homo sapiens
ccccacccccagctcaa

SEQ ID NO: 2636588 - DNA, 13 bp, Homo sapiens
ccccaccccttcc

SEQ ID NO: 2636589 - DNA, 15 bp, Homo sapiens
ccccaccccttcccc

SEQ ID NO: 2636590 - DNA, 17 bp, Homo sapiens
ccccaccccttccccac

SEQ ID NO: 2636591 - DNA, 13 bp, Homo sapiens
ccccaccccttgc

SEQ ID NO: 2636592 - DNA, 15 bp, Homo sapiens
ccccaccccttgctc

SEQ ID NO: 2636593 - DNA, 13 bp, Homo sapiens
ccccaccctcagc

SEQ ID NO: 2636594 - DNA, 18 bp, Homo sapiens
ccccaccctccctggagt

SEQ ID NO: 2636595 - DNA, 12 bp, Homo sapiens
ccccacctgcca

SEQ ID NO: 2636596 - DNA, 22 bp, Homo sapiens
ccccacggggcctcgggacctc

SEQ ID NO: 2636597 - DNA, 19 bp, Homo sapiens
ccccacgtgacagtgcctg

SEQ ID NO: 2636598 - DNA, 18 bp, Homo sapiens
ccccactcaccagtgtcc

SEQ ID NO: 2636599 - DNA, 15 bp, Homo sapiens
ccccactctccccac

SEQ ID NO: 2636600 - DNA, 21 bp, Homo sapiens
ccccactgacagcctcccacc

SEQ ID NO: 2636601 - DNA, 19 bp, Homo sapiens
ccccactgcctactgcatc

SEQ ID NO: 2636602 - DNA, 10 bp, Homo sapiens
ccccagagac

SEQ ID NO: 2636603 - DNA, 12 bp, Homo sapiens
ccccagagctgt

SEQ ID NO: 2636604 - DNA, 22 bp, Homo sapiens
ccccagagctgtttatggcctc

SEQ ID NO: 2636605 - DNA, 20 bp, Homo sapiens
ccccagattgcaacaggctg

SEQ ID NO: 2636606 - DNA, 21 bp, Homo sapiens
ccccagattgcaacaggctgg

SEQ ID NO: 2636607 - DNA, 22 bp, Homo sapiens
ccccagattgcaacaggctggg

SEQ ID NO: 2636608 - DNA, 23 bp, Homo sapiens
ccccagattgcaacaggctgggc

SEQ ID NO: 2636609 - DNA, 19 bp, Homo sapiens
ccccagcaagtgagagctg

SEQ ID NO: 2636610 - DNA, 21 bp, Homo sapiens
ccccagcaagtgagagctggg

SEQ ID NO: 2636611 - DNA, 19 bp, Homo sapiens
ccccagcactaaagcagtg

SEQ ID NO: 2636612 - DNA, 11 bp, Homo sapiens
ccccagcaggt

SEQ ID NO: 2636613 - DNA, 12 bp, Homo sapiens
ccccagcaggtg

SEQ ID NO: 2636614 - DNA, 11 bp, Homo sapiens
ccccagccaga

SEQ ID NO: 2636615 - DNA, 19 bp, Homo sapiens
ccccagcccaccctcctgt

SEQ ID NO: 2636616 - DNA, 12 bp, Homo sapiens
ccccagccccaa

SEQ ID NO: 2636617 - DNA, 17 bp, Homo sapiens
ccccagccccctttggg

SEQ ID NO: 2636618 - DNA, 23 bp, Homo sapiens
ccccagccccctttgggcccagg

SEQ ID NO: 2636619 - DNA, 16 bp, Homo sapiens
ccccagccctggctct

SEQ ID NO: 2636620 - DNA, 19 bp, Homo sapiens
ccagctcacccctggagga

SEQ ID NO: 2636621 - DNA, 14 bp, Homo sapiens
ccagctcacgtcac

SEQ ID NO: 2636622 - DNA, 15 bp, Homo sapiens
ccagctcacgtcaca

SEQ ID NO: 2636623 - DNA, 15 bp, Homo sapiens
ccagctcagtcccat

SEQ ID NO: 2636624 - DNA, 22 bp, Homo sapiens
ccagctcagtcccatcagagag

SEQ ID NO: 2636625 - DNA, 19 bp, Homo sapiens
ccagctccaagacctgttg

SEQ ID NO: 2636626 - DNA, 23 bp, Homo sapiens
ccagctccccaagaaagcctcag

SEQ ID NO: 2636627 - DNA, 20 bp, Homo sapiens
ccagctcctcccttgttctc

SEQ ID NO: 2636628 - DNA, 19 bp, Homo sapiens
ccagctctagacaaccctg

SEQ ID NO: 2636629 - DNA, 22 bp, Homo sapiens
ccagctctagacaaccctgcaa

SEQ ID NO: 2636630 - DNA, 21 bp, Homo sapiens
ccagctctgaaaccagtgtta

SEQ ID NO: 2636631 - DNA, 14 bp, Homo sapiens
ccagctctggtcca

SEQ ID NO: 2636632 - DNA, 21 bp, Homo sapiens
ccagctctgtatcaggaccca

SEQ ID NO: 2636633 - DNA, 19 bp, Homo sapiens
ccagctcttctccccaggt

SEQ ID NO: 2636634 - DNA, 17 bp, Homo sapiens
ccagctgcacctgccag

SEQ ID NO: 2636635 - DNA, 18 bp, Homo sapiens
ccagctgcacctgccagc

SEQ ID NO: 2636636 - DNA, 19 bp, Homo sapiens
ccagctgcacctgccagcc

SEQ ID NO: 2636637 - DNA, 20 bp, Homo sapiens
ccagctgcacctgccagcct

SEQ ID NO: 2636638 - DNA, 22 bp, Homo sapiens
ccagctgcacctgccagcctgg

SEQ ID NO: 2636639 - DNA, 18 bp, Homo sapiens
ccagctgccgaccagagc

SEQ ID NO: 2636640 - DNA, 19 bp, Homo sapiens
ccagctgccgaccagagcc

SEQ ID NO: 2636641 - DNA, 20 bp, Homo sapiens
ccagctgccgaccagagccc

SEQ ID NO: 2636642 - DNA, 12 bp, Homo sapiens
ccagctgctccc

SEQ ID NO: 2636643 - DNA, 14 bp, Homo sapiens
ccagctgggaggca

SEQ ID NO: 2636644 - DNA, 21 bp, Homo sapiens
ccagctgggaggcaagagggg

SEQ ID NO: 2636645 - DNA, 11 bp, Homo sapiens
ccagctgggct

SEQ ID NO: 2636646 - DNA, 17 bp, Homo sapiens
ccagctgggctctgcca

SEQ ID NO: 2636647 - DNA, 19 bp, Homo sapiens
ccagctggggcgtggggag

SEQ ID NO: 2636648 - DNA, 16 bp, Homo sapiens
ccagctgggttggaaa

SEQ ID NO: 2636649 - DNA, 16 bp, Homo sapiens
ccagcttctccaggct

SEQ ID NO: 2636650 - DNA, 17 bp, Homo sapiens
ccagcttctccaggctc

SEQ ID NO: 2636651 - DNA, 22 bp, Homo sapiens
ccagcttctggtactctcctag

SEQ ID NO: 2636652 - DNA, 19 bp, Homo sapiens
ccagcttgtggagccccac

SEQ ID NO: 2636653 - DNA, 12 bp, Homo sapiens
ccagctttccct

SEQ ID NO: 2636654 - DNA, 18 bp, Homo sapiens
ccagctttccctgcctct

SEQ ID NO: 2636655 - DNA, 17 bp, Homo sapiens
ccaggaaaggctccagg

SEQ ID NO: 2636656 - DNA, 20 bp, Homo sapiens
ccaggaaaggctccaggagc

SEQ ID NO: 2636657 - DNA, 22 bp, Homo sapiens
ccaggaacacccgactcctcaa

SEQ ID NO: 2636658 - DNA, 11 bp, Homo sapiens
ccaggaagccg

SEQ ID NO: 2636659 - DNA, 18 bp, Homo sapiens
ccaggaaggcggggcttc

SEQ ID NO: 2636660 - DNA, 19 bp, Homo sapiens
ccaggaatgcctcctccct

SEQ ID NO: 2636661 - DNA, 23 bp, Homo sapiens
ccaggaccagtcaacctgggcaa

SEQ ID NO: 2636662 - DNA, 15 bp, Homo sapiens
ccaggacgcttctga

SEQ ID NO: 2636663 - DNA, 16 bp, Homo sapiens
ccaggacgcttctgaa

SEQ ID NO: 2636664 - DNA, 19 bp, Homo sapiens
ccaggacgcttctgaatgc

SEQ ID NO: 2636665 - DNA, 20 bp, Homo sapiens
ccaggactatagcccaggtc

SEQ ID NO: 2636666 - DNA, 19 bp, Homo sapiens
ccaggactccccaggccag

SEQ ID NO: 2636667 - DNA, 16 bp, Homo sapiens
ccaggactccctcctc

SEQ ID NO: 2636668 - DNA, 18 bp, Homo sapiens
ccaggactccctcctcac

SEQ ID NO: 2636669 - DNA, 21 bp, Homo sapiens
ccaggagaaccactacatgca

SEQ ID NO: 2636670 - DNA, 21 bp, Homo sapiens
ccaggagaggagcgggacctg

SEQ ID NO: 2636671 - DNA, 15 bp, Homo sapiens
ccaggagcaaatgtt

SEQ ID NO: 2636672 - DNA, 23 bp, Homo sapiens
ccaggagcaaatgtttctgcagt

SEQ ID NO: 2636673 - DNA, 14 bp, Homo sapiens
ccaggagcagccac

SEQ ID NO: 2636674 - DNA, 15 bp, Homo sapiens
ccaggagccccgagg

SEQ ID NO: 2636675 - DNA, 19 bp, Homo sapiens
ccaggagccccgaggcctt

SEQ ID NO: 2636676 - DNA, 13 bp, Homo sapiens
ccaggagctcttc

SEQ ID NO: 2636677 - DNA, 18 bp, Homo sapiens
ccaggagctcttcaggcc

SEQ ID NO: 2636678 - DNA, 23 bp, Homo sapiens
ccaggagctcttcaggcctccct

SEQ ID NO: 2636679 - DNA, 16 bp, Homo sapiens
ccaggagctgggcaga

SEQ ID NO: 2636680 - DNA, 23 bp, Homo sapiens
ccaggagctgggcagaaggccaa

SEQ ID NO: 2636681 - DNA, 18 bp, Homo sapiens
ccaggaggccagccttga

SEQ ID NO: 2636682 - DNA, 16 bp, Homo sapiens
ccaggagggcactgga

SEQ ID NO: 2636683 - DNA, 19 bp, Homo sapiens
ccaggagggcactggagct

SEQ ID NO: 2636684 - DNA, 21 bp, Homo sapiens
ccaggagtgtggccacgtggg

SEQ ID NO: 2636685 - DNA, 18 bp, Homo sapiens
ccaggagtttgagaccag

SEQ ID NO: 2636686 - DNA, 17 bp, Homo sapiens
ccaggagtttgaggctg

SEQ ID NO: 2636687 - DNA, 20 bp, Homo sapiens
ccaggagtttgaggctgcag

SEQ ID NO: 2636688 - DNA, 22 bp, Homo sapiens
ccaggagtttgaggctgcagcg

SEQ ID NO: 2636689 - DNA, 21 bp, Homo sapiens
ccaggatcagattgcatgtga

SEQ ID NO: 2636690 - DNA, 17 bp, Homo sapiens
ccaggatcatggtgtaa

SEQ ID NO: 2636691 - DNA, 14 bp, Homo sapiens
ccaggatggagggg

SEQ ID NO: 2636692 - DNA, 20 bp, Homo sapiens
ccaggatggcccttcccact

SEQ ID NO: 2636693 - DNA, 23 bp, Homo sapiens
ccaggatggcccttcccactgga

SEQ ID NO: 2636694 - DNA, 23 bp, Homo sapiens
ccaggattttaacaaaagcaaga

SEQ ID NO: 2636695 - DNA, 13 bp, Homo sapiens
ccaggcacccttc

SEQ ID NO: 2636696 - DNA, 14 bp, Homo sapiens
ccaggcacccttct

SEQ ID NO: 2636697 - DNA, 16 bp, Homo sapiens
ccaggcactgctgccc

SEQ ID NO: 2636698 - DNA, 18 bp, Homo sapiens
ccaggcactgctgcccag

SEQ ID NO: 2636699 - DNA, 19 bp, Homo sapiens
catggggtgggcctctggt

SEQ ID NO: 2636700 - DNA, 22 bp, Homo sapiens
catggggttggctgggcccaga

SEQ ID NO: 2636701 - DNA, 19 bp, Homo sapiens
catgggtgaagggagagcc

SEQ ID NO: 2636702 - DNA, 23 bp, Homo sapiens
catgggtgaagggagagccagct

SEQ ID NO: 2636703 - DNA, 19 bp, Homo sapiens
catggtcagccctagggtg

SEQ ID NO: 2636704 - DNA, 23 bp, Homo sapiens
catggtggcaccagcgaagggag

SEQ ID NO: 2636705 - DNA, 14 bp, Homo sapiens
catggtgtaataag

SEQ ID NO: 2636706 - DNA, 19 bp, Homo sapiens
catggtgtaataagacata

SEQ ID NO: 2636707 - DNA, 21 bp, Homo sapiens
catggtgtaataagacataac

SEQ ID NO: 2636708 - DNA, 22 bp, Homo sapiens
catggtgtgaaagtcagatgcc

SEQ ID NO: 2636709 - DNA, 16 bp, Homo sapiens
catggttgagaaatga

SEQ ID NO: 2636710 - DNA, 14 bp, Homo sapiens
catgtaacagaaag

SEQ ID NO: 2636711 - DNA, 17 bp, Homo sapiens
catgtaacagaaagggc

SEQ ID NO: 2636712 - DNA, 21 bp, Homo sapiens
catgtaatggtatcttaaagt

SEQ ID NO: 2636713 - DNA, 18 bp, Homo sapiens
catgtaattaagtactat

SEQ ID NO: 2636714 - DNA, 20 bp, Homo sapiens
catgtacatgaagaagctaa

SEQ ID NO: 2636715 - DNA, 19 bp, Homo sapiens
catgtactgagccttgtaa

SEQ ID NO: 2636716 - DNA, 13 bp, Homo sapiens
catgtagaagctg

SEQ ID NO: 2636717 - DNA, 16 bp, Homo sapiens
catgtagtatcaaata

SEQ ID NO: 2636718 - DNA, 18 bp, Homo sapiens
catgtagtatcaaatatt

SEQ ID NO: 2636719 - DNA, 20 bp, Homo sapiens
catgtagtatcaaatattag

SEQ ID NO: 2636720 - DNA, 18 bp, Homo sapiens
catgtataatatttttaa

SEQ ID NO: 2636721 - DNA, 15 bp, Homo sapiens
catgtatcatctgga

SEQ ID NO: 2636722 - DNA, 22 bp, Homo sapiens
catgtatgttttggtatctgtt

SEQ ID NO: 2636723 - DNA, 16 bp, Homo sapiens
catgtattggcctgga

SEQ ID NO: 2636724 - DNA, 14 bp, Homo sapiens
catgtcaaacgtga

SEQ ID NO: 2636725 - DNA, 19 bp, Homo sapiens
catgtcaaacgtgaaaatg

SEQ ID NO: 2636726 - DNA, 23 bp, Homo sapiens
catgtcaccgtggaccttcctgc

SEQ ID NO: 2636727 - DNA, 18 bp, Homo sapiens
catgtcagcatcagctca

SEQ ID NO: 2636728 - DNA, 15 bp, Homo sapiens
catgtccaagaagcc

SEQ ID NO: 2636729 - DNA, 16 bp, Homo sapiens
catgtccaagaagccc

SEQ ID NO: 2636730 - DNA, 17 bp, Homo sapiens
catgtcgcgctcagcat

SEQ ID NO: 2636731 - DNA, 19 bp, Homo sapiens
catgtcgcgctcagcatgc

SEQ ID NO: 2636732 - DNA, 13 bp, Homo sapiens
catgtcttgtaca

SEQ ID NO: 2636733 - DNA, 17 bp, Homo sapiens
catgtcttgtacatgtg

SEQ ID NO: 2636734 - DNA, 13 bp, Homo sapiens
catgtgaagaggg

SEQ ID NO: 2636735 - DNA, 13 bp, Homo sapiens
catgtgacacata

SEQ ID NO: 2636736 - DNA, 16 bp, Homo sapiens
catgtgacacatatgc

SEQ ID NO: 2636737 - DNA, 17 bp, Homo sapiens
catgtgactctgaagct

SEQ ID NO: 2636738 - DNA, 16 bp, Homo sapiens
catgtgccgaatgtgc

SEQ ID NO: 2636739 - DNA, 20 bp, Homo sapiens
catgtggaaagtgaatttga

SEQ ID NO: 2636740 - DNA, 21 bp, Homo sapiens
catgtggaaagtgaatttgaa

SEQ ID NO: 2636741 - DNA, 23 bp, Homo sapiens
catgtggaaagtgaatttgaatg

SEQ ID NO: 2636742 - DNA, 19 bp, Homo sapiens
catgtggagaaaggagtga

SEQ ID NO: 2636743 - DNA, 14 bp, Homo sapiens
catgtggcctgtgg

SEQ ID NO: 2636744 - DNA, 22 bp, Homo sapiens
catgtggtggcacaggccccct

SEQ ID NO: 2636745 - DNA, 23 bp, Homo sapiens
catgtggtggcacaggccccctt

SEQ ID NO: 2636746 - DNA, 15 bp, Homo sapiens
catgtggtttataga

SEQ ID NO: 2636747 - DNA, 21 bp, Homo sapiens
catgtgtcctggttcccgttt

SEQ ID NO: 2636748 - DNA, 21 bp, Homo sapiens
catgtgtgagtgtgtgcaagt

SEQ ID NO: 2636749 - DNA, 17 bp, Homo sapiens
catgtgtgctcttcttc

SEQ ID NO: 2636750 - DNA, 22 bp, Homo sapiens
catgtgtgtccacgactgtctc

SEQ ID NO: 2636751 - DNA, 15 bp, Homo sapiens
catgtgtgtgcaagt

SEQ ID NO: 2636752 - DNA, 20 bp, Homo sapiens
catgtgttttaattccaata

SEQ ID NO: 2636753 - DNA, 18 bp, Homo sapiens
catgttaggaaaatttca

SEQ ID NO: 2636754 - DNA, 20 bp, Homo sapiens
catgttatatattttttgta

SEQ ID NO: 2636755 - DNA, 15 bp, Homo sapiens
catgttccactaacc

SEQ ID NO: 2636756 - DNA, 13 bp, Homo sapiens
catgttcctcaaa

SEQ ID NO: 2636757 - DNA, 15 bp, Homo sapiens
catgttctctgagga

SEQ ID NO: 2636758 - DNA, 16 bp, Homo sapiens
catgttcttaattctt

SEQ ID NO: 2636759 - DNA, 19 bp, Homo sapiens
catgttgagccaggcctgg

SEQ ID NO: 2636760 - DNA, 14 bp, Homo sapiens
catgttggccaggc

SEQ ID NO: 2636761 - DNA, 17 bp, Homo sapiens
catgttggccaggctgg

SEQ ID NO: 2636762 - DNA, 18 bp, Homo sapiens
catgttggccaggctggt

SEQ ID NO: 2636763 - DNA, 19 bp, Homo sapiens
catgtttacttttcagggc

SEQ ID NO: 2636764 - DNA, 21 bp, Homo sapiens
catgtttctctggccccaagg

SEQ ID NO: 2636765 - DNA, 10 bp, Homo sapiens
catgtttctt

SEQ ID NO: 2636766 - DNA, 14 bp, Homo sapiens
catgtttgcttcat

SEQ ID NO: 2636767 - DNA, 14 bp, Homo sapiens
catgtttgtgattg

SEQ ID NO: 2636768 - DNA, 15 bp, Homo sapiens
catgtttgtgattga

SEQ ID NO: 2636769 - DNA, 18 bp, Homo sapiens
catgttttaaagcttgct

SEQ ID NO: 2636770 - DNA, 23 bp, Homo sapiens
catgttttagacaaatactcatg

SEQ ID NO: 2636771 - DNA, 17 bp, Homo sapiens
catgttttccattgttt

SEQ ID NO: 2636772 - DNA, 21 bp, Homo sapiens
catgttttccattgtttgaaa

SEQ ID NO: 2636773 - DNA, 13 bp, Homo sapiens
catgttttgataa

SEQ ID NO: 2636774 - DNA, 14 bp, Homo sapiens
catgttttgataaa

SEQ ID NO: 2636775 - DNA, 18 bp, Homo sapiens
catgttttgataaagtag

SEQ ID NO: 2636776 - DNA, 15 bp, Homo sapiens
catgttttgtgacta

SEQ ID NO: 2636777 - DNA, 17 bp, Homo sapiens
catgttttgtgactata

SEQ ID NO: 2636778 - DNA, 23 bp, Homo sapiens
catgtttttgttttctttgaatg

SEQ ID NO: 2636779 - DNA, 22 bp, Homo sapiens
cattaaaaaaaaaaaaaaaagt

SEQ ID NO: 2636780 - DNA, 19 bp, Homo sapiens
cattaaaactgaagtctga

SEQ ID NO: 2636781 - DNA, 13 bp, Homo sapiens
cattaaaagaaaa

SEQ ID NO: 2636782 - DNA, 16 bp, Homo sapiens
cattaacagttttcca

SEQ ID NO: 2636783 - DNA, 21 bp, Homo sapiens
cattaacagttttccatgaaa

SEQ ID NO: 2636784 - DNA, 16 bp, Homo sapiens
cattaacttctctgga

SEQ ID NO: 2636785 - DNA, 16 bp, Homo sapiens
cattaatatttgctga

SEQ ID NO: 2636786 - DNA, 24 bp, Homo sapiens
cattacagggaatgcctgagtgcc

SEQ ID NO: 2636787 - DNA, 22 bp, Homo sapiens
cattacctcagtgagaagccag

SEQ ID NO: 2636788 - DNA, 13 bp, Homo sapiens
cattacgtgagcc

SEQ ID NO: 2636789 - DNA, 16 bp, Homo sapiens
cattacgtgagccagg

SEQ ID NO: 2636790 - DNA, 23 bp, Homo sapiens
cattactttaccacccccacacc

SEQ ID NO: 2636791 - DNA, 22 bp, Homo sapiens
cattagaagatattagtcttgg

SEQ ID NO: 2636792 - DNA, 14 bp, Homo sapiens
cattagaattattt

SEQ ID NO: 2636793 - DNA, 15 bp, Homo sapiens
cattagactcctcct

SEQ ID NO: 2636794 - DNA, 19 bp, Homo sapiens
cattaggacaatcagtccc

SEQ ID NO: 2636795 - DNA, 15 bp, Homo sapiens
cattaggatggctag

SEQ ID NO: 2636796 - DNA, 17 bp, Homo sapiens
cattatagatcccccag

SEQ ID NO: 2636797 - DNA, 16 bp, Homo sapiens
cattatcatgtgtaat

SEQ ID NO: 2636798 - DNA, 16 bp, Homo sapiens
cattatcgggagcagt

SEQ ID NO: 2636799 - DNA, 18 bp, Homo sapiens
cattatcgggagcagtgt

SEQ ID NO: 2636800 - DNA, 23 bp, Homo sapiens
cattatctagatactgtatcatg

SEQ ID NO: 2636801 - DNA, 12 bp, Homo sapiens
cattatctcaaa

SEQ ID NO: 2636802 - DNA, 22 bp, Homo sapiens
cattatgatgtgggtcaaggaa

SEQ ID NO: 2636803 - DNA, 23 bp, Homo sapiens
cattatgatgtgggtcaaggaat

SEQ ID NO: 2636804 - DNA, 20 bp, Homo sapiens
cattatgtaaaatgttttag

SEQ ID NO: 2636805 - DNA, 20 bp, Homo sapiens
cattatgtccactgtgtata

SEQ ID NO: 2636806 - DNA, 22 bp, Homo sapiens
cattattggaattaacctggtg

SEQ ID NO: 2636807 - DNA, 16 bp, Homo sapiens
cattcaatacaagtgt

SEQ ID NO: 2636808 - DNA, 20 bp, Homo sapiens
cattcaatttattcaagaaa

SEQ ID NO: 2636809 - DNA, 15 bp, Homo sapiens
cattcagcaagacaa

SEQ ID NO: 2636810 - DNA, 14 bp, Homo sapiens
cattcatgcctggc

SEQ ID NO: 2636811 - DNA, 16 bp, Homo sapiens
cattcattccattctg

SEQ ID NO: 2636812 - DNA, 22 bp, Homo sapiens
cattccaccttcccatgccctg

SEQ ID NO: 2636813 - DNA, 12 bp, Homo sapiens
cattccatcctt

SEQ ID NO: 2636814 - DNA, 14 bp, Homo sapiens
cattccattctgga

SEQ ID NO: 2636815 - DNA, 13 bp, Homo sapiens
cattccccaggag

SEQ ID NO: 2636816 - DNA, 17 bp, Homo sapiens
cattccccaggaggcca

SEQ ID NO: 2636817 - DNA, 19 bp, Homo sapiens
cattccccaggaggccagc

SEQ ID NO: 2636818 - DNA, 22 bp, Homo sapiens
cattccgacaaccgatgctcca

SEQ ID NO: 2636819 - DNA, 18 bp, Homo sapiens
cattcctaaactatcttt

SEQ ID NO: 2636820 - DNA, 19 bp, Homo sapiens
cattcctgaaagaaacagt

SEQ ID NO: 2636821 - DNA, 21 bp, Homo sapiens
cattcctgatatgatttaaaa

SEQ ID NO: 2636822 - DNA, 14 bp, Homo sapiens
cattcctgatgctt

SEQ ID NO: 2636823 - DNA, 13 bp, Homo sapiens
cattcctgcctgt

SEQ ID NO: 2636824 - DNA, 21 bp, Homo sapiens
cattcctgggaaatattccct

SEQ ID NO: 2636825 - DNA, 16 bp, Homo sapiens
cattcctgggcacagt

SEQ ID NO: 2636826 - DNA, 16 bp, Homo sapiens
cattccttctttgata

SEQ ID NO: 2636827 - DNA, 18 bp, Homo sapiens
cattccttctttgataat

SEQ ID NO: 2636828 - DNA, 17 bp, Homo sapiens
cattctacacagagcag

SEQ ID NO: 2636829 - DNA, 23 bp, Homo sapiens
cattctaggtaggggcccacttc

SEQ ID NO: 2636830 - DNA, 14 bp, Homo sapiens
cattctattgttaa

SEQ ID NO: 2636831 - DNA, 16 bp, Homo sapiens
cattctcatggagaag

SEQ ID NO: 2636832 - DNA, 11 bp, Homo sapiens
cattctcctgc

SEQ ID NO: 2636833 - DNA, 13 bp, Homo sapiens
cattctcctgcct

SEQ ID NO: 2636834 - DNA, 16 bp, Homo sapiens
cattctccttgtgtta

SEQ ID NO: 2636835 - DNA, 14 bp, Homo sapiens
cattctctgtctca

SEQ ID NO: 2636836 - DNA, 23 bp, Homo sapiens
ccaagggcttctgcaccctccac

SEQ ID NO: 2636837 - DNA, 21 bp, Homo sapiens
ccaagggctttgttttgcaca

SEQ ID NO: 2636838 - DNA, 23 bp, Homo sapiens
ccaagggttcagagactcagggc

SEQ ID NO: 2636839 - DNA, 17 bp, Homo sapiens
ccaaggtcttcagccat

SEQ ID NO: 2636840 - DNA, 16 bp, Homo sapiens
ccaaggtggcacggtg

SEQ ID NO: 2636841 - DNA, 18 bp, Homo sapiens
ccaaggtgggaggattgc

SEQ ID NO: 2636842 - DNA, 23 bp, Homo sapiens
ccaaggtgggctgagccctggca

SEQ ID NO: 2636843 - DNA, 20 bp, Homo sapiens
ccaagtcagctttgccttcc

SEQ ID NO: 2636844 - DNA, 13 bp, Homo sapiens
ccaagtccagatt

SEQ ID NO: 2636845 - DNA, 13 bp, Homo sapiens
ccaagtccctgtt

SEQ ID NO: 2636846 - DNA, 16 bp, Homo sapiens
ccaagtcctgaagagg

SEQ ID NO: 2636847 - DNA, 16 bp, Homo sapiens
ccaagtgcaggctggc

SEQ ID NO: 2636848 - DNA, 19 bp, Homo sapiens
ccaagtgcaggctggcacc

SEQ ID NO: 2636849 - DNA, 16 bp, Homo sapiens
ccaagtgccagaggtg

SEQ ID NO: 2636850 - DNA, 21 bp, Homo sapiens
ccaagtgccagaggtgggcag

SEQ ID NO: 2636851 - DNA, 22 bp, Homo sapiens
ccaagtgccagaggtgggcagg

SEQ ID NO: 2636852 - DNA, 20 bp, Homo sapiens
ccaagtggaccttgagacca

SEQ ID NO: 2636853 - DNA, 18 bp, Homo sapiens
ccaagtggcagagcttgg

SEQ ID NO: 2636854 - DNA, 21 bp, Homo sapiens
ccaagtgtgcatattgtacac

SEQ ID NO: 2636855 - DNA, 13 bp, Homo sapiens
ccaagtgtgtgtg

SEQ ID NO: 2636856 - DNA, 21 bp, Homo sapiens
ccaagtttactcaaccctctc

SEQ ID NO: 2636857 - DNA, 14 bp, Homo sapiens
ccaagtttatatac

SEQ ID NO: 2636858 - DNA, 16 bp, Homo sapiens
ccaataacacacagct

SEQ ID NO: 2636859 - DNA, 22 bp, Homo sapiens
ccaatagggctgagctctctgt

SEQ ID NO: 2636860 - DNA, 22 bp, Homo sapiens
ccaatattggagcatatcaaaa

SEQ ID NO: 2636861 - DNA, 15 bp, Homo sapiens
ccaatattgtacagt

SEQ ID NO: 2636862 - DNA, 16 bp, Homo sapiens
ccaatattgtacagtt

SEQ ID NO: 2636863 - DNA, 18 bp, Homo sapiens
ccaatatttctcagacat

SEQ ID NO: 2636864 - DNA, 14 bp, Homo sapiens
ccaatcattttaat

SEQ ID NO: 2636865 - DNA, 16 bp, Homo sapiens
ccaatcccctccttgg

SEQ ID NO: 2636866 - DNA, 14 bp, Homo sapiens
ccaatcctatgttt

SEQ ID NO: 2636867 - DNA, 19 bp, Homo sapiens
ccaatgaggtctgaaatgg

SEQ ID NO: 2636868 - DNA, 14 bp, Homo sapiens
ccaatgcactttgt

SEQ ID NO: 2636869 - DNA, 21 bp, Homo sapiens
ccaatgcatgcagccactgtg

SEQ ID NO: 2636870 - DNA, 23 bp, Homo sapiens
ccaatggactaacttgtctttgg

SEQ ID NO: 2636871 - DNA, 18 bp, Homo sapiens
ccaatgtctgccacacaa

SEQ ID NO: 2636872 - DNA, 12 bp, Homo sapiens
ccaatgtcttga

SEQ ID NO: 2636873 - DNA, 17 bp, Homo sapiens
ccaattaggaagtgtaa

SEQ ID NO: 2636874 - DNA, 21 bp, Homo sapiens
ccaattcaaccctttgcccca

SEQ ID NO: 2636875 - DNA, 18 bp, Homo sapiens
ccaattcttacaaacatg

SEQ ID NO: 2636876 - DNA, 13 bp, Homo sapiens
ccacaaaaattga

SEQ ID NO: 2636877 - DNA, 23 bp, Homo sapiens
ccacaaaataaccaatcctggac

SEQ ID NO: 2636878 - DNA, 14 bp, Homo sapiens
ccacaaagccttat

SEQ ID NO: 2636879 - DNA, 22 bp, Homo sapiens
ccacaaagccttatcaagtgtc

SEQ ID NO: 2636880 - DNA, 23 bp, Homo sapiens
ccacaaagccttatcaagtgtct

SEQ ID NO: 2636881 - DNA, 22 bp, Homo sapiens
ccacaagaaatgaaagcaggga

SEQ ID NO: 2636882 - DNA, 16 bp, Homo sapiens
ccacaagaaatttgat

SEQ ID NO: 2636883 - DNA, 23 bp, Homo sapiens
ccacaatcctattctcgggctga

SEQ ID NO: 2636884 - DNA, 17 bp, Homo sapiens
ccacacacacacacatg

SEQ ID NO: 2636885 - DNA, 13 bp, Homo sapiens
ccacacacacaga

SEQ ID NO: 2636886 - DNA, 14 bp, Homo sapiens
ccacacacacagaa

SEQ ID NO: 2636887 - DNA, 15 bp, Homo sapiens
ccacacacacagaaa

SEQ ID NO: 2636888 - DNA, 12 bp, Homo sapiens
ccacacacagag

SEQ ID NO: 2636889 - DNA, 16 bp, Homo sapiens
ccacacacagaggaag

SEQ ID NO: 2636890 - DNA, 15 bp, Homo sapiens
ccacacacgcaggaa

SEQ ID NO: 2636891 - DNA, 14 bp, Homo sapiens
ccacacactcgccc

SEQ ID NO: 2636892 - DNA, 15 bp, Homo sapiens
ccacaccaaacctct

SEQ ID NO: 2636893 - DNA, 12 bp, Homo sapiens
ccacacccagcc

SEQ ID NO: 2636894 - DNA, 11 bp, Homo sapiens
ccacaccctcc

SEQ ID NO: 2636895 - DNA, 15 bp, Homo sapiens
ccacaccctctccca

SEQ ID NO: 2636896 - DNA, 23 bp, Homo sapiens
ccacaccctgtactgttctgtgt

SEQ ID NO: 2636897 - DNA, 18 bp, Homo sapiens
ccacaccgtgtaaaccaa

SEQ ID NO: 2636898 - DNA, 18 bp, Homo sapiens
ccacacctcagttccctt

SEQ ID NO: 2636899 - DNA, 13 bp, Homo sapiens
ccacacctccaca

SEQ ID NO: 2636900 - DNA, 14 bp, Homo sapiens
ccacacctccctga

SEQ ID NO: 2636901 - DNA, 17 bp, Homo sapiens
ccacacctccctgaacc

SEQ ID NO: 2636902 - DNA, 15 bp, Homo sapiens
ccacacctctgccag

SEQ ID NO: 2636903 - DNA, 14 bp, Homo sapiens
ccacacctggcact

SEQ ID NO: 2636904 - DNA, 17 bp, Homo sapiens
ccacacctggcactgct

SEQ ID NO: 2636905 - DNA, 17 bp, Homo sapiens
ccacactattaccatga

SEQ ID NO: 2636906 - DNA, 17 bp, Homo sapiens
ccacactcactcctgag

SEQ ID NO: 2636907 - DNA, 20 bp, Homo sapiens
ccacacttcctgtccagaga

SEQ ID NO: 2636908 - DNA, 20 bp, Homo sapiens
ccacacttgttccagctctt

SEQ ID NO: 2636909 - DNA, 17 bp, Homo sapiens
ccacagaagccaggagc

SEQ ID NO: 2636910 - DNA, 13 bp, Homo sapiens
ccacagacacaca

SEQ ID NO: 2636911 - DNA, 14 bp, Homo sapiens
ccacagacacacac

SEQ ID NO: 2636912 - DNA, 15 bp, Homo sapiens
ccacagacacacaca

SEQ ID NO: 2636913 - DNA, 12 bp, Homo sapiens
ccacagcagttg

SEQ ID NO: 2636914 - DNA, 20 bp, Homo sapiens
ccacagcatcattttgcatt

SEQ ID NO: 2636915 - DNA, 20 bp, Homo sapiens
ccacagccatcccagccttg

SEQ ID NO: 2636916 - DNA, 21 bp, Homo sapiens
ccacagccctgtcagtgcagc

SEQ ID NO: 2636917 - DNA, 19 bp, Homo sapiens
ccacagcctcccctgccag

SEQ ID NO: 2636918 - DNA, 23 bp, Homo sapiens
ccacagcgctggccgggaccccg

SEQ ID NO: 2636919 - DNA, 17 bp, Homo sapiens
ccacagcttcccctctc

SEQ ID NO: 2636920 - DNA, 22 bp, Homo sapiens
ccacagctttttaccaagtttc

SEQ ID NO: 2636921 - DNA, 21 bp, Homo sapiens
ccacaggacatttctctaaga

SEQ ID NO: 2636922 - DNA, 20 bp, Homo sapiens
ccacaggagtgggaaaacac

SEQ ID NO: 2636923 - DNA, 12 bp, Homo sapiens
ccacaggcagct

SEQ ID NO: 2636924 - DNA, 13 bp, Homo sapiens
ccacaggcagctt

SEQ ID NO: 2636925 - DNA, 16 bp, Homo sapiens
ccacaggcccacagta

SEQ ID NO: 2636926 - DNA, 16 bp, Homo sapiens
ccacagggaaccctgc

SEQ ID NO: 2636927 - DNA, 17 bp, Homo sapiens
ccacaggtgggaggagt

SEQ ID NO: 2636928 - DNA, 23 bp, Homo sapiens
ccacaggtgtttatacagctcag

SEQ ID NO: 2636929 - DNA, 16 bp, Homo sapiens
ccacagtcaaagaagg

SEQ ID NO: 2636930 - DNA, 15 bp, Homo sapiens
ccacatccacacacg

SEQ ID NO: 2636931 - DNA, 20 bp, Homo sapiens
ccacatccacacacgcagga

SEQ ID NO: 2636932 - DNA, 13 bp, Homo sapiens
ccacatcccaggc

SEQ ID NO: 2636933 - DNA, 15 bp, Homo sapiens
ccacatcccaggctt

SEQ ID NO: 2636934 - DNA, 18 bp, Homo sapiens
ccacatcccaggcttcac

SEQ ID NO: 2636935 - DNA, 13 bp, Homo sapiens
ccacatcctccac

SEQ ID NO: 2636936 - DNA, 20 bp, Homo sapiens
ccacatcctccgtccagccg

SEQ ID NO: 2636937 - DNA, 18 bp, Homo sapiens
ccacatcttgctctgctg

SEQ ID NO: 2636938 - DNA, 13 bp, Homo sapiens
ccacatgagtccc

SEQ ID NO: 2636939 - DNA, 22 bp, Homo sapiens
ccacatgagtcccagtgggagg

SEQ ID NO: 2636940 - DNA, 21 bp, Homo sapiens
ccacatggcttcctcctgcgc

SEQ ID NO: 2636941 - DNA, 16 bp, Homo sapiens
ccacattttatattta

SEQ ID NO: 2636942 - DNA, 18 bp, Homo sapiens
ccaccaacatactcccat

SEQ ID NO: 2636943 - DNA, 21 bp, Homo sapiens
ccaccaacatactcccatctg

SEQ ID NO: 2636944 - DNA, 14 bp, Homo sapiens
ccaccaactcttgc

SEQ ID NO: 2636945 - DNA, 14 bp, Homo sapiens
ccaccacacccagc

SEQ ID NO: 2636946 - DNA, 15 bp, Homo sapiens
ccaccaccagaaagc

SEQ ID NO: 2636947 - DNA, 20 bp, Homo sapiens
ccaccaccccccactctgtg

SEQ ID NO: 2636948 - DNA, 16 bp, Homo sapiens
ccaccacggccactgg

SEQ ID NO: 2636949 - DNA, 20 bp, Homo sapiens
ccaccactggccaccaggct

SEQ ID NO: 2636950 - DNA, 21 bp, Homo sapiens
ccaccactggccaccaggctg

SEQ ID NO: 2636951 - DNA, 23 bp, Homo sapiens
ccaccagactgacaaatgtgtat

SEQ ID NO: 2636952 - DNA, 19 bp, Homo sapiens
ccaccaggagaaccactac

SEQ ID NO: 2636953 - DNA, 20 bp, Homo sapiens
ccaccaggctgctcagggct

SEQ ID NO: 2636954 - DNA, 20 bp, Homo sapiens
ccaccaggctggcgcagcca

SEQ ID NO: 2636955 - DNA, 21 bp, Homo sapiens
ccaccaggctggcgcagccaa

SEQ ID NO: 2636956 - DNA, 15 bp, Homo sapiens
ccaccatcaagccac

SEQ ID NO: 2636957 - DNA, 17 bp, Homo sapiens
ccaccatcaagccacca

SEQ ID NO: 2636958 - DNA, 20 bp, Homo sapiens
ccaccatcaagccaccaaca

SEQ ID NO: 2636959 - DNA, 19 bp, Homo sapiens
ccaccatcatgtctggcta

SEQ ID NO: 2636960 - DNA, 17 bp, Homo sapiens
ccaccatgcccagtcga

SEQ ID NO: 2636961 - DNA, 19 bp, Homo sapiens
ccaccatggggtcctacca

SEQ ID NO: 2636962 - DNA, 16 bp, Homo sapiens
ccacccaagcttggca

SEQ ID NO: 2636963 - DNA, 17 bp, Homo sapiens
ccacccaagggcctggc

SEQ ID NO: 2636964 - DNA, 14 bp, Homo sapiens
ccacccaggaggga

SEQ ID NO: 2636965 - DNA, 17 bp, Homo sapiens
ccacccaggagggaggg

SEQ ID NO: 2636966 - DNA, 18 bp, Homo sapiens
ccacccaggagggagggg

SEQ ID NO: 2636967 - DNA, 21 bp, Homo sapiens
ccacccatcctaccaatgcat

SEQ ID NO: 2636968 - DNA, 13 bp, Homo sapiens
ccaccccacactt

SEQ ID NO: 2636969 - DNA, 14 bp, Homo sapiens
ccaccccagcctaa

SEQ ID NO: 2636970 - DNA, 18 bp, Homo sapiens
ccaccccattttctgtgg

SEQ ID NO: 2636971 - DNA, 15 bp, Homo sapiens
ccacccccacccaag

SEQ ID NO: 2636972 - DNA, 15 bp, Homo sapiens
ccacccccaccccca

SEQ ID NO: 2636973 - DNA, 13 bp, Homo sapiens
ccacccccagctc

SEQ ID NO: 2636974 - DNA, 15 bp, Homo sapiens
ccacccccagctgct

SEQ ID NO: 2636975 - DNA, 21 bp, Homo sapiens
ccaccccccagaacctgtcct

SEQ ID NO: 2636976 - DNA, 14 bp, Homo sapiens
ccaccccctcaagc

SEQ ID NO: 2636977 - DNA, 19 bp, Homo sapiens
ccacccccttctctgctcc

SEQ ID NO: 2636978 - DNA, 16 bp, Homo sapiens
ccacttgggtcttccc

SEQ ID NO: 2636979 - DNA, 19 bp, Homo sapiens
ccacttgtcccactatctg

SEQ ID NO: 2636980 - DNA, 20 bp, Homo sapiens
ccacttgtcccactatctgg

SEQ ID NO: 2636981 - DNA, 20 bp, Homo sapiens
ccactttgcacagctctccg

SEQ ID NO: 2636982 - DNA, 21 bp, Homo sapiens
ccactttggtacatggccagt

SEQ ID NO: 2636983 - DNA, 21 bp, Homo sapiens
ccactttggtcccgtgcagct

SEQ ID NO: 2636984 - DNA, 20 bp, Homo sapiens
ccactttgttctttaggaga

SEQ ID NO: 2636985 - DNA, 15 bp, Homo sapiens
ccacttttgttcttg

SEQ ID NO: 2636986 - DNA, 12 bp, Homo sapiens
ccactttttaac

SEQ ID NO: 2636987 - DNA, 15 bp, Homo sapiens
ccagaaaaccccagc

SEQ ID NO: 2636988 - DNA, 16 bp, Homo sapiens
ccagaaaaccccagca

SEQ ID NO: 2636989 - DNA, 14 bp, Homo sapiens
ccagaaaaggacag

SEQ ID NO: 2636990 - DNA, 14 bp, Homo sapiens
ccagaaaggagact

SEQ ID NO: 2636991 - DNA, 22 bp, Homo sapiens
ccagaaatgtctaaatgctgaa

SEQ ID NO: 2636992 - DNA, 19 bp, Homo sapiens
ccagaacacactccatcag

SEQ ID NO: 2636993 - DNA, 12 bp, Homo sapiens
ccagaactggac

SEQ ID NO: 2636994 - DNA, 17 bp, Homo sapiens
ccagaagaatattcagg

SEQ ID NO: 2636995 - DNA, 19 bp, Homo sapiens
ccagaagaatattcaggac

SEQ ID NO: 2636996 - DNA, 20 bp, Homo sapiens
ccagaagaatattcaggact

SEQ ID NO: 2636997 - DNA, 22 bp, Homo sapiens
ccagaagatcccctcaggactg

SEQ ID NO: 2636998 - DNA, 15 bp, Homo sapiens
ccagaagcctctggc

SEQ ID NO: 2636999 - DNA, 15 bp, Homo sapiens
ccagaagcttccata

SEQ ID NO: 2637000 - DNA, 15 bp, Homo sapiens
ccagaagggggccat

SEQ ID NO: 2637001 - DNA, 21 bp, Homo sapiens
ccagaataagttattgcagtt

SEQ ID NO: 2637002 - DNA, 22 bp, Homo sapiens
ccagaataagttattgcagttt

SEQ ID NO: 2637003 - DNA, 23 bp, Homo sapiens
ccagaataagttattgcagttta

SEQ ID NO: 2637004 - DNA, 12 bp, Homo sapiens
ccagaatcaaag

SEQ ID NO: 2637005 - DNA, 22 bp, Homo sapiens
ccagacacatgtccaagaagcc

SEQ ID NO: 2637006 - DNA, 23 bp, Homo sapiens
ccagacactgaccatccactcta

SEQ ID NO: 2637007 - DNA, 17 bp, Homo sapiens
ccagacagacaacactg

SEQ ID NO: 2637008 - DNA, 19 bp, Homo sapiens
ccagacagacatctctgca

SEQ ID NO: 2637009 - DNA, 15 bp, Homo sapiens
ccagacccccacccc

SEQ ID NO: 2637010 - DNA, 16 bp, Homo sapiens
ccagacccccacccct

SEQ ID NO: 2637011 - DNA, 21 bp, Homo sapiens
ccagacccccaccccttcccc

SEQ ID NO: 2637012 - DNA, 17 bp, Homo sapiens
ccagacccctctggcca

SEQ ID NO: 2637013 - DNA, 19 bp, Homo sapiens
ccagacccctctggccagg

SEQ ID NO: 2637014 - DNA, 14 bp, Homo sapiens
ccagacccggctgc

SEQ ID NO: 2637015 - DNA, 16 bp, Homo sapiens
ccagacccggctgcgt

SEQ ID NO: 2637016 - DNA, 18 bp, Homo sapiens
ccagacctttgaggatat

SEQ ID NO: 2637017 - DNA, 20 bp, Homo sapiens
ccagacgatgtcttcatacc

SEQ ID NO: 2637018 - DNA, 17 bp, Homo sapiens
ccagacggttcaccagc

SEQ ID NO: 2637019 - DNA, 19 bp, Homo sapiens
ccagacggttcaccagcct

SEQ ID NO: 2637020 - DNA, 20 bp, Homo sapiens
ccagacggttcaccagcctc

SEQ ID NO: 2637021 - DNA, 14 bp, Homo sapiens
ccagactctctgtg

SEQ ID NO: 2637022 - DNA, 16 bp, Homo sapiens
ccagactgtggagaaa

SEQ ID NO: 2637023 - DNA, 18 bp, Homo sapiens
ccagactgtggagaaata

SEQ ID NO: 2637024 - DNA, 13 bp, Homo sapiens
ccagactgtgtat

SEQ ID NO: 2637025 - DNA, 20 bp, Homo sapiens
ccagactttacatgacacag

SEQ ID NO: 2637026 - DNA, 20 bp, Homo sapiens
ccagagaagccccttcccca

SEQ ID NO: 2637027 - DNA, 18 bp, Homo sapiens
ccagagaagtgacaggga

SEQ ID NO: 2637028 - DNA, 19 bp, Homo sapiens
ccagagagagaagtgcccc

SEQ ID NO: 2637029 - DNA, 21 bp, Homo sapiens
ccagagagcaactctgagatc

SEQ ID NO: 2637030 - DNA, 18 bp, Homo sapiens
catgaagagatttttcat

SEQ ID NO: 2637031 - DNA, 22 bp, Homo sapiens
catgaagcccaagtgaaatcaa

SEQ ID NO: 2637032 - DNA, 22 bp, Homo sapiens
catgaaggatgccaagaagttt

SEQ ID NO: 2637033 - DNA, 15 bp, Homo sapiens
catgaagtaatatgc

SEQ ID NO: 2637034 - DNA, 23 bp, Homo sapiens
catgaagtaatatgcacacattt

SEQ ID NO: 2637035 - DNA, 21 bp, Homo sapiens
catgaatcccacccacatgtg

SEQ ID NO: 2637036 - DNA, 16 bp, Homo sapiens
catgaatgcacactag

SEQ ID NO: 2637037 - DNA, 13 bp, Homo sapiens
catgaatgtatca

SEQ ID NO: 2637038 - DNA, 21 bp, Homo sapiens
catgaatttttttcatcttct

SEQ ID NO: 2637039 - DNA, 15 bp, Homo sapiens
catgacaagccccag

SEQ ID NO: 2637040 - DNA, 16 bp, Homo sapiens
catgacatgttatata

SEQ ID NO: 2637041 - DNA, 14 bp, Homo sapiens
catgacccacccct

SEQ ID NO: 2637042 - DNA, 17 bp, Homo sapiens
catgacccacccctgtg

SEQ ID NO: 2637043 - DNA, 19 bp, Homo sapiens
catgacccacccctgtgct

SEQ ID NO: 2637044 - DNA, 16 bp, Homo sapiens
catgacccaggctggg

SEQ ID NO: 2637045 - DNA, 18 bp, Homo sapiens
catgacctagttttccat

SEQ ID NO: 2637046 - DNA, 22 bp, Homo sapiens
catgagaagttgatatagaaca

SEQ ID NO: 2637047 - DNA, 12 bp, Homo sapiens
catgagaatcta

SEQ ID NO: 2637048 - DNA, 17 bp, Homo sapiens
catgagaggctctgtgc

SEQ ID NO: 2637049 - DNA, 15 bp, Homo sapiens
catgagcatcaggcc

SEQ ID NO: 2637050 - DNA, 21 bp, Homo sapiens
catgagcatcaggccaggccc

SEQ ID NO: 2637051 - DNA, 15 bp, Homo sapiens
catgagcctcagcat

SEQ ID NO: 2637052 - DNA, 23 bp, Homo sapiens
catgagctatttccattccagaa

SEQ ID NO: 2637053 - DNA, 17 bp, Homo sapiens
catgagctccagacccc

SEQ ID NO: 2637054 - DNA, 19 bp, Homo sapiens
catgagctccagaccccca

SEQ ID NO: 2637055 - DNA, 21 bp, Homo sapiens
catgagctccagacccccagc

SEQ ID NO: 2637056 - DNA, 22 bp, Homo sapiens
catgaggacatgatggagcgca

SEQ ID NO: 2637057 - DNA, 24 bp, Homo sapiens
catgaggcaatgtcaggaacagaa

SEQ ID NO: 2637058 - DNA, 22 bp, Homo sapiens
catgaggccactgctgcttctc

SEQ ID NO: 2637059 - DNA, 20 bp, Homo sapiens
catgagggatcacagggccc

SEQ ID NO: 2637060 - DNA, 19 bp, Homo sapiens
catgaggtactgagagtga

SEQ ID NO: 2637061 - DNA, 15 bp, Homo sapiens
catgagtcccagtgg

SEQ ID NO: 2637062 - DNA, 19 bp, Homo sapiens
catgagtcccagtgggagg

SEQ ID NO: 2637063 - DNA, 15 bp, Homo sapiens
catgagtcccctgtt

SEQ ID NO: 2637064 - DNA, 19 bp, Homo sapiens
catgagtccttgaaaatat

SEQ ID NO: 2637065 - DNA, 20 bp, Homo sapiens
catgagtccttgaaaatatt

SEQ ID NO: 2637066 - DNA, 22 bp, Homo sapiens
catgagttttttctcttgggct

SEQ ID NO: 2637067 - DNA, 19 bp, Homo sapiens
catgatggagcgcacctgc

SEQ ID NO: 2637068 - DNA, 19 bp, Homo sapiens
catgatggagtcaggtttg

SEQ ID NO: 2637069 - DNA, 23 bp, Homo sapiens
catgatggttattttcttttctt

SEQ ID NO: 2637070 - DNA, 12 bp, Homo sapiens
catgatgtggag

SEQ ID NO: 2637071 - DNA, 23 bp, Homo sapiens
catgattaaccacttcagctgac

SEQ ID NO: 2637072 - DNA, 21 bp, Homo sapiens
catgattcatgccaattagca

SEQ ID NO: 2637073 - DNA, 14 bp, Homo sapiens
catgcaaatgctgt

SEQ ID NO: 2637074 - DNA, 22 bp, Homo sapiens
catgcaaatgctgtattcttct

SEQ ID NO: 2637075 - DNA, 14 bp, Homo sapiens
catgcaaggggaaa

SEQ ID NO: 2637076 - DNA, 16 bp, Homo sapiens
catgcacgtgtgtgca

SEQ ID NO: 2637077 - DNA, 23 bp, Homo sapiens
catgcactgttccccctgtgcag

SEQ ID NO: 2637078 - DNA, 14 bp, Homo sapiens
catgcagcatctaa

SEQ ID NO: 2637079 - DNA, 19 bp, Homo sapiens
catgcagcccatgcccacc

SEQ ID NO: 2637080 - DNA, 20 bp, Homo sapiens
catgcagcccatgcccacct

SEQ ID NO: 2637081 - DNA, 23 bp, Homo sapiens
catgcagcccatgcccacctgcc

SEQ ID NO: 2637082 - DNA, 15 bp, Homo sapiens
catgcagctgcaccc

SEQ ID NO: 2637083 - DNA, 19 bp, Homo sapiens
catgcataaatatgcagtg

SEQ ID NO: 2637084 - DNA, 22 bp, Homo sapiens
catgcataaatatgcagtgata

SEQ ID NO: 2637085 - DNA, 13 bp, Homo sapiens
catgcatacacac

SEQ ID NO: 2637086 - DNA, 16 bp, Homo sapiens
catgcatacacacaca

SEQ ID NO: 2637087 - DNA, 23 bp, Homo sapiens
catgcatacacacacacacacag

SEQ ID NO: 2637088 - DNA, 16 bp, Homo sapiens
catgcatctccacctg

SEQ ID NO: 2637089 - DNA, 16 bp, Homo sapiens
catgcatcttactgaa

SEQ ID NO: 2637090 - DNA, 18 bp, Homo sapiens
catgcatgtcctgtaaag

SEQ ID NO: 2637091 - DNA, 18 bp, Homo sapiens
catgcatgttatgcttta

SEQ ID NO: 2637092 - DNA, 11 bp, Homo sapiens
catgcattgtt

SEQ ID NO: 2637093 - DNA, 17 bp, Homo sapiens
catgcatttgaggtcaa

SEQ ID NO: 2637094 - DNA, 21 bp, Homo sapiens
catgccagctacttcctcctc

SEQ ID NO: 2637095 - DNA, 17 bp, Homo sapiens
catgccagtgacacttc

SEQ ID NO: 2637096 - DNA, 14 bp, Homo sapiens
catgcccacctgcc

SEQ ID NO: 2637097 - DNA, 19 bp, Homo sapiens
catgcccccctcaaacctc

SEQ ID NO: 2637098 - DNA, 15 bp, Homo sapiens
catgccccctttcag

SEQ ID NO: 2637099 - DNA, 14 bp, Homo sapiens
catgccgggcgcag

SEQ ID NO: 2637100 - DNA, 16 bp, Homo sapiens
catgcctgagggtgga

SEQ ID NO: 2637101 - DNA, 20 bp, Homo sapiens
catgcctgccccaaacaaat

SEQ ID NO: 2637102 - DNA, 17 bp, Homo sapiens
catgcctgtccagcctg

SEQ ID NO: 2637103 - DNA, 20 bp, Homo sapiens
catgcctgtccagcctgggc

SEQ ID NO: 2637104 - DNA, 15 bp, Homo sapiens
catgccttccagcac

SEQ ID NO: 2637105 - DNA, 23 bp, Homo sapiens
catgcggagaacaaatgtgaagg

SEQ ID NO: 2637106 - DNA, 14 bp, Homo sapiens
catgcggcccagcc

SEQ ID NO: 2637107 - DNA, 15 bp, Homo sapiens
catgcggcccagccc

SEQ ID NO: 2637108 - DNA, 16 bp, Homo sapiens
catgcggcccagcccg

SEQ ID NO: 2637109 - DNA, 18 bp, Homo sapiens
catgcggcccagcccggc

SEQ ID NO: 2637110 - DNA, 19 bp, Homo sapiens
catgcggcccagcccggct

SEQ ID NO: 2637111 - DNA, 16 bp, Homo sapiens
catgcgtgtttctgac

SEQ ID NO: 2637112 - DNA, 14 bp, Homo sapiens
catgctacacactg

SEQ ID NO: 2637113 - DNA, 23 bp, Homo sapiens
catgctacacactgcatgtttgt

SEQ ID NO: 2637114 - DNA, 23 bp, Homo sapiens
catgctatctctgtgtgcacaaa

SEQ ID NO: 2637115 - DNA, 20 bp, Homo sapiens
catgctcagccctgactggt

SEQ ID NO: 2637116 - DNA, 20 bp, Homo sapiens
catgctcctggcccactgca

SEQ ID NO: 2637117 - DNA, 16 bp, Homo sapiens
catgctgaagccaaag

SEQ ID NO: 2637118 - DNA, 19 bp, Homo sapiens
catgctgaagggaccttga

SEQ ID NO: 2637119 - DNA, 21 bp, Homo sapiens
catgctgactttcatttcttg

SEQ ID NO: 2637120 - DNA, 13 bp, Homo sapiens
catgctgccctgt

SEQ ID NO: 2637121 - DNA, 16 bp, Homo sapiens
catgctgccctgtgag

SEQ ID NO: 2637122 - DNA, 16 bp, Homo sapiens
catgctgggttctgca

SEQ ID NO: 2637123 - DNA, 16 bp, Homo sapiens
catgctgttgattgct

SEQ ID NO: 2637124 - DNA, 18 bp, Homo sapiens
catgctgttgattgctaa

SEQ ID NO: 2637125 - DNA, 19 bp, Homo sapiens
catgctgttgattgctaaa

SEQ ID NO: 2637126 - DNA, 20 bp, Homo sapiens
catgctgttgattgctaaat

SEQ ID NO: 2637127 - DNA, 22 bp, Homo sapiens
catgctgttgattgctaaatgt

SEQ ID NO: 2637128 - DNA, 23 bp, Homo sapiens
catgctgttgattgctaaatgta

SEQ ID NO: 2637129 - DNA, 16 bp, Homo sapiens
catgcttcttccttac

SEQ ID NO: 2637130 - DNA, 18 bp, Homo sapiens
catggaatgcttgaaaaa

SEQ ID NO: 2637131 - DNA, 12 bp, Homo sapiens
catggacccgga

SEQ ID NO: 2637132 - DNA, 12 bp, Homo sapiens
catggacttgta

SEQ ID NO: 2637133 - DNA, 13 bp, Homo sapiens
catggacttgtat

SEQ ID NO: 2637134 - DNA, 16 bp, Homo sapiens
catggacttgtatatt

SEQ ID NO: 2637135 - DNA, 12 bp, Homo sapiens
catggagaagtt

SEQ ID NO: 2637136 - DNA, 17 bp, Homo sapiens
catggagaagttatcag

SEQ ID NO: 2637137 - DNA, 21 bp, Homo sapiens
catggagactcctgccctgtt

SEQ ID NO: 2637138 - DNA, 16 bp, Homo sapiens
catggagagctggagc

SEQ ID NO: 2637139 - DNA, 17 bp, Homo sapiens
catggagagctggagcc

SEQ ID NO: 2637140 - DNA, 20 bp, Homo sapiens
catggagagctggagcctgg

SEQ ID NO: 2637141 - DNA, 14 bp, Homo sapiens
catggagccccagc

SEQ ID NO: 2637142 - DNA, 18 bp, Homo sapiens
catggagccccagccccc

SEQ ID NO: 2637143 - DNA, 14 bp, Homo sapiens
catggagctggccg

SEQ ID NO: 2637144 - DNA, 22 bp, Homo sapiens
catggaggagcttgggggatga

SEQ ID NO: 2637145 - DNA, 14 bp, Homo sapiens
catggagtgtgtat

SEQ ID NO: 2637146 - DNA, 18 bp, Homo sapiens
catggagtgtgtattgtt

SEQ ID NO: 2637147 - DNA, 20 bp, Homo sapiens
catggagtgtgtattgttcc

SEQ ID NO: 2637148 - DNA, 18 bp, Homo sapiens
catggatatagttttact

SEQ ID NO: 2637149 - DNA, 19 bp, Homo sapiens
catggcacttgcatctgtg

SEQ ID NO: 2637150 - DNA, 22 bp, Homo sapiens
catggccacttgggtcttccct

SEQ ID NO: 2637151 - DNA, 16 bp, Homo sapiens
catggcccctgtgagt

SEQ ID NO: 2637152 - DNA, 22 bp, Homo sapiens
catggccctcccagtacctcct

SEQ ID NO: 2637153 - DNA, 23 bp, Homo sapiens
catggccctcccagtacctcctg

SEQ ID NO: 2637154 - DNA, 17 bp, Homo sapiens
catggcctatgcacata

SEQ ID NO: 2637155 - DNA, 14 bp, Homo sapiens
catggctaactggc

SEQ ID NO: 2637156 - DNA, 22 bp, Homo sapiens
catggctataaacaattacatg

SEQ ID NO: 2637157 - DNA, 17 bp, Homo sapiens
catggctccagaaatgt

SEQ ID NO: 2637158 - DNA, 13 bp, Homo sapiens
catggctccagtc

SEQ ID NO: 2637159 - DNA, 22 bp, Homo sapiens
catggctccagtctgctgccct

SEQ ID NO: 2637160 - DNA, 21 bp, Homo sapiens
catggctgggaactgcagacc

SEQ ID NO: 2637161 - DNA, 14 bp, Homo sapiens
catggcttcctcct

SEQ ID NO: 2637162 - DNA, 15 bp, Homo sapiens
catggcttcctcctg

SEQ ID NO: 2637163 - DNA, 15 bp, Homo sapiens
catggcttgccacag

SEQ ID NO: 2637164 - DNA, 19 bp, Homo sapiens
catggcttgccacagctct

SEQ ID NO: 2637165 - DNA, 18 bp, Homo sapiens
catgggaaagccacctct

SEQ ID NO: 2637166 - DNA, 13 bp, Homo sapiens
catgggagccggg

SEQ ID NO: 2637167 - DNA, 21 bp, Homo sapiens
catgggagctggttagaaatg

SEQ ID NO: 2637168 - DNA, 13 bp, Homo sapiens
catgggcctggcc

SEQ ID NO: 2637169 - DNA, 13 bp, Homo sapiens
catgggctctgac

SEQ ID NO: 2637170 - DNA, 12 bp, Homo sapiens
catgggcttcac

SEQ ID NO: 2637171 - DNA, 15 bp, Homo sapiens
catgggcttcactgt

SEQ ID NO: 2637172 - DNA, 20 bp, Homo sapiens
catgggcttcactgtataaa

SEQ ID NO: 2637173 - DNA, 16 bp, Homo sapiens
catggggaagggatat

SEQ ID NO: 2637174 - DNA, 19 bp, Homo sapiens
cagtgccctcattttatgt

SEQ ID NO: 2637175 - DNA, 14 bp, Homo sapiens
cagtgcctgggaat

SEQ ID NO: 2637176 - DNA, 18 bp, Homo sapiens
cagtgcctgggaatgtat

SEQ ID NO: 2637177 - DNA, 20 bp, Homo sapiens
cagtgcctgggaatgtatta

SEQ ID NO: 2637178 - DNA, 23 bp, Homo sapiens
cagtgccttccataattatgaca

SEQ ID NO: 2637179 - DNA, 22 bp, Homo sapiens
cagtgccttcctgtttttcaca

SEQ ID NO: 2637180 - DNA, 14 bp, Homo sapiens
cagtgccttgggga

SEQ ID NO: 2637181 - DNA, 22 bp, Homo sapiens
cagtgccttggggaatttcctc

SEQ ID NO: 2637182 - DNA, 24 bp, Homo sapiens
cagtgcgcgtgcacgtggagagct

SEQ ID NO: 2637183 - DNA, 16 bp, Homo sapiens
cagtgctaaaaatggg

SEQ ID NO: 2637184 - DNA, 14 bp, Homo sapiens
cagtgctccctcac

SEQ ID NO: 2637185 - DNA, 19 bp, Homo sapiens
cagtgctgtctgatctgtg

SEQ ID NO: 2637186 - DNA, 12 bp, Homo sapiens
cagtgctgtggc

SEQ ID NO: 2637187 - DNA, 18 bp, Homo sapiens
cagtgctgtggcctgggc

SEQ ID NO: 2637188 - DNA, 19 bp, Homo sapiens
cagtgctgtggcctgggca

SEQ ID NO: 2637189 - DNA, 20 bp, Homo sapiens
cagtgctgtggcctgggcaa

SEQ ID NO: 2637190 - DNA, 17 bp, Homo sapiens
cagtgcttctctacaga

SEQ ID NO: 2637191 - DNA, 18 bp, Homo sapiens
cagtgcttgccacagagc

SEQ ID NO: 2637192 - DNA, 13 bp, Homo sapiens
cagtggacaccag

SEQ ID NO: 2637193 - DNA, 22 bp, Homo sapiens
cagtggacaccaggagtccctg

SEQ ID NO: 2637194 - DNA, 17 bp, Homo sapiens
cagtggactttccaccc

SEQ ID NO: 2637195 - DNA, 13 bp, Homo sapiens
cagtggagaatta

SEQ ID NO: 2637196 - DNA, 14 bp, Homo sapiens
cagtggcagctgct

SEQ ID NO: 2637197 - DNA, 14 bp, Homo sapiens
cagtggcagggctc

SEQ ID NO: 2637198 - DNA, 15 bp, Homo sapiens
cagtggcagggctca

SEQ ID NO: 2637199 - DNA, 19 bp, Homo sapiens
cagtggcatggctccagtc

SEQ ID NO: 2637200 - DNA, 13 bp, Homo sapiens
cagtggccactca

SEQ ID NO: 2637201 - DNA, 19 bp, Homo sapiens
cagtggcctcaaccctccc

SEQ ID NO: 2637202 - DNA, 21 bp, Homo sapiens
cagtggcctcaaccctccctc

SEQ ID NO: 2637203 - DNA, 23 bp, Homo sapiens
cagtggcctcaaccctccctcag

SEQ ID NO: 2637204 - DNA, 18 bp, Homo sapiens
cagtggctgctgcccagg

SEQ ID NO: 2637205 - DNA, 18 bp, Homo sapiens
cagtggctggatctgtga

SEQ ID NO: 2637206 - DNA, 12 bp, Homo sapiens
cagtgggaaata

SEQ ID NO: 2637207 - DNA, 14 bp, Homo sapiens
cagtgggaaatatt

SEQ ID NO: 2637208 - DNA, 11 bp, Homo sapiens
cagtgggaact

SEQ ID NO: 2637209 - DNA, 11 bp, Homo sapiens
cagtgggagct

SEQ ID NO: 2637210 - DNA, 15 bp, Homo sapiens
cagtgggagctgcct

SEQ ID NO: 2637211 - DNA, 19 bp, Homo sapiens
cagtgggaggggcaggctg

SEQ ID NO: 2637212 - DNA, 17 bp, Homo sapiens
cagtggtaagctctggc

SEQ ID NO: 2637213 - DNA, 20 bp, Homo sapiens
cagtggtaagctctggcttt

SEQ ID NO: 2637214 - DNA, 18 bp, Homo sapiens
cagtggtcaaaccgcact

SEQ ID NO: 2637215 - DNA, 19 bp, Homo sapiens
cagtggtgcgatctgggtt

SEQ ID NO: 2637216 - DNA, 21 bp, Homo sapiens
cagtggtgcgatctgggttca

SEQ ID NO: 2637217 - DNA, 12 bp, Homo sapiens
cagtggtggcag

SEQ ID NO: 2637218 - DNA, 14 bp, Homo sapiens
cagtggtggcaggg

SEQ ID NO: 2637219 - DNA, 20 bp, Homo sapiens
cagtggtggttttctgttct

SEQ ID NO: 2637220 - DNA, 21 bp, Homo sapiens
cagtggtggttttctgttctt

SEQ ID NO: 2637221 - DNA, 12 bp, Homo sapiens
cagtgtaatttc

SEQ ID NO: 2637222 - DNA, 16 bp, Homo sapiens
cagtgtccaaagcagg

SEQ ID NO: 2637223 - DNA, 15 bp, Homo sapiens
cagtgtcccctccac

SEQ ID NO: 2637224 - DNA, 19 bp, Homo sapiens
cagtgtcccctccactgtc

SEQ ID NO: 2637225 - DNA, 20 bp, Homo sapiens
cagtgtcccctccactgtca

SEQ ID NO: 2637226 - DNA, 12 bp, Homo sapiens
cagtgtctcaca

SEQ ID NO: 2637227 - DNA, 17 bp, Homo sapiens
cagtgtcttccataatg

SEQ ID NO: 2637228 - DNA, 18 bp, Homo sapiens
cagtgtcttccataatgt

SEQ ID NO: 2637229 - DNA, 20 bp, Homo sapiens
cagtgtcttccataatgtat

SEQ ID NO: 2637230 - DNA, 17 bp, Homo sapiens
cagtgtgaagttagaat

SEQ ID NO: 2637231 - DNA, 16 bp, Homo sapiens
cagtgtgaggccaggg

SEQ ID NO: 2637232 - DNA, 19 bp, Homo sapiens
cagtgtgaggccagggcag

SEQ ID NO: 2637233 - DNA, 17 bp, Homo sapiens
cagtgtgtttgtgattg

SEQ ID NO: 2637234 - DNA, 17 bp, Homo sapiens
cagtgttaaatgaaatt

SEQ ID NO: 2637235 - DNA, 18 bp, Homo sapiens
cagtgttaaatgaaattg

SEQ ID NO: 2637236 - DNA, 19 bp, Homo sapiens
cagtgttgtggatttaaca

SEQ ID NO: 2637237 - DNA, 22 bp, Homo sapiens
cagtgttgtggatttaacagaa

SEQ ID NO: 2637238 - DNA, 14 bp, Homo sapiens
cagtgtttcccata

SEQ ID NO: 2637239 - DNA, 15 bp, Homo sapiens
cagtgtttttgtaaa

SEQ ID NO: 2637240 - DNA, 19 bp, Homo sapiens
cagtgtttttgtaaagtgt

SEQ ID NO: 2637241 - DNA, 21 bp, Homo sapiens
cagtgtttttgtaaagtgtgg

SEQ ID NO: 2637242 - DNA, 16 bp, Homo sapiens
cagttaaaaaaaattt

SEQ ID NO: 2637243 - DNA, 16 bp, Homo sapiens
cagttaactttcagaa

SEQ ID NO: 2637244 - DNA, 17 bp, Homo sapiens
cagttacagaaagtggt

SEQ ID NO: 2637245 - DNA, 14 bp, Homo sapiens
cagttactcagaat

SEQ ID NO: 2637246 - DNA, 15 bp, Homo sapiens
cagttactctgaagg

SEQ ID NO: 2637247 - DNA, 16 bp, Homo sapiens
cagttactctgaaggg

SEQ ID NO: 2637248 - DNA, 21 bp, Homo sapiens
cagttataagtagcaggccaa

SEQ ID NO: 2637249 - DNA, 22 bp, Homo sapiens
cagttatgatttttttttcata

SEQ ID NO: 2637250 - DNA, 18 bp, Homo sapiens
cagttatgtgaatgatct

SEQ ID NO: 2637251 - DNA, 20 bp, Homo sapiens
cagttatgtgaatgatctct

SEQ ID NO: 2637252 - DNA, 16 bp, Homo sapiens
cagttcacctgcactt

SEQ ID NO: 2637253 - DNA, 13 bp, Homo sapiens
cagttcagcacca

SEQ ID NO: 2637254 - DNA, 18 bp, Homo sapiens
cagttcagtggcagggct

SEQ ID NO: 2637255 - DNA, 20 bp, Homo sapiens
cagttcagtggcagggctca

SEQ ID NO: 2637256 - DNA, 23 bp, Homo sapiens
cagttcatatgtaccatgtacat

SEQ ID NO: 2637257 - DNA, 16 bp, Homo sapiens
cagttcatgtttgctt

SEQ ID NO: 2637258 - DNA, 15 bp, Homo sapiens
cagttcattgcactt

SEQ ID NO: 2637259 - DNA, 14 bp, Homo sapiens
cagttcccagaatc

SEQ ID NO: 2637260 - DNA, 15 bp, Homo sapiens
cagttcccagaatca

SEQ ID NO: 2637261 - DNA, 13 bp, Homo sapiens
cagttcccttggc

SEQ ID NO: 2637262 - DNA, 19 bp, Homo sapiens
cagttcccttggcctcaga

SEQ ID NO: 2637263 - DNA, 17 bp, Homo sapiens
cagttccgatttcccag

SEQ ID NO: 2637264 - DNA, 19 bp, Homo sapiens
cagttctagtttgcattcc

SEQ ID NO: 2637265 - DNA, 13 bp, Homo sapiens
cagttctgctcct

SEQ ID NO: 2637266 - DNA, 14 bp, Homo sapiens
cagttctgctcctc

SEQ ID NO: 2637267 - DNA, 16 bp, Homo sapiens
cagttctgctcctctc

SEQ ID NO: 2637268 - DNA, 17 bp, Homo sapiens
cagttctgctcctctcc

SEQ ID NO: 2637269 - DNA, 18 bp, Homo sapiens
cagttctgctcctctcca

SEQ ID NO: 2637270 - DNA, 19 bp, Homo sapiens
cagttctgctcctctccag

SEQ ID NO: 2637271 - DNA, 21 bp, Homo sapiens
cagttctgctcctctccaggc

SEQ ID NO: 2637272 - DNA, 20 bp, Homo sapiens
cagttcttcgggaagagagg

SEQ ID NO: 2637273 - DNA, 20 bp, Homo sapiens
cagttgagtcgtcatcactt

SEQ ID NO: 2637274 - DNA, 17 bp, Homo sapiens
cagttggccagagagcc

SEQ ID NO: 2637275 - DNA, 16 bp, Homo sapiens
cagttgggagcactgg

SEQ ID NO: 2637276 - DNA, 20 bp, Homo sapiens
cagttgggagcactggagtg

SEQ ID NO: 2637277 - DNA, 19 bp, Homo sapiens
cagttgggtggatgcctgg

SEQ ID NO: 2637278 - DNA, 18 bp, Homo sapiens
cagttgtagaatgtattg

SEQ ID NO: 2637279 - DNA, 15 bp, Homo sapiens
cagttgttggcctcc

SEQ ID NO: 2637280 - DNA, 20 bp, Homo sapiens
cagttgttggcctccggcct

SEQ ID NO: 2637281 - DNA, 18 bp, Homo sapiens
cagtttatcattcaagtg

SEQ ID NO: 2637282 - DNA, 19 bp, Homo sapiens
cagtttatcattcaagtgt

SEQ ID NO: 2637283 - DNA, 17 bp, Homo sapiens
cagtttcctcatctgtc

SEQ ID NO: 2637284 - DNA, 13 bp, Homo sapiens
cagtttgaacaaa

SEQ ID NO: 2637285 - DNA, 15 bp, Homo sapiens
cagtttgagacagga

SEQ ID NO: 2637286 - DNA, 18 bp, Homo sapiens
cagtttgagacaggagac

SEQ ID NO: 2637287 - DNA, 21 bp, Homo sapiens
cagtttgtacagacgtatgct

SEQ ID NO: 2637288 - DNA, 15 bp, Homo sapiens
cagtttgtgtgtctt

SEQ ID NO: 2637289 - DNA, 21 bp, Homo sapiens
cagtttgttagtatgaggcat

SEQ ID NO: 2637290 - DNA, 12 bp, Homo sapiens
cagttttcataa

SEQ ID NO: 2637291 - DNA, 16 bp, Homo sapiens
cagttttccatgaaaa

SEQ ID NO: 2637292 - DNA, 17 bp, Homo sapiens
cagttttccatgaaaac

SEQ ID NO: 2637293 - DNA, 14 bp, Homo sapiens
catcatgtctggct

SEQ ID NO: 2637294 - DNA, 19 bp, Homo sapiens
catcatgtttacagaggac

SEQ ID NO: 2637295 - DNA, 13 bp, Homo sapiens
catcattagaaca

SEQ ID NO: 2637296 - DNA, 14 bp, Homo sapiens
catcattagaacaa

SEQ ID NO: 2637297 - DNA, 18 bp, Homo sapiens
catcattcatgctactgc

SEQ ID NO: 2637298 - DNA, 17 bp, Homo sapiens
catcattccttgagaaa

SEQ ID NO: 2637299 - DNA, 21 bp, Homo sapiens
catcattctctgtctcatcca

SEQ ID NO: 2637300 - DNA, 22 bp, Homo sapiens
catcattctctgtctcatccat

SEQ ID NO: 2637301 - DNA, 14 bp, Homo sapiens
catcattgcactct

SEQ ID NO: 2637302 - DNA, 13 bp, Homo sapiens
catcattgtatat

SEQ ID NO: 2637303 - DNA, 16 bp, Homo sapiens
catcattttgcattca

SEQ ID NO: 2637304 - DNA, 20 bp, Homo sapiens
catcattttgcattcaaatt

SEQ ID NO: 2637305 - DNA, 15 bp, Homo sapiens
catccaaccccccac

SEQ ID NO: 2637306 - DNA, 16 bp, Homo sapiens
catccaaccccccacc

SEQ ID NO: 2637307 - DNA, 19 bp, Homo sapiens
catccaaccccccacctgc

SEQ ID NO: 2637308 - DNA, 21 bp, Homo sapiens
catccaaggagaaacagagac

SEQ ID NO: 2637309 - DNA, 23 bp, Homo sapiens
catccaaggagaaacagagacag

SEQ ID NO: 2637310 - DNA, 17 bp, Homo sapiens
catccaatcctcactgg

SEQ ID NO: 2637311 - DNA, 20 bp, Homo sapiens
catccaatctaaccacatca

SEQ ID NO: 2637312 - DNA, 23 bp, Homo sapiens
catccaatgctcaagaaacaact

SEQ ID NO: 2637313 - DNA, 18 bp, Homo sapiens
catccacacacgcaggaa

SEQ ID NO: 2637314 - DNA, 17 bp, Homo sapiens
catccacattgttttaa

SEQ ID NO: 2637315 - DNA, 17 bp, Homo sapiens
catccactctaccctcc

SEQ ID NO: 2637316 - DNA, 18 bp, Homo sapiens
catccactctaccctccc

SEQ ID NO: 2637317 - DNA, 19 bp, Homo sapiens
catccactctaccctccca

SEQ ID NO: 2637318 - DNA, 22 bp, Homo sapiens
catccactctaccctcccaccc

SEQ ID NO: 2637319 - DNA, 13 bp, Homo sapiens
catccagttcatg

SEQ ID NO: 2637320 - DNA, 14 bp, Homo sapiens
catccataaagaag

SEQ ID NO: 2637321 - DNA, 14 bp, Homo sapiens
catccatcatcatg

SEQ ID NO: 2637322 - DNA, 19 bp, Homo sapiens
catccatggggctgattgt

SEQ ID NO: 2637323 - DNA, 19 bp, Homo sapiens
catccatttcatctatttc

SEQ ID NO: 2637324 - DNA, 14 bp, Homo sapiens
catcccacaccctg

SEQ ID NO: 2637325 - DNA, 14 bp, Homo sapiens
catcccagccccaa

SEQ ID NO: 2637326 - DNA, 16 bp, Homo sapiens
catcccagccccaatg

SEQ ID NO: 2637327 - DNA, 14 bp, Homo sapiens
catcccagccttgg

SEQ ID NO: 2637328 - DNA, 14 bp, Homo sapiens
catcccaggggacc

SEQ ID NO: 2637329 - DNA, 19 bp, Homo sapiens
catcccaggggaccacacc

SEQ ID NO: 2637330 - DNA, 17 bp, Homo sapiens
catcccatgtaacagaa

SEQ ID NO: 2637331 - DNA, 19 bp, Homo sapiens
catcccatgtaacagaaag

SEQ ID NO: 2637332 - DNA, 16 bp, Homo sapiens
catccccacccttgga

SEQ ID NO: 2637333 - DNA, 16 bp, Homo sapiens
catccccatcctccag

SEQ ID NO: 2637334 - DNA, 19 bp, Homo sapiens
catcccctggactgggagg

SEQ ID NO: 2637335 - DNA, 23 bp, Homo sapiens
catcccgacatggacccggagct

SEQ ID NO: 2637336 - DNA, 17 bp, Homo sapiens
catcccgagcacctcca

SEQ ID NO: 2637337 - DNA, 16 bp, Homo sapiens
catcccgtgttctcct

SEQ ID NO: 2637338 - DNA, 21 bp, Homo sapiens
catcccgtgttctccttttcc

SEQ ID NO: 2637339 - DNA, 12 bp, Homo sapiens
catccctacccc

SEQ ID NO: 2637340 - DNA, 14 bp, Homo sapiens
catccctaccccct

SEQ ID NO: 2637341 - DNA, 22 bp, Homo sapiens
catccctaccccctaagagcca

SEQ ID NO: 2637342 - DNA, 14 bp, Homo sapiens
catccctccccagt

SEQ ID NO: 2637343 - DNA, 22 bp, Homo sapiens
catccctgaaggccccgcccag

SEQ ID NO: 2637344 - DNA, 15 bp, Homo sapiens
catccctgccagctc

SEQ ID NO: 2637345 - DNA, 14 bp, Homo sapiens
catccctggaaggt

SEQ ID NO: 2637346 - DNA, 14 bp, Homo sapiens
catccgccagggcc

SEQ ID NO: 2637347 - DNA, 15 bp, Homo sapiens
catcctatgcaatat

SEQ ID NO: 2637348 - DNA, 17 bp, Homo sapiens
catcctcaaacactgca

SEQ ID NO: 2637349 - DNA, 18 bp, Homo sapiens
catcctcaaacactgcag

SEQ ID NO: 2637350 - DNA, 17 bp, Homo sapiens
catcctcatacccaccc

SEQ ID NO: 2637351 - DNA, 18 bp, Homo sapiens
catcctcatacccacccc

SEQ ID NO: 2637352 - DNA, 22 bp, Homo sapiens
catcctcatacccacccccacc

SEQ ID NO: 2637353 - DNA, 21 bp, Homo sapiens
catcctccacgttctgctcat

SEQ ID NO: 2637354 - DNA, 15 bp, Homo sapiens
catcctccagcttct

SEQ ID NO: 2637355 - DNA, 13 bp, Homo sapiens
catcctccccttc

SEQ ID NO: 2637356 - DNA, 15 bp, Homo sapiens
catcctccccttccc

SEQ ID NO: 2637357 - DNA, 21 bp, Homo sapiens
catcctccccttccctgcaaa

SEQ ID NO: 2637358 - DNA, 16 bp, Homo sapiens
catcctccgtccagcc

SEQ ID NO: 2637359 - DNA, 20 bp, Homo sapiens
catcctccgtccagccgcca

SEQ ID NO: 2637360 - DNA, 22 bp, Homo sapiens
catcctctgtacagagcccacg

SEQ ID NO: 2637361 - DNA, 19 bp, Homo sapiens
catcctgactctgccccct

SEQ ID NO: 2637362 - DNA, 12 bp, Homo sapiens
catcctgcaggc

SEQ ID NO: 2637363 - DNA, 15 bp, Homo sapiens
catcctggcacccgg

SEQ ID NO: 2637364 - DNA, 22 bp, Homo sapiens
catcctgtgtttctagggaaat

SEQ ID NO: 2637365 - DNA, 18 bp, Homo sapiens
catctaaatacctgccct

SEQ ID NO: 2637366 - DNA, 19 bp, Homo sapiens
catctaacctcatcttctt

SEQ ID NO: 2637367 - DNA, 23 bp, Homo sapiens
catctaatagcgggttactttca

SEQ ID NO: 2637368 - DNA, 14 bp, Homo sapiens
catctataaattgt

SEQ ID NO: 2637369 - DNA, 14 bp, Homo sapiens
catctatttctgag

SEQ ID NO: 2637370 - DNA, 16 bp, Homo sapiens
catctcacacatgagc

SEQ ID NO: 2637371 - DNA, 20 bp, Homo sapiens
catctcacacatgagcatca

SEQ ID NO: 2637372 - DNA, 19 bp, Homo sapiens
catctcactggatgcaaag

SEQ ID NO: 2637373 - DNA, 22 bp, Homo sapiens
catctcattcaaaccccaccct

SEQ ID NO: 2637374 - DNA, 18 bp, Homo sapiens
catctccaagaatgctga

SEQ ID NO: 2637375 - DNA, 16 bp, Homo sapiens
catctccacccccagc

SEQ ID NO: 2637376 - DNA, 16 bp, Homo sapiens
catctccacctgctcc

SEQ ID NO: 2637377 - DNA, 20 bp, Homo sapiens
catctccagggagtcccctc

SEQ ID NO: 2637378 - DNA, 14 bp, Homo sapiens
catctccatcagct

SEQ ID NO: 2637379 - DNA, 15 bp, Homo sapiens
catctccatcagctg

SEQ ID NO: 2637380 - DNA, 16 bp, Homo sapiens
catctccatcagctgt

SEQ ID NO: 2637381 - DNA, 17 bp, Homo sapiens
catctcccagataatgt

SEQ ID NO: 2637382 - DNA, 22 bp, Homo sapiens
catctcccagataatgtgaaaa

SEQ ID NO: 2637383 - DNA, 16 bp, Homo sapiens
catctcctgccttcct

SEQ ID NO: 2637384 - DNA, 20 bp, Homo sapiens
catctcctgtgcatgggtga

SEQ ID NO: 2637385 - DNA, 22 bp, Homo sapiens
catctcgccacccctccttcct

SEQ ID NO: 2637386 - DNA, 12 bp, Homo sapiens
catctctccctc

SEQ ID NO: 2637387 - DNA, 23 bp, Homo sapiens
catctctccctcccctgccattt

SEQ ID NO: 2637388 - DNA, 22 bp, Homo sapiens
catctctctactcctacctcag

SEQ ID NO: 2637389 - DNA, 11 bp, Homo sapiens
catctctgcac

SEQ ID NO: 2637390 - DNA, 23 bp, Homo sapiens
catctcttacgcccaacccttcc

SEQ ID NO: 2637391 - DNA, 13 bp, Homo sapiens
catctctttgaat

SEQ ID NO: 2637392 - DNA, 15 bp, Homo sapiens
catctgaagagcaga

SEQ ID NO: 2637393 - DNA, 18 bp, Homo sapiens
catctgagcaagagctgg

SEQ ID NO: 2637394 - DNA, 19 bp, Homo sapiens
catctgcattttcacccca

SEQ ID NO: 2637395 - DNA, 16 bp, Homo sapiens
catctgcccaggggtg

SEQ ID NO: 2637396 - DNA, 13 bp, Homo sapiens
catctgcccctcc

SEQ ID NO: 2637397 - DNA, 19 bp, Homo sapiens
catctgcccctcccccaac

SEQ ID NO: 2637398 - DNA, 18 bp, Homo sapiens
catctgcgtgacaataaa

SEQ ID NO: 2637399 - DNA, 19 bp, Homo sapiens
catctgcgtgacaataaaa

SEQ ID NO: 2637400 - DNA, 22 bp, Homo sapiens
catctgcgtgacaataaaacat

SEQ ID NO: 2637401 - DNA, 12 bp, Homo sapiens
catctgctaata

SEQ ID NO: 2637402 - DNA, 21 bp, Homo sapiens
catctggataggagcctgctg

SEQ ID NO: 2637403 - DNA, 12 bp, Homo sapiens
catctgggaaag

SEQ ID NO: 2637404 - DNA, 16 bp, Homo sapiens
catctgggattcccac

SEQ ID NO: 2637405 - DNA, 20 bp, Homo sapiens
catctgggtagctgtaaggc

SEQ ID NO: 2637406 - DNA, 19 bp, Homo sapiens
catctgtgaaaggaaagag

SEQ ID NO: 2637407 - DNA, 13 bp, Homo sapiens
catctgtgaataa

SEQ ID NO: 2637408 - DNA, 14 bp, Homo sapiens
catctgtgaataag

SEQ ID NO: 2637409 - DNA, 15 bp, Homo sapiens
catctgtgattccct

SEQ ID NO: 2637410 - DNA, 11 bp, Homo sapiens
catctgtgtct

SEQ ID NO: 2637411 - DNA, 17 bp, Homo sapiens
catctgtgtttcaagtg

SEQ ID NO: 2637412 - DNA, 11 bp, Homo sapiens
catctgttttt

SEQ ID NO: 2637413 - DNA, 14 bp, Homo sapiens
catcttactgaagg

SEQ ID NO: 2637414 - DNA, 22 bp, Homo sapiens
catcttaggttggcaaaaaggc

SEQ ID NO: 2637415 - DNA, 19 bp, Homo sapiens
catcttagtatttgcatat

SEQ ID NO: 2637416 - DNA, 14 bp, Homo sapiens
catcttagtgcctg

SEQ ID NO: 2637417 - DNA, 20 bp, Homo sapiens
catcttattttcatgtatat

SEQ ID NO: 2637418 - DNA, 14 bp, Homo sapiens
catcttcaaagctt

SEQ ID NO: 2637419 - DNA, 14 bp, Homo sapiens
catcttcacttcta

SEQ ID NO: 2637420 - DNA, 13 bp, Homo sapiens
catcttcagcttc

SEQ ID NO: 2637421 - DNA, 12 bp, Homo sapiens
catcttccagaa

SEQ ID NO: 2637422 - DNA, 18 bp, Homo sapiens
catcttctcagctcccat

SEQ ID NO: 2637423 - DNA, 19 bp, Homo sapiens
catcttctggagtctccag

SEQ ID NO: 2637424 - DNA, 22 bp, Homo sapiens
catcttctttttgaaatcagca

SEQ ID NO: 2637425 - DNA, 16 bp, Homo sapiens
catcttgaccaagcag

SEQ ID NO: 2637426 - DNA, 18 bp, Homo sapiens
catcttgaccaagcagga

SEQ ID NO: 2637427 - DNA, 14 bp, Homo sapiens
catcttgctctgct

SEQ ID NO: 2637428 - DNA, 15 bp, Homo sapiens
catcttgctctgctg

SEQ ID NO: 2637429 - DNA, 19 bp, Homo sapiens
catcttgctctgctgacag

SEQ ID NO: 2637430 - DNA, 20 bp, Homo sapiens
catcttgctctgctgacaga

SEQ ID NO: 2637431 - DNA, 15 bp, Homo sapiens
catcttggggacatc

SEQ ID NO: 2637432 - DNA, 15 bp, Homo sapiens
catcttgtgttttat

SEQ ID NO: 2637433 - DNA, 14 bp, Homo sapiens
catctttcacactt

SEQ ID NO: 2637434 - DNA, 21 bp, Homo sapiens
catctttcttctattttattc

SEQ ID NO: 2637435 - DNA, 17 bp, Homo sapiens
catctttgccttgggct

SEQ ID NO: 2637436 - DNA, 14 bp, Homo sapiens
catcttttgtgaga

SEQ ID NO: 2637437 - DNA, 16 bp, Homo sapiens
catcttttgtgagatg

SEQ ID NO: 2637438 - DNA, 12 bp, Homo sapiens
catgaaaaagca

SEQ ID NO: 2637439 - DNA, 17 bp, Homo sapiens
catgaaaacacattttt

SEQ ID NO: 2637440 - DNA, 13 bp, Homo sapiens
catgaaaacgttt

SEQ ID NO: 2637441 - DNA, 21 bp, Homo sapiens
catgaaaacgttttattgtgt

SEQ ID NO: 2637442 - DNA, 22 bp, Homo sapiens
catgaaaatgcaacaacatgta

SEQ ID NO: 2637443 - DNA, 13 bp, Homo sapiens
catgaaacagaaa

SEQ ID NO: 2637444 - DNA, 22 bp, Homo sapiens
catgaaatatagatcagttata

SEQ ID NO: 2637445 - DNA, 18 bp, Homo sapiens
cagttttccatgaaaacg

SEQ ID NO: 2637446 - DNA, 13 bp, Homo sapiens
cagttttccattg

SEQ ID NO: 2637447 - DNA, 17 bp, Homo sapiens
cagttttggttgcttta

SEQ ID NO: 2637448 - DNA, 16 bp, Homo sapiens
cagttttttatgctaa

SEQ ID NO: 2637449 - DNA, 20 bp, Homo sapiens
cataaacaagaccacgtttc

SEQ ID NO: 2637450 - DNA, 21 bp, Homo sapiens
cataaagaagcaataaagaag

SEQ ID NO: 2637451 - DNA, 21 bp, Homo sapiens
cataaagccttggatgtatat

SEQ ID NO: 2637452 - DNA, 15 bp, Homo sapiens
cataaatatgcagtg

SEQ ID NO: 2637453 - DNA, 15 bp, Homo sapiens
cataacaacttcata

SEQ ID NO: 2637454 - DNA, 16 bp, Homo sapiens
cataacctagccttag

SEQ ID NO: 2637455 - DNA, 20 bp, Homo sapiens
cataacgtttttcctttaaa

SEQ ID NO: 2637456 - DNA, 20 bp, Homo sapiens
cataagaccataacagccaa

SEQ ID NO: 2637457 - DNA, 23 bp, Homo sapiens
cataagaccataacagccaacag

SEQ ID NO: 2637458 - DNA, 16 bp, Homo sapiens
cataagaccctaagcc

SEQ ID NO: 2637459 - DNA, 19 bp, Homo sapiens
cataagcggcgtaagttta

SEQ ID NO: 2637460 - DNA, 22 bp, Homo sapiens
cataaggaatgtagctggtttc

SEQ ID NO: 2637461 - DNA, 22 bp, Homo sapiens
cataaggtttcgtttctgtata

SEQ ID NO: 2637462 - DNA, 19 bp, Homo sapiens
cataagtattatgtctctt

SEQ ID NO: 2637463 - DNA, 18 bp, Homo sapiens
cataataaatatctgtac

SEQ ID NO: 2637464 - DNA, 20 bp, Homo sapiens
cataatctggactcctctgt

SEQ ID NO: 2637465 - DNA, 22 bp, Homo sapiens
cataatctggactcctctgtcc

SEQ ID NO: 2637466 - DNA, 21 bp, Homo sapiens
cataatcttctgccttctcat

SEQ ID NO: 2637467 - DNA, 23 bp, Homo sapiens
cataatgcgtgcataccactttt

SEQ ID NO: 2637468 - DNA, 19 bp, Homo sapiens
cataattatgacagttata

SEQ ID NO: 2637469 - DNA, 23 bp, Homo sapiens
cataatttgtacatatgtaaaat

SEQ ID NO: 2637470 - DNA, 20 bp, Homo sapiens
cataattttcttcatgcaat

SEQ ID NO: 2637471 - DNA, 12 bp, Homo sapiens
catacagctcta

SEQ ID NO: 2637472 - DNA, 16 bp, Homo sapiens
catacagtttgcactt

SEQ ID NO: 2637473 - DNA, 15 bp, Homo sapiens
cataccacttttgtt

SEQ ID NO: 2637474 - DNA, 18 bp, Homo sapiens
cataccacttttgttctt

SEQ ID NO: 2637475 - DNA, 11 bp, Homo sapiens
catacccaccc

SEQ ID NO: 2637476 - DNA, 14 bp, Homo sapiens
catacccaccccca

SEQ ID NO: 2637477 - DNA, 15 bp, Homo sapiens
catacctacatgtat

SEQ ID NO: 2637478 - DNA, 13 bp, Homo sapiens
catacgtacacat

SEQ ID NO: 2637479 - DNA, 14 bp, Homo sapiens
catactaaccagca

SEQ ID NO: 2637480 - DNA, 21 bp, Homo sapiens
catactaaccagcagaaatgc

SEQ ID NO: 2637481 - DNA, 19 bp, Homo sapiens
catactcaatgttactatc

SEQ ID NO: 2637482 - DNA, 23 bp, Homo sapiens
catactccatcagttagagctga

SEQ ID NO: 2637483 - DNA, 20 bp, Homo sapiens
catactcccatctgtgaaag

SEQ ID NO: 2637484 - DNA, 15 bp, Homo sapiens
catactgagggacca

SEQ ID NO: 2637485 - DNA, 11 bp, Homo sapiens
catactgctgt

SEQ ID NO: 2637486 - DNA, 14 bp, Homo sapiens
catacttcaaaagt

SEQ ID NO: 2637487 - DNA, 19 bp, Homo sapiens
catacttcaaaagtatttt

SEQ ID NO: 2637488 - DNA, 16 bp, Homo sapiens
catactttgtctgaaa

SEQ ID NO: 2637489 - DNA, 16 bp, Homo sapiens
catactttttaaatgt

SEQ ID NO: 2637490 - DNA, 19 bp, Homo sapiens
catagagagcaagacgctg

SEQ ID NO: 2637491 - DNA, 14 bp, Homo sapiens
catagagtttaaca

SEQ ID NO: 2637492 - DNA, 15 bp, Homo sapiens
catagatgcaggtga

SEQ ID NO: 2637493 - DNA, 17 bp, Homo sapiens
catagattccctgagca

SEQ ID NO: 2637494 - DNA, 20 bp, Homo sapiens
catagcaagacacatcccta

SEQ ID NO: 2637495 - DNA, 22 bp, Homo sapiens
catagcagagaatgaaagggcc

SEQ ID NO: 2637496 - DNA, 23 bp, Homo sapiens
catagcagagaatgaaagggccc

SEQ ID NO: 2637497 - DNA, 17 bp, Homo sapiens
catagcagattttaatt

SEQ ID NO: 2637498 - DNA, 18 bp, Homo sapiens
catagcagattttaattt

SEQ ID NO: 2637499 - DNA, 11 bp, Homo sapiens
catagcattaa

SEQ ID NO: 2637500 - DNA, 15 bp, Homo sapiens
catagcattaactaa

SEQ ID NO: 2637501 - DNA, 23 bp, Homo sapiens
catagcattaactaatctattgg

SEQ ID NO: 2637502 - DNA, 16 bp, Homo sapiens
catagcccagacacag

SEQ ID NO: 2637503 - DNA, 18 bp, Homo sapiens
catagcctaatccctggg

SEQ ID NO: 2637504 - DNA, 15 bp, Homo sapiens
catagcctatattta

SEQ ID NO: 2637505 - DNA, 22 bp, Homo sapiens
catagctaagaaataaaactgt

SEQ ID NO: 2637506 - DNA, 14 bp, Homo sapiens
catagctcctgctc

SEQ ID NO: 2637507 - DNA, 12 bp, Homo sapiens
cataggaaaagt

SEQ ID NO: 2637508 - DNA, 18 bp, Homo sapiens
cataggaaaagtacattt

SEQ ID NO: 2637509 - DNA, 19 bp, Homo sapiens
cataggaaaagtacattta

SEQ ID NO: 2637510 - DNA, 22 bp, Homo sapiens
cataggaaaagtacatttaata

SEQ ID NO: 2637511 - DNA, 23 bp, Homo sapiens
cataggaaaagtacatttaatac

SEQ ID NO: 2637512 - DNA, 24 bp, Homo sapiens
cataggaagggaccaaggcaaggc

SEQ ID NO: 2637513 - DNA, 13 bp, Homo sapiens
cataggcccagtg

SEQ ID NO: 2637514 - DNA, 19 bp, Homo sapiens
cataggtcactggctctcc

SEQ ID NO: 2637515 - DNA, 16 bp, Homo sapiens
catagtaccaatcatt

SEQ ID NO: 2637516 - DNA, 22 bp, Homo sapiens
catagtaccaatcattttaatt

SEQ ID NO: 2637517 - DNA, 15 bp, Homo sapiens
catagtatggtggct

SEQ ID NO: 2637518 - DNA, 16 bp, Homo sapiens
catagtatggtggctg

SEQ ID NO: 2637519 - DNA, 17 bp, Homo sapiens
catagtatggtggctgg

SEQ ID NO: 2637520 - DNA, 18 bp, Homo sapiens
catagtattccattgtgt

SEQ ID NO: 2637521 - DNA, 13 bp, Homo sapiens
catagtcacatgg

SEQ ID NO: 2637522 - DNA, 15 bp, Homo sapiens
catagtggtgcagag

SEQ ID NO: 2637523 - DNA, 19 bp, Homo sapiens
catagttcccatgttaaat

SEQ ID NO: 2637524 - DNA, 17 bp, Homo sapiens
catagtttttactgaac

SEQ ID NO: 2637525 - DNA, 20 bp, Homo sapiens
catataaacatcacacacac

SEQ ID NO: 2637526 - DNA, 19 bp, Homo sapiens
catataaactttttaaaga

SEQ ID NO: 2637527 - DNA, 20 bp, Homo sapiens
catataagtttgaaggaaac

SEQ ID NO: 2637528 - DNA, 17 bp, Homo sapiens
catataatgttgttatt

SEQ ID NO: 2637529 - DNA, 21 bp, Homo sapiens
catatatggggggccaacacc

SEQ ID NO: 2637530 - DNA, 22 bp, Homo sapiens
catatatggggggccaacacca

SEQ ID NO: 2637531 - DNA, 16 bp, Homo sapiens
catatgacctcatgca

SEQ ID NO: 2637532 - DNA, 18 bp, Homo sapiens
catatgacctcatgcatc

SEQ ID NO: 2637533 - DNA, 20 bp, Homo sapiens
catatgactcacatgatgca

SEQ ID NO: 2637534 - DNA, 18 bp, Homo sapiens
catatgcaccttgtgtct

SEQ ID NO: 2637535 - DNA, 19 bp, Homo sapiens
catatgcaccttgtgtctg

SEQ ID NO: 2637536 - DNA, 17 bp, Homo sapiens
catatggactctgcaca

SEQ ID NO: 2637537 - DNA, 13 bp, Homo sapiens
catatgtaaaata

SEQ ID NO: 2637538 - DNA, 20 bp, Homo sapiens
catattaccacagacatact

SEQ ID NO: 2637539 - DNA, 14 bp, Homo sapiens
catattcaggaagc

SEQ ID NO: 2637540 - DNA, 16 bp, Homo sapiens
catattgaatgtttcc

SEQ ID NO: 2637541 - DNA, 11 bp, Homo sapiens
catattgtaca

SEQ ID NO: 2637542 - DNA, 13 bp, Homo sapiens
catattgtacact

SEQ ID NO: 2637543 - DNA, 20 bp, Homo sapiens
catattgtgattctgccttt

SEQ ID NO: 2637544 - DNA, 13 bp, Homo sapiens
catattgtgccaa

SEQ ID NO: 2637545 - DNA, 21 bp, Homo sapiens
catattgtgccaatatgtatt

SEQ ID NO: 2637546 - DNA, 14 bp, Homo sapiens
catatttacttctt

SEQ ID NO: 2637547 - DNA, 17 bp, Homo sapiens
catatttacttcttata

SEQ ID NO: 2637548 - DNA, 12 bp, Homo sapiens
catatttcaatt

SEQ ID NO: 2637549 - DNA, 15 bp, Homo sapiens
catatttgagactag

SEQ ID NO: 2637550 - DNA, 15 bp, Homo sapiens
catatttgcatatgt

SEQ ID NO: 2637551 - DNA, 17 bp, Homo sapiens
catatttgcatatgtat

SEQ ID NO: 2637552 - DNA, 19 bp, Homo sapiens
catatttgcatatgtatga

SEQ ID NO: 2637553 - DNA, 14 bp, Homo sapiens
catatttgtggaat

SEQ ID NO: 2637554 - DNA, 13 bp, Homo sapiens
catattttagcta

SEQ ID NO: 2637555 - DNA, 17 bp, Homo sapiens
catattttatagaactt

SEQ ID NO: 2637556 - DNA, 18 bp, Homo sapiens
catattttcaccatttga

SEQ ID NO: 2637557 - DNA, 14 bp, Homo sapiens
catcaaaagacaat

SEQ ID NO: 2637558 - DNA, 20 bp, Homo sapiens
catcaaaagacaattcttta

SEQ ID NO: 2637559 - DNA, 10 bp, Homo sapiens
catcaactga

SEQ ID NO: 2637560 - DNA, 12 bp, Homo sapiens
catcaactgaat

SEQ ID NO: 2637561 - DNA, 22 bp, Homo sapiens
catcaagaatggggatcacaga

SEQ ID NO: 2637562 - DNA, 16 bp, Homo sapiens
catcaaggcactgcct

SEQ ID NO: 2637563 - DNA, 23 bp, Homo sapiens
catcaagttattgacaaactctc

SEQ ID NO: 2637564 - DNA, 15 bp, Homo sapiens
catcaatgttcattg

SEQ ID NO: 2637565 - DNA, 16 bp, Homo sapiens
catcaatgttcattgt

SEQ ID NO: 2637566 - DNA, 16 bp, Homo sapiens
catcaattatagaaag

SEQ ID NO: 2637567 - DNA, 22 bp, Homo sapiens
catcaattgaatggtcagcgtt

SEQ ID NO: 2637568 - DNA, 22 bp, Homo sapiens
catcacagggttgggcccagat

SEQ ID NO: 2637569 - DNA, 13 bp, Homo sapiens
catcacatttttg

SEQ ID NO: 2637570 - DNA, 12 bp, Homo sapiens
catcacccgcta

SEQ ID NO: 2637571 - DNA, 13 bp, Homo sapiens
catcacctcaggc

SEQ ID NO: 2637572 - DNA, 13 bp, Homo sapiens
catcacctccacc

SEQ ID NO: 2637573 - DNA, 14 bp, Homo sapiens
catcacctccacca

SEQ ID NO: 2637574 - DNA, 18 bp, Homo sapiens
catcaccttaggcaggga

SEQ ID NO: 2637575 - DNA, 23 bp, Homo sapiens
catcaccttaggcagggaagtgt

SEQ ID NO: 2637576 - DNA, 15 bp, Homo sapiens
catcacgcctgtgca

SEQ ID NO: 2637577 - DNA, 19 bp, Homo sapiens
catcacttgtacaaaataa

SEQ ID NO: 2637578 - DNA, 14 bp, Homo sapiens
catcagacagatgg

SEQ ID NO: 2637579 - DNA, 19 bp, Homo sapiens
catcagcacgatttctgtt

SEQ ID NO: 2637580 - DNA, 17 bp, Homo sapiens
catcagcatacctttat

SEQ ID NO: 2637581 - DNA, 17 bp, Homo sapiens
catcagctgctgaaaca

SEQ ID NO: 2637582 - DNA, 19 bp, Homo sapiens
catcagctgtaagaagaga

SEQ ID NO: 2637583 - DNA, 17 bp, Homo sapiens
catcaggatgaacccag

SEQ ID NO: 2637584 - DNA, 13 bp, Homo sapiens
catcaggccaggc

SEQ ID NO: 2637585 - DNA, 18 bp, Homo sapiens
catcagggacaggatgac

SEQ ID NO: 2637586 - DNA, 16 bp, Homo sapiens
catcagtattgaagca

SEQ ID NO: 2637587 - DNA, 24 bp, Homo sapiens
catcagtgctccctcacatgtcag

SEQ ID NO: 2637588 - DNA, 22 bp, Homo sapiens
catcagttactctgaagggcat

SEQ ID NO: 2637589 - DNA, 13 bp, Homo sapiens
catcataaaataa

SEQ ID NO: 2637590 - DNA, 18 bp, Homo sapiens
catcataaaataaagtat

SEQ ID NO: 2637591 - DNA, 22 bp, Homo sapiens
catcataaaataaagtatatat

SEQ ID NO: 2637592 - DNA, 23 bp, Homo sapiens
catcataggaagggaccaaggca

SEQ ID NO: 2637593 - DNA, 14 bp, Homo sapiens
catcatattataca

SEQ ID NO: 2637594 - DNA, 21 bp, Homo sapiens
catcatgtccccaaacctgca

SEQ ID NO: 2637595 - DNA, 13 bp, Homo sapiens
catcatgtctggc

SEQ ID NO: 2637596 - DNA, 19 bp, Homo sapiens
caggtgtgccgacagaagg

SEQ ID NO: 2637597 - DNA, 21 bp, Homo sapiens
caggtgtgtccacctgggcat

SEQ ID NO: 2637598 - DNA, 12 bp, Homo sapiens
caggtgttcttc

SEQ ID NO: 2637599 - DNA, 16 bp, Homo sapiens
caggtgtttagttgca

SEQ ID NO: 2637600 - DNA, 13 bp, Homo sapiens
caggttacaacag

SEQ ID NO: 2637601 - DNA, 21 bp, Homo sapiens
caggttacaacagatttgtga

SEQ ID NO: 2637602 - DNA, 19 bp, Homo sapiens
caggttatcgaaataacaa

SEQ ID NO: 2637603 - DNA, 14 bp, Homo sapiens
caggttattttagt

SEQ ID NO: 2637604 - DNA, 21 bp, Homo sapiens
caggttattttagtttctgtt

SEQ ID NO: 2637605 - DNA, 20 bp, Homo sapiens
caggttcacaggcgaggcct

SEQ ID NO: 2637606 - DNA, 17 bp, Homo sapiens
caggttcctatggctgg

SEQ ID NO: 2637607 - DNA, 16 bp, Homo sapiens
caggttctatttggaa

SEQ ID NO: 2637608 - DNA, 21 bp, Homo sapiens
caggttctatttggaatttat

SEQ ID NO: 2637609 - DNA, 18 bp, Homo sapiens
caggttcttcttcctgaa

SEQ ID NO: 2637610 - DNA, 17 bp, Homo sapiens
caggtttctggtctcta

SEQ ID NO: 2637611 - DNA, 13 bp, Homo sapiens
caggtttgttaca

SEQ ID NO: 2637612 - DNA, 19 bp, Homo sapiens
caggttttctgggtgtcca

SEQ ID NO: 2637613 - DNA, 15 bp, Homo sapiens
caggttttgtaaaga

SEQ ID NO: 2637614 - DNA, 15 bp, Homo sapiens
caggtttttcaatta

SEQ ID NO: 2637615 - DNA, 23 bp, Homo sapiens
caggtttttcaattaaacggatt

SEQ ID NO: 2637616 - DNA, 23 bp, Homo sapiens
caggtttttggtctgacccactg

SEQ ID NO: 2637617 - DNA, 14 bp, Homo sapiens
cagtaactttatgt

SEQ ID NO: 2637618 - DNA, 17 bp, Homo sapiens
cagtaactttatgtgta

SEQ ID NO: 2637619 - DNA, 15 bp, Homo sapiens
cagtaagggaaatag

SEQ ID NO: 2637620 - DNA, 13 bp, Homo sapiens
cagtaataactct

SEQ ID NO: 2637621 - DNA, 20 bp, Homo sapiens
cagtaatatttatatattta

SEQ ID NO: 2637622 - DNA, 17 bp, Homo sapiens
cagtaatttgaggacaa

SEQ ID NO: 2637623 - DNA, 13 bp, Homo sapiens
cagtacaggcagc

SEQ ID NO: 2637624 - DNA, 14 bp, Homo sapiens
cagtacaggcagca

SEQ ID NO: 2637625 - DNA, 14 bp, Homo sapiens
cagtaccctctcag

SEQ ID NO: 2637626 - DNA, 16 bp, Homo sapiens
cagtaccctctcagct

SEQ ID NO: 2637627 - DNA, 22 bp, Homo sapiens
cagtaccctctcagctccaggt

SEQ ID NO: 2637628 - DNA, 12 bp, Homo sapiens
cagtacctggag

SEQ ID NO: 2637629 - DNA, 19 bp, Homo sapiens
cagtagaaataatatgcat

SEQ ID NO: 2637630 - DNA, 12 bp, Homo sapiens
cagtagacaagc

SEQ ID NO: 2637631 - DNA, 23 bp, Homo sapiens
cagtagaggctatggacagggca

SEQ ID NO: 2637632 - DNA, 15 bp, Homo sapiens
cagtaggttggcagt

SEQ ID NO: 2637633 - DNA, 12 bp, Homo sapiens
cagtataattct

SEQ ID NO: 2637634 - DNA, 22 bp, Homo sapiens
cagtataattctgtactgattt

SEQ ID NO: 2637635 - DNA, 14 bp, Homo sapiens
cagtatatttatag

SEQ ID NO: 2637636 - DNA, 15 bp, Homo sapiens
cagtatatttatagt

SEQ ID NO: 2637637 - DNA, 22 bp, Homo sapiens
cagtatatttatagtcacaaga

SEQ ID NO: 2637638 - DNA, 16 bp, Homo sapiens
cagtatccactttgca

SEQ ID NO: 2637639 - DNA, 13 bp, Homo sapiens
cagtatctcaggg

SEQ ID NO: 2637640 - DNA, 16 bp, Homo sapiens
cagtatgtcccatagg

SEQ ID NO: 2637641 - DNA, 16 bp, Homo sapiens
cagtattacttctgct

SEQ ID NO: 2637642 - DNA, 13 bp, Homo sapiens
cagtattcttgtc

SEQ ID NO: 2637643 - DNA, 16 bp, Homo sapiens
cagtattcttgtcaaa

SEQ ID NO: 2637644 - DNA, 12 bp, Homo sapiens
cagtattgaagc

SEQ ID NO: 2637645 - DNA, 14 bp, Homo sapiens
cagtattgaagcat

SEQ ID NO: 2637646 - DNA, 15 bp, Homo sapiens
cagtattgaagcatt

SEQ ID NO: 2637647 - DNA, 21 bp, Homo sapiens
cagtattgaagcattttataa

SEQ ID NO: 2637648 - DNA, 14 bp, Homo sapiens
cagtattttggaga

SEQ ID NO: 2637649 - DNA, 19 bp, Homo sapiens
cagtattttggttcttagt

SEQ ID NO: 2637650 - DNA, 16 bp, Homo sapiens
cagtcaacaaactatt

SEQ ID NO: 2637651 - DNA, 15 bp, Homo sapiens
cagtcacattccaag

SEQ ID NO: 2637652 - DNA, 19 bp, Homo sapiens
cagtcaccccggccacctg

SEQ ID NO: 2637653 - DNA, 22 bp, Homo sapiens
cagtcaccccggccacctgcgg

SEQ ID NO: 2637654 - DNA, 18 bp, Homo sapiens
cagtcacgtggaggagca

SEQ ID NO: 2637655 - DNA, 23 bp, Homo sapiens
cagtcacgtggaggagcagtgca

SEQ ID NO: 2637656 - DNA, 17 bp, Homo sapiens
cagtcagcctctctccc

SEQ ID NO: 2637657 - DNA, 18 bp, Homo sapiens
cagtcagcctctctccca

SEQ ID NO: 2637658 - DNA, 16 bp, Homo sapiens
cagtcagtaattgcca

SEQ ID NO: 2637659 - DNA, 24 bp, Homo sapiens
cagtcatcttgaccaagcaggaag

SEQ ID NO: 2637660 - DNA, 19 bp, Homo sapiens
cagtcatgcataaatatgc

SEQ ID NO: 2637661 - DNA, 18 bp, Homo sapiens
cagtcattagactcctcc

SEQ ID NO: 2637662 - DNA, 13 bp, Homo sapiens
cagtcattatgag

SEQ ID NO: 2637663 - DNA, 12 bp, Homo sapiens
cagtcatttaaa

SEQ ID NO: 2637664 - DNA, 23 bp, Homo sapiens
cagtcatttttgtttctacctcc

SEQ ID NO: 2637665 - DNA, 22 bp, Homo sapiens
cagtccaaggaaaccacagctg

SEQ ID NO: 2637666 - DNA, 23 bp, Homo sapiens
cagtccaaggaaaccacagctgc

SEQ ID NO: 2637667 - DNA, 24 bp, Homo sapiens
cagtccaaggaaaccacagctgct

SEQ ID NO: 2637668 - DNA, 14 bp, Homo sapiens
cagtccagcctgga

SEQ ID NO: 2637669 - DNA, 19 bp, Homo sapiens
cagtcccatcagagagcga

SEQ ID NO: 2637670 - DNA, 12 bp, Homo sapiens
cagtcccctccc

SEQ ID NO: 2637671 - DNA, 17 bp, Homo sapiens
cagtcccctcccatctg

SEQ ID NO: 2637672 - DNA, 22 bp, Homo sapiens
cagtcccctcccatctgggagt

SEQ ID NO: 2637673 - DNA, 14 bp, Homo sapiens
cagtccctgccaat

SEQ ID NO: 2637674 - DNA, 15 bp, Homo sapiens
cagtccctgccaatg

SEQ ID NO: 2637675 - DNA, 16 bp, Homo sapiens
cagtccctgccaatgg

SEQ ID NO: 2637676 - DNA, 23 bp, Homo sapiens
cagtcctagctgcacagggcagc

SEQ ID NO: 2637677 - DNA, 15 bp, Homo sapiens
cagtcctcccatctc

SEQ ID NO: 2637678 - DNA, 17 bp, Homo sapiens
cagtcctgcctcagcct

SEQ ID NO: 2637679 - DNA, 17 bp, Homo sapiens
cagtcctgcctggccag

SEQ ID NO: 2637680 - DNA, 19 bp, Homo sapiens
cagtcctggcctggcttct

SEQ ID NO: 2637681 - DNA, 12 bp, Homo sapiens
cagtcctgggag

SEQ ID NO: 2637682 - DNA, 13 bp, Homo sapiens
cagtcgggggctg

SEQ ID NO: 2637683 - DNA, 18 bp, Homo sapiens
cagtcgggggctggccta

SEQ ID NO: 2637684 - DNA, 17 bp, Homo sapiens
cagtcgtcgcacagtct

SEQ ID NO: 2637685 - DNA, 20 bp, Homo sapiens
cagtcgtcgcacagtctctc

SEQ ID NO: 2637686 - DNA, 14 bp, Homo sapiens
cagtctacccagag

SEQ ID NO: 2637687 - DNA, 22 bp, Homo sapiens
cagtctacccagagaagcccct

SEQ ID NO: 2637688 - DNA, 13 bp, Homo sapiens
cagtctatccaca

SEQ ID NO: 2637689 - DNA, 15 bp, Homo sapiens
cagtctatccacaga

SEQ ID NO: 2637690 - DNA, 22 bp, Homo sapiens
cagtctatccacagagagtccc

SEQ ID NO: 2637691 - DNA, 19 bp, Homo sapiens
cagtctcaggagcatgggg

SEQ ID NO: 2637692 - DNA, 11 bp, Homo sapiens
cagtctccctt

SEQ ID NO: 2637693 - DNA, 21 bp, Homo sapiens
cagtctctctctctctctccc

SEQ ID NO: 2637694 - DNA, 16 bp, Homo sapiens
cagtctctgagggctt

SEQ ID NO: 2637695 - DNA, 22 bp, Homo sapiens
cagtctgatgagaactctgagc

SEQ ID NO: 2637696 - DNA, 19 bp, Homo sapiens
cagtctgattcccaagctc

SEQ ID NO: 2637697 - DNA, 23 bp, Homo sapiens
cagtctgattcccaagctctgct

SEQ ID NO: 2637698 - DNA, 21 bp, Homo sapiens
cagtctgctgccctccatccc

SEQ ID NO: 2637699 - DNA, 22 bp, Homo sapiens
cagtctgctgccctccatcccg

SEQ ID NO: 2637700 - DNA, 15 bp, Homo sapiens
cagtctggaatgcag

SEQ ID NO: 2637701 - DNA, 12 bp, Homo sapiens
cagtctgtcatg

SEQ ID NO: 2637702 - DNA, 15 bp, Homo sapiens
cagtcttccatttgc

SEQ ID NO: 2637703 - DNA, 21 bp, Homo sapiens
cagtcttccatttgcaaggga

SEQ ID NO: 2637704 - DNA, 15 bp, Homo sapiens
cagtcttgaatttct

SEQ ID NO: 2637705 - DNA, 14 bp, Homo sapiens
cagtcttgcagcag

SEQ ID NO: 2637706 - DNA, 22 bp, Homo sapiens
cacatgtcaccgtggaccttcc

SEQ ID NO: 2637707 - DNA, 21 bp, Homo sapiens
cacatgtccaagaagcccagg

SEQ ID NO: 2637708 - DNA, 15 bp, Homo sapiens
cacatgtcttgtaca

SEQ ID NO: 2637709 - DNA, 13 bp, Homo sapiens
cacatgtgacaca

SEQ ID NO: 2637710 - DNA, 15 bp, Homo sapiens
cacatgtgcacatgc

SEQ ID NO: 2637711 - DNA, 18 bp, Homo sapiens
cacattaatatttgctga

SEQ ID NO: 2637712 - DNA, 16 bp, Homo sapiens
cacattcaataagcat

SEQ ID NO: 2637713 - DNA, 16 bp, Homo sapiens
cacattcctgatgctt

SEQ ID NO: 2637714 - DNA, 18 bp, Homo sapiens
cacattccttgcctgcac

SEQ ID NO: 2637715 - DNA, 19 bp, Homo sapiens
cacattccttgcctgcaca

SEQ ID NO: 2637716 - DNA, 16 bp, Homo sapiens
cacattcggctccctg

SEQ ID NO: 2637717 - DNA, 17 bp, Homo sapiens
cacattcggctccctgg

SEQ ID NO: 2637718 - DNA, 21 bp, Homo sapiens
cacattcggctccctggagcc

SEQ ID NO: 2637719 - DNA, 21 bp, Homo sapiens
cacattctggctcagggaggt

SEQ ID NO: 2637720 - DNA, 22 bp, Homo sapiens
cacattcttaacacatgtcctt

SEQ ID NO: 2637721 - DNA, 17 bp, Homo sapiens
cacattcttataaatat

SEQ ID NO: 2637722 - DNA, 18 bp, Homo sapiens
cacattcttataaatatg

SEQ ID NO: 2637723 - DNA, 19 bp, Homo sapiens
cacattcttataaatatga

SEQ ID NO: 2637724 - DNA, 23 bp, Homo sapiens
cacattcttataaatatgaagct

SEQ ID NO: 2637725 - DNA, 12 bp, Homo sapiens
cacattgtttta

SEQ ID NO: 2637726 - DNA, 15 bp, Homo sapiens
cacattgttttaaaa

SEQ ID NO: 2637727 - DNA, 17 bp, Homo sapiens
cacatttattctgctca

SEQ ID NO: 2637728 - DNA, 15 bp, Homo sapiens
cacattttattttat

SEQ ID NO: 2637729 - DNA, 19 bp, Homo sapiens
cacattttattttattatg

SEQ ID NO: 2637730 - DNA, 20 bp, Homo sapiens
cacattttattttattatgc

SEQ ID NO: 2637731 - DNA, 18 bp, Homo sapiens
cacattttccttttcaaa

SEQ ID NO: 2637732 - DNA, 13 bp, Homo sapiens
cacatttttctta

SEQ ID NO: 2637733 - DNA, 23 bp, Homo sapiens
caccaacatactcccatctgtga

SEQ ID NO: 2637734 - DNA, 13 bp, Homo sapiens
caccaagcccagt

SEQ ID NO: 2637735 - DNA, 13 bp, Homo sapiens
caccaagctcaaa

SEQ ID NO: 2637736 - DNA, 13 bp, Homo sapiens
caccacacccagc

SEQ ID NO: 2637737 - DNA, 19 bp, Homo sapiens
caccacacccagcccactt

SEQ ID NO: 2637738 - DNA, 12 bp, Homo sapiens
caccacagacac

SEQ ID NO: 2637739 - DNA, 16 bp, Homo sapiens
caccacagacacacac

SEQ ID NO: 2637740 - DNA, 20 bp, Homo sapiens
caccacagacacacacacgc

SEQ ID NO: 2637741 - DNA, 18 bp, Homo sapiens
caccacatcctccgtcca

SEQ ID NO: 2637742 - DNA, 21 bp, Homo sapiens
caccacatcctccgtccagcc

SEQ ID NO: 2637743 - DNA, 15 bp, Homo sapiens
caccacatgtgcaca

SEQ ID NO: 2637744 - DNA, 18 bp, Homo sapiens
caccacatgtgcacatgc

SEQ ID NO: 2637745 - DNA, 18 bp, Homo sapiens
caccaccacggtggtcac

SEQ ID NO: 2637746 - DNA, 15 bp, Homo sapiens
caccaccactggcca

SEQ ID NO: 2637747 - DNA, 16 bp, Homo sapiens
caccaccactggccac

SEQ ID NO: 2637748 - DNA, 18 bp, Homo sapiens
caccaccactggccacca

SEQ ID NO: 2637749 - DNA, 14 bp, Homo sapiens
caccaccccccact

SEQ ID NO: 2637750 - DNA, 16 bp, Homo sapiens
caccaccccccactct

SEQ ID NO: 2637751 - DNA, 13 bp, Homo sapiens
caccacctcagag

SEQ ID NO: 2637752 - DNA, 13 bp, Homo sapiens
caccacctccctc

SEQ ID NO: 2637753 - DNA, 15 bp, Homo sapiens
caccacgtccagctg

SEQ ID NO: 2637754 - DNA, 18 bp, Homo sapiens
caccactacattctgtta

SEQ ID NO: 2637755 - DNA, 14 bp, Homo sapiens
caccactggccacc

SEQ ID NO: 2637756 - DNA, 15 bp, Homo sapiens
caccactggccacca

SEQ ID NO: 2637757 - DNA, 18 bp, Homo sapiens
caccactggccaccaggc

SEQ ID NO: 2637758 - DNA, 16 bp, Homo sapiens
caccacttcttttata

SEQ ID NO: 2637759 - DNA, 21 bp, Homo sapiens
caccagagcatttccaacacc

SEQ ID NO: 2637760 - DNA, 15 bp, Homo sapiens
caccagagcccacct

SEQ ID NO: 2637761 - DNA, 20 bp, Homo sapiens
caccagagcccaccttggct

SEQ ID NO: 2637762 - DNA, 22 bp, Homo sapiens
caccagagcccaccttggctca

SEQ ID NO: 2637763 - DNA, 16 bp, Homo sapiens
caccagaggctgcaga

SEQ ID NO: 2637764 - DNA, 14 bp, Homo sapiens
caccagccaggctc

SEQ ID NO: 2637765 - DNA, 21 bp, Homo sapiens
caccagccaggctctgtgctg

SEQ ID NO: 2637766 - DNA, 21 bp, Homo sapiens
caccagccccagtgcccacag

SEQ ID NO: 2637767 - DNA, 16 bp, Homo sapiens
caccagcccggcctgc

SEQ ID NO: 2637768 - DNA, 17 bp, Homo sapiens
caccagcccggcctgct

SEQ ID NO: 2637769 - DNA, 21 bp, Homo sapiens
caccagcccttagcagggaaa

SEQ ID NO: 2637770 - DNA, 13 bp, Homo sapiens
caccagcctgcac

SEQ ID NO: 2637771 - DNA, 22 bp, Homo sapiens
caccagcctttctcccaggcca

SEQ ID NO: 2637772 - DNA, 12 bp, Homo sapiens
caccagctgcct

SEQ ID NO: 2637773 - DNA, 14 bp, Homo sapiens
caccagctgcctct

SEQ ID NO: 2637774 - DNA, 17 bp, Homo sapiens
caccagctgcctcttct

SEQ ID NO: 2637775 - DNA, 19 bp, Homo sapiens
caccaggagaaccactaca

SEQ ID NO: 2637776 - DNA, 17 bp, Homo sapiens
caccaggagtccctggt

SEQ ID NO: 2637777 - DNA, 13 bp, Homo sapiens
caccaggctggcg

SEQ ID NO: 2637778 - DNA, 20 bp, Homo sapiens
caccaggctggcgcagccaa

SEQ ID NO: 2637779 - DNA, 18 bp, Homo sapiens
caccaggctgtgggcctc

SEQ ID NO: 2637780 - DNA, 22 bp, Homo sapiens
caccagggttgaccccagagga

SEQ ID NO: 2637781 - DNA, 16 bp, Homo sapiens
caccaggtagaacaca

SEQ ID NO: 2637782 - DNA, 15 bp, Homo sapiens
caccagtcactgtcc

SEQ ID NO: 2637783 - DNA, 16 bp, Homo sapiens
caccagtgtcccctcc

SEQ ID NO: 2637784 - DNA, 21 bp, Homo sapiens
caccatattcagtgctgtggc

SEQ ID NO: 2637785 - DNA, 13 bp, Homo sapiens
caccatcaagcca

SEQ ID NO: 2637786 - DNA, 24 bp, Homo sapiens
caccatcaagccaccaacatactc

SEQ ID NO: 2637787 - DNA, 17 bp, Homo sapiens
caccatcatgtctggct

SEQ ID NO: 2637788 - DNA, 18 bp, Homo sapiens
caccatccgccagggccc

SEQ ID NO: 2637789 - DNA, 13 bp, Homo sapiens
caccatctcaggc

SEQ ID NO: 2637790 - DNA, 14 bp, Homo sapiens
caccatctcaggcc

SEQ ID NO: 2637791 - DNA, 19 bp, Homo sapiens
caccatctcaggccacctg

SEQ ID NO: 2637792 - DNA, 20 bp, Homo sapiens
caccatctcaggccacctgc

SEQ ID NO: 2637793 - DNA, 14 bp, Homo sapiens
caccatctttgcag

SEQ ID NO: 2637794 - DNA, 22 bp, Homo sapiens
caccatgcagtgcccctagctt

SEQ ID NO: 2637795 - DNA, 22 bp, Homo sapiens
cacccaaagaggtatttatctt

SEQ ID NO: 2637796 - DNA, 14 bp, Homo sapiens
cacccaagcttggc

SEQ ID NO: 2637797 - DNA, 19 bp, Homo sapiens
cacccaagcttggcagccg

SEQ ID NO: 2637798 - DNA, 17 bp, Homo sapiens
cacccaagggcctggcc

SEQ ID NO: 2637799 - DNA, 19 bp, Homo sapiens
cacccaagggcctggcctg

SEQ ID NO: 2637800 - DNA, 21 bp, Homo sapiens
cacccacacactcgcccgccc

SEQ ID NO: 2637801 - DNA, 13 bp, Homo sapiens
cacccacatgtga

SEQ ID NO: 2637802 - DNA, 21 bp, Homo sapiens
cacccacatgtgacacatatg

SEQ ID NO: 2637803 - DNA, 20 bp, Homo sapiens
cacccaccgtccgccctgct

SEQ ID NO: 2637804 - DNA, 22 bp, Homo sapiens
cacccagacagctccctctgcc

SEQ ID NO: 2637805 - DNA, 21 bp, Homo sapiens
cacccagatgggggaaagcac

SEQ ID NO: 2637806 - DNA, 16 bp, Homo sapiens
cacccagcccacttct

SEQ ID NO: 2637807 - DNA, 17 bp, Homo sapiens
cacccagcccacttctg

SEQ ID NO: 2637808 - DNA, 13 bp, Homo sapiens
cacccagccctgg

SEQ ID NO: 2637809 - DNA, 18 bp, Homo sapiens
cacccagccctggtctca

SEQ ID NO: 2637810 - DNA, 24 bp, Homo sapiens
cacccaggagccccgaggccttct

SEQ ID NO: 2637811 - DNA, 17 bp, Homo sapiens
cacccagtgagcactcc

SEQ ID NO: 2637812 - DNA, 22 bp, Homo sapiens
cacccatcctaccaatgcatgc

SEQ ID NO: 2637813 - DNA, 23 bp, Homo sapiens
cacccatcctaccaatgcatgca

SEQ ID NO: 2637814 - DNA, 15 bp, Homo sapiens
cacccatgaagacag

SEQ ID NO: 2637815 - DNA, 22 bp, Homo sapiens
cacccatgaagacaggacagtg

SEQ ID NO: 2637816 - DNA, 18 bp, Homo sapiens
cacccatgggctctgaca

SEQ ID NO: 2637817 - DNA, 11 bp, Homo sapiens
caccccacact

SEQ ID NO: 2637818 - DNA, 12 bp, Homo sapiens
caccccacactt

SEQ ID NO: 2637819 - DNA, 15 bp, Homo sapiens
caccccaccctccct

SEQ ID NO: 2637820 - DNA, 19 bp, Homo sapiens
caccccaccctccctggag

SEQ ID NO: 2637821 - DNA, 20 bp, Homo sapiens
caccccaccctccctggagt

SEQ ID NO: 2637822 - DNA, 14 bp, Homo sapiens
caccccacccttcc

SEQ ID NO: 2637823 - DNA, 12 bp, Homo sapiens
caccccatgcca

SEQ ID NO: 2637824 - DNA, 22 bp, Homo sapiens
cacccccacccaagggcctggc

SEQ ID NO: 2637825 - DNA, 17 bp, Homo sapiens
cacccccacccccagct

SEQ ID NO: 2637826 - DNA, 12 bp, Homo sapiens
cacccccagctc

SEQ ID NO: 2637827 - DNA, 12 bp, Homo sapiens
cacccccagctt

SEQ ID NO: 2637828 - DNA, 13 bp, Homo sapiens
cacccccatctct

SEQ ID NO: 2637829 - DNA, 13 bp, Homo sapiens
caccccccacact

SEQ ID NO: 2637830 - DNA, 23 bp, Homo sapiens
caccccccacactcactcctgag

SEQ ID NO: 2637831 - DNA, 18 bp, Homo sapiens
caccccccagaacctgtc

SEQ ID NO: 2637832 - DNA, 20 bp, Homo sapiens
caccccccagaacctgtcct

SEQ ID NO: 2637833 - DNA, 16 bp, Homo sapiens
caccccctccctggcc

SEQ ID NO: 2637834 - DNA, 18 bp, Homo sapiens
cacccccttctccatcca

SEQ ID NO: 2637835 - DNA, 13 bp, Homo sapiens
cacccccttctct

SEQ ID NO: 2637836 - DNA, 16 bp, Homo sapiens
cacccccttctctgct

SEQ ID NO: 2637837 - DNA, 12 bp, Homo sapiens
caccccctttcc

SEQ ID NO: 2637838 - DNA, 15 bp, Homo sapiens
caccccgctctgcat

SEQ ID NO: 2637839 - DNA, 14 bp, Homo sapiens
caccccggccacct

SEQ ID NO: 2637840 - DNA, 20 bp, Homo sapiens
cacccctcaacacctctgca

SEQ ID NO: 2637841 - DNA, 22 bp, Homo sapiens
cacccctcccctgccctagagc

SEQ ID NO: 2637842 - DNA, 12 bp, Homo sapiens
cacccctctctg

SEQ ID NO: 2637843 - DNA, 21 bp, Homo sapiens
cacccctgcccccacttcctg

SEQ ID NO: 2637844 - DNA, 24 bp, Homo sapiens
cacccctgccctgggatgtccaca

SEQ ID NO: 2637845 - DNA, 12 bp, Homo sapiens
cacccctgcctc

SEQ ID NO: 2637846 - DNA, 13 bp, Homo sapiens
cacccctgcctcc

SEQ ID NO: 2637847 - DNA, 13 bp, Homo sapiens
cacccctgtctct

SEQ ID NO: 2637848 - DNA, 21 bp, Homo sapiens
cacccctgtgctccgtgcctc

SEQ ID NO: 2637849 - DNA, 16 bp, Homo sapiens
caccccttatccagga

SEQ ID NO: 2637850 - DNA, 19 bp, Homo sapiens
caccccttatccaggactc

SEQ ID NO: 2637851 - DNA, 22 bp, Homo sapiens
cagggacaccagccaggctctg

SEQ ID NO: 2637852 - DNA, 15 bp, Homo sapiens
cagggacagagccat

SEQ ID NO: 2637853 - DNA, 22 bp, Homo sapiens
cagggacccacttcacacacag

SEQ ID NO: 2637854 - DNA, 21 bp, Homo sapiens
cagggacctttggagaccatt

SEQ ID NO: 2637855 - DNA, 12 bp, Homo sapiens
cagggagacaga

SEQ ID NO: 2637856 - DNA, 15 bp, Homo sapiens
cagggagcatggctg

SEQ ID NO: 2637857 - DNA, 19 bp, Homo sapiens
cagggagcggaaagcagct

SEQ ID NO: 2637858 - DNA, 22 bp, Homo sapiens
cagggaggaggtggcagccctg

SEQ ID NO: 2637859 - DNA, 16 bp, Homo sapiens
cagggagggcttctgc

SEQ ID NO: 2637860 - DNA, 16 bp, Homo sapiens
cagggaggggaagagg

SEQ ID NO: 2637861 - DNA, 12 bp, Homo sapiens
cagggaggggac

SEQ ID NO: 2637862 - DNA, 16 bp, Homo sapiens
cagggaggtcattttg

SEQ ID NO: 2637863 - DNA, 18 bp, Homo sapiens
cagggaggtgaccccagg

SEQ ID NO: 2637864 - DNA, 13 bp, Homo sapiens
cagggagtcccct

SEQ ID NO: 2637865 - DNA, 17 bp, Homo sapiens
cagggatcttgcattcc

SEQ ID NO: 2637866 - DNA, 12 bp, Homo sapiens
cagggatgagca

SEQ ID NO: 2637867 - DNA, 16 bp, Homo sapiens
cagggatgagcatgga

SEQ ID NO: 2637868 - DNA, 20 bp, Homo sapiens
cagggatgagcatggagctg

SEQ ID NO: 2637869 - DNA, 23 bp, Homo sapiens
cagggatgagcatggagctggcc

SEQ ID NO: 2637870 - DNA, 16 bp, Homo sapiens
cagggattgctgccac

SEQ ID NO: 2637871 - DNA, 18 bp, Homo sapiens
cagggcacttcacagagt

SEQ ID NO: 2637872 - DNA, 16 bp, Homo sapiens
cagggcagagccggga

SEQ ID NO: 2637873 - DNA, 19 bp, Homo sapiens
cagggcagagtgagaccca

SEQ ID NO: 2637874 - DNA, 18 bp, Homo sapiens
cagggcagctgggcccaa

SEQ ID NO: 2637875 - DNA, 21 bp, Homo sapiens
cagggcagctgggcccaaccc

SEQ ID NO: 2637876 - DNA, 22 bp, Homo sapiens
cagggcagctgggcccaaccct

SEQ ID NO: 2637877 - DNA, 15 bp, Homo sapiens
cagggcagggctctg

SEQ ID NO: 2637878 - DNA, 15 bp, Homo sapiens
cagggcatctccagg

SEQ ID NO: 2637879 - DNA, 13 bp, Homo sapiens
cagggcatctcct

SEQ ID NO: 2637880 - DNA, 15 bp, Homo sapiens
cagggcatgccacgt

SEQ ID NO: 2637881 - DNA, 12 bp, Homo sapiens
cagggccactct

SEQ ID NO: 2637882 - DNA, 18 bp, Homo sapiens
cagggccactctgcctct

SEQ ID NO: 2637883 - DNA, 12 bp, Homo sapiens
cagggccagggc

SEQ ID NO: 2637884 - DNA, 18 bp, Homo sapiens
cagggccagggccctgca

SEQ ID NO: 2637885 - DNA, 19 bp, Homo sapiens
cagggcccaagtccctgtt

SEQ ID NO: 2637886 - DNA, 15 bp, Homo sapiens
cagggccccagaagg

SEQ ID NO: 2637887 - DNA, 17 bp, Homo sapiens
cagggccccagaaggca

SEQ ID NO: 2637888 - DNA, 15 bp, Homo sapiens
cagggccccagcact

SEQ ID NO: 2637889 - DNA, 20 bp, Homo sapiens
cagggccccaggcattgcca

SEQ ID NO: 2637890 - DNA, 13 bp, Homo sapiens
cagggccctgcag

SEQ ID NO: 2637891 - DNA, 15 bp, Homo sapiens
cagggccctgcagag

SEQ ID NO: 2637892 - DNA, 18 bp, Homo sapiens
cagggccctgcagagggg

SEQ ID NO: 2637893 - DNA, 19 bp, Homo sapiens
cagggcctagctgctacaa

SEQ ID NO: 2637894 - DNA, 12 bp, Homo sapiens
cagggcctggaa

SEQ ID NO: 2637895 - DNA, 14 bp, Homo sapiens
cagggcctggctca

SEQ ID NO: 2637896 - DNA, 17 bp, Homo sapiens
cagggctaccctccccc

SEQ ID NO: 2637897 - DNA, 14 bp, Homo sapiens
cagggctaccctga

SEQ ID NO: 2637898 - DNA, 12 bp, Homo sapiens
cagggctcagcc

SEQ ID NO: 2637899 - DNA, 15 bp, Homo sapiens
cagggctcagcctgg

SEQ ID NO: 2637900 - DNA, 12 bp, Homo sapiens
cagggctcagga

SEQ ID NO: 2637901 - DNA, 13 bp, Homo sapiens
cagggctcctgcc

SEQ ID NO: 2637902 - DNA, 16 bp, Homo sapiens
cagggctgaggcctct

SEQ ID NO: 2637903 - DNA, 14 bp, Homo sapiens
cagggctgctagac

SEQ ID NO: 2637904 - DNA, 17 bp, Homo sapiens
caggggactcagccctg

SEQ ID NO: 2637905 - DNA, 21 bp, Homo sapiens
caggggactcagccctgaggt

SEQ ID NO: 2637906 - DNA, 16 bp, Homo sapiens
caggggatggcgtggt

SEQ ID NO: 2637907 - DNA, 17 bp, Homo sapiens
caggggattgaagccct

SEQ ID NO: 2637908 - DNA, 20 bp, Homo sapiens
caggggattgaagccctcca

SEQ ID NO: 2637909 - DNA, 15 bp, Homo sapiens
caggggcgtggaggg

SEQ ID NO: 2637910 - DNA, 12 bp, Homo sapiens
caggggctgttt

SEQ ID NO: 2637911 - DNA, 19 bp, Homo sapiens
cagggggaaggtggggtcc

SEQ ID NO: 2637912 - DNA, 16 bp, Homo sapiens
caggggtctccctgga

SEQ ID NO: 2637913 - DNA, 17 bp, Homo sapiens
caggggtctccctggag

SEQ ID NO: 2637914 - DNA, 20 bp, Homo sapiens
caggggtgatttcagagagg

SEQ ID NO: 2637915 - DNA, 15 bp, Homo sapiens
caggggtgccccctc

SEQ ID NO: 2637916 - DNA, 20 bp, Homo sapiens
caggggtgccccctcctctc

SEQ ID NO: 2637917 - DNA, 22 bp, Homo sapiens
caggggtgccccctcctctccc

SEQ ID NO: 2637918 - DNA, 15 bp, Homo sapiens
caggggttgcagtga

SEQ ID NO: 2637919 - DNA, 15 bp, Homo sapiens
cagggtagcccgcct

SEQ ID NO: 2637920 - DNA, 20 bp, Homo sapiens
cagggtattccagagtgggg

SEQ ID NO: 2637921 - DNA, 21 bp, Homo sapiens
cagggtcactgaaggcctggc

SEQ ID NO: 2637922 - DNA, 22 bp, Homo sapiens
cagggtccacaggaagtgaaga

SEQ ID NO: 2637923 - DNA, 21 bp, Homo sapiens
cagggtcccatttctcactga

SEQ ID NO: 2637924 - DNA, 12 bp, Homo sapiens
cagggtccctgg

SEQ ID NO: 2637925 - DNA, 19 bp, Homo sapiens
cagggtccctggtggcagc

SEQ ID NO: 2637926 - DNA, 22 bp, Homo sapiens
cagggtccctggtggcagctca

SEQ ID NO: 2637927 - DNA, 20 bp, Homo sapiens
cagggtctctagtgctgtga

SEQ ID NO: 2637928 - DNA, 22 bp, Homo sapiens
cagggtctctagtgctgtgaaa

SEQ ID NO: 2637929 - DNA, 23 bp, Homo sapiens
cagggtctctagtgctgtgaaaa

SEQ ID NO: 2637930 - DNA, 13 bp, Homo sapiens
cagggtctctgct

SEQ ID NO: 2637931 - DNA, 15 bp, Homo sapiens
cagggtctgggcagg

SEQ ID NO: 2637932 - DNA, 21 bp, Homo sapiens
cagggtcttccctacctcagg

SEQ ID NO: 2637933 - DNA, 21 bp, Homo sapiens
cagggtcttttcatctgggaa

SEQ ID NO: 2637934 - DNA, 22 bp, Homo sapiens
cagggtcttttcatctgggaaa

SEQ ID NO: 2637935 - DNA, 21 bp, Homo sapiens
cagggtgagagctgctctgga

SEQ ID NO: 2637936 - DNA, 14 bp, Homo sapiens
cagggtgaggatgg

SEQ ID NO: 2637937 - DNA, 17 bp, Homo sapiens
cagggtggtgctgggac

SEQ ID NO: 2637938 - DNA, 17 bp, Homo sapiens
cagggttcccccagccc

SEQ ID NO: 2637939 - DNA, 18 bp, Homo sapiens
cagggttcccccagccct

SEQ ID NO: 2637940 - DNA, 20 bp, Homo sapiens
cagggttgaccccagaggat

SEQ ID NO: 2637941 - DNA, 13 bp, Homo sapiens
cagggttgggccc

SEQ ID NO: 2637942 - DNA, 15 bp, Homo sapiens
cagggttgggcccag

SEQ ID NO: 2637943 - DNA, 20 bp, Homo sapiens
cagggtttcgagaagctgct

SEQ ID NO: 2637944 - DNA, 15 bp, Homo sapiens
caggtaaactcctgt

SEQ ID NO: 2637945 - DNA, 17 bp, Homo sapiens
caggtaaattaagacat

SEQ ID NO: 2637946 - DNA, 14 bp, Homo sapiens
caggtaacaggcag

SEQ ID NO: 2637947 - DNA, 20 bp, Homo sapiens
caggtaacaggcagatacag

SEQ ID NO: 2637948 - DNA, 21 bp, Homo sapiens
caggtaacaggcagatacagg

SEQ ID NO: 2637949 - DNA, 23 bp, Homo sapiens
caggtaatgagggactggaacca

SEQ ID NO: 2637950 - DNA, 19 bp, Homo sapiens
caggtagaacacaaggtca

SEQ ID NO: 2637951 - DNA, 18 bp, Homo sapiens
caggtagttgcaattgaa

SEQ ID NO: 2637952 - DNA, 17 bp, Homo sapiens
attgtataaactatcag

SEQ ID NO: 2637953 - DNA, 15 bp, Homo sapiens
attgtatatatgtgt

SEQ ID NO: 2637954 - DNA, 22 bp, Homo sapiens
attgtatatatgtgtgtttaaa

SEQ ID NO: 2637955 - DNA, 14 bp, Homo sapiens
attgtatcagaggc

SEQ ID NO: 2637956 - DNA, 19 bp, Homo sapiens
attgtatcagaggcctata

SEQ ID NO: 2637957 - DNA, 15 bp, Homo sapiens
attgtatcgatgtta

SEQ ID NO: 2637958 - DNA, 16 bp, Homo sapiens
attgtatcgtatagct

SEQ ID NO: 2637959 - DNA, 12 bp, Homo sapiens
attgtatgatgt

SEQ ID NO: 2637960 - DNA, 21 bp, Homo sapiens
attgtatgatgtgttgtgata

SEQ ID NO: 2637961 - DNA, 23 bp, Homo sapiens
attgtattaggtgtcatttccat

SEQ ID NO: 2637962 - DNA, 18 bp, Homo sapiens
attgtatttattccatat

SEQ ID NO: 2637963 - DNA, 19 bp, Homo sapiens
attgtcagagttctgctct

SEQ ID NO: 2637964 - DNA, 14 bp, Homo sapiens
attgtcagatattt

SEQ ID NO: 2637965 - DNA, 19 bp, Homo sapiens
attgtcagctactaatgat

SEQ ID NO: 2637966 - DNA, 20 bp, Homo sapiens
attgtcttcggaaaccttgg

SEQ ID NO: 2637967 - DNA, 15 bp, Homo sapiens
attgtgaccaagtta

SEQ ID NO: 2637968 - DNA, 16 bp, Homo sapiens
attgtgaccaagttat

SEQ ID NO: 2637969 - DNA, 23 bp, Homo sapiens
attgtgatcagaccataatgtta

SEQ ID NO: 2637970 - DNA, 13 bp, Homo sapiens
attgtgatgtgtc

SEQ ID NO: 2637971 - DNA, 12 bp, Homo sapiens
attgtgatttga

SEQ ID NO: 2637972 - DNA, 18 bp, Homo sapiens
attgtgatttgactgttt

SEQ ID NO: 2637973 - DNA, 19 bp, Homo sapiens
attgtgcacatacttgaga

SEQ ID NO: 2637974 - DNA, 16 bp, Homo sapiens
attgtgccaatatgta

SEQ ID NO: 2637975 - DNA, 12 bp, Homo sapiens
attgtggctcct

SEQ ID NO: 2637976 - DNA, 19 bp, Homo sapiens
attgtggctgtcagcagga

SEQ ID NO: 2637977 - DNA, 20 bp, Homo sapiens
attgtggggatgatgaaata

SEQ ID NO: 2637978 - DNA, 19 bp, Homo sapiens
attgtggtacaatctcaaa

SEQ ID NO: 2637979 - DNA, 21 bp, Homo sapiens
attgtgtctcttggtcctgct

SEQ ID NO: 2637980 - DNA, 20 bp, Homo sapiens
attgtgttcccatttcagct

SEQ ID NO: 2637981 - DNA, 15 bp, Homo sapiens
attgttaaaataact

SEQ ID NO: 2637982 - DNA, 22 bp, Homo sapiens
attgttaagtctaaatatttcc

SEQ ID NO: 2637983 - DNA, 18 bp, Homo sapiens
attgttccaagacattgt

SEQ ID NO: 2637984 - DNA, 21 bp, Homo sapiens
attgttccaagacattgtcaa

SEQ ID NO: 2637985 - DNA, 21 bp, Homo sapiens
attgttcccagtgacacttca

SEQ ID NO: 2637986 - DNA, 13 bp, Homo sapiens
attgttcctgtca

SEQ ID NO: 2637987 - DNA, 21 bp, Homo sapiens
attgttgaggtggtctgaatg

SEQ ID NO: 2637988 - DNA, 22 bp, Homo sapiens
attgttgaggtggtctgaatgt

SEQ ID NO: 2637989 - DNA, 20 bp, Homo sapiens
attgttggtaattattttgg

SEQ ID NO: 2637990 - DNA, 21 bp, Homo sapiens
attgttgtacacagaaataca

SEQ ID NO: 2637991 - DNA, 22 bp, Homo sapiens
attgttgtttgccatactttgt

SEQ ID NO: 2637992 - DNA, 20 bp, Homo sapiens
attgttgtttgtatgtataa

SEQ ID NO: 2637993 - DNA, 21 bp, Homo sapiens
attgttgtttgtatgtataat

SEQ ID NO: 2637994 - DNA, 15 bp, Homo sapiens
attgtttaaaatcat

SEQ ID NO: 2637995 - DNA, 19 bp, Homo sapiens
attgtttaaaatcatttct

SEQ ID NO: 2637996 - DNA, 14 bp, Homo sapiens
attgtttattcttt

SEQ ID NO: 2637997 - DNA, 19 bp, Homo sapiens
attgtttatttatcagtga

SEQ ID NO: 2637998 - DNA, 22 bp, Homo sapiens
attgtttcaattgcatctccca

SEQ ID NO: 2637999 - DNA, 22 bp, Homo sapiens
attgtttcattgcgaatctttt

SEQ ID NO: 2638000 - DNA, 19 bp, Homo sapiens
attgtttctttaagaaagt

SEQ ID NO: 2638001 - DNA, 20 bp, Homo sapiens
attgtttgaaacaaagaagg

SEQ ID NO: 2638002 - DNA, 15 bp, Homo sapiens
attgtttgcttattg

SEQ ID NO: 2638003 - DNA, 21 bp, Homo sapiens
attgtttgcttattgttccaa

SEQ ID NO: 2638004 - DNA, 14 bp, Homo sapiens
attgttttaaaaag

SEQ ID NO: 2638005 - DNA, 18 bp, Homo sapiens
attgttttatcatgacat

SEQ ID NO: 2638006 - DNA, 17 bp, Homo sapiens
attgttttcagtgtaca

SEQ ID NO: 2638007 - DNA, 15 bp, Homo sapiens
attgttttgcacttt

SEQ ID NO: 2638008 - DNA, 13 bp, Homo sapiens
atttaaaaaataa

SEQ ID NO: 2638009 - DNA, 15 bp, Homo sapiens
atttaaaacagacac

SEQ ID NO: 2638010 - DNA, 17 bp, Homo sapiens
atttaaaacagacactg

SEQ ID NO: 2638011 - DNA, 23 bp, Homo sapiens
atttaaaacagacactggcatgg

SEQ ID NO: 2638012 - DNA, 15 bp, Homo sapiens
atttaaaagacactg

SEQ ID NO: 2638013 - DNA, 13 bp, Homo sapiens
atttaaaagatac

SEQ ID NO: 2638014 - DNA, 16 bp, Homo sapiens
atttaaaagatacagt

SEQ ID NO: 2638015 - DNA, 13 bp, Homo sapiens
atttaaaagattc

SEQ ID NO: 2638016 - DNA, 19 bp, Homo sapiens
atttaaaagattcattttt

SEQ ID NO: 2638017 - DNA, 15 bp, Homo sapiens
atttaaaagggaagt

SEQ ID NO: 2638018 - DNA, 21 bp, Homo sapiens
atttaaaatgtgtttcttaca

SEQ ID NO: 2638019 - DNA, 20 bp, Homo sapiens
atttaaaattgtgatgtgtc

SEQ ID NO: 2638020 - DNA, 19 bp, Homo sapiens
atttaaacaataaatgtgc

SEQ ID NO: 2638021 - DNA, 14 bp, Homo sapiens
atttaaacagcagt

SEQ ID NO: 2638022 - DNA, 18 bp, Homo sapiens
atttaaacaggcccagca

SEQ ID NO: 2638023 - DNA, 19 bp, Homo sapiens
atttaaagaacaccctata

SEQ ID NO: 2638024 - DNA, 20 bp, Homo sapiens
atttaaagggtgtacttata

SEQ ID NO: 2638025 - DNA, 19 bp, Homo sapiens
atttaaatataattctgta

SEQ ID NO: 2638026 - DNA, 22 bp, Homo sapiens
atttaaatataattctgtaaat

SEQ ID NO: 2638027 - DNA, 16 bp, Homo sapiens
atttaaatattaaata

SEQ ID NO: 2638028 - DNA, 17 bp, Homo sapiens
atttaaatttttttcct

SEQ ID NO: 2638029 - DNA, 16 bp, Homo sapiens
atttaacagaaatgta

SEQ ID NO: 2638030 - DNA, 17 bp, Homo sapiens
atttaacagggagggga

SEQ ID NO: 2638031 - DNA, 15 bp, Homo sapiens
atttaacagtcattt

SEQ ID NO: 2638032 - DNA, 20 bp, Homo sapiens
atttcttggtaagaagccgg

SEQ ID NO: 2638033 - DNA, 13 bp, Homo sapiens
atttctttccaga

SEQ ID NO: 2638034 - DNA, 22 bp, Homo sapiens
atttctttgttatcaaacttca

SEQ ID NO: 2638035 - DNA, 23 bp, Homo sapiens
atttctttgttatcaaacttcag

SEQ ID NO: 2638036 - DNA, 22 bp, Homo sapiens
atttgaaaacataatctgcaaa

SEQ ID NO: 2638037 - DNA, 15 bp, Homo sapiens
atttgaaaattttga

SEQ ID NO: 2638038 - DNA, 14 bp, Homo sapiens
atttgaaggtctgc

SEQ ID NO: 2638039 - DNA, 17 bp, Homo sapiens
atttgaatgggtccatt

SEQ ID NO: 2638040 - DNA, 18 bp, Homo sapiens
atttgactgtttttaccc

SEQ ID NO: 2638041 - DNA, 19 bp, Homo sapiens
atttgactgtttttaccca

SEQ ID NO: 2638042 - DNA, 12 bp, Homo sapiens
atttgagaaatg

SEQ ID NO: 2638043 - DNA, 14 bp, Homo sapiens
atttgagaaatgca

SEQ ID NO: 2638044 - DNA, 17 bp, Homo sapiens
atttgagagaaatatga

SEQ ID NO: 2638045 - DNA, 15 bp, Homo sapiens
atttgagcagggctc

SEQ ID NO: 2638046 - DNA, 17 bp, Homo sapiens
atttgagcagggctcag

SEQ ID NO: 2638047 - DNA, 17 bp, Homo sapiens
atttgaggggaaaacac

SEQ ID NO: 2638048 - DNA, 14 bp, Homo sapiens
atttgagtgctctg

SEQ ID NO: 2638049 - DNA, 16 bp, Homo sapiens
atttgagtgctctgat

SEQ ID NO: 2638050 - DNA, 12 bp, Homo sapiens
atttgagtgttt

SEQ ID NO: 2638051 - DNA, 17 bp, Homo sapiens
atttgatcgttccagtt

SEQ ID NO: 2638052 - DNA, 15 bp, Homo sapiens
atttgatgccaggac

SEQ ID NO: 2638053 - DNA, 14 bp, Homo sapiens
atttgatgctaaat

SEQ ID NO: 2638054 - DNA, 16 bp, Homo sapiens
atttgatgctggagag

SEQ ID NO: 2638055 - DNA, 23 bp, Homo sapiens
atttgatgctgtttgacaaagtt

SEQ ID NO: 2638056 - DNA, 23 bp, Homo sapiens
atttgattctgtgtgttttcata

SEQ ID NO: 2638057 - DNA, 20 bp, Homo sapiens
atttgcaagggaaaagtctc

SEQ ID NO: 2638058 - DNA, 15 bp, Homo sapiens
atttgcacaagtttt

SEQ ID NO: 2638059 - DNA, 21 bp, Homo sapiens
atttgcagctgagagaaaata

SEQ ID NO: 2638060 - DNA, 15 bp, Homo sapiens
atttgccatgggctt

SEQ ID NO: 2638061 - DNA, 19 bp, Homo sapiens
atttgccatgggcttcact

SEQ ID NO: 2638062 - DNA, 15 bp, Homo sapiens
atttgccttgctgga

SEQ ID NO: 2638063 - DNA, 12 bp, Homo sapiens
atttggaaaata

SEQ ID NO: 2638064 - DNA, 18 bp, Homo sapiens
atttggaatttatataca

SEQ ID NO: 2638065 - DNA, 17 bp, Homo sapiens
atttggagactctgtgg

SEQ ID NO: 2638066 - DNA, 21 bp, Homo sapiens
atttggagtgttccccttcca

SEQ ID NO: 2638067 - DNA, 18 bp, Homo sapiens
atttggtggtttcagaaa

SEQ ID NO: 2638068 - DNA, 15 bp, Homo sapiens
atttggttctaatag

SEQ ID NO: 2638069 - DNA, 20 bp, Homo sapiens
atttgtaacctcagctctgg

SEQ ID NO: 2638070 - DNA, 21 bp, Homo sapiens
atttgtaacctcagctctggg

SEQ ID NO: 2638071 - DNA, 15 bp, Homo sapiens
atttgtaagtttcag

SEQ ID NO: 2638072 - DNA, 21 bp, Homo sapiens
atttgtaagtttcaggtgaca

SEQ ID NO: 2638073 - DNA, 15 bp, Homo sapiens
atttgtaattgctta

SEQ ID NO: 2638074 - DNA, 19 bp, Homo sapiens
atttgtaattgcttacatt

SEQ ID NO: 2638075 - DNA, 23 bp, Homo sapiens
atttgtaattgcttacattttta

SEQ ID NO: 2638076 - DNA, 13 bp, Homo sapiens
atttgtacaaaaa

SEQ ID NO: 2638077 - DNA, 23 bp, Homo sapiens
atttgtactgaaaaatggtaatt

SEQ ID NO: 2638078 - DNA, 15 bp, Homo sapiens
atttgtcaacaaagt

SEQ ID NO: 2638079 - DNA, 14 bp, Homo sapiens
atttgtcaatgaca

SEQ ID NO: 2638080 - DNA, 15 bp, Homo sapiens
atttgtctttcagga

SEQ ID NO: 2638081 - DNA, 20 bp, Homo sapiens
atttgtgactaattgtataa

SEQ ID NO: 2638082 - DNA, 15 bp, Homo sapiens
atttgtgatacaatg

SEQ ID NO: 2638083 - DNA, 13 bp, Homo sapiens
atttgtgtaatag

SEQ ID NO: 2638084 - DNA, 12 bp, Homo sapiens
atttgtgtgtgt

SEQ ID NO: 2638085 - DNA, 20 bp, Homo sapiens
atttgtgttttaatttaaac

SEQ ID NO: 2638086 - DNA, 21 bp, Homo sapiens
atttgtgttttaatttaaaca

SEQ ID NO: 2638087 - DNA, 17 bp, Homo sapiens
atttgttattttcagta

SEQ ID NO: 2638088 - DNA, 12 bp, Homo sapiens
atttgtttaaaa

SEQ ID NO: 2638089 - DNA, 14 bp, Homo sapiens
atttgttttcatgg

SEQ ID NO: 2638090 - DNA, 15 bp, Homo sapiens
atttgttttcatggt

SEQ ID NO: 2638091 - DNA, 18 bp, Homo sapiens
atttgttttgacggatga

SEQ ID NO: 2638092 - DNA, 19 bp, Homo sapiens
attttaaaaagatttgttt

SEQ ID NO: 2638093 - DNA, 21 bp, Homo sapiens
attttaaaaagtcttcactct

SEQ ID NO: 2638094 - DNA, 14 bp, Homo sapiens
attttaaaaatgaa

SEQ ID NO: 2638095 - DNA, 18 bp, Homo sapiens
attttaaaattttatctc

SEQ ID NO: 2638096 - DNA, 13 bp, Homo sapiens
attttaaacaaag

SEQ ID NO: 2638097 - DNA, 14 bp, Homo sapiens
attttaaataaaag

SEQ ID NO: 2638098 - DNA, 21 bp, Homo sapiens
attttaaataaaagtgatcaa

SEQ ID NO: 2638099 - DNA, 16 bp, Homo sapiens
attttaacaaaagcaa

SEQ ID NO: 2638100 - DNA, 15 bp, Homo sapiens
attttaacaataact

SEQ ID NO: 2638101 - DNA, 14 bp, Homo sapiens
attttaactctgtc

SEQ ID NO: 2638102 - DNA, 15 bp, Homo sapiens
attttaactctgtct

SEQ ID NO: 2638103 - DNA, 16 bp, Homo sapiens
attttaactctgtctt

SEQ ID NO: 2638104 - DNA, 20 bp, Homo sapiens
attttaagacgtgtttgtgt

SEQ ID NO: 2638105 - DNA, 12 bp, Homo sapiens
attttaagtgct

SEQ ID NO: 2638106 - DNA, 17 bp, Homo sapiens
attttaagtgctttgta

SEQ ID NO: 2638107 - DNA, 18 bp, Homo sapiens
attttaagtgctttgtaa

SEQ ID NO: 2638108 - DNA, 20 bp, Homo sapiens
attttaagtgctttgtaatg

SEQ ID NO: 2638109 - DNA, 23 bp, Homo sapiens
attttaatgaagaaagtggaaaa

SEQ ID NO: 2638110 - DNA, 21 bp, Homo sapiens
attttaatgcacctgaatgtt

SEQ ID NO: 2638111 - DNA, 16 bp, Homo sapiens
attttacttttataat

SEQ ID NO: 2638112 - DNA, 19 bp, Homo sapiens
cacactcactcctgagacc

SEQ ID NO: 2638113 - DNA, 15 bp, Homo sapiens
cacactccatcagct

SEQ ID NO: 2638114 - DNA, 17 bp, Homo sapiens
cacactccatcagctta

SEQ ID NO: 2638115 - DNA, 16 bp, Homo sapiens
cacactcgcccgccca

SEQ ID NO: 2638116 - DNA, 17 bp, Homo sapiens
cacactgaggcagggaa

SEQ ID NO: 2638117 - DNA, 20 bp, Homo sapiens
cacactggactccggccctc

SEQ ID NO: 2638118 - DNA, 20 bp, Homo sapiens
cacacttcctgtccagagag

SEQ ID NO: 2638119 - DNA, 22 bp, Homo sapiens
cacacttctgtgagacccccac

SEQ ID NO: 2638120 - DNA, 22 bp, Homo sapiens
cacacttggttgggtcctcaca

SEQ ID NO: 2638121 - DNA, 18 bp, Homo sapiens
cacacttgttccagctct

SEQ ID NO: 2638122 - DNA, 17 bp, Homo sapiens
cacactttttaagaaat

SEQ ID NO: 2638123 - DNA, 13 bp, Homo sapiens
cacagaaaatata

SEQ ID NO: 2638124 - DNA, 19 bp, Homo sapiens
cacagaaaatatactgtaa

SEQ ID NO: 2638125 - DNA, 20 bp, Homo sapiens
cacagaaaatatactgtaaa

SEQ ID NO: 2638126 - DNA, 18 bp, Homo sapiens
cacagaaacacaatattt

SEQ ID NO: 2638127 - DNA, 15 bp, Homo sapiens
cacagaaagactgag

SEQ ID NO: 2638128 - DNA, 23 bp, Homo sapiens
cacagaagccaggagcaaatgtt

SEQ ID NO: 2638129 - DNA, 12 bp, Homo sapiens
cacagacacaca

SEQ ID NO: 2638130 - DNA, 13 bp, Homo sapiens
cacagacacacac

SEQ ID NO: 2638131 - DNA, 17 bp, Homo sapiens
cacagacacacacacgc

SEQ ID NO: 2638132 - DNA, 18 bp, Homo sapiens
cacagacatactaaccag

SEQ ID NO: 2638133 - DNA, 19 bp, Homo sapiens
cacagacatactaaccagc

SEQ ID NO: 2638134 - DNA, 17 bp, Homo sapiens
cacagaccctgccctgt

SEQ ID NO: 2638135 - DNA, 19 bp, Homo sapiens
cacagaccctgccctgtgg

SEQ ID NO: 2638136 - DNA, 22 bp, Homo sapiens
cacagaccctgccctgtgggcc

SEQ ID NO: 2638137 - DNA, 15 bp, Homo sapiens
cacagacctggagcc

SEQ ID NO: 2638138 - DNA, 19 bp, Homo sapiens
cacagagaaagtacttctc

SEQ ID NO: 2638139 - DNA, 21 bp, Homo sapiens
cacagagaaagtacttctcca

SEQ ID NO: 2638140 - DNA, 16 bp, Homo sapiens
cacagagacattcctc

SEQ ID NO: 2638141 - DNA, 21 bp, Homo sapiens
cacagagacattcctccgagc

SEQ ID NO: 2638142 - DNA, 14 bp, Homo sapiens
cacagagagagtca

SEQ ID NO: 2638143 - DNA, 19 bp, Homo sapiens
cacagagagtcccactgcc

SEQ ID NO: 2638144 - DNA, 14 bp, Homo sapiens
cacagagctctcca

SEQ ID NO: 2638145 - DNA, 18 bp, Homo sapiens
cacagagctctccagctc

SEQ ID NO: 2638146 - DNA, 18 bp, Homo sapiens
cacagagtggtctttctg

SEQ ID NO: 2638147 - DNA, 14 bp, Homo sapiens
cacagatcacagct

SEQ ID NO: 2638148 - DNA, 17 bp, Homo sapiens
cacagatggatttgcct

SEQ ID NO: 2638149 - DNA, 16 bp, Homo sapiens
cacagcagctgaacag

SEQ ID NO: 2638150 - DNA, 13 bp, Homo sapiens
cacagcagcttca

SEQ ID NO: 2638151 - DNA, 19 bp, Homo sapiens
cacagcagttgaaaagact

SEQ ID NO: 2638152 - DNA, 14 bp, Homo sapiens
cacagccaaggact

SEQ ID NO: 2638153 - DNA, 19 bp, Homo sapiens
cacagccacacacacagaa

SEQ ID NO: 2638154 - DNA, 17 bp, Homo sapiens
cacagccagactggcac

SEQ ID NO: 2638155 - DNA, 18 bp, Homo sapiens
cacagccagactggcaca

SEQ ID NO: 2638156 - DNA, 20 bp, Homo sapiens
cacagccatcccagccttgg

SEQ ID NO: 2638157 - DNA, 19 bp, Homo sapiens
cacagcccaaagaaggaaa

SEQ ID NO: 2638158 - DNA, 13 bp, Homo sapiens
cacagccctgtca

SEQ ID NO: 2638159 - DNA, 14 bp, Homo sapiens
cacagccctgtcag

SEQ ID NO: 2638160 - DNA, 21 bp, Homo sapiens
cacagccctgtcagtgcagcc

SEQ ID NO: 2638161 - DNA, 23 bp, Homo sapiens
cacagccctgtcagtgcagcccg

SEQ ID NO: 2638162 - DNA, 14 bp, Homo sapiens
cacagcctcctctg

SEQ ID NO: 2638163 - DNA, 23 bp, Homo sapiens
cacagcctcctctgtctgccctt

SEQ ID NO: 2638164 - DNA, 16 bp, Homo sapiens
cacagcggcccctgca

SEQ ID NO: 2638165 - DNA, 19 bp, Homo sapiens
cacagcgtcctgtccacac

SEQ ID NO: 2638166 - DNA, 15 bp, Homo sapiens
cacagctacctcttc

SEQ ID NO: 2638167 - DNA, 10 bp, Homo sapiens
cacagctcct

SEQ ID NO: 2638168 - DNA, 18 bp, Homo sapiens
cacagctctgtcctggga

SEQ ID NO: 2638169 - DNA, 20 bp, Homo sapiens
cacagctctgtcctgggagt

SEQ ID NO: 2638170 - DNA, 15 bp, Homo sapiens
cacagctcttctcca

SEQ ID NO: 2638171 - DNA, 15 bp, Homo sapiens
cacagctgctggaga

SEQ ID NO: 2638172 - DNA, 20 bp, Homo sapiens
cacagctgctttctgttgtc

SEQ ID NO: 2638173 - DNA, 14 bp, Homo sapiens
cacagctggcctcc

SEQ ID NO: 2638174 - DNA, 14 bp, Homo sapiens
cacagctgggctgt

SEQ ID NO: 2638175 - DNA, 14 bp, Homo sapiens
cacagcttcagcca

SEQ ID NO: 2638176 - DNA, 19 bp, Homo sapiens
cacagcttcagccaggagc

SEQ ID NO: 2638177 - DNA, 22 bp, Homo sapiens
cacagcttcagccaggagctgg

SEQ ID NO: 2638178 - DNA, 21 bp, Homo sapiens
cacagcttcatttcctgtgtc

SEQ ID NO: 2638179 - DNA, 22 bp, Homo sapiens
cacagcttcccctctctcctcc

SEQ ID NO: 2638180 - DNA, 15 bp, Homo sapiens
cacaggactctgcct

SEQ ID NO: 2638181 - DNA, 16 bp, Homo sapiens
cacaggactctgcctc

SEQ ID NO: 2638182 - DNA, 15 bp, Homo sapiens
cacaggatcagtctg

SEQ ID NO: 2638183 - DNA, 16 bp, Homo sapiens
cacaggatcagtctga

SEQ ID NO: 2638184 - DNA, 17 bp, Homo sapiens
cacaggatcagtctgat

SEQ ID NO: 2638185 - DNA, 16 bp, Homo sapiens
cacaggatgaaggcaa

SEQ ID NO: 2638186 - DNA, 20 bp, Homo sapiens
cacaggcaaaatccttgctt

SEQ ID NO: 2638187 - DNA, 22 bp, Homo sapiens
cacaggcaactgaggcagacag

SEQ ID NO: 2638188 - DNA, 14 bp, Homo sapiens
cacaggcagcattt

SEQ ID NO: 2638189 - DNA, 15 bp, Homo sapiens
cacaggcagcattta

SEQ ID NO: 2638190 - DNA, 12 bp, Homo sapiens
cacaggcagctt

SEQ ID NO: 2638191 - DNA, 14 bp, Homo sapiens
cacaggcaggtcca

SEQ ID NO: 2638192 - DNA, 21 bp, Homo sapiens
cacaggcccccttgagtgggg

SEQ ID NO: 2638193 - DNA, 14 bp, Homo sapiens
cacaggcccggctc

SEQ ID NO: 2638194 - DNA, 19 bp, Homo sapiens
cacaggcccggctccaggc

SEQ ID NO: 2638195 - DNA, 22 bp, Homo sapiens
cacagggactgaaaacctctcc

SEQ ID NO: 2638196 - DNA, 13 bp, Homo sapiens
cacagggcagagc

SEQ ID NO: 2638197 - DNA, 14 bp, Homo sapiens
cacagggcagagcc

SEQ ID NO: 2638198 - DNA, 17 bp, Homo sapiens
cacagggcagctgggcc

SEQ ID NO: 2638199 - DNA, 21 bp, Homo sapiens
cacagggcagctgggcccaac

SEQ ID NO: 2638200 - DNA, 14 bp, Homo sapiens
cacagggccccaga

SEQ ID NO: 2638201 - DNA, 19 bp, Homo sapiens
cacagtattacttctgcta

SEQ ID NO: 2638202 - DNA, 13 bp, Homo sapiens
cacagtccttacc

SEQ ID NO: 2638203 - DNA, 22 bp, Homo sapiens
cacagtctctttaatcttcagt

SEQ ID NO: 2638204 - DNA, 17 bp, Homo sapiens
cacagtgaaggctgtcc

SEQ ID NO: 2638205 - DNA, 22 bp, Homo sapiens
cacagtggaaagacagcttctc

SEQ ID NO: 2638206 - DNA, 19 bp, Homo sapiens
cacagtgggagccagggct

SEQ ID NO: 2638207 - DNA, 17 bp, Homo sapiens
cacagtggtggcagggc

SEQ ID NO: 2638208 - DNA, 23 bp, Homo sapiens
cacagtggtggcagggcctagct

SEQ ID NO: 2638209 - DNA, 14 bp, Homo sapiens
cacagtgttgccca

SEQ ID NO: 2638210 - DNA, 16 bp, Homo sapiens
cacagtgtttttgtaa

SEQ ID NO: 2638211 - DNA, 23 bp, Homo sapiens
cacagtgtttttgtaaagtgtgg

SEQ ID NO: 2638212 - DNA, 17 bp, Homo sapiens
cacagttcaattctcat

SEQ ID NO: 2638213 - DNA, 20 bp, Homo sapiens
cacagttcagtggcagggct

SEQ ID NO: 2638214 - DNA, 21 bp, Homo sapiens
cacagttcagtggcagggctc

SEQ ID NO: 2638215 - DNA, 23 bp, Homo sapiens
cacagttggccttcagaaccatc

SEQ ID NO: 2638216 - DNA, 22 bp, Homo sapiens
cacagttggctggatgaaattt

SEQ ID NO: 2638217 - DNA, 12 bp, Homo sapiens
cacagtttgaac

SEQ ID NO: 2638218 - DNA, 14 bp, Homo sapiens
cacagttttctgag

SEQ ID NO: 2638219 - DNA, 19 bp, Homo sapiens
cacagttttggttgcttta

SEQ ID NO: 2638220 - DNA, 16 bp, Homo sapiens
cacatagctgtctaga

SEQ ID NO: 2638221 - DNA, 12 bp, Homo sapiens
cacatatctgtc

SEQ ID NO: 2638222 - DNA, 14 bp, Homo sapiens
cacatatctgtcat

SEQ ID NO: 2638223 - DNA, 19 bp, Homo sapiens
cacatatgcaccttgtgtc

SEQ ID NO: 2638224 - DNA, 20 bp, Homo sapiens
cacatatgcaccttgtgtct

SEQ ID NO: 2638225 - DNA, 20 bp, Homo sapiens
cacatattgatttccgttaa

SEQ ID NO: 2638226 - DNA, 19 bp, Homo sapiens
cacatcacccttaccatgt

SEQ ID NO: 2638227 - DNA, 20 bp, Homo sapiens
cacatcagcacgatttctgt

SEQ ID NO: 2638228 - DNA, 21 bp, Homo sapiens
cacatcagcacgatttctgtt

SEQ ID NO: 2638229 - DNA, 17 bp, Homo sapiens
cacatcagtcacaagtt

SEQ ID NO: 2638230 - DNA, 21 bp, Homo sapiens
cacatccacacacgcaggaac

SEQ ID NO: 2638231 - DNA, 23 bp, Homo sapiens
cacatccatttcatctatttctg

SEQ ID NO: 2638232 - DNA, 22 bp, Homo sapiens
cacatcccaggcttcaccctga

SEQ ID NO: 2638233 - DNA, 19 bp, Homo sapiens
cacatcctatgcaatatat

SEQ ID NO: 2638234 - DNA, 18 bp, Homo sapiens
cacatcctccgtccagcc

SEQ ID NO: 2638235 - DNA, 22 bp, Homo sapiens
cacatctcctccatactcagga

SEQ ID NO: 2638236 - DNA, 18 bp, Homo sapiens
cacatcttgctctgctga

SEQ ID NO: 2638237 - DNA, 22 bp, Homo sapiens
cacatcttgctctgctgacaga

SEQ ID NO: 2638238 - DNA, 23 bp, Homo sapiens
cacatcttgctctgctgacagac

SEQ ID NO: 2638239 - DNA, 15 bp, Homo sapiens
cacatctttatctgt

SEQ ID NO: 2638240 - DNA, 18 bp, Homo sapiens
cacatctttcacacttcc

SEQ ID NO: 2638241 - DNA, 15 bp, Homo sapiens
cacatctttcctgtc

SEQ ID NO: 2638242 - DNA, 21 bp, Homo sapiens
cacatgagatctaggtgagga

SEQ ID NO: 2638243 - DNA, 20 bp, Homo sapiens
cacatgagcatcaggccagg

SEQ ID NO: 2638244 - DNA, 18 bp, Homo sapiens
cacatgagctatttccat

SEQ ID NO: 2638245 - DNA, 18 bp, Homo sapiens
cacatgcatacacacaca

SEQ ID NO: 2638246 - DNA, 22 bp, Homo sapiens
cacatgctcaatgactctctgg

SEQ ID NO: 2638247 - DNA, 18 bp, Homo sapiens
cacatggctatgttttag

SEQ ID NO: 2638248 - DNA, 12 bp, Homo sapiens
cacatggcttcc

SEQ ID NO: 2638249 - DNA, 20 bp, Homo sapiens
cacatggcttcctcctgcgc

SEQ ID NO: 2638250 - DNA, 12 bp, Homo sapiens
cacatgtcaccg

SEQ ID NO: 2638251 - DNA, 15 bp, Homo sapiens
caatgggcactggga

SEQ ID NO: 2638252 - DNA, 22 bp, Homo sapiens
caatggtgttgccctgagtgga

SEQ ID NO: 2638253 - DNA, 13 bp, Homo sapiens
caatggtttgcaa

SEQ ID NO: 2638254 - DNA, 16 bp, Homo sapiens
caatggtttgcaagga

SEQ ID NO: 2638255 - DNA, 18 bp, Homo sapiens
caatgtatttatttaaaa

SEQ ID NO: 2638256 - DNA, 20 bp, Homo sapiens
caatgtatttatttaaaaga

SEQ ID NO: 2638257 - DNA, 14 bp, Homo sapiens
caatgtcacttaaa

SEQ ID NO: 2638258 - DNA, 14 bp, Homo sapiens
caatgtcaggaaca

SEQ ID NO: 2638259 - DNA, 19 bp, Homo sapiens
caatgtcaggaacagaagg

SEQ ID NO: 2638260 - DNA, 21 bp, Homo sapiens
caatgtcaggaacagaaggat

SEQ ID NO: 2638261 - DNA, 21 bp, Homo sapiens
caatgtcttgatgcatgcact

SEQ ID NO: 2638262 - DNA, 23 bp, Homo sapiens
caatgtcttgatgcatgcactgt

SEQ ID NO: 2638263 - DNA, 22 bp, Homo sapiens
caatgtgaaaagaaaaatgagc

SEQ ID NO: 2638264 - DNA, 13 bp, Homo sapiens
caatgtgaccagg

SEQ ID NO: 2638265 - DNA, 15 bp, Homo sapiens
caatgtgataaaacc

SEQ ID NO: 2638266 - DNA, 11 bp, Homo sapiens
caatgttaagg

SEQ ID NO: 2638267 - DNA, 14 bp, Homo sapiens
caatgttaaggaaa

SEQ ID NO: 2638268 - DNA, 18 bp, Homo sapiens
caatgttaaggaaactct

SEQ ID NO: 2638269 - DNA, 24 bp, Homo sapiens
caatgttaaggaaactcttatctc

SEQ ID NO: 2638270 - DNA, 14 bp, Homo sapiens
caatgttcattgta

SEQ ID NO: 2638271 - DNA, 15 bp, Homo sapiens
caatgttcattgtaa

SEQ ID NO: 2638272 - DNA, 22 bp, Homo sapiens
caatgttcattgtaatgttact

SEQ ID NO: 2638273 - DNA, 23 bp, Homo sapiens
caatgttcattgtaatgttactg

SEQ ID NO: 2638274 - DNA, 14 bp, Homo sapiens
caatgttctctctt

SEQ ID NO: 2638275 - DNA, 23 bp, Homo sapiens
caatgtttatgcaaggaaggaaa

SEQ ID NO: 2638276 - DNA, 13 bp, Homo sapiens
caattaaacggat

SEQ ID NO: 2638277 - DNA, 17 bp, Homo sapiens
caattaaacggattatt

SEQ ID NO: 2638278 - DNA, 14 bp, Homo sapiens
caattaaatgtagg

SEQ ID NO: 2638279 - DNA, 23 bp, Homo sapiens
caattaaggattttatgctttaa

SEQ ID NO: 2638280 - DNA, 16 bp, Homo sapiens
caattagggcctagcc

SEQ ID NO: 2638281 - DNA, 14 bp, Homo sapiens
caattcaacactcc

SEQ ID NO: 2638282 - DNA, 20 bp, Homo sapiens
caattcacatctaacctcat

SEQ ID NO: 2638283 - DNA, 21 bp, Homo sapiens
caattcagtgctgtacttgat

SEQ ID NO: 2638284 - DNA, 13 bp, Homo sapiens
caattcatgaact

SEQ ID NO: 2638285 - DNA, 21 bp, Homo sapiens
caattccgtagccagctgctc

SEQ ID NO: 2638286 - DNA, 15 bp, Homo sapiens
caattcctctgggaa

SEQ ID NO: 2638287 - DNA, 16 bp, Homo sapiens
caattcctgggcccca

SEQ ID NO: 2638288 - DNA, 22 bp, Homo sapiens
caattctgttttaggttaaaaa

SEQ ID NO: 2638289 - DNA, 19 bp, Homo sapiens
caattcttacaaacatgtg

SEQ ID NO: 2638290 - DNA, 13 bp, Homo sapiens
caattctttatac

SEQ ID NO: 2638291 - DNA, 18 bp, Homo sapiens
caattgaacttaaataaa

SEQ ID NO: 2638292 - DNA, 21 bp, Homo sapiens
caattgaattaaattaggaat

SEQ ID NO: 2638293 - DNA, 22 bp, Homo sapiens
caattgtttggggttgaaaatt

SEQ ID NO: 2638294 - DNA, 18 bp, Homo sapiens
caatttaaacccatttta

SEQ ID NO: 2638295 - DNA, 20 bp, Homo sapiens
caatttaaacccattttagt

SEQ ID NO: 2638296 - DNA, 14 bp, Homo sapiens
caatttatgaattg

SEQ ID NO: 2638297 - DNA, 14 bp, Homo sapiens
caatttattcaaga

SEQ ID NO: 2638298 - DNA, 11 bp, Homo sapiens
caatttcaagt

SEQ ID NO: 2638299 - DNA, 15 bp, Homo sapiens
caatttcctttatat

SEQ ID NO: 2638300 - DNA, 20 bp, Homo sapiens
caatttcctttatatttagt

SEQ ID NO: 2638301 - DNA, 20 bp, Homo sapiens
caatttctacaaaatcctga

SEQ ID NO: 2638302 - DNA, 16 bp, Homo sapiens
caatttctactttgaa

SEQ ID NO: 2638303 - DNA, 18 bp, Homo sapiens
caatttgggagatatatt

SEQ ID NO: 2638304 - DNA, 19 bp, Homo sapiens
caatttgggagatatattt

SEQ ID NO: 2638305 - DNA, 23 bp, Homo sapiens
caatttgtaaaaacagcattgct

SEQ ID NO: 2638306 - DNA, 19 bp, Homo sapiens
caattttctggaatacatg

SEQ ID NO: 2638307 - DNA, 22 bp, Homo sapiens
caatttttcttatttcatttct

SEQ ID NO: 2638308 - DNA, 14 bp, Homo sapiens
caatttttgccttc

SEQ ID NO: 2638309 - DNA, 22 bp, Homo sapiens
caatttttttaattttgtattt

SEQ ID NO: 2638310 - DNA, 15 bp, Homo sapiens
cacaaaatctgtcca

SEQ ID NO: 2638311 - DNA, 16 bp, Homo sapiens
cacaaaattgggaaag

SEQ ID NO: 2638312 - DNA, 15 bp, Homo sapiens
cacaaacctgcctgg

SEQ ID NO: 2638313 - DNA, 17 bp, Homo sapiens
cacaaacgggctcagca

SEQ ID NO: 2638314 - DNA, 23 bp, Homo sapiens
cacaaacgtttacttatcttatg

SEQ ID NO: 2638315 - DNA, 22 bp, Homo sapiens
cacaaagcacagtttgaacaaa

SEQ ID NO: 2638316 - DNA, 20 bp, Homo sapiens
cacaaagccttatcaagtgt

SEQ ID NO: 2638317 - DNA, 15 bp, Homo sapiens
cacaagaaatgaaag

SEQ ID NO: 2638318 - DNA, 12 bp, Homo sapiens
cacaagaaattt

SEQ ID NO: 2638319 - DNA, 14 bp, Homo sapiens
cacaagaaatttga

SEQ ID NO: 2638320 - DNA, 20 bp, Homo sapiens
cacaagaaatttgatttcta

SEQ ID NO: 2638321 - DNA, 19 bp, Homo sapiens
cacaagaagaccagactgt

SEQ ID NO: 2638322 - DNA, 14 bp, Homo sapiens
cacaagacccttgt

SEQ ID NO: 2638323 - DNA, 21 bp, Homo sapiens
cacaagctccaagctcccagg

SEQ ID NO: 2638324 - DNA, 23 bp, Homo sapiens
cacaagctccaagctcccaggca

SEQ ID NO: 2638325 - DNA, 17 bp, Homo sapiens
cacaagctgcaccctca

SEQ ID NO: 2638326 - DNA, 15 bp, Homo sapiens
cacaagctggaagca

SEQ ID NO: 2638327 - DNA, 16 bp, Homo sapiens
cacaagctggaagcac

SEQ ID NO: 2638328 - DNA, 14 bp, Homo sapiens
cacaaggctgacca

SEQ ID NO: 2638329 - DNA, 16 bp, Homo sapiens
cacaagtcctgtgaat

SEQ ID NO: 2638330 - DNA, 16 bp, Homo sapiens
cacaagtgaaaaacat

SEQ ID NO: 2638331 - DNA, 22 bp, Homo sapiens
cacaagtgccactgcccgagct

SEQ ID NO: 2638332 - DNA, 13 bp, Homo sapiens
cacaatacaataa

SEQ ID NO: 2638333 - DNA, 22 bp, Homo sapiens
cacaatcctaacacattatcgg

SEQ ID NO: 2638334 - DNA, 20 bp, Homo sapiens
cacaatcttaaggggcagct

SEQ ID NO: 2638335 - DNA, 13 bp, Homo sapiens
cacacaaaacaac

SEQ ID NO: 2638336 - DNA, 15 bp, Homo sapiens
cacacacacacacac

SEQ ID NO: 2638337 - DNA, 16 bp, Homo sapiens
cacacacacacacagc

SEQ ID NO: 2638338 - DNA, 14 bp, Homo sapiens
cacacacacacact

SEQ ID NO: 2638339 - DNA, 13 bp, Homo sapiens
cacacacacacag

SEQ ID NO: 2638340 - DNA, 14 bp, Homo sapiens
cacacacacacagg

SEQ ID NO: 2638341 - DNA, 11 bp, Homo sapiens
cacacacacag

SEQ ID NO: 2638342 - DNA, 12 bp, Homo sapiens
cacacacacaga

SEQ ID NO: 2638343 - DNA, 15 bp, Homo sapiens
cacacacacagaaaa

SEQ ID NO: 2638344 - DNA, 13 bp, Homo sapiens
cacacacacccac

SEQ ID NO: 2638345 - DNA, 14 bp, Homo sapiens
cacacacactcact

SEQ ID NO: 2638346 - DNA, 13 bp, Homo sapiens
cacacacactcta

SEQ ID NO: 2638347 - DNA, 11 bp, Homo sapiens
cacacacagaa

SEQ ID NO: 2638348 - DNA, 15 bp, Homo sapiens
cacacacagaaaata

SEQ ID NO: 2638349 - DNA, 21 bp, Homo sapiens
cacacacagaaaatatactgt

SEQ ID NO: 2638350 - DNA, 14 bp, Homo sapiens
cacacacagaggaa

SEQ ID NO: 2638351 - DNA, 12 bp, Homo sapiens
cacacacagcca

SEQ ID NO: 2638352 - DNA, 21 bp, Homo sapiens
cacacacaggcaactgaggca

SEQ ID NO: 2638353 - DNA, 18 bp, Homo sapiens
cacacacatgcatacaca

SEQ ID NO: 2638354 - DNA, 14 bp, Homo sapiens
cacacaccagagcc

SEQ ID NO: 2638355 - DNA, 19 bp, Homo sapiens
cacacacctgtagtcccag

SEQ ID NO: 2638356 - DNA, 18 bp, Homo sapiens
cacacacgcacgcacaca

SEQ ID NO: 2638357 - DNA, 21 bp, Homo sapiens
cacacactcgcccgcccactg

SEQ ID NO: 2638358 - DNA, 12 bp, Homo sapiens
cacacagaaaat

SEQ ID NO: 2638359 - DNA, 14 bp, Homo sapiens
cacacagaaaatat

SEQ ID NO: 2638360 - DNA, 18 bp, Homo sapiens
cacacagaaaatatactg

SEQ ID NO: 2638361 - DNA, 19 bp, Homo sapiens
cacacagaaaatatactgt

SEQ ID NO: 2638362 - DNA, 22 bp, Homo sapiens
cacacagaggaagagcaggcac

SEQ ID NO: 2638363 - DNA, 15 bp, Homo sapiens
cacacagccacacac

SEQ ID NO: 2638364 - DNA, 16 bp, Homo sapiens
cacacagccacacaca

SEQ ID NO: 2638365 - DNA, 20 bp, Homo sapiens
cacacagccacacacacaga

SEQ ID NO: 2638366 - DNA, 22 bp, Homo sapiens
cacacagccacacacacagaaa

SEQ ID NO: 2638367 - DNA, 13 bp, Homo sapiens
cacacagctccca

SEQ ID NO: 2638368 - DNA, 15 bp, Homo sapiens
cacacagctctgtcc

SEQ ID NO: 2638369 - DNA, 17 bp, Homo sapiens
cacacagctctgtcctg

SEQ ID NO: 2638370 - DNA, 20 bp, Homo sapiens
cacacagctctgtcctggga

SEQ ID NO: 2638371 - DNA, 18 bp, Homo sapiens
cacacagctgggctgtgg

SEQ ID NO: 2638372 - DNA, 19 bp, Homo sapiens
cacacaggacccccttccc

SEQ ID NO: 2638373 - DNA, 20 bp, Homo sapiens
cacacaggacccccttcccc

SEQ ID NO: 2638374 - DNA, 21 bp, Homo sapiens
cacacagtattaagtgacagt

SEQ ID NO: 2638375 - DNA, 20 bp, Homo sapiens
cacacagtattacttctgct

SEQ ID NO: 2638376 - DNA, 23 bp, Homo sapiens
cacacagtgagtcgaggacaggg

SEQ ID NO: 2638377 - DNA, 14 bp, Homo sapiens
cacacatacacaca

SEQ ID NO: 2638378 - DNA, 17 bp, Homo sapiens
cacacatgcatacacac

SEQ ID NO: 2638379 - DNA, 18 bp, Homo sapiens
cacacatttgtgtaaaca

SEQ ID NO: 2638380 - DNA, 19 bp, Homo sapiens
cacacattttttaaatgca

SEQ ID NO: 2638381 - DNA, 13 bp, Homo sapiens
cacaccagagccc

SEQ ID NO: 2638382 - DNA, 21 bp, Homo sapiens
cacacccaccgtccgccctgc

SEQ ID NO: 2638383 - DNA, 21 bp, Homo sapiens
attattacttatttttgacag

SEQ ID NO: 2638384 - DNA, 21 bp, Homo sapiens
attattagtaagaaaacatca

SEQ ID NO: 2638385 - DNA, 15 bp, Homo sapiens
attattagtactgct

SEQ ID NO: 2638386 - DNA, 15 bp, Homo sapiens
attattcagtgtcac

SEQ ID NO: 2638387 - DNA, 18 bp, Homo sapiens
attattcatttaaaatga

SEQ ID NO: 2638388 - DNA, 19 bp, Homo sapiens
attattcatttaaaatgat

SEQ ID NO: 2638389 - DNA, 20 bp, Homo sapiens
attattcatttaaaatgatt

SEQ ID NO: 2638390 - DNA, 15 bp, Homo sapiens
attattccagatctg

SEQ ID NO: 2638391 - DNA, 12 bp, Homo sapiens
attattccctct

SEQ ID NO: 2638392 - DNA, 12 bp, Homo sapiens
attattgaaatt

SEQ ID NO: 2638393 - DNA, 23 bp, Homo sapiens
attattgtgtgttatttaaatga

SEQ ID NO: 2638394 - DNA, 14 bp, Homo sapiens
attatttgaaaaca

SEQ ID NO: 2638395 - DNA, 23 bp, Homo sapiens
attatttgtgtaatagaaaactg

SEQ ID NO: 2638396 - DNA, 15 bp, Homo sapiens
attatttgtgtttta

SEQ ID NO: 2638397 - DNA, 16 bp, Homo sapiens
attattttttcagacc

SEQ ID NO: 2638398 - DNA, 17 bp, Homo sapiens
attattttttcagaccg

SEQ ID NO: 2638399 - DNA, 16 bp, Homo sapiens
attcaaaaagtgttta

SEQ ID NO: 2638400 - DNA, 17 bp, Homo sapiens
attcaaaaagtgtttat

SEQ ID NO: 2638401 - DNA, 22 bp, Homo sapiens
attcaaaattgacattgcttta

SEQ ID NO: 2638402 - DNA, 16 bp, Homo sapiens
attcaaacagtctcag

SEQ ID NO: 2638403 - DNA, 22 bp, Homo sapiens
attcaaccactgtaaaatgaaa

SEQ ID NO: 2638404 - DNA, 14 bp, Homo sapiens
attcaactaaaaaa

SEQ ID NO: 2638405 - DNA, 23 bp, Homo sapiens
attcaactaaaaaaaaaaaagta

SEQ ID NO: 2638406 - DNA, 21 bp, Homo sapiens
attcaaggcatttctatcaca

SEQ ID NO: 2638407 - DNA, 15 bp, Homo sapiens
attcaaggtggccaa

SEQ ID NO: 2638408 - DNA, 16 bp, Homo sapiens
attcaagtgtacagtg

SEQ ID NO: 2638409 - DNA, 16 bp, Homo sapiens
attcaagttattgtac

SEQ ID NO: 2638410 - DNA, 14 bp, Homo sapiens
attcaatctgtaaa

SEQ ID NO: 2638411 - DNA, 18 bp, Homo sapiens
attcaatctgtaaactgt

SEQ ID NO: 2638412 - DNA, 18 bp, Homo sapiens
attcaattcctctgggaa

SEQ ID NO: 2638413 - DNA, 22 bp, Homo sapiens
attcacaatgaaatgctctcct

SEQ ID NO: 2638414 - DNA, 14 bp, Homo sapiens
attcacccagacag

SEQ ID NO: 2638415 - DNA, 16 bp, Homo sapiens
attcacccccaaacag

SEQ ID NO: 2638416 - DNA, 16 bp, Homo sapiens
attcacttatatgttc

SEQ ID NO: 2638417 - DNA, 14 bp, Homo sapiens
attcacttgcattt

SEQ ID NO: 2638418 - DNA, 15 bp, Homo sapiens
attcagaaggggagg

SEQ ID NO: 2638419 - DNA, 13 bp, Homo sapiens
attcagacaagca

SEQ ID NO: 2638420 - DNA, 14 bp, Homo sapiens
attcagagagcagc

SEQ ID NO: 2638421 - DNA, 19 bp, Homo sapiens
attcagattttaaaaagtc

SEQ ID NO: 2638422 - DNA, 17 bp, Homo sapiens
attcagcggaatattga

SEQ ID NO: 2638423 - DNA, 12 bp, Homo sapiens
attcagcttcat

SEQ ID NO: 2638424 - DNA, 19 bp, Homo sapiens
attcaggaagctcagggcc

SEQ ID NO: 2638425 - DNA, 20 bp, Homo sapiens
attcaggaagctcagggcct

SEQ ID NO: 2638426 - DNA, 16 bp, Homo sapiens
attcaggctgcttggg

SEQ ID NO: 2638427 - DNA, 15 bp, Homo sapiens
attcagtaataactc

SEQ ID NO: 2638428 - DNA, 16 bp, Homo sapiens
attcagtgagggtctt

SEQ ID NO: 2638429 - DNA, 21 bp, Homo sapiens
attcagtgagggtcttcttac

SEQ ID NO: 2638430 - DNA, 20 bp, Homo sapiens
attcagtgctgtggcctggg

SEQ ID NO: 2638431 - DNA, 14 bp, Homo sapiens
attcagtgcttctt

SEQ ID NO: 2638432 - DNA, 19 bp, Homo sapiens
attcagtgcttcttaaaga

SEQ ID NO: 2638433 - DNA, 19 bp, Homo sapiens
attcagtgttaaatgtgat

SEQ ID NO: 2638434 - DNA, 17 bp, Homo sapiens
attcatattgaatataa

SEQ ID NO: 2638435 - DNA, 22 bp, Homo sapiens
attcatctctctttaatataaa

SEQ ID NO: 2638436 - DNA, 20 bp, Homo sapiens
attcatctgtttttcttttt

SEQ ID NO: 2638437 - DNA, 15 bp, Homo sapiens
attcatcttttgtat

SEQ ID NO: 2638438 - DNA, 16 bp, Homo sapiens
attcatgctactgcca

SEQ ID NO: 2638439 - DNA, 12 bp, Homo sapiens
attcatgtaaac

SEQ ID NO: 2638440 - DNA, 13 bp, Homo sapiens
attcatgtttctt

SEQ ID NO: 2638441 - DNA, 14 bp, Homo sapiens
attcattacagctt

SEQ ID NO: 2638442 - DNA, 17 bp, Homo sapiens
attcattccattctgga

SEQ ID NO: 2638443 - DNA, 18 bp, Homo sapiens
attcattccattctggaa

SEQ ID NO: 2638444 - DNA, 19 bp, Homo sapiens
attcattccattctggaag

SEQ ID NO: 2638445 - DNA, 20 bp, Homo sapiens
attcattgaagtcagatgtg

SEQ ID NO: 2638446 - DNA, 15 bp, Homo sapiens
attcatttaaaatga

SEQ ID NO: 2638447 - DNA, 17 bp, Homo sapiens
attcatttaaaatgatt

SEQ ID NO: 2638448 - DNA, 19 bp, Homo sapiens
attccaacaaagggtttta

SEQ ID NO: 2638449 - DNA, 15 bp, Homo sapiens
attccaaccccaact

SEQ ID NO: 2638450 - DNA, 18 bp, Homo sapiens
attccaatatgatgactc

SEQ ID NO: 2638451 - DNA, 16 bp, Homo sapiens
attccacctgcaatca

SEQ ID NO: 2638452 - DNA, 12 bp, Homo sapiens
attccactggac

SEQ ID NO: 2638453 - DNA, 18 bp, Homo sapiens
attccagagacatcagca

SEQ ID NO: 2638454 - DNA, 13 bp, Homo sapiens
attccatatttat

SEQ ID NO: 2638455 - DNA, 17 bp, Homo sapiens
attccatgaatgtatca

SEQ ID NO: 2638456 - DNA, 23 bp, Homo sapiens
attccatgaatgtatcaggaaat

SEQ ID NO: 2638457 - DNA, 22 bp, Homo sapiens
attcccaagctctagtgggaag

SEQ ID NO: 2638458 - DNA, 14 bp, Homo sapiens
attcccaagctctg

SEQ ID NO: 2638459 - DNA, 16 bp, Homo sapiens
attcccaagctctgct

SEQ ID NO: 2638460 - DNA, 17 bp, Homo sapiens
attcccaagctctgctc

SEQ ID NO: 2638461 - DNA, 19 bp, Homo sapiens
attcccaagctctgctcct

SEQ ID NO: 2638462 - DNA, 18 bp, Homo sapiens
attcccacacctccacag

SEQ ID NO: 2638463 - DNA, 14 bp, Homo sapiens
attcccaccaaggt

SEQ ID NO: 2638464 - DNA, 17 bp, Homo sapiens
attcccagagcaaaata

SEQ ID NO: 2638465 - DNA, 20 bp, Homo sapiens
attcccagggaagtgctctg

SEQ ID NO: 2638466 - DNA, 22 bp, Homo sapiens
attcccagggaagtgctctgat

SEQ ID NO: 2638467 - DNA, 20 bp, Homo sapiens
attccccagattgcaacagg

SEQ ID NO: 2638468 - DNA, 20 bp, Homo sapiens
attccccaggaggccagcct

SEQ ID NO: 2638469 - DNA, 22 bp, Homo sapiens
attccccaggaggccagccttg

SEQ ID NO: 2638470 - DNA, 13 bp, Homo sapiens
attccccattgcc

SEQ ID NO: 2638471 - DNA, 17 bp, Homo sapiens
attccctagaaacttcc

SEQ ID NO: 2638472 - DNA, 22 bp, Homo sapiens
attccctatcttttagttttag

SEQ ID NO: 2638473 - DNA, 13 bp, Homo sapiens
attccctctctct

SEQ ID NO: 2638474 - DNA, 14 bp, Homo sapiens
attccctctctctg

SEQ ID NO: 2638475 - DNA, 16 bp, Homo sapiens
attccctctctctgac

SEQ ID NO: 2638476 - DNA, 19 bp, Homo sapiens
attccctctctctgactct

SEQ ID NO: 2638477 - DNA, 19 bp, Homo sapiens
attccctgtacaatattta

SEQ ID NO: 2638478 - DNA, 15 bp, Homo sapiens
attcctaaactatct

SEQ ID NO: 2638479 - DNA, 20 bp, Homo sapiens
attcctaaactatctttttt

SEQ ID NO: 2638480 - DNA, 20 bp, Homo sapiens
attcctaacacagcatgtgt

SEQ ID NO: 2638481 - DNA, 18 bp, Homo sapiens
attcctacaaagatgttt

SEQ ID NO: 2638482 - DNA, 14 bp, Homo sapiens
attcctattgtgat

SEQ ID NO: 2638483 - DNA, 18 bp, Homo sapiens
attcctattgtgatttga

SEQ ID NO: 2638484 - DNA, 19 bp, Homo sapiens
attcctattgtgatttgac

SEQ ID NO: 2638485 - DNA, 20 bp, Homo sapiens
attcctctactaacaatcag

SEQ ID NO: 2638486 - DNA, 12 bp, Homo sapiens
attcctctggga

SEQ ID NO: 2638487 - DNA, 13 bp, Homo sapiens
attcctctgggaa

SEQ ID NO: 2638488 - DNA, 19 bp, Homo sapiens
attcctgaatgaaatatca

SEQ ID NO: 2638489 - DNA, 11 bp, Homo sapiens
attcctgaccc

SEQ ID NO: 2638490 - DNA, 15 bp, Homo sapiens
attcctgacccaggc

SEQ ID NO: 2638491 - DNA, 22 bp, Homo sapiens
attcctgacccaggccgcagct

SEQ ID NO: 2638492 - DNA, 20 bp, Homo sapiens
attcctgatatgatttaaaa

SEQ ID NO: 2638493 - DNA, 23 bp, Homo sapiens
attcctgatatgatttaaaacat

SEQ ID NO: 2638494 - DNA, 17 bp, Homo sapiens
attcctgggaaatattc

SEQ ID NO: 2638495 - DNA, 23 bp, Homo sapiens
attcctgtagcatcttctggagt

SEQ ID NO: 2638496 - DNA, 22 bp, Homo sapiens
attcctgtggatgtaaagtgat

SEQ ID NO: 2638497 - DNA, 23 bp, Homo sapiens
attccttagcttagacctcagcc

SEQ ID NO: 2638498 - DNA, 14 bp, Homo sapiens
attccttcagggtg

SEQ ID NO: 2638499 - DNA, 22 bp, Homo sapiens
attccttcagggtgatgccagg

SEQ ID NO: 2638500 - DNA, 20 bp, Homo sapiens
attccttggcatgccttcca

SEQ ID NO: 2638501 - DNA, 21 bp, Homo sapiens
attccttggcatgccttccag

SEQ ID NO: 2638502 - DNA, 12 bp, Homo sapiens
attccttgtgaa

SEQ ID NO: 2638503 - DNA, 17 bp, Homo sapiens
attcctttctatcattt

SEQ ID NO: 2638504 - DNA, 18 bp, Homo sapiens
attcctttgtgtttctat

SEQ ID NO: 2638505 - DNA, 19 bp, Homo sapiens
attcgcccaaagccagaca

SEQ ID NO: 2638506 - DNA, 17 bp, Homo sapiens
attctaaatgaatgttt

SEQ ID NO: 2638507 - DNA, 18 bp, Homo sapiens
attctaatgtcttcattt

SEQ ID NO: 2638508 - DNA, 13 bp, Homo sapiens
attctactttgag

SEQ ID NO: 2638509 - DNA, 16 bp, Homo sapiens
attctaggcatcccag

SEQ ID NO: 2638510 - DNA, 20 bp, Homo sapiens
attctaggcatcccagggga

SEQ ID NO: 2638511 - DNA, 16 bp, Homo sapiens
attctagttttgtcaa

SEQ ID NO: 2638512 - DNA, 18 bp, Homo sapiens
attctataagttttatgt

SEQ ID NO: 2638513 - DNA, 14 bp, Homo sapiens
attctattaacttt

SEQ ID NO: 2638514 - DNA, 18 bp, Homo sapiens
attctatttgctgggctt

SEQ ID NO: 2638515 - DNA, 21 bp, Homo sapiens
attctcaacctaccacccctt

SEQ ID NO: 2638516 - DNA, 15 bp, Homo sapiens
attctcaagccctgc

SEQ ID NO: 2638517 - DNA, 16 bp, Homo sapiens
attctcaccaggaagg

SEQ ID NO: 2638518 - DNA, 16 bp, Homo sapiens
attctcagggtctctg

SEQ ID NO: 2638519 - DNA, 22 bp, Homo sapiens
attctcagggtctctgctgccg

SEQ ID NO: 2638520 - DNA, 17 bp, Homo sapiens
attctccacctgccagg

SEQ ID NO: 2638521 - DNA, 20 bp, Homo sapiens
attctccacctgccagggac

SEQ ID NO: 2638522 - DNA, 11 bp, Homo sapiens
attctcctgcc

SEQ ID NO: 2638523 - DNA, 17 bp, Homo sapiens
attctcctgcctcagcc

SEQ ID NO: 2638524 - DNA, 19 bp, Homo sapiens
attctcctgcctcagcctc

SEQ ID NO: 2638525 - DNA, 13 bp, Homo sapiens
attctcctgtgct

SEQ ID NO: 2638526 - DNA, 22 bp, Homo sapiens
attctccttgtgttactaagtt

SEQ ID NO: 2638527 - DNA, 17 bp, Homo sapiens
attctctagtttgatta

SEQ ID NO: 2638528 - DNA, 18 bp, Homo sapiens
attctctagtttgattaa

SEQ ID NO: 2638529 - DNA, 16 bp, Homo sapiens
attctctcctgtacct

SEQ ID NO: 2638530 - DNA, 14 bp, Homo sapiens
attctctgtctcat

SEQ ID NO: 2638531 - DNA, 17 bp, Homo sapiens
attctctgtctcatcca

SEQ ID NO: 2638532 - DNA, 12 bp, Homo sapiens
attctcttatcc

SEQ ID NO: 2638533 - DNA, 14 bp, Homo sapiens
attctctttcaaag

SEQ ID NO: 2638534 - DNA, 21 bp, Homo sapiens
atgcctttgagacagtttctt

SEQ ID NO: 2638535 - DNA, 14 bp, Homo sapiens
atgccttttatttc

SEQ ID NO: 2638536 - DNA, 19 bp, Homo sapiens
atgcgagtgctcatttcag

SEQ ID NO: 2638537 - DNA, 16 bp, Homo sapiens
atgcggcccaggatgg

SEQ ID NO: 2638538 - DNA, 20 bp, Homo sapiens
atgcggcccaggatggcttt

SEQ ID NO: 2638539 - DNA, 16 bp, Homo sapiens
atgcgtgtttctgact

SEQ ID NO: 2638540 - DNA, 14 bp, Homo sapiens
atgctaaaccttag

SEQ ID NO: 2638541 - DNA, 23 bp, Homo sapiens
atgctaaaccttagtactgagtt

SEQ ID NO: 2638542 - DNA, 13 bp, Homo sapiens
atgctaagtgaaa

SEQ ID NO: 2638543 - DNA, 23 bp, Homo sapiens
atgctaccttgtgacccagcact

SEQ ID NO: 2638544 - DNA, 17 bp, Homo sapiens
atgctacgtgtgatttt

SEQ ID NO: 2638545 - DNA, 23 bp, Homo sapiens
atgctactgtctcactgaaacat

SEQ ID NO: 2638546 - DNA, 22 bp, Homo sapiens
atgctactttatttatacactg

SEQ ID NO: 2638547 - DNA, 15 bp, Homo sapiens
atgctcaagtttttc

SEQ ID NO: 2638548 - DNA, 16 bp, Homo sapiens
atgctcaagtttttca

SEQ ID NO: 2638549 - DNA, 20 bp, Homo sapiens
atgctcaagtttttcagaaa

SEQ ID NO: 2638550 - DNA, 17 bp, Homo sapiens
atgctcagaccagctct

SEQ ID NO: 2638551 - DNA, 17 bp, Homo sapiens
atgctccagccaacccc

SEQ ID NO: 2638552 - DNA, 18 bp, Homo sapiens
atgctcccccatcctccc

SEQ ID NO: 2638553 - DNA, 20 bp, Homo sapiens
atgctcccccatcctcccct

SEQ ID NO: 2638554 - DNA, 14 bp, Homo sapiens
atgctccctcccct

SEQ ID NO: 2638555 - DNA, 18 bp, Homo sapiens
atgctccctcccctgccc

SEQ ID NO: 2638556 - DNA, 19 bp, Homo sapiens
atgctccctcccctgccct

SEQ ID NO: 2638557 - DNA, 14 bp, Homo sapiens
atgctcctggccca

SEQ ID NO: 2638558 - DNA, 16 bp, Homo sapiens
atgctccttgggccct

SEQ ID NO: 2638559 - DNA, 15 bp, Homo sapiens
atgctctgcatgtta

SEQ ID NO: 2638560 - DNA, 19 bp, Homo sapiens
atgctctgcatgttacata

SEQ ID NO: 2638561 - DNA, 17 bp, Homo sapiens
atgctgaacattgcata

SEQ ID NO: 2638562 - DNA, 23 bp, Homo sapiens
atgctgaacattgcatataactt

SEQ ID NO: 2638563 - DNA, 14 bp, Homo sapiens
atgctgatgtcctc

SEQ ID NO: 2638564 - DNA, 18 bp, Homo sapiens
atgctgatgttcagtgta

SEQ ID NO: 2638565 - DNA, 20 bp, Homo sapiens
atgctgatgttcagtgtaat

SEQ ID NO: 2638566 - DNA, 24 bp, Homo sapiens
atgctgatgttcagtgtaatttct

SEQ ID NO: 2638567 - DNA, 17 bp, Homo sapiens
atgctgcccatgccacc

SEQ ID NO: 2638568 - DNA, 12 bp, Homo sapiens
atgctgcctcca

SEQ ID NO: 2638569 - DNA, 12 bp, Homo sapiens
atgctgcctgag

SEQ ID NO: 2638570 - DNA, 17 bp, Homo sapiens
atgctgcctgcctgtct

SEQ ID NO: 2638571 - DNA, 19 bp, Homo sapiens
atgctgctaattcaaagct

SEQ ID NO: 2638572 - DNA, 23 bp, Homo sapiens
atgctgctcatccccacctgtct

SEQ ID NO: 2638573 - DNA, 13 bp, Homo sapiens
atgctgctttccc

SEQ ID NO: 2638574 - DNA, 21 bp, Homo sapiens
atgctggacggcattcctgct

SEQ ID NO: 2638575 - DNA, 13 bp, Homo sapiens
atgctggagaggt

SEQ ID NO: 2638576 - DNA, 19 bp, Homo sapiens
atgctggatgtctgccaat

SEQ ID NO: 2638577 - DNA, 19 bp, Homo sapiens
atgctggctgttggctggg

SEQ ID NO: 2638578 - DNA, 22 bp, Homo sapiens
atgctggggcaagtccctgact

SEQ ID NO: 2638579 - DNA, 23 bp, Homo sapiens
atgctgggttggtgcacagtgat

SEQ ID NO: 2638580 - DNA, 22 bp, Homo sapiens
atgctggttttcctaaatgcag

SEQ ID NO: 2638581 - DNA, 13 bp, Homo sapiens
atgctggtttttc

SEQ ID NO: 2638582 - DNA, 22 bp, Homo sapiens
atgctgtaactttctgaaataa

SEQ ID NO: 2638583 - DNA, 14 bp, Homo sapiens
atgctgtatatgtt

SEQ ID NO: 2638584 - DNA, 19 bp, Homo sapiens
atgctgtattcttctttgg

SEQ ID NO: 2638585 - DNA, 20 bp, Homo sapiens
atgctgtcaactatgatatg

SEQ ID NO: 2638586 - DNA, 22 bp, Homo sapiens
atgctgtcaactatgatatggt

SEQ ID NO: 2638587 - DNA, 14 bp, Homo sapiens
atgctgtgtgactc

SEQ ID NO: 2638588 - DNA, 15 bp, Homo sapiens
atgcttagtaatgct

SEQ ID NO: 2638589 - DNA, 21 bp, Homo sapiens
atgcttagtccctcatgcaaa

SEQ ID NO: 2638590 - DNA, 19 bp, Homo sapiens
atgcttatcatctaaagat

SEQ ID NO: 2638591 - DNA, 16 bp, Homo sapiens
atgcttattttaaaat

SEQ ID NO: 2638592 - DNA, 21 bp, Homo sapiens
atgcttattttaaaattttat

SEQ ID NO: 2638593 - DNA, 21 bp, Homo sapiens
atgcttcctagaagttactga

SEQ ID NO: 2638594 - DNA, 16 bp, Homo sapiens
atgcttcctgacaatc

SEQ ID NO: 2638595 - DNA, 17 bp, Homo sapiens
atgcttctgacttcata

SEQ ID NO: 2638596 - DNA, 14 bp, Homo sapiens
atgcttcttcagag

SEQ ID NO: 2638597 - DNA, 12 bp, Homo sapiens
atgcttgaaaaa

SEQ ID NO: 2638598 - DNA, 15 bp, Homo sapiens
atgcttgaaaaatgt

SEQ ID NO: 2638599 - DNA, 23 bp, Homo sapiens
atgcttgcctagggcctggtcca

SEQ ID NO: 2638600 - DNA, 13 bp, Homo sapiens
atgcttgtacata

SEQ ID NO: 2638601 - DNA, 14 bp, Homo sapiens
atgcttgtacataa

SEQ ID NO: 2638602 - DNA, 21 bp, Homo sapiens
atgctttgaagtacaattgtg

SEQ ID NO: 2638603 - DNA, 16 bp, Homo sapiens
atgctttttgaatgtt

SEQ ID NO: 2638604 - DNA, 14 bp, Homo sapiens
atggaaaaggaaga

SEQ ID NO: 2638605 - DNA, 20 bp, Homo sapiens
atggaaaaggaagactagag

SEQ ID NO: 2638606 - DNA, 16 bp, Homo sapiens
atggaaacctgaaaaa

SEQ ID NO: 2638607 - DNA, 13 bp, Homo sapiens
atggaaacggtga

SEQ ID NO: 2638608 - DNA, 14 bp, Homo sapiens
atggaaactgaatg

SEQ ID NO: 2638609 - DNA, 20 bp, Homo sapiens
atggaaatgggcagagcaga

SEQ ID NO: 2638610 - DNA, 23 bp, Homo sapiens
atggaacccttttggcccccgag

SEQ ID NO: 2638611 - DNA, 17 bp, Homo sapiens
atggaaccgcaggaagc

SEQ ID NO: 2638612 - DNA, 14 bp, Homo sapiens
atggaacctccttt

SEQ ID NO: 2638613 - DNA, 16 bp, Homo sapiens
atggaagggtttgtgg

SEQ ID NO: 2638614 - DNA, 15 bp, Homo sapiens
atggaatacagtgtt

SEQ ID NO: 2638615 - DNA, 15 bp, Homo sapiens
atggaatgcttgaaa

SEQ ID NO: 2638616 - DNA, 16 bp, Homo sapiens
atggaatggttataaa

SEQ ID NO: 2638617 - DNA, 17 bp, Homo sapiens
atggaatttctcccagt

SEQ ID NO: 2638618 - DNA, 14 bp, Homo sapiens
atggacatgatctt

SEQ ID NO: 2638619 - DNA, 19 bp, Homo sapiens
atggacatgatcttcttta

SEQ ID NO: 2638620 - DNA, 18 bp, Homo sapiens
atggacccaatgcacaca

SEQ ID NO: 2638621 - DNA, 13 bp, Homo sapiens
atggacggtgctc

SEQ ID NO: 2638622 - DNA, 15 bp, Homo sapiens
atggacggtgctcca

SEQ ID NO: 2638623 - DNA, 17 bp, Homo sapiens
atggacggtgctccagg

SEQ ID NO: 2638624 - DNA, 20 bp, Homo sapiens
atggacggtgctccaggcag

SEQ ID NO: 2638625 - DNA, 22 bp, Homo sapiens
atggagaagcagaaatacatat

SEQ ID NO: 2638626 - DNA, 20 bp, Homo sapiens
atggagactcctgccctgtt

SEQ ID NO: 2638627 - DNA, 14 bp, Homo sapiens
atggagagagggga

SEQ ID NO: 2638628 - DNA, 16 bp, Homo sapiens
atggagccccagcccc

SEQ ID NO: 2638629 - DNA, 22 bp, Homo sapiens
atggagctcagagagggcaggc

SEQ ID NO: 2638630 - DNA, 13 bp, Homo sapiens
atggaggaatatg

SEQ ID NO: 2638631 - DNA, 16 bp, Homo sapiens
atggatcctggaggat

SEQ ID NO: 2638632 - DNA, 13 bp, Homo sapiens
atggatgattcag

SEQ ID NO: 2638633 - DNA, 14 bp, Homo sapiens
atggattctcagat

SEQ ID NO: 2638634 - DNA, 18 bp, Homo sapiens
atggatttccagccaaag

SEQ ID NO: 2638635 - DNA, 21 bp, Homo sapiens
atggattttctattgttactc

SEQ ID NO: 2638636 - DNA, 13 bp, Homo sapiens
atggcacccagtg

SEQ ID NO: 2638637 - DNA, 21 bp, Homo sapiens
atggcaccttcagactttgct

SEQ ID NO: 2638638 - DNA, 16 bp, Homo sapiens
atggcacttgcatctg

SEQ ID NO: 2638639 - DNA, 16 bp, Homo sapiens
atggcagaagacacca

SEQ ID NO: 2638640 - DNA, 17 bp, Homo sapiens
atggcagaagacaccag

SEQ ID NO: 2638641 - DNA, 21 bp, Homo sapiens
atggcagaagacaccagagca

SEQ ID NO: 2638642 - DNA, 15 bp, Homo sapiens
atggcagaaggcaaa

SEQ ID NO: 2638643 - DNA, 22 bp, Homo sapiens
atggcagagtttgtgtgttgtc

SEQ ID NO: 2638644 - DNA, 16 bp, Homo sapiens
atggcaggatggcctg

SEQ ID NO: 2638645 - DNA, 17 bp, Homo sapiens
atggcaggatggcctgg

SEQ ID NO: 2638646 - DNA, 18 bp, Homo sapiens
atggcagtgttcctattt

SEQ ID NO: 2638647 - DNA, 17 bp, Homo sapiens
atggccaccttttcagc

SEQ ID NO: 2638648 - DNA, 16 bp, Homo sapiens
atggccagtgtctgtc

SEQ ID NO: 2638649 - DNA, 22 bp, Homo sapiens
atggccagtgtctgtcccgggg

SEQ ID NO: 2638650 - DNA, 11 bp, Homo sapiens
atggccctggg

SEQ ID NO: 2638651 - DNA, 14 bp, Homo sapiens
atggcctcagctgc

SEQ ID NO: 2638652 - DNA, 15 bp, Homo sapiens
atggcctcagctgcc

SEQ ID NO: 2638653 - DNA, 21 bp, Homo sapiens
atggcctcagctgcctcactt

SEQ ID NO: 2638654 - DNA, 18 bp, Homo sapiens
atggcctcttcagatctc

SEQ ID NO: 2638655 - DNA, 12 bp, Homo sapiens
atggcctggcca

SEQ ID NO: 2638656 - DNA, 16 bp, Homo sapiens
atggcctgggggatgt

SEQ ID NO: 2638657 - DNA, 19 bp, Homo sapiens
atggccttgcagcactcac

SEQ ID NO: 2638658 - DNA, 14 bp, Homo sapiens
atggcgcagtgcct

SEQ ID NO: 2638659 - DNA, 18 bp, Homo sapiens
atggcgcagtgcctctgg

SEQ ID NO: 2638660 - DNA, 20 bp, Homo sapiens
atggcgtgtccctctcggaa

SEQ ID NO: 2638661 - DNA, 19 bp, Homo sapiens
atggctaagcaaaatgtga

SEQ ID NO: 2638662 - DNA, 22 bp, Homo sapiens
atggctagaatatcctacttct

SEQ ID NO: 2638663 - DNA, 15 bp, Homo sapiens
atggctataggtgct

SEQ ID NO: 2638664 - DNA, 16 bp, Homo sapiens
atggctataggtgcta

SEQ ID NO: 2638665 - DNA, 23 bp, Homo sapiens
atggctataggtgctacaaaaac

SEQ ID NO: 2638666 - DNA, 19 bp, Homo sapiens
atggctatatggcaagaaa

SEQ ID NO: 2638667 - DNA, 18 bp, Homo sapiens
atggctcactatggtgcc

SEQ ID NO: 2638668 - DNA, 15 bp, Homo sapiens
atggctccagaaatg

SEQ ID NO: 2638669 - DNA, 22 bp, Homo sapiens
atggctgctgaagctgcctgct

SEQ ID NO: 2638670 - DNA, 13 bp, Homo sapiens
atgtcagtatgtg

SEQ ID NO: 2638671 - DNA, 16 bp, Homo sapiens
atgtcagtatgtggaa

SEQ ID NO: 2638672 - DNA, 14 bp, Homo sapiens
atgtcatcatacat

SEQ ID NO: 2638673 - DNA, 21 bp, Homo sapiens
atgtcatgtgtacaaaagttt

SEQ ID NO: 2638674 - DNA, 23 bp, Homo sapiens
atgtccaagaagcccaggaaagg

SEQ ID NO: 2638675 - DNA, 20 bp, Homo sapiens
atgtccacagatgcctccac

SEQ ID NO: 2638676 - DNA, 17 bp, Homo sapiens
atgtccactgtgtatag

SEQ ID NO: 2638677 - DNA, 22 bp, Homo sapiens
atgtccagaagaatattcagga

SEQ ID NO: 2638678 - DNA, 20 bp, Homo sapiens
atgtcccaacttgtaaaaat

SEQ ID NO: 2638679 - DNA, 21 bp, Homo sapiens
atgtccctacacccctcccct

SEQ ID NO: 2638680 - DNA, 19 bp, Homo sapiens
atgtcctaaggacacacta

SEQ ID NO: 2638681 - DNA, 19 bp, Homo sapiens
atgtcctatattggctaaa

SEQ ID NO: 2638682 - DNA, 18 bp, Homo sapiens
atgtcctccagaagcctc

SEQ ID NO: 2638683 - DNA, 20 bp, Homo sapiens
atgtcctccagaagcctctg

SEQ ID NO: 2638684 - DNA, 13 bp, Homo sapiens
atgtcctgtaaag

SEQ ID NO: 2638685 - DNA, 14 bp, Homo sapiens
atgtcctgtaaagg

SEQ ID NO: 2638686 - DNA, 14 bp, Homo sapiens
atgtcgcctctgca

SEQ ID NO: 2638687 - DNA, 13 bp, Homo sapiens
atgtcggcctcta

SEQ ID NO: 2638688 - DNA, 22 bp, Homo sapiens
atgtctataatcccagcacttt

SEQ ID NO: 2638689 - DNA, 14 bp, Homo sapiens
atgtctattcagct

SEQ ID NO: 2638690 - DNA, 14 bp, Homo sapiens
atgtctatttaagc

SEQ ID NO: 2638691 - DNA, 16 bp, Homo sapiens
atgtctcgtggtagga

SEQ ID NO: 2638692 - DNA, 14 bp, Homo sapiens
atgtctgccaattt

SEQ ID NO: 2638693 - DNA, 21 bp, Homo sapiens
atgtctgccaatttttgcctt

SEQ ID NO: 2638694 - DNA, 18 bp, Homo sapiens
atcttccagaagtgtgat

SEQ ID NO: 2638695 - DNA, 24 bp, Homo sapiens
atcttctcagaaggcaaatgactt

SEQ ID NO: 2638696 - DNA, 16 bp, Homo sapiens
atcttctcagctccca

SEQ ID NO: 2638697 - DNA, 21 bp, Homo sapiens
atcttctcagctcccatttct

SEQ ID NO: 2638698 - DNA, 15 bp, Homo sapiens
atcttctccaggatg

SEQ ID NO: 2638699 - DNA, 17 bp, Homo sapiens
atcttctgcaattgctt

SEQ ID NO: 2638700 - DNA, 14 bp, Homo sapiens
atcttctgccttct

SEQ ID NO: 2638701 - DNA, 20 bp, Homo sapiens
atcttcttatgcaatttcct

SEQ ID NO: 2638702 - DNA, 14 bp, Homo sapiens
atcttctttataat

SEQ ID NO: 2638703 - DNA, 17 bp, Homo sapiens
atcttgaaatgaaagta

SEQ ID NO: 2638704 - DNA, 21 bp, Homo sapiens
atcgtgacgctgaataaatgt

SEQ ID NO: 2638705 - DNA, 22 bp, Homo sapiens
atcgtgacgctgaataaatgtc

SEQ ID NO: 2638706 - DNA, 15 bp, Homo sapiens
atcgttatgtgtgta

SEQ ID NO: 2638707 - DNA, 22 bp, Homo sapiens
atctaaactggattcacagctc

SEQ ID NO: 2638708 - DNA, 13 bp, Homo sapiens
atctaaatggaac

SEQ ID NO: 2638709 - DNA, 18 bp, Homo sapiens
atctaaatggaaccactc

SEQ ID NO: 2638710 - DNA, 19 bp, Homo sapiens
atctaaatggaaccactct

SEQ ID NO: 2638711 - DNA, 14 bp, Homo sapiens
atctaaccacatca

SEQ ID NO: 2638712 - DNA, 15 bp, Homo sapiens
atctaacctcatctt

SEQ ID NO: 2638713 - DNA, 18 bp, Homo sapiens
atctaagcctttccataa

SEQ ID NO: 2638714 - DNA, 15 bp, Homo sapiens
atctaatacctctgt

SEQ ID NO: 2638715 - DNA, 19 bp, Homo sapiens
atctaatacctctgtgtgc

SEQ ID NO: 2638716 - DNA, 22 bp, Homo sapiens
atctaatacctctgtgtgctcc

SEQ ID NO: 2638717 - DNA, 20 bp, Homo sapiens
atctacatcttttttcacaa

SEQ ID NO: 2638718 - DNA, 21 bp, Homo sapiens
atctacatcttttttcacaaa

SEQ ID NO: 2638719 - DNA, 12 bp, Homo sapiens
atctagaagact

SEQ ID NO: 2638720 - DNA, 20 bp, Homo sapiens
atctagagcttgatgccagt

SEQ ID NO: 2638721 - DNA, 14 bp, Homo sapiens
atctagcaaatgtt

SEQ ID NO: 2638722 - DNA, 22 bp, Homo sapiens
atctaggaagactttggaaaga

SEQ ID NO: 2638723 - DNA, 23 bp, Homo sapiens
atctaggaagactttggaaagag

SEQ ID NO: 2638724 - DNA, 16 bp, Homo sapiens
atctaggtttaactca

SEQ ID NO: 2638725 - DNA, 17 bp, Homo sapiens
atctaggtttaactcag

SEQ ID NO: 2638726 - DNA, 15 bp, Homo sapiens
atctagtgcagctga

SEQ ID NO: 2638727 - DNA, 17 bp, Homo sapiens
atctagtgcagctgatt

SEQ ID NO: 2638728 - DNA, 18 bp, Homo sapiens
atctagtgcagctgattt

SEQ ID NO: 2638729 - DNA, 19 bp, Homo sapiens
atctagtgcagctgatttt

SEQ ID NO: 2638730 - DNA, 16 bp, Homo sapiens
atctataaagaagaac

SEQ ID NO: 2638731 - DNA, 19 bp, Homo sapiens
atctatatataattctgta

SEQ ID NO: 2638732 - DNA, 15 bp, Homo sapiens
atctatatatgtgta

SEQ ID NO: 2638733 - DNA, 17 bp, Homo sapiens
atctatatatgtgtatg

SEQ ID NO: 2638734 - DNA, 19 bp, Homo sapiens
atctatatatgtgtatgta

SEQ ID NO: 2638735 - DNA, 16 bp, Homo sapiens
atctatatgtacttgt

SEQ ID NO: 2638736 - DNA, 17 bp, Homo sapiens
atctatcaatagtcaag

SEQ ID NO: 2638737 - DNA, 18 bp, Homo sapiens
atctatgaagtatataat

SEQ ID NO: 2638738 - DNA, 17 bp, Homo sapiens
atctattcagacaagca

SEQ ID NO: 2638739 - DNA, 14 bp, Homo sapiens
atctatttctgaga

SEQ ID NO: 2638740 - DNA, 23 bp, Homo sapiens
atctatttttggcagtctgaatt

SEQ ID NO: 2638741 - DNA, 14 bp, Homo sapiens
atctcaaaaaataa

SEQ ID NO: 2638742 - DNA, 20 bp, Homo sapiens
atctcaaaactgcactgtca

SEQ ID NO: 2638743 - DNA, 23 bp, Homo sapiens
atctcaaataactaaaaggtatg

SEQ ID NO: 2638744 - DNA, 19 bp, Homo sapiens
atctcaaattctcaaccta

SEQ ID NO: 2638745 - DNA, 16 bp, Homo sapiens
atctcaaatttctaaa

SEQ ID NO: 2638746 - DNA, 17 bp, Homo sapiens
atctcaaatttctaaat

SEQ ID NO: 2638747 - DNA, 14 bp, Homo sapiens
atctcaattcttcc

SEQ ID NO: 2638748 - DNA, 16 bp, Homo sapiens
atctcaattcttccct

SEQ ID NO: 2638749 - DNA, 13 bp, Homo sapiens
atctcaccccatc

SEQ ID NO: 2638750 - DNA, 16 bp, Homo sapiens
atctcaccccatccca

SEQ ID NO: 2638751 - DNA, 19 bp, Homo sapiens
atctcacttttctccatga

SEQ ID NO: 2638752 - DNA, 14 bp, Homo sapiens
atctcaggccacct

SEQ ID NO: 2638753 - DNA, 17 bp, Homo sapiens
atctcaggccacctgcc

SEQ ID NO: 2638754 - DNA, 15 bp, Homo sapiens
atctcaggggccaga

SEQ ID NO: 2638755 - DNA, 16 bp, Homo sapiens
atctcaggttctcctt

SEQ ID NO: 2638756 - DNA, 20 bp, Homo sapiens
atctcagtcatgcataaata

SEQ ID NO: 2638757 - DNA, 23 bp, Homo sapiens
atctcataggttgccaataatac

SEQ ID NO: 2638758 - DNA, 19 bp, Homo sapiens
atctcatgtatcatctgga

SEQ ID NO: 2638759 - DNA, 14 bp, Homo sapiens
atctcattggaccc

SEQ ID NO: 2638760 - DNA, 20 bp, Homo sapiens
atctcattggacccttccat

SEQ ID NO: 2638761 - DNA, 20 bp, Homo sapiens
atctccaaaataaaactttt

SEQ ID NO: 2638762 - DNA, 13 bp, Homo sapiens
atctccaagaatg

SEQ ID NO: 2638763 - DNA, 18 bp, Homo sapiens
atctccaagaatgctgaa

SEQ ID NO: 2638764 - DNA, 20 bp, Homo sapiens
atctccaagaatgctgaaac

SEQ ID NO: 2638765 - DNA, 21 bp, Homo sapiens
atctccacccccagctgcttg

SEQ ID NO: 2638766 - DNA, 19 bp, Homo sapiens
atctccacctgctcccagg

SEQ ID NO: 2638767 - DNA, 15 bp, Homo sapiens
atctccactccagat

SEQ ID NO: 2638768 - DNA, 20 bp, Homo sapiens
atctccaggattgaagagca

SEQ ID NO: 2638769 - DNA, 21 bp, Homo sapiens
atctccagggagtcccctccc

SEQ ID NO: 2638770 - DNA, 15 bp, Homo sapiens
atctccagtattctt

SEQ ID NO: 2638771 - DNA, 19 bp, Homo sapiens
atctcccagataatgtgaa

SEQ ID NO: 2638772 - DNA, 15 bp, Homo sapiens
atctcccccagcccc

SEQ ID NO: 2638773 - DNA, 14 bp, Homo sapiens
atctcctgtgcatg

SEQ ID NO: 2638774 - DNA, 15 bp, Homo sapiens
atctcctgtgcatgg

SEQ ID NO: 2638775 - DNA, 13 bp, Homo sapiens
atctctaatatgg

SEQ ID NO: 2638776 - DNA, 15 bp, Homo sapiens
atctctaattggaag

SEQ ID NO: 2638777 - DNA, 15 bp, Homo sapiens
atctctagaatttta

SEQ ID NO: 2638778 - DNA, 16 bp, Homo sapiens
atctctagaattttaa

SEQ ID NO: 2638779 - DNA, 19 bp, Homo sapiens
atctctatttaatatttat

SEQ ID NO: 2638780 - DNA, 17 bp, Homo sapiens
atctctcagaagggagg

SEQ ID NO: 2638781 - DNA, 13 bp, Homo sapiens
atctctcaggagc

SEQ ID NO: 2638782 - DNA, 18 bp, Homo sapiens
atctctcaggagcacagg

SEQ ID NO: 2638783 - DNA, 23 bp, Homo sapiens
atctctccctcccctgccatttt

SEQ ID NO: 2638784 - DNA, 23 bp, Homo sapiens
atctctctgtgctgtggaagcaa

SEQ ID NO: 2638785 - DNA, 19 bp, Homo sapiens
atctctgaagcatgtttca

SEQ ID NO: 2638786 - DNA, 23 bp, Homo sapiens
atctctgcaccctggggcctgga

SEQ ID NO: 2638787 - DNA, 20 bp, Homo sapiens
atctcttcttttggcttcca

SEQ ID NO: 2638788 - DNA, 15 bp, Homo sapiens
atctcttgagcctgg

SEQ ID NO: 2638789 - DNA, 15 bp, Homo sapiens
atctctttgaatttt

SEQ ID NO: 2638790 - DNA, 16 bp, Homo sapiens
atctgacatccccact

SEQ ID NO: 2638791 - DNA, 20 bp, Homo sapiens
atctgacatctctgcaatct

SEQ ID NO: 2638792 - DNA, 17 bp, Homo sapiens
atctgagcaagagctgg

SEQ ID NO: 2638793 - DNA, 20 bp, Homo sapiens
atctgagggaggaggccacc

SEQ ID NO: 2638794 - DNA, 21 bp, Homo sapiens
atctgagggaggaggccacct

SEQ ID NO: 2638795 - DNA, 22 bp, Homo sapiens
atctgagggaggaggccacctc

SEQ ID NO: 2638796 - DNA, 17 bp, Homo sapiens
atctgatggcttctcca

SEQ ID NO: 2638797 - DNA, 17 bp, Homo sapiens
atctgcacccccctggg

SEQ ID NO: 2638798 - DNA, 13 bp, Homo sapiens
atctgcccagggg

SEQ ID NO: 2638799 - DNA, 16 bp, Homo sapiens
atctgcgtgacaataa

SEQ ID NO: 2638800 - DNA, 17 bp, Homo sapiens
atctgcgtgacaataaa

SEQ ID NO: 2638801 - DNA, 22 bp, Homo sapiens
atctgcgtgacaataaaacatt

SEQ ID NO: 2638802 - DNA, 23 bp, Homo sapiens
atctgcgtgacaataaaacatta

SEQ ID NO: 2638803 - DNA, 14 bp, Homo sapiens
atctgctaataaaa

SEQ ID NO: 2638804 - DNA, 15 bp, Homo sapiens
atctgctcagcagct

SEQ ID NO: 2638805 - DNA, 22 bp, Homo sapiens
atctgctgtccagacagcctgt

SEQ ID NO: 2638806 - DNA, 23 bp, Homo sapiens
atctgctgtccagacagcctgta

SEQ ID NO: 2638807 - DNA, 21 bp, Homo sapiens
atctgcttacaattccctgct

SEQ ID NO: 2638808 - DNA, 19 bp, Homo sapiens
atctggaccccatctgtga

SEQ ID NO: 2638809 - DNA, 17 bp, Homo sapiens
atctggactcctctgtc

SEQ ID NO: 2638810 - DNA, 19 bp, Homo sapiens
atctggactcctctgtcca

SEQ ID NO: 2638811 - DNA, 20 bp, Homo sapiens
atctggataggagcctgctg

SEQ ID NO: 2638812 - DNA, 21 bp, Homo sapiens
atctggataggagcctgctgg

SEQ ID NO: 2638813 - DNA, 16 bp, Homo sapiens
atctggcaacatcttt

SEQ ID NO: 2638814 - DNA, 23 bp, Homo sapiens
atctggccgttgatgttggctgg

SEQ ID NO: 2638815 - DNA, 20 bp, Homo sapiens
atctgggagtccccttttct

SEQ ID NO: 2638816 - DNA, 15 bp, Homo sapiens
atctgggtagctgta

SEQ ID NO: 2638817 - DNA, 17 bp, Homo sapiens
atctggtcccttgcagc

SEQ ID NO: 2638818 - DNA, 17 bp, Homo sapiens
atctggtgactttcctc

SEQ ID NO: 2638819 - DNA, 13 bp, Homo sapiens
atctgtaaactgt

SEQ ID NO: 2638820 - DNA, 22 bp, Homo sapiens
atctgtaaactgtgtattccaa

SEQ ID NO: 2638821 - DNA, 13 bp, Homo sapiens
atctgtacaatga

SEQ ID NO: 2638822 - DNA, 16 bp, Homo sapiens
atctgtacctctgcct

SEQ ID NO: 2638823 - DNA, 15 bp, Homo sapiens
atctgtacgtaagaa

SEQ ID NO: 2638824 - DNA, 18 bp, Homo sapiens
atctgtagggctggacct

SEQ ID NO: 2638825 - DNA, 17 bp, Homo sapiens
atctgtatataaaatat

SEQ ID NO: 2638826 - DNA, 23 bp, Homo sapiens
atctgtcaagtgggatctgtcac

SEQ ID NO: 2638827 - DNA, 12 bp, Homo sapiens
atctgtcatttg

SEQ ID NO: 2638828 - DNA, 22 bp, Homo sapiens
atctgtcatttgagcagggctc

SEQ ID NO: 2638829 - DNA, 18 bp, Homo sapiens
atctgtccaaaggaggct

SEQ ID NO: 2638830 - DNA, 17 bp, Homo sapiens
atctgtgaaaggaaaga

SEQ ID NO: 2638831 - DNA, 12 bp, Homo sapiens
atctgtgaataa

SEQ ID NO: 2638832 - DNA, 12 bp, Homo sapiens
atctgtgcccca

SEQ ID NO: 2638833 - DNA, 19 bp, Homo sapiens
atctgtgctttccagctca

SEQ ID NO: 2638834 - DNA, 22 bp, Homo sapiens
atctgtgggcatggtcaaaggc

SEQ ID NO: 2638835 - DNA, 17 bp, Homo sapiens
atctgtgtacaaagaaa

SEQ ID NO: 2638836 - DNA, 18 bp, Homo sapiens
atctgtgtacaaagaaat

SEQ ID NO: 2638837 - DNA, 22 bp, Homo sapiens
atctgtgtacaaagaaataaca

SEQ ID NO: 2638838 - DNA, 15 bp, Homo sapiens
atctgttgttttgtt

SEQ ID NO: 2638839 - DNA, 14 bp, Homo sapiens
atctgtttcccagc

SEQ ID NO: 2638840 - DNA, 18 bp, Homo sapiens
atctgtttttaaaaatca

SEQ ID NO: 2638841 - DNA, 16 bp, Homo sapiens
atcttaattattgtac

SEQ ID NO: 2638842 - DNA, 13 bp, Homo sapiens
atcttaattttgg

SEQ ID NO: 2638843 - DNA, 23 bp, Homo sapiens
atcttaattttggttgtattctt

SEQ ID NO: 2638844 - DNA, 14 bp, Homo sapiens
atcttactgaaggt

SEQ ID NO: 2638845 - DNA, 18 bp, Homo sapiens
atcttagtgcctgagagt

SEQ ID NO: 2638846 - DNA, 16 bp, Homo sapiens
atcttattttcatgta

SEQ ID NO: 2638847 - DNA, 22 bp, Homo sapiens
atcttcaccagaggaatcactc

SEQ ID NO: 2638848 - DNA, 13 bp, Homo sapiens
atcttcacttcta

SEQ ID NO: 2638849 - DNA, 23 bp, Homo sapiens
atcttcacttctaaatgcatatc

SEQ ID NO: 2638850 - DNA, 12 bp, Homo sapiens
atcttcagcttc

SEQ ID NO: 2638851 - DNA, 13 bp, Homo sapiens
atcttcagcttct

SEQ ID NO: 2638852 - DNA, 20 bp, Homo sapiens
atcttcagttttatctttaa

SEQ ID NO: 2638853 - DNA, 22 bp, Homo sapiens
atcttcagttttatctttaatc

SEQ ID NO: 2638854 - DNA, 19 bp, Homo sapiens
atcatggaatggttataaa

SEQ ID NO: 2638855 - DNA, 20 bp, Homo sapiens
atcatggattcattacagct

SEQ ID NO: 2638856 - DNA, 14 bp, Homo sapiens
atcatggtgtaata

SEQ ID NO: 2638857 - DNA, 20 bp, Homo sapiens
atcatggtgtaataagacat

SEQ ID NO: 2638858 - DNA, 19 bp, Homo sapiens
atcatgtagtatcaaatat

SEQ ID NO: 2638859 - DNA, 20 bp, Homo sapiens
atcatgtccccaaacctgca

SEQ ID NO: 2638860 - DNA, 14 bp, Homo sapiens
atcatgtctggcta

SEQ ID NO: 2638861 - DNA, 19 bp, Homo sapiens
atcatgtgtaatcaataaa

SEQ ID NO: 2638862 - DNA, 20 bp, Homo sapiens
atcatgtgtaatcaataaac

SEQ ID NO: 2638863 - DNA, 16 bp, Homo sapiens
atcattatgtaatgtc

SEQ ID NO: 2638864 - DNA, 12 bp, Homo sapiens
atcattctctgt

SEQ ID NO: 2638865 - DNA, 24 bp, Homo sapiens
atcattctctgtctcatccatcat

SEQ ID NO: 2638866 - DNA, 20 bp, Homo sapiens
atcattcttatttcatgaaa

SEQ ID NO: 2638867 - DNA, 18 bp, Homo sapiens
atcattgattgtcagcta

SEQ ID NO: 2638868 - DNA, 21 bp, Homo sapiens
atcattgcactctagcctggg

SEQ ID NO: 2638869 - DNA, 18 bp, Homo sapiens
atcattgctttgaagcag

SEQ ID NO: 2638870 - DNA, 23 bp, Homo sapiens
atcattgctttgaagcagttgtg

SEQ ID NO: 2638871 - DNA, 19 bp, Homo sapiens
atcatttattttttacatt

SEQ ID NO: 2638872 - DNA, 20 bp, Homo sapiens
atcatttctgcatcagctgc

SEQ ID NO: 2638873 - DNA, 18 bp, Homo sapiens
atcatttcttgggccctc

SEQ ID NO: 2638874 - DNA, 22 bp, Homo sapiens
atcatttcttgggccctcctga

SEQ ID NO: 2638875 - DNA, 12 bp, Homo sapiens
atcatttgttca

SEQ ID NO: 2638876 - DNA, 14 bp, Homo sapiens
atcattttcccccc

SEQ ID NO: 2638877 - DNA, 15 bp, Homo sapiens
atcattttcccccca

SEQ ID NO: 2638878 - DNA, 17 bp, Homo sapiens
atcattttgcattcaaa

SEQ ID NO: 2638879 - DNA, 19 bp, Homo sapiens
atcattttgcctcttttct

SEQ ID NO: 2638880 - DNA, 14 bp, Homo sapiens
atcatttttgtaca

SEQ ID NO: 2638881 - DNA, 18 bp, Homo sapiens
atccaactaatgccttac

SEQ ID NO: 2638882 - DNA, 21 bp, Homo sapiens
atccaagctggtcccactcag

SEQ ID NO: 2638883 - DNA, 13 bp, Homo sapiens
atccaaggagaaa

SEQ ID NO: 2638884 - DNA, 17 bp, Homo sapiens
atccaatcctcactggg

SEQ ID NO: 2638885 - DNA, 15 bp, Homo sapiens
atccacacacagagg

SEQ ID NO: 2638886 - DNA, 19 bp, Homo sapiens
atccacacacgcaggaact

SEQ ID NO: 2638887 - DNA, 13 bp, Homo sapiens
atccacagagagt

SEQ ID NO: 2638888 - DNA, 18 bp, Homo sapiens
atccacattgttttaaaa

SEQ ID NO: 2638889 - DNA, 14 bp, Homo sapiens
atccaccacctccc

SEQ ID NO: 2638890 - DNA, 14 bp, Homo sapiens
atccacctccttct

SEQ ID NO: 2638891 - DNA, 22 bp, Homo sapiens
atccactctaccctcccacccc

SEQ ID NO: 2638892 - DNA, 20 bp, Homo sapiens
atccagaattgaccttttga

SEQ ID NO: 2638893 - DNA, 19 bp, Homo sapiens
atccagccggaggccagag

SEQ ID NO: 2638894 - DNA, 14 bp, Homo sapiens
atccagcctctccc

SEQ ID NO: 2638895 - DNA, 14 bp, Homo sapiens
atccagctggtgag

SEQ ID NO: 2638896 - DNA, 16 bp, Homo sapiens
atccaggttcagcttg

SEQ ID NO: 2638897 - DNA, 16 bp, Homo sapiens
atccagtgatccttac

SEQ ID NO: 2638898 - DNA, 16 bp, Homo sapiens
atccagttcatgagaa

SEQ ID NO: 2638899 - DNA, 14 bp, Homo sapiens
atccataaagaagc

SEQ ID NO: 2638900 - DNA, 14 bp, Homo sapiens
atccatgtactgta

SEQ ID NO: 2638901 - DNA, 22 bp, Homo sapiens
atccatgtactgtagtttttct

SEQ ID NO: 2638902 - DNA, 14 bp, Homo sapiens
atccattatcatgt

SEQ ID NO: 2638903 - DNA, 16 bp, Homo sapiens
atccattatcatgtgt

SEQ ID NO: 2638904 - DNA, 17 bp, Homo sapiens
atccattatcatgtgta

SEQ ID NO: 2638905 - DNA, 21 bp, Homo sapiens
atccatttcatctatttctga

SEQ ID NO: 2638906 - DNA, 23 bp, Homo sapiens
atccatttcatctatttctgaga

SEQ ID NO: 2638907 - DNA, 21 bp, Homo sapiens
atcccaagatctgtgcagccc

SEQ ID NO: 2638908 - DNA, 15 bp, Homo sapiens
atcccaagtgccagt

SEQ ID NO: 2638909 - DNA, 20 bp, Homo sapiens
atcccacccacatgtgacac

SEQ ID NO: 2638910 - DNA, 23 bp, Homo sapiens
atcccacccacatgtgacacata

SEQ ID NO: 2638911 - DNA, 16 bp, Homo sapiens
atcccacgcactccat

SEQ ID NO: 2638912 - DNA, 17 bp, Homo sapiens
atcccacgcactccatg

SEQ ID NO: 2638913 - DNA, 18 bp, Homo sapiens
atcccacgcactccatga

SEQ ID NO: 2638914 - DNA, 20 bp, Homo sapiens
atcccagagggtgggcttca

SEQ ID NO: 2638915 - DNA, 12 bp, Homo sapiens
atcccagcccca

SEQ ID NO: 2638916 - DNA, 23 bp, Homo sapiens
atcccagccctttgggaggctga

SEQ ID NO: 2638917 - DNA, 20 bp, Homo sapiens
atcccagctacttgggaagc

SEQ ID NO: 2638918 - DNA, 22 bp, Homo sapiens
atcccagctacttgggaggctg

SEQ ID NO: 2638919 - DNA, 16 bp, Homo sapiens
atcccatgagcctcag

SEQ ID NO: 2638920 - DNA, 18 bp, Homo sapiens
atcccatgagcctcagca

SEQ ID NO: 2638921 - DNA, 14 bp, Homo sapiens
atcccatttaaaaa

SEQ ID NO: 2638922 - DNA, 15 bp, Homo sapiens
atcccatttaaaaaa

SEQ ID NO: 2638923 - DNA, 14 bp, Homo sapiens
atccccaagtgtga

SEQ ID NO: 2638924 - DNA, 11 bp, Homo sapiens
atccccaccct

SEQ ID NO: 2638925 - DNA, 16 bp, Homo sapiens
atccccaccctgggct

SEQ ID NO: 2638926 - DNA, 15 bp, Homo sapiens
atccccacctgtctt

SEQ ID NO: 2638927 - DNA, 12 bp, Homo sapiens
atcccccagact

SEQ ID NO: 2638928 - DNA, 12 bp, Homo sapiens
atcccccagcct

SEQ ID NO: 2638929 - DNA, 14 bp, Homo sapiens
atcccccttgccac

SEQ ID NO: 2638930 - DNA, 13 bp, Homo sapiens
atcccctcaggac

SEQ ID NO: 2638931 - DNA, 15 bp, Homo sapiens
atcccctctcccccc

SEQ ID NO: 2638932 - DNA, 21 bp, Homo sapiens
atccccttctcatcactcccc

SEQ ID NO: 2638933 - DNA, 15 bp, Homo sapiens
atcccgattcaccct

SEQ ID NO: 2638934 - DNA, 16 bp, Homo sapiens
atcccgccacctatct

SEQ ID NO: 2638935 - DNA, 13 bp, Homo sapiens
atcccgtgttctc

SEQ ID NO: 2638936 - DNA, 18 bp, Homo sapiens
atccctaatgtgtgccat

SEQ ID NO: 2638937 - DNA, 15 bp, Homo sapiens
atccctactgtaatt

SEQ ID NO: 2638938 - DNA, 17 bp, Homo sapiens
atccctatgggattcag

SEQ ID NO: 2638939 - DNA, 14 bp, Homo sapiens
atccctcatcctca

SEQ ID NO: 2638940 - DNA, 23 bp, Homo sapiens
atccctcatcctcatacccaccc

SEQ ID NO: 2638941 - DNA, 11 bp, Homo sapiens
atccctcatct

SEQ ID NO: 2638942 - DNA, 17 bp, Homo sapiens
atccctcatctgtccct

SEQ ID NO: 2638943 - DNA, 21 bp, Homo sapiens
atccctctacagagcttccct

SEQ ID NO: 2638944 - DNA, 22 bp, Homo sapiens
atccctctacagagcttccctg

SEQ ID NO: 2638945 - DNA, 16 bp, Homo sapiens
atccctctctggattg

SEQ ID NO: 2638946 - DNA, 15 bp, Homo sapiens
atccctctgggcact

SEQ ID NO: 2638947 - DNA, 20 bp, Homo sapiens
atccctgaatcccccttgcc

SEQ ID NO: 2638948 - DNA, 13 bp, Homo sapiens
atccctgtttaat

SEQ ID NO: 2638949 - DNA, 16 bp, Homo sapiens
atccctgtttaatatt

SEQ ID NO: 2638950 - DNA, 23 bp, Homo sapiens
atccctgtttaatatttaaacag

SEQ ID NO: 2638951 - DNA, 21 bp, Homo sapiens
atcccttccttttagcctagt

SEQ ID NO: 2638952 - DNA, 14 bp, Homo sapiens
atcccttgaccagg

SEQ ID NO: 2638953 - DNA, 15 bp, Homo sapiens
atccgccagggccca

SEQ ID NO: 2638954 - DNA, 21 bp, Homo sapiens
atcctaagctattcagtaata

SEQ ID NO: 2638955 - DNA, 14 bp, Homo sapiens
atcctacttctcca

SEQ ID NO: 2638956 - DNA, 19 bp, Homo sapiens
atcctagccttatcctctg

SEQ ID NO: 2638957 - DNA, 20 bp, Homo sapiens
atcctagccttatcctctga

SEQ ID NO: 2638958 - DNA, 22 bp, Homo sapiens
atcctagccttatcctctgatc

SEQ ID NO: 2638959 - DNA, 21 bp, Homo sapiens
atcctaggcatttgctgaata

SEQ ID NO: 2638960 - DNA, 23 bp, Homo sapiens
atcctatgtgattttaactctgt

SEQ ID NO: 2638961 - DNA, 12 bp, Homo sapiens
atcctatgtttt

SEQ ID NO: 2638962 - DNA, 15 bp, Homo sapiens
atcctcaaacactgc

SEQ ID NO: 2638963 - DNA, 17 bp, Homo sapiens
atcctcaaacactgcag

SEQ ID NO: 2638964 - DNA, 14 bp, Homo sapiens
atcctcactgggtg

SEQ ID NO: 2638965 - DNA, 19 bp, Homo sapiens
atcctcatacccaccccca

SEQ ID NO: 2638966 - DNA, 22 bp, Homo sapiens
atcctcatacccacccccaccc

SEQ ID NO: 2638967 - DNA, 16 bp, Homo sapiens
atcctcatatggccca

SEQ ID NO: 2638968 - DNA, 23 bp, Homo sapiens
atcctccaacttcatttgatgct

SEQ ID NO: 2638969 - DNA, 19 bp, Homo sapiens
atcctccacgttctgctca

SEQ ID NO: 2638970 - DNA, 11 bp, Homo sapiens
atcctccagct

SEQ ID NO: 2638971 - DNA, 13 bp, Homo sapiens
atcctccaggtgc

SEQ ID NO: 2638972 - DNA, 13 bp, Homo sapiens
atcctccaggttt

SEQ ID NO: 2638973 - DNA, 18 bp, Homo sapiens
atcctccaggtttttcaa

SEQ ID NO: 2638974 - DNA, 22 bp, Homo sapiens
atcctccaggtttttcaattaa

SEQ ID NO: 2638975 - DNA, 15 bp, Homo sapiens
atcctccccttccct

SEQ ID NO: 2638976 - DNA, 16 bp, Homo sapiens
atcctgaaatttcaga

SEQ ID NO: 2638977 - DNA, 13 bp, Homo sapiens
atcctgaggctga

SEQ ID NO: 2638978 - DNA, 14 bp, Homo sapiens
atcctgcttcagtg

SEQ ID NO: 2638979 - DNA, 17 bp, Homo sapiens
atcctggccaacatggt

SEQ ID NO: 2638980 - DNA, 14 bp, Homo sapiens
atcctggccctctg

SEQ ID NO: 2638981 - DNA, 20 bp, Homo sapiens
atcctggggcattaaaaaaa

SEQ ID NO: 2638982 - DNA, 15 bp, Homo sapiens
atcctggggctccct

SEQ ID NO: 2638983 - DNA, 22 bp, Homo sapiens
atcctgggtggtctgcaggcag

SEQ ID NO: 2638984 - DNA, 23 bp, Homo sapiens
atcctgggtggtctgcaggcagg

SEQ ID NO: 2638985 - DNA, 23 bp, Homo sapiens
atcctgtctttctgagcacactt

SEQ ID NO: 2638986 - DNA, 18 bp, Homo sapiens
atcctgtgtttctaggga

SEQ ID NO: 2638987 - DNA, 20 bp, Homo sapiens
atccttcaagaactctgggc

SEQ ID NO: 2638988 - DNA, 11 bp, Homo sapiens
atccttcctcc

SEQ ID NO: 2638989 - DNA, 17 bp, Homo sapiens
atcctttccagcatgag

SEQ ID NO: 2638990 - DNA, 16 bp, Homo sapiens
atccttttatgttatt

SEQ ID NO: 2638991 - DNA, 13 bp, Homo sapiens
atcgaaataacaa

SEQ ID NO: 2638992 - DNA, 22 bp, Homo sapiens
atcgaaataacaatgttaagga

SEQ ID NO: 2638993 - DNA, 23 bp, Homo sapiens
atcgaaataacaatgttaaggaa

SEQ ID NO: 2638994 - DNA, 15 bp, Homo sapiens
atcgatgttatgtaa

SEQ ID NO: 2638995 - DNA, 12 bp, Homo sapiens
atcgcctttccc

SEQ ID NO: 2638996 - DNA, 18 bp, Homo sapiens
atcggaggcttgtcagag

SEQ ID NO: 2638997 - DNA, 20 bp, Homo sapiens
atcggaggcttgtcagagct

SEQ ID NO: 2638998 - DNA, 15 bp, Homo sapiens
atcgggaacagtgtt

SEQ ID NO: 2638999 - DNA, 17 bp, Homo sapiens
atcgggaacagtgtttc

SEQ ID NO: 2639000 - DNA, 16 bp, Homo sapiens
atcgggagcagtgtct

SEQ ID NO: 2639001 - DNA, 15 bp, Homo sapiens
atcgtaaccagccag

SEQ ID NO: 2639002 - DNA, 18 bp, Homo sapiens
atcgtatagctgtattga

SEQ ID NO: 2639003 - DNA, 22 bp, Homo sapiens
atcgtatagctgtattgaatca

SEQ ID NO: 2639004 - DNA, 20 bp, Homo sapiens
atcgtgaaaccctgtctcta

SEQ ID NO: 2639005 - DNA, 17 bp, Homo sapiens
atatttataactcatca

SEQ ID NO: 2639006 - DNA, 20 bp, Homo sapiens
atatttataactcatcataa

SEQ ID NO: 2639007 - DNA, 15 bp, Homo sapiens
atatttatatttcac

SEQ ID NO: 2639008 - DNA, 14 bp, Homo sapiens
atatttattacctc

SEQ ID NO: 2639009 - DNA, 22 bp, Homo sapiens
atatttattgtttatttatcag

SEQ ID NO: 2639010 - DNA, 21 bp, Homo sapiens
atatttattttctttctgtaa

SEQ ID NO: 2639011 - DNA, 18 bp, Homo sapiens
atatttatttttttaagc

SEQ ID NO: 2639012 - DNA, 21 bp, Homo sapiens
atatttccttaaactgtgtgg

SEQ ID NO: 2639013 - DNA, 15 bp, Homo sapiens
atatttcgaaagctg

SEQ ID NO: 2639014 - DNA, 20 bp, Homo sapiens
atatttgtaaatttatgtga

SEQ ID NO: 2639015 - DNA, 14 bp, Homo sapiens
atatttgtacaaaa

SEQ ID NO: 2639016 - DNA, 14 bp, Homo sapiens
atatttgtggaata

SEQ ID NO: 2639017 - DNA, 14 bp, Homo sapiens
atattttaaaatga

SEQ ID NO: 2639018 - DNA, 12 bp, Homo sapiens
atattttaactt

SEQ ID NO: 2639019 - DNA, 17 bp, Homo sapiens
atattttacctcttatt

SEQ ID NO: 2639020 - DNA, 15 bp, Homo sapiens
atattttatgtgaga

SEQ ID NO: 2639021 - DNA, 20 bp, Homo sapiens
atattttatgtgagagaaag

SEQ ID NO: 2639022 - DNA, 17 bp, Homo sapiens
atattttcaaattgtat

SEQ ID NO: 2639023 - DNA, 20 bp, Homo sapiens
atatttttaaaatatttatt

SEQ ID NO: 2639024 - DNA, 12 bp, Homo sapiens
atatttttaaga

SEQ ID NO: 2639025 - DNA, 14 bp, Homo sapiens
atatttttatagac

SEQ ID NO: 2639026 - DNA, 19 bp, Homo sapiens
atatttttatagacaaata

SEQ ID NO: 2639027 - DNA, 18 bp, Homo sapiens
atatttttatatttagtt

SEQ ID NO: 2639028 - DNA, 14 bp, Homo sapiens
atatttttatcttt

SEQ ID NO: 2639029 - DNA, 20 bp, Homo sapiens
atattttttatatatacagt

SEQ ID NO: 2639030 - DNA, 18 bp, Homo sapiens
atattttttcagaaatat

SEQ ID NO: 2639031 - DNA, 15 bp, Homo sapiens
atattttttctgaat

SEQ ID NO: 2639032 - DNA, 20 bp, Homo sapiens
atattttttgttaaatgatt

SEQ ID NO: 2639033 - DNA, 21 bp, Homo sapiens
atcaaaacctttcaaatatca

SEQ ID NO: 2639034 - DNA, 15 bp, Homo sapiens
atcaaaagacaattc

SEQ ID NO: 2639035 - DNA, 21 bp, Homo sapiens
atcaaaagacaattctttata

SEQ ID NO: 2639036 - DNA, 15 bp, Homo sapiens
atcaaaataaaaagt

SEQ ID NO: 2639037 - DNA, 16 bp, Homo sapiens
atcaaactgaagccag

SEQ ID NO: 2639038 - DNA, 23 bp, Homo sapiens
atcaaagcacttggactcttgct

SEQ ID NO: 2639039 - DNA, 20 bp, Homo sapiens
atcaaatactttaaaggaaa

SEQ ID NO: 2639040 - DNA, 20 bp, Homo sapiens
atcaaatagaaccactatga

SEQ ID NO: 2639041 - DNA, 21 bp, Homo sapiens
atcaaatagaaccactatgaa

SEQ ID NO: 2639042 - DNA, 18 bp, Homo sapiens
atcaaatatgcaaagcac

SEQ ID NO: 2639043 - DNA, 22 bp, Homo sapiens
atcaaatttcacgtcgtcttct

SEQ ID NO: 2639044 - DNA, 16 bp, Homo sapiens
atcaacaaaaattgtc

SEQ ID NO: 2639045 - DNA, 22 bp, Homo sapiens
atcaaccccttcgctcctgtgt

SEQ ID NO: 2639046 - DNA, 19 bp, Homo sapiens
atcaactgggctgaacact

SEQ ID NO: 2639047 - DNA, 19 bp, Homo sapiens
atcaagagctgccctcctt

SEQ ID NO: 2639048 - DNA, 22 bp, Homo sapiens
atcaagatgagagaactggagg

SEQ ID NO: 2639049 - DNA, 18 bp, Homo sapiens
atcaagatgtcagactgg

SEQ ID NO: 2639050 - DNA, 20 bp, Homo sapiens
atcaagctagaaggccacat

SEQ ID NO: 2639051 - DNA, 14 bp, Homo sapiens
atcaagtattatac

SEQ ID NO: 2639052 - DNA, 18 bp, Homo sapiens
atcaagtattataccttt

SEQ ID NO: 2639053 - DNA, 13 bp, Homo sapiens
atcaagtgtcttc

SEQ ID NO: 2639054 - DNA, 16 bp, Homo sapiens
atcaagtgtcttccat

SEQ ID NO: 2639055 - DNA, 22 bp, Homo sapiens
atcaagttattgacaaactctc

SEQ ID NO: 2639056 - DNA, 23 bp, Homo sapiens
atcaagttggcttctaatcaaag

SEQ ID NO: 2639057 - DNA, 15 bp, Homo sapiens
atcaataaaatgtga

SEQ ID NO: 2639058 - DNA, 14 bp, Homo sapiens
atcaataaacgatt

SEQ ID NO: 2639059 - DNA, 19 bp, Homo sapiens
atcaataaacgatttaatt

SEQ ID NO: 2639060 - DNA, 19 bp, Homo sapiens
atcaatcatctgtgtgaaa

SEQ ID NO: 2639061 - DNA, 22 bp, Homo sapiens
atcaatcatctgtgtgaaaatg

SEQ ID NO: 2639062 - DNA, 12 bp, Homo sapiens
atcaatgacaga

SEQ ID NO: 2639063 - DNA, 14 bp, Homo sapiens
atcaatgagtaaca

SEQ ID NO: 2639064 - DNA, 23 bp, Homo sapiens
atcaatggcgcagtgcctctggt

SEQ ID NO: 2639065 - DNA, 16 bp, Homo sapiens
atcaatttaaacccat

SEQ ID NO: 2639066 - DNA, 16 bp, Homo sapiens
atcacacttctgtgag

SEQ ID NO: 2639067 - DNA, 18 bp, Homo sapiens
atcacacttctgtgagac

SEQ ID NO: 2639068 - DNA, 15 bp, Homo sapiens
atcacagagacattc

SEQ ID NO: 2639069 - DNA, 22 bp, Homo sapiens
atcacagagacattcctccgag

SEQ ID NO: 2639070 - DNA, 13 bp, Homo sapiens
atcacagcctctg

SEQ ID NO: 2639071 - DNA, 21 bp, Homo sapiens
atcacagcctctgaaaaccaa

SEQ ID NO: 2639072 - DNA, 18 bp, Homo sapiens
atcacagcttcagccagg

SEQ ID NO: 2639073 - DNA, 12 bp, Homo sapiens
atcacagggcag

SEQ ID NO: 2639074 - DNA, 21 bp, Homo sapiens
atcacagggccccagaaggca

SEQ ID NO: 2639075 - DNA, 22 bp, Homo sapiens
atcacagggccccagaaggcag

SEQ ID NO: 2639076 - DNA, 18 bp, Homo sapiens
atcacagggttgggccca

SEQ ID NO: 2639077 - DNA, 11 bp, Homo sapiens
atcacatgtat

SEQ ID NO: 2639078 - DNA, 16 bp, Homo sapiens
atcacatgtatgtttt

SEQ ID NO: 2639079 - DNA, 17 bp, Homo sapiens
atcacatgtatgttttg

SEQ ID NO: 2639080 - DNA, 15 bp, Homo sapiens
atcaccagcccggcc

SEQ ID NO: 2639081 - DNA, 23 bp, Homo sapiens
atcacccgctaagagggagggag

SEQ ID NO: 2639082 - DNA, 22 bp, Homo sapiens
atcaccgacgcgtctcctgttt

SEQ ID NO: 2639083 - DNA, 22 bp, Homo sapiens
atcaccgtgggctccctgactg

SEQ ID NO: 2639084 - DNA, 12 bp, Homo sapiens
atcacctcaggc

SEQ ID NO: 2639085 - DNA, 12 bp, Homo sapiens
atcacctcccct

SEQ ID NO: 2639086 - DNA, 18 bp, Homo sapiens
atcaccttaggcagggaa

SEQ ID NO: 2639087 - DNA, 15 bp, Homo sapiens
atcacgccactgcac

SEQ ID NO: 2639088 - DNA, 18 bp, Homo sapiens
atcacgctttcctgaatc

SEQ ID NO: 2639089 - DNA, 15 bp, Homo sapiens
atcacggctcactgc

SEQ ID NO: 2639090 - DNA, 22 bp, Homo sapiens
atcacggtcgccacctggcatt

SEQ ID NO: 2639091 - DNA, 14 bp, Homo sapiens
atcactctgctgct

SEQ ID NO: 2639092 - DNA, 21 bp, Homo sapiens
atcactgaactttgctgagcc

SEQ ID NO: 2639093 - DNA, 14 bp, Homo sapiens
atcactggagccca

SEQ ID NO: 2639094 - DNA, 16 bp, Homo sapiens
atcactggagcccagg

SEQ ID NO: 2639095 - DNA, 23 bp, Homo sapiens
atcactggcaatgaaaaattctc

SEQ ID NO: 2639096 - DNA, 23 bp, Homo sapiens
atcacttgaacccgggaggcaga

SEQ ID NO: 2639097 - DNA, 19 bp, Homo sapiens
atcacttgaggtcaggagt

SEQ ID NO: 2639098 - DNA, 17 bp, Homo sapiens
atcacttgtacaaaata

SEQ ID NO: 2639099 - DNA, 20 bp, Homo sapiens
atcactttctcagttttcat

SEQ ID NO: 2639100 - DNA, 21 bp, Homo sapiens
atcactttctcagttttcata

SEQ ID NO: 2639101 - DNA, 20 bp, Homo sapiens
atcagaaacaccctcacact

SEQ ID NO: 2639102 - DNA, 22 bp, Homo sapiens
atcagatgaactcttagaaatg

SEQ ID NO: 2639103 - DNA, 15 bp, Homo sapiens
atcagattgcatgtg

SEQ ID NO: 2639104 - DNA, 16 bp, Homo sapiens
atcagattgcatgtga

SEQ ID NO: 2639105 - DNA, 21 bp, Homo sapiens
atcagattgcatgtgactctg

SEQ ID NO: 2639106 - DNA, 13 bp, Homo sapiens
atcagcacgattt

SEQ ID NO: 2639107 - DNA, 19 bp, Homo sapiens
atcagcacgatttctgttt

SEQ ID NO: 2639108 - DNA, 23 bp, Homo sapiens
atcagcacgatttctgtttagat

SEQ ID NO: 2639109 - DNA, 11 bp, Homo sapiens
atcagcctctt

SEQ ID NO: 2639110 - DNA, 13 bp, Homo sapiens
atcagcctcttaa

SEQ ID NO: 2639111 - DNA, 22 bp, Homo sapiens
atcagcctgagtctcctgtgcc

SEQ ID NO: 2639112 - DNA, 19 bp, Homo sapiens
atcagcctgctccagctgt

SEQ ID NO: 2639113 - DNA, 20 bp, Homo sapiens
atcagcctgggcaatgtgat

SEQ ID NO: 2639114 - DNA, 14 bp, Homo sapiens
atcagcctgtgcca

SEQ ID NO: 2639115 - DNA, 23 bp, Homo sapiens
atcagcggccccttgactctggg

SEQ ID NO: 2639116 - DNA, 18 bp, Homo sapiens
atcagctccactttcagt

SEQ ID NO: 2639117 - DNA, 15 bp, Homo sapiens
atcagctccttcctg

SEQ ID NO: 2639118 - DNA, 13 bp, Homo sapiens
atcagctgctact

SEQ ID NO: 2639119 - DNA, 23 bp, Homo sapiens
atcagctgctactactcctgtag

SEQ ID NO: 2639120 - DNA, 22 bp, Homo sapiens
atcagcttgccctgttaaaaga

SEQ ID NO: 2639121 - DNA, 18 bp, Homo sapiens
atcaggacccagaggaag

SEQ ID NO: 2639122 - DNA, 22 bp, Homo sapiens
atcaggagaaaaagcctccagt

SEQ ID NO: 2639123 - DNA, 13 bp, Homo sapiens
atcaggccaggcc

SEQ ID NO: 2639124 - DNA, 15 bp, Homo sapiens
atcaggccaggccct

SEQ ID NO: 2639125 - DNA, 18 bp, Homo sapiens
atcaggccaggccctctg

SEQ ID NO: 2639126 - DNA, 22 bp, Homo sapiens
atcaggccaggccctctgccca

SEQ ID NO: 2639127 - DNA, 23 bp, Homo sapiens
atcaggccaggccctctgcccac

SEQ ID NO: 2639128 - DNA, 16 bp, Homo sapiens
atcaggtcctcagaga

SEQ ID NO: 2639129 - DNA, 20 bp, Homo sapiens
atcaggtgcccatccctgga

SEQ ID NO: 2639130 - DNA, 15 bp, Homo sapiens
atcaggtgctgccat

SEQ ID NO: 2639131 - DNA, 22 bp, Homo sapiens
atcagtataattctgtactgat

SEQ ID NO: 2639132 - DNA, 15 bp, Homo sapiens
atcagtcccctccca

SEQ ID NO: 2639133 - DNA, 23 bp, Homo sapiens
atcagtcccctcccatctgggag

SEQ ID NO: 2639134 - DNA, 16 bp, Homo sapiens
atcagtccctatgtat

SEQ ID NO: 2639135 - DNA, 15 bp, Homo sapiens
atcagtgtctcacac

SEQ ID NO: 2639136 - DNA, 16 bp, Homo sapiens
atcataaactgtgtgc

SEQ ID NO: 2639137 - DNA, 17 bp, Homo sapiens
atcataagatatttttc

SEQ ID NO: 2639138 - DNA, 17 bp, Homo sapiens
atcatacacttccttct

SEQ ID NO: 2639139 - DNA, 12 bp, Homo sapiens
atcatagaaatg

SEQ ID NO: 2639140 - DNA, 21 bp, Homo sapiens
atcataggaagggaccaaggc

SEQ ID NO: 2639141 - DNA, 22 bp, Homo sapiens
atcataggaagggaccaaggca

SEQ ID NO: 2639142 - DNA, 23 bp, Homo sapiens
atcatagtggcttaaaacaacac

SEQ ID NO: 2639143 - DNA, 15 bp, Homo sapiens
atcatattatacaga

SEQ ID NO: 2639144 - DNA, 22 bp, Homo sapiens
atcatcagcatacctttattgt

SEQ ID NO: 2639145 - DNA, 18 bp, Homo sapiens
atcatcagtggagccatg

SEQ ID NO: 2639146 - DNA, 18 bp, Homo sapiens
atcatcatgtgtgtccac

SEQ ID NO: 2639147 - DNA, 21 bp, Homo sapiens
atcatccactgtgccatgtgc

SEQ ID NO: 2639148 - DNA, 14 bp, Homo sapiens
atcatccagaagtt

SEQ ID NO: 2639149 - DNA, 23 bp, Homo sapiens
atcatctcctgccttcctcctgg

SEQ ID NO: 2639150 - DNA, 18 bp, Homo sapiens
atcatctgtgtgaaaatg

SEQ ID NO: 2639151 - DNA, 15 bp, Homo sapiens
atcatgaatgtgtaa

SEQ ID NO: 2639152 - DNA, 19 bp, Homo sapiens
atcatgcaaatgctgtatt

SEQ ID NO: 2639153 - DNA, 22 bp, Homo sapiens
atcatgcatcttactgaaggta

SEQ ID NO: 2639154 - DNA, 12 bp, Homo sapiens
atatagttttac

SEQ ID NO: 2639155 - DNA, 13 bp, Homo sapiens
atatagttttact

SEQ ID NO: 2639156 - DNA, 21 bp, Homo sapiens
atatataaaaagaaaagataa

SEQ ID NO: 2639157 - DNA, 16 bp, Homo sapiens
atatatacagtaactt

SEQ ID NO: 2639158 - DNA, 23 bp, Homo sapiens
atatatacagtaactttatgtgt

SEQ ID NO: 2639159 - DNA, 16 bp, Homo sapiens
atatatatgccatgat

SEQ ID NO: 2639160 - DNA, 18 bp, Homo sapiens
atatatctaaattgaata

SEQ ID NO: 2639161 - DNA, 14 bp, Homo sapiens
atatatctatctta

SEQ ID NO: 2639162 - DNA, 12 bp, Homo sapiens
atatatgtgtat

SEQ ID NO: 2639163 - DNA, 21 bp, Homo sapiens
atatatgtgtttttcacattt

SEQ ID NO: 2639164 - DNA, 20 bp, Homo sapiens
atatatgtttaccttttaat

SEQ ID NO: 2639165 - DNA, 17 bp, Homo sapiens
atatatgtttttgaagg

SEQ ID NO: 2639166 - DNA, 18 bp, Homo sapiens
atatatgtttttgaaggc

SEQ ID NO: 2639167 - DNA, 19 bp, Homo sapiens
atatattggtaacatcctt

SEQ ID NO: 2639168 - DNA, 21 bp, Homo sapiens
atatattggtaacatcctttc

SEQ ID NO: 2639169 - DNA, 13 bp, Homo sapiens
atatatttataac

SEQ ID NO: 2639170 - DNA, 23 bp, Homo sapiens
atatatttataactcatcataaa

SEQ ID NO: 2639171 - DNA, 22 bp, Homo sapiens
atatatttcacgtgttccctct

SEQ ID NO: 2639172 - DNA, 16 bp, Homo sapiens
atatatttttaagata

SEQ ID NO: 2639173 - DNA, 21 bp, Homo sapiens
atatatttttatatttagtta

SEQ ID NO: 2639174 - DNA, 15 bp, Homo sapiens
atatatttttcacag

SEQ ID NO: 2639175 - DNA, 21 bp, Homo sapiens
atatatttttcacagtttttc

SEQ ID NO: 2639176 - DNA, 20 bp, Homo sapiens
atatatttttggttgtcaat

SEQ ID NO: 2639177 - DNA, 14 bp, Homo sapiens
atatattttttgta

SEQ ID NO: 2639178 - DNA, 15 bp, Homo sapiens
atatcaatttaaaaa

SEQ ID NO: 2639179 - DNA, 14 bp, Homo sapiens
atatcagcaagtct

SEQ ID NO: 2639180 - DNA, 14 bp, Homo sapiens
atatcagcctgagt

SEQ ID NO: 2639181 - DNA, 22 bp, Homo sapiens
atatcagcctgagtctcctgtg

SEQ ID NO: 2639182 - DNA, 13 bp, Homo sapiens
atatcatcagtat

SEQ ID NO: 2639183 - DNA, 12 bp, Homo sapiens
atatccaaaagc

SEQ ID NO: 2639184 - DNA, 14 bp, Homo sapiens
atatccaccacctc

SEQ ID NO: 2639185 - DNA, 15 bp, Homo sapiens
atatcccctcccagt

SEQ ID NO: 2639186 - DNA, 15 bp, Homo sapiens
atatcctgagccatc

SEQ ID NO: 2639187 - DNA, 14 bp, Homo sapiens
atatctaaattgaa

SEQ ID NO: 2639188 - DNA, 18 bp, Homo sapiens
atatctaaattgaataat

SEQ ID NO: 2639189 - DNA, 22 bp, Homo sapiens
atatctaaattgaataatggta

SEQ ID NO: 2639190 - DNA, 17 bp, Homo sapiens
atatctatatgtacttg

SEQ ID NO: 2639191 - DNA, 14 bp, Homo sapiens
atatctatcttata

SEQ ID NO: 2639192 - DNA, 21 bp, Homo sapiens
atatctatcttatatagttta

SEQ ID NO: 2639193 - DNA, 16 bp, Homo sapiens
atatctgaaaatgtat

SEQ ID NO: 2639194 - DNA, 20 bp, Homo sapiens
atatctgaaaatgtatgtgt

SEQ ID NO: 2639195 - DNA, 22 bp, Homo sapiens
atatctgaaaatgtatgtgtaa

SEQ ID NO: 2639196 - DNA, 17 bp, Homo sapiens
atatctgggattctact

SEQ ID NO: 2639197 - DNA, 21 bp, Homo sapiens
atatctgggattctactttaa

SEQ ID NO: 2639198 - DNA, 20 bp, Homo sapiens
atatctgtatttaattttga

SEQ ID NO: 2639199 - DNA, 13 bp, Homo sapiens
atatgaaaaatat

SEQ ID NO: 2639200 - DNA, 19 bp, Homo sapiens
atatgaaaaatatgatatt

SEQ ID NO: 2639201 - DNA, 23 bp, Homo sapiens
atatgaaaatacaacttaaataa

SEQ ID NO: 2639202 - DNA, 19 bp, Homo sapiens
atatgaacatattgttgaa

SEQ ID NO: 2639203 - DNA, 14 bp, Homo sapiens
atatgaagacataa

SEQ ID NO: 2639204 - DNA, 15 bp, Homo sapiens
atatgaagacataaa

SEQ ID NO: 2639205 - DNA, 22 bp, Homo sapiens
atatgaatacagggcatgcatt

SEQ ID NO: 2639206 - DNA, 17 bp, Homo sapiens
atatgaatttaaatata

SEQ ID NO: 2639207 - DNA, 21 bp, Homo sapiens
atatgaatttaaatataattc

SEQ ID NO: 2639208 - DNA, 13 bp, Homo sapiens
atatgacctcatg

SEQ ID NO: 2639209 - DNA, 16 bp, Homo sapiens
atatgacggaagaaca

SEQ ID NO: 2639210 - DNA, 20 bp, Homo sapiens
atatgacggaagaacataga

SEQ ID NO: 2639211 - DNA, 23 bp, Homo sapiens
atatgaggatgcagagtcagcag

SEQ ID NO: 2639212 - DNA, 20 bp, Homo sapiens
atatgagtgtggaagccgga

SEQ ID NO: 2639213 - DNA, 19 bp, Homo sapiens
atatgagtttcatagctaa

SEQ ID NO: 2639214 - DNA, 21 bp, Homo sapiens
atatgagtttcatagctaaga

SEQ ID NO: 2639215 - DNA, 15 bp, Homo sapiens
atatgatattgcata

SEQ ID NO: 2639216 - DNA, 21 bp, Homo sapiens
atatgattagtaaagaaatga

SEQ ID NO: 2639217 - DNA, 13 bp, Homo sapiens
atatgatttaaaa

SEQ ID NO: 2639218 - DNA, 19 bp, Homo sapiens
atatgattttatttgacaa

SEQ ID NO: 2639219 - DNA, 15 bp, Homo sapiens
atatgcaaagcactg

SEQ ID NO: 2639220 - DNA, 15 bp, Homo sapiens
atatgcacaatagca

SEQ ID NO: 2639221 - DNA, 22 bp, Homo sapiens
atatgcacacattttttaaatg

SEQ ID NO: 2639222 - DNA, 15 bp, Homo sapiens
atatgcaccttgtgt

SEQ ID NO: 2639223 - DNA, 22 bp, Homo sapiens
atatgcctctcctttgtatatt

SEQ ID NO: 2639224 - DNA, 18 bp, Homo sapiens
atatgctgccaaattttg

SEQ ID NO: 2639225 - DNA, 14 bp, Homo sapiens
atatgcttactgat

SEQ ID NO: 2639226 - DNA, 18 bp, Homo sapiens
atatggactcagttttct

SEQ ID NO: 2639227 - DNA, 11 bp, Homo sapiens
atatggagccc

SEQ ID NO: 2639228 - DNA, 15 bp, Homo sapiens
atatggctataaata

SEQ ID NO: 2639229 - DNA, 17 bp, Homo sapiens
atatgggacatttttga

SEQ ID NO: 2639230 - DNA, 16 bp, Homo sapiens
atatggggatgcagca

SEQ ID NO: 2639231 - DNA, 16 bp, Homo sapiens
atatgtaaaataaaat

SEQ ID NO: 2639232 - DNA, 20 bp, Homo sapiens
atatgtaaaataaaattatg

SEQ ID NO: 2639233 - DNA, 16 bp, Homo sapiens
atatgtaacaagccac

SEQ ID NO: 2639234 - DNA, 14 bp, Homo sapiens
atatgtaccatgta

SEQ ID NO: 2639235 - DNA, 17 bp, Homo sapiens
atatgtacttgtcaaag

SEQ ID NO: 2639236 - DNA, 18 bp, Homo sapiens
atatgtagtataaagaaa

SEQ ID NO: 2639237 - DNA, 16 bp, Homo sapiens
atatgtatgtgtgtat

SEQ ID NO: 2639238 - DNA, 16 bp, Homo sapiens
atatgtattaatattc

SEQ ID NO: 2639239 - DNA, 14 bp, Homo sapiens
atatgtcagggcgt

SEQ ID NO: 2639240 - DNA, 19 bp, Homo sapiens
atatgtgaacatttatcaa

SEQ ID NO: 2639241 - DNA, 16 bp, Homo sapiens
atatgtgtatgtacgt

SEQ ID NO: 2639242 - DNA, 16 bp, Homo sapiens
atatgtgtgtgtatgt

SEQ ID NO: 2639243 - DNA, 19 bp, Homo sapiens
atatgtgtgtttaaataaa

SEQ ID NO: 2639244 - DNA, 22 bp, Homo sapiens
atatgtgtttttcacatttgcg

SEQ ID NO: 2639245 - DNA, 18 bp, Homo sapiens
atatgttctttaaaaata

SEQ ID NO: 2639246 - DNA, 14 bp, Homo sapiens
atatgttgatgaaa

SEQ ID NO: 2639247 - DNA, 22 bp, Homo sapiens
atatgttgatgaaaaatagcaa

SEQ ID NO: 2639248 - DNA, 20 bp, Homo sapiens
atatgtttaccttttaatta

SEQ ID NO: 2639249 - DNA, 18 bp, Homo sapiens
atatgttttaagaggcag

SEQ ID NO: 2639250 - DNA, 20 bp, Homo sapiens
atatgttttaagaggcaggg

SEQ ID NO: 2639251 - DNA, 14 bp, Homo sapiens
atattaaaataagc

SEQ ID NO: 2639252 - DNA, 14 bp, Homo sapiens
atattaaaggagtt

SEQ ID NO: 2639253 - DNA, 12 bp, Homo sapiens
atattaaataca

SEQ ID NO: 2639254 - DNA, 19 bp, Homo sapiens
atattaaatacagacacta

SEQ ID NO: 2639255 - DNA, 17 bp, Homo sapiens
atattaagaaagactat

SEQ ID NO: 2639256 - DNA, 22 bp, Homo sapiens
atattaagaaagactatctaaa

SEQ ID NO: 2639257 - DNA, 22 bp, Homo sapiens
atattaaggaagacaatgtgaa

SEQ ID NO: 2639258 - DNA, 22 bp, Homo sapiens
atattaccacagacatactaac

SEQ ID NO: 2639259 - DNA, 14 bp, Homo sapiens
atattagaagtgtt

SEQ ID NO: 2639260 - DNA, 14 bp, Homo sapiens
atattagatgtgat

SEQ ID NO: 2639261 - DNA, 16 bp, Homo sapiens
atattagatgtgattt

SEQ ID NO: 2639262 - DNA, 17 bp, Homo sapiens
atattagatgtgattta

SEQ ID NO: 2639263 - DNA, 15 bp, Homo sapiens
atattatatatatat

SEQ ID NO: 2639264 - DNA, 21 bp, Homo sapiens
atattatgtatttatattttg

SEQ ID NO: 2639265 - DNA, 17 bp, Homo sapiens
atattattcattcattt

SEQ ID NO: 2639266 - DNA, 20 bp, Homo sapiens
atattcaactcataagactt

SEQ ID NO: 2639267 - DNA, 13 bp, Homo sapiens
atattcaggaagc

SEQ ID NO: 2639268 - DNA, 23 bp, Homo sapiens
atattcagtgctgtggcctgggc

SEQ ID NO: 2639269 - DNA, 16 bp, Homo sapiens
atattcattgtataaa

SEQ ID NO: 2639270 - DNA, 21 bp, Homo sapiens
atattcattgtataaaaatag

SEQ ID NO: 2639271 - DNA, 13 bp, Homo sapiens
atattcatttgga

SEQ ID NO: 2639272 - DNA, 15 bp, Homo sapiens
atattcatttggaaa

SEQ ID NO: 2639273 - DNA, 16 bp, Homo sapiens
atattccatgaatgta

SEQ ID NO: 2639274 - DNA, 19 bp, Homo sapiens
atattccatgaatgtatca

SEQ ID NO: 2639275 - DNA, 18 bp, Homo sapiens
atattcccctatctctag

SEQ ID NO: 2639276 - DNA, 17 bp, Homo sapiens
atattccctagaaactt

SEQ ID NO: 2639277 - DNA, 23 bp, Homo sapiens
atattccctagaaacttccaaat

SEQ ID NO: 2639278 - DNA, 18 bp, Homo sapiens
atattcctgaatgaaata

SEQ ID NO: 2639279 - DNA, 16 bp, Homo sapiens
atattcctttctatca

SEQ ID NO: 2639280 - DNA, 16 bp, Homo sapiens
atattctgttggccag

SEQ ID NO: 2639281 - DNA, 16 bp, Homo sapiens
atattgaaaaaataga

SEQ ID NO: 2639282 - DNA, 21 bp, Homo sapiens
atattgatttccgttaaaata

SEQ ID NO: 2639283 - DNA, 22 bp, Homo sapiens
atattgatttccgttaaaatac

SEQ ID NO: 2639284 - DNA, 16 bp, Homo sapiens
atattgccgcactagg

SEQ ID NO: 2639285 - DNA, 15 bp, Homo sapiens
atattggtattcact

SEQ ID NO: 2639286 - DNA, 13 bp, Homo sapiens
atattgtaagaaa

SEQ ID NO: 2639287 - DNA, 16 bp, Homo sapiens
atattgtaagaaatac

SEQ ID NO: 2639288 - DNA, 13 bp, Homo sapiens
atattgtacactt

SEQ ID NO: 2639289 - DNA, 15 bp, Homo sapiens
atattgtacactttt

SEQ ID NO: 2639290 - DNA, 12 bp, Homo sapiens
atattgtacagt

SEQ ID NO: 2639291 - DNA, 14 bp, Homo sapiens
atattgtacagttt

SEQ ID NO: 2639292 - DNA, 15 bp, Homo sapiens
atattgtcagatatt

SEQ ID NO: 2639293 - DNA, 15 bp, Homo sapiens
atattgtcattcctg

SEQ ID NO: 2639294 - DNA, 14 bp, Homo sapiens
atattgtgattctg

SEQ ID NO: 2639295 - DNA, 12 bp, Homo sapiens
atattgtgccaa

SEQ ID NO: 2639296 - DNA, 12 bp, Homo sapiens
atattgtttcta

SEQ ID NO: 2639297 - DNA, 12 bp, Homo sapiens
atatttaaacag

SEQ ID NO: 2639298 - DNA, 21 bp, Homo sapiens
atatttaaacatggttacaat

SEQ ID NO: 2639299 - DNA, 14 bp, Homo sapiens
atatttaaagacag

SEQ ID NO: 2639300 - DNA, 23 bp, Homo sapiens
atatttacagtgaaaatgtaagc

SEQ ID NO: 2639301 - DNA, 15 bp, Homo sapiens
atatttacatatgaa

SEQ ID NO: 2639302 - DNA, 20 bp, Homo sapiens
atatttacatatgaaattta

SEQ ID NO: 2639303 - DNA, 19 bp, Homo sapiens
atatttagattgttaaaat

SEQ ID NO: 2639304 - DNA, 15 bp, Homo sapiens
atatttagcaaataa

SEQ ID NO: 2639305 - DNA, 16 bp, Homo sapiens
ataaaacaggtcaata

SEQ ID NO: 2639306 - DNA, 15 bp, Homo sapiens
ataaaacctttcaaa

SEQ ID NO: 2639307 - DNA, 21 bp, Homo sapiens
ataaaacctttcaaatttcac

SEQ ID NO: 2639308 - DNA, 22 bp, Homo sapiens
ataaaacctttcaaatttcaca

SEQ ID NO: 2639309 - DNA, 11 bp, Homo sapiens
ataaaactttt

SEQ ID NO: 2639310 - DNA, 19 bp, Homo sapiens
ataaaagcaattccaacct

SEQ ID NO: 2639311 - DNA, 20 bp, Homo sapiens
ataaaagcagcatctgctaa

SEQ ID NO: 2639312 - DNA, 20 bp, Homo sapiens
ataaaaggcaaatgtgtaca

SEQ ID NO: 2639313 - DNA, 17 bp, Homo sapiens
ataaaagtgatcaataa

SEQ ID NO: 2639314 - DNA, 18 bp, Homo sapiens
ataaaagtgatcaataaa

SEQ ID NO: 2639315 - DNA, 21 bp, Homo sapiens
ataaaagtgattgttggcaca

SEQ ID NO: 2639316 - DNA, 14 bp, Homo sapiens
ataaaataaagtat

SEQ ID NO: 2639317 - DNA, 15 bp, Homo sapiens
ataaaataattctaa

SEQ ID NO: 2639318 - DNA, 16 bp, Homo sapiens
ataaaatactattttt

SEQ ID NO: 2639319 - DNA, 19 bp, Homo sapiens
ataaaatactatttttact

SEQ ID NO: 2639320 - DNA, 21 bp, Homo sapiens
ataaaatatgaagacataaac

SEQ ID NO: 2639321 - DNA, 19 bp, Homo sapiens
ataaaatgaggacatgttt

SEQ ID NO: 2639322 - DNA, 13 bp, Homo sapiens
ataaaattataga

SEQ ID NO: 2639323 - DNA, 23 bp, Homo sapiens
ataaaattatagatgggaatgaa

SEQ ID NO: 2639324 - DNA, 17 bp, Homo sapiens
ataaaattttttttcat

SEQ ID NO: 2639325 - DNA, 21 bp, Homo sapiens
ataaacatccttcaagaactc

SEQ ID NO: 2639326 - DNA, 16 bp, Homo sapiens
ataaaccttaagtaag

SEQ ID NO: 2639327 - DNA, 15 bp, Homo sapiens
ataaacgatttaatt

SEQ ID NO: 2639328 - DNA, 17 bp, Homo sapiens
ataaactagattacatt

SEQ ID NO: 2639329 - DNA, 19 bp, Homo sapiens
ataaactagattacattca

SEQ ID NO: 2639330 - DNA, 15 bp, Homo sapiens
ataaactctaaacat

SEQ ID NO: 2639331 - DNA, 12 bp, Homo sapiens
ataaactgtgtg

SEQ ID NO: 2639332 - DNA, 23 bp, Homo sapiens
ataaacttagtgcggacaagttt

SEQ ID NO: 2639333 - DNA, 21 bp, Homo sapiens
ataaagagagaaaaacaaatt

SEQ ID NO: 2639334 - DNA, 14 bp, Homo sapiens
ataaagatgatcta

SEQ ID NO: 2639335 - DNA, 19 bp, Homo sapiens
ataaagatgatctactcag

SEQ ID NO: 2639336 - DNA, 15 bp, Homo sapiens
ataaagatgctcttt

SEQ ID NO: 2639337 - DNA, 20 bp, Homo sapiens
ataaagatttcttgagtttt

SEQ ID NO: 2639338 - DNA, 19 bp, Homo sapiens
ataaagcagcgtttctatg

SEQ ID NO: 2639339 - DNA, 20 bp, Homo sapiens
ataaagcagcgtttctatga

SEQ ID NO: 2639340 - DNA, 20 bp, Homo sapiens
ataaagccttggatgtatat

SEQ ID NO: 2639341 - DNA, 19 bp, Homo sapiens
ataaaggccccaaatacca

SEQ ID NO: 2639342 - DNA, 21 bp, Homo sapiens
ataaaggtggtatgtgtgtgt

SEQ ID NO: 2639343 - DNA, 21 bp, Homo sapiens
ataaaggttgacaataaatgt

SEQ ID NO: 2639344 - DNA, 13 bp, Homo sapiens
ataaagtgtaata

SEQ ID NO: 2639345 - DNA, 15 bp, Homo sapiens
ataaagttctgtact

SEQ ID NO: 2639346 - DNA, 17 bp, Homo sapiens
ataaataaaaatggata

SEQ ID NO: 2639347 - DNA, 13 bp, Homo sapiens
ataaataaaacat

SEQ ID NO: 2639348 - DNA, 12 bp, Homo sapiens
ataaataacttt

SEQ ID NO: 2639349 - DNA, 11 bp, Homo sapiens
ataaatagcta

SEQ ID NO: 2639350 - DNA, 15 bp, Homo sapiens
ataaatagctatatc

SEQ ID NO: 2639351 - DNA, 23 bp, Homo sapiens
ataaatatataaaaagaaaagat

SEQ ID NO: 2639352 - DNA, 13 bp, Homo sapiens
ataaatatgcagt

SEQ ID NO: 2639353 - DNA, 14 bp, Homo sapiens
ataaatcaatgtca

SEQ ID NO: 2639354 - DNA, 16 bp, Homo sapiens
ataaatcgcttttgat

SEQ ID NO: 2639355 - DNA, 18 bp, Homo sapiens
ataaatgaagcagcttta

SEQ ID NO: 2639356 - DNA, 20 bp, Homo sapiens
ataaatgaagcagctttaaa

SEQ ID NO: 2639357 - DNA, 16 bp, Homo sapiens
ataaatgaattttagt

SEQ ID NO: 2639358 - DNA, 20 bp, Homo sapiens
ataaatgagctatgtattaa

SEQ ID NO: 2639359 - DNA, 18 bp, Homo sapiens
ataaatgcaatatgtatt

SEQ ID NO: 2639360 - DNA, 19 bp, Homo sapiens
ataaatgctattttttatt

SEQ ID NO: 2639361 - DNA, 13 bp, Homo sapiens
ataaatgctttta

SEQ ID NO: 2639362 - DNA, 16 bp, Homo sapiens
ataaatggttaaaaga

SEQ ID NO: 2639363 - DNA, 13 bp, Homo sapiens
ataaatgtatcat

SEQ ID NO: 2639364 - DNA, 21 bp, Homo sapiens
ataaatgtatcatagaaatgt

SEQ ID NO: 2639365 - DNA, 15 bp, Homo sapiens
ataaatgtatcttat

SEQ ID NO: 2639366 - DNA, 12 bp, Homo sapiens
ataaatgtcttt

SEQ ID NO: 2639367 - DNA, 23 bp, Homo sapiens
ataaatgtcttttttttaatgtg

SEQ ID NO: 2639368 - DNA, 19 bp, Homo sapiens
ataaatgtgccttcatttt

SEQ ID NO: 2639369 - DNA, 21 bp, Homo sapiens
ataaattccctggcctttcat

SEQ ID NO: 2639370 - DNA, 21 bp, Homo sapiens
ataaattctataggaacatat

SEQ ID NO: 2639371 - DNA, 14 bp, Homo sapiens
ataaatttatttac

SEQ ID NO: 2639372 - DNA, 15 bp, Homo sapiens
ataacaacctggaga

SEQ ID NO: 2639373 - DNA, 16 bp, Homo sapiens
ataacaatgtgctctc

SEQ ID NO: 2639374 - DNA, 14 bp, Homo sapiens
ataacaatgttaag

SEQ ID NO: 2639375 - DNA, 18 bp, Homo sapiens
ataacaatgttaaggaaa

SEQ ID NO: 2639376 - DNA, 14 bp, Homo sapiens
ataacaattcctct

SEQ ID NO: 2639377 - DNA, 15 bp, Homo sapiens
agtgcttgccacaga

SEQ ID NO: 2639378 - DNA, 16 bp, Homo sapiens
agtgcttgccacagag

SEQ ID NO: 2639379 - DNA, 17 bp, Homo sapiens
agtgcttgccacagagc

SEQ ID NO: 2639380 - DNA, 18 bp, Homo sapiens
agtggaaaaatagcctgc

SEQ ID NO: 2639381 - DNA, 19 bp, Homo sapiens
agtggaaaaatagcctgcc

SEQ ID NO: 2639382 - DNA, 15 bp, Homo sapiens
agtggaaatgttcta

SEQ ID NO: 2639383 - DNA, 20 bp, Homo sapiens
agtggaatagtatcctccag

SEQ ID NO: 2639384 - DNA, 18 bp, Homo sapiens
agtggaccttgagaccac

SEQ ID NO: 2639385 - DNA, 19 bp, Homo sapiens
agtggaccttgagaccaca

SEQ ID NO: 2639386 - DNA, 19 bp, Homo sapiens
agtggactggagtggagca

SEQ ID NO: 2639387 - DNA, 15 bp, Homo sapiens
agtggactttccacc

SEQ ID NO: 2639388 - DNA, 18 bp, Homo sapiens
agtggactttccaccccc

SEQ ID NO: 2639389 - DNA, 22 bp, Homo sapiens
agtggactttccaccccctccc

SEQ ID NO: 2639390 - DNA, 22 bp, Homo sapiens
agtggaggttaaggctgaggaa

SEQ ID NO: 2639391 - DNA, 17 bp, Homo sapiens
agtggcaatatagaaac

SEQ ID NO: 2639392 - DNA, 11 bp, Homo sapiens
agtggcagctg

SEQ ID NO: 2639393 - DNA, 13 bp, Homo sapiens
agtggcagctgct

SEQ ID NO: 2639394 - DNA, 14 bp, Homo sapiens
agtggcagctgctt

SEQ ID NO: 2639395 - DNA, 13 bp, Homo sapiens
agtggcagggctc

SEQ ID NO: 2639396 - DNA, 15 bp, Homo sapiens
agtggcatggctcca

SEQ ID NO: 2639397 - DNA, 14 bp, Homo sapiens
agtggccactcagc

SEQ ID NO: 2639398 - DNA, 15 bp, Homo sapiens
agtggcctcaaccct

SEQ ID NO: 2639399 - DNA, 14 bp, Homo sapiens
agtggctgctgccc

SEQ ID NO: 2639400 - DNA, 16 bp, Homo sapiens
agtggctgctgcccag

SEQ ID NO: 2639401 - DNA, 17 bp, Homo sapiens
agtggctgtcatcagcc

SEQ ID NO: 2639402 - DNA, 19 bp, Homo sapiens
agtggcttttttcctcctg

SEQ ID NO: 2639403 - DNA, 14 bp, Homo sapiens
agtgggagccaggg

SEQ ID NO: 2639404 - DNA, 15 bp, Homo sapiens
agtgggagctgcctg

SEQ ID NO: 2639405 - DNA, 11 bp, Homo sapiens
agtgggagggg

SEQ ID NO: 2639406 - DNA, 14 bp, Homo sapiens
agtgggaggggcag

SEQ ID NO: 2639407 - DNA, 22 bp, Homo sapiens
agtgggaggggcaggctgacat

SEQ ID NO: 2639408 - DNA, 14 bp, Homo sapiens
agtgggccagtgtg

SEQ ID NO: 2639409 - DNA, 20 bp, Homo sapiens
agtggggttatctctgtgtt

SEQ ID NO: 2639410 - DNA, 18 bp, Homo sapiens
agtgggtgaataatacag

SEQ ID NO: 2639411 - DNA, 18 bp, Homo sapiens
agtgggtggtggatctgt

SEQ ID NO: 2639412 - DNA, 19 bp, Homo sapiens
agtgggttattctggagtt

SEQ ID NO: 2639413 - DNA, 14 bp, Homo sapiens
agtggtctttgtaa

SEQ ID NO: 2639414 - DNA, 17 bp, Homo sapiens
agtggtgctcagttgta

SEQ ID NO: 2639415 - DNA, 20 bp, Homo sapiens
agtggtggttttctgttctt

SEQ ID NO: 2639416 - DNA, 17 bp, Homo sapiens
agtgtaaagcattccaa

SEQ ID NO: 2639417 - DNA, 20 bp, Homo sapiens
agtgtaaagcattccaacaa

SEQ ID NO: 2639418 - DNA, 15 bp, Homo sapiens
agtgtaacagctgag

SEQ ID NO: 2639419 - DNA, 16 bp, Homo sapiens
agtgtaacagctgagg

SEQ ID NO: 2639420 - DNA, 16 bp, Homo sapiens
agtgtaatttctttgc

SEQ ID NO: 2639421 - DNA, 15 bp, Homo sapiens
agtgtacagtcttgt

SEQ ID NO: 2639422 - DNA, 17 bp, Homo sapiens
agtgtacagtcttgtat

SEQ ID NO: 2639423 - DNA, 17 bp, Homo sapiens
agtgtagaagcattcct

SEQ ID NO: 2639424 - DNA, 19 bp, Homo sapiens
agtgtagaagcattccttc

SEQ ID NO: 2639425 - DNA, 20 bp, Homo sapiens
agtgtagaagcattccttct

SEQ ID NO: 2639426 - DNA, 22 bp, Homo sapiens
agtgtagaagcattccttcttt

SEQ ID NO: 2639427 - DNA, 15 bp, Homo sapiens
agtgtagatcagagc

SEQ ID NO: 2639428 - DNA, 15 bp, Homo sapiens
agtgtagccttgccc

SEQ ID NO: 2639429 - DNA, 20 bp, Homo sapiens
agtgtatggaaataaatgta

SEQ ID NO: 2639430 - DNA, 21 bp, Homo sapiens
agtgtatggaaataaatgtat

SEQ ID NO: 2639431 - DNA, 22 bp, Homo sapiens
agtgtatggaaataaatgtatc

SEQ ID NO: 2639432 - DNA, 18 bp, Homo sapiens
agtgtatttttttactaa

SEQ ID NO: 2639433 - DNA, 15 bp, Homo sapiens
agtgtcaagttgtgc

SEQ ID NO: 2639434 - DNA, 22 bp, Homo sapiens
agtgtcaagttgtgcttgttta

SEQ ID NO: 2639435 - DNA, 19 bp, Homo sapiens
agtgtcacttacctagatt

SEQ ID NO: 2639436 - DNA, 14 bp, Homo sapiens
agtgtcaggaggaa

SEQ ID NO: 2639437 - DNA, 16 bp, Homo sapiens
agtgtcatcagaagat

SEQ ID NO: 2639438 - DNA, 20 bp, Homo sapiens
agtgtcatcagaagataact

SEQ ID NO: 2639439 - DNA, 19 bp, Homo sapiens
agtgtcatttatgaaaaga

SEQ ID NO: 2639440 - DNA, 17 bp, Homo sapiens
agtgtccaaagcagggt

SEQ ID NO: 2639441 - DNA, 14 bp, Homo sapiens
agtgtcccctccac

SEQ ID NO: 2639442 - DNA, 15 bp, Homo sapiens
agtgtctcacactgg

SEQ ID NO: 2639443 - DNA, 22 bp, Homo sapiens
agtgtctgtatcggagacagtg

SEQ ID NO: 2639444 - DNA, 22 bp, Homo sapiens
agtgtctgtcccggggtcctgt

SEQ ID NO: 2639445 - DNA, 15 bp, Homo sapiens
agtgtcttaattaaa

SEQ ID NO: 2639446 - DNA, 17 bp, Homo sapiens
agtgtcttaattaaaag

SEQ ID NO: 2639447 - DNA, 19 bp, Homo sapiens
agtgtcttcacggcaggac

SEQ ID NO: 2639448 - DNA, 13 bp, Homo sapiens
agtgtcttccata

SEQ ID NO: 2639449 - DNA, 15 bp, Homo sapiens
agtgtcttccataat

SEQ ID NO: 2639450 - DNA, 13 bp, Homo sapiens
agtgtctttccac

SEQ ID NO: 2639451 - DNA, 23 bp, Homo sapiens
agtgtctttccacggagccactc

SEQ ID NO: 2639452 - DNA, 13 bp, Homo sapiens
agtgtgaagttag

SEQ ID NO: 2639453 - DNA, 21 bp, Homo sapiens
agtgtgaagttagaattcctt

SEQ ID NO: 2639454 - DNA, 14 bp, Homo sapiens
agtgtgaccaggca

SEQ ID NO: 2639455 - DNA, 19 bp, Homo sapiens
agtgtgagtaagagctggt

SEQ ID NO: 2639456 - DNA, 21 bp, Homo sapiens
agtgtgattgggaataaatat

SEQ ID NO: 2639457 - DNA, 22 bp, Homo sapiens
agtgtgattgggaataaatatg

SEQ ID NO: 2639458 - DNA, 15 bp, Homo sapiens
agtgtgcatattgta

SEQ ID NO: 2639459 - DNA, 17 bp, Homo sapiens
agtgtgcatattgtaca

SEQ ID NO: 2639460 - DNA, 18 bp, Homo sapiens
agtgtgcatattgtacac

SEQ ID NO: 2639461 - DNA, 21 bp, Homo sapiens
agtgtgcctgaagtcccagat

SEQ ID NO: 2639462 - DNA, 12 bp, Homo sapiens
agtgtgctggag

SEQ ID NO: 2639463 - DNA, 17 bp, Homo sapiens
agtgtggaaattaagaa

SEQ ID NO: 2639464 - DNA, 19 bp, Homo sapiens
agtgtggaaattaagaaga

SEQ ID NO: 2639465 - DNA, 19 bp, Homo sapiens
agtgtgggtctgtgtgtgt

SEQ ID NO: 2639466 - DNA, 16 bp, Homo sapiens
agtgtgtattgttccc

SEQ ID NO: 2639467 - DNA, 21 bp, Homo sapiens
agtgtgtccaagtgtgtgtgc

SEQ ID NO: 2639468 - DNA, 17 bp, Homo sapiens
agtgtgtgcaagtatgt

SEQ ID NO: 2639469 - DNA, 17 bp, Homo sapiens
agtgtgttctgattaga

SEQ ID NO: 2639470 - DNA, 20 bp, Homo sapiens
agtgtgttctgattagaaat

SEQ ID NO: 2639471 - DNA, 15 bp, Homo sapiens
agtgtgttgttgctt

SEQ ID NO: 2639472 - DNA, 22 bp, Homo sapiens
agtgtgttgttgctttaggctc

SEQ ID NO: 2639473 - DNA, 20 bp, Homo sapiens
agtgtgtttccttcagtgca

SEQ ID NO: 2639474 - DNA, 15 bp, Homo sapiens
agtgttaatactagt

SEQ ID NO: 2639475 - DNA, 19 bp, Homo sapiens
agtgttaatactagttgtg

SEQ ID NO: 2639476 - DNA, 20 bp, Homo sapiens
agtgttaatcaatttaaacc

SEQ ID NO: 2639477 - DNA, 19 bp, Homo sapiens
agtgttagggaagggcctg

SEQ ID NO: 2639478 - DNA, 19 bp, Homo sapiens
agtgttatgcggtctaggg

SEQ ID NO: 2639479 - DNA, 22 bp, Homo sapiens
agtgttattagtgtatgctttg

SEQ ID NO: 2639480 - DNA, 22 bp, Homo sapiens
agtgttattttctttgaaattg

SEQ ID NO: 2639481 - DNA, 16 bp, Homo sapiens
agtgttccccttccac

SEQ ID NO: 2639482 - DNA, 20 bp, Homo sapiens
agtgttgtggatttaacaga

SEQ ID NO: 2639483 - DNA, 19 bp, Homo sapiens
agtgtttcgacagctgatt

SEQ ID NO: 2639484 - DNA, 14 bp, Homo sapiens
agtgtttctgttat

SEQ ID NO: 2639485 - DNA, 21 bp, Homo sapiens
agtgtttgggtatattcattt

SEQ ID NO: 2639486 - DNA, 18 bp, Homo sapiens
agtgttttggaataaaat

SEQ ID NO: 2639487 - DNA, 21 bp, Homo sapiens
agtgtttttacctctgtcttg

SEQ ID NO: 2639488 - DNA, 20 bp, Homo sapiens
agtgtttttgtaaagtgtgg

SEQ ID NO: 2639489 - DNA, 15 bp, Homo sapiens
agttaagaagctgtt

SEQ ID NO: 2639490 - DNA, 15 bp, Homo sapiens
agttaagtgaatgtc

SEQ ID NO: 2639491 - DNA, 17 bp, Homo sapiens
agttacagcgagaggca

SEQ ID NO: 2639492 - DNA, 13 bp, Homo sapiens
agttacagctgtg

SEQ ID NO: 2639493 - DNA, 16 bp, Homo sapiens
agttacagctgtgatt

SEQ ID NO: 2639494 - DNA, 13 bp, Homo sapiens
agttactcagaat

SEQ ID NO: 2639495 - DNA, 17 bp, Homo sapiens
agttactccagtgccaa

SEQ ID NO: 2639496 - DNA, 17 bp, Homo sapiens
agttactgttgtgacct

SEQ ID NO: 2639497 - DNA, 14 bp, Homo sapiens
agttacttcctatc

SEQ ID NO: 2639498 - DNA, 19 bp, Homo sapiens
agttactttgtcagaggca

SEQ ID NO: 2639499 - DNA, 14 bp, Homo sapiens
agttagaattcctt

SEQ ID NO: 2639500 - DNA, 21 bp, Homo sapiens
agttagaattccttcagggtg

SEQ ID NO: 2639501 - DNA, 16 bp, Homo sapiens
agttagcaaactttgt

SEQ ID NO: 2639502 - DNA, 14 bp, Homo sapiens
agttagctcaggag

SEQ ID NO: 2639503 - DNA, 19 bp, Homo sapiens
agttagctcaggaggcttg

SEQ ID NO: 2639504 - DNA, 12 bp, Homo sapiens
agttaggaaata

SEQ ID NO: 2639505 - DNA, 18 bp, Homo sapiens
agttaggatagcattttt

SEQ ID NO: 2639506 - DNA, 17 bp, Homo sapiens
agttagggaatggcaca

SEQ ID NO: 2639507 - DNA, 17 bp, Homo sapiens
agttagtagcatgttga

SEQ ID NO: 2639508 - DNA, 23 bp, Homo sapiens
agttagttctctcgtaactggtt

SEQ ID NO: 2639509 - DNA, 12 bp, Homo sapiens
agttataaatca

SEQ ID NO: 2639510 - DNA, 19 bp, Homo sapiens
agttatagtatatctggac

SEQ ID NO: 2639511 - DNA, 15 bp, Homo sapiens
agttatagtttcaga

SEQ ID NO: 2639512 - DNA, 18 bp, Homo sapiens
agttatcatgcatgttat

SEQ ID NO: 2639513 - DNA, 15 bp, Homo sapiens
agttatgtgaatgat

SEQ ID NO: 2639514 - DNA, 21 bp, Homo sapiens
agttattgtacagctgtttaa

SEQ ID NO: 2639515 - DNA, 22 bp, Homo sapiens
agttatttatgcctctgtattt

SEQ ID NO: 2639516 - DNA, 19 bp, Homo sapiens
agttattttaattatcttt

SEQ ID NO: 2639517 - DNA, 21 bp, Homo sapiens
agttatttttatttatttaaa

SEQ ID NO: 2639518 - DNA, 18 bp, Homo sapiens
agttcaataaatgtctgt

SEQ ID NO: 2639519 - DNA, 12 bp, Homo sapiens
agttcaatgatc

SEQ ID NO: 2639520 - DNA, 16 bp, Homo sapiens
agttcaatgatctagg

SEQ ID NO: 2639521 - DNA, 23 bp, Homo sapiens
agttcaatgatctaggtttaact

SEQ ID NO: 2639522 - DNA, 19 bp, Homo sapiens
agttcaggtaacaggcaga

SEQ ID NO: 2639523 - DNA, 20 bp, Homo sapiens
agttcaggtaacaggcagat

SEQ ID NO: 2639524 - DNA, 21 bp, Homo sapiens
agttcaggtagctgcccctgg

SEQ ID NO: 2639525 - DNA, 17 bp, Homo sapiens
agttcagtacctggagg

SEQ ID NO: 2639526 - DNA, 19 bp, Homo sapiens
agttcagtacctggaggag

SEQ ID NO: 2639527 - DNA, 20 bp, Homo sapiens
agttcagtacctggaggagg

SEQ ID NO: 2639528 - DNA, 19 bp, Homo sapiens
agttcagttttaccagatg

SEQ ID NO: 2639529 - DNA, 18 bp, Homo sapiens
agttcataaatttatggt

SEQ ID NO: 2639530 - DNA, 14 bp, Homo sapiens
agttcataccctgt

SEQ ID NO: 2639531 - DNA, 19 bp, Homo sapiens
agttcatattccatattta

SEQ ID NO: 2639532 - DNA, 20 bp, Homo sapiens
agttcatattccatatttat

SEQ ID NO: 2639533 - DNA, 20 bp, Homo sapiens
agttcatccaatcctcactg

SEQ ID NO: 2639534 - DNA, 18 bp, Homo sapiens
agttccaccatcaagcca

SEQ ID NO: 2639535 - DNA, 21 bp, Homo sapiens
agttccaccatcaagccacca

SEQ ID NO: 2639536 - DNA, 21 bp, Homo sapiens
agttccactgagctccatgtg

SEQ ID NO: 2639537 - DNA, 15 bp, Homo sapiens
agttcccatgttaaa

SEQ ID NO: 2639538 - DNA, 14 bp, Homo sapiens
agttccccatgcag

SEQ ID NO: 2639539 - DNA, 15 bp, Homo sapiens
agttccctacttcct

SEQ ID NO: 2639540 - DNA, 17 bp, Homo sapiens
agttcccttggcctcag

SEQ ID NO: 2639541 - DNA, 18 bp, Homo sapiens
agttcctctagtgccctc

SEQ ID NO: 2639542 - DNA, 20 bp, Homo sapiens
agttcctgcggagtgaagag

SEQ ID NO: 2639543 - DNA, 23 bp, Homo sapiens
agttcctgctacaacttcagcag

SEQ ID NO: 2639544 - DNA, 14 bp, Homo sapiens
agttcgagaccagc

SEQ ID NO: 2639545 - DNA, 21 bp, Homo sapiens
agttcgagaccagcctggcca

SEQ ID NO: 2639546 - DNA, 21 bp, Homo sapiens
agttcgatgggcccaattctt

SEQ ID NO: 2639547 - DNA, 23 bp, Homo sapiens
agttctacctcaggcagctcaag

SEQ ID NO: 2639548 - DNA, 13 bp, Homo sapiens
agttctagagaag

SEQ ID NO: 2639549 - DNA, 15 bp, Homo sapiens
agttctagtttgcat

SEQ ID NO: 2639550 - DNA, 16 bp, Homo sapiens
agttctagtttgcatt

SEQ ID NO: 2639551 - DNA, 19 bp, Homo sapiens
agttctcactgttccctct

SEQ ID NO: 2639552 - DNA, 19 bp, Homo sapiens
agttctcagggctcctgcc

SEQ ID NO: 2639553 - DNA, 21 bp, Homo sapiens
agttctgcagataaacagtag

SEQ ID NO: 2639554 - DNA, 12 bp, Homo sapiens
agttctgctcta

SEQ ID NO: 2639555 - DNA, 19 bp, Homo sapiens
agttctgggtgctccctac

SEQ ID NO: 2639556 - DNA, 23 bp, Homo sapiens
agttctgtactcaaatgtagcca

SEQ ID NO: 2639557 - DNA, 16 bp, Homo sapiens
agttcttagttgctgt

SEQ ID NO: 2639558 - DNA, 17 bp, Homo sapiens
agttgaaaaacagctga

SEQ ID NO: 2639559 - DNA, 18 bp, Homo sapiens
agttgaaaagactccaaa

SEQ ID NO: 2639560 - DNA, 19 bp, Homo sapiens
agttgaaaagactccaaag

SEQ ID NO: 2639561 - DNA, 20 bp, Homo sapiens
agttgaatggcctgccttga

SEQ ID NO: 2639562 - DNA, 17 bp, Homo sapiens
agttgacatgagattta

SEQ ID NO: 2639563 - DNA, 21 bp, Homo sapiens
agttgatagcacagaccctgc

SEQ ID NO: 2639564 - DNA, 23 bp, Homo sapiens
agttgatagcacagaccctgccc

SEQ ID NO: 2639565 - DNA, 15 bp, Homo sapiens
agttgatatagaaca

SEQ ID NO: 2639566 - DNA, 21 bp, Homo sapiens
agttgatcgcctttcccaggt

SEQ ID NO: 2639567 - DNA, 16 bp, Homo sapiens
agttgatgttgcattt

SEQ ID NO: 2639568 - DNA, 17 bp, Homo sapiens
agttgattcagctctgc

SEQ ID NO: 2639569 - DNA, 23 bp, Homo sapiens
agttgattcagctctgcaagaat

SEQ ID NO: 2639570 - DNA, 13 bp, Homo sapiens
agttgcaataata

SEQ ID NO: 2639571 - DNA, 19 bp, Homo sapiens
agttgcaattgaattaaat

SEQ ID NO: 2639572 - DNA, 15 bp, Homo sapiens
agttgcacggctgct

SEQ ID NO: 2639573 - DNA, 17 bp, Homo sapiens
agttgcacggctgctga

SEQ ID NO: 2639574 - DNA, 20 bp, Homo sapiens
agttgcacggctgctgaggc

SEQ ID NO: 2639575 - DNA, 16 bp, Homo sapiens
agttgcgtggactctg

SEQ ID NO: 2639576 - DNA, 14 bp, Homo sapiens
agttgcttgtaaaa

SEQ ID NO: 2639577 - DNA, 14 bp, Homo sapiens
agttggaaatattc

SEQ ID NO: 2639578 - DNA, 16 bp, Homo sapiens
agttggctaggacccc

SEQ ID NO: 2639579 - DNA, 19 bp, Homo sapiens
agttgtaccgcaatgtgac

SEQ ID NO: 2639580 - DNA, 18 bp, Homo sapiens
agttgtagaatgtattgt

SEQ ID NO: 2639581 - DNA, 21 bp, Homo sapiens
agttgtagaatgtattgtacc

SEQ ID NO: 2639582 - DNA, 18 bp, Homo sapiens
agtattggggtctgaccc

SEQ ID NO: 2639583 - DNA, 15 bp, Homo sapiens
agtatttatatattt

SEQ ID NO: 2639584 - DNA, 20 bp, Homo sapiens
agtatttatatatttataac

SEQ ID NO: 2639585 - DNA, 15 bp, Homo sapiens
agtatttatttaatg

SEQ ID NO: 2639586 - DNA, 20 bp, Homo sapiens
agtatttatttaatgttatg

SEQ ID NO: 2639587 - DNA, 17 bp, Homo sapiens
agtattttgctggaata

SEQ ID NO: 2639588 - DNA, 23 bp, Homo sapiens
agtattttggttcttagttctca

SEQ ID NO: 2639589 - DNA, 17 bp, Homo sapiens
agtcaaaccataaactt

SEQ ID NO: 2639590 - DNA, 12 bp, Homo sapiens
agtcaaagtaaa

SEQ ID NO: 2639591 - DNA, 21 bp, Homo sapiens
agtcaaagtaaaacttgctgc

SEQ ID NO: 2639592 - DNA, 22 bp, Homo sapiens
agtcaaatttgaaaataattgt

SEQ ID NO: 2639593 - DNA, 15 bp, Homo sapiens
agtcaacctgggcaa

SEQ ID NO: 2639594 - DNA, 15 bp, Homo sapiens
agtcaagagcatcct

SEQ ID NO: 2639595 - DNA, 16 bp, Homo sapiens
agtcaagtgaaaaagg

SEQ ID NO: 2639596 - DNA, 20 bp, Homo sapiens
agtcaagtgaaaaaggagga

SEQ ID NO: 2639597 - DNA, 23 bp, Homo sapiens
agtcaatgttttcagttctcttg

SEQ ID NO: 2639598 - DNA, 16 bp, Homo sapiens
agtcacaagagcccag

SEQ ID NO: 2639599 - DNA, 22 bp, Homo sapiens
agtcacacagtattacttctgc

SEQ ID NO: 2639600 - DNA, 15 bp, Homo sapiens
agtcacacagtgagt

SEQ ID NO: 2639601 - DNA, 16 bp, Homo sapiens
agtcacccatgaagac

SEQ ID NO: 2639602 - DNA, 20 bp, Homo sapiens
agtcacccatgaagacagga

SEQ ID NO: 2639603 - DNA, 13 bp, Homo sapiens
agtcaccccagga

SEQ ID NO: 2639604 - DNA, 19 bp, Homo sapiens
agtcaccccggccacctgc

SEQ ID NO: 2639605 - DNA, 18 bp, Homo sapiens
agtcacgtggaggagcag

SEQ ID NO: 2639606 - DNA, 16 bp, Homo sapiens
agtcactgagacagcc

SEQ ID NO: 2639607 - DNA, 17 bp, Homo sapiens
agtcactgcctctccct

SEQ ID NO: 2639608 - DNA, 21 bp, Homo sapiens
agtcactgcctctccctggcc

SEQ ID NO: 2639609 - DNA, 14 bp, Homo sapiens
agtcagagagaatc

SEQ ID NO: 2639610 - DNA, 14 bp, Homo sapiens
agtcagaggatggc

SEQ ID NO: 2639611 - DNA, 18 bp, Homo sapiens
agtcagaggatggccagt

SEQ ID NO: 2639612 - DNA, 22 bp, Homo sapiens
agtcagaggatggccagtgtct

SEQ ID NO: 2639613 - DNA, 14 bp, Homo sapiens
agtcagatgcccag

SEQ ID NO: 2639614 - DNA, 14 bp, Homo sapiens
agtcagcagaactg

SEQ ID NO: 2639615 - DNA, 11 bp, Homo sapiens
agtcagcctct

SEQ ID NO: 2639616 - DNA, 15 bp, Homo sapiens
agtcagcctctctcc

SEQ ID NO: 2639617 - DNA, 18 bp, Homo sapiens
agtcagcctctctcccag

SEQ ID NO: 2639618 - DNA, 21 bp, Homo sapiens
agtcagcctctctcccagtct

SEQ ID NO: 2639619 - DNA, 19 bp, Homo sapiens
agtcagctttgccttccac

SEQ ID NO: 2639620 - DNA, 22 bp, Homo sapiens
agtcagctttgccttccacgct

SEQ ID NO: 2639621 - DNA, 14 bp, Homo sapiens
agtcaggggcagct

SEQ ID NO: 2639622 - DNA, 14 bp, Homo sapiens
agtcaggtccaatt

SEQ ID NO: 2639623 - DNA, 14 bp, Homo sapiens
aggggcccgtggga

SEQ ID NO: 2639624 - DNA, 19 bp, Homo sapiens
aggggcctcttatgggctg

SEQ ID NO: 2639625 - DNA, 21 bp, Homo sapiens
aggggcctcttatgggctggg

SEQ ID NO: 2639626 - DNA, 23 bp, Homo sapiens
aggggcgccgcaaaccacactgg

SEQ ID NO: 2639627 - DNA, 16 bp, Homo sapiens
aggggcgctggcccag

SEQ ID NO: 2639628 - DNA, 21 bp, Homo sapiens
aggggcgctggcccagccggc

SEQ ID NO: 2639629 - DNA, 22 bp, Homo sapiens
aggggcgctggcccagccggcc

SEQ ID NO: 2639630 - DNA, 19 bp, Homo sapiens
aggggcgggacccaggcac

SEQ ID NO: 2639631 - DNA, 13 bp, Homo sapiens
aggggctcctgga

SEQ ID NO: 2639632 - DNA, 23 bp, Homo sapiens
aggggctcctggaaaggctcagt

SEQ ID NO: 2639633 - DNA, 22 bp, Homo sapiens
aggggctctcagctcagcgcca

SEQ ID NO: 2639634 - DNA, 23 bp, Homo sapiens
aggggctggccttcctgccctac

SEQ ID NO: 2639635 - DNA, 17 bp, Homo sapiens
agggggatatgaatgga

SEQ ID NO: 2639636 - DNA, 19 bp, Homo sapiens
agggggtcccagtgggagg

SEQ ID NO: 2639637 - DNA, 23 bp, Homo sapiens
agggggtgattagagggaggaga

SEQ ID NO: 2639638 - DNA, 20 bp, Homo sapiens
agggggtgtctcaggccaca

SEQ ID NO: 2639639 - DNA, 15 bp, Homo sapiens
aggggtcaggctcca

SEQ ID NO: 2639640 - DNA, 20 bp, Homo sapiens
aggggtcagggaccaaggac

SEQ ID NO: 2639641 - DNA, 18 bp, Homo sapiens
aggggtcccagccacccc

SEQ ID NO: 2639642 - DNA, 22 bp, Homo sapiens
aggggtgatttcagagagggca

SEQ ID NO: 2639643 - DNA, 16 bp, Homo sapiens
aggggtgccccctcct

SEQ ID NO: 2639644 - DNA, 20 bp, Homo sapiens
aggggtgccccctcctctcc

SEQ ID NO: 2639645 - DNA, 18 bp, Homo sapiens
aggggtgggacaccctgt

SEQ ID NO: 2639646 - DNA, 22 bp, Homo sapiens
aggggtgggacaccctgtgatg

SEQ ID NO: 2639647 - DNA, 22 bp, Homo sapiens
aggggttttcgaagctcagccc

SEQ ID NO: 2639648 - DNA, 19 bp, Homo sapiens
agggtaccttgaacactgg

SEQ ID NO: 2639649 - DNA, 19 bp, Homo sapiens
agggtactaaggaatcttt

SEQ ID NO: 2639650 - DNA, 13 bp, Homo sapiens
agggtcagagagg

SEQ ID NO: 2639651 - DNA, 21 bp, Homo sapiens
agggtcagagaggagtcagag

SEQ ID NO: 2639652 - DNA, 13 bp, Homo sapiens
agggtcaggaagg

SEQ ID NO: 2639653 - DNA, 22 bp, Homo sapiens
agggtcaggaaggatgagcatt

SEQ ID NO: 2639654 - DNA, 23 bp, Homo sapiens
agggtccacaggaagtgaagaat

SEQ ID NO: 2639655 - DNA, 20 bp, Homo sapiens
agggtcccatttctcactga

SEQ ID NO: 2639656 - DNA, 14 bp, Homo sapiens
agggtcctggctcc

SEQ ID NO: 2639657 - DNA, 19 bp, Homo sapiens
agggtcctggctcctgagg

SEQ ID NO: 2639658 - DNA, 18 bp, Homo sapiens
agggtcctttagtacctg

SEQ ID NO: 2639659 - DNA, 23 bp, Homo sapiens
agggtctcactatgttgcccagg

SEQ ID NO: 2639660 - DNA, 14 bp, Homo sapiens
agggtctcactctg

SEQ ID NO: 2639661 - DNA, 21 bp, Homo sapiens
agggtctcactctgtcgccca

SEQ ID NO: 2639662 - DNA, 22 bp, Homo sapiens
agggtctctagtgctgtgaaaa

SEQ ID NO: 2639663 - DNA, 15 bp, Homo sapiens
agggtctctgctgcc

SEQ ID NO: 2639664 - DNA, 16 bp, Homo sapiens
agggtctctgctgccg

SEQ ID NO: 2639665 - DNA, 21 bp, Homo sapiens
agggtcttttcatctgggaaa

SEQ ID NO: 2639666 - DNA, 22 bp, Homo sapiens
agggtgatgggaaagcattgta

SEQ ID NO: 2639667 - DNA, 17 bp, Homo sapiens
agggtgctgcttccctc

SEQ ID NO: 2639668 - DNA, 21 bp, Homo sapiens
agggtggcatcccagtggcct

SEQ ID NO: 2639669 - DNA, 17 bp, Homo sapiens
agggtggtgctgggact

SEQ ID NO: 2639670 - DNA, 15 bp, Homo sapiens
agggtggtggagcca

SEQ ID NO: 2639671 - DNA, 22 bp, Homo sapiens
agggtgtccggtccctgtccca

SEQ ID NO: 2639672 - DNA, 13 bp, Homo sapiens
agggttaagaaaa

SEQ ID NO: 2639673 - DNA, 16 bp, Homo sapiens
agggttagggaggggt

SEQ ID NO: 2639674 - DNA, 21 bp, Homo sapiens
agggttcctgtagacctaggg

SEQ ID NO: 2639675 - DNA, 23 bp, Homo sapiens
agggttcctgtagacctagggag

SEQ ID NO: 2639676 - DNA, 18 bp, Homo sapiens
agggttgaccccagagga

SEQ ID NO: 2639677 - DNA, 13 bp, Homo sapiens
agggttgggctgg

SEQ ID NO: 2639678 - DNA, 23 bp, Homo sapiens
agggttgggttcatctgagcaag

SEQ ID NO: 2639679 - DNA, 21 bp, Homo sapiens
agggttgttaatggtgcaaat

SEQ ID NO: 2639680 - DNA, 17 bp, Homo sapiens
agggtttcagagagcct

SEQ ID NO: 2639681 - DNA, 17 bp, Homo sapiens
agggtttctgagctgct

SEQ ID NO: 2639682 - DNA, 18 bp, Homo sapiens
agggttttccaccctgga

SEQ ID NO: 2639683 - DNA, 17 bp, Homo sapiens
aggtaacagaacagctt

SEQ ID NO: 2639684 - DNA, 18 bp, Homo sapiens
aggtaacagaacagcttc

SEQ ID NO: 2639685 - DNA, 19 bp, Homo sapiens
aggtaacagaacagcttca

SEQ ID NO: 2639686 - DNA, 13 bp, Homo sapiens
aggtaacaggcag

SEQ ID NO: 2639687 - DNA, 16 bp, Homo sapiens
aggtaacaggcagata

SEQ ID NO: 2639688 - DNA, 21 bp, Homo sapiens
aggtaatccaagatattttaa

SEQ ID NO: 2639689 - DNA, 13 bp, Homo sapiens
aggtaatgaggga

SEQ ID NO: 2639690 - DNA, 16 bp, Homo sapiens
aggtaatgtgaataaa

SEQ ID NO: 2639691 - DNA, 15 bp, Homo sapiens
aggtactaaatacct

SEQ ID NO: 2639692 - DNA, 19 bp, Homo sapiens
aggtagaaatatctgaaaa

SEQ ID NO: 2639693 - DNA, 14 bp, Homo sapiens
aggtagctgcccct

SEQ ID NO: 2639694 - DNA, 22 bp, Homo sapiens
aggtatcagttgcaataatact

SEQ ID NO: 2639695 - DNA, 22 bp, Homo sapiens
aggtatgaccttctaggaagct

SEQ ID NO: 2639696 - DNA, 21 bp, Homo sapiens
aggtatgcaatcaaatctgct

SEQ ID NO: 2639697 - DNA, 20 bp, Homo sapiens
aggtatgttgcctttatggt

SEQ ID NO: 2639698 - DNA, 21 bp, Homo sapiens
aggtcaaggctgcagtgagcc

SEQ ID NO: 2639699 - DNA, 23 bp, Homo sapiens
aggtcaatacagtacaggcagca

SEQ ID NO: 2639700 - DNA, 15 bp, Homo sapiens
aggtcactcctgggg

SEQ ID NO: 2639701 - DNA, 16 bp, Homo sapiens
aggtcactggctctcc

SEQ ID NO: 2639702 - DNA, 21 bp, Homo sapiens
aggtcactggctctccaagtg

SEQ ID NO: 2639703 - DNA, 14 bp, Homo sapiens
aggtcagagcctgc

SEQ ID NO: 2639704 - DNA, 17 bp, Homo sapiens
aggtcagagcctgcagt

SEQ ID NO: 2639705 - DNA, 18 bp, Homo sapiens
aggtcagagcctgcagtt

SEQ ID NO: 2639706 - DNA, 15 bp, Homo sapiens
aggtcagcatgtcta

SEQ ID NO: 2639707 - DNA, 16 bp, Homo sapiens
aggtcaggagttccta

SEQ ID NO: 2639708 - DNA, 20 bp, Homo sapiens
aggtcaggagttcctaacca

SEQ ID NO: 2639709 - DNA, 17 bp, Homo sapiens
aggtcattttttttaag

SEQ ID NO: 2639710 - DNA, 22 bp, Homo sapiens
aggtcattttttttaagaaaaa

SEQ ID NO: 2639711 - DNA, 22 bp, Homo sapiens
aggtccacggtctgttcttgaa

SEQ ID NO: 2639712 - DNA, 17 bp, Homo sapiens
aggtccagccctggctg

SEQ ID NO: 2639713 - DNA, 22 bp, Homo sapiens
aggtccagccctggctgaagga

SEQ ID NO: 2639714 - DNA, 20 bp, Homo sapiens
aggtcctctgatacccagag

SEQ ID NO: 2639715 - DNA, 21 bp, Homo sapiens
aggtcctgcagtctggctgag

SEQ ID NO: 2639716 - DNA, 14 bp, Homo sapiens
aggtcgaggcagga

SEQ ID NO: 2639717 - DNA, 15 bp, Homo sapiens
aggtctcctcttaaa

SEQ ID NO: 2639718 - DNA, 23 bp, Homo sapiens
aggtctcctcttaaaaaataaaa

SEQ ID NO: 2639719 - DNA, 13 bp, Homo sapiens
aggtctgaaatgg

SEQ ID NO: 2639720 - DNA, 15 bp, Homo sapiens
aggtctgaaatggag

SEQ ID NO: 2639721 - DNA, 17 bp, Homo sapiens
aggtcttgaactcctgg

SEQ ID NO: 2639722 - DNA, 18 bp, Homo sapiens
aggtcttgaactcctggc

SEQ ID NO: 2639723 - DNA, 22 bp, Homo sapiens
aggtcttgaactcctggcctca

SEQ ID NO: 2639724 - DNA, 21 bp, Homo sapiens
aggtcttggagctgagcctct

SEQ ID NO: 2639725 - DNA, 15 bp, Homo sapiens
aggtcttttgacatg

SEQ ID NO: 2639726 - DNA, 20 bp, Homo sapiens
aggtgacatgtgaaaccttt

SEQ ID NO: 2639727 - DNA, 20 bp, Homo sapiens
aggtgaccttgcaacttcat

SEQ ID NO: 2639728 - DNA, 19 bp, Homo sapiens
aggtgactgggccctgcct

SEQ ID NO: 2639729 - DNA, 20 bp, Homo sapiens
aggtgactgggccctgcctc

SEQ ID NO: 2639730 - DNA, 22 bp, Homo sapiens
aggtgagcacggccaacaaagc

SEQ ID NO: 2639731 - DNA, 20 bp, Homo sapiens
aggtgatccacccacctcag

SEQ ID NO: 2639732 - DNA, 23 bp, Homo sapiens
aggtgatccacccacctcagcct

SEQ ID NO: 2639733 - DNA, 16 bp, Homo sapiens
aggtgcacaagctcca

SEQ ID NO: 2639734 - DNA, 17 bp, Homo sapiens
aggtgcagagtgcccag

SEQ ID NO: 2639735 - DNA, 20 bp, Homo sapiens
aggtgcagagtgcccagaac

SEQ ID NO: 2639736 - DNA, 16 bp, Homo sapiens
aggtgcagtggctcac

SEQ ID NO: 2639737 - DNA, 17 bp, Homo sapiens
aggtgcccatccctgga

SEQ ID NO: 2639738 - DNA, 20 bp, Homo sapiens
aggtgcccttggaggccagc

SEQ ID NO: 2639739 - DNA, 14 bp, Homo sapiens
aggtgcctccaggt

SEQ ID NO: 2639740 - DNA, 17 bp, Homo sapiens
aggtgcctgtcccaccc

SEQ ID NO: 2639741 - DNA, 16 bp, Homo sapiens
aggtgctacaaaaaca

SEQ ID NO: 2639742 - DNA, 18 bp, Homo sapiens
aggtgctacaaaaacaca

SEQ ID NO: 2639743 - DNA, 22 bp, Homo sapiens
aggtgctacaaaaacacagcaa

SEQ ID NO: 2639744 - DNA, 23 bp, Homo sapiens
aggtgctacaaaaacacagcaag

SEQ ID NO: 2639745 - DNA, 19 bp, Homo sapiens
aggtgctaggaacactcct

SEQ ID NO: 2639746 - DNA, 17 bp, Homo sapiens
aggtgctgccatccagg

SEQ ID NO: 2639747 - DNA, 20 bp, Homo sapiens
aggtggaggttgcagtgagc

SEQ ID NO: 2639748 - DNA, 23 bp, Homo sapiens
aggtggcactttttcatttgcct

SEQ ID NO: 2639749 - DNA, 15 bp, Homo sapiens
aggtggcagccctgt

SEQ ID NO: 2639750 - DNA, 15 bp, Homo sapiens
aggtggcatctctaa

SEQ ID NO: 2639751 - DNA, 15 bp, Homo sapiens
aggtggctctccagt

SEQ ID NO: 2639752 - DNA, 23 bp, Homo sapiens
aggtgggaaatggtatgagctga

SEQ ID NO: 2639753 - DNA, 18 bp, Homo sapiens
aggtgggatcctccaggt

SEQ ID NO: 2639754 - DNA, 13 bp, Homo sapiens
aggtgggcaggtg

SEQ ID NO: 2639755 - DNA, 19 bp, Homo sapiens
aggtgggccagcccctccc

SEQ ID NO: 2639756 - DNA, 21 bp, Homo sapiens
aggtgggccagcccctcccac

SEQ ID NO: 2639757 - DNA, 14 bp, Homo sapiens
aggtgggcccagga

SEQ ID NO: 2639758 - DNA, 22 bp, Homo sapiens
aggtgggccttgctacctcaag

SEQ ID NO: 2639759 - DNA, 15 bp, Homo sapiens
aggtgggctgagccc

SEQ ID NO: 2639760 - DNA, 19 bp, Homo sapiens
aggtgggctgagccctggc

SEQ ID NO: 2639761 - DNA, 18 bp, Homo sapiens
aggtggggagactgggct

SEQ ID NO: 2639762 - DNA, 19 bp, Homo sapiens
aggtggggtcactctggca

SEQ ID NO: 2639763 - DNA, 18 bp, Homo sapiens
aggtggtatgtgtgtgta

SEQ ID NO: 2639764 - DNA, 14 bp, Homo sapiens
aggtggtctgaatg

SEQ ID NO: 2639765 - DNA, 17 bp, Homo sapiens
aggtggtctgaatgttc

SEQ ID NO: 2639766 - DNA, 21 bp, Homo sapiens
aggtggtctgaatgttctgac

SEQ ID NO: 2639767 - DNA, 15 bp, Homo sapiens
aggtgtcatttccat

SEQ ID NO: 2639768 - DNA, 17 bp, Homo sapiens
aggtgtcatttccatta

SEQ ID NO: 2639769 - DNA, 21 bp, Homo sapiens
aggtgtctgcacccaggggtg

SEQ ID NO: 2639770 - DNA, 23 bp, Homo sapiens
aggtgtgaaccaccacacccagc

SEQ ID NO: 2639771 - DNA, 20 bp, Homo sapiens
aggtgtgactgaatttcttt

SEQ ID NO: 2639772 - DNA, 20 bp, Homo sapiens
aggtgtgagtcaccaagccc

SEQ ID NO: 2639773 - DNA, 15 bp, Homo sapiens
aggtgtgctctgatc

SEQ ID NO: 2639774 - DNA, 18 bp, Homo sapiens
aggtgtgggggctgcagc

SEQ ID NO: 2639775 - DNA, 18 bp, Homo sapiens
aggtgttgattttctgtt

SEQ ID NO: 2639776 - DNA, 20 bp, Homo sapiens
aggtgtttaaagagaggtta

SEQ ID NO: 2639777 - DNA, 22 bp, Homo sapiens
aggttaaaaaaaggcattgttt

SEQ ID NO: 2639778 - DNA, 17 bp, Homo sapiens
aggttaaggctgaggaa

SEQ ID NO: 2639779 - DNA, 16 bp, Homo sapiens
aggttacaacagattt

SEQ ID NO: 2639780 - DNA, 23 bp, Homo sapiens
aggttacaacagatttgtgaact

SEQ ID NO: 2639781 - DNA, 21 bp, Homo sapiens
aggttacaagcctgcacaata

SEQ ID NO: 2639782 - DNA, 15 bp, Homo sapiens
aggttaccaagaagc

SEQ ID NO: 2639783 - DNA, 17 bp, Homo sapiens
aggttataggtcactcc

SEQ ID NO: 2639784 - DNA, 19 bp, Homo sapiens
aggttataggtcactcctg

SEQ ID NO: 2639785 - DNA, 19 bp, Homo sapiens
aggttatcgaaataacaat

SEQ ID NO: 2639786 - DNA, 19 bp, Homo sapiens
aggttattttagtttctgt

SEQ ID NO: 2639787 - DNA, 20 bp, Homo sapiens
aggttattttagtttctgtt

SEQ ID NO: 2639788 - DNA, 16 bp, Homo sapiens
aggttcactaaagcag

SEQ ID NO: 2639789 - DNA, 13 bp, Homo sapiens
aggttcagcttgt

SEQ ID NO: 2639790 - DNA, 17 bp, Homo sapiens
aggttccaactgtatat

SEQ ID NO: 2639791 - DNA, 16 bp, Homo sapiens
aggttccctctgagaa

SEQ ID NO: 2639792 - DNA, 22 bp, Homo sapiens
aggttccctttgacgccatccc

SEQ ID NO: 2639793 - DNA, 23 bp, Homo sapiens
aggttccctttgacgccatccca

SEQ ID NO: 2639794 - DNA, 18 bp, Homo sapiens
aggttccgcttggagcag

SEQ ID NO: 2639795 - DNA, 17 bp, Homo sapiens
aggttctggtgtgaact

SEQ ID NO: 2639796 - DNA, 12 bp, Homo sapiens
aggttgaagagg

SEQ ID NO: 2639797 - DNA, 20 bp, Homo sapiens
aggttgaggggctcctggaa

SEQ ID NO: 2639798 - DNA, 20 bp, Homo sapiens
agctcattctccttgtgtta

SEQ ID NO: 2639799 - DNA, 20 bp, Homo sapiens
agctccaagacctgttggtt

SEQ ID NO: 2639800 - DNA, 22 bp, Homo sapiens
agctccaagacctgttggttcc

SEQ ID NO: 2639801 - DNA, 18 bp, Homo sapiens
agctccaagctcccaggc

SEQ ID NO: 2639802 - DNA, 23 bp, Homo sapiens
agctccactgtcaccctccacct

SEQ ID NO: 2639803 - DNA, 17 bp, Homo sapiens
agctccagacccccagc

SEQ ID NO: 2639804 - DNA, 23 bp, Homo sapiens
agctccagacccccagcaaccct

SEQ ID NO: 2639805 - DNA, 15 bp, Homo sapiens
agctccatctccact

SEQ ID NO: 2639806 - DNA, 22 bp, Homo sapiens
agctcccaagggatggtgccct

SEQ ID NO: 2639807 - DNA, 14 bp, Homo sapiens
agctcccaggaaca

SEQ ID NO: 2639808 - DNA, 18 bp, Homo sapiens
agctcccatttctactct

SEQ ID NO: 2639809 - DNA, 13 bp, Homo sapiens
agctcccctcctc

SEQ ID NO: 2639810 - DNA, 15 bp, Homo sapiens
agctccctaggagac

SEQ ID NO: 2639811 - DNA, 17 bp, Homo sapiens
agctccctaggagacca

SEQ ID NO: 2639812 - DNA, 23 bp, Homo sapiens
agctcccttctctgtagggaact

SEQ ID NO: 2639813 - DNA, 14 bp, Homo sapiens
agctccgtggagca

SEQ ID NO: 2639814 - DNA, 15 bp, Homo sapiens
agctccgtggagcag

SEQ ID NO: 2639815 - DNA, 12 bp, Homo sapiens
agctcctcccac

SEQ ID NO: 2639816 - DNA, 17 bp, Homo sapiens
agctcctcgagggcagg

SEQ ID NO: 2639817 - DNA, 20 bp, Homo sapiens
agctcctcgagggcagggac

SEQ ID NO: 2639818 - DNA, 15 bp, Homo sapiens
agctcctctcctgga

SEQ ID NO: 2639819 - DNA, 12 bp, Homo sapiens
agctcctctggg

SEQ ID NO: 2639820 - DNA, 15 bp, Homo sapiens
agctcctctgggcag

SEQ ID NO: 2639821 - DNA, 19 bp, Homo sapiens
agctcctctgggcaggacc

SEQ ID NO: 2639822 - DNA, 20 bp, Homo sapiens
agctcctctgggcaggacct

SEQ ID NO: 2639823 - DNA, 20 bp, Homo sapiens
agctcctggtcttgagatgt

SEQ ID NO: 2639824 - DNA, 12 bp, Homo sapiens
agctcctgtcct

SEQ ID NO: 2639825 - DNA, 16 bp, Homo sapiens
agctcctgtcctccca

SEQ ID NO: 2639826 - DNA, 21 bp, Homo sapiens
agcttctggtactctcctaga

SEQ ID NO: 2639827 - DNA, 23 bp, Homo sapiens
agcttctggtactctcctagaga

SEQ ID NO: 2639828 - DNA, 12 bp, Homo sapiens
agcttctgtcct

SEQ ID NO: 2639829 - DNA, 16 bp, Homo sapiens
agcttcttaaatgaga

SEQ ID NO: 2639830 - DNA, 17 bp, Homo sapiens
agcttgaaagttttcag

SEQ ID NO: 2639831 - DNA, 22 bp, Homo sapiens
agcttgagggttgggctggtgt

SEQ ID NO: 2639832 - DNA, 16 bp, Homo sapiens
agcttgccctgttaaa

SEQ ID NO: 2639833 - DNA, 22 bp, Homo sapiens
agcttgcgcattctcatggaga

SEQ ID NO: 2639834 - DNA, 16 bp, Homo sapiens
agcttggaagagcctg

SEQ ID NO: 2639835 - DNA, 15 bp, Homo sapiens
agcttggcagccgag

SEQ ID NO: 2639836 - DNA, 14 bp, Homo sapiens
agcttgggaatgga

SEQ ID NO: 2639837 - DNA, 12 bp, Homo sapiens
agcttgggccca

SEQ ID NO: 2639838 - DNA, 17 bp, Homo sapiens
agcttgggcccagctgg

SEQ ID NO: 2639839 - DNA, 20 bp, Homo sapiens
agcttgggcccagctgggct

SEQ ID NO: 2639840 - DNA, 21 bp, Homo sapiens
agcttgggggatgactagagg

SEQ ID NO: 2639841 - DNA, 21 bp, Homo sapiens
agcttgtaaatagctcaggtg

SEQ ID NO: 2639842 - DNA, 21 bp, Homo sapiens
agcttgtatagtgtaaaataa

SEQ ID NO: 2639843 - DNA, 22 bp, Homo sapiens
agcttgtccaacccgaggcccg

SEQ ID NO: 2639844 - DNA, 17 bp, Homo sapiens
agcttgttccctgtctt

SEQ ID NO: 2639845 - DNA, 21 bp, Homo sapiens
agctttaaactcagggacaga

SEQ ID NO: 2639846 - DNA, 22 bp, Homo sapiens
agctttaaccattaaaactgaa

SEQ ID NO: 2639847 - DNA, 21 bp, Homo sapiens
agctttacatgcaatttatta

SEQ ID NO: 2639848 - DNA, 18 bp, Homo sapiens
agctttatacgtgtagct

SEQ ID NO: 2639849 - DNA, 14 bp, Homo sapiens
agctttattcttca

SEQ ID NO: 2639850 - DNA, 21 bp, Homo sapiens
agctttcccaaataaactcta

SEQ ID NO: 2639851 - DNA, 20 bp, Homo sapiens
agctttctgtccttttggca

SEQ ID NO: 2639852 - DNA, 22 bp, Homo sapiens
agctttctgtccttttggcact

SEQ ID NO: 2639853 - DNA, 16 bp, Homo sapiens
agctttgccagctgct

SEQ ID NO: 2639854 - DNA, 16 bp, Homo sapiens
agctttgctaccaaag

SEQ ID NO: 2639855 - DNA, 18 bp, Homo sapiens
agctttggacctaatcca

SEQ ID NO: 2639856 - DNA, 19 bp, Homo sapiens
agctttggacctaatccaa

SEQ ID NO: 2639857 - DNA, 21 bp, Homo sapiens
agctttgtgactgtatataaa

SEQ ID NO: 2639858 - DNA, 23 bp, Homo sapiens
agctttgtttgttgtcagctgaa

SEQ ID NO: 2639859 - DNA, 16 bp, Homo sapiens
agcttttaaaccctat

SEQ ID NO: 2639860 - DNA, 15 bp, Homo sapiens
agcttttattgtata

SEQ ID NO: 2639861 - DNA, 17 bp, Homo sapiens
agcttttattgtataaa

SEQ ID NO: 2639862 - DNA, 19 bp, Homo sapiens
agcttttattgtataaact

SEQ ID NO: 2639863 - DNA, 13 bp, Homo sapiens
agcttttcccttc

SEQ ID NO: 2639864 - DNA, 14 bp, Homo sapiens
agcttttcctccct

SEQ ID NO: 2639865 - DNA, 17 bp, Homo sapiens
agctttttgtcttttct

SEQ ID NO: 2639866 - DNA, 18 bp, Homo sapiens
agcttttttacacaaatg

SEQ ID NO: 2639867 - DNA, 14 bp, Homo sapiens
agcttttttcttta

SEQ ID NO: 2639868 - DNA, 15 bp, Homo sapiens
aggaaaaaaatgact

SEQ ID NO: 2639869 - DNA, 16 bp, Homo sapiens
aggaaaagctgctgac

SEQ ID NO: 2639870 - DNA, 22 bp, Homo sapiens
aggaaaagtacatttaatacag

SEQ ID NO: 2639871 - DNA, 15 bp, Homo sapiens
aggaaacaacagctt

SEQ ID NO: 2639872 - DNA, 15 bp, Homo sapiens
aggaaacccagctct

SEQ ID NO: 2639873 - DNA, 21 bp, Homo sapiens
aggaaacccagctctggtcca

SEQ ID NO: 2639874 - DNA, 17 bp, Homo sapiens
aggaaactcacctgctg

SEQ ID NO: 2639875 - DNA, 19 bp, Homo sapiens
aggaaactgggttcctgca

SEQ ID NO: 2639876 - DNA, 17 bp, Homo sapiens
aggaaagaaagaaggaa

SEQ ID NO: 2639877 - DNA, 16 bp, Homo sapiens
aggaaagcaataaatg

SEQ ID NO: 2639878 - DNA, 18 bp, Homo sapiens
aggaaagcaataaatgaa

SEQ ID NO: 2639879 - DNA, 13 bp, Homo sapiens
aggaaaggccagc

SEQ ID NO: 2639880 - DNA, 15 bp, Homo sapiens
aggaaaggccagctg

SEQ ID NO: 2639881 - DNA, 21 bp, Homo sapiens
aggaaaggccagctggcagca

SEQ ID NO: 2639882 - DNA, 24 bp, Homo sapiens
aggaaaggccagctggcagcagag

SEQ ID NO: 2639883 - DNA, 14 bp, Homo sapiens
aggaaaggctccag

SEQ ID NO: 2639884 - DNA, 16 bp, Homo sapiens
aggaaataaaaccttt

SEQ ID NO: 2639885 - DNA, 20 bp, Homo sapiens
aggaaatcaaatatgcaaag

SEQ ID NO: 2639886 - DNA, 19 bp, Homo sapiens
aggaaatgaaaatgtcttg

SEQ ID NO: 2639887 - DNA, 23 bp, Homo sapiens
aggaaattgagattagagggagg

SEQ ID NO: 2639888 - DNA, 21 bp, Homo sapiens
aggaacagaaggatgaatgag

SEQ ID NO: 2639889 - DNA, 16 bp, Homo sapiens
aggaacatatgaaaat

SEQ ID NO: 2639890 - DNA, 23 bp, Homo sapiens
aggaactcccagcaacacaagct

SEQ ID NO: 2639891 - DNA, 16 bp, Homo sapiens
aggaactgtccagaga

SEQ ID NO: 2639892 - DNA, 23 bp, Homo sapiens
aggaacttaaataatgtgaaact

SEQ ID NO: 2639893 - DNA, 15 bp, Homo sapiens
aggaagaattttaaa

SEQ ID NO: 2639894 - DNA, 14 bp, Homo sapiens
aggaagagagcatg

SEQ ID NO: 2639895 - DNA, 17 bp, Homo sapiens
aggaagagcaggcacat

SEQ ID NO: 2639896 - DNA, 20 bp, Homo sapiens
aggaagagcaggcacatgga

SEQ ID NO: 2639897 - DNA, 16 bp, Homo sapiens
aggaagatcttaaatt

SEQ ID NO: 2639898 - DNA, 18 bp, Homo sapiens
aggaagatcttaaatttt

SEQ ID NO: 2639899 - DNA, 13 bp, Homo sapiens
aggaagcaacgaa

SEQ ID NO: 2639900 - DNA, 18 bp, Homo sapiens
aggaagcaccccatgcca

SEQ ID NO: 2639901 - DNA, 19 bp, Homo sapiens
aggaagcattcagagagca

SEQ ID NO: 2639902 - DNA, 15 bp, Homo sapiens
aggaagccacagctg

SEQ ID NO: 2639903 - DNA, 19 bp, Homo sapiens
aggaagcctgcagtcctgg

SEQ ID NO: 2639904 - DNA, 20 bp, Homo sapiens
aggaagcctgcagtcctgga

SEQ ID NO: 2639905 - DNA, 12 bp, Homo sapiens
aggaagctcagg

SEQ ID NO: 2639906 - DNA, 17 bp, Homo sapiens
aggaagctcagggcctg

SEQ ID NO: 2639907 - DNA, 19 bp, Homo sapiens
aggaaggaaacccagctct

SEQ ID NO: 2639908 - DNA, 20 bp, Homo sapiens
aggaaggaaacccagctctg

SEQ ID NO: 2639909 - DNA, 18 bp, Homo sapiens
aggaaggagagcctgctg

SEQ ID NO: 2639910 - DNA, 14 bp, Homo sapiens
aggaaggatgagca

SEQ ID NO: 2639911 - DNA, 16 bp, Homo sapiens
aggaaggattgtaaaa

SEQ ID NO: 2639912 - DNA, 18 bp, Homo sapiens
aggaaggattgtaaaaaa

SEQ ID NO: 2639913 - DNA, 20 bp, Homo sapiens
aggaaggctcttctccccag

SEQ ID NO: 2639914 - DNA, 21 bp, Homo sapiens
aggaaggctcttctccccaga

SEQ ID NO: 2639915 - DNA, 17 bp, Homo sapiens
aggaagggaccaaggca

SEQ ID NO: 2639916 - DNA, 23 bp, Homo sapiens
aggaagggaccaaggcaaggcag

SEQ ID NO: 2639917 - DNA, 16 bp, Homo sapiens
aggaaggggccagagg

SEQ ID NO: 2639918 - DNA, 18 bp, Homo sapiens
aggaaggggccagaggct

SEQ ID NO: 2639919 - DNA, 20 bp, Homo sapiens
aggaaggggccagaggctcg

SEQ ID NO: 2639920 - DNA, 14 bp, Homo sapiens
aggaaggttctggt

SEQ ID NO: 2639921 - DNA, 14 bp, Homo sapiens
aggaaggttttctc

SEQ ID NO: 2639922 - DNA, 13 bp, Homo sapiens
aggaagtagagga

SEQ ID NO: 2639923 - DNA, 15 bp, Homo sapiens
aggaagtaggaagta

SEQ ID NO: 2639924 - DNA, 17 bp, Homo sapiens
aggaagtgtaacagctg

SEQ ID NO: 2639925 - DNA, 15 bp, Homo sapiens
aggaataatgggctt

SEQ ID NO: 2639926 - DNA, 17 bp, Homo sapiens
aggaataattatttatt

SEQ ID NO: 2639927 - DNA, 18 bp, Homo sapiens
aggaataattatttattt

SEQ ID NO: 2639928 - DNA, 15 bp, Homo sapiens
aggaatacctgtccc

SEQ ID NO: 2639929 - DNA, 17 bp, Homo sapiens
aggaatagttgagcccc

SEQ ID NO: 2639930 - DNA, 21 bp, Homo sapiens
aggaatagttgagccccaagt

SEQ ID NO: 2639931 - DNA, 20 bp, Homo sapiens
aggaatatgacggaagaaca

SEQ ID NO: 2639932 - DNA, 18 bp, Homo sapiens
aggaatatgggagaaata

SEQ ID NO: 2639933 - DNA, 16 bp, Homo sapiens
aggaatcaagagctgc

SEQ ID NO: 2639934 - DNA, 19 bp, Homo sapiens
aggaatcaagagctgccct

SEQ ID NO: 2639935 - DNA, 18 bp, Homo sapiens
aggaatcactcttgtgga

SEQ ID NO: 2639936 - DNA, 16 bp, Homo sapiens
aggaatccactcccag

SEQ ID NO: 2639937 - DNA, 23 bp, Homo sapiens
aggaatccagacccggctgcgtg

SEQ ID NO: 2639938 - DNA, 16 bp, Homo sapiens
aggaatgcctgtgtga

SEQ ID NO: 2639939 - DNA, 15 bp, Homo sapiens
aggaatgctccccca

SEQ ID NO: 2639940 - DNA, 22 bp, Homo sapiens
aggaatgctcccccatcctccc

SEQ ID NO: 2639941 - DNA, 13 bp, Homo sapiens
aggaatgggctgt

SEQ ID NO: 2639942 - DNA, 23 bp, Homo sapiens
aggaattgacccacaagaaatga

SEQ ID NO: 2639943 - DNA, 14 bp, Homo sapiens
aggaattttctttg

SEQ ID NO: 2639944 - DNA, 16 bp, Homo sapiens
aggaattttctttgtg

SEQ ID NO: 2639945 - DNA, 14 bp, Homo sapiens
aggacaacgaggaa

SEQ ID NO: 2639946 - DNA, 18 bp, Homo sapiens
aggacaacgaggaagccc

SEQ ID NO: 2639947 - DNA, 18 bp, Homo sapiens
aggacaattcatgaactt

SEQ ID NO: 2639948 - DNA, 23 bp, Homo sapiens
aggacacactaatcgaactatga

SEQ ID NO: 2639949 - DNA, 23 bp, Homo sapiens
aggacacagatgaaacacaaaca

SEQ ID NO: 2639950 - DNA, 15 bp, Homo sapiens
aggacagctgtcctc

SEQ ID NO: 2639951 - DNA, 16 bp, Homo sapiens
aggacagtgcttcagc

SEQ ID NO: 2639952 - DNA, 19 bp, Homo sapiens
aggacagtgcttcagcctg

SEQ ID NO: 2639953 - DNA, 20 bp, Homo sapiens
aggacataaattagaggtct

SEQ ID NO: 2639954 - DNA, 19 bp, Homo sapiens
aggccgagaagcaagaaag

SEQ ID NO: 2639955 - DNA, 16 bp, Homo sapiens
aggccgagaagccagt

SEQ ID NO: 2639956 - DNA, 12 bp, Homo sapiens
aggccgcagctc

SEQ ID NO: 2639957 - DNA, 13 bp, Homo sapiens
aggccgcagctct

SEQ ID NO: 2639958 - DNA, 18 bp, Homo sapiens
aggccgcagctcttgccc

SEQ ID NO: 2639959 - DNA, 14 bp, Homo sapiens
aggccgctagaggc

SEQ ID NO: 2639960 - DNA, 16 bp, Homo sapiens
aggccgtcctcccggg

SEQ ID NO: 2639961 - DNA, 16 bp, Homo sapiens
aggcctaaaagtaaac

SEQ ID NO: 2639962 - DNA, 17 bp, Homo sapiens
aggacatgctgaagcca

SEQ ID NO: 2639963 - DNA, 21 bp, Homo sapiens
aggacatgtttttgttttctt

SEQ ID NO: 2639964 - DNA, 14 bp, Homo sapiens
aggacattccaaga

SEQ ID NO: 2639965 - DNA, 18 bp, Homo sapiens
aggacattccaagacagt

SEQ ID NO: 2639966 - DNA, 17 bp, Homo sapiens
aggacattgcggacagc

SEQ ID NO: 2639967 - DNA, 14 bp, Homo sapiens
aggacatttctcta

SEQ ID NO: 2639968 - DNA, 13 bp, Homo sapiens
aggaccagctggg

SEQ ID NO: 2639969 - DNA, 22 bp, Homo sapiens
aggaccaggactatagcccagg

SEQ ID NO: 2639970 - DNA, 13 bp, Homo sapiens
aggaccaggcaat

SEQ ID NO: 2639971 - DNA, 18 bp, Homo sapiens
aggacccagacccagtgg

SEQ ID NO: 2639972 - DNA, 18 bp, Homo sapiens
aggacccatcacgcctgt

SEQ ID NO: 2639973 - DNA, 13 bp, Homo sapiens
aggacccttccct

SEQ ID NO: 2639974 - DNA, 22 bp, Homo sapiens
aggacctagggatgttctggcc

SEQ ID NO: 2639975 - DNA, 21 bp, Homo sapiens
agcccagggttcccccagccc

SEQ ID NO: 2639976 - DNA, 23 bp, Homo sapiens
agcccaggtcctctgatacccag

SEQ ID NO: 2639977 - DNA, 16 bp, Homo sapiens
agcccatgcccacctg

SEQ ID NO: 2639978 - DNA, 22 bp, Homo sapiens
agcccatgcccacctgcccatc

SEQ ID NO: 2639979 - DNA, 18 bp, Homo sapiens
agcccatggcactctatg

SEQ ID NO: 2639980 - DNA, 16 bp, Homo sapiens
agccccaaaactctcc

SEQ ID NO: 2639981 - DNA, 20 bp, Homo sapiens
agccccaaaactctcctctg

SEQ ID NO: 2639982 - DNA, 23 bp, Homo sapiens
agccccaaagtcaattaaaggct

SEQ ID NO: 2639983 - DNA, 15 bp, Homo sapiens
agccccacccaggag

SEQ ID NO: 2639984 - DNA, 12 bp, Homo sapiens
agccccagcact

SEQ ID NO: 2639985 - DNA, 15 bp, Homo sapiens
agccccagcactaac

SEQ ID NO: 2639986 - DNA, 18 bp, Homo sapiens
agccccagccccctttgg

SEQ ID NO: 2639987 - DNA, 16 bp, Homo sapiens
agccccaggcctctgt

SEQ ID NO: 2639988 - DNA, 13 bp, Homo sapiens
agccccagtgccc

SEQ ID NO: 2639989 - DNA, 14 bp, Homo sapiens
agccccagtgccca

SEQ ID NO: 2639990 - DNA, 23 bp, Homo sapiens
agccccataattttttttttcct

SEQ ID NO: 2639991 - DNA, 13 bp, Homo sapiens
agccccattcctg

SEQ ID NO: 2639992 - DNA, 19 bp, Homo sapiens
agccccattctgcctgccc

SEQ ID NO: 2639993 - DNA, 20 bp, Homo sapiens
agccccattctgcctgccca

SEQ ID NO: 2639994 - DNA, 18 bp, Homo sapiens
agcccccaggctgctgga

SEQ ID NO: 2639995 - DNA, 20 bp, Homo sapiens
agcccccccaacactgtgcc

SEQ ID NO: 2639996 - DNA, 21 bp, Homo sapiens
agcccccccaacactgtgccc

SEQ ID NO: 2639997 - DNA, 22 bp, Homo sapiens
agcccccccaacactgtgccct

SEQ ID NO: 2639998 - DNA, 23 bp, Homo sapiens
agcccccgccccgccccacattc

SEQ ID NO: 2639999 - DNA, 16 bp, Homo sapiens
agccccctccttgtct

SEQ ID NO: 2640000 - DNA, 18 bp, Homo sapiens
agccccctttgggcccag

SEQ ID NO: 2640001 - DNA, 19 bp, Homo sapiens
agccccctttgggcccagg

SEQ ID NO: 2640002 - DNA, 16 bp, Homo sapiens
agccccgcctccaggc

SEQ ID NO: 2640003 - DNA, 14 bp, Homo sapiens
agccccggccctgg

SEQ ID NO: 2640004 - DNA, 21 bp, Homo sapiens
agcccctaccccacaccaggc

SEQ ID NO: 2640005 - DNA, 14 bp, Homo sapiens
agcccctcccacca

SEQ ID NO: 2640006 - DNA, 16 bp, Homo sapiens
agcccctcccaccaca

SEQ ID NO: 2640007 - DNA, 17 bp, Homo sapiens
agcccctcccaccacag

SEQ ID NO: 2640008 - DNA, 18 bp, Homo sapiens
agcccctcccaccacagc

SEQ ID NO: 2640009 - DNA, 17 bp, Homo sapiens
agcccctcttgcccccc

SEQ ID NO: 2640010 - DNA, 20 bp, Homo sapiens
agcccctcttgccccccacc

SEQ ID NO: 2640011 - DNA, 14 bp, Homo sapiens
agcccctggtcctg

SEQ ID NO: 2640012 - DNA, 15 bp, Homo sapiens
agccccttccccatg

SEQ ID NO: 2640013 - DNA, 17 bp, Homo sapiens
agccccttccccatggg

SEQ ID NO: 2640014 - DNA, 17 bp, Homo sapiens
agccccttccttgctct

SEQ ID NO: 2640015 - DNA, 15 bp, Homo sapiens
agccccttctgaccc

SEQ ID NO: 2640016 - DNA, 19 bp, Homo sapiens
agccccttctgacccatgc

SEQ ID NO: 2640017 - DNA, 20 bp, Homo sapiens
agccccttctgacccatgct

SEQ ID NO: 2640018 - DNA, 14 bp, Homo sapiens
agcccgaatacaaa

SEQ ID NO: 2640019 - DNA, 18 bp, Homo sapiens
agcccgcacccccaccct

SEQ ID NO: 2640020 - DNA, 19 bp, Homo sapiens
agcccgcacccccaccctt

SEQ ID NO: 2640021 - DNA, 14 bp, Homo sapiens
agcccggatgcttc

SEQ ID NO: 2640022 - DNA, 19 bp, Homo sapiens
agcccggcctgctcccagc

SEQ ID NO: 2640023 - DNA, 22 bp, Homo sapiens
agcccggcctgctcccagcagc

SEQ ID NO: 2640024 - DNA, 22 bp, Homo sapiens
agcccggcgcccctgccacctc

SEQ ID NO: 2640025 - DNA, 17 bp, Homo sapiens
agcccgggctctgcctc

SEQ ID NO: 2640026 - DNA, 20 bp, Homo sapiens
agcccgggctctgcctccca

SEQ ID NO: 2640027 - DNA, 14 bp, Homo sapiens
agcccgggctgcct

SEQ ID NO: 2640028 - DNA, 15 bp, Homo sapiens
agcccgggctgcctg

SEQ ID NO: 2640029 - DNA, 16 bp, Homo sapiens
agcccgggctgcctgg

SEQ ID NO: 2640030 - DNA, 19 bp, Homo sapiens
agcccgggctgcctgggct

SEQ ID NO: 2640031 - DNA, 18 bp, Homo sapiens
agcccgtgtggccccttc

SEQ ID NO: 2640032 - DNA, 19 bp, Homo sapiens
agcccgtgtggccccttca

SEQ ID NO: 2640033 - DNA, 22 bp, Homo sapiens
agccctaaaattccactgcgtt

SEQ ID NO: 2640034 - DNA, 16 bp, Homo sapiens
agccctagagcctgcc

SEQ ID NO: 2640035 - DNA, 17 bp, Homo sapiens
agccctagagcctgcct

SEQ ID NO: 2640036 - DNA, 22 bp, Homo sapiens
agccctagagcctgcctggagc

SEQ ID NO: 2640037 - DNA, 20 bp, Homo sapiens
agccctagggtggagagcca

SEQ ID NO: 2640038 - DNA, 14 bp, Homo sapiens
agccctatggatgt

SEQ ID NO: 2640039 - DNA, 15 bp, Homo sapiens
agccctatggatgtg

SEQ ID NO: 2640040 - DNA, 16 bp, Homo sapiens
agccctatggatgtgg

SEQ ID NO: 2640041 - DNA, 14 bp, Homo sapiens
agccctcaaagtga

SEQ ID NO: 2640042 - DNA, 16 bp, Homo sapiens
agccctcatcccgagc

SEQ ID NO: 2640043 - DNA, 19 bp, Homo sapiens
agccctcttccatcatgtc

SEQ ID NO: 2640044 - DNA, 21 bp, Homo sapiens
agccctgaggtgaaagggagc

SEQ ID NO: 2640045 - DNA, 22 bp, Homo sapiens
agccctgaggtgaaagggagct

SEQ ID NO: 2640046 - DNA, 16 bp, Homo sapiens
agccctgctggccgcc

SEQ ID NO: 2640047 - DNA, 19 bp, Homo sapiens
agccctggagccaactgct

SEQ ID NO: 2640048 - DNA, 19 bp, Homo sapiens
agccctggagtcatgccaa

SEQ ID NO: 2640049 - DNA, 21 bp, Homo sapiens
agccctggcaggatgaccctg

SEQ ID NO: 2640050 - DNA, 14 bp, Homo sapiens
agccctggctctgc

SEQ ID NO: 2640051 - DNA, 20 bp, Homo sapiens
agccctggctgaaggactgt

SEQ ID NO: 2640052 - DNA, 21 bp, Homo sapiens
agccctggctgaaggactgtg

SEQ ID NO: 2640053 - DNA, 17 bp, Homo sapiens
agccctggtctcagcag

SEQ ID NO: 2640054 - DNA, 22 bp, Homo sapiens
agccctggtggcagtgggagct

SEQ ID NO: 2640055 - DNA, 17 bp, Homo sapiens
agccctgtcagtgcagc

SEQ ID NO: 2640056 - DNA, 12 bp, Homo sapiens
agccctgtggaa

SEQ ID NO: 2640057 - DNA, 19 bp, Homo sapiens
agcccttccatgtcgcctc

SEQ ID NO: 2640058 - DNA, 23 bp, Homo sapiens
agcccttccatgtcgcctctgca

SEQ ID NO: 2640059 - DNA, 13 bp, Homo sapiens
agccctttctgtg

SEQ ID NO: 2640060 - DNA, 16 bp, Homo sapiens
agccctttctgtgtgc

SEQ ID NO: 2640061 - DNA, 12 bp, Homo sapiens
agccgacctcag

SEQ ID NO: 2640062 - DNA, 14 bp, Homo sapiens
agccgacctcagcc

SEQ ID NO: 2640063 - DNA, 15 bp, Homo sapiens
agccgacctcagcct

SEQ ID NO: 2640064 - DNA, 16 bp, Homo sapiens
agccgacctcagcctt

SEQ ID NO: 2640065 - DNA, 18 bp, Homo sapiens
agccgagccgggcctggg

SEQ ID NO: 2640066 - DNA, 20 bp, Homo sapiens
agccgccattgccaccagga

SEQ ID NO: 2640067 - DNA, 14 bp, Homo sapiens
agccgctcctgtct

SEQ ID NO: 2640068 - DNA, 16 bp, Homo sapiens
agccggcatggctggg

SEQ ID NO: 2640069 - DNA, 23 bp, Homo sapiens
agccgggaacagacaacagaagt

SEQ ID NO: 2640070 - DNA, 21 bp, Homo sapiens
agccgggcgtggtggtgagtg

SEQ ID NO: 2640071 - DNA, 21 bp, Homo sapiens
agccggggagtttctttcctg

SEQ ID NO: 2640072 - DNA, 18 bp, Homo sapiens
agccgtgatgctcaggct

SEQ ID NO: 2640073 - DNA, 16 bp, Homo sapiens
agccgtggtcctttgg

SEQ ID NO: 2640074 - DNA, 17 bp, Homo sapiens
agcctagaagagcttct

SEQ ID NO: 2640075 - DNA, 18 bp, Homo sapiens
agcctagccgacctcagc

SEQ ID NO: 2640076 - DNA, 20 bp, Homo sapiens
agcctagccgacctcagcct

SEQ ID NO: 2640077 - DNA, 21 bp, Homo sapiens
agcctagccgacctcagcctt

SEQ ID NO: 2640078 - DNA, 14 bp, Homo sapiens
agcctagtgaaggc

SEQ ID NO: 2640079 - DNA, 14 bp, Homo sapiens
agcctatatttaca

SEQ ID NO: 2640080 - DNA, 20 bp, Homo sapiens
agcctcaacctcctgggcta

SEQ ID NO: 2640081 - DNA, 20 bp, Homo sapiens
agcctcaataagccttgtcg

SEQ ID NO: 2640082 - DNA, 15 bp, Homo sapiens
agcctcagcatcctg

SEQ ID NO: 2640083 - DNA, 17 bp, Homo sapiens
agcctcagcatcctggc

SEQ ID NO: 2640084 - DNA, 20 bp, Homo sapiens
agcctcagcatcctggcacc

SEQ ID NO: 2640085 - DNA, 22 bp, Homo sapiens
agcctcagcatcctggcacccg

SEQ ID NO: 2640086 - DNA, 23 bp, Homo sapiens
agcctcagcatcctggcacccgg

SEQ ID NO: 2640087 - DNA, 18 bp, Homo sapiens
agcctcatccgaggcagg

SEQ ID NO: 2640088 - DNA, 20 bp, Homo sapiens
agcctcatccgaggcagggt

SEQ ID NO: 2640089 - DNA, 16 bp, Homo sapiens
agcctccagcctctgt

SEQ ID NO: 2640090 - DNA, 16 bp, Homo sapiens
agcctccagtccaagg

SEQ ID NO: 2640091 - DNA, 18 bp, Homo sapiens
agcctccatgctgcctcc

SEQ ID NO: 2640092 - DNA, 13 bp, Homo sapiens
agcctcccacccc

SEQ ID NO: 2640093 - DNA, 14 bp, Homo sapiens
agcctcccctgcca

SEQ ID NO: 2640094 - DNA, 22 bp, Homo sapiens
agcctcccctgccagggcaggg

SEQ ID NO: 2640095 - DNA, 19 bp, Homo sapiens
agcctcccgaatagctggg

SEQ ID NO: 2640096 - DNA, 20 bp, Homo sapiens
agcctcccgaatagctggga

SEQ ID NO: 2640097 - DNA, 18 bp, Homo sapiens
agcctcccgagtagctgg

SEQ ID NO: 2640098 - DNA, 23 bp, Homo sapiens
agcctccctattttttttctgtt

SEQ ID NO: 2640099 - DNA, 14 bp, Homo sapiens
agcctccctctgac

SEQ ID NO: 2640100 - DNA, 15 bp, Homo sapiens
agcctccctctgacc

SEQ ID NO: 2640101 - DNA, 21 bp, Homo sapiens
agcctccctctgacctgcagg

SEQ ID NO: 2640102 - DNA, 17 bp, Homo sapiens
agcctccctgaagacca

SEQ ID NO: 2640103 - DNA, 18 bp, Homo sapiens
agcctccctgtcggcctg

SEQ ID NO: 2640104 - DNA, 15 bp, Homo sapiens
agcctcctctgtctg

SEQ ID NO: 2640105 - DNA, 16 bp, Homo sapiens
agcctcctgacctgag

SEQ ID NO: 2640106 - DNA, 19 bp, Homo sapiens
agcctcctgacctgaggct

SEQ ID NO: 2640107 - DNA, 22 bp, Homo sapiens
agcctcctgacctgaggctcct

SEQ ID NO: 2640108 - DNA, 19 bp, Homo sapiens
agcctcctgagtagctgga

SEQ ID NO: 2640109 - DNA, 20 bp, Homo sapiens
agcctctagggacccctcct

SEQ ID NO: 2640110 - DNA, 12 bp, Homo sapiens
agcctctccagg

SEQ ID NO: 2640111 - DNA, 23 bp, Homo sapiens
agcctctccaggaatgcctcctc

SEQ ID NO: 2640112 - DNA, 20 bp, Homo sapiens
agcctctccggcagaaggga

SEQ ID NO: 2640113 - DNA, 15 bp, Homo sapiens
agcctctctcccagt

SEQ ID NO: 2640114 - DNA, 17 bp, Homo sapiens
agcctctctcccagtct

SEQ ID NO: 2640115 - DNA, 12 bp, Homo sapiens
agcctctgctgc

SEQ ID NO: 2640116 - DNA, 13 bp, Homo sapiens
agcctctggctag

SEQ ID NO: 2640117 - DNA, 20 bp, Homo sapiens
agcctctggctagaggccag

SEQ ID NO: 2640118 - DNA, 14 bp, Homo sapiens
agcctctgtcactg

SEQ ID NO: 2640119 - DNA, 20 bp, Homo sapiens
agcctcttaaagctgcctgt

SEQ ID NO: 2640120 - DNA, 23 bp, Homo sapiens
agcctcttaaagctgcctgtagt

SEQ ID NO: 2640121 - DNA, 22 bp, Homo sapiens
agcctgaaagaggaatgaagta

SEQ ID NO: 2640122 - DNA, 21 bp, Homo sapiens
agcctgaattttgttgctgtt

SEQ ID NO: 2640123 - DNA, 18 bp, Homo sapiens
agcctgagcgacagtgag

SEQ ID NO: 2640124 - DNA, 13 bp, Homo sapiens
aaaatcatggaat

SEQ ID NO: 2640125 - DNA, 16 bp, Homo sapiens
aaaatcatgtacattt

SEQ ID NO: 2640126 - DNA, 17 bp, Homo sapiens
aaaatcatgtacatttc

SEQ ID NO: 2640127 - DNA, 12 bp, Homo sapiens
aaaatcattgat

SEQ ID NO: 2640128 - DNA, 22 bp, Homo sapiens
aaaatcattgattgtcagctac

SEQ ID NO: 2640129 - DNA, 12 bp, Homo sapiens
aaaatcatttct

SEQ ID NO: 2640130 - DNA, 18 bp, Homo sapiens
aaaatctaccttctgtag

SEQ ID NO: 2640131 - DNA, 20 bp, Homo sapiens
aaaatctattttgtaacttt

SEQ ID NO: 2640132 - DNA, 16 bp, Homo sapiens
aaaatctcaaatttct

SEQ ID NO: 2640133 - DNA, 23 bp, Homo sapiens
aaaatctgaaaatgtgaataaaa

SEQ ID NO: 2640134 - DNA, 15 bp, Homo sapiens
aaaatctgctaggga

SEQ ID NO: 2640135 - DNA, 20 bp, Homo sapiens
aaaatctgtcacgtagaact

SEQ ID NO: 2640136 - DNA, 12 bp, Homo sapiens
aaaatctgtcca

SEQ ID NO: 2640137 - DNA, 19 bp, Homo sapiens
aaaatctgtttgatccctg

SEQ ID NO: 2640138 - DNA, 18 bp, Homo sapiens
aaaatcttggcacagaaa

SEQ ID NO: 2640139 - DNA, 19 bp, Homo sapiens
aaaatgaaagcatgtctca

SEQ ID NO: 2640140 - DNA, 16 bp, Homo sapiens
aaaatgaatcctacac

SEQ ID NO: 2640141 - DNA, 15 bp, Homo sapiens
aaaatgacagatgtt

SEQ ID NO: 2640142 - DNA, 23 bp, Homo sapiens
aaaatgagctcgcatttgtcaat

SEQ ID NO: 2640143 - DNA, 16 bp, Homo sapiens
aaaatgaggacatgtt

SEQ ID NO: 2640144 - DNA, 16 bp, Homo sapiens
aaaatgatgttcattt

SEQ ID NO: 2640145 - DNA, 22 bp, Homo sapiens
aaaatgcaaatcctatgtgatt

SEQ ID NO: 2640146 - DNA, 18 bp, Homo sapiens
aaaatgcaacaacatgta

SEQ ID NO: 2640147 - DNA, 14 bp, Homo sapiens
aaaatgcacgtagc

SEQ ID NO: 2640148 - DNA, 14 bp, Homo sapiens
aaaatgcctttgag

SEQ ID NO: 2640149 - DNA, 15 bp, Homo sapiens
aaaatgctgaacatt

SEQ ID NO: 2640150 - DNA, 18 bp, Homo sapiens
aaaatgctgaacattgca

SEQ ID NO: 2640151 - DNA, 23 bp, Homo sapiens
aaaatgctgtattagtcacagag

SEQ ID NO: 2640152 - DNA, 14 bp, Homo sapiens
aaaatggaaagaat

SEQ ID NO: 2640153 - DNA, 21 bp, Homo sapiens
aaaatgggacttcttttcaca

SEQ ID NO: 2640154 - DNA, 18 bp, Homo sapiens
aaaatggtttaaatggtc

SEQ ID NO: 2640155 - DNA, 22 bp, Homo sapiens
aaaatgtcaaagagaaaactta

SEQ ID NO: 2640156 - DNA, 12 bp, Homo sapiens
aaaatgtctgta

SEQ ID NO: 2640157 - DNA, 12 bp, Homo sapiens
aaaatgtgattt

SEQ ID NO: 2640158 - DNA, 17 bp, Homo sapiens
aaaatgtgcaaaacagc

SEQ ID NO: 2640159 - DNA, 19 bp, Homo sapiens
aaaatgtgctatactgcat

SEQ ID NO: 2640160 - DNA, 19 bp, Homo sapiens
aaaatgttggatttataaa

SEQ ID NO: 2640161 - DNA, 20 bp, Homo sapiens
aaaatgttggatttataaat

SEQ ID NO: 2640162 - DNA, 15 bp, Homo sapiens
aaaatgttttagcaa

SEQ ID NO: 2640163 - DNA, 11 bp, Homo sapiens
aaaattaaagc

SEQ ID NO: 2640164 - DNA, 14 bp, Homo sapiens
aaaattagaaattg

SEQ ID NO: 2640165 - DNA, 20 bp, Homo sapiens
aaaattagaaattggctgga

SEQ ID NO: 2640166 - DNA, 13 bp, Homo sapiens
aaaattatttgca

SEQ ID NO: 2640167 - DNA, 18 bp, Homo sapiens
aaaattattttaaacaaa

SEQ ID NO: 2640168 - DNA, 15 bp, Homo sapiens
aaaattctgaatgta

SEQ ID NO: 2640169 - DNA, 16 bp, Homo sapiens
aaaatttaagcattgt

SEQ ID NO: 2640170 - DNA, 19 bp, Homo sapiens
aaaatttaagtatcttttt

SEQ ID NO: 2640171 - DNA, 16 bp, Homo sapiens
aaaatttagtttttgt

SEQ ID NO: 2640172 - DNA, 23 bp, Homo sapiens
aaaatttagtttttgttcttaat

SEQ ID NO: 2640173 - DNA, 20 bp, Homo sapiens
aaaatttcaacaagtagcta

SEQ ID NO: 2640174 - DNA, 18 bp, Homo sapiens
aaaatttgaaatttagct

SEQ ID NO: 2640175 - DNA, 18 bp, Homo sapiens
aaaatttgttattttgca

SEQ ID NO: 2640176 - DNA, 21 bp, Homo sapiens
aaaattttataaaattaagca

SEQ ID NO: 2640177 - DNA, 20 bp, Homo sapiens
aaaattttgatgttttaagg

SEQ ID NO: 2640178 - DNA, 15 bp, Homo sapiens
aaaattttttttcat

SEQ ID NO: 2640179 - DNA, 18 bp, Homo sapiens
aaaattttttttcatgtt

SEQ ID NO: 2640180 - DNA, 19 bp, Homo sapiens
aaaattttttttcatgttt

SEQ ID NO: 2640181 - DNA, 17 bp, Homo sapiens
aaacaaagcttagcagg

SEQ ID NO: 2640182 - DNA, 16 bp, Homo sapiens
aaacaacaatttctac

SEQ ID NO: 2640183 - DNA, 22 bp, Homo sapiens
aaacaacaatttctactttgaa

SEQ ID NO: 2640184 - DNA, 16 bp, Homo sapiens
aaacaataaatgtgca

SEQ ID NO: 2640185 - DNA, 16 bp, Homo sapiens
aaacacaccaggctgt

SEQ ID NO: 2640186 - DNA, 23 bp, Homo sapiens
aaacacaccaggctgtgggcctc

SEQ ID NO: 2640187 - DNA, 16 bp, Homo sapiens
aaacacactgaggcag

SEQ ID NO: 2640188 - DNA, 16 bp, Homo sapiens
aaacacatcttcccta

SEQ ID NO: 2640189 - DNA, 18 bp, Homo sapiens
aaacacatctttcctgtc

SEQ ID NO: 2640190 - DNA, 12 bp, Homo sapiens
aaacacattttt

SEQ ID NO: 2640191 - DNA, 16 bp, Homo sapiens
aaacacatttttctta

SEQ ID NO: 2640192 - DNA, 21 bp, Homo sapiens
aaacactcggcatttcaaatg

SEQ ID NO: 2640193 - DNA, 13 bp, Homo sapiens
aaacactgccatc

SEQ ID NO: 2640194 - DNA, 13 bp, Homo sapiens
aaacactgtgcac

SEQ ID NO: 2640195 - DNA, 13 bp, Homo sapiens
aaacagaacatca

SEQ ID NO: 2640196 - DNA, 14 bp, Homo sapiens
aaacagactcaggt

SEQ ID NO: 2640197 - DNA, 20 bp, Homo sapiens
aaacagactcgattcatatt

SEQ ID NO: 2640198 - DNA, 16 bp, Homo sapiens
aaacagagatgtgata

SEQ ID NO: 2640199 - DNA, 12 bp, Homo sapiens
aaacagatataa

SEQ ID NO: 2640200 - DNA, 14 bp, Homo sapiens
aaacagatttttac

SEQ ID NO: 2640201 - DNA, 14 bp, Homo sapiens
aaacagcagtgttc

SEQ ID NO: 2640202 - DNA, 14 bp, Homo sapiens
aaacagcattgctt

SEQ ID NO: 2640203 - DNA, 16 bp, Homo sapiens
aaacagcattgctttc

SEQ ID NO: 2640204 - DNA, 17 bp, Homo sapiens
ctgccctccccagagca

SEQ ID NO: 2640205 - DNA, 20 bp, Homo sapiens
ctgccctcccctctctgcac

SEQ ID NO: 2640206 - DNA, 20 bp, Homo sapiens
ctgccctcgtggccagcccg

SEQ ID NO: 2640207 - DNA, 21 bp, Homo sapiens
ctgccctcgtggccagcccgg

SEQ ID NO: 2640208 - DNA, 16 bp, Homo sapiens
ctgccctgccactttg

SEQ ID NO: 2640209 - DNA, 13 bp, Homo sapiens
ctgccctgcccac

SEQ ID NO: 2640210 - DNA, 18 bp, Homo sapiens
ctgccctgccctagctcc

SEQ ID NO: 2640211 - DNA, 16 bp, Homo sapiens
ctgccctgcctgaggg

SEQ ID NO: 2640212 - DNA, 16 bp, Homo sapiens
ctgccctggccctgag

SEQ ID NO: 2640213 - DNA, 18 bp, Homo sapiens
ctgccctggccctgaggt

SEQ ID NO: 2640214 - DNA, 19 bp, Homo sapiens
ctgccctgggatgtccaca

SEQ ID NO: 2640215 - DNA, 21 bp, Homo sapiens
ctgccctgggatgtccacaga

SEQ ID NO: 2640216 - DNA, 15 bp, Homo sapiens
ctgccctggtccagg

SEQ ID NO: 2640217 - DNA, 21 bp, Homo sapiens
ctgccctggtccagggaagct

SEQ ID NO: 2640218 - DNA, 12 bp, Homo sapiens
ctgccctgtgag

SEQ ID NO: 2640219 - DNA, 24 bp, Homo sapiens
ctgccctgtgagtactacagtcct

SEQ ID NO: 2640220 - DNA, 12 bp, Homo sapiens
ctgccctgtggg

SEQ ID NO: 2640221 - DNA, 19 bp, Homo sapiens
ctgccctgtgggcccccaa

SEQ ID NO: 2640222 - DNA, 21 bp, Homo sapiens
ctgccctgttgtgtatagatg

SEQ ID NO: 2640223 - DNA, 21 bp, Homo sapiens
ctgcccttcaccccagtggcc

SEQ ID NO: 2640224 - DNA, 15 bp, Homo sapiens
ctgccgaccagagcc

SEQ ID NO: 2640225 - DNA, 16 bp, Homo sapiens
ctgccgaccagagccc

SEQ ID NO: 2640226 - DNA, 19 bp, Homo sapiens
ctgccgactcctgggttga

SEQ ID NO: 2640227 - DNA, 17 bp, Homo sapiens
ctgccgcaatacaggaa

SEQ ID NO: 2640228 - DNA, 15 bp, Homo sapiens
ctgccgcctcccagc

SEQ ID NO: 2640229 - DNA, 14 bp, Homo sapiens
ctgccgggttctag

SEQ ID NO: 2640230 - DNA, 23 bp, Homo sapiens
ctgccgggttctagtctcctttg

SEQ ID NO: 2640231 - DNA, 14 bp, Homo sapiens
ctgcctactgcatc

SEQ ID NO: 2640232 - DNA, 19 bp, Homo sapiens
ctgcctaggaattcccagc

SEQ ID NO: 2640233 - DNA, 15 bp, Homo sapiens
ctgcctcacagctgg

SEQ ID NO: 2640234 - DNA, 23 bp, Homo sapiens
ctgcctcacttcctacaagagca

SEQ ID NO: 2640235 - DNA, 13 bp, Homo sapiens
ctgcctcagcctc

SEQ ID NO: 2640236 - DNA, 15 bp, Homo sapiens
ctgcctcagcctccc

SEQ ID NO: 2640237 - DNA, 12 bp, Homo sapiens
ctgcctcaggtt

SEQ ID NO: 2640238 - DNA, 17 bp, Homo sapiens
ctgcctccaccctctga

SEQ ID NO: 2640239 - DNA, 20 bp, Homo sapiens
ctgcctccaccctctgagct

SEQ ID NO: 2640240 - DNA, 14 bp, Homo sapiens
ctgcctccagaatg

SEQ ID NO: 2640241 - DNA, 22 bp, Homo sapiens
ctgcctccccaaccctgcccct

SEQ ID NO: 2640242 - DNA, 13 bp, Homo sapiens
ctgcctcccctgt

SEQ ID NO: 2640243 - DNA, 22 bp, Homo sapiens
ctgcctcccctgtgcagtcctg

SEQ ID NO: 2640244 - DNA, 19 bp, Homo sapiens
ctgcctccctcaccctgag

SEQ ID NO: 2640245 - DNA, 20 bp, Homo sapiens
ctgcctccctcaccctgagc

SEQ ID NO: 2640246 - DNA, 14 bp, Homo sapiens
ctgcctcccttcat

SEQ ID NO: 2640247 - DNA, 15 bp, Homo sapiens
ctgcctcccttcatg

SEQ ID NO: 2640248 - DNA, 24 bp, Homo sapiens
ctgcctcctcttcaactgaccagc

SEQ ID NO: 2640249 - DNA, 16 bp, Homo sapiens
ctgcctcctgcctgcc

SEQ ID NO: 2640250 - DNA, 21 bp, Homo sapiens
ctgcctcctttgtgaggaagc

SEQ ID NO: 2640251 - DNA, 23 bp, Homo sapiens
ctgcctcctttgtgaggaagccg

SEQ ID NO: 2640252 - DNA, 18 bp, Homo sapiens
ctgcctcgaactggctgc

SEQ ID NO: 2640253 - DNA, 22 bp, Homo sapiens
ctgcctctcccatcacttccct

SEQ ID NO: 2640254 - DNA, 23 bp, Homo sapiens
ctgcctctcccatcacttcccta

SEQ ID NO: 2640255 - DNA, 22 bp, Homo sapiens
ctgcctctgacacacagctctg

SEQ ID NO: 2640256 - DNA, 19 bp, Homo sapiens
ctgcctcttagacttctgc

SEQ ID NO: 2640257 - DNA, 13 bp, Homo sapiens
ctgcctcttctct

SEQ ID NO: 2640258 - DNA, 18 bp, Homo sapiens
ctgcctgaagtcacacag

SEQ ID NO: 2640259 - DNA, 23 bp, Homo sapiens
ctgcctgacatttggagtgttcc

SEQ ID NO: 2640260 - DNA, 18 bp, Homo sapiens
ctgcctgagggcccctct

SEQ ID NO: 2640261 - DNA, 20 bp, Homo sapiens
ctgcctgagggcccctctgc

SEQ ID NO: 2640262 - DNA, 13 bp, Homo sapiens
cgtaatgcttaga

SEQ ID NO: 2640263 - DNA, 16 bp, Homo sapiens
cgtaattttgccaaat

SEQ ID NO: 2640264 - DNA, 13 bp, Homo sapiens
cgtacagttcttc

SEQ ID NO: 2640265 - DNA, 15 bp, Homo sapiens
cgtaccccaccctca

SEQ ID NO: 2640266 - DNA, 18 bp, Homo sapiens
cgtagaagtttttgtact

SEQ ID NO: 2640267 - DNA, 19 bp, Homo sapiens
cgtagaagtttttgtactg

SEQ ID NO: 2640268 - DNA, 20 bp, Homo sapiens
cgtagccaaggtgggctgag

SEQ ID NO: 2640269 - DNA, 22 bp, Homo sapiens
cgtatatgtctcaggtccctgc

SEQ ID NO: 2640270 - DNA, 21 bp, Homo sapiens
cgtcaccatctcaggccacct

SEQ ID NO: 2640271 - DNA, 17 bp, Homo sapiens
cgtcagaagcacccagg

SEQ ID NO: 2640272 - DNA, 14 bp, Homo sapiens
cgtcagcctccagc

SEQ ID NO: 2640273 - DNA, 18 bp, Homo sapiens
cgtcagcctccagcctct

SEQ ID NO: 2640274 - DNA, 20 bp, Homo sapiens
cgtcagcctccagcctctgt

SEQ ID NO: 2640275 - DNA, 19 bp, Homo sapiens
cgtcagctggcactgtctc

SEQ ID NO: 2640276 - DNA, 15 bp, Homo sapiens
cgtcatgttcctcaa

SEQ ID NO: 2640277 - DNA, 22 bp, Homo sapiens
cgtccacggctctaggtggggc

SEQ ID NO: 2640278 - DNA, 13 bp, Homo sapiens
cgtccctgcccat

SEQ ID NO: 2640279 - DNA, 14 bp, Homo sapiens
cgtccctgcccatg

SEQ ID NO: 2640280 - DNA, 16 bp, Homo sapiens
cgtcctcgagcaactg

SEQ ID NO: 2640281 - DNA, 23 bp, Homo sapiens
cgtcctgtccacacccagctcag

SEQ ID NO: 2640282 - DNA, 15 bp, Homo sapiens
cgtcgccctcccagg

SEQ ID NO: 2640283 - DNA, 13 bp, Homo sapiens
cgtctgacaggca

SEQ ID NO: 2640284 - DNA, 14 bp, Homo sapiens
cgtctgacaggcaa

SEQ ID NO: 2640285 - DNA, 21 bp, Homo sapiens
cgtctgtggctttcagcctct

SEQ ID NO: 2640286 - DNA, 17 bp, Homo sapiens
cgtcttgcttgggaagg

SEQ ID NO: 2640287 - DNA, 12 bp, Homo sapiens
cgtgaaacacac

SEQ ID NO: 2640288 - DNA, 22 bp, Homo sapiens
cgtgaaacacaccaggctgtgg

SEQ ID NO: 2640289 - DNA, 19 bp, Homo sapiens
cgtgacaataaaacattaa

SEQ ID NO: 2640290 - DNA, 18 bp, Homo sapiens
cgtgacagactcctgagg

SEQ ID NO: 2640291 - DNA, 23 bp, Homo sapiens
cgtgaccaactagacattctgtc

SEQ ID NO: 2640292 - DNA, 14 bp, Homo sapiens
cgtgacgctgaata

SEQ ID NO: 2640293 - DNA, 21 bp, Homo sapiens
cgtgagccaggtaatgaggga

SEQ ID NO: 2640294 - DNA, 19 bp, Homo sapiens
cgtgagcgacaaagatgat

SEQ ID NO: 2640295 - DNA, 19 bp, Homo sapiens
cgtgaggatgtcactcaga

SEQ ID NO: 2640296 - DNA, 16 bp, Homo sapiens
cgtgagttctcagggc

SEQ ID NO: 2640297 - DNA, 21 bp, Homo sapiens
cgtgagttctcagggctcctg

SEQ ID NO: 2640298 - DNA, 14 bp, Homo sapiens
cgtgatcaaagcca

SEQ ID NO: 2640299 - DNA, 16 bp, Homo sapiens
cgtgcacacaccagag

SEQ ID NO: 2640300 - DNA, 14 bp, Homo sapiens
ctctcccatttcct

SEQ ID NO: 2640301 - DNA, 24 bp, Homo sapiens
ctctccccagcaagtgagagctgg

SEQ ID NO: 2640302 - DNA, 19 bp, Homo sapiens
ctctcccccccccctccaa

SEQ ID NO: 2640303 - DNA, 23 bp, Homo sapiens
ctctcccccccccctccaatcct

SEQ ID NO: 2640304 - DNA, 14 bp, Homo sapiens
ctctcccctcaaag

SEQ ID NO: 2640305 - DNA, 17 bp, Homo sapiens
ctctcccctgccctgct

SEQ ID NO: 2640306 - DNA, 18 bp, Homo sapiens
ctctcccctgccctgctg

SEQ ID NO: 2640307 - DNA, 15 bp, Homo sapiens
ctctcccgtcagggc

SEQ ID NO: 2640308 - DNA, 21 bp, Homo sapiens
ctctccgaccagacaccttga

SEQ ID NO: 2640309 - DNA, 15 bp, Homo sapiens
ctctccggtctctct

SEQ ID NO: 2640310 - DNA, 21 bp, Homo sapiens
ctctcctagagacagaagcag

SEQ ID NO: 2640311 - DNA, 20 bp, Homo sapiens
ctctcctcatgttctgcttt

SEQ ID NO: 2640312 - DNA, 20 bp, Homo sapiens
ctctcctccaagacactgtg

SEQ ID NO: 2640313 - DNA, 20 bp, Homo sapiens
ctctcctcctgcccacctgt

SEQ ID NO: 2640314 - DNA, 10 bp, Homo sapiens
ctctcctctg

SEQ ID NO: 2640315 - DNA, 15 bp, Homo sapiens
ctctcctctgcctca

SEQ ID NO: 2640316 - DNA, 15 bp, Homo sapiens
ctctcctctgctgct

SEQ ID NO: 2640317 - DNA, 18 bp, Homo sapiens
ctctcctctgctgctggc

SEQ ID NO: 2640318 - DNA, 14 bp, Homo sapiens
ctctcctcttgcca

SEQ ID NO: 2640319 - DNA, 15 bp, Homo sapiens
gacacttgccttctt

SEQ ID NO: 2640320 - DNA, 21 bp, Homo sapiens
gacacttttcatgtgtgattt

SEQ ID NO: 2640321 - DNA, 19 bp, Homo sapiens
gacacttttttgagtggat

SEQ ID NO: 2640322 - DNA, 12 bp, Homo sapiens
gacagaaagcag

SEQ ID NO: 2640323 - DNA, 13 bp, Homo sapiens
gacagaacactgt

SEQ ID NO: 2640324 - DNA, 20 bp, Homo sapiens
gacagaacccctacatgaaa

SEQ ID NO: 2640325 - DNA, 13 bp, Homo sapiens
gacagaagaaggc

SEQ ID NO: 2640326 - DNA, 16 bp, Homo sapiens
gacagaagcaggctgg

SEQ ID NO: 2640327 - DNA, 13 bp, Homo sapiens
gacagacacacac

SEQ ID NO: 2640328 - DNA, 19 bp, Homo sapiens
gacagactcctgaggacag

SEQ ID NO: 2640329 - DNA, 16 bp, Homo sapiens
gacagagacctcctgc

SEQ ID NO: 2640330 - DNA, 19 bp, Homo sapiens
gacagagggaagaaaagag

SEQ ID NO: 2640331 - DNA, 14 bp, Homo sapiens
gacagagtctcact

SEQ ID NO: 2640332 - DNA, 16 bp, Homo sapiens
gacagagtgagactct

SEQ ID NO: 2640333 - DNA, 20 bp, Homo sapiens
gacagagtgagactctgtct

SEQ ID NO: 2640334 - DNA, 21 bp, Homo sapiens
gacagagttcactataaatgg

SEQ ID NO: 2640335 - DNA, 13 bp, Homo sapiens
gacagataactct

SEQ ID NO: 2640336 - DNA, 19 bp, Homo sapiens
gacagatcaagctgtgaga

SEQ ID NO: 2640337 - DNA, 19 bp, Homo sapiens
gacagatgccccagagctg

SEQ ID NO: 2640338 - DNA, 18 bp, Homo sapiens
gacagatgtcagccgagc

SEQ ID NO: 2640339 - DNA, 18 bp, Homo sapiens
gacagcagctcaggcaca

SEQ ID NO: 2640340 - DNA, 18 bp, Homo sapiens
gacagccacggccaggcc

SEQ ID NO: 2640341 - DNA, 11 bp, Homo sapiens
gacagcctccc

SEQ ID NO: 2640342 - DNA, 17 bp, Homo sapiens
gacagctccctctgcct

SEQ ID NO: 2640343 - DNA, 16 bp, Homo sapiens
gacagctccttctgtc

SEQ ID NO: 2640344 - DNA, 15 bp, Homo sapiens
gacagctgcctggga

SEQ ID NO: 2640345 - DNA, 16 bp, Homo sapiens
gacagctgcctgggat

SEQ ID NO: 2640346 - DNA, 14 bp, Homo sapiens
gacaggaccaggga

SEQ ID NO: 2640347 - DNA, 15 bp, Homo sapiens
gacaggaccagggat

SEQ ID NO: 2640348 - DNA, 23 bp, Homo sapiens
gacaggaccagggatttccatga

SEQ ID NO: 2640349 - DNA, 14 bp, Homo sapiens
gacaggacctagga

SEQ ID NO: 2640350 - DNA, 20 bp, Homo sapiens
gacaggagggcaagggccat

SEQ ID NO: 2640351 - DNA, 18 bp, Homo sapiens
gacaggcaagcacctcct

SEQ ID NO: 2640352 - DNA, 17 bp, Homo sapiens
gacaggcaatgctggct

SEQ ID NO: 2640353 - DNA, 23 bp, Homo sapiens
gacaggcaatgctggctgttggc

SEQ ID NO: 2640354 - DNA, 19 bp, Homo sapiens
gacaggcatgttctctgag

SEQ ID NO: 2640355 - DNA, 14 bp, Homo sapiens
gacaggcccaagag

SEQ ID NO: 2640356 - DNA, 18 bp, Homo sapiens
gacaggcccaagagatga

SEQ ID NO: 2640357 - DNA, 19 bp, Homo sapiens
gacagggacccacttcaca

SEQ ID NO: 2640358 - DNA, 12 bp, Homo sapiens
gacagggctggc

SEQ ID NO: 2640359 - DNA, 20 bp, Homo sapiens
gacagggctggcccagccct

SEQ ID NO: 2640360 - DNA, 21 bp, Homo sapiens
gacagggctggcccagccctg

SEQ ID NO: 2640361 - DNA, 22 bp, Homo sapiens
gacagggctggcccagccctgc

SEQ ID NO: 2640362 - DNA, 17 bp, Homo sapiens
gacagggtttcaccatg

SEQ ID NO: 2640363 - DNA, 14 bp, Homo sapiens
gacaggtaaattaa

SEQ ID NO: 2640364 - DNA, 17 bp, Homo sapiens
gacaggtccctcaccca

SEQ ID NO: 2640365 - DNA, 16 bp, Homo sapiens
gacaggtgtgccgaca

SEQ ID NO: 2640366 - DNA, 19 bp, Homo sapiens
gacagtccagcctggagat

SEQ ID NO: 2640367 - DNA, 18 bp, Homo sapiens
gacagtcctgggagaacc

SEQ ID NO: 2640368 - DNA, 13 bp, Homo sapiens
gacagtcttgtgc

SEQ ID NO: 2640369 - DNA, 15 bp, Homo sapiens
gacagtgatctccat

SEQ ID NO: 2640370 - DNA, 17 bp, Homo sapiens
gacagtgcctgggaatg

SEQ ID NO: 2640371 - DNA, 22 bp, Homo sapiens
gacagtgcctgggaatgtatta

SEQ ID NO: 2640372 - DNA, 16 bp, Homo sapiens
gacagtgcttcagcct

SEQ ID NO: 2640373 - DNA, 18 bp, Homo sapiens
gacagtgcttcagcctga

SEQ ID NO: 2640374 - DNA, 20 bp, Homo sapiens
gacagtgcttcagcctgagg

SEQ ID NO: 2640375 - DNA, 21 bp, Homo sapiens
gacagttatactgtcggtttt

SEQ ID NO: 2640376 - DNA, 21 bp, Homo sapiens
gacagtttcttagctttttaa

SEQ ID NO: 2640377 - DNA, 15 bp, Homo sapiens
gacatactaaccagc

SEQ ID NO: 2640378 - DNA, 22 bp, Homo sapiens
gacatactccttccatcaaata

SEQ ID NO: 2640379 - DNA, 21 bp, Homo sapiens
gacatagagagggagaagaag

SEQ ID NO: 2640380 - DNA, 19 bp, Homo sapiens
gacatcaagcacagaagga

SEQ ID NO: 2640381 - DNA, 13 bp, Homo sapiens
gacatcagctggt

SEQ ID NO: 2640382 - DNA, 16 bp, Homo sapiens
gacatcctcttctgct

SEQ ID NO: 2640383 - DNA, 13 bp, Homo sapiens
gacatctcagggg

SEQ ID NO: 2640384 - DNA, 20 bp, Homo sapiens
gacatcttcaaagcttgaag

SEQ ID NO: 2640385 - DNA, 20 bp, Homo sapiens
gacatgaagattctttccca

SEQ ID NO: 2640386 - DNA, 14 bp, Homo sapiens
gacatgcactcagc

SEQ ID NO: 2640387 - DNA, 14 bp, Homo sapiens
gacatgctgaagcc

SEQ ID NO: 2640388 - DNA, 19 bp, Homo sapiens
gacatgctgaagccaaagc

SEQ ID NO: 2640389 - DNA, 19 bp, Homo sapiens
gacatggagactcctgccc

SEQ ID NO: 2640390 - DNA, 22 bp, Homo sapiens
gacatggagactcctgccctgt

SEQ ID NO: 2640391 - DNA, 14 bp, Homo sapiens
gacatgggaaaggg

SEQ ID NO: 2640392 - DNA, 18 bp, Homo sapiens
gacatgggaaaggggaag

SEQ ID NO: 2640393 - DNA, 15 bp, Homo sapiens
gacatggggaggaag

SEQ ID NO: 2640394 - DNA, 15 bp, Homo sapiens
gacatgtctgttcta

SEQ ID NO: 2640395 - DNA, 13 bp, Homo sapiens
gacatgtggaaag

SEQ ID NO: 2640396 - DNA, 18 bp, Homo sapiens
gacatgtggaaagtgaat

SEQ ID NO: 2640397 - DNA, 22 bp, Homo sapiens
gacatgtggtgggacagggacc

SEQ ID NO: 2640398 - DNA, 15 bp, Homo sapiens
gacatgttatatatt

SEQ ID NO: 2640399 - DNA, 18 bp, Homo sapiens
gacatgttatatattttt

SEQ ID NO: 2640400 - DNA, 14 bp, Homo sapiens
gacatgttttgata

SEQ ID NO: 2640401 - DNA, 18 bp, Homo sapiens
gacattcatgcctggctt

SEQ ID NO: 2640402 - DNA, 23 bp, Homo sapiens
gacattcctgggcacagtttggt

SEQ ID NO: 2640403 - DNA, 22 bp, Homo sapiens
gacattctgccaggcccccaag

SEQ ID NO: 2640404 - DNA, 12 bp, Homo sapiens
gacattgtcaat

SEQ ID NO: 2640405 - DNA, 15 bp, Homo sapiens
gacattgtcaataaa

SEQ ID NO: 2640406 - DNA, 16 bp, Homo sapiens
gacatttctctaagag

SEQ ID NO: 2640407 - DNA, 19 bp, Homo sapiens
gacatttctcttactgcaa

SEQ ID NO: 2640408 - DNA, 21 bp, Homo sapiens
gacatttctcttactgcaaat

SEQ ID NO: 2640409 - DNA, 17 bp, Homo sapiens
gacattttgccaaaatt

SEQ ID NO: 2640410 - DNA, 20 bp, Homo sapiens
gacattttttcagtcatata

SEQ ID NO: 2640411 - DNA, 18 bp, Homo sapiens
gaccaaccctgtttcctg

SEQ ID NO: 2640412 - DNA, 13 bp, Homo sapiens
gaccaactgggcc

SEQ ID NO: 2640413 - DNA, 15 bp, Homo sapiens
gaccaagagagaaag

SEQ ID NO: 2640414 - DNA, 14 bp, Homo sapiens
gaccaagcaggaag

SEQ ID NO: 2640415 - DNA, 13 bp, Homo sapiens
gaccaaggacccc

SEQ ID NO: 2640416 - DNA, 17 bp, Homo sapiens
gaccaaggacccctcac

SEQ ID NO: 2640417 - DNA, 16 bp, Homo sapiens
gaccaaggagatgaag

SEQ ID NO: 2640418 - DNA, 19 bp, Homo sapiens
gaccaaggcaaggcaggtg

SEQ ID NO: 2640419 - DNA, 18 bp, Homo sapiens
gaccaaggggtgggccac

SEQ ID NO: 2640420 - DNA, 18 bp, Homo sapiens
gaccaaggttccagctca

SEQ ID NO: 2640421 - DNA, 14 bp, Homo sapiens
gaccaagttataaa

SEQ ID NO: 2640422 - DNA, 17 bp, Homo sapiens
gaccacacttcctgtcc

SEQ ID NO: 2640423 - DNA, 17 bp, Homo sapiens
gaccacatctttatctg

SEQ ID NO: 2640424 - DNA, 18 bp, Homo sapiens
gaccaccccgcctgccct

SEQ ID NO: 2640425 - DNA, 14 bp, Homo sapiens
gaccacccctgcct

SEQ ID NO: 2640426 - DNA, 22 bp, Homo sapiens
gaccacccctgcctccaccctc

SEQ ID NO: 2640427 - DNA, 13 bp, Homo sapiens
gacccagcactgc

SEQ ID NO: 2640428 - DNA, 22 bp, Homo sapiens
gacccagccccttgagaaacct

SEQ ID NO: 2640429 - DNA, 23 bp, Homo sapiens
gacccagccccttgagaaacctt

SEQ ID NO: 2640430 - DNA, 16 bp, Homo sapiens
gacccagccctcatcc

SEQ ID NO: 2640431 - DNA, 17 bp, Homo sapiens
gacccatcacgcctgtg

SEQ ID NO: 2640432 - DNA, 13 bp, Homo sapiens
gacccatgctgcc

SEQ ID NO: 2640433 - DNA, 15 bp, Homo sapiens
gacccatgctgccct

SEQ ID NO: 2640434 - DNA, 20 bp, Homo sapiens
gacccattctacacagagca

SEQ ID NO: 2640435 - DNA, 16 bp, Homo sapiens
gaccccaaagagcctg

SEQ ID NO: 2640436 - DNA, 18 bp, Homo sapiens
gaccccaaagagcctgga

SEQ ID NO: 2640437 - DNA, 20 bp, Homo sapiens
gaccccaaagagcctggaga

SEQ ID NO: 2640438 - DNA, 14 bp, Homo sapiens
gaccccacccaagc

SEQ ID NO: 2640439 - DNA, 22 bp, Homo sapiens
gaccccacccaagcttggcagc

SEQ ID NO: 2640440 - DNA, 19 bp, Homo sapiens
gaccccatctgtgaataag

SEQ ID NO: 2640441 - DNA, 13 bp, Homo sapiens
gacccccacacct

SEQ ID NO: 2640442 - DNA, 12 bp, Homo sapiens
gacccccacccc

SEQ ID NO: 2640443 - DNA, 16 bp, Homo sapiens
gacccccaccccttcc

SEQ ID NO: 2640444 - DNA, 17 bp, Homo sapiens
gacccccaccccttccc

SEQ ID NO: 2640445 - DNA, 18 bp, Homo sapiens
gacccccaccccttcccc

SEQ ID NO: 2640446 - DNA, 11 bp, Homo sapiens
gacccccgccc

SEQ ID NO: 2640447 - DNA, 20 bp, Homo sapiens
gaccccgagcctggctccaa

SEQ ID NO: 2640448 - DNA, 12 bp, Homo sapiens
gacccctcacct

SEQ ID NO: 2640449 - DNA, 14 bp, Homo sapiens
gacccctccatgtg

SEQ ID NO: 2640450 - DNA, 21 bp, Homo sapiens
gacccctccatgtgggctagt

SEQ ID NO: 2640451 - DNA, 13 bp, Homo sapiens
gacccctcctccc

SEQ ID NO: 2640452 - DNA, 13 bp, Homo sapiens
gacccctctggcc

SEQ ID NO: 2640453 - DNA, 20 bp, Homo sapiens
gacccctctggccaggatgg

SEQ ID NO: 2640454 - DNA, 16 bp, Homo sapiens
gacccgctctggacca

SEQ ID NO: 2640455 - DNA, 23 bp, Homo sapiens
gacccggagctaacactggcccc

SEQ ID NO: 2640456 - DNA, 13 bp, Homo sapiens
gacccggaggcca

SEQ ID NO: 2640457 - DNA, 16 bp, Homo sapiens
gaccctaaatcttgac

SEQ ID NO: 2640458 - DNA, 15 bp, Homo sapiens
gaccctacaggagag

SEQ ID NO: 2640459 - DNA, 15 bp, Homo sapiens
gaccctccccgcacc

SEQ ID NO: 2640460 - DNA, 17 bp, Homo sapiens
gaccctccccgcacccc

SEQ ID NO: 2640461 - DNA, 19 bp, Homo sapiens
gaccctcctcctcccccag

SEQ ID NO: 2640462 - DNA, 22 bp, Homo sapiens
gaccctcctcctcccccagagg

SEQ ID NO: 2640463 - DNA, 22 bp, Homo sapiens
gaccctcctgttgcacccagcc

SEQ ID NO: 2640464 - DNA, 23 bp, Homo sapiens
gaccctcctgttgcacccagccc

SEQ ID NO: 2640465 - DNA, 15 bp, Homo sapiens
gaccctctgaatggt

SEQ ID NO: 2640466 - DNA, 11 bp, Homo sapiens
gaccctgaggc

SEQ ID NO: 2640467 - DNA, 12 bp, Homo sapiens
gaccctgaggcc

SEQ ID NO: 2640468 - DNA, 19 bp, Homo sapiens
gaccctgaggcccagaggg

SEQ ID NO: 2640469 - DNA, 20 bp, Homo sapiens
gaccctgaggcccagagggc

SEQ ID NO: 2640470 - DNA, 22 bp, Homo sapiens
gaccctgaggcccagagggcct

SEQ ID NO: 2640471 - DNA, 20 bp, Homo sapiens
gaccctgccctgtgggcccc

SEQ ID NO: 2640472 - DNA, 22 bp, Homo sapiens
gaccctgccctgtgggccccca

SEQ ID NO: 2640473 - DNA, 20 bp, Homo sapiens
gaccctgcgaaggggccctg

SEQ ID NO: 2640474 - DNA, 17 bp, Homo sapiens
gaccctgggcagggact

SEQ ID NO: 2640475 - DNA, 21 bp, Homo sapiens
gacccttattacacggaaaac

SEQ ID NO: 2640476 - DNA, 20 bp, Homo sapiens
gacccttgtggtcccacccc

SEQ ID NO: 2640477 - DNA, 20 bp, Homo sapiens
gaccgccagatggggcctct

SEQ ID NO: 2640478 - DNA, 22 bp, Homo sapiens
gaccgccagatggggcctctgt

SEQ ID NO: 2640479 - DNA, 14 bp, Homo sapiens
gaccgccccctcct

SEQ ID NO: 2640480 - DNA, 15 bp, Homo sapiens
gaccgccccctcctc

SEQ ID NO: 2640481 - DNA, 21 bp, Homo sapiens
gaccgtgggcggggccttgcg

SEQ ID NO: 2640482 - DNA, 22 bp, Homo sapiens
gacctaaaatttgccctcccat

SEQ ID NO: 2640483 - DNA, 21 bp, Homo sapiens
gacctagggatgttctggccc

SEQ ID NO: 2640484 - DNA, 22 bp, Homo sapiens
gacctatgtcctaaggacacac

SEQ ID NO: 2640485 - DNA, 23 bp, Homo sapiens
gacctatgtcctaaggacacact

SEQ ID NO: 2640486 - DNA, 10 bp, Homo sapiens
gacctcagcc

SEQ ID NO: 2640487 - DNA, 18 bp, Homo sapiens
gacctcaggtgagaagca

SEQ ID NO: 2640488 - DNA, 19 bp, Homo sapiens
gacctcaggtgatccaccc

SEQ ID NO: 2640489 - DNA, 21 bp, Homo sapiens
gacctcaggtgatccacccac

SEQ ID NO: 2640490 - DNA, 20 bp, Homo sapiens
gacctcagttttatcatttt

SEQ ID NO: 2640491 - DNA, 19 bp, Homo sapiens
gacctcatcaggatgaacc

SEQ ID NO: 2640492 - DNA, 14 bp, Homo sapiens
gacctcccagccct

SEQ ID NO: 2640493 - DNA, 16 bp, Homo sapiens
gacctcccctgaggct

SEQ ID NO: 2640494 - DNA, 12 bp, Homo sapiens
gacctcctgcct

SEQ ID NO: 2640495 - DNA, 14 bp, Homo sapiens
gacctcctgcctcc

SEQ ID NO: 2640496 - DNA, 22 bp, Homo sapiens
gacctctgcagcaataaagcag

SEQ ID NO: 2640497 - DNA, 15 bp, Homo sapiens
gacctctgctctgag

SEQ ID NO: 2640498 - DNA, 16 bp, Homo sapiens
gacctctgctctgagg

SEQ ID NO: 2640499 - DNA, 16 bp, Homo sapiens
gacctctgttgtcctc

SEQ ID NO: 2640500 - DNA, 13 bp, Homo sapiens
gacctgaggccct

SEQ ID NO: 2640501 - DNA, 14 bp, Homo sapiens
gacctgaggccctt

SEQ ID NO: 2640502 - DNA, 20 bp, Homo sapiens
gacctgcactggggagcccg

SEQ ID NO: 2640503 - DNA, 21 bp, Homo sapiens
gacctgccccgcccagctgca

SEQ ID NO: 2640504 - DNA, 22 bp, Homo sapiens
gacctgcctcccttcatgcatg

SEQ ID NO: 2640505 - DNA, 13 bp, Homo sapiens
gacctgcctcctg

SEQ ID NO: 2640506 - DNA, 16 bp, Homo sapiens
gacctgcctcctgcct

SEQ ID NO: 2640507 - DNA, 19 bp, Homo sapiens
gacctgcctcctgcctgcc

SEQ ID NO: 2640508 - DNA, 16 bp, Homo sapiens
gacctgcggctgctgt

SEQ ID NO: 2640509 - DNA, 12 bp, Homo sapiens
gacctggagccc

SEQ ID NO: 2640510 - DNA, 17 bp, Homo sapiens
gacctggagcccctggg

SEQ ID NO: 2640511 - DNA, 18 bp, Homo sapiens
gacctggagcccctgggt

SEQ ID NO: 2640512 - DNA, 15 bp, Homo sapiens
gacctggataactta

SEQ ID NO: 2640513 - DNA, 17 bp, Homo sapiens
gacctggataacttagg

SEQ ID NO: 2640514 - DNA, 16 bp, Homo sapiens
gacctggcaaggacac

SEQ ID NO: 2640515 - DNA, 18 bp, Homo sapiens
gacctgggacctcccctg

SEQ ID NO: 2640516 - DNA, 21 bp, Homo sapiens
gacctggtaccctcctggctc

SEQ ID NO: 2640517 - DNA, 12 bp, Homo sapiens
gacctgtaatca

SEQ ID NO: 2640518 - DNA, 19 bp, Homo sapiens
gacctgtcatgcccccctc

SEQ ID NO: 2640519 - DNA, 14 bp, Homo sapiens
gacctgtcctcctg

SEQ ID NO: 2640520 - DNA, 19 bp, Homo sapiens
gacctgtggccaagttctt

SEQ ID NO: 2640521 - DNA, 22 bp, Homo sapiens
gacctgtggggatttctcccag

SEQ ID NO: 2640522 - DNA, 23 bp, Homo sapiens
gacctgtggggatttctcccagc

SEQ ID NO: 2640523 - DNA, 19 bp, Homo sapiens
gacctgtgtcactacgtga

SEQ ID NO: 2640524 - DNA, 15 bp, Homo sapiens
gacctgttggttcca

SEQ ID NO: 2640525 - DNA, 19 bp, Homo sapiens
gacctgttggttccaagcc

SEQ ID NO: 2640526 - DNA, 16 bp, Homo sapiens
gaccttagtgtttctg

SEQ ID NO: 2640527 - DNA, 16 bp, Homo sapiens
gaccttcaccaaacat

SEQ ID NO: 2640528 - DNA, 12 bp, Homo sapiens
gaccttcctcat

SEQ ID NO: 2640529 - DNA, 18 bp, Homo sapiens
gaccttcctcgcagagag

SEQ ID NO: 2640530 - DNA, 21 bp, Homo sapiens
gaccttcctcgcagagaggcc

SEQ ID NO: 2640531 - DNA, 22 bp, Homo sapiens
gaccttcctcgcagagaggcca

SEQ ID NO: 2640532 - DNA, 12 bp, Homo sapiens
gaccttcctgcc

SEQ ID NO: 2640533 - DNA, 18 bp, Homo sapiens
gaccttctccaaatgaga

SEQ ID NO: 2640534 - DNA, 16 bp, Homo sapiens
gaccttctccttcacc

SEQ ID NO: 2640535 - DNA, 12 bp, Homo sapiens
gaccttctggga

SEQ ID NO: 2640536 - DNA, 13 bp, Homo sapiens
gaccttgtgatct

SEQ ID NO: 2640537 - DNA, 20 bp, Homo sapiens
gaccttgttgcatgatgtat

SEQ ID NO: 2640538 - DNA, 12 bp, Homo sapiens
gacgccacccag

SEQ ID NO: 2640539 - DNA, 18 bp, Homo sapiens
gacgccatcccagcccca

SEQ ID NO: 2640540 - DNA, 17 bp, Homo sapiens
gacgcctgagctcactc

SEQ ID NO: 2640541 - DNA, 18 bp, Homo sapiens
gacgcctgccctccccag

SEQ ID NO: 2640542 - DNA, 23 bp, Homo sapiens
gacgcctgccctccccagagcac

SEQ ID NO: 2640543 - DNA, 21 bp, Homo sapiens
gacgcctgggggtgccaggac

SEQ ID NO: 2640544 - DNA, 14 bp, Homo sapiens
gacgcgtctcctgt

SEQ ID NO: 2640545 - DNA, 22 bp, Homo sapiens
catatgtttcgctgatatatgt

SEQ ID NO: 2640546 - DNA, 16 bp, Homo sapiens
catattaccacagaca

SEQ ID NO: 2640547 - DNA, 17 bp, Homo sapiens
catattaccacagacat

SEQ ID NO: 2640548 - DNA, 22 bp, Homo sapiens
catattaccacagacatactaa

SEQ ID NO: 2640549 - DNA, 14 bp, Homo sapiens
catattaggaaaat

SEQ ID NO: 2640550 - DNA, 20 bp, Homo sapiens
catattcaggaagctcaggg

SEQ ID NO: 2640551 - DNA, 22 bp, Homo sapiens
catattcaggaagctcagggcc

SEQ ID NO: 2640552 - DNA, 17 bp, Homo sapiens
catattccatatttatt

SEQ ID NO: 2640553 - DNA, 17 bp, Homo sapiens
catattctgttggccag

SEQ ID NO: 2640554 - DNA, 21 bp, Homo sapiens
catattgagcacttgctgtat

SEQ ID NO: 2640555 - DNA, 17 bp, Homo sapiens
catattgatttccgtta

SEQ ID NO: 2640556 - DNA, 14 bp, Homo sapiens
catattgtacactt

SEQ ID NO: 2640557 - DNA, 15 bp, Homo sapiens
catattgtacacttt

SEQ ID NO: 2640558 - DNA, 23 bp, Homo sapiens
catattgtacacttttttgggga

SEQ ID NO: 2640559 - DNA, 14 bp, Homo sapiens
catattgtgtgtaa

SEQ ID NO: 2640560 - DNA, 16 bp, Homo sapiens
catattgttgaaaggt

SEQ ID NO: 2640561 - DNA, 20 bp, Homo sapiens
catatttacttcttatacat

SEQ ID NO: 2640562 - DNA, 21 bp, Homo sapiens
catatttgttaaatatttaca

SEQ ID NO: 2640563 - DNA, 17 bp, Homo sapiens
catattttattctttta

SEQ ID NO: 2640564 - DNA, 20 bp, Homo sapiens
catattttgattattgtatt

SEQ ID NO: 2640565 - DNA, 18 bp, Homo sapiens
catcaaaaactttggagt

SEQ ID NO: 2640566 - DNA, 15 bp, Homo sapiens
catcaaaagacaatt

SEQ ID NO: 2640567 - DNA, 18 bp, Homo sapiens
catcaaaagacaattctt

SEQ ID NO: 2640568 - DNA, 19 bp, Homo sapiens
catcaaaagacaattcttt

SEQ ID NO: 2640569 - DNA, 22 bp, Homo sapiens
catcaaaagacaattctttata

SEQ ID NO: 2640570 - DNA, 17 bp, Homo sapiens
catcaaatggaagacac

SEQ ID NO: 2640571 - DNA, 19 bp, Homo sapiens
catcaaatggaagacacat

SEQ ID NO: 2640572 - DNA, 14 bp, Homo sapiens
catcaacatcttgg

SEQ ID NO: 2640573 - DNA, 14 bp, Homo sapiens
catcaactgaatga

SEQ ID NO: 2640574 - DNA, 19 bp, Homo sapiens
catcaagaaggtagcttga

SEQ ID NO: 2640575 - DNA, 13 bp, Homo sapiens
catcaagactgga

SEQ ID NO: 2640576 - DNA, 18 bp, Homo sapiens
catcaagcacagaaggag

SEQ ID NO: 2640577 - DNA, 17 bp, Homo sapiens
catcaaggcactgcctg

SEQ ID NO: 2640578 - DNA, 18 bp, Homo sapiens
catcaatgttcattgtaa

SEQ ID NO: 2640579 - DNA, 22 bp, Homo sapiens
catcacaggacacggggcagtg

SEQ ID NO: 2640580 - DNA, 20 bp, Homo sapiens
catcacagggcagagccggg

SEQ ID NO: 2640581 - DNA, 19 bp, Homo sapiens
catcacagggttgggccca

SEQ ID NO: 2640582 - DNA, 22 bp, Homo sapiens
catcaccgacgcgtctcctgtt

SEQ ID NO: 2640583 - DNA, 15 bp, Homo sapiens
catcacctcaggcca

SEQ ID NO: 2640584 - DNA, 19 bp, Homo sapiens
catcaccttaggcagggaa

SEQ ID NO: 2640585 - DNA, 14 bp, Homo sapiens
catcactcccctcc

SEQ ID NO: 2640586 - DNA, 17 bp, Homo sapiens
catcagaaacaccctca

SEQ ID NO: 2640587 - DNA, 13 bp, Homo sapiens
catcagcatacct

SEQ ID NO: 2640588 - DNA, 18 bp, Homo sapiens
catcagcatacctttatt

SEQ ID NO: 2640589 - DNA, 13 bp, Homo sapiens
catcagctgctga

SEQ ID NO: 2640590 - DNA, 15 bp, Homo sapiens
catcagctgctgaaa

SEQ ID NO: 2640591 - DNA, 23 bp, Homo sapiens
catcagctgtaagaagagactgg

SEQ ID NO: 2640592 - DNA, 20 bp, Homo sapiens
catcagcttgccctgttaaa

SEQ ID NO: 2640593 - DNA, 19 bp, Homo sapiens
catcaggagaaaaagcctc

SEQ ID NO: 2640594 - DNA, 19 bp, Homo sapiens
catcaggatgaacccagga

SEQ ID NO: 2640595 - DNA, 14 bp, Homo sapiens
catcaggccaggcc

SEQ ID NO: 2640596 - DNA, 20 bp, Homo sapiens
catcaggccaggccctctgc

SEQ ID NO: 2640597 - DNA, 22 bp, Homo sapiens
catcaggccaggccctctgccc

SEQ ID NO: 2640598 - DNA, 12 bp, Homo sapiens
catcagggacag

SEQ ID NO: 2640599 - DNA, 15 bp, Homo sapiens
catcagtccctatgt

SEQ ID NO: 2640600 - DNA, 17 bp, Homo sapiens
catcagtccctatgtat

SEQ ID NO: 2640601 - DNA, 14 bp, Homo sapiens
catcagtggagcca

SEQ ID NO: 2640602 - DNA, 16 bp, Homo sapiens
catcagtggcatggct

SEQ ID NO: 2640603 - DNA, 15 bp, Homo sapiens
catcagttagagctg

SEQ ID NO: 2640604 - DNA, 20 bp, Homo sapiens
catcagttagagctgacaca

SEQ ID NO: 2640605 - DNA, 12 bp, Homo sapiens
catcataaaata

SEQ ID NO: 2640606 - DNA, 13 bp, Homo sapiens
catcatcaaggca

SEQ ID NO: 2640607 - DNA, 21 bp, Homo sapiens
catcatcaaggcactgcctga

SEQ ID NO: 2640608 - DNA, 16 bp, Homo sapiens
catcatgcatcttact

SEQ ID NO: 2640609 - DNA, 21 bp, Homo sapiens
catcatgcttacaaaaaagaa

SEQ ID NO: 2640610 - DNA, 22 bp, Homo sapiens
catcatgtccccaaacctgcaa

SEQ ID NO: 2640611 - DNA, 21 bp, Homo sapiens
catcattatttgcagagacag

SEQ ID NO: 2640612 - DNA, 12 bp, Homo sapiens
catcattctctg

SEQ ID NO: 2640613 - DNA, 14 bp, Homo sapiens
catcattctctgtc

SEQ ID NO: 2640614 - DNA, 17 bp, Homo sapiens
catcattctctgtctca

SEQ ID NO: 2640615 - DNA, 18 bp, Homo sapiens
catcattttgcattcaaa

SEQ ID NO: 2640616 - DNA, 22 bp, Homo sapiens
catcattttgcattcaaattaa

SEQ ID NO: 2640617 - DNA, 17 bp, Homo sapiens
catcatttttgtatcta

SEQ ID NO: 2640618 - DNA, 21 bp, Homo sapiens
catccaaccccccacctgcca

SEQ ID NO: 2640619 - DNA, 15 bp, Homo sapiens
catccaactccagga

SEQ ID NO: 2640620 - DNA, 17 bp, Homo sapiens
catccaagagtgcgccg

SEQ ID NO: 2640621 - DNA, 22 bp, Homo sapiens
catccaaggagaaacagagaca

SEQ ID NO: 2640622 - DNA, 13 bp, Homo sapiens
catccaatcctca

SEQ ID NO: 2640623 - DNA, 15 bp, Homo sapiens
catccaatcctcact

SEQ ID NO: 2640624 - DNA, 21 bp, Homo sapiens
catccaatcctcactgggtgg

SEQ ID NO: 2640625 - DNA, 17 bp, Homo sapiens
catccacatgggagccg

SEQ ID NO: 2640626 - DNA, 14 bp, Homo sapiens
catccaccccatcc

SEQ ID NO: 2640627 - DNA, 14 bp, Homo sapiens
catccacctccttc

SEQ ID NO: 2640628 - DNA, 23 bp, Homo sapiens
catccactgtgccatgtgccagg

SEQ ID NO: 2640629 - DNA, 12 bp, Homo sapiens
catccaggcagt

SEQ ID NO: 2640630 - DNA, 19 bp, Homo sapiens
catccagggctctgaccag

SEQ ID NO: 2640631 - DNA, 15 bp, Homo sapiens
catccaggttcagct

SEQ ID NO: 2640632 - DNA, 17 bp, Homo sapiens
catccaggttcagcttg

SEQ ID NO: 2640633 - DNA, 23 bp, Homo sapiens
catccagtctcccaacttgtatt

SEQ ID NO: 2640634 - DNA, 22 bp, Homo sapiens
catccagtgtctcacagccctg

SEQ ID NO: 2640635 - DNA, 16 bp, Homo sapiens
catccataaagaagca

SEQ ID NO: 2640636 - DNA, 17 bp, Homo sapiens
catccataaagaagcaa

SEQ ID NO: 2640637 - DNA, 18 bp, Homo sapiens
catccatagtagtatgat

SEQ ID NO: 2640638 - DNA, 13 bp, Homo sapiens
catccatcatcat

SEQ ID NO: 2640639 - DNA, 15 bp, Homo sapiens
catccatgtttgtaa

SEQ ID NO: 2640640 - DNA, 18 bp, Homo sapiens
catccatgtttgtaaaac

SEQ ID NO: 2640641 - DNA, 20 bp, Homo sapiens
catccatttcatctatttct

SEQ ID NO: 2640642 - DNA, 23 bp, Homo sapiens
catccatttcatctatttctgag

SEQ ID NO: 2640643 - DNA, 23 bp, Homo sapiens
catcccaaaatcataagatattt

SEQ ID NO: 2640644 - DNA, 11 bp, Homo sapiens
catcccagccc

SEQ ID NO: 2640645 - DNA, 12 bp, Homo sapiens
catcccagcccc

SEQ ID NO: 2640646 - DNA, 13 bp, Homo sapiens
catcccaggggac

SEQ ID NO: 2640647 - DNA, 12 bp, Homo sapiens
catcccatcatc

SEQ ID NO: 2640648 - DNA, 14 bp, Homo sapiens
catccccactcacg

SEQ ID NO: 2640649 - DNA, 21 bp, Homo sapiens
catccccatcctccagcttct

SEQ ID NO: 2640650 - DNA, 11 bp, Homo sapiens
catccccctgc

SEQ ID NO: 2640651 - DNA, 21 bp, Homo sapiens
catcccctgtagagtgggagc

SEQ ID NO: 2640652 - DNA, 17 bp, Homo sapiens
catcccgtgttctcctt

SEQ ID NO: 2640653 - DNA, 21 bp, Homo sapiens
catccctgaaggccccgccca

SEQ ID NO: 2640654 - DNA, 19 bp, Homo sapiens
catcccttgaccaggcctg

SEQ ID NO: 2640655 - DNA, 19 bp, Homo sapiens
catccctttgaaacaagat

SEQ ID NO: 2640656 - DNA, 13 bp, Homo sapiens
catccgaggcagg

SEQ ID NO: 2640657 - DNA, 15 bp, Homo sapiens
catccgaggcagggt

SEQ ID NO: 2640658 - DNA, 22 bp, Homo sapiens
catccgaggcagggtcaggaga

SEQ ID NO: 2640659 - DNA, 15 bp, Homo sapiens
catccggcagcctgg

SEQ ID NO: 2640660 - DNA, 14 bp, Homo sapiens
catcctaccaatgc

SEQ ID NO: 2640661 - DNA, 15 bp, Homo sapiens
catcctaccaatgca

SEQ ID NO: 2640662 - DNA, 15 bp, Homo sapiens
catcctaccctcggg

SEQ ID NO: 2640663 - DNA, 22 bp, Homo sapiens
catcctcaaacactgcaggcat

SEQ ID NO: 2640664 - DNA, 16 bp, Homo sapiens
catcctcatacccacc

SEQ ID NO: 2640665 - DNA, 14 bp, Homo sapiens
catcctccaagaat

SEQ ID NO: 2640666 - DNA, 18 bp, Homo sapiens
catcctccacgttctgct

SEQ ID NO: 2640667 - DNA, 20 bp, Homo sapiens
catcctccacgttctgctca

SEQ ID NO: 2640668 - DNA, 14 bp, Homo sapiens
catcctccagcttc

SEQ ID NO: 2640669 - DNA, 14 bp, Homo sapiens
catcctccccttcc

SEQ ID NO: 2640670 - DNA, 20 bp, Homo sapiens
catcctccccttccctgcaa

SEQ ID NO: 2640671 - DNA, 19 bp, Homo sapiens
catcctctgtacagagccc

SEQ ID NO: 2640672 - DNA, 18 bp, Homo sapiens
catcctcttctgcttagg

SEQ ID NO: 2640673 - DNA, 16 bp, Homo sapiens
catcctgactctgccc

SEQ ID NO: 2640674 - DNA, 20 bp, Homo sapiens
catcctgtcccaccatgcag

SEQ ID NO: 2640675 - DNA, 12 bp, Homo sapiens
catcctgtgaag

SEQ ID NO: 2640676 - DNA, 11 bp, Homo sapiens
catccttaaag

SEQ ID NO: 2640677 - DNA, 21 bp, Homo sapiens
catccttcaagaactctgggc

SEQ ID NO: 2640678 - DNA, 22 bp, Homo sapiens
catccttcaagaactctgggct

SEQ ID NO: 2640679 - DNA, 23 bp, Homo sapiens
catccttcaagaactctgggctg

SEQ ID NO: 2640680 - DNA, 14 bp, Homo sapiens
catccttgagtcaa

SEQ ID NO: 2640681 - DNA, 16 bp, Homo sapiens
catcctttgcactgtc

SEQ ID NO: 2640682 - DNA, 16 bp, Homo sapiens
catcgccgggactcca

SEQ ID NO: 2640683 - DNA, 21 bp, Homo sapiens
catcgtataacacaatatgaa

SEQ ID NO: 2640684 - DNA, 18 bp, Homo sapiens
catctagcaaatgttatg

SEQ ID NO: 2640685 - DNA, 13 bp, Homo sapiens
catctatttctga

SEQ ID NO: 2640686 - DNA, 14 bp, Homo sapiens
catctcaaccatcc

SEQ ID NO: 2640687 - DNA, 14 bp, Homo sapiens
catctcaggccacc

SEQ ID NO: 2640688 - DNA, 15 bp, Homo sapiens
catctcaggccacct

SEQ ID NO: 2640689 - DNA, 22 bp, Homo sapiens
catctcaggccacctgccccct

SEQ ID NO: 2640690 - DNA, 22 bp, Homo sapiens
ctggaagggctagaacctgtag

SEQ ID NO: 2640691 - DNA, 19 bp, Homo sapiens
ctggaaggggaagggacac

SEQ ID NO: 2640692 - DNA, 17 bp, Homo sapiens
ctggaagttttgcattt

SEQ ID NO: 2640693 - DNA, 14 bp, Homo sapiens
ctggaataagttca

SEQ ID NO: 2640694 - DNA, 15 bp, Homo sapiens
ctggaatacatgaaa

SEQ ID NO: 2640695 - DNA, 18 bp, Homo sapiens
ctggaatatataaccagt

SEQ ID NO: 2640696 - DNA, 11 bp, Homo sapiens
ctggacaagcc

SEQ ID NO: 2640697 - DNA, 17 bp, Homo sapiens
ctggacaccgggccagt

SEQ ID NO: 2640698 - DNA, 17 bp, Homo sapiens
ctggacactcagacctg

SEQ ID NO: 2640699 - DNA, 14 bp, Homo sapiens
ctggacaggcatgt

SEQ ID NO: 2640700 - DNA, 23 bp, Homo sapiens
ctggacaggcatgttctctgagg

SEQ ID NO: 2640701 - DNA, 18 bp, Homo sapiens
ctggacatttgccttgct

SEQ ID NO: 2640702 - DNA, 22 bp, Homo sapiens
ctggaccaaccctgtttcctga

SEQ ID NO: 2640703 - DNA, 18 bp, Homo sapiens
ctggaccccatctgtgaa

SEQ ID NO: 2640704 - DNA, 20 bp, Homo sapiens
ctggaccttgaactgggtac

SEQ ID NO: 2640705 - DNA, 20 bp, Homo sapiens
ctggacggcattcctgctta

SEQ ID NO: 2640706 - DNA, 18 bp, Homo sapiens
ctggacggggactgggga

SEQ ID NO: 2640707 - DNA, 23 bp, Homo sapiens
ctggacggggactggggatgtgg

SEQ ID NO: 2640708 - DNA, 20 bp, Homo sapiens
ctggactagagggacctctc

SEQ ID NO: 2640709 - DNA, 23 bp, Homo sapiens
ctggactagagggacctctccca

SEQ ID NO: 2640710 - DNA, 22 bp, Homo sapiens
ctggactcaggatgcccagggc

SEQ ID NO: 2640711 - DNA, 18 bp, Homo sapiens
ctggactccggccctcct

SEQ ID NO: 2640712 - DNA, 20 bp, Homo sapiens
ctggactgtcatagaaatta

SEQ ID NO: 2640713 - DNA, 18 bp, Homo sapiens
ctggacttgagcttggca

SEQ ID NO: 2640714 - DNA, 19 bp, Homo sapiens
ctggagaagaccctccccg

SEQ ID NO: 2640715 - DNA, 18 bp, Homo sapiens
ctggagaagctcacccaa

SEQ ID NO: 2640716 - DNA, 19 bp, Homo sapiens
ctggagaagctcacccaat

SEQ ID NO: 2640717 - DNA, 19 bp, Homo sapiens
ctggagaagctgatgcttt

SEQ ID NO: 2640718 - DNA, 18 bp, Homo sapiens
ctggagaccatgcagagc

SEQ ID NO: 2640719 - DNA, 21 bp, Homo sapiens
ctggagaccatgcagagcgcc

SEQ ID NO: 2640720 - DNA, 12 bp, Homo sapiens
ctggagagaagt

SEQ ID NO: 2640721 - DNA, 22 bp, Homo sapiens
ctggagagctagaacctggagg

SEQ ID NO: 2640722 - DNA, 18 bp, Homo sapiens
ctggagatgttttagagt

SEQ ID NO: 2640723 - DNA, 21 bp, Homo sapiens
ctggagcaggccttgcgctgt

SEQ ID NO: 2640724 - DNA, 16 bp, Homo sapiens
ctggagcatctgactc

SEQ ID NO: 2640725 - DNA, 18 bp, Homo sapiens
ctggagccactaactaga

SEQ ID NO: 2640726 - DNA, 13 bp, Homo sapiens
ctggagcccaggg

SEQ ID NO: 2640727 - DNA, 18 bp, Homo sapiens
ctggagcccctgggtggg

SEQ ID NO: 2640728 - DNA, 19 bp, Homo sapiens
ctggagctggcgtctgtct

SEQ ID NO: 2640729 - DNA, 21 bp, Homo sapiens
ctggaggactagaacctggag

SEQ ID NO: 2640730 - DNA, 14 bp, Homo sapiens
ctggaggaggagca

SEQ ID NO: 2640731 - DNA, 20 bp, Homo sapiens
ctggagggctagaacctgga

SEQ ID NO: 2640732 - DNA, 19 bp, Homo sapiens
ctggagggctagaatctgg

SEQ ID NO: 2640733 - DNA, 20 bp, Homo sapiens
ctggagggctagaatctgga

SEQ ID NO: 2640734 - DNA, 22 bp, Homo sapiens
ctggaggtcacattcaggaaga

SEQ ID NO: 2640735 - DNA, 22 bp, Homo sapiens
ctggaggtggggttgggattgg

SEQ ID NO: 2640736 - DNA, 17 bp, Homo sapiens
ctggaggttgataactt

SEQ ID NO: 2640737 - DNA, 18 bp, Homo sapiens
ctggaggttgataacttt

SEQ ID NO: 2640738 - DNA, 19 bp, Homo sapiens
ctggaggttgataactttg

SEQ ID NO: 2640739 - DNA, 20 bp, Homo sapiens
ctggagtcatgccaagcatt

SEQ ID NO: 2640740 - DNA, 14 bp, Homo sapiens
ctggagtctccagt

SEQ ID NO: 2640741 - DNA, 16 bp, Homo sapiens
ctggagtgcagggagg

SEQ ID NO: 2640742 - DNA, 15 bp, Homo sapiens
ctggagtgcagtgag

SEQ ID NO: 2640743 - DNA, 13 bp, Homo sapiens
ctggagtgcagtt

SEQ ID NO: 2640744 - DNA, 19 bp, Homo sapiens
ctggagtggtgttcagcca

SEQ ID NO: 2640745 - DNA, 18 bp, Homo sapiens
ctggagtgtggctgagga

SEQ ID NO: 2640746 - DNA, 19 bp, Homo sapiens
ctggagtgtggctgaggag

SEQ ID NO: 2640747 - DNA, 21 bp, Homo sapiens
ctggagtgtggctgaggaggc

SEQ ID NO: 2640748 - DNA, 13 bp, Homo sapiens
ctggataaaatga

SEQ ID NO: 2640749 - DNA, 15 bp, Homo sapiens
ctggataacttaggt

SEQ ID NO: 2640750 - DNA, 19 bp, Homo sapiens
ctggataggagcctgctgg

SEQ ID NO: 2640751 - DNA, 15 bp, Homo sapiens
ctggatattttcaaa

SEQ ID NO: 2640752 - DNA, 21 bp, Homo sapiens
ctggatattttcaaattgtat

SEQ ID NO: 2640753 - DNA, 22 bp, Homo sapiens
ctggatattttcaaattgtatc

SEQ ID NO: 2640754 - DNA, 13 bp, Homo sapiens
ctggatcagtcct

SEQ ID NO: 2640755 - DNA, 21 bp, Homo sapiens
ctggatcagtcctttgatcag

SEQ ID NO: 2640756 - DNA, 22 bp, Homo sapiens
ctggatgaaataactccttctt

SEQ ID NO: 2640757 - DNA, 13 bp, Homo sapiens
ctggatgaagatt

SEQ ID NO: 2640758 - DNA, 15 bp, Homo sapiens
ctggatgcagcctca

SEQ ID NO: 2640759 - DNA, 16 bp, Homo sapiens
ctggatgctccttcca

SEQ ID NO: 2640760 - DNA, 19 bp, Homo sapiens
ctggatggttcccagaggg

SEQ ID NO: 2640761 - DNA, 20 bp, Homo sapiens
ctggatggttcccagagggt

SEQ ID NO: 2640762 - DNA, 19 bp, Homo sapiens
ctggatgtctgccaatttt

SEQ ID NO: 2640763 - DNA, 22 bp, Homo sapiens
ctggattgatcggagcctcctc

SEQ ID NO: 2640764 - DNA, 18 bp, Homo sapiens
ctggcaaagacagaagcc

SEQ ID NO: 2640765 - DNA, 21 bp, Homo sapiens
ctggcaaaggtggctctccag

SEQ ID NO: 2640766 - DNA, 22 bp, Homo sapiens
ctggcaaaggtggctctccagt

SEQ ID NO: 2640767 - DNA, 19 bp, Homo sapiens
ctggcaagctagaacctgg

SEQ ID NO: 2640768 - DNA, 17 bp, Homo sapiens
ctggcaaggacacagat

SEQ ID NO: 2640769 - DNA, 18 bp, Homo sapiens
ctggcaaggacacagatg

SEQ ID NO: 2640770 - DNA, 15 bp, Homo sapiens
ctggcaatagtgtgt

SEQ ID NO: 2640771 - DNA, 21 bp, Homo sapiens
ctggcacacatcaggagttca

SEQ ID NO: 2640772 - DNA, 22 bp, Homo sapiens
ctggcacagttttctgagaaag

SEQ ID NO: 2640773 - DNA, 20 bp, Homo sapiens
ctggcacccggcccctgctg

SEQ ID NO: 2640774 - DNA, 21 bp, Homo sapiens
ctggcacccggcccctgctgg

SEQ ID NO: 2640775 - DNA, 15 bp, Homo sapiens
ctggcactataatgt

SEQ ID NO: 2640776 - DNA, 23 bp, Homo sapiens
ctggcactataatgtaagctcta

SEQ ID NO: 2640777 - DNA, 20 bp, Homo sapiens
ctggcactgcttccagtgag

SEQ ID NO: 2640778 - DNA, 14 bp, Homo sapiens
ctggcacttggaga

SEQ ID NO: 2640779 - DNA, 23 bp, Homo sapiens
ctggcagaaagcaaatgtgacct

SEQ ID NO: 2640780 - DNA, 19 bp, Homo sapiens
ctggcagaactgagctcct

SEQ ID NO: 2640781 - DNA, 21 bp, Homo sapiens
ctggcagaactgagctcctct

SEQ ID NO: 2640782 - DNA, 23 bp, Homo sapiens
ctggcagaatgctagctctgagc

SEQ ID NO: 2640783 - DNA, 12 bp, Homo sapiens
ctggcagctcag

SEQ ID NO: 2640784 - DNA, 13 bp, Homo sapiens
ctggcagctcaga

SEQ ID NO: 2640785 - DNA, 17 bp, Homo sapiens
ctggcagctcagagagg

SEQ ID NO: 2640786 - DNA, 19 bp, Homo sapiens
ctggcagctcagagagggt

SEQ ID NO: 2640787 - DNA, 15 bp, Homo sapiens
ctggcattacagctg

SEQ ID NO: 2640788 - DNA, 18 bp, Homo sapiens
ctggcattagaattattt

SEQ ID NO: 2640789 - DNA, 19 bp, Homo sapiens
ctggcattatgtccactgt

SEQ ID NO: 2640790 - DNA, 16 bp, Homo sapiens
ctggcattgtccctgt

SEQ ID NO: 2640791 - DNA, 19 bp, Homo sapiens
ctggcattgtccctgtgcc

SEQ ID NO: 2640792 - DNA, 23 bp, Homo sapiens
ctggccaacatcgtgaaaccctg

SEQ ID NO: 2640793 - DNA, 13 bp, Homo sapiens
ctggccaccaccc

SEQ ID NO: 2640794 - DNA, 16 bp, Homo sapiens
ctggccaccacccccc

SEQ ID NO: 2640795 - DNA, 19 bp, Homo sapiens
ctggccaccaccccccact

SEQ ID NO: 2640796 - DNA, 13 bp, Homo sapiens
ctggccaccaggc

SEQ ID NO: 2640797 - DNA, 20 bp, Homo sapiens
ctggccaccaggctggcgca

SEQ ID NO: 2640798 - DNA, 23 bp, Homo sapiens
ctggccaccaggctggcgcagcc

SEQ ID NO: 2640799 - DNA, 11 bp, Homo sapiens
ctggccacctg

SEQ ID NO: 2640800 - DNA, 15 bp, Homo sapiens
ctggccacctgaggt

SEQ ID NO: 2640801 - DNA, 20 bp, Homo sapiens
ctggccacctgaggtgggcc

SEQ ID NO: 2640802 - DNA, 22 bp, Homo sapiens
ctggccacctgaggtgggccca

SEQ ID NO: 2640803 - DNA, 19 bp, Homo sapiens
ctggccactgcacagagct

SEQ ID NO: 2640804 - DNA, 21 bp, Homo sapiens
ctggccactgcacagagctct

SEQ ID NO: 2640805 - DNA, 22 bp, Homo sapiens
ctggccactgcacagagctctc

SEQ ID NO: 2640806 - DNA, 22 bp, Homo sapiens
ctggccagatgcaccagccctt

SEQ ID NO: 2640807 - DNA, 12 bp, Homo sapiens
ctggccaggagc

SEQ ID NO: 2640808 - DNA, 15 bp, Homo sapiens
ctggccaggagctct

SEQ ID NO: 2640809 - DNA, 20 bp, Homo sapiens
ctggccaggagctcttcagg

SEQ ID NO: 2640810 - DNA, 12 bp, Homo sapiens
ctggccaggatg

SEQ ID NO: 2640811 - DNA, 14 bp, Homo sapiens
ctggccaggcagat

SEQ ID NO: 2640812 - DNA, 15 bp, Homo sapiens
ctggccagggcctgg

SEQ ID NO: 2640813 - DNA, 16 bp, Homo sapiens
ctggccagggcctgga

SEQ ID NO: 2640814 - DNA, 20 bp, Homo sapiens
ctggcccagccaaaccctgt

SEQ ID NO: 2640815 - DNA, 23 bp, Homo sapiens
ctggcccagccaaaccctgtctg

SEQ ID NO: 2640816 - DNA, 17 bp, Homo sapiens
ctggcccagccctgctg

SEQ ID NO: 2640817 - DNA, 16 bp, Homo sapiens
ctggcccagccggcct

SEQ ID NO: 2640818 - DNA, 18 bp, Homo sapiens
ctggcccagccggcctct

SEQ ID NO: 2640819 - DNA, 20 bp, Homo sapiens
ctggcccagccggcctctct

SEQ ID NO: 2640820 - DNA, 21 bp, Homo sapiens
ctggcccagccggcctctctg

SEQ ID NO: 2640821 - DNA, 23 bp, Homo sapiens
ctggcccagccggcctctctggc

SEQ ID NO: 2640822 - DNA, 14 bp, Homo sapiens
ctggcccagcggcc

SEQ ID NO: 2640823 - DNA, 14 bp, Homo sapiens
ctggccccgccgcc

SEQ ID NO: 2640824 - DNA, 22 bp, Homo sapiens
ctggccccgccgcctggtactc

SEQ ID NO: 2640825 - DNA, 12 bp, Homo sapiens
ctggcccctcac

SEQ ID NO: 2640826 - DNA, 22 bp, Homo sapiens
ctggcccctcacctgggcacct

SEQ ID NO: 2640827 - DNA, 20 bp, Homo sapiens
ctggcccctcagggtccctg

SEQ ID NO: 2640828 - DNA, 18 bp, Homo sapiens
ctggcccgtcatgttcct

SEQ ID NO: 2640829 - DNA, 22 bp, Homo sapiens
ctggcccgtcatgttcctcaaa

SEQ ID NO: 2640830 - DNA, 19 bp, Homo sapiens
ctggcccgtgacagactcc

SEQ ID NO: 2640831 - DNA, 17 bp, Homo sapiens
ctggccctcacccctgc

SEQ ID NO: 2640832 - DNA, 23 bp, Homo sapiens
ctgtaaagagacctacctcaggt

SEQ ID NO: 2640833 - DNA, 17 bp, Homo sapiens
ctgtaacacaagccaca

SEQ ID NO: 2640834 - DNA, 18 bp, Homo sapiens
ctgtaacacaagccacag

SEQ ID NO: 2640835 - DNA, 22 bp, Homo sapiens
ctgtaacacaagccacagaagc

SEQ ID NO: 2640836 - DNA, 22 bp, Homo sapiens
ctgtaacctcttcagaggccct

SEQ ID NO: 2640837 - DNA, 16 bp, Homo sapiens
ctgtaaggcatgaagg

SEQ ID NO: 2640838 - DNA, 16 bp, Homo sapiens
ctgtaagttttgaatt

SEQ ID NO: 2640839 - DNA, 13 bp, Homo sapiens
ctgtaatcccagc

SEQ ID NO: 2640840 - DNA, 15 bp, Homo sapiens
ctgtaatcccagcac

SEQ ID NO: 2640841 - DNA, 14 bp, Homo sapiens
ctgtaatcccagct

SEQ ID NO: 2640842 - DNA, 19 bp, Homo sapiens
ctgtaatcccagctactcg

SEQ ID NO: 2640843 - DNA, 19 bp, Homo sapiens
ctgtaatcctagcactttg

SEQ ID NO: 2640844 - DNA, 20 bp, Homo sapiens
ctgtaatcctagcactttgg

SEQ ID NO: 2640845 - DNA, 19 bp, Homo sapiens
ctgtaatctcgtttcaaaa

SEQ ID NO: 2640846 - DNA, 15 bp, Homo sapiens
ctgtaatgaatctaa

SEQ ID NO: 2640847 - DNA, 17 bp, Homo sapiens
ctgtaatttgtgataca

SEQ ID NO: 2640848 - DNA, 18 bp, Homo sapiens
ctgtaatttgtgatacaa

SEQ ID NO: 2640849 - DNA, 15 bp, Homo sapiens
ctgtacaatatttaa

SEQ ID NO: 2640850 - DNA, 17 bp, Homo sapiens
ctgtacaatatttaaaa

SEQ ID NO: 2640851 - DNA, 21 bp, Homo sapiens
ctgtacaatatttaaaattta

SEQ ID NO: 2640852 - DNA, 17 bp, Homo sapiens
ctgtacacgtgtcctgt

SEQ ID NO: 2640853 - DNA, 14 bp, Homo sapiens
ctgtacagagccca

SEQ ID NO: 2640854 - DNA, 22 bp, Homo sapiens
ctgtacagagcccacgccccca

SEQ ID NO: 2640855 - DNA, 17 bp, Homo sapiens
ctgtacatagcctatat

SEQ ID NO: 2640856 - DNA, 21 bp, Homo sapiens
ctgtacatgaaaacacatttt

SEQ ID NO: 2640857 - DNA, 22 bp, Homo sapiens
ctgtacatgaaaacacattttt

SEQ ID NO: 2640858 - DNA, 19 bp, Homo sapiens
ctgtaccagcccagatgtt

SEQ ID NO: 2640859 - DNA, 21 bp, Homo sapiens
ctgtacctcttgagccttgaa

SEQ ID NO: 2640860 - DNA, 21 bp, Homo sapiens
ctgtacctgttccttagacct

SEQ ID NO: 2640861 - DNA, 20 bp, Homo sapiens
ctgtaccttttgaggagccc

SEQ ID NO: 2640862 - DNA, 16 bp, Homo sapiens
ctgtacgtctgacagg

SEQ ID NO: 2640863 - DNA, 20 bp, Homo sapiens
ctgtacgtctgacaggcaat

SEQ ID NO: 2640864 - DNA, 13 bp, Homo sapiens
ctgtactagagat

SEQ ID NO: 2640865 - DNA, 15 bp, Homo sapiens
ctgtagaagagggat

SEQ ID NO: 2640866 - DNA, 17 bp, Homo sapiens
ctgtagagggccctggt

SEQ ID NO: 2640867 - DNA, 15 bp, Homo sapiens
ctgtagagtgggagc

SEQ ID NO: 2640868 - DNA, 20 bp, Homo sapiens
ctgtagcagtgagaaaaagc

SEQ ID NO: 2640869 - DNA, 21 bp, Homo sapiens
ctgtagcagtgagaaaaagct

SEQ ID NO: 2640870 - DNA, 16 bp, Homo sapiens
ctgtagcatcttctgg

SEQ ID NO: 2640871 - DNA, 18 bp, Homo sapiens
ctgtagcatcttctggag

SEQ ID NO: 2640872 - DNA, 18 bp, Homo sapiens
ctgtagcattacagtggg

SEQ ID NO: 2640873 - DNA, 13 bp, Homo sapiens
ctgtagccttctg

SEQ ID NO: 2640874 - DNA, 18 bp, Homo sapiens
ctgtaggaaggttaatgt

SEQ ID NO: 2640875 - DNA, 21 bp, Homo sapiens
ctgtaggaaggttaatgttca

SEQ ID NO: 2640876 - DNA, 14 bp, Homo sapiens
ctgtagggctggac

SEQ ID NO: 2640877 - DNA, 15 bp, Homo sapiens
ctgtagggctggacc

SEQ ID NO: 2640878 - DNA, 16 bp, Homo sapiens
ctgtagggctggacct

SEQ ID NO: 2640879 - DNA, 18 bp, Homo sapiens
ctgtagggctggacctat

SEQ ID NO: 2640880 - DNA, 21 bp, Homo sapiens
ctgtagggctggacctatgtc

SEQ ID NO: 2640881 - DNA, 18 bp, Homo sapiens
ctgtagtagccctttctg

SEQ ID NO: 2640882 - DNA, 14 bp, Homo sapiens
ctgtagtcccagcc

SEQ ID NO: 2640883 - DNA, 18 bp, Homo sapiens
ctgtagtcccagctactc

SEQ ID NO: 2640884 - DNA, 22 bp, Homo sapiens
ctgtagtcccagctactcggga

SEQ ID NO: 2640885 - DNA, 15 bp, Homo sapiens
ctgtagtctcaggac

SEQ ID NO: 2640886 - DNA, 14 bp, Homo sapiens
ctgtagttaggaaa

SEQ ID NO: 2640887 - DNA, 22 bp, Homo sapiens
ctgtagttaggaaataaaacct

SEQ ID NO: 2640888 - DNA, 21 bp, Homo sapiens
ctgtagttttatcacatgtat

SEQ ID NO: 2640889 - DNA, 15 bp, Homo sapiens
ctgtataaataggag

SEQ ID NO: 2640890 - DNA, 20 bp, Homo sapiens
ctgtataaataggagaggat

SEQ ID NO: 2640891 - DNA, 21 bp, Homo sapiens
ctgtataaataggagaggatg

SEQ ID NO: 2640892 - DNA, 19 bp, Homo sapiens
ctgtatacaaccctggcat

SEQ ID NO: 2640893 - DNA, 15 bp, Homo sapiens
ctgtatatacaataa

SEQ ID NO: 2640894 - DNA, 15 bp, Homo sapiens
ctgtatcccatgagc

SEQ ID NO: 2640895 - DNA, 19 bp, Homo sapiens
ctgtatcccatgagcctca

SEQ ID NO: 2640896 - DNA, 17 bp, Homo sapiens
ctgtatcggagacagtg

SEQ ID NO: 2640897 - DNA, 17 bp, Homo sapiens
ctgtatctgtagtgaga

SEQ ID NO: 2640898 - DNA, 23 bp, Homo sapiens
ctgtatctgtagtgagatagcat

SEQ ID NO: 2640899 - DNA, 12 bp, Homo sapiens
ctgtatgtcaga

SEQ ID NO: 2640900 - DNA, 13 bp, Homo sapiens
ctgtatgttgtcc

SEQ ID NO: 2640901 - DNA, 15 bp, Homo sapiens
ctgtatgttgtccaa

SEQ ID NO: 2640902 - DNA, 19 bp, Homo sapiens
ctgtattagtcacagagat

SEQ ID NO: 2640903 - DNA, 13 bp, Homo sapiens
ctgtattgaatca

SEQ ID NO: 2640904 - DNA, 20 bp, Homo sapiens
ctgtattgaatcatgtagta

SEQ ID NO: 2640905 - DNA, 16 bp, Homo sapiens
ctgtatttgtgactaa

SEQ ID NO: 2640906 - DNA, 20 bp, Homo sapiens
ctgtattttgtattgtttca

SEQ ID NO: 2640907 - DNA, 16 bp, Homo sapiens
ctgtcaaaataatttt

SEQ ID NO: 2640908 - DNA, 12 bp, Homo sapiens
ctgtcaagaaga

SEQ ID NO: 2640909 - DNA, 14 bp, Homo sapiens
ctgtcaagaagatg

SEQ ID NO: 2640910 - DNA, 17 bp, Homo sapiens
ctgtcaatttccctgac

SEQ ID NO: 2640911 - DNA, 20 bp, Homo sapiens
ctgtcacccaggctggagta

SEQ ID NO: 2640912 - DNA, 16 bp, Homo sapiens
ctgtcaccctccacct

SEQ ID NO: 2640913 - DNA, 12 bp, Homo sapiens
ctgtcactttgc

SEQ ID NO: 2640914 - DNA, 21 bp, Homo sapiens
ctgtcagatgggaagacatga

SEQ ID NO: 2640915 - DNA, 23 bp, Homo sapiens
ctgtcagccgggccctgagtaat

SEQ ID NO: 2640916 - DNA, 17 bp, Homo sapiens
ctgtcagcgcaggttta

SEQ ID NO: 2640917 - DNA, 15 bp, Homo sapiens
ctgtcagtgcagccc

SEQ ID NO: 2640918 - DNA, 19 bp, Homo sapiens
ctgtcagtgcagcccgtgt

SEQ ID NO: 2640919 - DNA, 15 bp, Homo sapiens
ctgtcatcaattgaa

SEQ ID NO: 2640920 - DNA, 15 bp, Homo sapiens
ctgtcatgaacatgt

SEQ ID NO: 2640921 - DNA, 17 bp, Homo sapiens
ctgtcatgcccccctca

SEQ ID NO: 2640922 - DNA, 18 bp, Homo sapiens
ctgtcatgcccccctcaa

SEQ ID NO: 2640923 - DNA, 14 bp, Homo sapiens
ctgtcatttgagca

SEQ ID NO: 2640924 - DNA, 22 bp, Homo sapiens
ctgtcatttgagcagggctcag

SEQ ID NO: 2640925 - DNA, 20 bp, Homo sapiens
ctgtccaaactgcctaagcc

SEQ ID NO: 2640926 - DNA, 20 bp, Homo sapiens
ctgtccacacccagctcagc

SEQ ID NO: 2640927 - DNA, 11 bp, Homo sapiens
ctgtccagaga

SEQ ID NO: 2640928 - DNA, 18 bp, Homo sapiens
ctgtccagcctgggcagc

SEQ ID NO: 2640929 - DNA, 17 bp, Homo sapiens
ctgtccaggcactgctg

SEQ ID NO: 2640930 - DNA, 18 bp, Homo sapiens
ctgtccaggcactgctgc

SEQ ID NO: 2640931 - DNA, 20 bp, Homo sapiens
ctgtccaggcactgctgccc

SEQ ID NO: 2640932 - DNA, 21 bp, Homo sapiens
ctgtccaggcactgctgccca

SEQ ID NO: 2640933 - DNA, 18 bp, Homo sapiens
ctgtccagttcccagaag

SEQ ID NO: 2640934 - DNA, 20 bp, Homo sapiens
ctgtccagttcccagaaggc

SEQ ID NO: 2640935 - DNA, 15 bp, Homo sapiens
ctgtcccacctcttc

SEQ ID NO: 2640936 - DNA, 19 bp, Homo sapiens
ctgtcccaggttatctggg

SEQ ID NO: 2640937 - DNA, 22 bp, Homo sapiens
ctgtcccagtgccgagaaggaa

SEQ ID NO: 2640938 - DNA, 19 bp, Homo sapiens
ctgtcccatggacactcca

SEQ ID NO: 2640939 - DNA, 14 bp, Homo sapiens
ctgtcccccagctc

SEQ ID NO: 2640940 - DNA, 15 bp, Homo sapiens
ctgtcccccagctct

SEQ ID NO: 2640941 - DNA, 18 bp, Homo sapiens
ctgtcccccagctctggt

SEQ ID NO: 2640942 - DNA, 13 bp, Homo sapiens
ctgtccccctgac

SEQ ID NO: 2640943 - DNA, 17 bp, Homo sapiens
ctgtcccggggtcctgt

SEQ ID NO: 2640944 - DNA, 18 bp, Homo sapiens
ctgtcccggggtcctgtg

SEQ ID NO: 2640945 - DNA, 15 bp, Homo sapiens
ctgtccctcaaatga

SEQ ID NO: 2640946 - DNA, 21 bp, Homo sapiens
ctgtccctccgggacctggtg

SEQ ID NO: 2640947 - DNA, 19 bp, Homo sapiens
ctgtcccttcccccataag

SEQ ID NO: 2640948 - DNA, 14 bp, Homo sapiens
ctgtccgagctttg

SEQ ID NO: 2640949 - DNA, 15 bp, Homo sapiens
ctgtccgagctttga

SEQ ID NO: 2640950 - DNA, 17 bp, Homo sapiens
ctgtcctactctgtgtc

SEQ ID NO: 2640951 - DNA, 15 bp, Homo sapiens
ctgtcctaggccaca

SEQ ID NO: 2640952 - DNA, 16 bp, Homo sapiens
ctgtcctcccatcccc

SEQ ID NO: 2640953 - DNA, 19 bp, Homo sapiens
ctgtcctcccatcccctgg

SEQ ID NO: 2640954 - DNA, 19 bp, Homo sapiens
ctgtcctcctggtgggtcc

SEQ ID NO: 2640955 - DNA, 18 bp, Homo sapiens
ctgtcctgacctgtctca

SEQ ID NO: 2640956 - DNA, 19 bp, Homo sapiens
ctgtcctgatggtcagctc

SEQ ID NO: 2640957 - DNA, 20 bp, Homo sapiens
ctgtcctgatggtcagctcc

SEQ ID NO: 2640958 - DNA, 14 bp, Homo sapiens
ctgtcgagacactt

SEQ ID NO: 2640959 - DNA, 18 bp, Homo sapiens
ctgtcgagacacttgcct

SEQ ID NO: 2640960 - DNA, 18 bp, Homo sapiens
ctgtcgccttagcatgtt

SEQ ID NO: 2640961 - DNA, 13 bp, Homo sapiens
ctgtctaaaaaac

SEQ ID NO: 2640962 - DNA, 16 bp, Homo sapiens
ctgtctcagcctccca

SEQ ID NO: 2640963 - DNA, 17 bp, Homo sapiens
ctgtctcagtttcactt

SEQ ID NO: 2640964 - DNA, 15 bp, Homo sapiens
ctgtctcatccatca

SEQ ID NO: 2640965 - DNA, 16 bp, Homo sapiens
ctgtctcatccatcat

SEQ ID NO: 2640966 - DNA, 22 bp, Homo sapiens
ctgtctccagacccccacccct

SEQ ID NO: 2640967 - DNA, 20 bp, Homo sapiens
ctgtctccttaacactgagc

SEQ ID NO: 2640968 - DNA, 20 bp, Homo sapiens
ctgtctctagccactttggt

SEQ ID NO: 2640969 - DNA, 16 bp, Homo sapiens
ctgtctctgcctccct

SEQ ID NO: 2640970 - DNA, 13 bp, Homo sapiens
ctgtctctggcct

SEQ ID NO: 2640971 - DNA, 21 bp, Homo sapiens
ctgtctgatctgtgctttcca

SEQ ID NO: 2640972 - DNA, 14 bp, Homo sapiens
ctgtctgccagcca

SEQ ID NO: 2640973 - DNA, 15 bp, Homo sapiens
ctgtctgccagccag

SEQ ID NO: 2640974 - DNA, 20 bp, Homo sapiens
ctgtctgccagccagcagcc

SEQ ID NO: 2640975 - DNA, 20 bp, Homo sapiens
ctgtctgtagagggccctgg

SEQ ID NO: 2640976 - DNA, 15 bp, Homo sapiens
cttacctcttccgga

SEQ ID NO: 2640977 - DNA, 20 bp, Homo sapiens
cttacctgtatgtctccagt

SEQ ID NO: 2640978 - DNA, 16 bp, Homo sapiens
cttaccttcaataaag

SEQ ID NO: 2640979 - DNA, 20 bp, Homo sapiens
cttacctttttatttgcatg

SEQ ID NO: 2640980 - DNA, 21 bp, Homo sapiens
cttactaagctttgccagctg

SEQ ID NO: 2640981 - DNA, 24 bp, Homo sapiens
cttactaagctttgccagctgctg

SEQ ID NO: 2640982 - DNA, 15 bp, Homo sapiens
cttactcttcttgaa

SEQ ID NO: 2640983 - DNA, 12 bp, Homo sapiens
cttactgaaggt

SEQ ID NO: 2640984 - DNA, 15 bp, Homo sapiens
cttactgatatattt

SEQ ID NO: 2640985 - DNA, 16 bp, Homo sapiens
cttactgtggaggaag

SEQ ID NO: 2640986 - DNA, 17 bp, Homo sapiens
cttactgtggaggaagg

SEQ ID NO: 2640987 - DNA, 18 bp, Homo sapiens
cttactgtggaggaagga

SEQ ID NO: 2640988 - DNA, 21 bp, Homo sapiens
cttactgtttctgtcaggaga

SEQ ID NO: 2640989 - DNA, 16 bp, Homo sapiens
cttagacagtccctgc

SEQ ID NO: 2640990 - DNA, 17 bp, Homo sapiens
cttagacagtccctgcc

SEQ ID NO: 2640991 - DNA, 12 bp, Homo sapiens
cttagacctcag

SEQ ID NO: 2640992 - DNA, 16 bp, Homo sapiens
cttagacttctgcttt

SEQ ID NO: 2640993 - DNA, 18 bp, Homo sapiens
cttagatgttctaagtct

SEQ ID NO: 2640994 - DNA, 16 bp, Homo sapiens
cttagcagctatctct

SEQ ID NO: 2640995 - DNA, 13 bp, Homo sapiens
cttagcaggagag

SEQ ID NO: 2640996 - DNA, 21 bp, Homo sapiens
cttagcaggagaggagagcca

SEQ ID NO: 2640997 - DNA, 21 bp, Homo sapiens
cttagcagggaaacagctaat

SEQ ID NO: 2640998 - DNA, 17 bp, Homo sapiens
cttagcatgtttgctga

SEQ ID NO: 2640999 - DNA, 15 bp, Homo sapiens
cttagcctccctgaa

SEQ ID NO: 2641000 - DNA, 14 bp, Homo sapiens
cttagctgagtgga

SEQ ID NO: 2641001 - DNA, 14 bp, Homo sapiens
cttagcttagacct

SEQ ID NO: 2641002 - DNA, 14 bp, Homo sapiens
cttagctttttaat

SEQ ID NO: 2641003 - DNA, 17 bp, Homo sapiens
cttagctttttaattgt

SEQ ID NO: 2641004 - DNA, 16 bp, Homo sapiens
cttaggagcagagctc

SEQ ID NO: 2641005 - DNA, 15 bp, Homo sapiens
cttaggcagggaagt

SEQ ID NO: 2641006 - DNA, 19 bp, Homo sapiens
cttaggcatgactgtagaa

SEQ ID NO: 2641007 - DNA, 21 bp, Homo sapiens
cttagggaaggatacaaaagc

SEQ ID NO: 2641008 - DNA, 12 bp, Homo sapiens
cttagtctcagt

SEQ ID NO: 2641009 - DNA, 20 bp, Homo sapiens
cttagtctcagtttgtgtgt

SEQ ID NO: 2641010 - DNA, 15 bp, Homo sapiens
cttagtcttctcata

SEQ ID NO: 2641011 - DNA, 19 bp, Homo sapiens
cttagtgcggacaagtttt

SEQ ID NO: 2641012 - DNA, 20 bp, Homo sapiens
cttagtgcggacaagtttta

SEQ ID NO: 2641013 - DNA, 15 bp, Homo sapiens
cttagttctcactgt

SEQ ID NO: 2641014 - DNA, 16 bp, Homo sapiens
cttagttctcactgtt

SEQ ID NO: 2641015 - DNA, 14 bp, Homo sapiens
cttatacccatgaa

SEQ ID NO: 2641016 - DNA, 13 bp, Homo sapiens
cttataggtggcc

SEQ ID NO: 2641017 - DNA, 18 bp, Homo sapiens
cttatatagtttactatt

SEQ ID NO: 2641018 - DNA, 17 bp, Homo sapiens
cttatattgtaagaaat

SEQ ID NO: 2641019 - DNA, 16 bp, Homo sapiens
cttatcaagtgtcttc

SEQ ID NO: 2641020 - DNA, 19 bp, Homo sapiens
cttatcaagtgtcttccat

SEQ ID NO: 2641021 - DNA, 13 bp, Homo sapiens
cttatcaccagct

SEQ ID NO: 2641022 - DNA, 18 bp, Homo sapiens
cttatcactgacacaaaa

SEQ ID NO: 2641023 - DNA, 15 bp, Homo sapiens
cttatcatccacatt

SEQ ID NO: 2641024 - DNA, 19 bp, Homo sapiens
cttatcatccacattgttt

SEQ ID NO: 2641025 - DNA, 13 bp, Homo sapiens
cttatccaggact

SEQ ID NO: 2641026 - DNA, 15 bp, Homo sapiens
cttatcctctgatct

SEQ ID NO: 2641027 - DNA, 16 bp, Homo sapiens
cttatcctctgatctc

SEQ ID NO: 2641028 - DNA, 19 bp, Homo sapiens
cttatctcagtcatgcata

SEQ ID NO: 2641029 - DNA, 22 bp, Homo sapiens
cttatctcagtcatgcataaat

SEQ ID NO: 2641030 - DNA, 13 bp, Homo sapiens
cttatctccaaga

SEQ ID NO: 2641031 - DNA, 16 bp, Homo sapiens
cttatctccaagacca

SEQ ID NO: 2641032 - DNA, 13 bp, Homo sapiens
cttatctctctgt

SEQ ID NO: 2641033 - DNA, 21 bp, Homo sapiens
cttatgacatcacttgtacaa

SEQ ID NO: 2641034 - DNA, 21 bp, Homo sapiens
cttatgccatgttaatttcat

SEQ ID NO: 2641035 - DNA, 14 bp, Homo sapiens
cttattaaagttct

SEQ ID NO: 2641036 - DNA, 17 bp, Homo sapiens
cttattagaacaggcaa

SEQ ID NO: 2641037 - DNA, 13 bp, Homo sapiens
cttattgcccacg

SEQ ID NO: 2641038 - DNA, 18 bp, Homo sapiens
cttattgcccacgctgga

SEQ ID NO: 2641039 - DNA, 14 bp, Homo sapiens
cttattgtacctct

SEQ ID NO: 2641040 - DNA, 15 bp, Homo sapiens
cttattgtacctctc

SEQ ID NO: 2641041 - DNA, 18 bp, Homo sapiens
cttattgtacctctctta

SEQ ID NO: 2641042 - DNA, 17 bp, Homo sapiens
cttattgttccaagaca

SEQ ID NO: 2641043 - DNA, 15 bp, Homo sapiens
cttatttaatgaaag

SEQ ID NO: 2641044 - DNA, 17 bp, Homo sapiens
cttatttaatgaaagac

SEQ ID NO: 2641045 - DNA, 18 bp, Homo sapiens
cttatttaatgaaagact

SEQ ID NO: 2641046 - DNA, 14 bp, Homo sapiens
cttattttcaagaa

SEQ ID NO: 2641047 - DNA, 14 bp, Homo sapiens
cttattttctctgt

SEQ ID NO: 2641048 - DNA, 16 bp, Homo sapiens
cttatttttttctgat

SEQ ID NO: 2641049 - DNA, 15 bp, Homo sapiens
cttcaaaagtatttt

SEQ ID NO: 2641050 - DNA, 16 bp, Homo sapiens
cttcaaaagtattttc

SEQ ID NO: 2641051 - DNA, 23 bp, Homo sapiens
cttcaacagaccccctctagaaa

SEQ ID NO: 2641052 - DNA, 16 bp, Homo sapiens
cttcaacagctcccca

SEQ ID NO: 2641053 - DNA, 17 bp, Homo sapiens
cttcaacagctccccat

SEQ ID NO: 2641054 - DNA, 18 bp, Homo sapiens
cttcaacatcaatgttca

SEQ ID NO: 2641055 - DNA, 17 bp, Homo sapiens
cttcaaccttgagacag

SEQ ID NO: 2641056 - DNA, 18 bp, Homo sapiens
cttcaagatcatgtaccc

SEQ ID NO: 2641057 - DNA, 16 bp, Homo sapiens
cttcaagttagctcag

SEQ ID NO: 2641058 - DNA, 18 bp, Homo sapiens
cttcaagttagctcagga

SEQ ID NO: 2641059 - DNA, 19 bp, Homo sapiens
cttcaagttagctcaggag

SEQ ID NO: 2641060 - DNA, 12 bp, Homo sapiens
cttcaataaagt

SEQ ID NO: 2641061 - DNA, 21 bp, Homo sapiens
cttcaataaatggtatagcaa

SEQ ID NO: 2641062 - DNA, 15 bp, Homo sapiens
cttcacaaattctca

SEQ ID NO: 2641063 - DNA, 12 bp, Homo sapiens
cttcacaacaga

SEQ ID NO: 2641064 - DNA, 14 bp, Homo sapiens
cttcacaacagatt

SEQ ID NO: 2641065 - DNA, 16 bp, Homo sapiens
cttcacacacaggcaa

SEQ ID NO: 2641066 - DNA, 22 bp, Homo sapiens
cttcacacacaggcaactgagg

SEQ ID NO: 2641067 - DNA, 17 bp, Homo sapiens
cttcacagagtgtgctg

SEQ ID NO: 2641068 - DNA, 23 bp, Homo sapiens
cttcacagagtgtgctggaggac

SEQ ID NO: 2641069 - DNA, 14 bp, Homo sapiens
cttcacagtgtttc

SEQ ID NO: 2641070 - DNA, 21 bp, Homo sapiens
cttcacatcctgtgtttctag

SEQ ID NO: 2641071 - DNA, 19 bp, Homo sapiens
cttcaccagagcatttcca

SEQ ID NO: 2641072 - DNA, 15 bp, Homo sapiens
cttcacctcactgaa

SEQ ID NO: 2641073 - DNA, 20 bp, Homo sapiens
cttcacctgattcaactaaa

SEQ ID NO: 2641074 - DNA, 21 bp, Homo sapiens
cttcacctgattcaactaaaa

SEQ ID NO: 2641075 - DNA, 17 bp, Homo sapiens
cttcacctttgtcccca

SEQ ID NO: 2641076 - DNA, 19 bp, Homo sapiens
cttcacgaagtgttgcatg

SEQ ID NO: 2641077 - DNA, 20 bp, Homo sapiens
cttcacgaagtgttgcatgg

SEQ ID NO: 2641078 - DNA, 15 bp, Homo sapiens
cttcacggaagagcc

SEQ ID NO: 2641079 - DNA, 22 bp, Homo sapiens
cttcactccggtgtgcctgcag

SEQ ID NO: 2641080 - DNA, 15 bp, Homo sapiens
cttcactctctgaag

SEQ ID NO: 2641081 - DNA, 13 bp, Homo sapiens
cttcactgccttt

SEQ ID NO: 2641082 - DNA, 17 bp, Homo sapiens
cttcactgcctttgctc

SEQ ID NO: 2641083 - DNA, 13 bp, Homo sapiens
cttcactgtataa

SEQ ID NO: 2641084 - DNA, 15 bp, Homo sapiens
cttcacttctgacca

SEQ ID NO: 2641085 - DNA, 19 bp, Homo sapiens
cttcacttctgaccacact

SEQ ID NO: 2641086 - DNA, 21 bp, Homo sapiens
cttcactttaattctcatgtg

SEQ ID NO: 2641087 - DNA, 16 bp, Homo sapiens
cttcagagagctggta

SEQ ID NO: 2641088 - DNA, 22 bp, Homo sapiens
cttcagagagctggtagttagt

SEQ ID NO: 2641089 - DNA, 12 bp, Homo sapiens
cttcagagcagg

SEQ ID NO: 2641090 - DNA, 12 bp, Homo sapiens
cttcagagctga

SEQ ID NO: 2641091 - DNA, 18 bp, Homo sapiens
cttcagagctgacacagg

SEQ ID NO: 2641092 - DNA, 20 bp, Homo sapiens
cttcagagctgacacaggat

SEQ ID NO: 2641093 - DNA, 18 bp, Homo sapiens
cttcagccaggagctggg

SEQ ID NO: 2641094 - DNA, 13 bp, Homo sapiens
cttcagcctagcc

SEQ ID NO: 2641095 - DNA, 20 bp, Homo sapiens
cttcagcctagccgacctca

SEQ ID NO: 2641096 - DNA, 20 bp, Homo sapiens
cttcagcctccccaccttct

SEQ ID NO: 2641097 - DNA, 14 bp, Homo sapiens
cttcagcctcccga

SEQ ID NO: 2641098 - DNA, 22 bp, Homo sapiens
cttcagcctgaggctgagactg

SEQ ID NO: 2641099 - DNA, 19 bp, Homo sapiens
cttcagctgtacttcgtct

SEQ ID NO: 2641100 - DNA, 13 bp, Homo sapiens
cttcagcttcttc

SEQ ID NO: 2641101 - DNA, 18 bp, Homo sapiens
cttcagcttcttcatctt

SEQ ID NO: 2641102 - DNA, 17 bp, Homo sapiens
cttcagggcagggctct

SEQ ID NO: 2641103 - DNA, 20 bp, Homo sapiens
cttcagggcagggctctgat

SEQ ID NO: 2641104 - DNA, 21 bp, Homo sapiens
cttcaggttatcgaaataaca

SEQ ID NO: 2641105 - DNA, 16 bp, Homo sapiens
cttcagtaagccgtga

SEQ ID NO: 2641106 - DNA, 23 bp, Homo sapiens
cttcagtaagccgtgattttcat

SEQ ID NO: 2641107 - DNA, 19 bp, Homo sapiens
cttcagtaccctctcagct

SEQ ID NO: 2641108 - DNA, 16 bp, Homo sapiens
cttcagtggcagctgc

SEQ ID NO: 2641109 - DNA, 17 bp, Homo sapiens
cttcagtgtatggaaat

SEQ ID NO: 2641110 - DNA, 15 bp, Homo sapiens
cttcataacaatttt

SEQ ID NO: 2641111 - DNA, 20 bp, Homo sapiens
cttcatacctacatgtattt

SEQ ID NO: 2641112 - DNA, 18 bp, Homo sapiens
cttcatagcagattttaa

SEQ ID NO: 2641113 - DNA, 11 bp, Homo sapiens
cttcatcctct

SEQ ID NO: 2641114 - DNA, 15 bp, Homo sapiens
cttcatctggaacca

SEQ ID NO: 2641115 - DNA, 14 bp, Homo sapiens
cttcatctggcaac

SEQ ID NO: 2641116 - DNA, 12 bp, Homo sapiens
cttcatcttctc

SEQ ID NO: 2641117 - DNA, 15 bp, Homo sapiens
cttcatcttctcagc

SEQ ID NO: 2641118 - DNA, 12 bp, Homo sapiens
cttcatgacatt

SEQ ID NO: 2641119 - DNA, 16 bp, Homo sapiens
cttcatgccagctact

SEQ ID NO: 2641120 - DNA, 15 bp, Homo sapiens
cttcatggcagaagg

SEQ ID NO: 2641121 - DNA, 20 bp, Homo sapiens
cttcattaagccctcttcca

SEQ ID NO: 2641122 - DNA, 16 bp, Homo sapiens
caaaattatttcagaa

SEQ ID NO: 2641123 - DNA, 14 bp, Homo sapiens
caaaatttccagta

SEQ ID NO: 2641124 - DNA, 19 bp, Homo sapiens
caaaatttgatgccaggac

SEQ ID NO: 2641125 - DNA, 11 bp, Homo sapiens
caaaatttgtt

SEQ ID NO: 2641126 - DNA, 21 bp, Homo sapiens
caaaattttatagctcagttt

SEQ ID NO: 2641127 - DNA, 23 bp, Homo sapiens
caaaattttatagctcagtttat

SEQ ID NO: 2641128 - DNA, 19 bp, Homo sapiens
caaacaatggaaactgaat

SEQ ID NO: 2641129 - DNA, 20 bp, Homo sapiens
caaacaatggaaactgaatg

SEQ ID NO: 2641130 - DNA, 21 bp, Homo sapiens
caaacaatggaaactgaatgc

SEQ ID NO: 2641131 - DNA, 22 bp, Homo sapiens
caaacaatggaaactgaatgct

SEQ ID NO: 2641132 - DNA, 15 bp, Homo sapiens
caaacacatacagga

SEQ ID NO: 2641133 - DNA, 13 bp, Homo sapiens
caaacagccacac

SEQ ID NO: 2641134 - DNA, 23 bp, Homo sapiens
caaacatggggttggctgggccc

SEQ ID NO: 2641135 - DNA, 17 bp, Homo sapiens
caaaccccaccctagtt

SEQ ID NO: 2641136 - DNA, 23 bp, Homo sapiens
caaaccgccagcgaacttgacaa

SEQ ID NO: 2641137 - DNA, 20 bp, Homo sapiens
caaacctagccccttagccc

SEQ ID NO: 2641138 - DNA, 15 bp, Homo sapiens
caaacctcctcttct

SEQ ID NO: 2641139 - DNA, 12 bp, Homo sapiens
caaacctctgtt

SEQ ID NO: 2641140 - DNA, 19 bp, Homo sapiens
caaacctgacccctgctca

SEQ ID NO: 2641141 - DNA, 19 bp, Homo sapiens
caaacctgcaagggctccc

SEQ ID NO: 2641142 - DNA, 13 bp, Homo sapiens
caaacctgcctgg

SEQ ID NO: 2641143 - DNA, 22 bp, Homo sapiens
caaacctgtttaaatatttcaa

SEQ ID NO: 2641144 - DNA, 16 bp, Homo sapiens
caaaccttgatgtgcc

SEQ ID NO: 2641145 - DNA, 18 bp, Homo sapiens
caaacctttattttagaa

SEQ ID NO: 2641146 - DNA, 14 bp, Homo sapiens
caaacgtatgtaaa

SEQ ID NO: 2641147 - DNA, 13 bp, Homo sapiens
caaactaagcccc

SEQ ID NO: 2641148 - DNA, 19 bp, Homo sapiens
caaactaagcccccgctgt

SEQ ID NO: 2641149 - DNA, 14 bp, Homo sapiens
caaactctctgaac

SEQ ID NO: 2641150 - DNA, 16 bp, Homo sapiens
caaactctgccagcca

SEQ ID NO: 2641151 - DNA, 14 bp, Homo sapiens
caaactgaagccag

SEQ ID NO: 2641152 - DNA, 22 bp, Homo sapiens
caaactgaggaatttcacctgt

SEQ ID NO: 2641153 - DNA, 18 bp, Homo sapiens
caaactgcctaagccctc

SEQ ID NO: 2641154 - DNA, 19 bp, Homo sapiens
caaactgccttggcttcag

SEQ ID NO: 2641155 - DNA, 23 bp, Homo sapiens
caaacttccagtgcaacactgaa

SEQ ID NO: 2641156 - DNA, 22 bp, Homo sapiens
caaacttggaatttgtaacctc

SEQ ID NO: 2641157 - DNA, 12 bp, Homo sapiens
caaactttattt

SEQ ID NO: 2641158 - DNA, 19 bp, Homo sapiens
caaacttttcccctgtcct

SEQ ID NO: 2641159 - DNA, 13 bp, Homo sapiens
caaagaagacatg

SEQ ID NO: 2641160 - DNA, 16 bp, Homo sapiens
caaagaagacatgttt

SEQ ID NO: 2641161 - DNA, 20 bp, Homo sapiens
caaagacaaattctgtttct

SEQ ID NO: 2641162 - DNA, 21 bp, Homo sapiens
caaagacaaattctgtttctt

SEQ ID NO: 2641163 - DNA, 18 bp, Homo sapiens
caaagaccaaattccttg

SEQ ID NO: 2641164 - DNA, 21 bp, Homo sapiens
caaagaccacacatttgtgta

SEQ ID NO: 2641165 - DNA, 17 bp, Homo sapiens
caaagacgacctttacc

SEQ ID NO: 2641166 - DNA, 17 bp, Homo sapiens
caaagagactggagcat

SEQ ID NO: 2641167 - DNA, 13 bp, Homo sapiens
caaagagcctgga

SEQ ID NO: 2641168 - DNA, 15 bp, Homo sapiens
caaagagcctggaga

SEQ ID NO: 2641169 - DNA, 20 bp, Homo sapiens
caaagaggcaagaggctgga

SEQ ID NO: 2641170 - DNA, 13 bp, Homo sapiens
caaagaggtattt

SEQ ID NO: 2641171 - DNA, 22 bp, Homo sapiens
caaagagtgggctgcatctggg

SEQ ID NO: 2641172 - DNA, 16 bp, Homo sapiens
caaagagttaatatat

SEQ ID NO: 2641173 - DNA, 18 bp, Homo sapiens
caaagatattttgctttg

SEQ ID NO: 2641174 - DNA, 23 bp, Homo sapiens
caaagatattttgctttgtgatt

SEQ ID NO: 2641175 - DNA, 13 bp, Homo sapiens
caaagatcaaaat

SEQ ID NO: 2641176 - DNA, 20 bp, Homo sapiens
caaagatcaaaataaaaagt

SEQ ID NO: 2641177 - DNA, 16 bp, Homo sapiens
caaagatgtttgtcag

SEQ ID NO: 2641178 - DNA, 16 bp, Homo sapiens
caaagcaataatagta

SEQ ID NO: 2641179 - DNA, 15 bp, Homo sapiens
caaagcaatgcattt

SEQ ID NO: 2641180 - DNA, 18 bp, Homo sapiens
caaagcaatgcattttgg

SEQ ID NO: 2641181 - DNA, 13 bp, Homo sapiens
caaagcacagtgt

SEQ ID NO: 2641182 - DNA, 19 bp, Homo sapiens
caaagcacagtgttaaatg

SEQ ID NO: 2641183 - DNA, 17 bp, Homo sapiens
caaagcacattgaaaga

SEQ ID NO: 2641184 - DNA, 18 bp, Homo sapiens
caaagcacattgaaagag

SEQ ID NO: 2641185 - DNA, 18 bp, Homo sapiens
caaagcaccaaaataaga

SEQ ID NO: 2641186 - DNA, 21 bp, Homo sapiens
caaagcaccaaaataagaaaa

SEQ ID NO: 2641187 - DNA, 22 bp, Homo sapiens
caaagcaccaaaataagaaaag

SEQ ID NO: 2641188 - DNA, 24 bp, Homo sapiens
caaagcaccaaaataagaaaagat

SEQ ID NO: 2641189 - DNA, 20 bp, Homo sapiens
caaagcactgacttctaagt

SEQ ID NO: 2641190 - DNA, 21 bp, Homo sapiens
caaagcacttggactcttgct

SEQ ID NO: 2641191 - DNA, 22 bp, Homo sapiens
caaagcacttggactcttgctc

SEQ ID NO: 2641192 - DNA, 18 bp, Homo sapiens
caaagccaaactctgcca

SEQ ID NO: 2641193 - DNA, 14 bp, Homo sapiens
caaagccagaagct

SEQ ID NO: 2641194 - DNA, 18 bp, Homo sapiens
caaagccagaagctgagc

SEQ ID NO: 2641195 - DNA, 20 bp, Homo sapiens
caaagccagcgtcctcctct

SEQ ID NO: 2641196 - DNA, 18 bp, Homo sapiens
caaagcccttccatgtcg

SEQ ID NO: 2641197 - DNA, 23 bp, Homo sapiens
caaagccttgtgtctacagagaa

SEQ ID NO: 2641198 - DNA, 22 bp, Homo sapiens
caaagctagggtggcccttgca

SEQ ID NO: 2641199 - DNA, 14 bp, Homo sapiens
caaagcttagcagg

SEQ ID NO: 2641200 - DNA, 15 bp, Homo sapiens
caaagcttagcagga

SEQ ID NO: 2641201 - DNA, 14 bp, Homo sapiens
caaagcttgaagat

SEQ ID NO: 2641202 - DNA, 21 bp, Homo sapiens
caaagcttggaagagcctgca

SEQ ID NO: 2641203 - DNA, 22 bp, Homo sapiens
caaagcttggaagagcctgcag

SEQ ID NO: 2641204 - DNA, 20 bp, Homo sapiens
caaaggagggtcaggaagga

SEQ ID NO: 2641205 - DNA, 15 bp, Homo sapiens
caaaggcaagcactt

SEQ ID NO: 2641206 - DNA, 20 bp, Homo sapiens
caaaggcacagtgaaggctg

SEQ ID NO: 2641207 - DNA, 15 bp, Homo sapiens
caaaggccagggtca

SEQ ID NO: 2641208 - DNA, 23 bp, Homo sapiens
caaaggccatggagagctggagc

SEQ ID NO: 2641209 - DNA, 17 bp, Homo sapiens
caaaggccccagcatct

SEQ ID NO: 2641210 - DNA, 13 bp, Homo sapiens
caaaggcccccta

SEQ ID NO: 2641211 - DNA, 23 bp, Homo sapiens
caaaggctgagaacactgtgaaa

SEQ ID NO: 2641212 - DNA, 13 bp, Homo sapiens
caaaggctgggac

SEQ ID NO: 2641213 - DNA, 17 bp, Homo sapiens
caaagggctgaaagcca

SEQ ID NO: 2641214 - DNA, 21 bp, Homo sapiens
caaagggctgaaagccatttg

SEQ ID NO: 2641215 - DNA, 20 bp, Homo sapiens
caaagggtatcaggtgctgc

SEQ ID NO: 2641216 - DNA, 21 bp, Homo sapiens
caaagggtgaagctatttatc

SEQ ID NO: 2641217 - DNA, 13 bp, Homo sapiens
caaaggtggctct

SEQ ID NO: 2641218 - DNA, 19 bp, Homo sapiens
caaaggttttcctcttcta

SEQ ID NO: 2641219 - DNA, 21 bp, Homo sapiens
tactgtaaagaaagagagaaa

SEQ ID NO: 2641220 - DNA, 15 bp, Homo sapiens
tactgtaatttgtga

SEQ ID NO: 2641221 - DNA, 19 bp, Homo sapiens
tactgtcaaaataatttta

SEQ ID NO: 2641222 - DNA, 20 bp, Homo sapiens
tactgtctggttttaacaat

SEQ ID NO: 2641223 - DNA, 22 bp, Homo sapiens
tactgtctggttttaacaattt

SEQ ID NO: 2641224 - DNA, 21 bp, Homo sapiens
tactgtcttcagtaagccgtg

SEQ ID NO: 2641225 - DNA, 16 bp, Homo sapiens
tactgtgctggagcca

SEQ ID NO: 2641226 - DNA, 18 bp, Homo sapiens
tactgtgctggagccact

SEQ ID NO: 2641227 - DNA, 16 bp, Homo sapiens
tactgtggaaaaatat

SEQ ID NO: 2641228 - DNA, 20 bp, Homo sapiens
tactgtggaaaaatatttaa

SEQ ID NO: 2641229 - DNA, 22 bp, Homo sapiens
tactgtggaggaaggattgtaa

SEQ ID NO: 2641230 - DNA, 23 bp, Homo sapiens
tactgtgtacagaattctgctac

SEQ ID NO: 2641231 - DNA, 14 bp, Homo sapiens
tactgtgttcctgg

SEQ ID NO: 2641232 - DNA, 22 bp, Homo sapiens
tactgtgttcctggcaatagtg

SEQ ID NO: 2641233 - DNA, 13 bp, Homo sapiens
tactgtgtttcag

SEQ ID NO: 2641234 - DNA, 16 bp, Homo sapiens
tactgttctgtgtctt

SEQ ID NO: 2641235 - DNA, 13 bp, Homo sapiens
tactgtttctgtc

SEQ ID NO: 2641236 - DNA, 19 bp, Homo sapiens
tacttaaagatttatcaaa

SEQ ID NO: 2641237 - DNA, 14 bp, Homo sapiens
tacttaataaattc

SEQ ID NO: 2641238 - DNA, 18 bp, Homo sapiens
tacttaattcctttctca

SEQ ID NO: 2641239 - DNA, 20 bp, Homo sapiens
tacttatcatccacattgtt

SEQ ID NO: 2641240 - DNA, 17 bp, Homo sapiens
tacttatttttgacagt

SEQ ID NO: 2641241 - DNA, 19 bp, Homo sapiens
tacttatttttgacagtgt

SEQ ID NO: 2641242 - DNA, 12 bp, Homo sapiens
tacttcaaaagt

SEQ ID NO: 2641243 - DNA, 23 bp, Homo sapiens
tacttcaaaagtattttcctgta

SEQ ID NO: 2641244 - DNA, 18 bp, Homo sapiens
tacttcaagttaaagtga

SEQ ID NO: 2641245 - DNA, 21 bp, Homo sapiens
tacttcaagttaaagtgaata

SEQ ID NO: 2641246 - DNA, 16 bp, Homo sapiens
tacttcactttaattc

SEQ ID NO: 2641247 - DNA, 19 bp, Homo sapiens
tacttcactttaattctca

SEQ ID NO: 2641248 - DNA, 16 bp, Homo sapiens
tacttcctcctcccca

SEQ ID NO: 2641249 - DNA, 17 bp, Homo sapiens
tacttcgtcttctaatt

SEQ ID NO: 2641250 - DNA, 13 bp, Homo sapiens
tacttctccaccc

SEQ ID NO: 2641251 - DNA, 16 bp, Homo sapiens
tacttctttgctttgc

SEQ ID NO: 2641252 - DNA, 20 bp, Homo sapiens
tacttgaaatctaggattat

SEQ ID NO: 2641253 - DNA, 12 bp, Homo sapiens
tacttgggaggc

SEQ ID NO: 2641254 - DNA, 15 bp, Homo sapiens
tacttgtcaaagaag

SEQ ID NO: 2641255 - DNA, 16 bp, Homo sapiens
tacttgtcaaagaagg

SEQ ID NO: 2641256 - DNA, 18 bp, Homo sapiens
tacttgtcaaagaaggtt

SEQ ID NO: 2641257 - DNA, 11 bp, Homo sapiens
tacttgtcaat

SEQ ID NO: 2641258 - DNA, 20 bp, Homo sapiens
tacttgtcaatatttaaaca

SEQ ID NO: 2641259 - DNA, 14 bp, Homo sapiens
tacttgtggacaca

SEQ ID NO: 2641260 - DNA, 15 bp, Homo sapiens
tacttgtggacacag

SEQ ID NO: 2641261 - DNA, 21 bp, Homo sapiens
tactttaaaggaaaaaatgtt

SEQ ID NO: 2641262 - DNA, 15 bp, Homo sapiens
tactttaccaccccc

SEQ ID NO: 2641263 - DNA, 20 bp, Homo sapiens
tactttcatcctgactctgc

SEQ ID NO: 2641264 - DNA, 19 bp, Homo sapiens
tactttgaaaccagaaaat

SEQ ID NO: 2641265 - DNA, 14 bp, Homo sapiens
tactttgaagtcat

SEQ ID NO: 2641266 - DNA, 18 bp, Homo sapiens
tactttgaagtcatacca

SEQ ID NO: 2641267 - DNA, 11 bp, Homo sapiens
tactttgtcag

SEQ ID NO: 2641268 - DNA, 20 bp, Homo sapiens
tactttgtcctttttgttat

SEQ ID NO: 2641269 - DNA, 14 bp, Homo sapiens
tactttgtctgaaa

SEQ ID NO: 2641270 - DNA, 15 bp, Homo sapiens
tacttttaaactgtg

SEQ ID NO: 2641271 - DNA, 16 bp, Homo sapiens
tacttttataataaaa

SEQ ID NO: 2641272 - DNA, 22 bp, Homo sapiens
tacttttataataaaaggaaaa

SEQ ID NO: 2641273 - DNA, 20 bp, Homo sapiens
tactttttaaaatcttttct

SEQ ID NO: 2641274 - DNA, 16 bp, Homo sapiens
tactttttcattcttt

SEQ ID NO: 2641275 - DNA, 14 bp, Homo sapiens
tacttttttcttat

SEQ ID NO: 2641276 - DNA, 14 bp, Homo sapiens
tactttttttcaca

SEQ ID NO: 2641277 - DNA, 13 bp, Homo sapiens
tagaaaaagcagt

SEQ ID NO: 2641278 - DNA, 16 bp, Homo sapiens
tagaaaactgaaaatc

SEQ ID NO: 2641279 - DNA, 22 bp, Homo sapiens
tagaaaactgaaaatctaatat

SEQ ID NO: 2641280 - DNA, 22 bp, Homo sapiens
tagaaaatttgttattttgcaa

SEQ ID NO: 2641281 - DNA, 15 bp, Homo sapiens
tagaaacattgaaga

SEQ ID NO: 2641282 - DNA, 21 bp, Homo sapiens
tagaaagaagcccaatattat

SEQ ID NO: 2641283 - DNA, 12 bp, Homo sapiens
tagaaataagtg

SEQ ID NO: 2641284 - DNA, 21 bp, Homo sapiens
tagaaatagctccgtggagca

SEQ ID NO: 2641285 - DNA, 22 bp, Homo sapiens
tagaaatagctccgtggagcag

SEQ ID NO: 2641286 - DNA, 18 bp, Homo sapiens
tagaaatgaccaatatta

SEQ ID NO: 2641287 - DNA, 22 bp, Homo sapiens
tagaaattaccagagttgttct

SEQ ID NO: 2641288 - DNA, 18 bp, Homo sapiens
tagaaattagctgtgtga

SEQ ID NO: 2641289 - DNA, 16 bp, Homo sapiens
tagaacaaaggacaga

SEQ ID NO: 2641290 - DNA, 15 bp, Homo sapiens
tagaacacaggcaaa

SEQ ID NO: 2641291 - DNA, 18 bp, Homo sapiens
tagaacatccctgccagc

SEQ ID NO: 2641292 - DNA, 17 bp, Homo sapiens
tagcctgcctcttctct

SEQ ID NO: 2641293 - DNA, 20 bp, Homo sapiens
tagccttagaagtcacacag

SEQ ID NO: 2641294 - DNA, 15 bp, Homo sapiens
tagccttatcctctg

SEQ ID NO: 2641295 - DNA, 20 bp, Homo sapiens
tagccttatcctctgatctc

SEQ ID NO: 2641296 - DNA, 20 bp, Homo sapiens
tagccttccgtaacccaact

SEQ ID NO: 2641297 - DNA, 22 bp, Homo sapiens
tagccttccgtaacccaactct

SEQ ID NO: 2641298 - DNA, 14 bp, Homo sapiens
tagcgcccagttgg

SEQ ID NO: 2641299 - DNA, 23 bp, Homo sapiens
tagctaacattttaaataaaaga

SEQ ID NO: 2641300 - DNA, 19 bp, Homo sapiens
tagctaagcggaccagcct

SEQ ID NO: 2641301 - DNA, 18 bp, Homo sapiens
tagctatatccatgtact

SEQ ID NO: 2641302 - DNA, 19 bp, Homo sapiens
tagctatatccatgtactg

SEQ ID NO: 2641303 - DNA, 14 bp, Homo sapiens
tagctatcagaaga

SEQ ID NO: 2641304 - DNA, 15 bp, Homo sapiens
tagctatcagaagac

SEQ ID NO: 2641305 - DNA, 21 bp, Homo sapiens
tagctatcagaagaccacaaa

SEQ ID NO: 2641306 - DNA, 13 bp, Homo sapiens
tagctattactgt

SEQ ID NO: 2641307 - DNA, 12 bp, Homo sapiens
tagctcattctc

SEQ ID NO: 2641308 - DNA, 17 bp, Homo sapiens
tagctctgagccagttc

SEQ ID NO: 2641309 - DNA, 21 bp, Homo sapiens
tagctgacccagccccttgag

SEQ ID NO: 2641310 - DNA, 17 bp, Homo sapiens
tagctgagcgtggtggc

SEQ ID NO: 2641311 - DNA, 21 bp, Homo sapiens
tagctgatgaacttattctgt

SEQ ID NO: 2641312 - DNA, 23 bp, Homo sapiens
tagctgatgaacttattctgtag

SEQ ID NO: 2641313 - DNA, 15 bp, Homo sapiens
tagctgggactacag

SEQ ID NO: 2641314 - DNA, 17 bp, Homo sapiens
tagctgggactacaggc

SEQ ID NO: 2641315 - DNA, 17 bp, Homo sapiens
tagctgtaaggcatgaa

SEQ ID NO: 2641316 - DNA, 19 bp, Homo sapiens
tagctgtaaggcatgaagg

SEQ ID NO: 2641317 - DNA, 14 bp, Homo sapiens
tagctgtattgaat

SEQ ID NO: 2641318 - DNA, 17 bp, Homo sapiens
tagctgtctagagtagc

SEQ ID NO: 2641319 - DNA, 21 bp, Homo sapiens
tagctgtctgctcagacagaa

SEQ ID NO: 2641320 - DNA, 14 bp, Homo sapiens
tagctgtgtgaaat

SEQ ID NO: 2641321 - DNA, 17 bp, Homo sapiens
tagctgttgagctgttt

SEQ ID NO: 2641322 - DNA, 17 bp, Homo sapiens
tagcttagacctcagcc

SEQ ID NO: 2641323 - DNA, 19 bp, Homo sapiens
tagcttagacctcagcctg

SEQ ID NO: 2641324 - DNA, 20 bp, Homo sapiens
tagcttagacctcagcctgt

SEQ ID NO: 2641325 - DNA, 19 bp, Homo sapiens
tagcttagagcctccctca

SEQ ID NO: 2641326 - DNA, 21 bp, Homo sapiens
tagcttctaccatgaacagaa

SEQ ID NO: 2641327 - DNA, 17 bp, Homo sapiens
tagcttgcgcattctca

SEQ ID NO: 2641328 - DNA, 19 bp, Homo sapiens
tagcttgggaggcttcccc

SEQ ID NO: 2641329 - DNA, 14 bp, Homo sapiens
tagctttaccctca

SEQ ID NO: 2641330 - DNA, 19 bp, Homo sapiens
tagctttactgtttgttat

SEQ ID NO: 2641331 - DNA, 18 bp, Homo sapiens
tagctttattttttaagt

SEQ ID NO: 2641332 - DNA, 22 bp, Homo sapiens
tagctttattttttaagtattt

SEQ ID NO: 2641333 - DNA, 18 bp, Homo sapiens
tagcttttattgtataaa

SEQ ID NO: 2641334 - DNA, 20 bp, Homo sapiens
taggaaataaaacctttcaa

SEQ ID NO: 2641335 - DNA, 13 bp, Homo sapiens
taggaacactcct

SEQ ID NO: 2641336 - DNA, 20 bp, Homo sapiens
taggaacggtaaatttctgt

SEQ ID NO: 2641337 - DNA, 15 bp, Homo sapiens
taggaactgctgggc

SEQ ID NO: 2641338 - DNA, 21 bp, Homo sapiens
taggaagaattttaaaaatga

SEQ ID NO: 2641339 - DNA, 22 bp, Homo sapiens
taggaagaattttaaaaatgaa

SEQ ID NO: 2641340 - DNA, 17 bp, Homo sapiens
taggaagactttggaaa

SEQ ID NO: 2641341 - DNA, 22 bp, Homo sapiens
taggaagagtagcatttcattc

SEQ ID NO: 2641342 - DNA, 18 bp, Homo sapiens
taggaagggaccaaggca

SEQ ID NO: 2641343 - DNA, 16 bp, Homo sapiens
taggaagtaaattata

SEQ ID NO: 2641344 - DNA, 19 bp, Homo sapiens
taggaagtgtaacagctga

SEQ ID NO: 2641345 - DNA, 21 bp, Homo sapiens
taggaagtgtaacagctgagg

SEQ ID NO: 2641346 - DNA, 22 bp, Homo sapiens
taggaagtgtaacagctgaggt

SEQ ID NO: 2641347 - DNA, 12 bp, Homo sapiens
taggaataaata

SEQ ID NO: 2641348 - DNA, 18 bp, Homo sapiens
taggaattaagttatctt

SEQ ID NO: 2641349 - DNA, 20 bp, Homo sapiens
taggaattgacccacaagaa

SEQ ID NO: 2641350 - DNA, 23 bp, Homo sapiens
taggaattgacccacaagaaatg

SEQ ID NO: 2641351 - DNA, 20 bp, Homo sapiens
taggacataaattagaggtc

SEQ ID NO: 2641352 - DNA, 16 bp, Homo sapiens
taggacgccacccagc

SEQ ID NO: 2641353 - DNA, 22 bp, Homo sapiens
taggagaattgcttgaacctgg

SEQ ID NO: 2641354 - DNA, 21 bp, Homo sapiens
taggagaccaaggcgggagca

SEQ ID NO: 2641355 - DNA, 14 bp, Homo sapiens
taggagagaccgag

SEQ ID NO: 2641356 - DNA, 16 bp, Homo sapiens
taggagataccaggtt

SEQ ID NO: 2641357 - DNA, 22 bp, Homo sapiens
taggagataccaggttgaaaga

SEQ ID NO: 2641358 - DNA, 21 bp, Homo sapiens
taggagttcacttcatcttct

SEQ ID NO: 2641359 - DNA, 17 bp, Homo sapiens
taggagttcgagaccag

SEQ ID NO: 2641360 - DNA, 22 bp, Homo sapiens
taggatatggtgggtggacagg

SEQ ID NO: 2641361 - DNA, 21 bp, Homo sapiens
taggatccagtgatccttaca

SEQ ID NO: 2641362 - DNA, 13 bp, Homo sapiens
taggatgttgaaa

SEQ ID NO: 2641363 - DNA, 22 bp, Homo sapiens
taggatttaacagtcatttaaa

SEQ ID NO: 2641364 - DNA, 13 bp, Homo sapiens
taggcagagcctt

SEQ ID NO: 2641365 - DNA, 16 bp, Homo sapiens
taggcaggacatgctg

SEQ ID NO: 2641366 - DNA, 14 bp, Homo sapiens
taggcatcccaggg

SEQ ID NO: 2641367 - DNA, 19 bp, Homo sapiens
taggcatcccaggggacca

SEQ ID NO: 2641368 - DNA, 14 bp, Homo sapiens
taggcattgtggga

SEQ ID NO: 2641369 - DNA, 20 bp, Homo sapiens
taggccatgaaaaaaatgat

SEQ ID NO: 2641370 - DNA, 13 bp, Homo sapiens
taggcctggccag

SEQ ID NO: 2641371 - DNA, 18 bp, Homo sapiens
taggcctggccagatgca

SEQ ID NO: 2641372 - DNA, 13 bp, Homo sapiens
taggcctgggtgc

SEQ ID NO: 2641373 - DNA, 21 bp, Homo sapiens
taggcgggcggtcaggggttc

SEQ ID NO: 2641374 - DNA, 15 bp, Homo sapiens
taggctacaattttc

SEQ ID NO: 2641375 - DNA, 14 bp, Homo sapiens
taggctattcacaa

SEQ ID NO: 2641376 - DNA, 22 bp, Homo sapiens
taggctcctgccagtgtggaac

SEQ ID NO: 2641377 - DNA, 15 bp, Homo sapiens
taggctggagaagct

SEQ ID NO: 2641378 - DNA, 21 bp, Homo sapiens
caaatgctgacccatgcaata

SEQ ID NO: 2641379 - DNA, 15 bp, Homo sapiens
caaatgctgtattct

SEQ ID NO: 2641380 - DNA, 21 bp, Homo sapiens
caaatggaaatgggcagagca

SEQ ID NO: 2641381 - DNA, 19 bp, Homo sapiens
caaatggaagacacattga

SEQ ID NO: 2641382 - DNA, 17 bp, Homo sapiens
caaatgtcatcagaact

SEQ ID NO: 2641383 - DNA, 14 bp, Homo sapiens
caaatgtggctcct

SEQ ID NO: 2641384 - DNA, 21 bp, Homo sapiens
caaatgttatgcataaagtca

SEQ ID NO: 2641385 - DNA, 11 bp, Homo sapiens
caaatgtttct

SEQ ID NO: 2641386 - DNA, 14 bp, Homo sapiens
caaatgtttctgca

SEQ ID NO: 2641387 - DNA, 13 bp, Homo sapiens
caaattaacttga

SEQ ID NO: 2641388 - DNA, 15 bp, Homo sapiens
caaattaatctttct

SEQ ID NO: 2641389 - DNA, 14 bp, Homo sapiens
caaattatttgtgt

SEQ ID NO: 2641390 - DNA, 15 bp, Homo sapiens
caaattatttgtgta

SEQ ID NO: 2641391 - DNA, 16 bp, Homo sapiens
caaattcatattctgt

SEQ ID NO: 2641392 - DNA, 15 bp, Homo sapiens
caaattctcaccaaa

SEQ ID NO: 2641393 - DNA, 15 bp, Homo sapiens
caaattctgtttctt

SEQ ID NO: 2641394 - DNA, 19 bp, Homo sapiens
caaattgagagaatggaaa

SEQ ID NO: 2641395 - DNA, 18 bp, Homo sapiens
caaattgtatctagtgca

SEQ ID NO: 2641396 - DNA, 23 bp, Homo sapiens
caaatttacagagacagaaagca

SEQ ID NO: 2641397 - DNA, 12 bp, Homo sapiens
caaatttctaaa

SEQ ID NO: 2641398 - DNA, 14 bp, Homo sapiens
caaatttctaaatc

SEQ ID NO: 2641399 - DNA, 22 bp, Homo sapiens
caaatttctaaatctccaaaat

SEQ ID NO: 2641400 - DNA, 19 bp, Homo sapiens
caaatttgaaaataattgt

SEQ ID NO: 2641401 - DNA, 21 bp, Homo sapiens
caaattttgatgccaagaaag

SEQ ID NO: 2641402 - DNA, 20 bp, Homo sapiens
caacaaagggttttaatgta

SEQ ID NO: 2641403 - DNA, 19 bp, Homo sapiens
caacaaattaggttttgta

SEQ ID NO: 2641404 - DNA, 22 bp, Homo sapiens
caacaacatgtataatattttt

SEQ ID NO: 2641405 - DNA, 14 bp, Homo sapiens
caacaagagtttat

SEQ ID NO: 2641406 - DNA, 14 bp, Homo sapiens
caacaagggagaga

SEQ ID NO: 2641407 - DNA, 21 bp, Homo sapiens
caacaagggagagacctcatc

SEQ ID NO: 2641408 - DNA, 16 bp, Homo sapiens
caacaataaaatagca

SEQ ID NO: 2641409 - DNA, 13 bp, Homo sapiens
caacaataacact

SEQ ID NO: 2641410 - DNA, 18 bp, Homo sapiens
caacaatttctactttga

SEQ ID NO: 2641411 - DNA, 19 bp, Homo sapiens
caacaatttctactttgaa

SEQ ID NO: 2641412 - DNA, 20 bp, Homo sapiens
caacacaagctggaagcaca

SEQ ID NO: 2641413 - DNA, 19 bp, Homo sapiens
caacaccacagacacacac

SEQ ID NO: 2641414 - DNA, 22 bp, Homo sapiens
caacacctctgcacaagctgca

SEQ ID NO: 2641415 - DNA, 15 bp, Homo sapiens
caacacgagcaggct

SEQ ID NO: 2641416 - DNA, 20 bp, Homo sapiens
caacactcattgacctgagg

SEQ ID NO: 2641417 - DNA, 13 bp, Homo sapiens
caacactggtgtg

SEQ ID NO: 2641418 - DNA, 22 bp, Homo sapiens
caacactggtgtgacctgaggg

SEQ ID NO: 2641419 - DNA, 13 bp, Homo sapiens
caacactgtgccc

SEQ ID NO: 2641420 - DNA, 14 bp, Homo sapiens
caacactgtgccct

SEQ ID NO: 2641421 - DNA, 15 bp, Homo sapiens
caacactgtgccctg

SEQ ID NO: 2641422 - DNA, 17 bp, Homo sapiens
caacactgtgccctggt

SEQ ID NO: 2641423 - DNA, 23 bp, Homo sapiens
caacactgtgccctggtggagaa

SEQ ID NO: 2641424 - DNA, 16 bp, Homo sapiens
caacagaagcttcaga

SEQ ID NO: 2641425 - DNA, 12 bp, Homo sapiens
caacagaagtgg

SEQ ID NO: 2641426 - DNA, 23 bp, Homo sapiens
caacagagtgagaccctgtctct

SEQ ID NO: 2641427 - DNA, 21 bp, Homo sapiens
caacagatgcttttctgtctc

SEQ ID NO: 2641428 - DNA, 17 bp, Homo sapiens
caacagatttgtgaact

SEQ ID NO: 2641429 - DNA, 20 bp, Homo sapiens
caacagatttgtgaactcag

SEQ ID NO: 2641430 - DNA, 23 bp, Homo sapiens
caacagatttgtgaactcagcca

SEQ ID NO: 2641431 - DNA, 22 bp, Homo sapiens
caacagcactggctctctccag

SEQ ID NO: 2641432 - DNA, 15 bp, Homo sapiens
caacaggagaatttt

SEQ ID NO: 2641433 - DNA, 14 bp, Homo sapiens
caacaggagctggg

SEQ ID NO: 2641434 - DNA, 21 bp, Homo sapiens
caacaggagctgggatcctaa

SEQ ID NO: 2641435 - DNA, 17 bp, Homo sapiens
caacaggaggacaattc

SEQ ID NO: 2641436 - DNA, 19 bp, Homo sapiens
caacaggaggacaattcat

SEQ ID NO: 2641437 - DNA, 23 bp, Homo sapiens
caacaggaggacaattcatgaac

SEQ ID NO: 2641438 - DNA, 24 bp, Homo sapiens
caacaggctgggcttcagtggcag

SEQ ID NO: 2641439 - DNA, 18 bp, Homo sapiens
caacaggtggcaggacca

SEQ ID NO: 2641440 - DNA, 22 bp, Homo sapiens
caacaggtggcaggaccaggac

SEQ ID NO: 2641441 - DNA, 20 bp, Homo sapiens
caacagtagcataggaccct

SEQ ID NO: 2641442 - DNA, 16 bp, Homo sapiens
caacagtgctaaaaat

SEQ ID NO: 2641443 - DNA, 18 bp, Homo sapiens
caacagtgctaaaaatgg

SEQ ID NO: 2641444 - DNA, 13 bp, Homo sapiens
caacagtgtgaag

SEQ ID NO: 2641445 - DNA, 16 bp, Homo sapiens
caacagtgtgaagtta

SEQ ID NO: 2641446 - DNA, 17 bp, Homo sapiens
caacagtgtgaagttag

SEQ ID NO: 2641447 - DNA, 22 bp, Homo sapiens
caacagttttttatgctaatca

SEQ ID NO: 2641448 - DNA, 14 bp, Homo sapiens
caacatactcccat

SEQ ID NO: 2641449 - DNA, 18 bp, Homo sapiens
caacatcaatgttcattg

SEQ ID NO: 2641450 - DNA, 22 bp, Homo sapiens
caacatcaatgttcattgtaat

SEQ ID NO: 2641451 - DNA, 15 bp, Homo sapiens
caacatgagtcaaga

SEQ ID NO: 2641452 - DNA, 17 bp, Homo sapiens
caacatgtataatattt

SEQ ID NO: 2641453 - DNA, 21 bp, Homo sapiens
caacatgtgtacttaatttct

SEQ ID NO: 2641454 - DNA, 21 bp, Homo sapiens
caacattacagggaatgcctg

SEQ ID NO: 2641455 - DNA, 14 bp, Homo sapiens
caacatttctcaat

SEQ ID NO: 2641456 - DNA, 17 bp, Homo sapiens
caaccaccgctccccag

SEQ ID NO: 2641457 - DNA, 13 bp, Homo sapiens
caaccatcgcttt

SEQ ID NO: 2641458 - DNA, 16 bp, Homo sapiens
caaccattccagactg

SEQ ID NO: 2641459 - DNA, 22 bp, Homo sapiens
caacccatgatgagctcctctt

SEQ ID NO: 2641460 - DNA, 14 bp, Homo sapiens
caaccccagttctg

SEQ ID NO: 2641461 - DNA, 18 bp, Homo sapiens
caacccccaccccacact

SEQ ID NO: 2641462 - DNA, 16 bp, Homo sapiens
caacccctgtggagcc

SEQ ID NO: 2641463 - DNA, 19 bp, Homo sapiens
caaccccttcgctcctgtg

SEQ ID NO: 2641464 - DNA, 22 bp, Homo sapiens
caaccccttcgctcctgtgtct

SEQ ID NO: 2641465 - DNA, 12 bp, Homo sapiens
caaccctcatca

SEQ ID NO: 2641466 - DNA, 18 bp, Homo sapiens
caaccctccctcagcccc

SEQ ID NO: 2641467 - DNA, 20 bp, Homo sapiens
caaccctccctcagcccctc

SEQ ID NO: 2641468 - DNA, 22 bp, Homo sapiens
caaccctgcaaaggactgtttt

SEQ ID NO: 2641469 - DNA, 23 bp, Homo sapiens
caaccctgcccctgccccgtcac

SEQ ID NO: 2641470 - DNA, 13 bp, Homo sapiens
caaccctgtttcc

SEQ ID NO: 2641471 - DNA, 15 bp, Homo sapiens
caaccctgtttcctg

SEQ ID NO: 2641472 - DNA, 17 bp, Homo sapiens
caaccctgttttatact

SEQ ID NO: 2641473 - DNA, 19 bp, Homo sapiens
caaccctgttttatactgt

SEQ ID NO: 2641474 - DNA, 19 bp, Homo sapiens
caacccttaccccttagcc

SEQ ID NO: 2641475 - DNA, 21 bp, Homo sapiens
caacctaccaccccttcctgt

SEQ ID NO: 2641476 - DNA, 18 bp, Homo sapiens
caacctcaactgcctact

SEQ ID NO: 2641477 - DNA, 19 bp, Homo sapiens
caacctccgcctcccgggt

SEQ ID NO: 2641478 - DNA, 18 bp, Homo sapiens
caacctgctctcctcttg

SEQ ID NO: 2641479 - DNA, 21 bp, Homo sapiens
caacctgctctcctcttgcca

SEQ ID NO: 2641480 - DNA, 23 bp, Homo sapiens
caacctgctctcctcttgccact

SEQ ID NO: 2641481 - DNA, 14 bp, Homo sapiens
caacctgggtccaa

SEQ ID NO: 2641482 - DNA, 17 bp, Homo sapiens
caacctgggtccaaata

SEQ ID NO: 2641483 - DNA, 16 bp, Homo sapiens
caacctggtcacagga

SEQ ID NO: 2641484 - DNA, 10 bp, Homo sapiens
aaaaaaaaga

SEQ ID NO: 2641485 - DNA, 11 bp, Homo sapiens
aaaaaaaagaa

SEQ ID NO: 2641486 - DNA, 11 bp, Homo sapiens
aaaaaaagtta

SEQ ID NO: 2641487 - DNA, 13 bp, Homo sapiens
aaactcaaaatat

SEQ ID NO: 2641488 - DNA, 16 bp, Homo sapiens
aaactcactgctcaag

SEQ ID NO: 2641489 - DNA, 23 bp, Homo sapiens
aaactcagcctcaataagccttg

SEQ ID NO: 2641490 - DNA, 17 bp, Homo sapiens
aaactcagggacagagc

SEQ ID NO: 2641491 - DNA, 18 bp, Homo sapiens
aaactcagggacagagcc

SEQ ID NO: 2641492 - DNA, 19 bp, Homo sapiens
aaactcagggacagagcca

SEQ ID NO: 2641493 - DNA, 22 bp, Homo sapiens
aaactcatttcctatgtaactg

SEQ ID NO: 2641494 - DNA, 17 bp, Homo sapiens
aaactcgaggactgtat

SEQ ID NO: 2641495 - DNA, 19 bp, Homo sapiens
aaactcgaggactgtattt

SEQ ID NO: 2641496 - DNA, 13 bp, Homo sapiens
aaactctcctctg

SEQ ID NO: 2641497 - DNA, 14 bp, Homo sapiens
aaactctgggaaat

SEQ ID NO: 2641498 - DNA, 16 bp, Homo sapiens
aaactcttatctcagt

SEQ ID NO: 2641499 - DNA, 14 bp, Homo sapiens
aaactctttaactt

SEQ ID NO: 2641500 - DNA, 13 bp, Homo sapiens
aaactgaaaatct

SEQ ID NO: 2641501 - DNA, 17 bp, Homo sapiens
aaactgaaaatctaata

SEQ ID NO: 2641502 - DNA, 15 bp, Homo sapiens
aaactgaagtctgaa

SEQ ID NO: 2641503 - DNA, 17 bp, Homo sapiens
aaactgaagtctgaaat

SEQ ID NO: 2641504 - DNA, 14 bp, Homo sapiens
aaactgaatggaag

SEQ ID NO: 2641505 - DNA, 22 bp, Homo sapiens
aaactgagatccttccttttga

SEQ ID NO: 2641506 - DNA, 21 bp, Homo sapiens
aaactgagatgtgaacacatc

SEQ ID NO: 2641507 - DNA, 14 bp, Homo sapiens
aaactgcattagaa

SEQ ID NO: 2641508 - DNA, 19 bp, Homo sapiens
aaactgccagcaacgcagg

SEQ ID NO: 2641509 - DNA, 13 bp, Homo sapiens
aaactgcttgttt

SEQ ID NO: 2641510 - DNA, 16 bp, Homo sapiens
aaactgggttcctgca

SEQ ID NO: 2641511 - DNA, 15 bp, Homo sapiens
aaactgtagaaatga

SEQ ID NO: 2641512 - DNA, 16 bp, Homo sapiens
aaactgtagaaatgat

SEQ ID NO: 2641513 - DNA, 20 bp, Homo sapiens
aaactgtgtacataactgaa

SEQ ID NO: 2641514 - DNA, 16 bp, Homo sapiens
aaactgtgtattccaa

SEQ ID NO: 2641515 - DNA, 20 bp, Homo sapiens
aaactgtgtggactgtgatg

SEQ ID NO: 2641516 - DNA, 17 bp, Homo sapiens
aaacttaacatatttac

SEQ ID NO: 2641517 - DNA, 17 bp, Homo sapiens
aaacttaatctaaatgg

SEQ ID NO: 2641518 - DNA, 21 bp, Homo sapiens
aaacttagtgcggacaagttt

SEQ ID NO: 2641519 - DNA, 19 bp, Homo sapiens
aaacttccagtgcaacact

SEQ ID NO: 2641520 - DNA, 22 bp, Homo sapiens
aaacttccagtgcaacactgaa

SEQ ID NO: 2641521 - DNA, 18 bp, Homo sapiens
aaacttctctgaagggag

SEQ ID NO: 2641522 - DNA, 19 bp, Homo sapiens
aaacttctctgaagggagg

SEQ ID NO: 2641523 - DNA, 11 bp, Homo sapiens
aaacttgtaaa

SEQ ID NO: 2641524 - DNA, 22 bp, Homo sapiens
aaactttaccttttttatacat

SEQ ID NO: 2641525 - DNA, 18 bp, Homo sapiens
aaactttactaagatgac

SEQ ID NO: 2641526 - DNA, 19 bp, Homo sapiens
aaactttactaagatgaca

SEQ ID NO: 2641527 - DNA, 12 bp, Homo sapiens
aaactttactat

SEQ ID NO: 2641528 - DNA, 18 bp, Homo sapiens
aaactttactatggccct

SEQ ID NO: 2641529 - DNA, 21 bp, Homo sapiens
aaactttagagtagcatgaga

SEQ ID NO: 2641530 - DNA, 17 bp, Homo sapiens
aaacttttttttgagaa

SEQ ID NO: 2641531 - DNA, 10 bp, Homo sapiens
aaagaaaaaa

SEQ ID NO: 2641532 - DNA, 16 bp, Homo sapiens
aaagaaaaaaaaagaa

SEQ ID NO: 2641533 - DNA, 18 bp, Homo sapiens
aaagaaaaaagagaaaag

SEQ ID NO: 2641534 - DNA, 23 bp, Homo sapiens
aaagaaaagataaagatgatcta

SEQ ID NO: 2641535 - DNA, 18 bp, Homo sapiens
aaagaaaattcttggaat

SEQ ID NO: 2641536 - DNA, 14 bp, Homo sapiens
aaagaaagaaggaa

SEQ ID NO: 2641537 - DNA, 16 bp, Homo sapiens
aaagaaagagagaaaa

SEQ ID NO: 2641538 - DNA, 18 bp, Homo sapiens
aaagaaagcctcagagaa

SEQ ID NO: 2641539 - DNA, 23 bp, Homo sapiens
aaagaaagttgcacggctgctga

SEQ ID NO: 2641540 - DNA, 15 bp, Homo sapiens
aaagaacagtaaaca

SEQ ID NO: 2641541 - DNA, 15 bp, Homo sapiens
aaagaagacatgttt

SEQ ID NO: 2641542 - DNA, 20 bp, Homo sapiens
aaagaagcccaatattataa

SEQ ID NO: 2641543 - DNA, 20 bp, Homo sapiens
aaagaaggtttcagaaagaa

SEQ ID NO: 2641544 - DNA, 12 bp, Homo sapiens
aaagaatgggca

SEQ ID NO: 2641545 - DNA, 23 bp, Homo sapiens
aaagaatgggcagttacatgcat

SEQ ID NO: 2641546 - DNA, 19 bp, Homo sapiens
aaagacaaatcaaagcaga

SEQ ID NO: 2641547 - DNA, 16 bp, Homo sapiens
aaagacaaattctgtt

SEQ ID NO: 2641548 - DNA, 19 bp, Homo sapiens
aaagacaaattctgtttct

SEQ ID NO: 2641549 - DNA, 17 bp, Homo sapiens
aaagacaattctttata

SEQ ID NO: 2641550 - DNA, 14 bp, Homo sapiens
aaagacatcaagca

SEQ ID NO: 2641551 - DNA, 19 bp, Homo sapiens
aaagacatccataaagaag

SEQ ID NO: 2641552 - DNA, 20 bp, Homo sapiens
aaagactaatttaaaaaata

SEQ ID NO: 2641553 - DNA, 17 bp, Homo sapiens
aaagactatctaaatgt

SEQ ID NO: 2641554 - DNA, 14 bp, Homo sapiens
aaagactattcaaa

SEQ ID NO: 2641555 - DNA, 17 bp, Homo sapiens
aaagactattcaaacag

SEQ ID NO: 2641556 - DNA, 13 bp, Homo sapiens
aaagactccaaag

SEQ ID NO: 2641557 - DNA, 15 bp, Homo sapiens
aaagactgtacaaag

SEQ ID NO: 2641558 - DNA, 14 bp, Homo sapiens
aaagagaaggagcc

SEQ ID NO: 2641559 - DNA, 21 bp, Homo sapiens
aaagagacctacctcaggttg

SEQ ID NO: 2641560 - DNA, 18 bp, Homo sapiens
aaagagagaaaaacaaat

SEQ ID NO: 2641561 - DNA, 13 bp, Homo sapiens
aaagagagaaaat

SEQ ID NO: 2641562 - DNA, 17 bp, Homo sapiens
aaagagagaaaataaaa

SEQ ID NO: 2641563 - DNA, 19 bp, Homo sapiens
aaagagagaaaataaaaag

SEQ ID NO: 2641564 - DNA, 18 bp, Homo sapiens
aaagagagaatgtagata

SEQ ID NO: 2641565 - DNA, 12 bp, Homo sapiens
aaagagaggtta

SEQ ID NO: 2641566 - DNA, 20 bp, Homo sapiens
aaagagatattttaaaatga

SEQ ID NO: 2641567 - DNA, 22 bp, Homo sapiens
aaagagctttcttcccgaaccc

SEQ ID NO: 2641568 - DNA, 14 bp, Homo sapiens
aaagaggaaagaat

SEQ ID NO: 2641569 - DNA, 15 bp, Homo sapiens
aaagaggaatgaagt

SEQ ID NO: 2641570 - DNA, 15 bp, Homo sapiens
aaagaggcagcttga

SEQ ID NO: 2641571 - DNA, 18 bp, Homo sapiens
aaagaggcgtctgtatat

SEQ ID NO: 2641572 - DNA, 20 bp, Homo sapiens
aaagaggctgaaagaggcca

SEQ ID NO: 2641573 - DNA, 11 bp, Homo sapiens
aaagaggtttt

SEQ ID NO: 2641574 - DNA, 16 bp, Homo sapiens
aaagaggtttttctta

SEQ ID NO: 2641575 - DNA, 22 bp, Homo sapiens
aaagagtgggctgcatctggga

SEQ ID NO: 2641576 - DNA, 20 bp, Homo sapiens
aaagataacaagatctttca

SEQ ID NO: 2641577 - DNA, 22 bp, Homo sapiens
aaagataacaagatctttcagg

SEQ ID NO: 2641578 - DNA, 19 bp, Homo sapiens
aaagataatctctcagctt

SEQ ID NO: 2641579 - DNA, 17 bp, Homo sapiens
aaagatatatacacagg

SEQ ID NO: 2641580 - DNA, 22 bp, Homo sapiens
aaagatgcatctaccgctcttg

SEQ ID NO: 2641581 - DNA, 22 bp, Homo sapiens
aaagatgccgggttttatattt

SEQ ID NO: 2641582 - DNA, 14 bp, Homo sapiens
aaagatgcttctca

SEQ ID NO: 2641583 - DNA, 21 bp, Homo sapiens
aaagatggctgtgcctctgcc

SEQ ID NO: 2641584 - DNA, 23 bp, Homo sapiens
aaagatggctgtgcctctgcctg

SEQ ID NO: 2641585 - DNA, 21 bp, Homo sapiens
aaagatgtttgtcagatatga

SEQ ID NO: 2641586 - DNA, 19 bp, Homo sapiens
aaagattcatttttaatca

SEQ ID NO: 2641587 - DNA, 20 bp, Homo sapiens
aaagattcatttttaatcat

SEQ ID NO: 2641588 - DNA, 16 bp, Homo sapiens
aaagcaaatgtgacct

SEQ ID NO: 2641589 - DNA, 14 bp, Homo sapiens
aaagcaagactgtt

SEQ ID NO: 2641590 - DNA, 22 bp, Homo sapiens
aaagcaagtgattgggacagag

SEQ ID NO: 2641591 - DNA, 14 bp, Homo sapiens
aaagcaataatggt

SEQ ID NO: 2641592 - DNA, 23 bp, Homo sapiens
aaagcaataatggtcccatccag

SEQ ID NO: 2641593 - DNA, 22 bp, Homo sapiens
aaagcacaggtgggcttcccag

SEQ ID NO: 2641594 - DNA, 22 bp, Homo sapiens
aaagcaccaaaataagaaaaga

SEQ ID NO: 2641595 - DNA, 19 bp, Homo sapiens
aaagcacgaaatgttattt

SEQ ID NO: 2641596 - DNA, 14 bp, Homo sapiens
aaagcacggactct

SEQ ID NO: 2641597 - DNA, 14 bp, Homo sapiens
aaagcactgacctg

SEQ ID NO: 2641598 - DNA, 22 bp, Homo sapiens
aaagcactgacctgtcatgccc

SEQ ID NO: 2641599 - DNA, 21 bp, Homo sapiens
aaagcactgacttctaagtaa

SEQ ID NO: 2641600 - DNA, 16 bp, Homo sapiens
aaagcacttggactct

SEQ ID NO: 2641601 - DNA, 21 bp, Homo sapiens
aaagcacttggactcttgctc

SEQ ID NO: 2641602 - DNA, 22 bp, Homo sapiens
aaagcacttggactcttgctct

SEQ ID NO: 2641603 - DNA, 16 bp, Homo sapiens
aaagcagcgtttctat

SEQ ID NO: 2641604 - DNA, 18 bp, Homo sapiens
aaagcagctcaaaggcac

SEQ ID NO: 2641605 - DNA, 15 bp, Homo sapiens
aaagcagctctcccc

SEQ ID NO: 2641606 - DNA, 18 bp, Homo sapiens
aaagcagctctcccctca

SEQ ID NO: 2641607 - DNA, 22 bp, Homo sapiens
aaagcagtagaaataatatgca

SEQ ID NO: 2641608 - DNA, 23 bp, Homo sapiens
aaagcagttaactttaagactga

SEQ ID NO: 2641609 - DNA, 15 bp, Homo sapiens
aaagcataaatgcaa

SEQ ID NO: 2641610 - DNA, 17 bp, Homo sapiens
aaagcatcacctcaggc

SEQ ID NO: 2641611 - DNA, 13 bp, Homo sapiens
aaagcatgaatgg

SEQ ID NO: 2641612 - DNA, 18 bp, Homo sapiens
aaagcattccaacaaagg

SEQ ID NO: 2641613 - DNA, 17 bp, Homo sapiens
aaagcattgtaaatgtg

SEQ ID NO: 2641614 - DNA, 17 bp, Homo sapiens
aaagcatttactttgaa

SEQ ID NO: 2641615 - DNA, 15 bp, Homo sapiens
aaagccaaagctagg

SEQ ID NO: 2641616 - DNA, 17 bp, Homo sapiens
aaagccacctctccctc

SEQ ID NO: 2641617 - DNA, 14 bp, Homo sapiens
aaagccagaagctg

SEQ ID NO: 2641618 - DNA, 21 bp, Homo sapiens
aaagccagcgtcctcctctgt

SEQ ID NO: 2641619 - DNA, 19 bp, Homo sapiens
aaagccagctgccgaccag

SEQ ID NO: 2641620 - DNA, 15 bp, Homo sapiens
aaagcccaaagtggt

SEQ ID NO: 2641621 - DNA, 22 bp, Homo sapiens
aaagcccttccatgtcgcctct

SEQ ID NO: 2641622 - DNA, 16 bp, Homo sapiens
aaagcctcctccagcc

SEQ ID NO: 2641623 - DNA, 17 bp, Homo sapiens
aaagccttatcaagtgt

SEQ ID NO: 2641624 - DNA, 23 bp, Homo sapiens
aaagctaaaatgattttatctgt

SEQ ID NO: 2641625 - DNA, 14 bp, Homo sapiens
aaagctagaaatga

SEQ ID NO: 2641626 - DNA, 17 bp, Homo sapiens
aaagctaggcctggcca

SEQ ID NO: 2641627 - DNA, 15 bp, Homo sapiens
aaagctatggtgaga

SEQ ID NO: 2641628 - DNA, 22 bp, Homo sapiens
aaagctatggtgagatgcagct

SEQ ID NO: 2641629 - DNA, 17 bp, Homo sapiens
aaagctattagccagga

SEQ ID NO: 2641630 - DNA, 19 bp, Homo sapiens
aaagctattagccaggatc

SEQ ID NO: 2641631 - DNA, 15 bp, Homo sapiens
aacagtgtgaagtta

SEQ ID NO: 2641632 - DNA, 16 bp, Homo sapiens
aacagtgtgaagttag

SEQ ID NO: 2641633 - DNA, 18 bp, Homo sapiens
aacagtgtgaagttagaa

SEQ ID NO: 2641634 - DNA, 13 bp, Homo sapiens
aacagtgtttccc

SEQ ID NO: 2641635 - DNA, 15 bp, Homo sapiens
aacagtgtttcccat

SEQ ID NO: 2641636 - DNA, 14 bp, Homo sapiens
aacagtttgtacag

SEQ ID NO: 2641637 - DNA, 13 bp, Homo sapiens
aacagttttccat

SEQ ID NO: 2641638 - DNA, 19 bp, Homo sapiens
aacagttttccatgaaaac

SEQ ID NO: 2641639 - DNA, 21 bp, Homo sapiens
aacataaccattacagggagc

SEQ ID NO: 2641640 - DNA, 22 bp, Homo sapiens
aacataatcttctgccttctca

SEQ ID NO: 2641641 - DNA, 20 bp, Homo sapiens
aacatactcccatctgtgaa

SEQ ID NO: 2641642 - DNA, 13 bp, Homo sapiens
aacatatttgtta

SEQ ID NO: 2641643 - DNA, 14 bp, Homo sapiens
aacatcaatgttca

SEQ ID NO: 2641644 - DNA, 16 bp, Homo sapiens
aacatcatcaaggcac

SEQ ID NO: 2641645 - DNA, 22 bp, Homo sapiens
aacatcatcaaggcactgcctg

SEQ ID NO: 2641646 - DNA, 14 bp, Homo sapiens
aacatcattagaac

SEQ ID NO: 2641647 - DNA, 15 bp, Homo sapiens
aacatcattagaaca

SEQ ID NO: 2641648 - DNA, 19 bp, Homo sapiens
aacatccttcaagaactct

SEQ ID NO: 2641649 - DNA, 22 bp, Homo sapiens
aacatcctttctattgaaaaat

SEQ ID NO: 2641650 - DNA, 17 bp, Homo sapiens
aacatgagtcaagagca

SEQ ID NO: 2641651 - DNA, 19 bp, Homo sapiens
aacatgcaattttgcattt

SEQ ID NO: 2641652 - DNA, 22 bp, Homo sapiens
aacatgcaattttgcatttgaa

SEQ ID NO: 2641653 - DNA, 21 bp, Homo sapiens
aacatgcctgccccaaacaaa

SEQ ID NO: 2641654 - DNA, 22 bp, Homo sapiens
aacatgctacacactgcatgtt

SEQ ID NO: 2641655 - DNA, 15 bp, Homo sapiens
aacatggacttgtat

SEQ ID NO: 2641656 - DNA, 23 bp, Homo sapiens
aacatggcctttgcttgaaagaa

SEQ ID NO: 2641657 - DNA, 20 bp, Homo sapiens
aacatggttttgaaatgctt

SEQ ID NO: 2641658 - DNA, 19 bp, Homo sapiens
aacatgtaatataaagatg

SEQ ID NO: 2641659 - DNA, 21 bp, Homo sapiens
aacatgtaattaagtactatg

SEQ ID NO: 2641660 - DNA, 20 bp, Homo sapiens
aacatgtttacttttcaggg

SEQ ID NO: 2641661 - DNA, 17 bp, Homo sapiens
aacattaccttactgtg

SEQ ID NO: 2641662 - DNA, 16 bp, Homo sapiens
aacattgaagtaatga

SEQ ID NO: 2641663 - DNA, 22 bp, Homo sapiens
aacattgcatataacttatatt

SEQ ID NO: 2641664 - DNA, 16 bp, Homo sapiens
aacattggttcttgta

SEQ ID NO: 2641665 - DNA, 13 bp, Homo sapiens
aacattgtgttcc

SEQ ID NO: 2641666 - DNA, 14 bp, Homo sapiens
aacatttacatgta

SEQ ID NO: 2641667 - DNA, 22 bp, Homo sapiens
aacatttcaagggcaataccgt

SEQ ID NO: 2641668 - DNA, 22 bp, Homo sapiens
aaccaaatcactgaactttgct

SEQ ID NO: 2641669 - DNA, 16 bp, Homo sapiens
aaccaagtcatgtgca

SEQ ID NO: 2641670 - DNA, 12 bp, Homo sapiens
aaccacagcagt

SEQ ID NO: 2641671 - DNA, 18 bp, Homo sapiens
aaccacatcttgctctgc

SEQ ID NO: 2641672 - DNA, 21 bp, Homo sapiens
aaccaccacacccagcccact

SEQ ID NO: 2641673 - DNA, 20 bp, Homo sapiens
aaccaccgctccccagccca

SEQ ID NO: 2641674 - DNA, 19 bp, Homo sapiens
aaccacctaatcaggctga

SEQ ID NO: 2641675 - DNA, 14 bp, Homo sapiens
aaccacggaaaaga

SEQ ID NO: 2641676 - DNA, 16 bp, Homo sapiens
aaccactgtaaaatga

SEQ ID NO: 2641677 - DNA, 12 bp, Homo sapiens
aaccacttccct

SEQ ID NO: 2641678 - DNA, 18 bp, Homo sapiens
aaccagggaagctgtccc

SEQ ID NO: 2641679 - DNA, 19 bp, Homo sapiens
aaccagggaagctgtccct

SEQ ID NO: 2641680 - DNA, 16 bp, Homo sapiens
aaccagggagactgca

SEQ ID NO: 2641681 - DNA, 14 bp, Homo sapiens
aaccagtgtagcct

SEQ ID NO: 2641682 - DNA, 18 bp, Homo sapiens
aaccataaacttcatggt

SEQ ID NO: 2641683 - DNA, 18 bp, Homo sapiens
aaccataacaacttcata

SEQ ID NO: 2641684 - DNA, 22 bp, Homo sapiens
aaccatccctgatgtctgtctg

SEQ ID NO: 2641685 - DNA, 17 bp, Homo sapiens
aaccatgtagaaaattt

SEQ ID NO: 2641686 - DNA, 13 bp, Homo sapiens
aaccatgttttgg

SEQ ID NO: 2641687 - DNA, 18 bp, Homo sapiens
aacccaagtccaagcata

SEQ ID NO: 2641688 - DNA, 13 bp, Homo sapiens
aacccaatagttg

SEQ ID NO: 2641689 - DNA, 16 bp, Homo sapiens
aacccaggacgcttct

SEQ ID NO: 2641690 - DNA, 17 bp, Homo sapiens
aacccaggacgcttctg

SEQ ID NO: 2641691 - DNA, 19 bp, Homo sapiens
aacccaggacgcttctgaa

SEQ ID NO: 2641692 - DNA, 13 bp, Homo sapiens
aacccaggagcat

SEQ ID NO: 2641693 - DNA, 15 bp, Homo sapiens
aacccagttgccatc

SEQ ID NO: 2641694 - DNA, 20 bp, Homo sapiens
aacccatcaacaaaaattgt

SEQ ID NO: 2641695 - DNA, 13 bp, Homo sapiens
aacccattttagt

SEQ ID NO: 2641696 - DNA, 16 bp, Homo sapiens
aaccccagttctgctc

SEQ ID NO: 2641697 - DNA, 18 bp, Homo sapiens
aacccccaccccacactt

SEQ ID NO: 2641698 - DNA, 19 bp, Homo sapiens
aacccccaccccacacttg

SEQ ID NO: 2641699 - DNA, 13 bp, Homo sapiens
aacccctgtggag

SEQ ID NO: 2641700 - DNA, 16 bp, Homo sapiens
aacccgaggcccgcat

SEQ ID NO: 2641701 - DNA, 16 bp, Homo sapiens
aacccgggaggcagag

SEQ ID NO: 2641702 - DNA, 21 bp, Homo sapiens
aaccctaaaaagcagagcttt

SEQ ID NO: 2641703 - DNA, 14 bp, Homo sapiens
aaccctccctcagc

SEQ ID NO: 2641704 - DNA, 19 bp, Homo sapiens
aaccctccctcagcccctc

SEQ ID NO: 2641705 - DNA, 19 bp, Homo sapiens
aaccctcctatcacctccc

SEQ ID NO: 2641706 - DNA, 11 bp, Homo sapiens
aaccctgcccc

SEQ ID NO: 2641707 - DNA, 14 bp, Homo sapiens
aaccctgcccctgc

SEQ ID NO: 2641708 - DNA, 19 bp, Homo sapiens
aaccctgcccctgccccgt

SEQ ID NO: 2641709 - DNA, 12 bp, Homo sapiens
aaccctggagag

SEQ ID NO: 2641710 - DNA, 16 bp, Homo sapiens
aaccctgttttatact

SEQ ID NO: 2641711 - DNA, 16 bp, Homo sapiens
aacccttttggccccc

SEQ ID NO: 2641712 - DNA, 19 bp, Homo sapiens
aacccttttgtctgcctct

SEQ ID NO: 2641713 - DNA, 20 bp, Homo sapiens
aaccgaggggctcaggaaaa

SEQ ID NO: 2641714 - DNA, 17 bp, Homo sapiens
aaccgatgctccagcca

SEQ ID NO: 2641715 - DNA, 21 bp, Homo sapiens
aaccggatggcggacacctgg

SEQ ID NO: 2641716 - DNA, 23 bp, Homo sapiens
aaccggggagcccccgccccgcc

SEQ ID NO: 2641717 - DNA, 21 bp, Homo sapiens
aacctaccttcatttcaggag

SEQ ID NO: 2641718 - DNA, 21 bp, Homo sapiens
aacctattttgaaaaattcct

SEQ ID NO: 2641719 - DNA, 22 bp, Homo sapiens
aacctcacgcacctcccatcct

SEQ ID NO: 2641720 - DNA, 13 bp, Homo sapiens
aacctcagctctg

SEQ ID NO: 2641721 - DNA, 14 bp, Homo sapiens
aacctcagctctgg

SEQ ID NO: 2641722 - DNA, 15 bp, Homo sapiens
aacctcagctctggg

SEQ ID NO: 2641723 - DNA, 16 bp, Homo sapiens
aacctcagctctggga

SEQ ID NO: 2641724 - DNA, 19 bp, Homo sapiens
aacctcagtgtcatttatg

SEQ ID NO: 2641725 - DNA, 16 bp, Homo sapiens
aacctcattgacaaga

SEQ ID NO: 2641726 - DNA, 21 bp, Homo sapiens
aacctcattgacaagaactga

SEQ ID NO: 2641727 - DNA, 17 bp, Homo sapiens
aacctccgcctcttggg

SEQ ID NO: 2641728 - DNA, 19 bp, Homo sapiens
aacctcgctggactctcag

SEQ ID NO: 2641729 - DNA, 18 bp, Homo sapiens
aacctctgttcagtgtaa

SEQ ID NO: 2641730 - DNA, 11 bp, Homo sapiens
aacctcttccc

SEQ ID NO: 2641731 - DNA, 21 bp, Homo sapiens
aacctgaaaaaaagtttacaa

SEQ ID NO: 2641732 - DNA, 17 bp, Homo sapiens
aacctgacccctgctca

SEQ ID NO: 2641733 - DNA, 19 bp, Homo sapiens
aacctgattgtgtctcttg

SEQ ID NO: 2641734 - DNA, 17 bp, Homo sapiens
aacctgccctgcctgag

SEQ ID NO: 2641735 - DNA, 11 bp, Homo sapiens
aacctgctctc

SEQ ID NO: 2641736 - DNA, 15 bp, Homo sapiens
aacctgctctcctct

SEQ ID NO: 2641737 - DNA, 22 bp, Homo sapiens
aacctgcttgggtggagaagcc

SEQ ID NO: 2641738 - DNA, 19 bp, Homo sapiens
aacctggagagctagaacc

SEQ ID NO: 2641739 - DNA, 10 bp, Homo sapiens
aacctggagg

SEQ ID NO: 2641740 - DNA, 22 bp, Homo sapiens
aacctggagggctagaatctgg

SEQ ID NO: 2641741 - DNA, 20 bp, Homo sapiens
aacctggaggggctagaacc

SEQ ID NO: 2641742 - DNA, 22 bp, Homo sapiens
aacctgggaggcggagagtaca

SEQ ID NO: 2641743 - DNA, 19 bp, Homo sapiens
aacctgtttaaatatttca

SEQ ID NO: 2641744 - DNA, 15 bp, Homo sapiens
aaccttattgtacct

SEQ ID NO: 2641745 - DNA, 17 bp, Homo sapiens
aaccttccatctcgcca

SEQ ID NO: 2641746 - DNA, 19 bp, Homo sapiens
aaccttccatctcgccacc

SEQ ID NO: 2641747 - DNA, 18 bp, Homo sapiens
aaccttgaaaactttatg

SEQ ID NO: 2641748 - DNA, 22 bp, Homo sapiens
aaccttggtgtagttgaactga

SEQ ID NO: 2641749 - DNA, 14 bp, Homo sapiens
aacctttagggcag

SEQ ID NO: 2641750 - DNA, 15 bp, Homo sapiens
aacctttagggcagc

SEQ ID NO: 2641751 - DNA, 14 bp, Homo sapiens
aacctttcaaattt

SEQ ID NO: 2641752 - DNA, 15 bp, Homo sapiens
aaccttttttaagat

SEQ ID NO: 2641753 - DNA, 17 bp, Homo sapiens
aaccttttttaagattt

SEQ ID NO: 2641754 - DNA, 22 bp, Homo sapiens
aaccttttttaagatttttctc

SEQ ID NO: 2641755 - DNA, 11 bp, Homo sapiens
aacgaatgaag

SEQ ID NO: 2641756 - DNA, 14 bp, Homo sapiens
aacgacaatagctt

SEQ ID NO: 2641757 - DNA, 23 bp, Homo sapiens
aacgagaggggaagagtgtactg

SEQ ID NO: 2641758 - DNA, 20 bp, Homo sapiens
aacgatttaattctcttgaa

SEQ ID NO: 2641759 - DNA, 12 bp, Homo sapiens
aacgatttagaa

SEQ ID NO: 2641760 - DNA, 18 bp, Homo sapiens
aacgcaaagggctgaaag

SEQ ID NO: 2641761 - DNA, 23 bp, Homo sapiens
aacgcagccctagagcctgcctg

SEQ ID NO: 2641762 - DNA, 20 bp, Homo sapiens
aacgcaggcccccaggtgcc

SEQ ID NO: 2641763 - DNA, 16 bp, Homo sapiens
aacgcgtgtgtacacg

SEQ ID NO: 2641764 - DNA, 21 bp, Homo sapiens
aacgcttaaaggtgtcttcct

SEQ ID NO: 2641765 - DNA, 14 bp, Homo sapiens
aacggagaaaggtg

SEQ ID NO: 2641766 - DNA, 16 bp, Homo sapiens
aacggattattttttc

SEQ ID NO: 2641767 - DNA, 19 bp, Homo sapiens
aacggattattttttcaga

SEQ ID NO: 2641768 - DNA, 15 bp, Homo sapiens
aacgggctgccctgc

SEQ ID NO: 2641769 - DNA, 17 bp, Homo sapiens
aacggtaaatttctgtg

SEQ ID NO: 2641770 - DNA, 18 bp, Homo sapiens
aacgtatgcatgtgaaga

SEQ ID NO: 2641771 - DNA, 17 bp, Homo sapiens
aacgtgcagactatgca

SEQ ID NO: 2641772 - DNA, 19 bp, Homo sapiens
aacgtgttgccttgaacca

SEQ ID NO: 2641773 - DNA, 14 bp, Homo sapiens
aacgttgctcccca

SEQ ID NO: 2641774 - DNA, 14 bp, Homo sapiens
aacgttgctgtggg

SEQ ID NO: 2641775 - DNA, 15 bp, Homo sapiens
aacgttttgaactaa

SEQ ID NO: 2641776 - DNA, 17 bp, Homo sapiens
aagagtaaaggaaatga

SEQ ID NO: 2641777 - DNA, 13 bp, Homo sapiens
aagagtagaaact

SEQ ID NO: 2641778 - DNA, 21 bp, Homo sapiens
aagagtagcaagttctagaga

SEQ ID NO: 2641779 - DNA, 18 bp, Homo sapiens
aagagtagcatttcattc

SEQ ID NO: 2641780 - DNA, 16 bp, Homo sapiens
aagagtaggaagactt

SEQ ID NO: 2641781 - DNA, 18 bp, Homo sapiens
aagagtaggaagactttg

SEQ ID NO: 2641782 - DNA, 19 bp, Homo sapiens
aagagtaggaagactttgg

SEQ ID NO: 2641783 - DNA, 15 bp, Homo sapiens
aagagtcctctgaat

SEQ ID NO: 2641784 - DNA, 16 bp, Homo sapiens
aagagtgggctgcatc

SEQ ID NO: 2641785 - DNA, 13 bp, Homo sapiens
aagagtgtactgg

SEQ ID NO: 2641786 - DNA, 23 bp, Homo sapiens
aagagtgtcctaggagtatcctc

SEQ ID NO: 2641787 - DNA, 23 bp, Homo sapiens
aagagttcttaaggattgtgata

SEQ ID NO: 2641788 - DNA, 12 bp, Homo sapiens
aagataaagatg

SEQ ID NO: 2641789 - DNA, 14 bp, Homo sapiens
aagataaagatgat

SEQ ID NO: 2641790 - DNA, 17 bp, Homo sapiens
aagataaagatgatcta

SEQ ID NO: 2641791 - DNA, 12 bp, Homo sapiens
aagataaatgtg

SEQ ID NO: 2641792 - DNA, 19 bp, Homo sapiens
aagataatattaaggaaga

SEQ ID NO: 2641793 - DNA, 20 bp, Homo sapiens
aagatacagaactctttcaa

SEQ ID NO: 2641794 - DNA, 22 bp, Homo sapiens
aagatacagaactctttcaaaa

SEQ ID NO: 2641795 - DNA, 22 bp, Homo sapiens
aagatacagcctgcaagtggta

SEQ ID NO: 2641796 - DNA, 23 bp, Homo sapiens
aagatacagttactcagaattct

SEQ ID NO: 2641797 - DNA, 22 bp, Homo sapiens
aagatacctaaaagagatttca

SEQ ID NO: 2641798 - DNA, 15 bp, Homo sapiens
aagatacgactttat

SEQ ID NO: 2641799 - DNA, 21 bp, Homo sapiens
aagatacgactttattttctg

SEQ ID NO: 2641800 - DNA, 17 bp, Homo sapiens
aagatagcttcacccca

SEQ ID NO: 2641801 - DNA, 13 bp, Homo sapiens
aagataggctctg

SEQ ID NO: 2641802 - DNA, 17 bp, Homo sapiens
aagataggctctgcaca

SEQ ID NO: 2641803 - DNA, 18 bp, Homo sapiens
aagataggctctgcacag

SEQ ID NO: 2641804 - DNA, 16 bp, Homo sapiens
aagatatgggacattt

SEQ ID NO: 2641805 - DNA, 19 bp, Homo sapiens
aagatatgggacatttttg

SEQ ID NO: 2641806 - DNA, 15 bp, Homo sapiens
aagatattttgcttt

SEQ ID NO: 2641807 - DNA, 13 bp, Homo sapiens
aagatatttttcc

SEQ ID NO: 2641808 - DNA, 22 bp, Homo sapiens
aagatcaaaagcttattcatct

SEQ ID NO: 2641809 - DNA, 23 bp, Homo sapiens
aagatcaaaaggttaataaagta

SEQ ID NO: 2641810 - DNA, 15 bp, Homo sapiens
aagatcactttctca

SEQ ID NO: 2641811 - DNA, 17 bp, Homo sapiens
aagatcactttctcagt

SEQ ID NO: 2641812 - DNA, 23 bp, Homo sapiens
aagatcactttctcagttttcat

SEQ ID NO: 2641813 - DNA, 20 bp, Homo sapiens
aagatcgcgccactgcactc

SEQ ID NO: 2641814 - DNA, 14 bp, Homo sapiens
aagatcttaaattt

SEQ ID NO: 2641815 - DNA, 15 bp, Homo sapiens
aagatcttaaatttt

SEQ ID NO: 2641816 - DNA, 16 bp, Homo sapiens
aagatgacattgctaa

SEQ ID NO: 2641817 - DNA, 21 bp, Homo sapiens
aagatgacattgctaagatgc

SEQ ID NO: 2641818 - DNA, 17 bp, Homo sapiens
aagatgatctactcaga

SEQ ID NO: 2641819 - DNA, 18 bp, Homo sapiens
aagatgatctactcagaa

SEQ ID NO: 2641820 - DNA, 21 bp, Homo sapiens
aagatgctctatcttgctctg

SEQ ID NO: 2641821 - DNA, 22 bp, Homo sapiens
aagatgctctatcttgctctgt

SEQ ID NO: 2641822 - DNA, 14 bp, Homo sapiens
aagatgctgggttg

SEQ ID NO: 2641823 - DNA, 17 bp, Homo sapiens
aagatgcttctcactgc

SEQ ID NO: 2641824 - DNA, 15 bp, Homo sapiens
aagatggatgtgctt

SEQ ID NO: 2641825 - DNA, 17 bp, Homo sapiens
aagatggattctcagat

SEQ ID NO: 2641826 - DNA, 21 bp, Homo sapiens
aagatggcccagctccccaag

SEQ ID NO: 2641827 - DNA, 18 bp, Homo sapiens
aagatggctgtgcctctg

SEQ ID NO: 2641828 - DNA, 23 bp, Homo sapiens
aagatggctgtgcctctgcctgt

SEQ ID NO: 2641829 - DNA, 22 bp, Homo sapiens
aagatgtagaggagaaactgga

SEQ ID NO: 2641830 - DNA, 16 bp, Homo sapiens
aagatgtagatttatt

SEQ ID NO: 2641831 - DNA, 19 bp, Homo sapiens
aagatgtagatttatttca

SEQ ID NO: 2641832 - DNA, 16 bp, Homo sapiens
aagatgtcagactggc

SEQ ID NO: 2641833 - DNA, 13 bp, Homo sapiens
aagattagaatga

SEQ ID NO: 2641834 - DNA, 18 bp, Homo sapiens
aagattagaatgaaaatt

SEQ ID NO: 2641835 - DNA, 19 bp, Homo sapiens
aagattcatttttaatcat

SEQ ID NO: 2641836 - DNA, 15 bp, Homo sapiens
aagattgctgaaatt

SEQ ID NO: 2641837 - DNA, 22 bp, Homo sapiens
aagatttgatgctggagaggtt

SEQ ID NO: 2641838 - DNA, 23 bp, Homo sapiens
aagattttggagggtcctccaca

SEQ ID NO: 2641839 - DNA, 21 bp, Homo sapiens
aagatttttctcaaagttttg

SEQ ID NO: 2641840 - DNA, 17 bp, Homo sapiens
aagcaaaatcatggaat

SEQ ID NO: 2641841 - DNA, 22 bp, Homo sapiens
aagcaacctgggtccaaataaa

SEQ ID NO: 2641842 - DNA, 15 bp, Homo sapiens
aagcaagaaagaaac

SEQ ID NO: 2641843 - DNA, 16 bp, Homo sapiens
aagcaagatttcagat

SEQ ID NO: 2641844 - DNA, 21 bp, Homo sapiens
aagcaataatggtcccatcca

SEQ ID NO: 2641845 - DNA, 22 bp, Homo sapiens
aagcaataatggtcccatccag

SEQ ID NO: 2641846 - DNA, 13 bp, Homo sapiens
aagcaatatgcat

SEQ ID NO: 2641847 - DNA, 19 bp, Homo sapiens
aagcaatatgcatttaaat

SEQ ID NO: 2641848 - DNA, 13 bp, Homo sapiens
aagcaatgcattt

SEQ ID NO: 2641849 - DNA, 20 bp, Homo sapiens
aagcacagtggtggcagggc

SEQ ID NO: 2641850 - DNA, 16 bp, Homo sapiens
aagcacagtttgaaca

SEQ ID NO: 2641851 - DNA, 21 bp, Homo sapiens
aagcaccaaaataagaaaaga

SEQ ID NO: 2641852 - DNA, 22 bp, Homo sapiens
aagcaccaaaataagaaaagat

SEQ ID NO: 2641853 - DNA, 21 bp, Homo sapiens
aagcaccagcttctccaggct

SEQ ID NO: 2641854 - DNA, 12 bp, Homo sapiens
aagcacccttga

SEQ ID NO: 2641855 - DNA, 16 bp, Homo sapiens
aagcacctcctgcctc

SEQ ID NO: 2641856 - DNA, 16 bp, Homo sapiens
aagcaccttagctggc

SEQ ID NO: 2641857 - DNA, 15 bp, Homo sapiens
aagcacgaaatgtta

SEQ ID NO: 2641858 - DNA, 16 bp, Homo sapiens
aagcactgacctgtca

SEQ ID NO: 2641859 - DNA, 17 bp, Homo sapiens
aagcactgacttctaag

SEQ ID NO: 2641860 - DNA, 23 bp, Homo sapiens
aagcactgctaggcgagtgccag

SEQ ID NO: 2641861 - DNA, 13 bp, Homo sapiens
aagcactgtgcta

SEQ ID NO: 2641862 - DNA, 19 bp, Homo sapiens
aagcacttggactcttgct

SEQ ID NO: 2641863 - DNA, 12 bp, Homo sapiens
aagcagaaatac

SEQ ID NO: 2641864 - DNA, 14 bp, Homo sapiens
aagcagatgcaaag

SEQ ID NO: 2641865 - DNA, 18 bp, Homo sapiens
aagcagatgcaaagaggc

SEQ ID NO: 2641866 - DNA, 16 bp, Homo sapiens
aagcagccaagctcct

SEQ ID NO: 2641867 - DNA, 21 bp, Homo sapiens
aagcagccaagctccttggga

SEQ ID NO: 2641868 - DNA, 19 bp, Homo sapiens
aagcagcgaccgccccctc

SEQ ID NO: 2641869 - DNA, 18 bp, Homo sapiens
aagcagctcaaaggcaca

SEQ ID NO: 2641870 - DNA, 19 bp, Homo sapiens
aagcagctcaaaggcacag

SEQ ID NO: 2641871 - DNA, 14 bp, Homo sapiens
aagcagctctcccc

SEQ ID NO: 2641872 - DNA, 17 bp, Homo sapiens
aagcagctcttgctaat

SEQ ID NO: 2641873 - DNA, 22 bp, Homo sapiens
aagcaggaaatgaaaatgtctt

SEQ ID NO: 2641874 - DNA, 11 bp, Homo sapiens
aagcaggaagc

SEQ ID NO: 2641875 - DNA, 12 bp, Homo sapiens
aagcaggaagct

SEQ ID NO: 2641876 - DNA, 15 bp, Homo sapiens
aagcaggctggaggt

SEQ ID NO: 2641877 - DNA, 15 bp, Homo sapiens
aagcagggacttgaa

SEQ ID NO: 2641878 - DNA, 20 bp, Homo sapiens
aagcagtagaaataatatgc

SEQ ID NO: 2641879 - DNA, 18 bp, Homo sapiens
aagcagtgccttccataa

SEQ ID NO: 2641880 - DNA, 22 bp, Homo sapiens
aagcataaatgcaaacacacaa

SEQ ID NO: 2641881 - DNA, 15 bp, Homo sapiens
aagcatcacctcagg

SEQ ID NO: 2641882 - DNA, 23 bp, Homo sapiens
aagcatcacctcaggccaggtgc

SEQ ID NO: 2641883 - DNA, 21 bp, Homo sapiens
aagcatccatgtgtggactca

SEQ ID NO: 2641884 - DNA, 17 bp, Homo sapiens
aagcatgtctcaatagt

SEQ ID NO: 2641885 - DNA, 12 bp, Homo sapiens
aagcatgtgaga

SEQ ID NO: 2641886 - DNA, 13 bp, Homo sapiens
aagcatgtggcat

SEQ ID NO: 2641887 - DNA, 16 bp, Homo sapiens
aagcatgtttcatgtt

SEQ ID NO: 2641888 - DNA, 20 bp, Homo sapiens
aagcatgtttcatgttttgt

SEQ ID NO: 2641889 - DNA, 19 bp, Homo sapiens
aagcattaccactcaggca

SEQ ID NO: 2641890 - DNA, 22 bp, Homo sapiens
aagcattcaatttattcaagaa

SEQ ID NO: 2641891 - DNA, 12 bp, Homo sapiens
aagcattcacaa

SEQ ID NO: 2641892 - DNA, 17 bp, Homo sapiens
aagcattcagagagcag

SEQ ID NO: 2641893 - DNA, 13 bp, Homo sapiens
aagcattccaaca

SEQ ID NO: 2641894 - DNA, 17 bp, Homo sapiens
aagcattccaacaaagg

SEQ ID NO: 2641895 - DNA, 23 bp, Homo sapiens
aagcattccttctttgataatgt

SEQ ID NO: 2641896 - DNA, 22 bp, Homo sapiens
aagcattgggtgggtaaattca

SEQ ID NO: 2641897 - DNA, 22 bp, Homo sapiens
aagcattgtttgcttattgttc

SEQ ID NO: 2641898 - DNA, 20 bp, Homo sapiens
aagcatttaatgtagccatg

SEQ ID NO: 2641899 - DNA, 16 bp, Homo sapiens
aagcatttactttgaa

SEQ ID NO: 2641900 - DNA, 12 bp, Homo sapiens
aagcattttata

SEQ ID NO: 2641901 - DNA, 14 bp, Homo sapiens
aagcattttataaa

SEQ ID NO: 2641902 - DNA, 15 bp, Homo sapiens
aagcattttataaat

SEQ ID NO: 2641903 - DNA, 17 bp, Homo sapiens
aagccaaacctctgtga

SEQ ID NO: 2641904 - DNA, 16 bp, Homo sapiens
aagccaaactctgcca

SEQ ID NO: 2641905 - DNA, 17 bp, Homo sapiens
aagccaacttgtaaata

SEQ ID NO: 2641906 - DNA, 16 bp, Homo sapiens
aagccaagcagccaag

SEQ ID NO: 2641907 - DNA, 18 bp, Homo sapiens
aagccaataacacacagc

SEQ ID NO: 2641908 - DNA, 14 bp, Homo sapiens
aagccaatcccctc

SEQ ID NO: 2641909 - DNA, 15 bp, Homo sapiens
aagccacaagaaatt

SEQ ID NO: 2641910 - DNA, 11 bp, Homo sapiens
aagccacctct

SEQ ID NO: 2641911 - DNA, 13 bp, Homo sapiens
aagccacctctcc

SEQ ID NO: 2641912 - DNA, 20 bp, Homo sapiens
aagccacctctccctcaaca

SEQ ID NO: 2641913 - DNA, 13 bp, Homo sapiens
aagccactgaagc

SEQ ID NO: 2641914 - DNA, 14 bp, Homo sapiens
aagccactgaagct

SEQ ID NO: 2641915 - DNA, 12 bp, Homo sapiens
aagccagaagct

SEQ ID NO: 2641916 - DNA, 14 bp, Homo sapiens
aagccagaagctga

SEQ ID NO: 2641917 - DNA, 20 bp, Homo sapiens
aagccagaagctgagcacca

SEQ ID NO: 2641918 - DNA, 11 bp, Homo sapiens
aagccagacag

SEQ ID NO: 2641919 - DNA, 19 bp, Homo sapiens
aagccagcgtcctcctctg

SEQ ID NO: 2641920 - DNA, 15 bp, Homo sapiens
aagccagctgccgac

SEQ ID NO: 2641921 - DNA, 15 bp, Homo sapiens
aaggcaaatgacttt

SEQ ID NO: 2641922 - DNA, 16 bp, Homo sapiens
aaggcaaatgactttg

SEQ ID NO: 2641923 - DNA, 13 bp, Homo sapiens
aaggcactgcctg

SEQ ID NO: 2641924 - DNA, 14 bp, Homo sapiens
aaggcactgcctga

SEQ ID NO: 2641925 - DNA, 15 bp, Homo sapiens
aaggcagaaagcaaa

SEQ ID NO: 2641926 - DNA, 11 bp, Homo sapiens
aaggcagccac

SEQ ID NO: 2641927 - DNA, 14 bp, Homo sapiens
aaggcaggaagaga

SEQ ID NO: 2641928 - DNA, 14 bp, Homo sapiens
aaggcaggtgcctc

SEQ ID NO: 2641929 - DNA, 17 bp, Homo sapiens
aaggcattctctgaaga

SEQ ID NO: 2641930 - DNA, 13 bp, Homo sapiens
aaggcattttatt

SEQ ID NO: 2641931 - DNA, 18 bp, Homo sapiens
aaggccatggagagctgg

SEQ ID NO: 2641932 - DNA, 22 bp, Homo sapiens
aaggccatggagagctggagcc

SEQ ID NO: 2641933 - DNA, 14 bp, Homo sapiens
aaggccccagagac

SEQ ID NO: 2641934 - DNA, 16 bp, Homo sapiens
aaggccccgcccaggc

SEQ ID NO: 2641935 - DNA, 19 bp, Homo sapiens
aaggccccgcccaggctta

SEQ ID NO: 2641936 - DNA, 15 bp, Homo sapiens
aaggccttctcctcc

SEQ ID NO: 2641937 - DNA, 13 bp, Homo sapiens
aaggcggcccctc

SEQ ID NO: 2641938 - DNA, 18 bp, Homo sapiens
aaggcgggagcatctctt

SEQ ID NO: 2641939 - DNA, 19 bp, Homo sapiens
aaggcgtggagctgcctga

SEQ ID NO: 2641940 - DNA, 16 bp, Homo sapiens
aaggctaaaacttaac

SEQ ID NO: 2641941 - DNA, 19 bp, Homo sapiens
aaggctcgagcatgcctgg

SEQ ID NO: 2641942 - DNA, 22 bp, Homo sapiens
aaggctcgagcatgcctggatg

SEQ ID NO: 2641943 - DNA, 18 bp, Homo sapiens
aaggctctgaaagccagc

SEQ ID NO: 2641944 - DNA, 23 bp, Homo sapiens
aaggctctgagcaaatgtggctc

SEQ ID NO: 2641945 - DNA, 19 bp, Homo sapiens
aaggctcttctccccagag

SEQ ID NO: 2641946 - DNA, 19 bp, Homo sapiens
aaggctgagaggagagaga

SEQ ID NO: 2641947 - DNA, 23 bp, Homo sapiens
aaggctgaggaaaggccagctgg

SEQ ID NO: 2641948 - DNA, 16 bp, Homo sapiens
aaggctggctgggcat

SEQ ID NO: 2641949 - DNA, 19 bp, Homo sapiens
aaggctgggggaagaagct

SEQ ID NO: 2641950 - DNA, 22 bp, Homo sapiens
aaggctgggggaagaagctctc

SEQ ID NO: 2641951 - DNA, 16 bp, Homo sapiens
aagggaaactgccagc

SEQ ID NO: 2641952 - DNA, 23 bp, Homo sapiens
aagggaaactgccagcaacgcag

SEQ ID NO: 2641953 - DNA, 13 bp, Homo sapiens
aagggaaatatca

SEQ ID NO: 2641954 - DNA, 13 bp, Homo sapiens
aagggaccaaggc

SEQ ID NO: 2641955 - DNA, 18 bp, Homo sapiens
aagggacgctacccggga

SEQ ID NO: 2641956 - DNA, 20 bp, Homo sapiens
aagggacttggaagctccgc

SEQ ID NO: 2641957 - DNA, 16 bp, Homo sapiens
aagggagagagagagg

SEQ ID NO: 2641958 - DNA, 24 bp, Homo sapiens
aagggagcactgggttgactttca

SEQ ID NO: 2641959 - DNA, 15 bp, Homo sapiens
aagggatggaaaagg

SEQ ID NO: 2641960 - DNA, 20 bp, Homo sapiens
aagggatggaaaaggaagac

SEQ ID NO: 2641961 - DNA, 24 bp, Homo sapiens
aagggatggaggtcacactggtag

SEQ ID NO: 2641962 - DNA, 14 bp, Homo sapiens
aagggatggcaaga

SEQ ID NO: 2641963 - DNA, 17 bp, Homo sapiens
aagggattacccaagca

SEQ ID NO: 2641964 - DNA, 17 bp, Homo sapiens
aagggattttagtcaca

SEQ ID NO: 2641965 - DNA, 21 bp, Homo sapiens
aagggcaataccgtgttggtt

SEQ ID NO: 2641966 - DNA, 21 bp, Homo sapiens
aagggcaggaaggagagcctg

SEQ ID NO: 2641967 - DNA, 18 bp, Homo sapiens
aagggccagtctgggctg

SEQ ID NO: 2641968 - DNA, 16 bp, Homo sapiens
aagggccatgctgaag

SEQ ID NO: 2641969 - DNA, 14 bp, Homo sapiens
aagggcctggcctg

SEQ ID NO: 2641970 - DNA, 17 bp, Homo sapiens
aagggctagaacctgga

SEQ ID NO: 2641971 - DNA, 17 bp, Homo sapiens
aagggcttctgcaccct

SEQ ID NO: 2641972 - DNA, 18 bp, Homo sapiens
aagggcttctgcaccctc

SEQ ID NO: 2641973 - DNA, 22 bp, Homo sapiens
aagggcttctgcaccctccacc

SEQ ID NO: 2641974 - DNA, 17 bp, Homo sapiens
aaggggccagaggctcg

SEQ ID NO: 2641975 - DNA, 13 bp, Homo sapiens
aaggggccatcct

SEQ ID NO: 2641976 - DNA, 22 bp, Homo sapiens
aaggggcccaaattctttcagt

SEQ ID NO: 2641977 - DNA, 13 bp, Homo sapiens
aaggggccctggt

SEQ ID NO: 2641978 - DNA, 21 bp, Homo sapiens
aaggggccctggtccttccag

SEQ ID NO: 2641979 - DNA, 21 bp, Homo sapiens
aaggggcctttgtcttgtcaa

SEQ ID NO: 2641980 - DNA, 12 bp, Homo sapiens
aagggggctggg

SEQ ID NO: 2641981 - DNA, 17 bp, Homo sapiens
aagggggtcccagtggg

SEQ ID NO: 2641982 - DNA, 15 bp, Homo sapiens
aagggtcttgggaaa

SEQ ID NO: 2641983 - DNA, 19 bp, Homo sapiens
aagggtgatgggaaagcat

SEQ ID NO: 2641984 - DNA, 21 bp, Homo sapiens
aagggtgatgggaaagcattg

SEQ ID NO: 2641985 - DNA, 19 bp, Homo sapiens
aagggtgctgcttccctct

SEQ ID NO: 2641986 - DNA, 14 bp, Homo sapiens
aagggttaagaaaa

SEQ ID NO: 2641987 - DNA, 17 bp, Homo sapiens
aagggtttgtggctggg

SEQ ID NO: 2641988 - DNA, 12 bp, Homo sapiens
aaggtaaaattg

SEQ ID NO: 2641989 - DNA, 22 bp, Homo sapiens
aaggtattccttttgtgtacag

SEQ ID NO: 2641990 - DNA, 18 bp, Homo sapiens
aaggtcattttttttaag

SEQ ID NO: 2641991 - DNA, 19 bp, Homo sapiens
aaggtcattttttttaaga

SEQ ID NO: 2641992 - DNA, 13 bp, Homo sapiens
aaggtctttggtt

SEQ ID NO: 2641993 - DNA, 14 bp, Homo sapiens
aaggtgcagttccc

SEQ ID NO: 2641994 - DNA, 16 bp, Homo sapiens
aaggtgggctgagccc

SEQ ID NO: 2641995 - DNA, 15 bp, Homo sapiens
aaggtgtcttcctcc

SEQ ID NO: 2641996 - DNA, 15 bp, Homo sapiens
aaggttaataaagta

SEQ ID NO: 2641997 - DNA, 20 bp, Homo sapiens
aaggttaatgttcatcatcc

SEQ ID NO: 2641998 - DNA, 17 bp, Homo sapiens
aaggttaggatttaaca

SEQ ID NO: 2641999 - DNA, 19 bp, Homo sapiens
aaggttccaactgtatata

SEQ ID NO: 2642000 - DNA, 21 bp, Homo sapiens
aaggttctctcctccccaagg

SEQ ID NO: 2642001 - DNA, 21 bp, Homo sapiens
aaggttcttcccttttacata

SEQ ID NO: 2642002 - DNA, 16 bp, Homo sapiens
aaggtttcgtttctgt

SEQ ID NO: 2642003 - DNA, 17 bp, Homo sapiens
aagtaaaaccacagcag

SEQ ID NO: 2642004 - DNA, 13 bp, Homo sapiens
aagtaagaagaca

SEQ ID NO: 2642005 - DNA, 15 bp, Homo sapiens
aagtaaggtgcagtt

SEQ ID NO: 2642006 - DNA, 18 bp, Homo sapiens
aagtaagtaccactcagg

SEQ ID NO: 2642007 - DNA, 16 bp, Homo sapiens
aagtaatatgcacaca

SEQ ID NO: 2642008 - DNA, 14 bp, Homo sapiens
aagtaattcctctc

SEQ ID NO: 2642009 - DNA, 22 bp, Homo sapiens
aagtaattctgctgtctcagcc

SEQ ID NO: 2642010 - DNA, 18 bp, Homo sapiens
aagtacactgtttcaaac

SEQ ID NO: 2642011 - DNA, 20 bp, Homo sapiens
aagtacactgtttcaaactt

SEQ ID NO: 2642012 - DNA, 17 bp, Homo sapiens
aagtaccactcaggcca

SEQ ID NO: 2642013 - DNA, 16 bp, Homo sapiens
aagtactgtgtacaga

SEQ ID NO: 2642014 - DNA, 19 bp, Homo sapiens
aagtacttctccaccctgc

SEQ ID NO: 2642015 - DNA, 11 bp, Homo sapiens
aagtacttctt

SEQ ID NO: 2642016 - DNA, 12 bp, Homo sapiens
aagtagaggagg

SEQ ID NO: 2642017 - DNA, 13 bp, Homo sapiens
aagtaggaagtaa

SEQ ID NO: 2642018 - DNA, 22 bp, Homo sapiens
aagtaggactttcctaaatgtt

SEQ ID NO: 2642019 - DNA, 15 bp, Homo sapiens
aagtaggcaggacca

SEQ ID NO: 2642020 - DNA, 15 bp, Homo sapiens
aagtagtaaaaatta

SEQ ID NO: 2642021 - DNA, 12 bp, Homo sapiens
aagtagtttgta

SEQ ID NO: 2642022 - DNA, 11 bp, Homo sapiens
aagtatatata

SEQ ID NO: 2642023 - DNA, 16 bp, Homo sapiens
aagtatatatagaatc

SEQ ID NO: 2642024 - DNA, 23 bp, Homo sapiens
aagtatccctactgtaatttgtg

SEQ ID NO: 2642025 - DNA, 18 bp, Homo sapiens
aagtatcttttttcaaaa

SEQ ID NO: 2642026 - DNA, 21 bp, Homo sapiens
aagtatgtaaacaggagacag

SEQ ID NO: 2642027 - DNA, 22 bp, Homo sapiens
aagtatgtaaagtatgtaaaca

SEQ ID NO: 2642028 - DNA, 18 bp, Homo sapiens
aagtatgtgagtgtgtcc

SEQ ID NO: 2642029 - DNA, 15 bp, Homo sapiens
aagtattatgtctct

SEQ ID NO: 2642030 - DNA, 18 bp, Homo sapiens
aagtattcttatttaatg

SEQ ID NO: 2642031 - DNA, 21 bp, Homo sapiens
aagtattcttatttaatgaaa

SEQ ID NO: 2642032 - DNA, 10 bp, Homo sapiens
aagtatttag

SEQ ID NO: 2642033 - DNA, 11 bp, Homo sapiens
aagtatttagg

SEQ ID NO: 2642034 - DNA, 12 bp, Homo sapiens
aagtatttatat

SEQ ID NO: 2642035 - DNA, 16 bp, Homo sapiens
aagtatttatatattt

SEQ ID NO: 2642036 - DNA, 17 bp, Homo sapiens
aagtatttatatattta

SEQ ID NO: 2642037 - DNA, 18 bp, Homo sapiens
aagtatttatatatttat

SEQ ID NO: 2642038 - DNA, 21 bp, Homo sapiens
aagtatttatatatttataac

SEQ ID NO: 2642039 - DNA, 15 bp, Homo sapiens
aagtattttcctgta

SEQ ID NO: 2642040 - DNA, 15 bp, Homo sapiens
aagtatttttttatc

SEQ ID NO: 2642041 - DNA, 20 bp, Homo sapiens
aagtcaaagcaaggaaacta

SEQ ID NO: 2642042 - DNA, 17 bp, Homo sapiens
aagtcaatgttttcagt

SEQ ID NO: 2642043 - DNA, 24 bp, Homo sapiens
aagtcacacagtattacttctgct

SEQ ID NO: 2642044 - DNA, 13 bp, Homo sapiens
aagtcacacagtg

SEQ ID NO: 2642045 - DNA, 19 bp, Homo sapiens
aagtcacatcacaggacac

SEQ ID NO: 2642046 - DNA, 17 bp, Homo sapiens
aagtcactcccaagccc

SEQ ID NO: 2642047 - DNA, 20 bp, Homo sapiens
aagtcagactgctgggactg

SEQ ID NO: 2642048 - DNA, 23 bp, Homo sapiens
aagtcagaggatggccagtgtct

SEQ ID NO: 2642049 - DNA, 21 bp, Homo sapiens
aagtcagatgtggtaactgtt

SEQ ID NO: 2642050 - DNA, 21 bp, Homo sapiens
aagtcaggcccttattttcaa

SEQ ID NO: 2642051 - DNA, 20 bp, Homo sapiens
aagtcagtgcccaactgtta

SEQ ID NO: 2642052 - DNA, 21 bp, Homo sapiens
aagtcagtgcccaactgttat

SEQ ID NO: 2642053 - DNA, 15 bp, Homo sapiens
aagtcatccaatcta

SEQ ID NO: 2642054 - DNA, 15 bp, Homo sapiens
aagtcatgaagccca

SEQ ID NO: 2642055 - DNA, 17 bp, Homo sapiens
aagtcatgaagcccaag

SEQ ID NO: 2642056 - DNA, 21 bp, Homo sapiens
aagtcatgcgtttaatcacat

SEQ ID NO: 2642057 - DNA, 15 bp, Homo sapiens
aagtcatgtgcattt

SEQ ID NO: 2642058 - DNA, 22 bp, Homo sapiens
aagtccccaggccccaggaagc

SEQ ID NO: 2642059 - DNA, 23 bp, Homo sapiens
aagtccccaggccccaggaagcc

SEQ ID NO: 2642060 - DNA, 21 bp, Homo sapiens
aagtccccgagtttccccaga

SEQ ID NO: 2642061 - DNA, 22 bp, Homo sapiens
aagtcctgaagaggcgggccag

SEQ ID NO: 2642062 - DNA, 15 bp, Homo sapiens
aagtcgttgtgaggg

SEQ ID NO: 2642063 - DNA, 17 bp, Homo sapiens
aagtctaaatatttcct

SEQ ID NO: 2642064 - DNA, 16 bp, Homo sapiens
aagtctctgctggccc

SEQ ID NO: 2642065 - DNA, 23 bp, Homo sapiens
aagtctgtgtgatgaactttctc

SEQ ID NO: 2642066 - DNA, 21 bp, Homo sapiens
aatgattcagtgttaaatgtg

SEQ ID NO: 2642067 - DNA, 23 bp, Homo sapiens
aatgattcagtgttaaatgtgat

SEQ ID NO: 2642068 - DNA, 22 bp, Homo sapiens
aatgatttcatgctatctctgt

SEQ ID NO: 2642069 - DNA, 20 bp, Homo sapiens
aatgcaaacacacaaaggta

SEQ ID NO: 2642070 - DNA, 15 bp, Homo sapiens
aatgcaacaacatgt

SEQ ID NO: 2642071 - DNA, 14 bp, Homo sapiens
aatgcaacatgtgt

SEQ ID NO: 2642072 - DNA, 14 bp, Homo sapiens
aatgcaatatgtat

SEQ ID NO: 2642073 - DNA, 13 bp, Homo sapiens
aatgcacctggaa

SEQ ID NO: 2642074 - DNA, 19 bp, Homo sapiens
aatgcacgtagctgaggcc

SEQ ID NO: 2642075 - DNA, 11 bp, Homo sapiens
aatgcactttc

SEQ ID NO: 2642076 - DNA, 15 bp, Homo sapiens
aatgcactttctatc

SEQ ID NO: 2642077 - DNA, 22 bp, Homo sapiens
aatgcactttgttctggctctt

SEQ ID NO: 2642078 - DNA, 22 bp, Homo sapiens
aatgcagcgaaccaatatttgt

SEQ ID NO: 2642079 - DNA, 13 bp, Homo sapiens
aatgcataaaatg

SEQ ID NO: 2642080 - DNA, 18 bp, Homo sapiens
aatgcatatcctgagcca

SEQ ID NO: 2642081 - DNA, 16 bp, Homo sapiens
aatgcatattgtatta

SEQ ID NO: 2642082 - DNA, 15 bp, Homo sapiens
aatgcatctgtcctc

SEQ ID NO: 2642083 - DNA, 19 bp, Homo sapiens
aatgcatgcagccactgtg

SEQ ID NO: 2642084 - DNA, 18 bp, Homo sapiens
aatgcatgttaggaaaat

SEQ ID NO: 2642085 - DNA, 12 bp, Homo sapiens
aatgcattgtat

SEQ ID NO: 2642086 - DNA, 22 bp, Homo sapiens
aatgcattgtatcgatgttatg

SEQ ID NO: 2642087 - DNA, 15 bp, Homo sapiens
aatgccatcatctcc

SEQ ID NO: 2642088 - DNA, 15 bp, Homo sapiens
aatgcccagcccctt

SEQ ID NO: 2642089 - DNA, 22 bp, Homo sapiens
aatgccctcaggggacttgaat

SEQ ID NO: 2642090 - DNA, 18 bp, Homo sapiens
aatgcccttacacttact

SEQ ID NO: 2642091 - DNA, 22 bp, Homo sapiens
aatgcccttacacttactgttg

SEQ ID NO: 2642092 - DNA, 12 bp, Homo sapiens
aatgcctcctcc

SEQ ID NO: 2642093 - DNA, 12 bp, Homo sapiens
aatgcctttgag

SEQ ID NO: 2642094 - DNA, 16 bp, Homo sapiens
aatgcctttgagacag

SEQ ID NO: 2642095 - DNA, 22 bp, Homo sapiens
aatgcctttgagacagtttctt

SEQ ID NO: 2642096 - DNA, 14 bp, Homo sapiens
aatgcgtaattaaa

SEQ ID NO: 2642097 - DNA, 18 bp, Homo sapiens
aatgcgtgcataccactt

SEQ ID NO: 2642098 - DNA, 21 bp, Homo sapiens
aatgcgtgcataccacttttg

SEQ ID NO: 2642099 - DNA, 20 bp, Homo sapiens
aatgctaaagaaaaagtcat

SEQ ID NO: 2642100 - DNA, 13 bp, Homo sapiens
aatgctactttat

SEQ ID NO: 2642101 - DNA, 18 bp, Homo sapiens
aatgctagctctgagcca

SEQ ID NO: 2642102 - DNA, 17 bp, Homo sapiens
aatgctaggtctcggac

SEQ ID NO: 2642103 - DNA, 23 bp, Homo sapiens
aatgctataactatgttgataaa

SEQ ID NO: 2642104 - DNA, 15 bp, Homo sapiens
aatgctcagaccagc

SEQ ID NO: 2642105 - DNA, 12 bp, Homo sapiens
aatgctcatctg

SEQ ID NO: 2642106 - DNA, 18 bp, Homo sapiens
aatgctgaacattgcata

SEQ ID NO: 2642107 - DNA, 20 bp, Homo sapiens
aatgctgcagatttgggctg

SEQ ID NO: 2642108 - DNA, 22 bp, Homo sapiens
aatgctgcccatgccaccgctt

SEQ ID NO: 2642109 - DNA, 23 bp, Homo sapiens
aatgctgcccatgccaccgcttc

SEQ ID NO: 2642110 - DNA, 19 bp, Homo sapiens
aatgctggttttcctaaat

SEQ ID NO: 2642111 - DNA, 18 bp, Homo sapiens
aatgctggtttttcagtt

SEQ ID NO: 2642112 - DNA, 22 bp, Homo sapiens
aatgctgtattagtcacagaga

SEQ ID NO: 2642113 - DNA, 13 bp, Homo sapiens
aatgctgtgccct

SEQ ID NO: 2642114 - DNA, 20 bp, Homo sapiens
aatgctgtgccctaaagtgt

SEQ ID NO: 2642115 - DNA, 21 bp, Homo sapiens
aatgcttcctgacaatcaact

SEQ ID NO: 2642116 - DNA, 13 bp, Homo sapiens
aatgcttgaaaaa

SEQ ID NO: 2642117 - DNA, 19 bp, Homo sapiens
aatgcttgaaaaatgtgca

SEQ ID NO: 2642118 - DNA, 17 bp, Homo sapiens
aatgcttggcttctcat

SEQ ID NO: 2642119 - DNA, 20 bp, Homo sapiens
aatgcttgtggattgagggt

SEQ ID NO: 2642120 - DNA, 14 bp, Homo sapiens
aatggaatactgaa

SEQ ID NO: 2642121 - DNA, 23 bp, Homo sapiens
aatggactggaaggggaagggac

SEQ ID NO: 2642122 - DNA, 23 bp, Homo sapiens
aatggattggattatttaataac

SEQ ID NO: 2642123 - DNA, 16 bp, Homo sapiens
aatggcagccttggca

SEQ ID NO: 2642124 - DNA, 19 bp, Homo sapiens
aatggcgcagtgcctctgg

SEQ ID NO: 2642125 - DNA, 21 bp, Homo sapiens
aatggctcactatggtgccaa

SEQ ID NO: 2642126 - DNA, 12 bp, Homo sapiens
aatggctcagat

SEQ ID NO: 2642127 - DNA, 22 bp, Homo sapiens
aatgggaactgcctctttcctg

SEQ ID NO: 2642128 - DNA, 13 bp, Homo sapiens
aatgggacactaa

SEQ ID NO: 2642129 - DNA, 20 bp, Homo sapiens
aatgggacttcttttcacat

SEQ ID NO: 2642130 - DNA, 18 bp, Homo sapiens
aatgggcaaaactgaatt

SEQ ID NO: 2642131 - DNA, 17 bp, Homo sapiens
aatgggcagttacatgc

SEQ ID NO: 2642132 - DNA, 18 bp, Homo sapiens
aatgggggtagcagctgg

SEQ ID NO: 2642133 - DNA, 12 bp, Homo sapiens
aatgggtaatat

SEQ ID NO: 2642134 - DNA, 16 bp, Homo sapiens
aatggtaccagataaa

SEQ ID NO: 2642135 - DNA, 23 bp, Homo sapiens
aatggtagtaatcacagttggcc

SEQ ID NO: 2642136 - DNA, 16 bp, Homo sapiens
aatggtatggaactct

SEQ ID NO: 2642137 - DNA, 14 bp, Homo sapiens
aatggtcagcgttg

SEQ ID NO: 2642138 - DNA, 18 bp, Homo sapiens
aatggtcagcgttgcatg

SEQ ID NO: 2642139 - DNA, 20 bp, Homo sapiens
aatggtcagcgttgcatgtc

SEQ ID NO: 2642140 - DNA, 13 bp, Homo sapiens
aatggtccagggt

SEQ ID NO: 2642141 - DNA, 15 bp, Homo sapiens
aatggtcgcccagga

SEQ ID NO: 2642142 - DNA, 22 bp, Homo sapiens
aatggtctttctaatgtgtgaa

SEQ ID NO: 2642143 - DNA, 22 bp, Homo sapiens
aatggtggggaactataaagaa

SEQ ID NO: 2642144 - DNA, 13 bp, Homo sapiens
aatggtgtacata

SEQ ID NO: 2642145 - DNA, 14 bp, Homo sapiens
aatggttccatgcc

SEQ ID NO: 2642146 - DNA, 15 bp, Homo sapiens
aatggttgccttaaa

SEQ ID NO: 2642147 - DNA, 16 bp, Homo sapiens
aatggtttaaatggtc

SEQ ID NO: 2642148 - DNA, 13 bp, Homo sapiens
aatggtttcaaag

SEQ ID NO: 2642149 - DNA, 14 bp, Homo sapiens
aatggttttcaaaa

SEQ ID NO: 2642150 - DNA, 16 bp, Homo sapiens
aatggttttcaaaata

SEQ ID NO: 2642151 - DNA, 17 bp, Homo sapiens
aatgtaaaatgttgaat

SEQ ID NO: 2642152 - DNA, 20 bp, Homo sapiens
aatgtaagggaaactgccag

SEQ ID NO: 2642153 - DNA, 17 bp, Homo sapiens
aatgtacatctggcctt

SEQ ID NO: 2642154 - DNA, 14 bp, Homo sapiens
aatgtactgcatat

SEQ ID NO: 2642155 - DNA, 14 bp, Homo sapiens
aatgtagctggttt

SEQ ID NO: 2642156 - DNA, 14 bp, Homo sapiens
aatgtatatgcact

SEQ ID NO: 2642157 - DNA, 15 bp, Homo sapiens
aatgtatcaggaaat

SEQ ID NO: 2642158 - DNA, 13 bp, Homo sapiens
aatgtatcttatt

SEQ ID NO: 2642159 - DNA, 18 bp, Homo sapiens
aatgtatgtgcactgtca

SEQ ID NO: 2642160 - DNA, 18 bp, Homo sapiens
aatgtattattctgcagc

SEQ ID NO: 2642161 - DNA, 22 bp, Homo sapiens
aatgtattattctgcagcatga

SEQ ID NO: 2642162 - DNA, 15 bp, Homo sapiens
aatgtattgtacctt

SEQ ID NO: 2642163 - DNA, 15 bp, Homo sapiens
aatgtcacaggcagg

SEQ ID NO: 2642164 - DNA, 18 bp, Homo sapiens
aatgtcaggaacagaagg

SEQ ID NO: 2642165 - DNA, 15 bp, Homo sapiens
aatgtcagtatgtgg

SEQ ID NO: 2642166 - DNA, 17 bp, Homo sapiens
aatgtcctccagaagcc

SEQ ID NO: 2642167 - DNA, 20 bp, Homo sapiens
aatgtctctttaatgtcaca

SEQ ID NO: 2642168 - DNA, 15 bp, Homo sapiens
aatgtcttttgaata

SEQ ID NO: 2642169 - DNA, 16 bp, Homo sapiens
aatgtgaataaaatta

SEQ ID NO: 2642170 - DNA, 17 bp, Homo sapiens
aatgtgaataaaattat

SEQ ID NO: 2642171 - DNA, 17 bp, Homo sapiens
aatgtgaccaggggtga

SEQ ID NO: 2642172 - DNA, 14 bp, Homo sapiens
aatgtgattctaat

SEQ ID NO: 2642173 - DNA, 20 bp, Homo sapiens
aatgtgcaggtttgttacat

SEQ ID NO: 2642174 - DNA, 21 bp, Homo sapiens
aatgtgctgaatggttttcaa

SEQ ID NO: 2642175 - DNA, 14 bp, Homo sapiens
aatgtgctgtgtaa

SEQ ID NO: 2642176 - DNA, 15 bp, Homo sapiens
aatgtgctgtgtaaa

SEQ ID NO: 2642177 - DNA, 18 bp, Homo sapiens
aatgtgctgtgtaaagtt

SEQ ID NO: 2642178 - DNA, 21 bp, Homo sapiens
aatgtggcccctgaacaagaa

SEQ ID NO: 2642179 - DNA, 17 bp, Homo sapiens
aatgtggcctaaaaatg

SEQ ID NO: 2642180 - DNA, 14 bp, Homo sapiens
aatgtggctcctgg

SEQ ID NO: 2642181 - DNA, 14 bp, Homo sapiens
aatgtgggcagaga

SEQ ID NO: 2642182 - DNA, 18 bp, Homo sapiens
aatgtggttatttctctg

SEQ ID NO: 2642183 - DNA, 21 bp, Homo sapiens
aatgtggttatttctctgatt

SEQ ID NO: 2642184 - DNA, 22 bp, Homo sapiens
aatgtgtattacaaatattttg

SEQ ID NO: 2642185 - DNA, 13 bp, Homo sapiens
aatgttaaatttg

SEQ ID NO: 2642186 - DNA, 16 bp, Homo sapiens
aatgttaaatttgtaa

SEQ ID NO: 2642187 - DNA, 17 bp, Homo sapiens
aatgttaaatttgtaag

SEQ ID NO: 2642188 - DNA, 22 bp, Homo sapiens
aatgttaaatttgtaagtttca

SEQ ID NO: 2642189 - DNA, 15 bp, Homo sapiens
aatgttacattatta

SEQ ID NO: 2642190 - DNA, 20 bp, Homo sapiens
aatgttactgatcatgcatt

SEQ ID NO: 2642191 - DNA, 21 bp, Homo sapiens
aatgttactgatcatgcattg

SEQ ID NO: 2642192 - DNA, 17 bp, Homo sapiens
aatgttagaggttttaa

SEQ ID NO: 2642193 - DNA, 22 bp, Homo sapiens
aatgttagaggttttaaagtga

SEQ ID NO: 2642194 - DNA, 11 bp, Homo sapiens
aatgttcattg

SEQ ID NO: 2642195 - DNA, 21 bp, Homo sapiens
aatgttctctcttctccacct

SEQ ID NO: 2642196 - DNA, 12 bp, Homo sapiens
aatgttctgaca

SEQ ID NO: 2642197 - DNA, 14 bp, Homo sapiens
aatgttctgacatt

SEQ ID NO: 2642198 - DNA, 15 bp, Homo sapiens
aatgttctgacatta

SEQ ID NO: 2642199 - DNA, 19 bp, Homo sapiens
aatgttctgacattaacag

SEQ ID NO: 2642200 - DNA, 19 bp, Homo sapiens
aatgttggatttataaatg

SEQ ID NO: 2642201 - DNA, 13 bp, Homo sapiens
aatgttgggactg

SEQ ID NO: 2642202 - DNA, 21 bp, Homo sapiens
aatgttgggactgctaaataa

SEQ ID NO: 2642203 - DNA, 23 bp, Homo sapiens
aatgtttacactctttgtaagag

SEQ ID NO: 2642204 - DNA, 21 bp, Homo sapiens
aatgtttatgcaaggaaggaa

SEQ ID NO: 2642205 - DNA, 22 bp, Homo sapiens
aatgtttatgcaaggaaggaaa

SEQ ID NO: 2642206 - DNA, 22 bp, Homo sapiens
aatgttttactgtgaaactggc

SEQ ID NO: 2642207 - DNA, 12 bp, Homo sapiens
aatgttttgaca

SEQ ID NO: 2642208 - DNA, 21 bp, Homo sapiens
aattaaacggattattttttc

SEQ ID NO: 2642209 - DNA, 12 bp, Homo sapiens
aattaaatgtag

SEQ ID NO: 2642210 - DNA, 12 bp, Homo sapiens
aattaacactgc

SEQ ID NO: 2642211 - DNA, 18 bp, Homo sapiens
acaataactactgtgttc

SEQ ID NO: 2642212 - DNA, 20 bp, Homo sapiens
acaataactactgtgttcct

SEQ ID NO: 2642213 - DNA, 12 bp, Homo sapiens
acaataatttca

SEQ ID NO: 2642214 - DNA, 13 bp, Homo sapiens
acaatacccccag

SEQ ID NO: 2642215 - DNA, 20 bp, Homo sapiens
acaatactcataatgtgaag

SEQ ID NO: 2642216 - DNA, 20 bp, Homo sapiens
acaatagctttaccctcagg

SEQ ID NO: 2642217 - DNA, 21 bp, Homo sapiens
acaatataaccacaaagcaca

SEQ ID NO: 2642218 - DNA, 19 bp, Homo sapiens
acaatatgcaatgtgaagc

SEQ ID NO: 2642219 - DNA, 14 bp, Homo sapiens
acaatattgtttct

SEQ ID NO: 2642220 - DNA, 13 bp, Homo sapiens
acaatatttaaaa

SEQ ID NO: 2642221 - DNA, 18 bp, Homo sapiens
acaatatttaaaatttat

SEQ ID NO: 2642222 - DNA, 17 bp, Homo sapiens
acaatattttgtggctt

SEQ ID NO: 2642223 - DNA, 19 bp, Homo sapiens
acaatcaaaggaaaatagt

SEQ ID NO: 2642224 - DNA, 19 bp, Homo sapiens
acaatcagccacattctag

SEQ ID NO: 2642225 - DNA, 22 bp, Homo sapiens
acaatcagctccttcctggaga

SEQ ID NO: 2642226 - DNA, 16 bp, Homo sapiens
acaatcagtcccctcc

SEQ ID NO: 2642227 - DNA, 22 bp, Homo sapiens
acaatcagtcccctcccatctg

SEQ ID NO: 2642228 - DNA, 18 bp, Homo sapiens
acaatcatttgctttttg

SEQ ID NO: 2642229 - DNA, 15 bp, Homo sapiens
acaatcctagtgctt

SEQ ID NO: 2642230 - DNA, 16 bp, Homo sapiens
acaatcctagtgcttt

SEQ ID NO: 2642231 - DNA, 19 bp, Homo sapiens
acaatcttaaggggcagct

SEQ ID NO: 2642232 - DNA, 20 bp, Homo sapiens
acaatcttaaggggcagctt

SEQ ID NO: 2642233 - DNA, 13 bp, Homo sapiens
acaatgactttat

SEQ ID NO: 2642234 - DNA, 21 bp, Homo sapiens
acaatgtatttatttaaaaga

SEQ ID NO: 2642235 - DNA, 19 bp, Homo sapiens
acaatgtgaaaagaaaaat

SEQ ID NO: 2642236 - DNA, 20 bp, Homo sapiens
acaatgttaaggaaactctt

SEQ ID NO: 2642237 - DNA, 21 bp, Homo sapiens
acaatgttaaggaaactctta

SEQ ID NO: 2642238 - DNA, 22 bp, Homo sapiens
acaatgttaaggaaactcttat

SEQ ID NO: 2642239 - DNA, 21 bp, Homo sapiens
acaattatttttacagttctc

SEQ ID NO: 2642240 - DNA, 14 bp, Homo sapiens
acaattcatgaact

SEQ ID NO: 2642241 - DNA, 20 bp, Homo sapiens
acaattcatgaacttcgcat

SEQ ID NO: 2642242 - DNA, 22 bp, Homo sapiens
acaattctgttttaggttaaaa

SEQ ID NO: 2642243 - DNA, 21 bp, Homo sapiens
acaattctttatacaacagtg

SEQ ID NO: 2642244 - DNA, 19 bp, Homo sapiens
acaattgaacttaaataaa

SEQ ID NO: 2642245 - DNA, 20 bp, Homo sapiens
acaatttaaagcaaaggagt

SEQ ID NO: 2642246 - DNA, 20 bp, Homo sapiens
acaatttcaaaaaaataaaa

SEQ ID NO: 2642247 - DNA, 16 bp, Homo sapiens
acaatttcctttatat

SEQ ID NO: 2642248 - DNA, 23 bp, Homo sapiens
acaatttcctttatatttagtga

SEQ ID NO: 2642249 - DNA, 15 bp, Homo sapiens
acaattttgtacaaa

SEQ ID NO: 2642250 - DNA, 19 bp, Homo sapiens
acaatttttttaattttgt

SEQ ID NO: 2642251 - DNA, 19 bp, Homo sapiens
acacaaaagtttctctttt

SEQ ID NO: 2642252 - DNA, 16 bp, Homo sapiens
acacaaacctgcctgg

SEQ ID NO: 2642253 - DNA, 15 bp, Homo sapiens
acacaaacgtatgta

SEQ ID NO: 2642254 - DNA, 22 bp, Homo sapiens
acacaagaagaagggcacccta

SEQ ID NO: 2642255 - DNA, 14 bp, Homo sapiens
acacaagccacaga

SEQ ID NO: 2642256 - DNA, 14 bp, Homo sapiens
acacaagctggaag

SEQ ID NO: 2642257 - DNA, 15 bp, Homo sapiens
acacaagctggaagc

SEQ ID NO: 2642258 - DNA, 22 bp, Homo sapiens
acacaagcttttttacacaaat

SEQ ID NO: 2642259 - DNA, 14 bp, Homo sapiens
acacaagtaaacat

SEQ ID NO: 2642260 - DNA, 14 bp, Homo sapiens
acacacacacacac

SEQ ID NO: 2642261 - DNA, 15 bp, Homo sapiens
acacacacacacagc

SEQ ID NO: 2642262 - DNA, 17 bp, Homo sapiens
acacacacacacatgca

SEQ ID NO: 2642263 - DNA, 14 bp, Homo sapiens
acacacacaggagg

SEQ ID NO: 2642264 - DNA, 11 bp, Homo sapiens
acacacacatg

SEQ ID NO: 2642265 - DNA, 13 bp, Homo sapiens
acacacacatgca

SEQ ID NO: 2642266 - DNA, 15 bp, Homo sapiens
acacacacatgcata

SEQ ID NO: 2642267 - DNA, 16 bp, Homo sapiens
acacacacatgcatac

SEQ ID NO: 2642268 - DNA, 22 bp, Homo sapiens
acacacacgcgtgcacacacca

SEQ ID NO: 2642269 - DNA, 13 bp, Homo sapiens
acacacagaaaat

SEQ ID NO: 2642270 - DNA, 15 bp, Homo sapiens
acacacagaaaatat

SEQ ID NO: 2642271 - DNA, 21 bp, Homo sapiens
acacacagaaaatatactgta

SEQ ID NO: 2642272 - DNA, 12 bp, Homo sapiens
acacacagccac

SEQ ID NO: 2642273 - DNA, 20 bp, Homo sapiens
acacacagctaacacacagc

SEQ ID NO: 2642274 - DNA, 11 bp, Homo sapiens
acacacagctc

SEQ ID NO: 2642275 - DNA, 14 bp, Homo sapiens
acacacagctctgt

SEQ ID NO: 2642276 - DNA, 21 bp, Homo sapiens
acacacatataaacatcacac

SEQ ID NO: 2642277 - DNA, 15 bp, Homo sapiens
acacaccagagccca

SEQ ID NO: 2642278 - DNA, 18 bp, Homo sapiens
acacaccaggctgtgggc

SEQ ID NO: 2642279 - DNA, 22 bp, Homo sapiens
acacacctaagggacatgtttt

SEQ ID NO: 2642280 - DNA, 24 bp, Homo sapiens
acacacctgtagtcccagctactc

SEQ ID NO: 2642281 - DNA, 15 bp, Homo sapiens
acacactcaaatcaa

SEQ ID NO: 2642282 - DNA, 12 bp, Homo sapiens
acacagaaaata

SEQ ID NO: 2642283 - DNA, 14 bp, Homo sapiens
acacagaaaatata

SEQ ID NO: 2642284 - DNA, 18 bp, Homo sapiens
acacagaaaatatactgt

SEQ ID NO: 2642285 - DNA, 23 bp, Homo sapiens
acacagacattctgccaggcccc

SEQ ID NO: 2642286 - DNA, 12 bp, Homo sapiens
acacagaggaag

SEQ ID NO: 2642287 - DNA, 13 bp, Homo sapiens
acacagaggaaga

SEQ ID NO: 2642288 - DNA, 17 bp, Homo sapiens
acacagaggaagagcag

SEQ ID NO: 2642289 - DNA, 16 bp, Homo sapiens
acacagatgaaacaca

SEQ ID NO: 2642290 - DNA, 11 bp, Homo sapiens
acacagccaca

SEQ ID NO: 2642291 - DNA, 15 bp, Homo sapiens
acacagccacacaca

SEQ ID NO: 2642292 - DNA, 19 bp, Homo sapiens
acacagccacacacacaga

SEQ ID NO: 2642293 - DNA, 12 bp, Homo sapiens
acacagctctgt

SEQ ID NO: 2642294 - DNA, 14 bp, Homo sapiens
acacagctctgtcc

SEQ ID NO: 2642295 - DNA, 16 bp, Homo sapiens
acacagctcttctcca

SEQ ID NO: 2642296 - DNA, 18 bp, Homo sapiens
acacagctcttctccagg

SEQ ID NO: 2642297 - DNA, 21 bp, Homo sapiens
acacagctcttctccaggctg

SEQ ID NO: 2642298 - DNA, 12 bp, Homo sapiens
acacagctgggc

SEQ ID NO: 2642299 - DNA, 15 bp, Homo sapiens
acacagctgggctgt

SEQ ID NO: 2642300 - DNA, 17 bp, Homo sapiens
acacaggacccccttcc

SEQ ID NO: 2642301 - DNA, 20 bp, Homo sapiens
acacaggacccccttcccct

SEQ ID NO: 2642302 - DNA, 20 bp, Homo sapiens
acacaggcaactgaggcaga

SEQ ID NO: 2642303 - DNA, 16 bp, Homo sapiens
acacagtattacttct

SEQ ID NO: 2642304 - DNA, 19 bp, Homo sapiens
acacagtattacttctgct

SEQ ID NO: 2642305 - DNA, 23 bp, Homo sapiens
acacagtctcacccagactccag

SEQ ID NO: 2642306 - DNA, 11 bp, Homo sapiens
acacagtgagt

SEQ ID NO: 2642307 - DNA, 20 bp, Homo sapiens
acacagtgccttcaataaat

SEQ ID NO: 2642308 - DNA, 20 bp, Homo sapiens
acacagtgggtggtggatct

SEQ ID NO: 2642309 - DNA, 16 bp, Homo sapiens
acacatatgtcatata

SEQ ID NO: 2642310 - DNA, 15 bp, Homo sapiens
acacatcagcttgcc

SEQ ID NO: 2642311 - DNA, 12 bp, Homo sapiens
acacatcagtca

SEQ ID NO: 2642312 - DNA, 15 bp, Homo sapiens
acacatcttcaacag

SEQ ID NO: 2642313 - DNA, 15 bp, Homo sapiens
acacatcttccctag

SEQ ID NO: 2642314 - DNA, 16 bp, Homo sapiens
acacatgcatacacac

SEQ ID NO: 2642315 - DNA, 17 bp, Homo sapiens
acacatgcatacacaca

SEQ ID NO: 2642316 - DNA, 23 bp, Homo sapiens
acacattatcgggagcagtgtct

SEQ ID NO: 2642317 - DNA, 16 bp, Homo sapiens
acacattttttaaatg

SEQ ID NO: 2642318 - DNA, 18 bp, Homo sapiens
acacattttttaaatgca

SEQ ID NO: 2642319 - DNA, 16 bp, Homo sapiens
acaccaagcagcaaca

SEQ ID NO: 2642320 - DNA, 13 bp, Homo sapiens
acaccacagacac

SEQ ID NO: 2642321 - DNA, 14 bp, Homo sapiens
acaccacagacaca

SEQ ID NO: 2642322 - DNA, 17 bp, Homo sapiens
acaccacagacacacac

SEQ ID NO: 2642323 - DNA, 14 bp, Homo sapiens
acaccactacattc

SEQ ID NO: 2642324 - DNA, 19 bp, Homo sapiens
acaccagagcagatgcaga

SEQ ID NO: 2642325 - DNA, 22 bp, Homo sapiens
acaccagagcagatgcagagag

SEQ ID NO: 2642326 - DNA, 12 bp, Homo sapiens
acaccaggccgt

SEQ ID NO: 2642327 - DNA, 21 bp, Homo sapiens
acaccaggccgtcctcccggg

SEQ ID NO: 2642328 - DNA, 14 bp, Homo sapiens
acaccaggctgtgg

SEQ ID NO: 2642329 - DNA, 18 bp, Homo sapiens
acaccaggctgtgggcct

SEQ ID NO: 2642330 - DNA, 21 bp, Homo sapiens
acaccaggcttgcctgcaggc

SEQ ID NO: 2642331 - DNA, 14 bp, Homo sapiens
acaccatcttttgt

SEQ ID NO: 2642332 - DNA, 12 bp, Homo sapiens
acacccagccca

SEQ ID NO: 2642333 - DNA, 21 bp, Homo sapiens
acacccagcccacttctgcca

SEQ ID NO: 2642334 - DNA, 15 bp, Homo sapiens
acacccatctgtttt

SEQ ID NO: 2642335 - DNA, 16 bp, Homo sapiens
acacccctcccctgcc

SEQ ID NO: 2642336 - DNA, 23 bp, Homo sapiens
acacccctcccctgccctagagc

SEQ ID NO: 2642337 - DNA, 18 bp, Homo sapiens
acaccccttatccaggac

SEQ ID NO: 2642338 - DNA, 19 bp, Homo sapiens
acaccccttatccaggact

SEQ ID NO: 2642339 - DNA, 17 bp, Homo sapiens
acacccgactcctcaaa

SEQ ID NO: 2642340 - DNA, 16 bp, Homo sapiens
acaccctcacactggg

SEQ ID NO: 2642341 - DNA, 12 bp, Homo sapiens
acaccctctccc

SEQ ID NO: 2642342 - DNA, 13 bp, Homo sapiens
acaccctctccca

SEQ ID NO: 2642343 - DNA, 16 bp, Homo sapiens
acaccctctcccagga

SEQ ID NO: 2642344 - DNA, 21 bp, Homo sapiens
acacctactctatcagagaaa

SEQ ID NO: 2642345 - DNA, 15 bp, Homo sapiens
acacctagcatctca

SEQ ID NO: 2642346 - DNA, 18 bp, Homo sapiens
acacctagctttattctt

SEQ ID NO: 2642347 - DNA, 21 bp, Homo sapiens
acacctagctttattcttcag

SEQ ID NO: 2642348 - DNA, 22 bp, Homo sapiens
acacctagctttattcttcaga

SEQ ID NO: 2642349 - DNA, 18 bp, Homo sapiens
acacctcagttcccttgg

SEQ ID NO: 2642350 - DNA, 22 bp, Homo sapiens
acacctcagttcccttggcctc

SEQ ID NO: 2642351 - DNA, 20 bp, Homo sapiens
acacctccacagttcagtgg

SEQ ID NO: 2642352 - DNA, 13 bp, Homo sapiens
acacctcccagga

SEQ ID NO: 2642353 - DNA, 16 bp, Homo sapiens
acacctccctgaacca

SEQ ID NO: 2642354 - DNA, 22 bp, Homo sapiens
acacctccctgaaccatccctg

SEQ ID NO: 2642355 - DNA, 21 bp, Homo sapiens
acacctctgcacaagctgcac

SEQ ID NO: 2642356 - DNA, 19 bp, Homo sapiens
acaggttacaacagatttg

SEQ ID NO: 2642357 - DNA, 20 bp, Homo sapiens
acaggttacaacagatttgt

SEQ ID NO: 2642358 - DNA, 21 bp, Homo sapiens
acaggttacaacagatttgtg

SEQ ID NO: 2642359 - DNA, 23 bp, Homo sapiens
acaggttacaacagatttgtgaa

SEQ ID NO: 2642360 - DNA, 23 bp, Homo sapiens
acaggttattttagtttctgttc

SEQ ID NO: 2642361 - DNA, 14 bp, Homo sapiens
acaggttttataat

SEQ ID NO: 2642362 - DNA, 17 bp, Homo sapiens
acagtaacgcaggggaa

SEQ ID NO: 2642363 - DNA, 19 bp, Homo sapiens
acagtaacgcaggggaaac

SEQ ID NO: 2642364 - DNA, 16 bp, Homo sapiens
acagtaactttatgtg

SEQ ID NO: 2642365 - DNA, 18 bp, Homo sapiens
acagtaactttatgtgta

SEQ ID NO: 2642366 - DNA, 19 bp, Homo sapiens
acagtaactttatgtgtaa

SEQ ID NO: 2642367 - DNA, 12 bp, Homo sapiens
acagtacaggca

SEQ ID NO: 2642368 - DNA, 17 bp, Homo sapiens
acagtatgtcccatagg

SEQ ID NO: 2642369 - DNA, 15 bp, Homo sapiens
acagtattacttctg

SEQ ID NO: 2642370 - DNA, 18 bp, Homo sapiens
acagtcaaaacagagatg

SEQ ID NO: 2642371 - DNA, 14 bp, Homo sapiens
acagtcatttaaaa

SEQ ID NO: 2642372 - DNA, 13 bp, Homo sapiens
acagtccctgcca

SEQ ID NO: 2642373 - DNA, 21 bp, Homo sapiens
acagtcctgggagaacctcag

SEQ ID NO: 2642374 - DNA, 19 bp, Homo sapiens
acagtctctttaatcttca

SEQ ID NO: 2642375 - DNA, 20 bp, Homo sapiens
acagtctgatcgtgacgctg

SEQ ID NO: 2642376 - DNA, 14 bp, Homo sapiens
acagtcttccattt

SEQ ID NO: 2642377 - DNA, 15 bp, Homo sapiens
acagtcttgcagcag

SEQ ID NO: 2642378 - DNA, 18 bp, Homo sapiens
acagtcttgtattaagtt

SEQ ID NO: 2642379 - DNA, 22 bp, Homo sapiens
acagtcttgtattaagttgtta

SEQ ID NO: 2642380 - DNA, 13 bp, Homo sapiens
acagtgagccaag

SEQ ID NO: 2642381 - DNA, 12 bp, Homo sapiens
acagtgagcctg

SEQ ID NO: 2642382 - DNA, 17 bp, Homo sapiens
acagtgagcctgaattt

SEQ ID NO: 2642383 - DNA, 18 bp, Homo sapiens
acagtgagcctgaatttt

SEQ ID NO: 2642384 - DNA, 23 bp, Homo sapiens
acagtgagcttggaaaggaccag

SEQ ID NO: 2642385 - DNA, 23 bp, Homo sapiens
acagtgagtcgaggacagggagg

SEQ ID NO: 2642386 - DNA, 19 bp, Homo sapiens
acagtgatctccatatgtt

SEQ ID NO: 2642387 - DNA, 21 bp, Homo sapiens
acagtgatctccatatgttac

SEQ ID NO: 2642388 - DNA, 19 bp, Homo sapiens
acagtgattaccagggact

SEQ ID NO: 2642389 - DNA, 14 bp, Homo sapiens
acagtgcctgggaa

SEQ ID NO: 2642390 - DNA, 20 bp, Homo sapiens
acagtgcctgggaatgtatt

SEQ ID NO: 2642391 - DNA, 21 bp, Homo sapiens
acagtgccttcaataaatggt

SEQ ID NO: 2642392 - DNA, 16 bp, Homo sapiens
acagtgctaaaaatgg

SEQ ID NO: 2642393 - DNA, 14 bp, Homo sapiens
acagtgctgtctga

SEQ ID NO: 2642394 - DNA, 23 bp, Homo sapiens
acagtgctgtctgatctgtgctt

SEQ ID NO: 2642395 - DNA, 17 bp, Homo sapiens
acagtgcttcagcctga

SEQ ID NO: 2642396 - DNA, 20 bp, Homo sapiens
acagtgcttcagcctgaggc

SEQ ID NO: 2642397 - DNA, 14 bp, Homo sapiens
acagtgggaaatat

SEQ ID NO: 2642398 - DNA, 15 bp, Homo sapiens
acagtgggaaatatt

SEQ ID NO: 2642399 - DNA, 13 bp, Homo sapiens
acagtgggagcca

SEQ ID NO: 2642400 - DNA, 17 bp, Homo sapiens
acagtgggagccagggc

SEQ ID NO: 2642401 - DNA, 15 bp, Homo sapiens
acagtggtggcaggg

SEQ ID NO: 2642402 - DNA, 16 bp, Homo sapiens
acagtggtggcagggc

SEQ ID NO: 2642403 - DNA, 12 bp, Homo sapiens
acagtgtgaagt

SEQ ID NO: 2642404 - DNA, 14 bp, Homo sapiens
acagtgttaaatga

SEQ ID NO: 2642405 - DNA, 20 bp, Homo sapiens
acagtgttattttctttgaa

SEQ ID NO: 2642406 - DNA, 22 bp, Homo sapiens
acagtgttattttctttgaaat

SEQ ID NO: 2642407 - DNA, 16 bp, Homo sapiens
acagtgtttcccataa

SEQ ID NO: 2642408 - DNA, 22 bp, Homo sapiens
acagtgtttcccataattttct

SEQ ID NO: 2642409 - DNA, 17 bp, Homo sapiens
acagtgtttgcaatggt

SEQ ID NO: 2642410 - DNA, 16 bp, Homo sapiens
acagtgtttttgtaaa

SEQ ID NO: 2642411 - DNA, 20 bp, Homo sapiens
acagtgtttttgtaaagtgt

SEQ ID NO: 2642412 - DNA, 22 bp, Homo sapiens
acagttagggttgagttacttc

SEQ ID NO: 2642413 - DNA, 24 bp, Homo sapiens
acagttcttcgggaagagaggagt

SEQ ID NO: 2642414 - DNA, 20 bp, Homo sapiens
acagttgaaaaacagctgag

SEQ ID NO: 2642415 - DNA, 15 bp, Homo sapiens
acagttgctgtcata

SEQ ID NO: 2642416 - DNA, 21 bp, Homo sapiens
acagttgctgtcataagaatg

SEQ ID NO: 2642417 - DNA, 11 bp, Homo sapiens
acagttgtttg

SEQ ID NO: 2642418 - DNA, 12 bp, Homo sapiens
acagttgtttga

SEQ ID NO: 2642419 - DNA, 20 bp, Homo sapiens
acagtttaataccacagctt

SEQ ID NO: 2642420 - DNA, 14 bp, Homo sapiens
acagtttgctctag

SEQ ID NO: 2642421 - DNA, 16 bp, Homo sapiens
acagtttgttagtatg

SEQ ID NO: 2642422 - DNA, 15 bp, Homo sapiens
acagttttccatgaa

SEQ ID NO: 2642423 - DNA, 19 bp, Homo sapiens
acagttttctgagaaagac

SEQ ID NO: 2642424 - DNA, 20 bp, Homo sapiens
acagttttctgagaaagact

SEQ ID NO: 2642425 - DNA, 23 bp, Homo sapiens
acagttttgtcagtctttcttag

SEQ ID NO: 2642426 - DNA, 15 bp, Homo sapiens
acagtttttattgct

SEQ ID NO: 2642427 - DNA, 13 bp, Homo sapiens
acataaactgact

SEQ ID NO: 2642428 - DNA, 15 bp, Homo sapiens
acataaactgacttt

SEQ ID NO: 2642429 - DNA, 21 bp, Homo sapiens
acataaaggtggtatgtgtgt

SEQ ID NO: 2642430 - DNA, 21 bp, Homo sapiens
acataacgtttttcctttaaa

SEQ ID NO: 2642431 - DNA, 23 bp, Homo sapiens
acataacgtttttcctttaaaaa

SEQ ID NO: 2642432 - DNA, 20 bp, Homo sapiens
acataactgaaaatgtgcta

SEQ ID NO: 2642433 - DNA, 22 bp, Homo sapiens
acataatgcgtgcataccactt

SEQ ID NO: 2642434 - DNA, 23 bp, Homo sapiens
acataatgcgtgcataccacttt

SEQ ID NO: 2642435 - DNA, 12 bp, Homo sapiens
acataatttttt

SEQ ID NO: 2642436 - DNA, 16 bp, Homo sapiens
acatacaattccaaac

SEQ ID NO: 2642437 - DNA, 20 bp, Homo sapiens
acatacaggaaggtagaaat

SEQ ID NO: 2642438 - DNA, 20 bp, Homo sapiens
acataccctggccgccccct

SEQ ID NO: 2642439 - DNA, 13 bp, Homo sapiens
acatactaaccag

SEQ ID NO: 2642440 - DNA, 14 bp, Homo sapiens
acatactctgctta

SEQ ID NO: 2642441 - DNA, 18 bp, Homo sapiens
acatactggcctggactg

SEQ ID NO: 2642442 - DNA, 17 bp, Homo sapiens
acatagcctatatttac

SEQ ID NO: 2642443 - DNA, 19 bp, Homo sapiens
acatagcctatatttacag

SEQ ID NO: 2642444 - DNA, 22 bp, Homo sapiens
acatagcttgataaagggccaa

SEQ ID NO: 2642445 - DNA, 20 bp, Homo sapiens
acatataaacatcacacaca

SEQ ID NO: 2642446 - DNA, 21 bp, Homo sapiens
acatataaagcactatacaga

SEQ ID NO: 2642447 - DNA, 21 bp, Homo sapiens
acatatgagtgtggaagccgg

SEQ ID NO: 2642448 - DNA, 18 bp, Homo sapiens
acatatgcaccttgtgtc

SEQ ID NO: 2642449 - DNA, 19 bp, Homo sapiens
acatatgcaccttgtgtct

SEQ ID NO: 2642450 - DNA, 23 bp, Homo sapiens
acatatggactctgcacatgaat

SEQ ID NO: 2642451 - DNA, 13 bp, Homo sapiens
acatatgtaaaat

SEQ ID NO: 2642452 - DNA, 23 bp, Homo sapiens
acatattgatttccgttaaaata

SEQ ID NO: 2642453 - DNA, 16 bp, Homo sapiens
acatatttgtggaata

SEQ ID NO: 2642454 - DNA, 14 bp, Homo sapiens
acatatttgttaaa

SEQ ID NO: 2642455 - DNA, 16 bp, Homo sapiens
acatattttatagaac

SEQ ID NO: 2642456 - DNA, 16 bp, Homo sapiens
acatcaacatcttggt

SEQ ID NO: 2642457 - DNA, 21 bp, Homo sapiens
acatcaccgacgcgtctcctg

SEQ ID NO: 2642458 - DNA, 15 bp, Homo sapiens
acatcagcacgattt

SEQ ID NO: 2642459 - DNA, 21 bp, Homo sapiens
acatcagcacgatttctgttt

SEQ ID NO: 2642460 - DNA, 22 bp, Homo sapiens
acatcagctggtcaaacaaact

SEQ ID NO: 2642461 - DNA, 14 bp, Homo sapiens
acatcaggagttca

SEQ ID NO: 2642462 - DNA, 18 bp, Homo sapiens
acatcagttactctgaag

SEQ ID NO: 2642463 - DNA, 19 bp, Homo sapiens
acatcatcaaggcactgcc

SEQ ID NO: 2642464 - DNA, 13 bp, Homo sapiens
acatccataaaga

SEQ ID NO: 2642465 - DNA, 15 bp, Homo sapiens
acatccataaagaag

SEQ ID NO: 2642466 - DNA, 20 bp, Homo sapiens
acatccatgtttgtaaaact

SEQ ID NO: 2642467 - DNA, 16 bp, Homo sapiens
acatcccatgtaacag

SEQ ID NO: 2642468 - DNA, 14 bp, Homo sapiens
acatccccaccctt

SEQ ID NO: 2642469 - DNA, 14 bp, Homo sapiens
acatcctccgtcca

SEQ ID NO: 2642470 - DNA, 20 bp, Homo sapiens
acatcgtgaaaccctgtctc

SEQ ID NO: 2642471 - DNA, 19 bp, Homo sapiens
acatctcaggggccagagg

SEQ ID NO: 2642472 - DNA, 20 bp, Homo sapiens
acatctcaggggccagagga

SEQ ID NO: 2642473 - DNA, 17 bp, Homo sapiens
acatctctttgaatttt

SEQ ID NO: 2642474 - DNA, 20 bp, Homo sapiens
acatctctttgatgtcatat

SEQ ID NO: 2642475 - DNA, 17 bp, Homo sapiens
acatctgtgtttcaagt

SEQ ID NO: 2642476 - DNA, 16 bp, Homo sapiens
acatcttgctctgctg

SEQ ID NO: 2642477 - DNA, 19 bp, Homo sapiens
acatcttttttcacaaatt

SEQ ID NO: 2642478 - DNA, 17 bp, Homo sapiens
acatgaaaacacatttt

SEQ ID NO: 2642479 - DNA, 19 bp, Homo sapiens
acatgaaaacacatttttc

SEQ ID NO: 2642480 - DNA, 13 bp, Homo sapiens
acatgaaacagaa

SEQ ID NO: 2642481 - DNA, 21 bp, Homo sapiens
acatgaagtgtgtttccttca

SEQ ID NO: 2642482 - DNA, 21 bp, Homo sapiens
acatgaatcccacccacatgt

SEQ ID NO: 2642483 - DNA, 19 bp, Homo sapiens
acatgagcatcaggccagg

SEQ ID NO: 2642484 - DNA, 22 bp, Homo sapiens
acatgagctatttccattccag

SEQ ID NO: 2642485 - DNA, 16 bp, Homo sapiens
acatgaggtactgaga

SEQ ID NO: 2642486 - DNA, 13 bp, Homo sapiens
acatgagtcccag

SEQ ID NO: 2642487 - DNA, 18 bp, Homo sapiens
acatgagtcccagtggga

SEQ ID NO: 2642488 - DNA, 17 bp, Homo sapiens
acatgatcttctttata

SEQ ID NO: 2642489 - DNA, 19 bp, Homo sapiens
acatgatcttctttataat

SEQ ID NO: 2642490 - DNA, 21 bp, Homo sapiens
acatgcaatttattaaaatga

SEQ ID NO: 2642491 - DNA, 17 bp, Homo sapiens
acatgcagcccatgccc

SEQ ID NO: 2642492 - DNA, 12 bp, Homo sapiens
acatgcatacac

SEQ ID NO: 2642493 - DNA, 17 bp, Homo sapiens
acatgcatacttcaaaa

SEQ ID NO: 2642494 - DNA, 15 bp, Homo sapiens
acatgctacacactg

SEQ ID NO: 2642495 - DNA, 13 bp, Homo sapiens
acatgctttgtga

SEQ ID NO: 2642496 - DNA, 20 bp, Homo sapiens
acatggaataacatgtaatt

SEQ ID NO: 2642497 - DNA, 22 bp, Homo sapiens
acatggacccggagctaacact

SEQ ID NO: 2642498 - DNA, 23 bp, Homo sapiens
acatggacttgtatatttgtaca

SEQ ID NO: 2642499 - DNA, 21 bp, Homo sapiens
accctgaatttggcctgcact

SEQ ID NO: 2642500 - DNA, 23 bp, Homo sapiens
accctgagctgaggcagcagtgt

SEQ ID NO: 2642501 - DNA, 14 bp, Homo sapiens
accctgaggcccag

SEQ ID NO: 2642502 - DNA, 21 bp, Homo sapiens
accctgaggcccagagggcct

SEQ ID NO: 2642503 - DNA, 15 bp, Homo sapiens
accctgcccctgccc

SEQ ID NO: 2642504 - DNA, 12 bp, Homo sapiens
accctgccctgt

SEQ ID NO: 2642505 - DNA, 19 bp, Homo sapiens
accctgcgaaggggccctg

SEQ ID NO: 2642506 - DNA, 15 bp, Homo sapiens
accctgcgtggggac

SEQ ID NO: 2642507 - DNA, 23 bp, Homo sapiens
accctggcactataatgtaagct

SEQ ID NO: 2642508 - DNA, 16 bp, Homo sapiens
accctggccgccccct

SEQ ID NO: 2642509 - DNA, 23 bp, Homo sapiens
accctgggacctaggggcgccgc

SEQ ID NO: 2642510 - DNA, 21 bp, Homo sapiens
accctgggctctgggagcagc

SEQ ID NO: 2642511 - DNA, 19 bp, Homo sapiens
accctggggcctggacctg

SEQ ID NO: 2642512 - DNA, 22 bp, Homo sapiens
accctgtactgttctgtgtctt

SEQ ID NO: 2642513 - DNA, 19 bp, Homo sapiens
accctgtccaaactgccta

SEQ ID NO: 2642514 - DNA, 14 bp, Homo sapiens
accctgtcccccag

SEQ ID NO: 2642515 - DNA, 22 bp, Homo sapiens
accctgtctgtagagggccctg

SEQ ID NO: 2642516 - DNA, 22 bp, Homo sapiens
acccttcccctccttctccctt

SEQ ID NO: 2642517 - DNA, 13 bp, Homo sapiens
acccttgaaaaga

SEQ ID NO: 2642518 - DNA, 16 bp, Homo sapiens
acccttgaaaagacat

SEQ ID NO: 2642519 - DNA, 20 bp, Homo sapiens
acccttgccgtctacctgag

SEQ ID NO: 2642520 - DNA, 21 bp, Homo sapiens
acccttggaggctgtcttctc

SEQ ID NO: 2642521 - DNA, 17 bp, Homo sapiens
acccttggcctgtctca

SEQ ID NO: 2642522 - DNA, 15 bp, Homo sapiens
acccttgtggtccca

SEQ ID NO: 2642523 - DNA, 20 bp, Homo sapiens
acccttgtggtcccacccca

SEQ ID NO: 2642524 - DNA, 12 bp, Homo sapiens
accctttggggg

SEQ ID NO: 2642525 - DNA, 23 bp, Homo sapiens
accctttggggggggcccgcctg

SEQ ID NO: 2642526 - DNA, 17 bp, Homo sapiens
accctttttctccagct

SEQ ID NO: 2642527 - DNA, 23 bp, Homo sapiens
accgaagtggactggcccctggg

SEQ ID NO: 2642528 - DNA, 23 bp, Homo sapiens
accgacctggtttttaaatagag

SEQ ID NO: 2642529 - DNA, 18 bp, Homo sapiens
accgacgcgtctcctgtt

SEQ ID NO: 2642530 - DNA, 18 bp, Homo sapiens
accgacgttgccatcaaa

SEQ ID NO: 2642531 - DNA, 15 bp, Homo sapiens
accgagcaaagatca

SEQ ID NO: 2642532 - DNA, 15 bp, Homo sapiens
accgaggacatgaaa

SEQ ID NO: 2642533 - DNA, 22 bp, Homo sapiens
accgattcatctctcagaaggg

SEQ ID NO: 2642534 - DNA, 12 bp, Homo sapiens
accgcagacagg

SEQ ID NO: 2642535 - DNA, 12 bp, Homo sapiens
accgccccctcc

SEQ ID NO: 2642536 - DNA, 12 bp, Homo sapiens
accgccttctct

SEQ ID NO: 2642537 - DNA, 14 bp, Homo sapiens
accgctccccagcc

SEQ ID NO: 2642538 - DNA, 14 bp, Homo sapiens
accggctggcctgg

SEQ ID NO: 2642539 - DNA, 19 bp, Homo sapiens
accggctggcctggcccct

SEQ ID NO: 2642540 - DNA, 20 bp, Homo sapiens
accgggcactcagaagacac

SEQ ID NO: 2642541 - DNA, 22 bp, Homo sapiens
accggggagcccccgccccgcc

SEQ ID NO: 2642542 - DNA, 17 bp, Homo sapiens
accgtaataattattat

SEQ ID NO: 2642543 - DNA, 18 bp, Homo sapiens
accgtgagcgacaaagat

SEQ ID NO: 2642544 - DNA, 18 bp, Homo sapiens
accgtggaccttcctgcc

SEQ ID NO: 2642545 - DNA, 18 bp, Homo sapiens
accgttggggattgggga

SEQ ID NO: 2642546 - DNA, 14 bp, Homo sapiens
accgtttcttccct

SEQ ID NO: 2642547 - DNA, 22 bp, Homo sapiens
acctaaaaggaaatctcacccc

SEQ ID NO: 2642548 - DNA, 21 bp, Homo sapiens
acctaaaatttgccctcccat

SEQ ID NO: 2642549 - DNA, 21 bp, Homo sapiens
acctaactcacctaactcata

SEQ ID NO: 2642550 - DNA, 16 bp, Homo sapiens
acctaagggacatgtt

SEQ ID NO: 2642551 - DNA, 23 bp, Homo sapiens
acctaagggacatgttttgataa

SEQ ID NO: 2642552 - DNA, 18 bp, Homo sapiens
acctaagtcctttatgtg

SEQ ID NO: 2642553 - DNA, 22 bp, Homo sapiens
acctacaccattatcttggaaa

SEQ ID NO: 2642554 - DNA, 16 bp, Homo sapiens
acctacagtgtacagt

SEQ ID NO: 2642555 - DNA, 20 bp, Homo sapiens
acctacagtgtacagtcttg

SEQ ID NO: 2642556 - DNA, 15 bp, Homo sapiens
acctaccacagtgtc

SEQ ID NO: 2642557 - DNA, 16 bp, Homo sapiens
acctaccacagtgtct

SEQ ID NO: 2642558 - DNA, 12 bp, Homo sapiens
acctaccacatg

SEQ ID NO: 2642559 - DNA, 13 bp, Homo sapiens
acctagccttaga

SEQ ID NO: 2642560 - DNA, 17 bp, Homo sapiens
acctagggaggacctta

SEQ ID NO: 2642561 - DNA, 15 bp, Homo sapiens
acctaggggcgccgc

SEQ ID NO: 2642562 - DNA, 18 bp, Homo sapiens
acctataaaacaggtcaa

SEQ ID NO: 2642563 - DNA, 16 bp, Homo sapiens
acctataaagtaaagc

SEQ ID NO: 2642564 - DNA, 16 bp, Homo sapiens
acctatagtcccagct

SEQ ID NO: 2642565 - DNA, 22 bp, Homo sapiens
acctatagtcccagctactcag

SEQ ID NO: 2642566 - DNA, 19 bp, Homo sapiens
acctatgatattttctgtg

SEQ ID NO: 2642567 - DNA, 17 bp, Homo sapiens
acctatgtcctaaggac

SEQ ID NO: 2642568 - DNA, 19 bp, Homo sapiens
acctatgtcctaaggacac

SEQ ID NO: 2642569 - DNA, 14 bp, Homo sapiens
acctatttgacata

SEQ ID NO: 2642570 - DNA, 20 bp, Homo sapiens
acctattttgaaaaattcct

SEQ ID NO: 2642571 - DNA, 10 bp, Homo sapiens
acctcaaggg

SEQ ID NO: 2642572 - DNA, 18 bp, Homo sapiens
acctcacagaaatgagat

SEQ ID NO: 2642573 - DNA, 14 bp, Homo sapiens
acctcaccctgcta

SEQ ID NO: 2642574 - DNA, 22 bp, Homo sapiens
acctcacgcacctcccatccta

SEQ ID NO: 2642575 - DNA, 13 bp, Homo sapiens
acctcactcctgt

SEQ ID NO: 2642576 - DNA, 22 bp, Homo sapiens
acctcagaggctgttcttgggg

SEQ ID NO: 2642577 - DNA, 19 bp, Homo sapiens
acctcagagtccaggcccc

SEQ ID NO: 2642578 - DNA, 10 bp, Homo sapiens
acctcagcct

SEQ ID NO: 2642579 - DNA, 12 bp, Homo sapiens
acctcagcctgt

SEQ ID NO: 2642580 - DNA, 21 bp, Homo sapiens
acctcaggtgatccacccacc

SEQ ID NO: 2642581 - DNA, 14 bp, Homo sapiens
acctcaggttgctg

SEQ ID NO: 2642582 - DNA, 15 bp, Homo sapiens
acctcaggttgctgg

SEQ ID NO: 2642583 - DNA, 19 bp, Homo sapiens
acctcaggttgctggttgc

SEQ ID NO: 2642584 - DNA, 17 bp, Homo sapiens
acctcagttcccttggc

SEQ ID NO: 2642585 - DNA, 18 bp, Homo sapiens
acctcagttcccttggcc

SEQ ID NO: 2642586 - DNA, 19 bp, Homo sapiens
acctcagttcccttggcct

SEQ ID NO: 2642587 - DNA, 17 bp, Homo sapiens
acctcagttttatcatt

SEQ ID NO: 2642588 - DNA, 15 bp, Homo sapiens
acctcatcaggatga

SEQ ID NO: 2642589 - DNA, 20 bp, Homo sapiens
acctcatcaggatgaaccca

SEQ ID NO: 2642590 - DNA, 20 bp, Homo sapiens
acctccaaaactcctgcccc

SEQ ID NO: 2642591 - DNA, 13 bp, Homo sapiens
acctccacagctt

SEQ ID NO: 2642592 - DNA, 15 bp, Homo sapiens
acctccacagcttcc

SEQ ID NO: 2642593 - DNA, 20 bp, Homo sapiens
acctccacagttcagtggca

SEQ ID NO: 2642594 - DNA, 16 bp, Homo sapiens
acctccacatcctcca

SEQ ID NO: 2642595 - DNA, 14 bp, Homo sapiens
acctcccagcccta

SEQ ID NO: 2642596 - DNA, 15 bp, Homo sapiens
acctcccagccctat

SEQ ID NO: 2642597 - DNA, 19 bp, Homo sapiens
acctcccagccctatggat

SEQ ID NO: 2642598 - DNA, 21 bp, Homo sapiens
acctcccagccctatggatgt

SEQ ID NO: 2642599 - DNA, 15 bp, Homo sapiens
acctcccatcctaat

SEQ ID NO: 2642600 - DNA, 20 bp, Homo sapiens
acctccccctcccccttctc

SEQ ID NO: 2642601 - DNA, 17 bp, Homo sapiens
acctcccctccttgcct

SEQ ID NO: 2642602 - DNA, 15 bp, Homo sapiens
acctcccctgaggct

SEQ ID NO: 2642603 - DNA, 14 bp, Homo sapiens
acctccctgaacca

SEQ ID NO: 2642604 - DNA, 20 bp, Homo sapiens
acctccgcctcttgggttca

SEQ ID NO: 2642605 - DNA, 11 bp, Homo sapiens
acctcctctgt

SEQ ID NO: 2642606 - DNA, 12 bp, Homo sapiens
acctcctctgtg

SEQ ID NO: 2642607 - DNA, 17 bp, Homo sapiens
acctcctgtctctggcc

SEQ ID NO: 2642608 - DNA, 12 bp, Homo sapiens
acctccttctct

SEQ ID NO: 2642609 - DNA, 23 bp, Homo sapiens
acctccttctctgtctcatgtgt

SEQ ID NO: 2642610 - DNA, 14 bp, Homo sapiens
acctcgctggactc

SEQ ID NO: 2642611 - DNA, 10 bp, Homo sapiens
acctctccaa

SEQ ID NO: 2642612 - DNA, 20 bp, Homo sapiens
acctctccatcttcagcttc

SEQ ID NO: 2642613 - DNA, 13 bp, Homo sapiens
acctctcccaggg

SEQ ID NO: 2642614 - DNA, 15 bp, Homo sapiens
acctctccctcaaca

SEQ ID NO: 2642615 - DNA, 22 bp, Homo sapiens
acctctcttatagaatatttat

SEQ ID NO: 2642616 - DNA, 13 bp, Homo sapiens
acctctgatacct

SEQ ID NO: 2642617 - DNA, 12 bp, Homo sapiens
acctctgcacaa

SEQ ID NO: 2642618 - DNA, 16 bp, Homo sapiens
acctctgcacaagctg

SEQ ID NO: 2642619 - DNA, 20 bp, Homo sapiens
acctctgcctgaagtcacac

SEQ ID NO: 2642620 - DNA, 23 bp, Homo sapiens
acctctgcctgaagtcacacagt

SEQ ID NO: 2642621 - DNA, 23 bp, Homo sapiens
acctctgctctgaggcttccaga

SEQ ID NO: 2642622 - DNA, 23 bp, Homo sapiens
acctctggactggctagagtcct

SEQ ID NO: 2642623 - DNA, 11 bp, Homo sapiens
acctctgtgtg

SEQ ID NO: 2642624 - DNA, 14 bp, Homo sapiens
acctctgttcagtg

SEQ ID NO: 2642625 - DNA, 18 bp, Homo sapiens
acctctgttcagtgtaaa

SEQ ID NO: 2642626 - DNA, 20 bp, Homo sapiens
acctctgttgtcctcccctt

SEQ ID NO: 2642627 - DNA, 22 bp, Homo sapiens
acctctgttgtcctccccttgg

SEQ ID NO: 2642628 - DNA, 21 bp, Homo sapiens
acctcttaaagaaaacccacc

SEQ ID NO: 2642629 - DNA, 22 bp, Homo sapiens
acctcttaaagaaaacccaccc

SEQ ID NO: 2642630 - DNA, 14 bp, Homo sapiens
acctcttagctgag

SEQ ID NO: 2642631 - DNA, 15 bp, Homo sapiens
acctcttcagaggcc

SEQ ID NO: 2642632 - DNA, 18 bp, Homo sapiens
acctcttcagaggccctc

SEQ ID NO: 2642633 - DNA, 19 bp, Homo sapiens
acctcttccggagatgtag

SEQ ID NO: 2642634 - DNA, 17 bp, Homo sapiens
acctcttgagccttgaa

SEQ ID NO: 2642635 - DNA, 19 bp, Homo sapiens
acctcttgagccttgaact

SEQ ID NO: 2642636 - DNA, 21 bp, Homo sapiens
acctcttgagccttgaacttt

SEQ ID NO: 2642637 - DNA, 15 bp, Homo sapiens
acctgaaaaaaagtt

SEQ ID NO: 2642638 - DNA, 18 bp, Homo sapiens
acctgaaaaaaagtttac

SEQ ID NO: 2642639 - DNA, 19 bp, Homo sapiens
acctgaaaaaaagtttaca

SEQ ID NO: 2642640 - DNA, 11 bp, Homo sapiens
acctgaaaaca

SEQ ID NO: 2642641 - DNA, 13 bp, Homo sapiens
acctgaagttcac

SEQ ID NO: 2642642 - DNA, 17 bp, Homo sapiens
acctgacactcccttgg

SEQ ID NO: 2642643 - DNA, 12 bp, Homo sapiens
acctgacagatg

SEQ ID NO: 2642644 - DNA, 13 bp, Homo sapiens
actataatgtaag

SEQ ID NO: 2642645 - DNA, 21 bp, Homo sapiens
actataatgtaagctctactg

SEQ ID NO: 2642646 - DNA, 14 bp, Homo sapiens
actatagcccaggt

SEQ ID NO: 2642647 - DNA, 14 bp, Homo sapiens
actatatctgtata

SEQ ID NO: 2642648 - DNA, 18 bp, Homo sapiens
actatattatcatgcaaa

SEQ ID NO: 2642649 - DNA, 19 bp, Homo sapiens
actatcaaactgaagccag

SEQ ID NO: 2642650 - DNA, 22 bp, Homo sapiens
actatcagtttgtcctgtagag

SEQ ID NO: 2642651 - DNA, 18 bp, Homo sapiens
actatgaactacaaagct

SEQ ID NO: 2642652 - DNA, 16 bp, Homo sapiens
actatggtatttgagt

SEQ ID NO: 2642653 - DNA, 21 bp, Homo sapiens
actatggtgccaatggaacct

SEQ ID NO: 2642654 - DNA, 14 bp, Homo sapiens
actattcaaacagt

SEQ ID NO: 2642655 - DNA, 18 bp, Homo sapiens
actattcaaacagtctca

SEQ ID NO: 2642656 - DNA, 15 bp, Homo sapiens
actattctgattaca

SEQ ID NO: 2642657 - DNA, 21 bp, Homo sapiens
actattctgattacacaaaac

SEQ ID NO: 2642658 - DNA, 23 bp, Homo sapiens
actattctgattacacaaaacaa

SEQ ID NO: 2642659 - DNA, 19 bp, Homo sapiens
actattggagggtgggaga

SEQ ID NO: 2642660 - DNA, 20 bp, Homo sapiens
actatttaaagcctcctcat

SEQ ID NO: 2642661 - DNA, 12 bp, Homo sapiens
actatttttact

SEQ ID NO: 2642662 - DNA, 15 bp, Homo sapiens
actcaaaatatttgt

SEQ ID NO: 2642663 - DNA, 17 bp, Homo sapiens
actcaaaatatttgtac

SEQ ID NO: 2642664 - DNA, 20 bp, Homo sapiens
actcaaaccaaatcactgaa

SEQ ID NO: 2642665 - DNA, 17 bp, Homo sapiens
actcaaactcttaaaac

SEQ ID NO: 2642666 - DNA, 14 bp, Homo sapiens
actcaaactgagga

SEQ ID NO: 2642667 - DNA, 21 bp, Homo sapiens
actcaaatgctcagaccagct

SEQ ID NO: 2642668 - DNA, 22 bp, Homo sapiens
actcaaatgcttggcttctcat

SEQ ID NO: 2642669 - DNA, 19 bp, Homo sapiens
actcaaattaatctttctt

SEQ ID NO: 2642670 - DNA, 19 bp, Homo sapiens
actcaacatgagtcaagag

SEQ ID NO: 2642671 - DNA, 17 bp, Homo sapiens
actcaacatgttactga

SEQ ID NO: 2642672 - DNA, 22 bp, Homo sapiens
actcaacatgttactgaccagc

SEQ ID NO: 2642673 - DNA, 15 bp, Homo sapiens
actcaaccctctcag

SEQ ID NO: 2642674 - DNA, 19 bp, Homo sapiens
actcaagaagcaggctaca

SEQ ID NO: 2642675 - DNA, 14 bp, Homo sapiens
actcaagaggctga

SEQ ID NO: 2642676 - DNA, 14 bp, Homo sapiens
actcaagccaagca

SEQ ID NO: 2642677 - DNA, 17 bp, Homo sapiens
actcaagccaagcagcc

SEQ ID NO: 2642678 - DNA, 22 bp, Homo sapiens
actcaagccaagcagccaagct

SEQ ID NO: 2642679 - DNA, 15 bp, Homo sapiens
actcaataaaatcat

SEQ ID NO: 2642680 - DNA, 12 bp, Homo sapiens
actcaatatttt

SEQ ID NO: 2642681 - DNA, 15 bp, Homo sapiens
actcaatattttcca

SEQ ID NO: 2642682 - DNA, 18 bp, Homo sapiens
actcaatattttccatga

SEQ ID NO: 2642683 - DNA, 23 bp, Homo sapiens
actcaatctccccttgcactaaa

SEQ ID NO: 2642684 - DNA, 14 bp, Homo sapiens
actcaatgagctct

SEQ ID NO: 2642685 - DNA, 21 bp, Homo sapiens
actcaatgttactatctgctt

SEQ ID NO: 2642686 - DNA, 16 bp, Homo sapiens
actcaatttctcccca

SEQ ID NO: 2642687 - DNA, 21 bp, Homo sapiens
actcacaagaagaccagactg

SEQ ID NO: 2642688 - DNA, 14 bp, Homo sapiens
actcacagacctgg

SEQ ID NO: 2642689 - DNA, 22 bp, Homo sapiens
actcacagacctggagcccctg

SEQ ID NO: 2642690 - DNA, 23 bp, Homo sapiens
actcacagacctggagcccctgg

SEQ ID NO: 2642691 - DNA, 16 bp, Homo sapiens
actcacatggctatgt

SEQ ID NO: 2642692 - DNA, 14 bp, Homo sapiens
actcaccccagccc

SEQ ID NO: 2642693 - DNA, 15 bp, Homo sapiens
actcaccccagcccc

SEQ ID NO: 2642694 - DNA, 16 bp, Homo sapiens
actcacctaatgttta

SEQ ID NO: 2642695 - DNA, 23 bp, Homo sapiens
actcacctaatgtttatgagcca

SEQ ID NO: 2642696 - DNA, 17 bp, Homo sapiens
actcacctgctggcccc

SEQ ID NO: 2642697 - DNA, 18 bp, Homo sapiens
actcacctggggctgctg

SEQ ID NO: 2642698 - DNA, 19 bp, Homo sapiens
actcacctggggctgctgg

SEQ ID NO: 2642699 - DNA, 16 bp, Homo sapiens
actcactcctgagacc

SEQ ID NO: 2642700 - DNA, 15 bp, Homo sapiens
actcactgctcaaga

SEQ ID NO: 2642701 - DNA, 15 bp, Homo sapiens
actcactttctagat

SEQ ID NO: 2642702 - DNA, 14 bp, Homo sapiens
actcagaaattttt

SEQ ID NO: 2642703 - DNA, 14 bp, Homo sapiens
actcagaagacact

SEQ ID NO: 2642704 - DNA, 18 bp, Homo sapiens
actcagaagacactgatg

SEQ ID NO: 2642705 - DNA, 14 bp, Homo sapiens
actcagaagcctga

SEQ ID NO: 2642706 - DNA, 14 bp, Homo sapiens
actcagaattctct

SEQ ID NO: 2642707 - DNA, 22 bp, Homo sapiens
actcagaattctctagtttgat

SEQ ID NO: 2642708 - DNA, 12 bp, Homo sapiens
actcagacctga

SEQ ID NO: 2642709 - DNA, 18 bp, Homo sapiens
actcagatcactactgca

SEQ ID NO: 2642710 - DNA, 16 bp, Homo sapiens
actcagatctgtctga

SEQ ID NO: 2642711 - DNA, 21 bp, Homo sapiens
actcagatggaaccgcaggaa

SEQ ID NO: 2642712 - DNA, 22 bp, Homo sapiens
actcagatgtctctggcgtgtg

SEQ ID NO: 2642713 - DNA, 14 bp, Homo sapiens
actcagccaagcac

SEQ ID NO: 2642714 - DNA, 16 bp, Homo sapiens
actcagccaagcacag

SEQ ID NO: 2642715 - DNA, 15 bp, Homo sapiens
actcagctccccaga

SEQ ID NO: 2642716 - DNA, 22 bp, Homo sapiens
actcagctcttggctccactgg

SEQ ID NO: 2642717 - DNA, 16 bp, Homo sapiens
actcaggaggctgagg

SEQ ID NO: 2642718 - DNA, 19 bp, Homo sapiens
actcaggaggctgaggcag

SEQ ID NO: 2642719 - DNA, 18 bp, Homo sapiens
actcaggatccagtccct

SEQ ID NO: 2642720 - DNA, 15 bp, Homo sapiens
actcaggatgcccag

SEQ ID NO: 2642721 - DNA, 18 bp, Homo sapiens
actcagggccatgcctgc

SEQ ID NO: 2642722 - DNA, 13 bp, Homo sapiens
actcagggcccca

SEQ ID NO: 2642723 - DNA, 22 bp, Homo sapiens
actcagggccccagcactaaag

SEQ ID NO: 2642724 - DNA, 20 bp, Homo sapiens
actcaggttgtagtaaagaa

SEQ ID NO: 2642725 - DNA, 19 bp, Homo sapiens
actcagtccatagcagaga

SEQ ID NO: 2642726 - DNA, 19 bp, Homo sapiens
actcagtttgtcagacttt

SEQ ID NO: 2642727 - DNA, 23 bp, Homo sapiens
actcatactgtgctggagccact

SEQ ID NO: 2642728 - DNA, 13 bp, Homo sapiens
actcatcataaaa

SEQ ID NO: 2642729 - DNA, 14 bp, Homo sapiens
actcatgagaagtt

SEQ ID NO: 2642730 - DNA, 21 bp, Homo sapiens
actcatgatcttgtgacatat

SEQ ID NO: 2642731 - DNA, 13 bp, Homo sapiens
actcattcctgta

SEQ ID NO: 2642732 - DNA, 15 bp, Homo sapiens
actcattctgaagga

SEQ ID NO: 2642733 - DNA, 15 bp, Homo sapiens
actcattgacctgag

SEQ ID NO: 2642734 - DNA, 17 bp, Homo sapiens
actcattgacctgaggc

SEQ ID NO: 2642735 - DNA, 16 bp, Homo sapiens
actcatttcctatgta

SEQ ID NO: 2642736 - DNA, 21 bp, Homo sapiens
actccaaagaaatgtaaggga

SEQ ID NO: 2642737 - DNA, 19 bp, Homo sapiens
actccaagatatggacaca

SEQ ID NO: 2642738 - DNA, 20 bp, Homo sapiens
actccagcctgagcaacaga

SEQ ID NO: 2642739 - DNA, 23 bp, Homo sapiens
actccagcctgggcaacagagca

SEQ ID NO: 2642740 - DNA, 15 bp, Homo sapiens
actccagcctgggcg

SEQ ID NO: 2642741 - DNA, 20 bp, Homo sapiens
actccagctgggttggaaaa

SEQ ID NO: 2642742 - DNA, 14 bp, Homo sapiens
actccatcagctta

SEQ ID NO: 2642743 - DNA, 17 bp, Homo sapiens
actccatgagaagccgt

SEQ ID NO: 2642744 - DNA, 22 bp, Homo sapiens
actcccagtccaaatgtcctcc

SEQ ID NO: 2642745 - DNA, 22 bp, Homo sapiens
actcccatctgtgaaaggaaag

SEQ ID NO: 2642746 - DNA, 12 bp, Homo sapiens
actcccctgcac

SEQ ID NO: 2642747 - DNA, 16 bp, Homo sapiens
actcccctgcactgga

SEQ ID NO: 2642748 - DNA, 15 bp, Homo sapiens
actccctcctcacct

SEQ ID NO: 2642749 - DNA, 19 bp, Homo sapiens
actccctcctcacctctgg

SEQ ID NO: 2642750 - DNA, 20 bp, Homo sapiens
actccctcctcacctctgga

SEQ ID NO: 2642751 - DNA, 18 bp, Homo sapiens
actcccttctacctgcca

SEQ ID NO: 2642752 - DNA, 21 bp, Homo sapiens
actcccttctacctgccactc

SEQ ID NO: 2642753 - DNA, 21 bp, Homo sapiens
actcccttggtggcaagagcc

SEQ ID NO: 2642754 - DNA, 18 bp, Homo sapiens
actccggagtgagaagct

SEQ ID NO: 2642755 - DNA, 13 bp, Homo sapiens
actccggccctcc

SEQ ID NO: 2642756 - DNA, 16 bp, Homo sapiens
actccgtctcaaggaa

SEQ ID NO: 2642757 - DNA, 16 bp, Homo sapiens
actcctacacctaact

SEQ ID NO: 2642758 - DNA, 16 bp, Homo sapiens
actcctacctcagcct

SEQ ID NO: 2642759 - DNA, 16 bp, Homo sapiens
actcctaggaaaatac

SEQ ID NO: 2642760 - DNA, 20 bp, Homo sapiens
actcctaggcaggacatgct

SEQ ID NO: 2642761 - DNA, 20 bp, Homo sapiens
actcctcaaaagcaaatgag

SEQ ID NO: 2642762 - DNA, 14 bp, Homo sapiens
actcctctgactca

SEQ ID NO: 2642763 - DNA, 20 bp, Homo sapiens
actcctctgcagtgccttgg

SEQ ID NO: 2642764 - DNA, 15 bp, Homo sapiens
actcctgacagtctt

SEQ ID NO: 2642765 - DNA, 15 bp, Homo sapiens
actcctgacctcaag

SEQ ID NO: 2642766 - DNA, 17 bp, Homo sapiens
actcctgagacccctgg

SEQ ID NO: 2642767 - DNA, 15 bp, Homo sapiens
actcctgcaggcagc

SEQ ID NO: 2642768 - DNA, 17 bp, Homo sapiens
actcctgcaggcagcca

SEQ ID NO: 2642769 - DNA, 19 bp, Homo sapiens
actcctgcaggcagccagg

SEQ ID NO: 2642770 - DNA, 22 bp, Homo sapiens
actcctgccctgttgtgtatag

SEQ ID NO: 2642771 - DNA, 13 bp, Homo sapiens
actcctgtacact

SEQ ID NO: 2642772 - DNA, 17 bp, Homo sapiens
actcctgtacactgaat

SEQ ID NO: 2642773 - DNA, 18 bp, Homo sapiens
actcctgtacactgaata

SEQ ID NO: 2642774 - DNA, 16 bp, Homo sapiens
actcctgttacttacc

SEQ ID NO: 2642775 - DNA, 20 bp, Homo sapiens
actcctgttacttacctaaa

SEQ ID NO: 2642776 - DNA, 24 bp, Homo sapiens
actccttgaaaacactgttctctg

SEQ ID NO: 2642777 - DNA, 21 bp, Homo sapiens
actccttgtggtttatgtcat

SEQ ID NO: 2642778 - DNA, 16 bp, Homo sapiens
actcgagaccttttca

SEQ ID NO: 2642779 - DNA, 23 bp, Homo sapiens
actcgagaccttttcaacttggc

SEQ ID NO: 2642780 - DNA, 21 bp, Homo sapiens
actcgaggactgtatttgtga

SEQ ID NO: 2642781 - DNA, 19 bp, Homo sapiens
actcgcccgcccactgtcc

SEQ ID NO: 2642782 - DNA, 16 bp, Homo sapiens
actcggcaccctgcaa

SEQ ID NO: 2642783 - DNA, 14 bp, Homo sapiens
actcgtatatgtct

SEQ ID NO: 2642784 - DNA, 16 bp, Homo sapiens
actctacactgtgaac

SEQ ID NO: 2642785 - DNA, 14 bp, Homo sapiens
actctaccagactg

SEQ ID NO: 2642786 - DNA, 19 bp, Homo sapiens
actctaccagactgtgtat

SEQ ID NO: 2642787 - DNA, 17 bp, Homo sapiens
actctacccatattaca

SEQ ID NO: 2642788 - DNA, 13 bp, Homo sapiens
acttaaagattta

SEQ ID NO: 2642789 - DNA, 17 bp, Homo sapiens
acttaaaggctgtggta

SEQ ID NO: 2642790 - DNA, 19 bp, Homo sapiens
acttaaataaatgtcatta

SEQ ID NO: 2642791 - DNA, 14 bp, Homo sapiens
acttaaataatgtg

SEQ ID NO: 2642792 - DNA, 15 bp, Homo sapiens
acttaaataatgtga

SEQ ID NO: 2642793 - DNA, 17 bp, Homo sapiens
acttaaataatgtgaaa

SEQ ID NO: 2642794 - DNA, 17 bp, Homo sapiens
acttaaattttaattta

SEQ ID NO: 2642795 - DNA, 13 bp, Homo sapiens
acttaataaattc

SEQ ID NO: 2642796 - DNA, 17 bp, Homo sapiens
acttaataaattcagat

SEQ ID NO: 2642797 - DNA, 13 bp, Homo sapiens
acttaataatgtg

SEQ ID NO: 2642798 - DNA, 14 bp, Homo sapiens
acttaatagaaaca

SEQ ID NO: 2642799 - DNA, 15 bp, Homo sapiens
acttaatagaaacat

SEQ ID NO: 2642800 - DNA, 16 bp, Homo sapiens
acttaatctaaatgga

SEQ ID NO: 2642801 - DNA, 21 bp, Homo sapiens
acttaatttctttatgtaatc

SEQ ID NO: 2642802 - DNA, 16 bp, Homo sapiens
acttacactttatgca

SEQ ID NO: 2642803 - DNA, 15 bp, Homo sapiens
acttaccttcaataa

SEQ ID NO: 2642804 - DNA, 17 bp, Homo sapiens
acttaccttcaataaag

SEQ ID NO: 2642805 - DNA, 19 bp, Homo sapiens
acttaccttcaataaagta

SEQ ID NO: 2642806 - DNA, 22 bp, Homo sapiens
acttactgtacatgaaaacaca

SEQ ID NO: 2642807 - DNA, 24 bp, Homo sapiens
acttactgttgtcctatgggagtc

SEQ ID NO: 2642808 - DNA, 16 bp, Homo sapiens
acttactgtttctgtc

SEQ ID NO: 2642809 - DNA, 20 bp, Homo sapiens
acttactgtttctgtcagga

SEQ ID NO: 2642810 - DNA, 16 bp, Homo sapiens
acttacttaccctcac

SEQ ID NO: 2642811 - DNA, 15 bp, Homo sapiens
acttaggtgtggggg

SEQ ID NO: 2642812 - DNA, 17 bp, Homo sapiens
acttagtatattttctt

SEQ ID NO: 2642813 - DNA, 20 bp, Homo sapiens
acttagtgcggacaagtttt

SEQ ID NO: 2642814 - DNA, 17 bp, Homo sapiens
acttatattgtaagaaa

SEQ ID NO: 2642815 - DNA, 18 bp, Homo sapiens
acttatattgtaagaaat

SEQ ID NO: 2642816 - DNA, 19 bp, Homo sapiens
acttatattgtaagaaata

SEQ ID NO: 2642817 - DNA, 21 bp, Homo sapiens
acttatattgtaagaaatact

SEQ ID NO: 2642818 - DNA, 22 bp, Homo sapiens
acttatcatccacattgtttta

SEQ ID NO: 2642819 - DNA, 19 bp, Homo sapiens
acttatcctaaaacaaata

SEQ ID NO: 2642820 - DNA, 16 bp, Homo sapiens
acttatctctctgtgc

SEQ ID NO: 2642821 - DNA, 22 bp, Homo sapiens
acttatctctctgtgctgtgga

SEQ ID NO: 2642822 - DNA, 14 bp, Homo sapiens
acttatcttatgcc

SEQ ID NO: 2642823 - DNA, 22 bp, Homo sapiens
acttattaatctgtatgaagat

SEQ ID NO: 2642824 - DNA, 16 bp, Homo sapiens
acttattctcaagaag

SEQ ID NO: 2642825 - DNA, 15 bp, Homo sapiens
acttatttatataaa

SEQ ID NO: 2642826 - DNA, 14 bp, Homo sapiens
acttatttttgaca

SEQ ID NO: 2642827 - DNA, 18 bp, Homo sapiens
acttcaaaagtattttcc

SEQ ID NO: 2642828 - DNA, 19 bp, Homo sapiens
acttcaacatttacatgta

SEQ ID NO: 2642829 - DNA, 16 bp, Homo sapiens
acttcaagttaaagtg

SEQ ID NO: 2642830 - DNA, 17 bp, Homo sapiens
acttcacacacaggcaa

SEQ ID NO: 2642831 - DNA, 18 bp, Homo sapiens
acttcacagagtgtgctg

SEQ ID NO: 2642832 - DNA, 19 bp, Homo sapiens
acttcacagagtgtgctgg

SEQ ID NO: 2642833 - DNA, 17 bp, Homo sapiens
acttcattaataataaa

SEQ ID NO: 2642834 - DNA, 21 bp, Homo sapiens
acttcattgagagttttgtct

SEQ ID NO: 2642835 - DNA, 19 bp, Homo sapiens
acttccaaatcccctaagc

SEQ ID NO: 2642836 - DNA, 18 bp, Homo sapiens
acttccaatttacatact

SEQ ID NO: 2642837 - DNA, 14 bp, Homo sapiens
acttccaccagcct

SEQ ID NO: 2642838 - DNA, 15 bp, Homo sapiens
acttccaccagcctg

SEQ ID NO: 2642839 - DNA, 17 bp, Homo sapiens
acttccatggccctcat

SEQ ID NO: 2642840 - DNA, 20 bp, Homo sapiens
acttccatggccctcattaa

SEQ ID NO: 2642841 - DNA, 14 bp, Homo sapiens
acttccctgggcaa

SEQ ID NO: 2642842 - DNA, 13 bp, Homo sapiens
acttcctgtccag

SEQ ID NO: 2642843 - DNA, 14 bp, Homo sapiens
acttcctgtccaga

SEQ ID NO: 2642844 - DNA, 19 bp, Homo sapiens
acttcgactcaggatccag

SEQ ID NO: 2642845 - DNA, 17 bp, Homo sapiens
acttcgcatcaaaagac

SEQ ID NO: 2642846 - DNA, 23 bp, Homo sapiens
acttcgcatcaaaagacaattct

SEQ ID NO: 2642847 - DNA, 24 bp, Homo sapiens
acttcgcatcaaaagacaattctt

SEQ ID NO: 2642848 - DNA, 20 bp, Homo sapiens
acttcgggaggtcgaggcag

SEQ ID NO: 2642849 - DNA, 22 bp, Homo sapiens
acttcgggaggtcgaggcagga

SEQ ID NO: 2642850 - DNA, 18 bp, Homo sapiens
acttcgtcttctaatttc

SEQ ID NO: 2642851 - DNA, 13 bp, Homo sapiens
acttcgtgggatc

SEQ ID NO: 2642852 - DNA, 21 bp, Homo sapiens
acttctaagtaaaaccacagc

SEQ ID NO: 2642853 - DNA, 11 bp, Homo sapiens
acttctaatat

SEQ ID NO: 2642854 - DNA, 22 bp, Homo sapiens
acttctaatatatttttatatt

SEQ ID NO: 2642855 - DNA, 18 bp, Homo sapiens
acttctccaccctgctct

SEQ ID NO: 2642856 - DNA, 13 bp, Homo sapiens
acttctctgaagg

SEQ ID NO: 2642857 - DNA, 15 bp, Homo sapiens
acttctgaccacact

SEQ ID NO: 2642858 - DNA, 18 bp, Homo sapiens
acttctgccatattctgt

SEQ ID NO: 2642859 - DNA, 19 bp, Homo sapiens
acttctgccatattctgtt

SEQ ID NO: 2642860 - DNA, 13 bp, Homo sapiens
acttctgcctctt

SEQ ID NO: 2642861 - DNA, 13 bp, Homo sapiens
acttctggctcct

SEQ ID NO: 2642862 - DNA, 17 bp, Homo sapiens
acttctgggcttcatct

SEQ ID NO: 2642863 - DNA, 22 bp, Homo sapiens
acttctgtcttcacaacagatt

SEQ ID NO: 2642864 - DNA, 19 bp, Homo sapiens
acttctgtgagacccccac

SEQ ID NO: 2642865 - DNA, 23 bp, Homo sapiens
acttctgtgagacccccacacct

SEQ ID NO: 2642866 - DNA, 18 bp, Homo sapiens
acttcttatacatttgat

SEQ ID NO: 2642867 - DNA, 16 bp, Homo sapiens
acttcttcagagctga

SEQ ID NO: 2642868 - DNA, 15 bp, Homo sapiens
acttcttttataact

SEQ ID NO: 2642869 - DNA, 14 bp, Homo sapiens
acttcttttcacat

SEQ ID NO: 2642870 - DNA, 19 bp, Homo sapiens
acttcttttgctcttagct

SEQ ID NO: 2642871 - DNA, 20 bp, Homo sapiens
acttcttttgctcttagctg

SEQ ID NO: 2642872 - DNA, 18 bp, Homo sapiens
acttgaaataccagtgaa

SEQ ID NO: 2642873 - DNA, 19 bp, Homo sapiens
acttgaacccgggaggcag

SEQ ID NO: 2642874 - DNA, 20 bp, Homo sapiens
acttgaacccgggaggcaga

SEQ ID NO: 2642875 - DNA, 23 bp, Homo sapiens
acttgaacccgggaggcagaggt

SEQ ID NO: 2642876 - DNA, 16 bp, Homo sapiens
acttgaatcaaagcag

SEQ ID NO: 2642877 - DNA, 18 bp, Homo sapiens
acttgacagaacactgtc

SEQ ID NO: 2642878 - DNA, 16 bp, Homo sapiens
acttgagaggatgaat

SEQ ID NO: 2642879 - DNA, 16 bp, Homo sapiens
acttgagggcccagag

SEQ ID NO: 2642880 - DNA, 20 bp, Homo sapiens
acttgagggcccagagcagg

SEQ ID NO: 2642881 - DNA, 21 bp, Homo sapiens
acttgagttttatttatttta

SEQ ID NO: 2642882 - DNA, 21 bp, Homo sapiens
acttgcaaccgtctgttatgc

SEQ ID NO: 2642883 - DNA, 19 bp, Homo sapiens
acttgcagactctacagag

SEQ ID NO: 2642884 - DNA, 22 bp, Homo sapiens
acttgcagactctacagaggcc

SEQ ID NO: 2642885 - DNA, 20 bp, Homo sapiens
acttgcagctgatgttggaa

SEQ ID NO: 2642886 - DNA, 13 bp, Homo sapiens
acttgcatctgtg

SEQ ID NO: 2642887 - DNA, 15 bp, Homo sapiens
acttgcatggagcag

SEQ ID NO: 2642888 - DNA, 23 bp, Homo sapiens
acttgccgcgtcgccctcccagg

SEQ ID NO: 2642889 - DNA, 20 bp, Homo sapiens
acttgccttcttcacccagc

SEQ ID NO: 2642890 - DNA, 22 bp, Homo sapiens
acttgctgcagtatgaaaataa

SEQ ID NO: 2642891 - DNA, 22 bp, Homo sapiens
acttggaaaaatccagaaagaa

SEQ ID NO: 2642892 - DNA, 23 bp, Homo sapiens
acttggaatttgtaacctcagct

SEQ ID NO: 2642893 - DNA, 14 bp, Homo sapiens
acttggagccaagg

SEQ ID NO: 2642894 - DNA, 14 bp, Homo sapiens
acttggagccccag

SEQ ID NO: 2642895 - DNA, 11 bp, Homo sapiens
acttggagccg

SEQ ID NO: 2642896 - DNA, 16 bp, Homo sapiens
acttggcaacagaagc

SEQ ID NO: 2642897 - DNA, 13 bp, Homo sapiens
acttgggaatata

SEQ ID NO: 2642898 - DNA, 13 bp, Homo sapiens
acttgggacattg

SEQ ID NO: 2642899 - DNA, 15 bp, Homo sapiens
acttgggccactgtg

SEQ ID NO: 2642900 - DNA, 18 bp, Homo sapiens
acttgggccatagctcct

SEQ ID NO: 2642901 - DNA, 18 bp, Homo sapiens
acttggttgggtcctcac

SEQ ID NO: 2642902 - DNA, 15 bp, Homo sapiens
acttgtaaatacacc

SEQ ID NO: 2642903 - DNA, 14 bp, Homo sapiens
acttgtaaatgctg

SEQ ID NO: 2642904 - DNA, 18 bp, Homo sapiens
acttgtaaatgtggtaaa

SEQ ID NO: 2642905 - DNA, 14 bp, Homo sapiens
acttgtacaaaata

SEQ ID NO: 2642906 - DNA, 15 bp, Homo sapiens
acttgtatatttgta

SEQ ID NO: 2642907 - DNA, 19 bp, Homo sapiens
acttgtatatttgtacaaa

SEQ ID NO: 2642908 - DNA, 14 bp, Homo sapiens
acttgtatgaaaga

SEQ ID NO: 2642909 - DNA, 20 bp, Homo sapiens
acttgtcaatatttaaacat

SEQ ID NO: 2642910 - DNA, 17 bp, Homo sapiens
acttgtccccaaatccg

SEQ ID NO: 2642911 - DNA, 13 bp, Homo sapiens
acttgtgccaaca

SEQ ID NO: 2642912 - DNA, 14 bp, Homo sapiens
acttgtggacacag

SEQ ID NO: 2642913 - DNA, 17 bp, Homo sapiens
acttgtggacacagctc

SEQ ID NO: 2642914 - DNA, 14 bp, Homo sapiens
acttgtgtctctgt

SEQ ID NO: 2642915 - DNA, 21 bp, Homo sapiens
acttgtgtgtgggctgtgagt

SEQ ID NO: 2642916 - DNA, 22 bp, Homo sapiens
acttgtgtgtgggctgtgagtg

SEQ ID NO: 2642917 - DNA, 23 bp, Homo sapiens
acttgtgtgtgggctgtgagtgt

SEQ ID NO: 2642918 - DNA, 21 bp, Homo sapiens
acttgttcaaaatatgttctt

SEQ ID NO: 2642919 - DNA, 16 bp, Homo sapiens
acttgttccagctctt

SEQ ID NO: 2642920 - DNA, 13 bp, Homo sapiens
acttgtttccaat

SEQ ID NO: 2642921 - DNA, 15 bp, Homo sapiens
actttaaaataaaat

SEQ ID NO: 2642922 - DNA, 12 bp, Homo sapiens
actttaaaggaa

SEQ ID NO: 2642923 - DNA, 13 bp, Homo sapiens
actttaagcacta

SEQ ID NO: 2642924 - DNA, 23 bp, Homo sapiens
actttaagcagctcttgctaatc

SEQ ID NO: 2642925 - DNA, 18 bp, Homo sapiens
actttaagtttcaggata

SEQ ID NO: 2642926 - DNA, 20 bp, Homo sapiens
actttaattaccaacctgtt

SEQ ID NO: 2642927 - DNA, 23 bp, Homo sapiens
actttaattctcatgtgatcctt

SEQ ID NO: 2642928 - DNA, 23 bp, Homo sapiens
actttaccttttttatacataaa

SEQ ID NO: 2642929 - DNA, 15 bp, Homo sapiens
actttactaagatga

SEQ ID NO: 2642930 - DNA, 16 bp, Homo sapiens
actttactaagatgac

SEQ ID NO: 2642931 - DNA, 22 bp, Homo sapiens
actttactaagatgacattgct

SEQ ID NO: 2642932 - DNA, 23 bp, Homo sapiens
agaacctggagggctagaactgg

SEQ ID NO: 2642933 - DNA, 17 bp, Homo sapiens
agaacctggagttcctg

SEQ ID NO: 2642934 - DNA, 18 bp, Homo sapiens
agaacctggagttcctga

SEQ ID NO: 2642935 - DNA, 12 bp, Homo sapiens
agaacctgtcct

SEQ ID NO: 2642936 - DNA, 21 bp, Homo sapiens
agaacctgtccttgcacactc

SEQ ID NO: 2642937 - DNA, 17 bp, Homo sapiens
agaaccttgtgcctggc

SEQ ID NO: 2642938 - DNA, 13 bp, Homo sapiens
agaacgcagccct

SEQ ID NO: 2642939 - DNA, 23 bp, Homo sapiens
agaacgcagccctagagcctgcc

SEQ ID NO: 2642940 - DNA, 18 bp, Homo sapiens
agaactagaacctggagg

SEQ ID NO: 2642941 - DNA, 16 bp, Homo sapiens
agaactatatgtgaat

SEQ ID NO: 2642942 - DNA, 19 bp, Homo sapiens
agaactatatgtgaatcct

SEQ ID NO: 2642943 - DNA, 21 bp, Homo sapiens
agaactatatgtgaatcctct

SEQ ID NO: 2642944 - DNA, 14 bp, Homo sapiens
agaactcctagggt

SEQ ID NO: 2642945 - DNA, 23 bp, Homo sapiens
agaactctccatcttattttcat

SEQ ID NO: 2642946 - DNA, 20 bp, Homo sapiens
agaactctgggctgccatgt

SEQ ID NO: 2642947 - DNA, 20 bp, Homo sapiens
agaactctgggctgctaccc

SEQ ID NO: 2642948 - DNA, 15 bp, Homo sapiens
agaactgaatgagaa

SEQ ID NO: 2642949 - DNA, 12 bp, Homo sapiens
agaactgagctc

SEQ ID NO: 2642950 - DNA, 23 bp, Homo sapiens
agaactgctttctttcgtttgtt

SEQ ID NO: 2642951 - DNA, 15 bp, Homo sapiens
agaactggactcagg

SEQ ID NO: 2642952 - DNA, 13 bp, Homo sapiens
agaagaaactagg

SEQ ID NO: 2642953 - DNA, 13 bp, Homo sapiens
agaagaaggcagc

SEQ ID NO: 2642954 - DNA, 14 bp, Homo sapiens
agaagaagtgtgtc

SEQ ID NO: 2642955 - DNA, 16 bp, Homo sapiens
agaagacaccagagca

SEQ ID NO: 2642956 - DNA, 13 bp, Homo sapiens
agaagacactgat

SEQ ID NO: 2642957 - DNA, 12 bp, Homo sapiens
agaagacactgc

SEQ ID NO: 2642958 - DNA, 19 bp, Homo sapiens
agaagacatggagactcct

SEQ ID NO: 2642959 - DNA, 15 bp, Homo sapiens
agaagacatgtttta

SEQ ID NO: 2642960 - DNA, 16 bp, Homo sapiens
agaagacatgttttag

SEQ ID NO: 2642961 - DNA, 14 bp, Homo sapiens
agaagactctacca

SEQ ID NO: 2642962 - DNA, 18 bp, Homo sapiens
agaagagactctttgcat

SEQ ID NO: 2642963 - DNA, 22 bp, Homo sapiens
agaagagatgggcttgttttct

SEQ ID NO: 2642964 - DNA, 14 bp, Homo sapiens
agaagagggcctgt

SEQ ID NO: 2642965 - DNA, 16 bp, Homo sapiens
agaagagggcctgtgg

SEQ ID NO: 2642966 - DNA, 18 bp, Homo sapiens
agaagatcctaaaacaaa

SEQ ID NO: 2642967 - DNA, 14 bp, Homo sapiens
agaagatgaataca

SEQ ID NO: 2642968 - DNA, 19 bp, Homo sapiens
agaagatgaatacaaacaa

SEQ ID NO: 2642969 - DNA, 17 bp, Homo sapiens
agaagatgatcagacct

SEQ ID NO: 2642970 - DNA, 17 bp, Homo sapiens
agaagcaacagaaaaaa

SEQ ID NO: 2642971 - DNA, 19 bp, Homo sapiens
agaagcaacccaaatgttc

SEQ ID NO: 2642972 - DNA, 21 bp, Homo sapiens
agaagcaataaagaagagtgc

SEQ ID NO: 2642973 - DNA, 15 bp, Homo sapiens
agaagcagaaataca

SEQ ID NO: 2642974 - DNA, 16 bp, Homo sapiens
agaagcagaggaagga

SEQ ID NO: 2642975 - DNA, 13 bp, Homo sapiens
agaagcagatgag

SEQ ID NO: 2642976 - DNA, 15 bp, Homo sapiens
agaagcatacaactt

SEQ ID NO: 2642977 - DNA, 13 bp, Homo sapiens
agaagcatgaaaa

SEQ ID NO: 2642978 - DNA, 21 bp, Homo sapiens
agaagcattaacttctctgga

SEQ ID NO: 2642979 - DNA, 15 bp, Homo sapiens
agaagcattccttct

SEQ ID NO: 2642980 - DNA, 20 bp, Homo sapiens
agaagcattccttctttgat

SEQ ID NO: 2642981 - DNA, 12 bp, Homo sapiens
agaagccaggag

SEQ ID NO: 2642982 - DNA, 14 bp, Homo sapiens
agaagccattgtct

SEQ ID NO: 2642983 - DNA, 18 bp, Homo sapiens
agaagcccaatattataa

SEQ ID NO: 2642984 - DNA, 23 bp, Homo sapiens
agaagcccaggaaaggctccagg

SEQ ID NO: 2642985 - DNA, 15 bp, Homo sapiens
agaagccccttcccc

SEQ ID NO: 2642986 - DNA, 15 bp, Homo sapiens
agaagcctccccagc

SEQ ID NO: 2642987 - DNA, 16 bp, Homo sapiens
agaagcctctggctag

SEQ ID NO: 2642988 - DNA, 14 bp, Homo sapiens
agaagcgagcactg

SEQ ID NO: 2642989 - DNA, 15 bp, Homo sapiens
agaagcggctggcag

SEQ ID NO: 2642990 - DNA, 13 bp, Homo sapiens
agaagctggagga

SEQ ID NO: 2642991 - DNA, 14 bp, Homo sapiens
agaagctgttgtac

SEQ ID NO: 2642992 - DNA, 18 bp, Homo sapiens
agaagctgttgtacattt

SEQ ID NO: 2642993 - DNA, 21 bp, Homo sapiens
agaagctgttgtacatttatg

SEQ ID NO: 2642994 - DNA, 16 bp, Homo sapiens
agaagcttcagaagtt

SEQ ID NO: 2642995 - DNA, 17 bp, Homo sapiens
agaaggaagtgaagagg

SEQ ID NO: 2642996 - DNA, 22 bp, Homo sapiens
agaaggaattctaggcatccca

SEQ ID NO: 2642997 - DNA, 15 bp, Homo sapiens
agaaggaatttgagt

SEQ ID NO: 2642998 - DNA, 17 bp, Homo sapiens
agaaggagacagagctg

SEQ ID NO: 2642999 - DNA, 20 bp, Homo sapiens
agaaggagacagagctggtt

SEQ ID NO: 2643000 - DNA, 17 bp, Homo sapiens
agaaggatgtacatttc

SEQ ID NO: 2643001 - DNA, 15 bp, Homo sapiens
agaaggcagggaaag

SEQ ID NO: 2643002 - DNA, 17 bp, Homo sapiens
agaaggccaagaggctg

SEQ ID NO: 2643003 - DNA, 13 bp, Homo sapiens
agaagggctagaa

SEQ ID NO: 2643004 - DNA, 22 bp, Homo sapiens
agaagggttttccaccctggaa

SEQ ID NO: 2643005 - DNA, 14 bp, Homo sapiens
agaaggtccttaat

SEQ ID NO: 2643006 - DNA, 18 bp, Homo sapiens
agaaggtttcagaaagaa

SEQ ID NO: 2643007 - DNA, 14 bp, Homo sapiens
agaagtaacttact

SEQ ID NO: 2643008 - DNA, 16 bp, Homo sapiens
agaagtattataaatt

SEQ ID NO: 2643009 - DNA, 17 bp, Homo sapiens
agaagtcaaagtaaaac

SEQ ID NO: 2643010 - DNA, 22 bp, Homo sapiens
agaagtcagagagggtgacaag

SEQ ID NO: 2643011 - DNA, 19 bp, Homo sapiens
agaagtcttagatgtatat

SEQ ID NO: 2643012 - DNA, 12 bp, Homo sapiens
agaagtgacagg

SEQ ID NO: 2643013 - DNA, 16 bp, Homo sapiens
agaagtgacagggaag

SEQ ID NO: 2643014 - DNA, 19 bp, Homo sapiens
agaagtgacagggaagcta

SEQ ID NO: 2643015 - DNA, 16 bp, Homo sapiens
agaagtgcccctgctg

SEQ ID NO: 2643016 - DNA, 22 bp, Homo sapiens
agaagtgcccctgctgcctccc

SEQ ID NO: 2643017 - DNA, 20 bp, Homo sapiens
agaagtggggacagagcaga

SEQ ID NO: 2643018 - DNA, 12 bp, Homo sapiens
agaagtgtgatt

SEQ ID NO: 2643019 - DNA, 14 bp, Homo sapiens
agaagtgtgattgg

SEQ ID NO: 2643020 - DNA, 18 bp, Homo sapiens
agaagttgatatagaaca

SEQ ID NO: 2643021 - DNA, 17 bp, Homo sapiens
agaagtttaaggaatat

SEQ ID NO: 2643022 - DNA, 16 bp, Homo sapiens
agaagttttgtacaga

SEQ ID NO: 2643023 - DNA, 12 bp, Homo sapiens
agaagtttttgt

SEQ ID NO: 2643024 - DNA, 17 bp, Homo sapiens
agaagtttttgtactgt

SEQ ID NO: 2643025 - DNA, 20 bp, Homo sapiens
agaagtttttgtactgtaaa

SEQ ID NO: 2643026 - DNA, 22 bp, Homo sapiens
agaagtttttgtactgtaaaga

SEQ ID NO: 2643027 - DNA, 21 bp, Homo sapiens
agaataaagttctgagtgttt

SEQ ID NO: 2643028 - DNA, 16 bp, Homo sapiens
agaataagagaaagaa

SEQ ID NO: 2643029 - DNA, 21 bp, Homo sapiens
agaataagagaaagaaaatga

SEQ ID NO: 2643030 - DNA, 12 bp, Homo sapiens
agaataagttat

SEQ ID NO: 2643031 - DNA, 13 bp, Homo sapiens
agaataagttatt

SEQ ID NO: 2643032 - DNA, 14 bp, Homo sapiens
agaataagttattg

SEQ ID NO: 2643033 - DNA, 17 bp, Homo sapiens
agaataagttattgcag

SEQ ID NO: 2643034 - DNA, 20 bp, Homo sapiens
agaataatcacgctttcctg

SEQ ID NO: 2643035 - DNA, 13 bp, Homo sapiens
agaataatctttg

SEQ ID NO: 2643036 - DNA, 12 bp, Homo sapiens
agaatacagaaa

SEQ ID NO: 2643037 - DNA, 19 bp, Homo sapiens
agaatatcctacttctcca

SEQ ID NO: 2643038 - DNA, 21 bp, Homo sapiens
agaatattagctttactgttt

SEQ ID NO: 2643039 - DNA, 15 bp, Homo sapiens
agaatattcaggact

SEQ ID NO: 2643040 - DNA, 11 bp, Homo sapiens
agaatatttat

SEQ ID NO: 2643041 - DNA, 22 bp, Homo sapiens
agaatatttattacctctgata

SEQ ID NO: 2643042 - DNA, 21 bp, Homo sapiens
agaatcaaagcaatgcatttt

SEQ ID NO: 2643043 - DNA, 18 bp, Homo sapiens
agaatccctggcaaaggg

SEQ ID NO: 2643044 - DNA, 22 bp, Homo sapiens
agaatcctggccctctgtgttg

SEQ ID NO: 2643045 - DNA, 16 bp, Homo sapiens
agaatctggagagcta

SEQ ID NO: 2643046 - DNA, 19 bp, Homo sapiens
agaatctgtttcccagcag

SEQ ID NO: 2643047 - DNA, 12 bp, Homo sapiens
agaatgaaagag

SEQ ID NO: 2643048 - DNA, 15 bp, Homo sapiens
agaatgaaagctcct

SEQ ID NO: 2643049 - DNA, 18 bp, Homo sapiens
agaatgaaagggcccaga

SEQ ID NO: 2643050 - DNA, 16 bp, Homo sapiens
agaatgaaatactgtt

SEQ ID NO: 2643051 - DNA, 20 bp, Homo sapiens
agaatgaaatactgtttgag

SEQ ID NO: 2643052 - DNA, 16 bp, Homo sapiens
agaatgatttttagat

SEQ ID NO: 2643053 - DNA, 18 bp, Homo sapiens
agaatgctctttacttca

SEQ ID NO: 2643054 - DNA, 23 bp, Homo sapiens
agaatgtattgtaccttttaaca

SEQ ID NO: 2643055 - DNA, 16 bp, Homo sapiens
agaatgtcagtatgtg

SEQ ID NO: 2643056 - DNA, 17 bp, Homo sapiens
agaatgtgttttctgaa

SEQ ID NO: 2643057 - DNA, 15 bp, Homo sapiens
agaatgttgtattca

SEQ ID NO: 2643058 - DNA, 19 bp, Homo sapiens
agaattagtggcacttgct

SEQ ID NO: 2643059 - DNA, 20 bp, Homo sapiens
agaattataattagttcctc

SEQ ID NO: 2643060 - DNA, 13 bp, Homo sapiens
agaattatatagg

SEQ ID NO: 2643061 - DNA, 11 bp, Homo sapiens
agaattattta

SEQ ID NO: 2643062 - DNA, 19 bp, Homo sapiens
agaattccctctctctgac

SEQ ID NO: 2643063 - DNA, 20 bp, Homo sapiens
agaattctcagaatctcaaa

SEQ ID NO: 2643064 - DNA, 14 bp, Homo sapiens
agaattctctagtt

SEQ ID NO: 2643065 - DNA, 19 bp, Homo sapiens
agaattctctagtttgatt

SEQ ID NO: 2643066 - DNA, 13 bp, Homo sapiens
agaattctgctac

SEQ ID NO: 2643067 - DNA, 22 bp, Homo sapiens
agaattctgctacctcactggg

SEQ ID NO: 2643068 - DNA, 21 bp, Homo sapiens
agaattggctgaactcatgag

SEQ ID NO: 2643069 - DNA, 22 bp, Homo sapiens
agaattggctgaactcatgaga

SEQ ID NO: 2643070 - DNA, 15 bp, Homo sapiens
agaattgtatcattt

SEQ ID NO: 2643071 - DNA, 14 bp, Homo sapiens
agaatttagggaga

SEQ ID NO: 2643072 - DNA, 13 bp, Homo sapiens
agaatttattcaa

SEQ ID NO: 2643073 - DNA, 14 bp, Homo sapiens
agaatttattcaat

SEQ ID NO: 2643074 - DNA, 21 bp, Homo sapiens
agaattttaagtgctttgtaa

SEQ ID NO: 2643075 - DNA, 22 bp, Homo sapiens
agaattttaagtgctttgtaat

SEQ ID NO: 2643076 - DNA, 12 bp, Homo sapiens
agacaaatattt

SEQ ID NO: 2643077 - DNA, 16 bp, Homo sapiens
agacaaatcaaagcag

SEQ ID NO: 2643078 - DNA, 17 bp, Homo sapiens
agagctggtgtctgatt

SEQ ID NO: 2643079 - DNA, 22 bp, Homo sapiens
agagctggttgggaagacatgg

SEQ ID NO: 2643080 - DNA, 19 bp, Homo sapiens
agagctgtattaagccact

SEQ ID NO: 2643081 - DNA, 19 bp, Homo sapiens
agagctgttcacagccaga

SEQ ID NO: 2643082 - DNA, 20 bp, Homo sapiens
agagcttccctgactcattc

SEQ ID NO: 2643083 - DNA, 15 bp, Homo sapiens
agagcttctggcact

SEQ ID NO: 2643084 - DNA, 22 bp, Homo sapiens
agagctttcttcccgaacccca

SEQ ID NO: 2643085 - DNA, 17 bp, Homo sapiens
agaggaaaaaaatgact

SEQ ID NO: 2643086 - DNA, 19 bp, Homo sapiens
agaggaaaagtaaggtgca

SEQ ID NO: 2643087 - DNA, 20 bp, Homo sapiens
agaggaaatattgctggggt

SEQ ID NO: 2643088 - DNA, 15 bp, Homo sapiens
agaggaactgtccag

SEQ ID NO: 2643089 - DNA, 18 bp, Homo sapiens
agaggaactgtccagaga

SEQ ID NO: 2643090 - DNA, 22 bp, Homo sapiens
agaggaatcactcttgtggatg

SEQ ID NO: 2643091 - DNA, 13 bp, Homo sapiens
agaggaatgaagt

SEQ ID NO: 2643092 - DNA, 21 bp, Homo sapiens
agaggagagccagagaagtga

SEQ ID NO: 2643093 - DNA, 20 bp, Homo sapiens
agaggagcgggacctgtggc

SEQ ID NO: 2643094 - DNA, 21 bp, Homo sapiens
agaggagcgggacctgtggct

SEQ ID NO: 2643095 - DNA, 20 bp, Homo sapiens
agaggagtacaggtgaagca

SEQ ID NO: 2643096 - DNA, 12 bp, Homo sapiens
agaggagttcaa

SEQ ID NO: 2643097 - DNA, 15 bp, Homo sapiens
agaggagttcaatga

SEQ ID NO: 2643098 - DNA, 23 bp, Homo sapiens
agaggagttcaatgatctaggtt

SEQ ID NO: 2643099 - DNA, 21 bp, Homo sapiens
agaggatgaatgtatgtgcac

SEQ ID NO: 2643100 - DNA, 22 bp, Homo sapiens
agaggatgagagcccagaggta

SEQ ID NO: 2643101 - DNA, 14 bp, Homo sapiens
agaggatggccagt

SEQ ID NO: 2643102 - DNA, 16 bp, Homo sapiens
agaggatggccagtgt

SEQ ID NO: 2643103 - DNA, 18 bp, Homo sapiens
agaggatggccagtgtct

SEQ ID NO: 2643104 - DNA, 22 bp, Homo sapiens
agaggatggccagtgtctgtcc

SEQ ID NO: 2643105 - DNA, 20 bp, Homo sapiens
agaggatttttttctgagcg

SEQ ID NO: 2643106 - DNA, 20 bp, Homo sapiens
agaggcagaaaattgcacaa

SEQ ID NO: 2643107 - DNA, 14 bp, Homo sapiens
agaggcagagaaag

SEQ ID NO: 2643108 - DNA, 18 bp, Homo sapiens
agaggcagagaaagaaga

SEQ ID NO: 2643109 - DNA, 22 bp, Homo sapiens
agaggcagagaaagaagagaca

SEQ ID NO: 2643110 - DNA, 21 bp, Homo sapiens
agaggcagccccattctgcct

SEQ ID NO: 2643111 - DNA, 13 bp, Homo sapiens
agaggcagggtct

SEQ ID NO: 2643112 - DNA, 13 bp, Homo sapiens
agaggccaatgcc

SEQ ID NO: 2643113 - DNA, 23 bp, Homo sapiens
agaggccatggcagaataatctt

SEQ ID NO: 2643114 - DNA, 22 bp, Homo sapiens
agaggcctgaggatgagctgga

SEQ ID NO: 2643115 - DNA, 12 bp, Homo sapiens
agaggcctgccc

SEQ ID NO: 2643116 - DNA, 20 bp, Homo sapiens
agaggcgggccagccaggcg

SEQ ID NO: 2643117 - DNA, 19 bp, Homo sapiens
agaggctattattttcact

SEQ ID NO: 2643118 - DNA, 19 bp, Homo sapiens
agaggctgaaagaggccaa

SEQ ID NO: 2643119 - DNA, 13 bp, Homo sapiens
agaggctgaggac

SEQ ID NO: 2643120 - DNA, 22 bp, Homo sapiens
agaggctgcctctcccatcact

SEQ ID NO: 2643121 - DNA, 21 bp, Homo sapiens
agaggctggtgctgtggccag

SEQ ID NO: 2643122 - DNA, 15 bp, Homo sapiens
agagggaagaaaaga

SEQ ID NO: 2643123 - DNA, 23 bp, Homo sapiens
agagggaagaaaagagctttctt

SEQ ID NO: 2643124 - DNA, 21 bp, Homo sapiens
agagggacgcctgggggtgcc

SEQ ID NO: 2643125 - DNA, 19 bp, Homo sapiens
agagggagaagcatgaaaa

SEQ ID NO: 2643126 - DNA, 19 bp, Homo sapiens
agagggagaagggatggag

SEQ ID NO: 2643127 - DNA, 16 bp, Homo sapiens
agagggagggagggct

SEQ ID NO: 2643128 - DNA, 14 bp, Homo sapiens
agagggaggtgttt

SEQ ID NO: 2643129 - DNA, 15 bp, Homo sapiens
agagggagtgacaga

SEQ ID NO: 2643130 - DNA, 13 bp, Homo sapiens
agagggccctggt

SEQ ID NO: 2643131 - DNA, 13 bp, Homo sapiens
agagggcctgcaa

SEQ ID NO: 2643132 - DNA, 15 bp, Homo sapiens
agagggcctgtggga

SEQ ID NO: 2643133 - DNA, 22 bp, Homo sapiens
agaggggaaaccagtgtagcct

SEQ ID NO: 2643134 - DNA, 14 bp, Homo sapiens
agaggggcagccct

SEQ ID NO: 2643135 - DNA, 16 bp, Homo sapiens
agaggggcagcccttg

SEQ ID NO: 2643136 - DNA, 18 bp, Homo sapiens
agaggggctttctggaga

SEQ ID NO: 2643137 - DNA, 20 bp, Homo sapiens
agagggtctgaggaatccag

SEQ ID NO: 2643138 - DNA, 20 bp, Homo sapiens
agagggtggtgacctctgcc

SEQ ID NO: 2643139 - DNA, 13 bp, Homo sapiens
agagggttcctgt

SEQ ID NO: 2643140 - DNA, 18 bp, Homo sapiens
agaggtaaaagtgtgagc

SEQ ID NO: 2643141 - DNA, 20 bp, Homo sapiens
agaggtaaaagtgtgagcag

SEQ ID NO: 2643142 - DNA, 23 bp, Homo sapiens
agaggtaaaagtgtgagcagtga

SEQ ID NO: 2643143 - DNA, 16 bp, Homo sapiens
agaggtcttttttaaa

SEQ ID NO: 2643144 - DNA, 14 bp, Homo sapiens
agaggtgccagcaa

SEQ ID NO: 2643145 - DNA, 16 bp, Homo sapiens
agaggtgccagcaact

SEQ ID NO: 2643146 - DNA, 19 bp, Homo sapiens
agaggtgccagcaactgaa

SEQ ID NO: 2643147 - DNA, 22 bp, Homo sapiens
agaggtgccagcaactgaataa

SEQ ID NO: 2643148 - DNA, 19 bp, Homo sapiens
agaggttcaaagatatttt

SEQ ID NO: 2643149 - DNA, 16 bp, Homo sapiens
agaggttttgttgttt

SEQ ID NO: 2643150 - DNA, 22 bp, Homo sapiens
agaggtttttcttaaataataa

SEQ ID NO: 2643151 - DNA, 15 bp, Homo sapiens
agagtaaaaactgaa

SEQ ID NO: 2643152 - DNA, 18 bp, Homo sapiens
agagtaaaggaaatgatt

SEQ ID NO: 2643153 - DNA, 13 bp, Homo sapiens
agagtagacattt

SEQ ID NO: 2643154 - DNA, 21 bp, Homo sapiens
agagtagatggtgaaatttat

SEQ ID NO: 2643155 - DNA, 18 bp, Homo sapiens
agagtagcatttcattct

SEQ ID NO: 2643156 - DNA, 13 bp, Homo sapiens
agagtatatgcac

SEQ ID NO: 2643157 - DNA, 14 bp, Homo sapiens
agagtatggagctc

SEQ ID NO: 2643158 - DNA, 18 bp, Homo sapiens
agagtcagccttccccct

SEQ ID NO: 2643159 - DNA, 13 bp, Homo sapiens
agagtcatatttt

SEQ ID NO: 2643160 - DNA, 15 bp, Homo sapiens
agagtcatattttga

SEQ ID NO: 2643161 - DNA, 19 bp, Homo sapiens
agagtcccactgcctcagg

SEQ ID NO: 2643162 - DNA, 21 bp, Homo sapiens
agagtcccagagcaggaggcc

SEQ ID NO: 2643163 - DNA, 12 bp, Homo sapiens
agagtcctctga

SEQ ID NO: 2643164 - DNA, 14 bp, Homo sapiens
agagtcctctgaat

SEQ ID NO: 2643165 - DNA, 18 bp, Homo sapiens
agagtctggtgaagctca

SEQ ID NO: 2643166 - DNA, 22 bp, Homo sapiens
agagtgaacaaatttacagaga

SEQ ID NO: 2643167 - DNA, 15 bp, Homo sapiens
agagtgagactctgt

SEQ ID NO: 2643168 - DNA, 21 bp, Homo sapiens
agagtgagagggcatgcgcac

SEQ ID NO: 2643169 - DNA, 22 bp, Homo sapiens
agagtgcaacagtagcatagga

SEQ ID NO: 2643170 - DNA, 18 bp, Homo sapiens
agagtgcattgtgagggt

SEQ ID NO: 2643171 - DNA, 13 bp, Homo sapiens
agagtgcccagaa

SEQ ID NO: 2643172 - DNA, 22 bp, Homo sapiens
agagtggaatgcttcctagaag

SEQ ID NO: 2643173 - DNA, 13 bp, Homo sapiens
agagtggcctggc

SEQ ID NO: 2643174 - DNA, 14 bp, Homo sapiens
agagtggcctggcc

SEQ ID NO: 2643175 - DNA, 13 bp, Homo sapiens
agagtgtagaagc

SEQ ID NO: 2643176 - DNA, 14 bp, Homo sapiens
agagtgtagaagca

SEQ ID NO: 2643177 - DNA, 18 bp, Homo sapiens
agagtgtagatcagagca

SEQ ID NO: 2643178 - DNA, 15 bp, Homo sapiens
agagtgtctttccac

SEQ ID NO: 2643179 - DNA, 14 bp, Homo sapiens
agagtgtgcctgaa

SEQ ID NO: 2643180 - DNA, 23 bp, Homo sapiens
agagttaaatagagtatatgcac

SEQ ID NO: 2643181 - DNA, 13 bp, Homo sapiens
agagttaagaagc

SEQ ID NO: 2643182 - DNA, 14 bp, Homo sapiens
agagttaagaagct

SEQ ID NO: 2643183 - DNA, 16 bp, Homo sapiens
agagttaagaagctgt

SEQ ID NO: 2643184 - DNA, 21 bp, Homo sapiens
agagttaagaagctgttgtac

SEQ ID NO: 2643185 - DNA, 19 bp, Homo sapiens
agagttagtttctttggga

SEQ ID NO: 2643186 - DNA, 17 bp, Homo sapiens
agagttcaatggctgct

SEQ ID NO: 2643187 - DNA, 18 bp, Homo sapiens
agagttcaatggctgctg

SEQ ID NO: 2643188 - DNA, 20 bp, Homo sapiens
agagttcaatggctgctgaa

SEQ ID NO: 2643189 - DNA, 21 bp, Homo sapiens
agagttcaatggctgctgaag

SEQ ID NO: 2643190 - DNA, 14 bp, Homo sapiens
agagttctgctcta

SEQ ID NO: 2643191 - DNA, 17 bp, Homo sapiens
agagttgatactacagt

SEQ ID NO: 2643192 - DNA, 20 bp, Homo sapiens
agagttgatactacagtttg

SEQ ID NO: 2643193 - DNA, 22 bp, Homo sapiens
agagttgatactacagtttgtt

SEQ ID NO: 2643194 - DNA, 16 bp, Homo sapiens
agagttttgtcttgaa

SEQ ID NO: 2643195 - DNA, 19 bp, Homo sapiens
agataaactcagaaattta

SEQ ID NO: 2643196 - DNA, 11 bp, Homo sapiens
agataaagatg

SEQ ID NO: 2643197 - DNA, 18 bp, Homo sapiens
agataaagatttcttgag

SEQ ID NO: 2643198 - DNA, 18 bp, Homo sapiens
agataacaagatctttca

SEQ ID NO: 2643199 - DNA, 13 bp, Homo sapiens
agataagcaagag

SEQ ID NO: 2643200 - DNA, 17 bp, Homo sapiens
agataagggtatctggt

SEQ ID NO: 2643201 - DNA, 19 bp, Homo sapiens
agataagggtatctggtga

SEQ ID NO: 2643202 - DNA, 17 bp, Homo sapiens
agataataatatatgtt

SEQ ID NO: 2643203 - DNA, 17 bp, Homo sapiens
agataatatgagaatca

SEQ ID NO: 2643204 - DNA, 17 bp, Homo sapiens
agataatcagcctctta

SEQ ID NO: 2643205 - DNA, 12 bp, Homo sapiens
agataatgtgaa

SEQ ID NO: 2643206 - DNA, 12 bp, Homo sapiens
agataattataa

SEQ ID NO: 2643207 - DNA, 15 bp, Homo sapiens
agatacaatgtattt

SEQ ID NO: 2643208 - DNA, 20 bp, Homo sapiens
agatacagaactctttcaaa

SEQ ID NO: 2643209 - DNA, 13 bp, Homo sapiens
agatacagttact

SEQ ID NO: 2643210 - DNA, 21 bp, Homo sapiens
agatacatggttgtgacctga

SEQ ID NO: 2643211 - DNA, 23 bp, Homo sapiens
agataccagcgaggaggctccag

SEQ ID NO: 2643212 - DNA, 17 bp, Homo sapiens
agatacctcaccctgct

SEQ ID NO: 2643213 - DNA, 15 bp, Homo sapiens
agatactgtatcatg

SEQ ID NO: 2643214 - DNA, 16 bp, Homo sapiens
agatactgtatcatga

SEQ ID NO: 2643215 - DNA, 13 bp, Homo sapiens
agatagaagaact

SEQ ID NO: 2643216 - DNA, 15 bp, Homo sapiens
agatagaagaactgc

SEQ ID NO: 2643217 - DNA, 14 bp, Homo sapiens
agatagcattgtga

SEQ ID NO: 2643218 - DNA, 13 bp, Homo sapiens
agataggctctgc

SEQ ID NO: 2643219 - DNA, 14 bp, Homo sapiens
agataggctctgca

SEQ ID NO: 2643220 - DNA, 19 bp, Homo sapiens
agatagtatctagcaatca

SEQ ID NO: 2643221 - DNA, 15 bp, Homo sapiens
agatataaatggctg

SEQ ID NO: 2643222 - DNA, 17 bp, Homo sapiens
agatataaatggctggt

SEQ ID NO: 2643223 - DNA, 15 bp, Homo sapiens
agcagttaactttaa

SEQ ID NO: 2643224 - DNA, 13 bp, Homo sapiens
agcataaatgcaa

SEQ ID NO: 2643225 - DNA, 14 bp, Homo sapiens
agcataaatgcaaa

SEQ ID NO: 2643226 - DNA, 17 bp, Homo sapiens
agcatacctttattgtg

SEQ ID NO: 2643227 - DNA, 15 bp, Homo sapiens
agcatacgtacacat

SEQ ID NO: 2643228 - DNA, 16 bp, Homo sapiens
agcatacgtacacatt

SEQ ID NO: 2643229 - DNA, 14 bp, Homo sapiens
agcatattcaggaa

SEQ ID NO: 2643230 - DNA, 15 bp, Homo sapiens
agcatcacagttttg

SEQ ID NO: 2643231 - DNA, 17 bp, Homo sapiens
agcatcacagttttggt

SEQ ID NO: 2643232 - DNA, 20 bp, Homo sapiens
agcatcacctcaggccaggt

SEQ ID NO: 2643233 - DNA, 16 bp, Homo sapiens
agcatcaggccaggcc

SEQ ID NO: 2643234 - DNA, 19 bp, Homo sapiens
agcatcaggccaggccctc

SEQ ID NO: 2643235 - DNA, 21 bp, Homo sapiens
agcatcattatttgcagagac

SEQ ID NO: 2643236 - DNA, 18 bp, Homo sapiens
agcatcattttgcattca

SEQ ID NO: 2643237 - DNA, 17 bp, Homo sapiens
agcatccacctccttct

SEQ ID NO: 2643238 - DNA, 18 bp, Homo sapiens
agcatccacctccttctc

SEQ ID NO: 2643239 - DNA, 22 bp, Homo sapiens
agcatcctggcacccggcccct

SEQ ID NO: 2643240 - DNA, 19 bp, Homo sapiens
agcatccttttctgcagag

SEQ ID NO: 2643241 - DNA, 13 bp, Homo sapiens
agcatcggaggga

SEQ ID NO: 2643242 - DNA, 20 bp, Homo sapiens
agcatctcagcctaccatga

SEQ ID NO: 2643243 - DNA, 18 bp, Homo sapiens
agcatcttcacttctaaa

SEQ ID NO: 2643244 - DNA, 20 bp, Homo sapiens
agcatcttcacttctaaatg

SEQ ID NO: 2643245 - DNA, 23 bp, Homo sapiens
agcatcttccagaagtgtgattg

SEQ ID NO: 2643246 - DNA, 13 bp, Homo sapiens
agcatgaaaaagc

SEQ ID NO: 2643247 - DNA, 20 bp, Homo sapiens
agcatgaatttttttcatct

SEQ ID NO: 2643248 - DNA, 23 bp, Homo sapiens
agcatgacctgtgaccagcactg

SEQ ID NO: 2643249 - DNA, 19 bp, Homo sapiens
agcatgagagaattgtatc

SEQ ID NO: 2643250 - DNA, 14 bp, Homo sapiens
agcatgggcctggc

SEQ ID NO: 2643251 - DNA, 13 bp, Homo sapiens
agcatgtaatggt

SEQ ID NO: 2643252 - DNA, 18 bp, Homo sapiens
agcatgtggcatgttcat

SEQ ID NO: 2643253 - DNA, 22 bp, Homo sapiens
agcatgtgtttggttctggggc

SEQ ID NO: 2643254 - DNA, 18 bp, Homo sapiens
agcatgttgctgaggagt

SEQ ID NO: 2643255 - DNA, 14 bp, Homo sapiens
agcatgtttcatgt

SEQ ID NO: 2643256 - DNA, 18 bp, Homo sapiens
agcattaactaatctatt

SEQ ID NO: 2643257 - DNA, 17 bp, Homo sapiens
agcattaacttctctgg

SEQ ID NO: 2643258 - DNA, 18 bp, Homo sapiens
agcattacgtgagccagg

SEQ ID NO: 2643259 - DNA, 20 bp, Homo sapiens
agcattacgtgagccaggta

SEQ ID NO: 2643260 - DNA, 19 bp, Homo sapiens
agcattatgatgtgggtca

SEQ ID NO: 2643261 - DNA, 22 bp, Homo sapiens
agcattcaatttattcaagaaa

SEQ ID NO: 2643262 - DNA, 23 bp, Homo sapiens
agcattcaatttattcaagaaaa

SEQ ID NO: 2643263 - DNA, 14 bp, Homo sapiens
agcattcagagagc

SEQ ID NO: 2643264 - DNA, 13 bp, Homo sapiens
agcattccaacaa

SEQ ID NO: 2643265 - DNA, 15 bp, Homo sapiens
agcattccttctttg

SEQ ID NO: 2643266 - DNA, 18 bp, Homo sapiens
agcattccttctttgata

SEQ ID NO: 2643267 - DNA, 19 bp, Homo sapiens
agcattccttctttgataa

SEQ ID NO: 2643268 - DNA, 21 bp, Homo sapiens
agcattccttctttgataatg

SEQ ID NO: 2643269 - DNA, 22 bp, Homo sapiens
agcattccttctttgataatgt

SEQ ID NO: 2643270 - DNA, 19 bp, Homo sapiens
agcattcgagacagaacct

SEQ ID NO: 2643271 - DNA, 13 bp, Homo sapiens
agcattgccattc

SEQ ID NO: 2643272 - DNA, 22 bp, Homo sapiens
agcattgccattccctgcctgg

SEQ ID NO: 2643273 - DNA, 14 bp, Homo sapiens
agcattgctggttc

SEQ ID NO: 2643274 - DNA, 16 bp, Homo sapiens
agcattgctggttcta

SEQ ID NO: 2643275 - DNA, 12 bp, Homo sapiens
agcattgctttc

SEQ ID NO: 2643276 - DNA, 17 bp, Homo sapiens
agcattgtaaatgtgct

SEQ ID NO: 2643277 - DNA, 18 bp, Homo sapiens
agcattgtaaatgtgctt

SEQ ID NO: 2643278 - DNA, 17 bp, Homo sapiens
agcattgtgaactgaca

SEQ ID NO: 2643279 - DNA, 20 bp, Homo sapiens
agcattgtggctgtcagcag

SEQ ID NO: 2643280 - DNA, 20 bp, Homo sapiens
agcatttaatgtagccatgg

SEQ ID NO: 2643281 - DNA, 17 bp, Homo sapiens
agcatttactttgaatt

SEQ ID NO: 2643282 - DNA, 20 bp, Homo sapiens
agcatttcattcttctctag

SEQ ID NO: 2643283 - DNA, 23 bp, Homo sapiens
agcatttccaacaccacagacac

SEQ ID NO: 2643284 - DNA, 22 bp, Homo sapiens
agcatttctgaagtggactctt

SEQ ID NO: 2643285 - DNA, 16 bp, Homo sapiens
agcatttgtcaacaaa

SEQ ID NO: 2643286 - DNA, 14 bp, Homo sapiens
agcattttataaat

SEQ ID NO: 2643287 - DNA, 15 bp, Homo sapiens
agcattttataaatc

SEQ ID NO: 2643288 - DNA, 20 bp, Homo sapiens
agcattttataaatcgcttt

SEQ ID NO: 2643289 - DNA, 15 bp, Homo sapiens
agcattttgtatttg

SEQ ID NO: 2643290 - DNA, 18 bp, Homo sapiens
agccaaacccatgaggca

SEQ ID NO: 2643291 - DNA, 19 bp, Homo sapiens
agccaaacccttgtcagtg

SEQ ID NO: 2643292 - DNA, 16 bp, Homo sapiens
agccaaacctctgtga

SEQ ID NO: 2643293 - DNA, 18 bp, Homo sapiens
agccaaagctaggcctgg

SEQ ID NO: 2643294 - DNA, 20 bp, Homo sapiens
agccaaagctaggcctggcc

SEQ ID NO: 2643295 - DNA, 17 bp, Homo sapiens
agccaacaggtggcagg

SEQ ID NO: 2643296 - DNA, 23 bp, Homo sapiens
agccaacaggtggcaggaccagg

SEQ ID NO: 2643297 - DNA, 12 bp, Homo sapiens
agccaactccat

SEQ ID NO: 2643298 - DNA, 19 bp, Homo sapiens
agccaacttggctttcccg

SEQ ID NO: 2643299 - DNA, 19 bp, Homo sapiens
agccaagattgcgccattg

SEQ ID NO: 2643300 - DNA, 21 bp, Homo sapiens
agccaagcacagtggtggcag

SEQ ID NO: 2643301 - DNA, 16 bp, Homo sapiens
agccaagcagccaagc

SEQ ID NO: 2643302 - DNA, 20 bp, Homo sapiens
agccaaggccgaagctctgg

SEQ ID NO: 2643303 - DNA, 19 bp, Homo sapiens
agccaaggtgggctgagcc

SEQ ID NO: 2643304 - DNA, 20 bp, Homo sapiens
agccaaggtgggctgagccc

SEQ ID NO: 2643305 - DNA, 22 bp, Homo sapiens
agccaaggtgggctgagccctg

SEQ ID NO: 2643306 - DNA, 23 bp, Homo sapiens
agccaagtgtggtagagtgtgcc

SEQ ID NO: 2643307 - DNA, 18 bp, Homo sapiens
agccaataacacacagct

SEQ ID NO: 2643308 - DNA, 16 bp, Homo sapiens
agccaatcccctcctt

SEQ ID NO: 2643309 - DNA, 22 bp, Homo sapiens
agccaatcccctccttgggcac

SEQ ID NO: 2643310 - DNA, 14 bp, Homo sapiens
agccacacacacag

SEQ ID NO: 2643311 - DNA, 20 bp, Homo sapiens
agccacacacacagaaaata

SEQ ID NO: 2643312 - DNA, 21 bp, Homo sapiens
agccacactgtgggactcttc

SEQ ID NO: 2643313 - DNA, 12 bp, Homo sapiens
agccacagaagc

SEQ ID NO: 2643314 - DNA, 18 bp, Homo sapiens
agccacagaagccaggag

SEQ ID NO: 2643315 - DNA, 20 bp, Homo sapiens
agccacagaagccaggagca

SEQ ID NO: 2643316 - DNA, 22 bp, Homo sapiens
agccacagtttcctcatctgtc

SEQ ID NO: 2643317 - DNA, 23 bp, Homo sapiens
agccacatccctttgaaacaaga

SEQ ID NO: 2643318 - DNA, 14 bp, Homo sapiens
agccacattcctga

SEQ ID NO: 2643319 - DNA, 17 bp, Homo sapiens
agccaccacgtccagct

SEQ ID NO: 2643320 - DNA, 13 bp, Homo sapiens
agccaccatcttt

SEQ ID NO: 2643321 - DNA, 17 bp, Homo sapiens
agccaccatctttgcag

SEQ ID NO: 2643322 - DNA, 23 bp, Homo sapiens
agccaccccgggctctctgctgt

SEQ ID NO: 2643323 - DNA, 14 bp, Homo sapiens
agccacctctccct

SEQ ID NO: 2643324 - DNA, 17 bp, Homo sapiens
agccacggccaggccag

SEQ ID NO: 2643325 - DNA, 18 bp, Homo sapiens
agccacggccaggccaga

SEQ ID NO: 2643326 - DNA, 12 bp, Homo sapiens
agccactcctct

SEQ ID NO: 2643327 - DNA, 14 bp, Homo sapiens
agccactcctctga

SEQ ID NO: 2643328 - DNA, 21 bp, Homo sapiens
agccactcctctgactcaggg

SEQ ID NO: 2643329 - DNA, 15 bp, Homo sapiens
agccactcgggaggc

SEQ ID NO: 2643330 - DNA, 13 bp, Homo sapiens
agccactgcaccg

SEQ ID NO: 2643331 - DNA, 18 bp, Homo sapiens
agccactgcaccgggcca

SEQ ID NO: 2643332 - DNA, 20 bp, Homo sapiens
agccactgcaccgggccaca

SEQ ID NO: 2643333 - DNA, 21 bp, Homo sapiens
agccactgcaccgggccacag

SEQ ID NO: 2643334 - DNA, 16 bp, Homo sapiens
agccacttaccttcaa

SEQ ID NO: 2643335 - DNA, 17 bp, Homo sapiens
agccacttaccttcaat

SEQ ID NO: 2643336 - DNA, 23 bp, Homo sapiens
agccagaaataaagttggtgaca

SEQ ID NO: 2643337 - DNA, 14 bp, Homo sapiens
agccagaacctgga

SEQ ID NO: 2643338 - DNA, 18 bp, Homo sapiens
agccagacctattcctcc

SEQ ID NO: 2643339 - DNA, 20 bp, Homo sapiens
agccagacctattcctcctg

SEQ ID NO: 2643340 - DNA, 18 bp, Homo sapiens
agccagagaagtgacagg

SEQ ID NO: 2643341 - DNA, 15 bp, Homo sapiens
agccagatcctcttg

SEQ ID NO: 2643342 - DNA, 16 bp, Homo sapiens
agccagatcctcttgg

SEQ ID NO: 2643343 - DNA, 22 bp, Homo sapiens
agccagcaatgatgtccagaag

SEQ ID NO: 2643344 - DNA, 15 bp, Homo sapiens
agccagcacttgtat

SEQ ID NO: 2643345 - DNA, 16 bp, Homo sapiens
agccagcgtcctcctc

SEQ ID NO: 2643346 - DNA, 18 bp, Homo sapiens
agccagcgtcctcctctg

SEQ ID NO: 2643347 - DNA, 19 bp, Homo sapiens
agccagcgtcctcctctgt

SEQ ID NO: 2643348 - DNA, 23 bp, Homo sapiens
agccagcgtcctcctctgtgacc

SEQ ID NO: 2643349 - DNA, 15 bp, Homo sapiens
agccagctcatttca

SEQ ID NO: 2643350 - DNA, 13 bp, Homo sapiens
agccagctctcag

SEQ ID NO: 2643351 - DNA, 14 bp, Homo sapiens
agccagctttccct

SEQ ID NO: 2643352 - DNA, 22 bp, Homo sapiens
agccagctttccctgcctctca

SEQ ID NO: 2643353 - DNA, 13 bp, Homo sapiens
agccaggagcaaa

SEQ ID NO: 2643354 - DNA, 22 bp, Homo sapiens
agccaggagcaaatgtttctgc

SEQ ID NO: 2643355 - DNA, 18 bp, Homo sapiens
agccaggagctgggcaga

SEQ ID NO: 2643356 - DNA, 12 bp, Homo sapiens
agccaggcctgg

SEQ ID NO: 2643357 - DNA, 13 bp, Homo sapiens
agccaggcgggct

SEQ ID NO: 2643358 - DNA, 14 bp, Homo sapiens
agccaggcgggctc

SEQ ID NO: 2643359 - DNA, 19 bp, Homo sapiens
agccaggcgggctcaagga

SEQ ID NO: 2643360 - DNA, 16 bp, Homo sapiens
agccaggctctgtgct

SEQ ID NO: 2643361 - DNA, 21 bp, Homo sapiens
agccaggctctgtgctgaccc

SEQ ID NO: 2643362 - DNA, 18 bp, Homo sapiens
agccaggtaatgagggac

SEQ ID NO: 2643363 - DNA, 23 bp, Homo sapiens
agccaggtaatgagggactggaa

SEQ ID NO: 2643364 - DNA, 16 bp, Homo sapiens
agccaggtgccttgga

SEQ ID NO: 2643365 - DNA, 18 bp, Homo sapiens
agccagtaaacagaggag

SEQ ID NO: 2643366 - DNA, 14 bp, Homo sapiens
agccagtcccaggg

SEQ ID NO: 2643367 - DNA, 19 bp, Homo sapiens
agctgcctgggatccctca

SEQ ID NO: 2643368 - DNA, 10 bp, Homo sapiens
agctgcctgt

SEQ ID NO: 2643369 - DNA, 20 bp, Homo sapiens
agctgcctgtagttaggaaa

SEQ ID NO: 2643370 - DNA, 18 bp, Homo sapiens
agctgcctgttcagctcc

SEQ ID NO: 2643371 - DNA, 19 bp, Homo sapiens
agctgcctgttcagctcca

SEQ ID NO: 2643372 - DNA, 21 bp, Homo sapiens
agctgcctgttcagctccagc

SEQ ID NO: 2643373 - DNA, 22 bp, Homo sapiens
agctgccttgagccttaaaacc

SEQ ID NO: 2643374 - DNA, 16 bp, Homo sapiens
agctgcggtccaccca

SEQ ID NO: 2643375 - DNA, 18 bp, Homo sapiens
agctgcggtccacccagg

SEQ ID NO: 2643376 - DNA, 14 bp, Homo sapiens
agctgctacaaaga

SEQ ID NO: 2643377 - DNA, 17 bp, Homo sapiens
agctgctacaaagaaga

SEQ ID NO: 2643378 - DNA, 18 bp, Homo sapiens
agctgctacaaagaagac

SEQ ID NO: 2643379 - DNA, 21 bp, Homo sapiens
agctgctacaaagaagacatg

SEQ ID NO: 2643380 - DNA, 16 bp, Homo sapiens
agctgctcagggaaaa

SEQ ID NO: 2643381 - DNA, 16 bp, Homo sapiens
agctgctgaaacaaca

SEQ ID NO: 2643382 - DNA, 14 bp, Homo sapiens
agctgctgacagtg

SEQ ID NO: 2643383 - DNA, 20 bp, Homo sapiens
agctgcttgtgtccctcctg

SEQ ID NO: 2643384 - DNA, 21 bp, Homo sapiens
agctgcttgtgtccctcctgg

SEQ ID NO: 2643385 - DNA, 20 bp, Homo sapiens
agctgctttctgttgtcatt

SEQ ID NO: 2643386 - DNA, 24 bp, Homo sapiens
agctgcttttgtctatgggactca

SEQ ID NO: 2643387 - DNA, 12 bp, Homo sapiens
agctggaagcac

SEQ ID NO: 2643388 - DNA, 16 bp, Homo sapiens
agctggactacccacg

SEQ ID NO: 2643389 - DNA, 15 bp, Homo sapiens
agctggagcctggtg

SEQ ID NO: 2643390 - DNA, 22 bp, Homo sapiens
agctggatctccattctctcag

SEQ ID NO: 2643391 - DNA, 13 bp, Homo sapiens
agctggccccgcc

SEQ ID NO: 2643392 - DNA, 23 bp, Homo sapiens
agctggccgagggtcctggctcc

SEQ ID NO: 2643393 - DNA, 16 bp, Homo sapiens
agctggccgtgggcct

SEQ ID NO: 2643394 - DNA, 17 bp, Homo sapiens
agctggccgtgggcctg

SEQ ID NO: 2643395 - DNA, 15 bp, Homo sapiens
agctggcgtctgtct

SEQ ID NO: 2643396 - DNA, 19 bp, Homo sapiens
agctgggactacaggcacc

SEQ ID NO: 2643397 - DNA, 23 bp, Homo sapiens
agctgggactacaggcacccacc

SEQ ID NO: 2643398 - DNA, 17 bp, Homo sapiens
agctgggactacaggtg

SEQ ID NO: 2643399 - DNA, 19 bp, Homo sapiens
agctgggactacaggtgtg

SEQ ID NO: 2643400 - DNA, 23 bp, Homo sapiens
agctgggaggcaagaggggtgga

SEQ ID NO: 2643401 - DNA, 19 bp, Homo sapiens
agctgggaggcatggccct

SEQ ID NO: 2643402 - DNA, 14 bp, Homo sapiens
agctgggcaggttg

SEQ ID NO: 2643403 - DNA, 12 bp, Homo sapiens
agctgggcccaa

SEQ ID NO: 2643404 - DNA, 20 bp, Homo sapiens
agctgggcccaaccctgtct

SEQ ID NO: 2643405 - DNA, 14 bp, Homo sapiens
agctgggccccagc

SEQ ID NO: 2643406 - DNA, 22 bp, Homo sapiens
agctgggccccagcccaccctc

SEQ ID NO: 2643407 - DNA, 15 bp, Homo sapiens
agctgggctctgcaa

SEQ ID NO: 2643408 - DNA, 20 bp, Homo sapiens
agctggggaagcttcttaaa

SEQ ID NO: 2643409 - DNA, 22 bp, Homo sapiens
agctgggtgtcaagagggtctg

SEQ ID NO: 2643410 - DNA, 16 bp, Homo sapiens
agctgggttggaaaac

SEQ ID NO: 2643411 - DNA, 20 bp, Homo sapiens
agctgggttggaaaacagta

SEQ ID NO: 2643412 - DNA, 15 bp, Homo sapiens
agctggtcccactca

SEQ ID NO: 2643413 - DNA, 18 bp, Homo sapiens
agctggtcccactcagtc

SEQ ID NO: 2643414 - DNA, 19 bp, Homo sapiens
agctggtcccactcagtcc

SEQ ID NO: 2643415 - DNA, 10 bp, Homo sapiens
agctggtgca

SEQ ID NO: 2643416 - DNA, 20 bp, Homo sapiens
agctggtgcattacagagag

SEQ ID NO: 2643417 - DNA, 22 bp, Homo sapiens
agctggtgcattacagagagga

SEQ ID NO: 2643418 - DNA, 21 bp, Homo sapiens
agctggtggtatctgagttga

SEQ ID NO: 2643419 - DNA, 16 bp, Homo sapiens
agctggtggtttcacg

SEQ ID NO: 2643420 - DNA, 15 bp, Homo sapiens
agctggtttcctcat

SEQ ID NO: 2643421 - DNA, 22 bp, Homo sapiens
agctggtttcctcattcctgaa

SEQ ID NO: 2643422 - DNA, 17 bp, Homo sapiens
agctgtaaaccagagag

SEQ ID NO: 2643423 - DNA, 18 bp, Homo sapiens
agctgtaagaagagactg

SEQ ID NO: 2643424 - DNA, 22 bp, Homo sapiens
agctgtaagaagagactgggaa

SEQ ID NO: 2643425 - DNA, 11 bp, Homo sapiens
agctgtctgct

SEQ ID NO: 2643426 - DNA, 17 bp, Homo sapiens
agctgtctgctcagaca

SEQ ID NO: 2643427 - DNA, 18 bp, Homo sapiens
agctgtgacttctccagg

SEQ ID NO: 2643428 - DNA, 12 bp, Homo sapiens
agctgtgcaggt

SEQ ID NO: 2643429 - DNA, 18 bp, Homo sapiens
agctgtgcaggtggggag

SEQ ID NO: 2643430 - DNA, 18 bp, Homo sapiens
agctgtgctctggacagg

SEQ ID NO: 2643431 - DNA, 23 bp, Homo sapiens
agctgtgctctggacaggcatgt

SEQ ID NO: 2643432 - DNA, 19 bp, Homo sapiens
agctgttatttctattttt

SEQ ID NO: 2643433 - DNA, 13 bp, Homo sapiens
agctgttgagctg

SEQ ID NO: 2643434 - DNA, 16 bp, Homo sapiens
agctgttgagctgttt

SEQ ID NO: 2643435 - DNA, 18 bp, Homo sapiens
agctgttgtacatttatg

SEQ ID NO: 2643436 - DNA, 22 bp, Homo sapiens
agctgttgtacatttatgattt

SEQ ID NO: 2643437 - DNA, 19 bp, Homo sapiens
agctgtttattttatatta

SEQ ID NO: 2643438 - DNA, 17 bp, Homo sapiens
agcttacaagccagctg

SEQ ID NO: 2643439 - DNA, 14 bp, Homo sapiens
agcttagacctcag

SEQ ID NO: 2643440 - DNA, 17 bp, Homo sapiens
agcttagacctcagcct

SEQ ID NO: 2643441 - DNA, 15 bp, Homo sapiens
agcttatcatgctgt

SEQ ID NO: 2643442 - DNA, 19 bp, Homo sapiens
agcttatcatgctgtcttt

SEQ ID NO: 2643443 - DNA, 12 bp, Homo sapiens
agcttatctcag

SEQ ID NO: 2643444 - DNA, 14 bp, Homo sapiens
agcttatctcaggg

SEQ ID NO: 2643445 - DNA, 15 bp, Homo sapiens
agcttatctcagggg

SEQ ID NO: 2643446 - DNA, 22 bp, Homo sapiens
agcttattcatctgtttttctt

SEQ ID NO: 2643447 - DNA, 12 bp, Homo sapiens
agcttatttaat

SEQ ID NO: 2643448 - DNA, 15 bp, Homo sapiens
agcttcaccagagca

SEQ ID NO: 2643449 - DNA, 20 bp, Homo sapiens
agcttcaccccaatcccagc

SEQ ID NO: 2643450 - DNA, 17 bp, Homo sapiens
agcttcagccaggagct

SEQ ID NO: 2643451 - DNA, 19 bp, Homo sapiens
agcttcatggcagaaggca

SEQ ID NO: 2643452 - DNA, 13 bp, Homo sapiens
agcttcatttgtg

SEQ ID NO: 2643453 - DNA, 17 bp, Homo sapiens
agcttcatttgtgtcaa

SEQ ID NO: 2643454 - DNA, 17 bp, Homo sapiens
agcttcccctctctcct

SEQ ID NO: 2643455 - DNA, 23 bp, Homo sapiens
agcttccctcccgtgtgttctcc

SEQ ID NO: 2643456 - DNA, 20 bp, Homo sapiens
agcttcgtttattttcaaga

SEQ ID NO: 2643457 - DNA, 19 bp, Homo sapiens
agcttctcatcctgcaggc

SEQ ID NO: 2643458 - DNA, 23 bp, Homo sapiens
agcttctccaggctctttggggt

SEQ ID NO: 2643459 - DNA, 17 bp, Homo sapiens
agcttctggtactctcc

SEQ ID NO: 2643460 - DNA, 19 bp, Homo sapiens
agcttgaaggatctgtttt

SEQ ID NO: 2643461 - DNA, 14 bp, Homo sapiens
agcttgagggttgg

SEQ ID NO: 2643462 - DNA, 20 bp, Homo sapiens
agcttgccctggtgcctcac

SEQ ID NO: 2643463 - DNA, 18 bp, Homo sapiens
agcttgccctgttaaaag

SEQ ID NO: 2643464 - DNA, 23 bp, Homo sapiens
agcttgcgcattctcatggagaa

SEQ ID NO: 2643465 - DNA, 17 bp, Homo sapiens
agcttgctcacatcttg

SEQ ID NO: 2643466 - DNA, 23 bp, Homo sapiens
agcttggaaactggatgaggtca

SEQ ID NO: 2643467 - DNA, 18 bp, Homo sapiens
agcttggaagagcctgca

SEQ ID NO: 2643468 - DNA, 14 bp, Homo sapiens
agcttggcagccga

SEQ ID NO: 2643469 - DNA, 16 bp, Homo sapiens
agcttggctgtagaag

SEQ ID NO: 2643470 - DNA, 10 bp, Homo sapiens
agcttgggcc

SEQ ID NO: 2643471 - DNA, 18 bp, Homo sapiens
agcttgggcccagctggg

SEQ ID NO: 2643472 - DNA, 19 bp, Homo sapiens
agcttgtaaatagctcagg

SEQ ID NO: 2643473 - DNA, 20 bp, Homo sapiens
agcttgtaaatagctcaggt

SEQ ID NO: 2643474 - DNA, 18 bp, Homo sapiens
agcttgtatagtgtaaaa

SEQ ID NO: 2643475 - DNA, 23 bp, Homo sapiens
agcttgtccaacccgaggcccgc

SEQ ID NO: 2643476 - DNA, 19 bp, Homo sapiens
agcttgtgcacaattctgt

SEQ ID NO: 2643477 - DNA, 15 bp, Homo sapiens
agctttaaaagaaaa

SEQ ID NO: 2643478 - DNA, 15 bp, Homo sapiens
agctttaaacaaatt

SEQ ID NO: 2643479 - DNA, 20 bp, Homo sapiens
agctttaaccattaaaactg

SEQ ID NO: 2643480 - DNA, 20 bp, Homo sapiens
agctttaccctcaggcatag

SEQ ID NO: 2643481 - DNA, 15 bp, Homo sapiens
agctttactgtttgt

SEQ ID NO: 2643482 - DNA, 16 bp, Homo sapiens
agctttatgtaataat

SEQ ID NO: 2643483 - DNA, 17 bp, Homo sapiens
agctttcaaagaaggaa

SEQ ID NO: 2643484 - DNA, 15 bp, Homo sapiens
agctttcaattccgt

SEQ ID NO: 2643485 - DNA, 22 bp, Homo sapiens
agctttgaaggccgaaggcagt

SEQ ID NO: 2643486 - DNA, 15 bp, Homo sapiens
agctttgatttttac

SEQ ID NO: 2643487 - DNA, 22 bp, Homo sapiens
agctttgcatgttccactaacc

SEQ ID NO: 2643488 - DNA, 19 bp, Homo sapiens
agctttgccagctgctgct

SEQ ID NO: 2643489 - DNA, 20 bp, Homo sapiens
agctttgccagctgctgctg

SEQ ID NO: 2643490 - DNA, 10 bp, Homo sapiens
agctttgctc

SEQ ID NO: 2643491 - DNA, 20 bp, Homo sapiens
agctttgcttctctctctaa

SEQ ID NO: 2643492 - DNA, 16 bp, Homo sapiens
agctttggaaacagga

SEQ ID NO: 2643493 - DNA, 12 bp, Homo sapiens
agctttgttctt

SEQ ID NO: 2643494 - DNA, 18 bp, Homo sapiens
agctttgttcttcttaaa

SEQ ID NO: 2643495 - DNA, 19 bp, Homo sapiens
agctttgtttcaaccaagt

SEQ ID NO: 2643496 - DNA, 13 bp, Homo sapiens
agcttttgctttt

SEQ ID NO: 2643497 - DNA, 14 bp, Homo sapiens
agctttttaattgt

SEQ ID NO: 2643498 - DNA, 17 bp, Homo sapiens
agctttttaattgttgt

SEQ ID NO: 2643499 - DNA, 22 bp, Homo sapiens
agctttttattcctcctgctca

SEQ ID NO: 2643500 - DNA, 13 bp, Homo sapiens
agctttttgtctt

SEQ ID NO: 2643501 - DNA, 14 bp, Homo sapiens
aggaaaaaaatgac

SEQ ID NO: 2643502 - DNA, 23 bp, Homo sapiens
aggaaaaaatgttggatttataa

SEQ ID NO: 2643503 - DNA, 19 bp, Homo sapiens
aggaaaagtacatttaata

SEQ ID NO: 2643504 - DNA, 13 bp, Homo sapiens
aggaaaatttcac

SEQ ID NO: 2643505 - DNA, 21 bp, Homo sapiens
aggaaacaaagcttagcagga

SEQ ID NO: 2643506 - DNA, 17 bp, Homo sapiens
aggaaaccacagctgct

SEQ ID NO: 2643507 - DNA, 16 bp, Homo sapiens
aggaaacccagctctg

SEQ ID NO: 2643508 - DNA, 17 bp, Homo sapiens
aggaaacccagctctgg

SEQ ID NO: 2643509 - DNA, 16 bp, Homo sapiens
aggaaactcacctgct

SEQ ID NO: 2643510 - DNA, 21 bp, Homo sapiens
aggaaactcacctgctggccc

SEQ ID NO: 2643511 - DNA, 21 bp, Homo sapiens
aggaaactctgcattctagta

SEQ ID NO: 2643512 - DNA, 13 bp, Homo sapiens
aggaaactcttat

SEQ ID NO: 2643513 - DNA, 22 bp, Homo sapiens
aggaaactcttatctcagtcat

SEQ ID NO: 2643514 - DNA, 22 bp, Homo sapiens
aggaaagcaataaatgaatggg

SEQ ID NO: 2643515 - DNA, 14 bp, Homo sapiens
aggaaaggccagct

SEQ ID NO: 2643516 - DNA, 16 bp, Homo sapiens
aggaaaggccagctgg

SEQ ID NO: 2643517 - DNA, 17 bp, Homo sapiens
aggaaaggccagctggc

SEQ ID NO: 2643518 - DNA, 22 bp, Homo sapiens
aggaaaggccagctggcagcag

SEQ ID NO: 2643519 - DNA, 16 bp, Homo sapiens
aggaaaggctccagga

SEQ ID NO: 2643520 - DNA, 22 bp, Homo sapiens
aggaaaggctccaggagcagcc

SEQ ID NO: 2643521 - DNA, 23 bp, Homo sapiens
aggaaaggctccaggagcagcca

SEQ ID NO: 2643522 - DNA, 21 bp, Homo sapiens
aggaaagggggtcccagtggg

SEQ ID NO: 2643523 - DNA, 17 bp, Homo sapiens
aggaaataaaacctttc

SEQ ID NO: 2643524 - DNA, 16 bp, Homo sapiens
aggaaatattgctggg

SEQ ID NO: 2643525 - DNA, 14 bp, Homo sapiens
aggaaatctcaccc

SEQ ID NO: 2643526 - DNA, 15 bp, Homo sapiens
aggaacactccttca

SEQ ID NO: 2643527 - DNA, 14 bp, Homo sapiens
aggaacagaaggat

SEQ ID NO: 2643528 - DNA, 19 bp, Homo sapiens
aggaacctcctccacacca

SEQ ID NO: 2643529 - DNA, 16 bp, Homo sapiens
aggaacggtaaatttc

SEQ ID NO: 2643530 - DNA, 20 bp, Homo sapiens
aggaacggtaaatttctgtg

SEQ ID NO: 2643531 - DNA, 14 bp, Homo sapiens
aggaactcccagca

SEQ ID NO: 2643532 - DNA, 21 bp, Homo sapiens
aggaactctggcttccaggta

SEQ ID NO: 2643533 - DNA, 17 bp, Homo sapiens
aggaagaattttaaaaa

SEQ ID NO: 2643534 - DNA, 14 bp, Homo sapiens
aggaagactttgga

SEQ ID NO: 2643535 - DNA, 15 bp, Homo sapiens
aggaagactttggaa

SEQ ID NO: 2643536 - DNA, 23 bp, Homo sapiens
aggaagagcaggcacatggagga

SEQ ID NO: 2643537 - DNA, 17 bp, Homo sapiens
aggaagatgaaagagga

SEQ ID NO: 2643538 - DNA, 16 bp, Homo sapiens
aggaagcaaactaagc

SEQ ID NO: 2643539 - DNA, 18 bp, Homo sapiens
aggaagccgctggggcca

SEQ ID NO: 2643540 - DNA, 20 bp, Homo sapiens
aggaagccgtgccctgcccc

SEQ ID NO: 2643541 - DNA, 16 bp, Homo sapiens
aggaagctcagactgg

SEQ ID NO: 2643542 - DNA, 17 bp, Homo sapiens
aggaagctcagactggt

SEQ ID NO: 2643543 - DNA, 14 bp, Homo sapiens
aggaagctcagggc

SEQ ID NO: 2643544 - DNA, 18 bp, Homo sapiens
aggaagctcagggcctgg

SEQ ID NO: 2643545 - DNA, 22 bp, Homo sapiens
aggaagctcagggcctggctca

SEQ ID NO: 2643546 - DNA, 15 bp, Homo sapiens
aggaagctccactgt

SEQ ID NO: 2643547 - DNA, 23 bp, Homo sapiens
aggaaggaaacccagctctggtc

SEQ ID NO: 2643548 - DNA, 12 bp, Homo sapiens
aggaaggaaaga

SEQ ID NO: 2643549 - DNA, 17 bp, Homo sapiens
aggaaggcaggaagaga

SEQ ID NO: 2643550 - DNA, 22 bp, Homo sapiens
aggaaggctgagaggagagaga

SEQ ID NO: 2643551 - DNA, 16 bp, Homo sapiens
aggaagggaccaaggc

SEQ ID NO: 2643552 - DNA, 12 bp, Homo sapiens
aggaagggcaaa

SEQ ID NO: 2643553 - DNA, 14 bp, Homo sapiens
aggaaggtggtggg

SEQ ID NO: 2643554 - DNA, 16 bp, Homo sapiens
aggaaggttctggtgt

SEQ ID NO: 2643555 - DNA, 21 bp, Homo sapiens
aggaaggttctggtgtgaact

SEQ ID NO: 2643556 - DNA, 14 bp, Homo sapiens
aggaagtaggaagt

SEQ ID NO: 2643557 - DNA, 18 bp, Homo sapiens
aggaagtcaaagcaagga

SEQ ID NO: 2643558 - DNA, 18 bp, Homo sapiens
aggaagtgtaacagctga

SEQ ID NO: 2643559 - DNA, 19 bp, Homo sapiens
aggaataaattgctccttg

SEQ ID NO: 2643560 - DNA, 14 bp, Homo sapiens
aggaataaggcctt

SEQ ID NO: 2643561 - DNA, 16 bp, Homo sapiens
aggaataattatttat

SEQ ID NO: 2643562 - DNA, 18 bp, Homo sapiens
aggaatacctgtccccct

SEQ ID NO: 2643563 - DNA, 17 bp, Homo sapiens
aggaatcaagagctgcc

SEQ ID NO: 2643564 - DNA, 15 bp, Homo sapiens
aggaatcactcttgt

SEQ ID NO: 2643565 - DNA, 16 bp, Homo sapiens
aggaatcactcttgtg

SEQ ID NO: 2643566 - DNA, 20 bp, Homo sapiens
aggaatccagacccggctgc

SEQ ID NO: 2643567 - DNA, 24 bp, Homo sapiens
aggaatgcctcctccctgggcaga

SEQ ID NO: 2643568 - DNA, 14 bp, Homo sapiens
aggaatgctccccc

SEQ ID NO: 2643569 - DNA, 22 bp, Homo sapiens
aggaattcccagcccaaagctg

SEQ ID NO: 2643570 - DNA, 22 bp, Homo sapiens
aggaattctaggcatcccaggg

SEQ ID NO: 2643571 - DNA, 16 bp, Homo sapiens
aggacaaacagctcag

SEQ ID NO: 2643572 - DNA, 14 bp, Homo sapiens
aggacaaccattcc

SEQ ID NO: 2643573 - DNA, 14 bp, Homo sapiens
aggacaaggctaga

SEQ ID NO: 2643574 - DNA, 17 bp, Homo sapiens
aggacaatcagtcccct

SEQ ID NO: 2643575 - DNA, 18 bp, Homo sapiens
aggacaatcagtcccctc

SEQ ID NO: 2643576 - DNA, 20 bp, Homo sapiens
aggacaatcagtcccctccc

SEQ ID NO: 2643577 - DNA, 21 bp, Homo sapiens
aggacaatcagtcccctccca

SEQ ID NO: 2643578 - DNA, 12 bp, Homo sapiens
aggacagctgtc

SEQ ID NO: 2643579 - DNA, 22 bp, Homo sapiens
aggacagggaggtgaccccagg

SEQ ID NO: 2643580 - DNA, 19 bp, Homo sapiens
aggacagtatttgtgggga

SEQ ID NO: 2643581 - DNA, 18 bp, Homo sapiens
aggacagtgcttcagcct

SEQ ID NO: 2643582 - DNA, 20 bp, Homo sapiens
aggacagtgcttcagcctga

SEQ ID NO: 2643583 - DNA, 13 bp, Homo sapiens
aggacatgaaact

SEQ ID NO: 2643584 - DNA, 21 bp, Homo sapiens
aggacatgatggagcgcacct

SEQ ID NO: 2643585 - DNA, 16 bp, Homo sapiens
aggacatgtttttgtt

SEQ ID NO: 2643586 - DNA, 15 bp, Homo sapiens
aggacattgcggaca

SEQ ID NO: 2643587 - DNA, 18 bp, Homo sapiens
aggacattgcggacagcc

SEQ ID NO: 2643588 - DNA, 19 bp, Homo sapiens
aggacattgcggacagcca

SEQ ID NO: 2643589 - DNA, 15 bp, Homo sapiens
aggacatttcccagg

SEQ ID NO: 2643590 - DNA, 12 bp, Homo sapiens
aggaccactcct

SEQ ID NO: 2643591 - DNA, 19 bp, Homo sapiens
aggaccagctggggcgtgg

SEQ ID NO: 2643592 - DNA, 12 bp, Homo sapiens
aggaccaggact

SEQ ID NO: 2643593 - DNA, 13 bp, Homo sapiens
aggaccaggactc

SEQ ID NO: 2643594 - DNA, 17 bp, Homo sapiens
aggaccaggactccctc

SEQ ID NO: 2643595 - DNA, 18 bp, Homo sapiens
aggaccaggactccctcc

SEQ ID NO: 2643596 - DNA, 20 bp, Homo sapiens
aggaccagtcaacctgggca

SEQ ID NO: 2643597 - DNA, 13 bp, Homo sapiens
aggacccagagga

SEQ ID NO: 2643598 - DNA, 20 bp, Homo sapiens
aggacccatcacgcctgtgc

SEQ ID NO: 2643599 - DNA, 13 bp, Homo sapiens
aggacccccttcc

SEQ ID NO: 2643600 - DNA, 17 bp, Homo sapiens
aggacccccttccccta

SEQ ID NO: 2643601 - DNA, 15 bp, Homo sapiens
aggacccctcacctt

SEQ ID NO: 2643602 - DNA, 23 bp, Homo sapiens
aggacccctcaccttgcaacaca

SEQ ID NO: 2643603 - DNA, 20 bp, Homo sapiens
aggacccctccatgtgggct

SEQ ID NO: 2643604 - DNA, 12 bp, Homo sapiens
aggacccttccc

SEQ ID NO: 2643605 - DNA, 20 bp, Homo sapiens
aggacccttcccttgagccc

SEQ ID NO: 2643606 - DNA, 19 bp, Homo sapiens
aggacctagggatgttctg

SEQ ID NO: 2643607 - DNA, 13 bp, Homo sapiens
aggacctcaggtg

SEQ ID NO: 2643608 - DNA, 14 bp, Homo sapiens
aggacctcaggtga

SEQ ID NO: 2643609 - DNA, 13 bp, Homo sapiens
aggacggccggct

SEQ ID NO: 2643610 - DNA, 18 bp, Homo sapiens
aggactagaacctggagg

SEQ ID NO: 2643611 - DNA, 18 bp, Homo sapiens
aggactcagctccccaga

SEQ ID NO: 2643612 - DNA, 20 bp, Homo sapiens
aggactcagctccccagagt

SEQ ID NO: 2643613 - DNA, 13 bp, Homo sapiens
aggactccccagg

SEQ ID NO: 2643614 - DNA, 17 bp, Homo sapiens
aggactccccaggccag

SEQ ID NO: 2643615 - DNA, 20 bp, Homo sapiens
aggactccccaggccaggcc

SEQ ID NO: 2643616 - DNA, 16 bp, Homo sapiens
aggactccctcctcac

SEQ ID NO: 2643617 - DNA, 23 bp, Homo sapiens
aggactccctcctcacctctgga

SEQ ID NO: 2643618 - DNA, 13 bp, Homo sapiens
aggactctgaggc

SEQ ID NO: 2643619 - DNA, 15 bp, Homo sapiens
aggactctgcccaga

SEQ ID NO: 2643620 - DNA, 12 bp, Homo sapiens
aggactctgcct

SEQ ID NO: 2643621 - DNA, 22 bp, Homo sapiens
aggactgccgaccgaggctgga

SEQ ID NO: 2643622 - DNA, 15 bp, Homo sapiens
aggactgtatttgtg

SEQ ID NO: 2643623 - DNA, 17 bp, Homo sapiens
aggactgtatttgtgac

SEQ ID NO: 2643624 - DNA, 22 bp, Homo sapiens
aggactgtatttgtgactaatt

SEQ ID NO: 2643625 - DNA, 17 bp, Homo sapiens
aggactgtgacaggcag

SEQ ID NO: 2643626 - DNA, 19 bp, Homo sapiens
aggactgtgacaggcagca

SEQ ID NO: 2643627 - DNA, 21 bp, Homo sapiens
aggactgtgacaggcagcaga

SEQ ID NO: 2643628 - DNA, 18 bp, Homo sapiens
aggactgttttttcctga

SEQ ID NO: 2643629 - DNA, 22 bp, Homo sapiens
aggactgttttttcctgagctt

SEQ ID NO: 2643630 - DNA, 20 bp, Homo sapiens
aggacttaacggctccagga

SEQ ID NO: 2643631 - DNA, 21 bp, Homo sapiens
aggacttaacggctccaggat

SEQ ID NO: 2643632 - DNA, 16 bp, Homo sapiens
aggacttgaaagcatc

SEQ ID NO: 2643633 - DNA, 16 bp, Homo sapiens
aggacttggtctgatt

SEQ ID NO: 2643634 - DNA, 23 bp, Homo sapiens
aggacttggtctgatttcaggat

SEQ ID NO: 2643635 - DNA, 17 bp, Homo sapiens
aggacttttctttgtgg

SEQ ID NO: 2643636 - DNA, 19 bp, Homo sapiens
aggacttttctttgtggct

SEQ ID NO: 2643637 - DNA, 13 bp, Homo sapiens
aggagaaaaacaa

SEQ ID NO: 2643638 - DNA, 13 bp, Homo sapiens
aggagaaacacat

SEQ ID NO: 2643639 - DNA, 18 bp, Homo sapiens
aggagaaacagagacagg

SEQ ID NO: 2643640 - DNA, 11 bp, Homo sapiens
aggagaaactg

SEQ ID NO: 2643641 - DNA, 19 bp, Homo sapiens
aggagaaactggaactctc

SEQ ID NO: 2643642 - DNA, 15 bp, Homo sapiens
aggagaaccactaca

SEQ ID NO: 2643643 - DNA, 20 bp, Homo sapiens
aggagaatggcgtgaacccg

SEQ ID NO: 2643644 - DNA, 11 bp, Homo sapiens
aggagacacaa

SEQ ID NO: 2643645 - DNA, 18 bp, Homo sapiens
aggagacagttcaagaaa

SEQ ID NO: 2643646 - DNA, 14 bp, Homo sapiens
aggagaccaaggcg

SEQ ID NO: 2643647 - DNA, 15 bp, Homo sapiens
aggagagaagaatga

SEQ ID NO: 2643648 - DNA, 11 bp, Homo sapiens
aggagagaccg

SEQ ID NO: 2643649 - DNA, 12 bp, Homo sapiens
aggagagccaga

SEQ ID NO: 2643650 - DNA, 14 bp, Homo sapiens
aggagagccagaga

SEQ ID NO: 2643651 - DNA, 15 bp, Homo sapiens
aggagagcctgctgc

SEQ ID NO: 2643652 - DNA, 16 bp, Homo sapiens
aggagagcctgctgca

SEQ ID NO: 2643653 - DNA, 17 bp, Homo sapiens
aggagaggagagccaga

SEQ ID NO: 2643654 - DNA, 19 bp, Homo sapiens
aggagaggagagccagaga

SEQ ID NO: 2643655 - DNA, 15 bp, Homo sapiens
aggagaggagagggg

SEQ ID NO: 2643656 - DNA, 18 bp, Homo sapiens
aggctctgcgcctgcccc

SEQ ID NO: 2643657 - DNA, 18 bp, Homo sapiens
aggctcttctccccagag

SEQ ID NO: 2643658 - DNA, 20 bp, Homo sapiens
aggctctttctgggccaagt

SEQ ID NO: 2643659 - DNA, 23 bp, Homo sapiens
aggctctttggggtcagccaggg

SEQ ID NO: 2643660 - DNA, 13 bp, Homo sapiens
aggctgaaagagg

SEQ ID NO: 2643661 - DNA, 16 bp, Homo sapiens
aggctgaaagaggcca

SEQ ID NO: 2643662 - DNA, 20 bp, Homo sapiens
aggctgaccaagagagaaag

SEQ ID NO: 2643663 - DNA, 16 bp, Homo sapiens
aggctgagactgcggg

SEQ ID NO: 2643664 - DNA, 18 bp, Homo sapiens
aggctgaggaaaggccag

SEQ ID NO: 2643665 - DNA, 13 bp, Homo sapiens
aggctgaggactt

SEQ ID NO: 2643666 - DNA, 11 bp, Homo sapiens
aggctgaggca

SEQ ID NO: 2643667 - DNA, 21 bp, Homo sapiens
aggctgaggcgggtggatcac

SEQ ID NO: 2643668 - DNA, 18 bp, Homo sapiens
aggctgcagaaggccaag

SEQ ID NO: 2643669 - DNA, 15 bp, Homo sapiens
aggctgcccccggcc

SEQ ID NO: 2643670 - DNA, 18 bp, Homo sapiens
aggctgcctctcccatca

SEQ ID NO: 2643671 - DNA, 14 bp, Homo sapiens
aggctgctggcgcc

SEQ ID NO: 2643672 - DNA, 13 bp, Homo sapiens
aggctggagccca

SEQ ID NO: 2643673 - DNA, 20 bp, Homo sapiens
aggctggagtgcagtggcat

SEQ ID NO: 2643674 - DNA, 20 bp, Homo sapiens
aggctggagtggagtggcgt

SEQ ID NO: 2643675 - DNA, 20 bp, Homo sapiens
aggctggcaccgccttctct

SEQ ID NO: 2643676 - DNA, 16 bp, Homo sapiens
aggctggcagctctcc

SEQ ID NO: 2643677 - DNA, 17 bp, Homo sapiens
aggctggcagctctcca

SEQ ID NO: 2643678 - DNA, 15 bp, Homo sapiens
aggctggcgcagcca

SEQ ID NO: 2643679 - DNA, 20 bp, Homo sapiens
aggctggcgcagccaaggcc

SEQ ID NO: 2643680 - DNA, 13 bp, Homo sapiens
aggctggcgtgca

SEQ ID NO: 2643681 - DNA, 22 bp, Homo sapiens
aggctggctggcccgtcatgtt

SEQ ID NO: 2643682 - DNA, 17 bp, Homo sapiens
aggctgggaccacgtga

SEQ ID NO: 2643683 - DNA, 19 bp, Homo sapiens
aggctgggagagccttcca

SEQ ID NO: 2643684 - DNA, 22 bp, Homo sapiens
aggctgggagagccttccaggg

SEQ ID NO: 2643685 - DNA, 21 bp, Homo sapiens
aggctgggctcccttcccacc

SEQ ID NO: 2643686 - DNA, 22 bp, Homo sapiens
aggctgggcttcagtggcagct

SEQ ID NO: 2643687 - DNA, 23 bp, Homo sapiens
aggctgggcttcagtggcagctg

SEQ ID NO: 2643688 - DNA, 16 bp, Homo sapiens
aggctggggaagtcct

SEQ ID NO: 2643689 - DNA, 21 bp, Homo sapiens
aggctggggctgaccttcctc

SEQ ID NO: 2643690 - DNA, 22 bp, Homo sapiens
aggctggtctcaaactcctgac

SEQ ID NO: 2643691 - DNA, 20 bp, Homo sapiens
aggctgtatcccatgagcct

SEQ ID NO: 2643692 - DNA, 21 bp, Homo sapiens
aggctgtatcccatgagcctc

SEQ ID NO: 2643693 - DNA, 22 bp, Homo sapiens
aggctgtatcccatgagcctca

SEQ ID NO: 2643694 - DNA, 21 bp, Homo sapiens
aggctgtccttacccatctgc

SEQ ID NO: 2643695 - DNA, 18 bp, Homo sapiens
aggctgtgggcctcaagg

SEQ ID NO: 2643696 - DNA, 14 bp, Homo sapiens
aggcttacacccac

SEQ ID NO: 2643697 - DNA, 20 bp, Homo sapiens
aggcttcagcatatttatag

SEQ ID NO: 2643698 - DNA, 16 bp, Homo sapiens
aggcttctctctgtgg

SEQ ID NO: 2643699 - DNA, 18 bp, Homo sapiens
aggcttgcataataagct

SEQ ID NO: 2643700 - DNA, 20 bp, Homo sapiens
aggcttgctgagaggggctg

SEQ ID NO: 2643701 - DNA, 16 bp, Homo sapiens
agggaaaacattccat

SEQ ID NO: 2643702 - DNA, 18 bp, Homo sapiens
agggaaaattatttgcat

SEQ ID NO: 2643703 - DNA, 18 bp, Homo sapiens
agggaaaggatattttct

SEQ ID NO: 2643704 - DNA, 15 bp, Homo sapiens
agggaaatagaaaaa

SEQ ID NO: 2643705 - DNA, 23 bp, Homo sapiens
agggaaatagaaaaaccctgccc

SEQ ID NO: 2643706 - DNA, 14 bp, Homo sapiens
agggaactctgggg

SEQ ID NO: 2643707 - DNA, 16 bp, Homo sapiens
agggaagaaaagagct

SEQ ID NO: 2643708 - DNA, 14 bp, Homo sapiens
agggaagagtgcat

SEQ ID NO: 2643709 - DNA, 16 bp, Homo sapiens
agggaagctacaggtt

SEQ ID NO: 2643710 - DNA, 19 bp, Homo sapiens
agggaagctacaggttaca

SEQ ID NO: 2643711 - DNA, 13 bp, Homo sapiens
agggaagggcctg

SEQ ID NO: 2643712 - DNA, 21 bp, Homo sapiens
agggaaggggaggcagccggc

SEQ ID NO: 2643713 - DNA, 16 bp, Homo sapiens
agggacaccagccagg

SEQ ID NO: 2643714 - DNA, 14 bp, Homo sapiens
agggacagagccat

SEQ ID NO: 2643715 - DNA, 12 bp, Homo sapiens
agggacagaggg

SEQ ID NO: 2643716 - DNA, 22 bp, Homo sapiens
agggacagagggggtggcctcc

SEQ ID NO: 2643717 - DNA, 17 bp, Homo sapiens
agggacaggataagagg

SEQ ID NO: 2643718 - DNA, 13 bp, Homo sapiens
agggacatattca

SEQ ID NO: 2643719 - DNA, 23 bp, Homo sapiens
agggacatattcatttggaaata

SEQ ID NO: 2643720 - DNA, 20 bp, Homo sapiens
agggacatgttttgataaag

SEQ ID NO: 2643721 - DNA, 18 bp, Homo sapiens
agggaccaaggacccctc

SEQ ID NO: 2643722 - DNA, 19 bp, Homo sapiens
agggaccaaggacccctca

SEQ ID NO: 2643723 - DNA, 21 bp, Homo sapiens
agggaccaaggacccctcacc

SEQ ID NO: 2643724 - DNA, 13 bp, Homo sapiens
agggaccaaggca

SEQ ID NO: 2643725 - DNA, 23 bp, Homo sapiens
agggaccaaggcaaggcaggtgc

SEQ ID NO: 2643726 - DNA, 15 bp, Homo sapiens
agggaccagccaaga

SEQ ID NO: 2643727 - DNA, 13 bp, Homo sapiens
agggacccctcct

SEQ ID NO: 2643728 - DNA, 15 bp, Homo sapiens
agggacccctcctcc

SEQ ID NO: 2643729 - DNA, 16 bp, Homo sapiens
agggacctctcccagg

SEQ ID NO: 2643730 - DNA, 14 bp, Homo sapiens
agggaccttgaagg

SEQ ID NO: 2643731 - DNA, 15 bp, Homo sapiens
agggacgcctggggg

SEQ ID NO: 2643732 - DNA, 23 bp, Homo sapiens
agggacgcctgggggtgccagga

SEQ ID NO: 2643733 - DNA, 17 bp, Homo sapiens
agggacgctacccggga

SEQ ID NO: 2643734 - DNA, 17 bp, Homo sapiens
agggacttaaaaaactt

SEQ ID NO: 2643735 - DNA, 15 bp, Homo sapiens
agggacttggaagct

SEQ ID NO: 2643736 - DNA, 21 bp, Homo sapiens
agggagaagactatattgtac

SEQ ID NO: 2643737 - DNA, 15 bp, Homo sapiens
agggagaaggatcta

SEQ ID NO: 2643738 - DNA, 12 bp, Homo sapiens
agggagacagag

SEQ ID NO: 2643739 - DNA, 13 bp, Homo sapiens
agggagaggagtg

SEQ ID NO: 2643740 - DNA, 19 bp, Homo sapiens
agggagagtcatattttga

SEQ ID NO: 2643741 - DNA, 17 bp, Homo sapiens
agggagcccctttgatg

SEQ ID NO: 2643742 - DNA, 14 bp, Homo sapiens
agggagcctggccc

SEQ ID NO: 2643743 - DNA, 16 bp, Homo sapiens
agggagcgagggagaa

SEQ ID NO: 2643744 - DNA, 14 bp, Homo sapiens
agggagcggaaagc

SEQ ID NO: 2643745 - DNA, 17 bp, Homo sapiens
agggagcggaaagcagc

SEQ ID NO: 2643746 - DNA, 18 bp, Homo sapiens
agggagcggaaagcagct

SEQ ID NO: 2643747 - DNA, 22 bp, Homo sapiens
agggaggaatcgaggaaccaga

SEQ ID NO: 2643748 - DNA, 19 bp, Homo sapiens
agggaggaggccacctctc

SEQ ID NO: 2643749 - DNA, 18 bp, Homo sapiens
agggagggacatggcccc

SEQ ID NO: 2643750 - DNA, 17 bp, Homo sapiens
agggagggagggctcca

SEQ ID NO: 2643751 - DNA, 14 bp, Homo sapiens
agggagggctccag

SEQ ID NO: 2643752 - DNA, 17 bp, Homo sapiens
agggagggctccagaca

SEQ ID NO: 2643753 - DNA, 23 bp, Homo sapiens
agggagtccgaaagggacttgga

SEQ ID NO: 2643754 - DNA, 17 bp, Homo sapiens
agggagtgacagaggca

SEQ ID NO: 2643755 - DNA, 20 bp, Homo sapiens
agggagtgagttgatagcac

SEQ ID NO: 2643756 - DNA, 17 bp, Homo sapiens
agggatagcactgagca

SEQ ID NO: 2643757 - DNA, 13 bp, Homo sapiens
agggatcacaggg

SEQ ID NO: 2643758 - DNA, 15 bp, Homo sapiens
agggatcacagggcc

SEQ ID NO: 2643759 - DNA, 15 bp, Homo sapiens
agggatccctcatct

SEQ ID NO: 2643760 - DNA, 16 bp, Homo sapiens
agggatccctcatctg

SEQ ID NO: 2643761 - DNA, 19 bp, Homo sapiens
agggatccctcatctgtcc

SEQ ID NO: 2643762 - DNA, 19 bp, Homo sapiens
agggatcttgcattcccag

SEQ ID NO: 2643763 - DNA, 17 bp, Homo sapiens
agggatgaaagagaagg

SEQ ID NO: 2643764 - DNA, 17 bp, Homo sapiens
agggatgctgcctgagt

SEQ ID NO: 2643765 - DNA, 22 bp, Homo sapiens
agggatggaaaaggaagactag

SEQ ID NO: 2643766 - DNA, 13 bp, Homo sapiens
agggatggtgccc

SEQ ID NO: 2643767 - DNA, 18 bp, Homo sapiens
agggattacccaagcaaa

SEQ ID NO: 2643768 - DNA, 19 bp, Homo sapiens
agggattacccaagcaaaa

SEQ ID NO: 2643769 - DNA, 16 bp, Homo sapiens
agggattcaggctgct

SEQ ID NO: 2643770 - DNA, 18 bp, Homo sapiens
agggattcaggctgcttg

SEQ ID NO: 2643771 - DNA, 22 bp, Homo sapiens
agggcaacaatacatgctgcta

SEQ ID NO: 2643772 - DNA, 22 bp, Homo sapiens
agggcagaacactaacctgacc

SEQ ID NO: 2643773 - DNA, 15 bp, Homo sapiens
agggcagagccggga

SEQ ID NO: 2643774 - DNA, 12 bp, Homo sapiens
agggcagagtga

SEQ ID NO: 2643775 - DNA, 19 bp, Homo sapiens
agggcagagtgagacccag

SEQ ID NO: 2643776 - DNA, 14 bp, Homo sapiens
agggcagctgggcc

SEQ ID NO: 2643777 - DNA, 11 bp, Homo sapiens
agggcaggcat

SEQ ID NO: 2643778 - DNA, 19 bp, Homo sapiens
agggcataatgatgatggg

SEQ ID NO: 2643779 - DNA, 13 bp, Homo sapiens
agggcatctccag

SEQ ID NO: 2643780 - DNA, 14 bp, Homo sapiens
agggcatctccagg

SEQ ID NO: 2643781 - DNA, 18 bp, Homo sapiens
agggccacactattacca

SEQ ID NO: 2643782 - DNA, 15 bp, Homo sapiens
agggccactctgcct

SEQ ID NO: 2643783 - DNA, 10 bp, Homo sapiens
agggccaggc

SEQ ID NO: 2643784 - DNA, 13 bp, Homo sapiens
agggccaggcagg

SEQ ID NO: 2643785 - DNA, 22 bp, Homo sapiens
agggccaggcaggtgcctggac

SEQ ID NO: 2643786 - DNA, 21 bp, Homo sapiens
agggccaggggtctccctgga

SEQ ID NO: 2643787 - DNA, 19 bp, Homo sapiens
agggccagtcctgcctggc

SEQ ID NO: 2643788 - DNA, 15 bp, Homo sapiens
agggccagtctgggc

SEQ ID NO: 2643789 - DNA, 19 bp, Homo sapiens
agggccatgctgaagggac

SEQ ID NO: 2643790 - DNA, 12 bp, Homo sapiens
agggcccagaga

SEQ ID NO: 2643791 - DNA, 14 bp, Homo sapiens
agggcccagagagg

SEQ ID NO: 2643792 - DNA, 18 bp, Homo sapiens
agggccccagaaggcagg

SEQ ID NO: 2643793 - DNA, 12 bp, Homo sapiens
agggccccagca

SEQ ID NO: 2643794 - DNA, 20 bp, Homo sapiens
agggcccctctgcccagctt

SEQ ID NO: 2643795 - DNA, 13 bp, Homo sapiens
agggccctacctg

SEQ ID NO: 2643796 - DNA, 15 bp, Homo sapiens
agggccgagtgagag

SEQ ID NO: 2643797 - DNA, 16 bp, Homo sapiens
agggccgtaccccacc

SEQ ID NO: 2643798 - DNA, 17 bp, Homo sapiens
agggccgtaccccaccc

SEQ ID NO: 2643799 - DNA, 18 bp, Homo sapiens
agggccgtaccccaccct

SEQ ID NO: 2643800 - DNA, 18 bp, Homo sapiens
agggcctagctgctacaa

SEQ ID NO: 2643801 - DNA, 18 bp, Homo sapiens
agtaaatgggggtgcatt

SEQ ID NO: 2643802 - DNA, 21 bp, Homo sapiens
agtaaccttttgcacctgctc

SEQ ID NO: 2643803 - DNA, 16 bp, Homo sapiens
agtaagaagacatgaa

SEQ ID NO: 2643804 - DNA, 12 bp, Homo sapiens
agtaagagctgg

SEQ ID NO: 2643805 - DNA, 22 bp, Homo sapiens
agtaagcccttgaagatatctt

SEQ ID NO: 2643806 - DNA, 13 bp, Homo sapiens
agtaaggctgtgt

SEQ ID NO: 2643807 - DNA, 17 bp, Homo sapiens
agtaagggaaatagaaa

SEQ ID NO: 2643808 - DNA, 17 bp, Homo sapiens
agtaagtaccactcagg

SEQ ID NO: 2643809 - DNA, 13 bp, Homo sapiens
agtaagtgccttc

SEQ ID NO: 2643810 - DNA, 20 bp, Homo sapiens
agtaatatgcacacattttt

SEQ ID NO: 2643811 - DNA, 17 bp, Homo sapiens
agtaatcgcttaaagat

SEQ ID NO: 2643812 - DNA, 21 bp, Homo sapiens
agtaatgaatttttatgatat

SEQ ID NO: 2643813 - DNA, 22 bp, Homo sapiens
agtaatgaatttttatgatatt

SEQ ID NO: 2643814 - DNA, 20 bp, Homo sapiens
agtaatgctacgtgtgattt

SEQ ID NO: 2643815 - DNA, 12 bp, Homo sapiens
agtaattgtgaa

SEQ ID NO: 2643816 - DNA, 16 bp, Homo sapiens
agtacactgtttcaaa

SEQ ID NO: 2643817 - DNA, 23 bp, Homo sapiens
agtacactgtttcaaactttact

SEQ ID NO: 2643818 - DNA, 23 bp, Homo sapiens
agtacaggtaaggtgagggaata

SEQ ID NO: 2643819 - DNA, 17 bp, Homo sapiens
agtacatattaggaaaa

SEQ ID NO: 2643820 - DNA, 12 bp, Homo sapiens
agtacatttaat

SEQ ID NO: 2643821 - DNA, 15 bp, Homo sapiens
agtaccaatcatttt

SEQ ID NO: 2643822 - DNA, 22 bp, Homo sapiens
agtacccaaaagctcagccagc

SEQ ID NO: 2643823 - DNA, 18 bp, Homo sapiens
agtaccctctcagctcca

SEQ ID NO: 2643824 - DNA, 15 bp, Homo sapiens
agtacctgaaaagta

SEQ ID NO: 2643825 - DNA, 15 bp, Homo sapiens
agtacctggaggagg

SEQ ID NO: 2643826 - DNA, 13 bp, Homo sapiens
agtacctttgtca

SEQ ID NO: 2643827 - DNA, 13 bp, Homo sapiens
agtacgttattgt

SEQ ID NO: 2643828 - DNA, 16 bp, Homo sapiens
agtactcctgcaaaat

SEQ ID NO: 2643829 - DNA, 20 bp, Homo sapiens
agtacttctccaccctgctc

SEQ ID NO: 2643830 - DNA, 17 bp, Homo sapiens
agtagaagtcttagatg

SEQ ID NO: 2643831 - DNA, 17 bp, Homo sapiens
agtagatggtgaaattt

SEQ ID NO: 2643832 - DNA, 13 bp, Homo sapiens
agtagattttctt

SEQ ID NO: 2643833 - DNA, 17 bp, Homo sapiens
agtagattttctttaaa

SEQ ID NO: 2643834 - DNA, 23 bp, Homo sapiens
agtagcatgagagaattgtatca

SEQ ID NO: 2643835 - DNA, 19 bp, Homo sapiens
agtagcatgttgagccagg

SEQ ID NO: 2643836 - DNA, 13 bp, Homo sapiens
agtagcatttcat

SEQ ID NO: 2643837 - DNA, 16 bp, Homo sapiens
agtagccctttctgtg

SEQ ID NO: 2643838 - DNA, 17 bp, Homo sapiens
agtagccctttctgtgt

SEQ ID NO: 2643839 - DNA, 13 bp, Homo sapiens
agtagctgggact

SEQ ID NO: 2643840 - DNA, 22 bp, Homo sapiens
agtagctgggactacaggcacc

SEQ ID NO: 2643841 - DNA, 20 bp, Homo sapiens
agtagcttgggacaaatcaa

SEQ ID NO: 2643842 - DNA, 13 bp, Homo sapiens
agtagggggtcta

SEQ ID NO: 2643843 - DNA, 20 bp, Homo sapiens
agtaggttggaagctagctc

SEQ ID NO: 2643844 - DNA, 13 bp, Homo sapiens
agtagtaaaaatt

SEQ ID NO: 2643845 - DNA, 14 bp, Homo sapiens
agtagtaaaaatta

SEQ ID NO: 2643846 - DNA, 14 bp, Homo sapiens
agtagtacttgaaa

SEQ ID NO: 2643847 - DNA, 12 bp, Homo sapiens
agtagtcatttc

SEQ ID NO: 2643848 - DNA, 13 bp, Homo sapiens
agtagtcatttca

SEQ ID NO: 2643849 - DNA, 17 bp, Homo sapiens
agtagtttgtataactt

SEQ ID NO: 2643850 - DNA, 19 bp, Homo sapiens
agtatataatggtttcaaa

SEQ ID NO: 2643851 - DNA, 13 bp, Homo sapiens
agtatatctggac

SEQ ID NO: 2643852 - DNA, 15 bp, Homo sapiens
agtatattatgtatt

SEQ ID NO: 2643853 - DNA, 19 bp, Homo sapiens
agtatcaaatattagatgt

SEQ ID NO: 2643854 - DNA, 23 bp, Homo sapiens
agtatcaaatattagatgtgatt

SEQ ID NO: 2643855 - DNA, 14 bp, Homo sapiens
agtatcatgcattc

SEQ ID NO: 2643856 - DNA, 15 bp, Homo sapiens
agtatcctccaggtt

SEQ ID NO: 2643857 - DNA, 19 bp, Homo sapiens
agtatcctccaggtttttc

SEQ ID NO: 2643858 - DNA, 17 bp, Homo sapiens
agtatctatatatgtgt

SEQ ID NO: 2643859 - DNA, 19 bp, Homo sapiens
agtatctatatatgtgtat

SEQ ID NO: 2643860 - DNA, 23 bp, Homo sapiens
agtatctatatatgtgtatgtac

SEQ ID NO: 2643861 - DNA, 15 bp, Homo sapiens
agtatctgtatctct

SEQ ID NO: 2643862 - DNA, 18 bp, Homo sapiens
agtatgggttagggaaaa

SEQ ID NO: 2643863 - DNA, 16 bp, Homo sapiens
agtatggtggctgggt

SEQ ID NO: 2643864 - DNA, 16 bp, Homo sapiens
agtatgtaaagtatgt

SEQ ID NO: 2643865 - DNA, 23 bp, Homo sapiens
agtatgtgggcagattttcagca

SEQ ID NO: 2643866 - DNA, 19 bp, Homo sapiens
agtatgtgtttgtgtgtgt

SEQ ID NO: 2643867 - DNA, 16 bp, Homo sapiens
agtatgttttagcatg

SEQ ID NO: 2643868 - DNA, 20 bp, Homo sapiens
agtatgttttagcatgtgtt

SEQ ID NO: 2643869 - DNA, 15 bp, Homo sapiens
agtattacttctgct

SEQ ID NO: 2643870 - DNA, 20 bp, Homo sapiens
agtattataggccaaactgg

SEQ ID NO: 2643871 - DNA, 14 bp, Homo sapiens
agtattattttcca

SEQ ID NO: 2643872 - DNA, 19 bp, Homo sapiens
agtattcttatttaatgaa

SEQ ID NO: 2643873 - DNA, 15 bp, Homo sapiens
agtattcttgtcaaa

SEQ ID NO: 2643874 - DNA, 18 bp, Homo sapiens
agtattcttgtcaaaaaa

SEQ ID NO: 2643875 - DNA, 18 bp, Homo sapiens
agtattgaagcattttat

SEQ ID NO: 2643876 - DNA, 16 bp, Homo sapiens
agtatttatatattta

SEQ ID NO: 2643877 - DNA, 19 bp, Homo sapiens
agtatttatatatttataa

SEQ ID NO: 2643878 - DNA, 16 bp, Homo sapiens
agtatttcaaattgga

SEQ ID NO: 2643879 - DNA, 16 bp, Homo sapiens
agtatttgcatattct

SEQ ID NO: 2643880 - DNA, 12 bp, Homo sapiens
agtattttcctg

SEQ ID NO: 2643881 - DNA, 16 bp, Homo sapiens
agtattttcctgtaaa

SEQ ID NO: 2643882 - DNA, 14 bp, Homo sapiens
agtcaaaacagaga

SEQ ID NO: 2643883 - DNA, 21 bp, Homo sapiens
agtcaaaacagagatgtgata

SEQ ID NO: 2643884 - DNA, 13 bp, Homo sapiens
agtcaaagacatt

SEQ ID NO: 2643885 - DNA, 15 bp, Homo sapiens
agtcaacctgcctga

SEQ ID NO: 2643886 - DNA, 14 bp, Homo sapiens
agtcaacctgggca

SEQ ID NO: 2643887 - DNA, 19 bp, Homo sapiens
agtcaagaaaaattattgt

SEQ ID NO: 2643888 - DNA, 14 bp, Homo sapiens
agtcaatgtgcagt

SEQ ID NO: 2643889 - DNA, 15 bp, Homo sapiens
agtcaatgtgcagtg

SEQ ID NO: 2643890 - DNA, 23 bp, Homo sapiens
agtcacacagtgagtcgaggaca

SEQ ID NO: 2643891 - DNA, 16 bp, Homo sapiens
agtcacacgggggcag

SEQ ID NO: 2643892 - DNA, 15 bp, Homo sapiens
agtcacatcacagga

SEQ ID NO: 2643893 - DNA, 16 bp, Homo sapiens
agtcacatctcttcct

SEQ ID NO: 2643894 - DNA, 23 bp, Homo sapiens
agtcacatggcctatgcacatat

SEQ ID NO: 2643895 - DNA, 20 bp, Homo sapiens
agtcacattccaagcctcat

SEQ ID NO: 2643896 - DNA, 13 bp, Homo sapiens
agtcaccaagccc

SEQ ID NO: 2643897 - DNA, 15 bp, Homo sapiens
agtcaccaagcccag

SEQ ID NO: 2643898 - DNA, 17 bp, Homo sapiens
agtcacccatgaagaca

SEQ ID NO: 2643899 - DNA, 21 bp, Homo sapiens
agtcacgtggaggagcagtgc

SEQ ID NO: 2643900 - DNA, 19 bp, Homo sapiens
agtcactttttttttccaa

SEQ ID NO: 2643901 - DNA, 15 bp, Homo sapiens
agtcagactgctggg

SEQ ID NO: 2643902 - DNA, 12 bp, Homo sapiens
agtcaggaaagg

SEQ ID NO: 2643903 - DNA, 19 bp, Homo sapiens
agtcagggacccctgccct

SEQ ID NO: 2643904 - DNA, 19 bp, Homo sapiens
agtcaggggttcccttttt

SEQ ID NO: 2643905 - DNA, 20 bp, Homo sapiens
agtcagtgcccaactgttat

SEQ ID NO: 2643906 - DNA, 13 bp, Homo sapiens
agtcataaacctt

SEQ ID NO: 2643907 - DNA, 14 bp, Homo sapiens
agtcataccaatga

SEQ ID NO: 2643908 - DNA, 17 bp, Homo sapiens
agtcataccaatgaaaa

SEQ ID NO: 2643909 - DNA, 15 bp, Homo sapiens
agtcatattttgatt

SEQ ID NO: 2643910 - DNA, 13 bp, Homo sapiens
agtcatccaatct

SEQ ID NO: 2643911 - DNA, 17 bp, Homo sapiens
agtcatctccatcagct

SEQ ID NO: 2643912 - DNA, 21 bp, Homo sapiens
agtcatcttgaccaagcagga

SEQ ID NO: 2643913 - DNA, 22 bp, Homo sapiens
agtcatgcataaatatgcagtg

SEQ ID NO: 2643914 - DNA, 19 bp, Homo sapiens
agtcatgcgtttaatcaca

SEQ ID NO: 2643915 - DNA, 13 bp, Homo sapiens
agtcatgtgcatt

SEQ ID NO: 2643916 - DNA, 19 bp, Homo sapiens
agtcatgttccttcaagat

SEQ ID NO: 2643917 - DNA, 16 bp, Homo sapiens
agtcattagactcctc

SEQ ID NO: 2643918 - DNA, 19 bp, Homo sapiens
agtcattagactcctcctc

SEQ ID NO: 2643919 - DNA, 20 bp, Homo sapiens
agtcattatagatcccccag

SEQ ID NO: 2643920 - DNA, 23 bp, Homo sapiens
agtcattatagatcccccagact

SEQ ID NO: 2643921 - DNA, 13 bp, Homo sapiens
agtcatttaataa

SEQ ID NO: 2643922 - DNA, 16 bp, Homo sapiens
agtccaaatgtcctcc

SEQ ID NO: 2643923 - DNA, 11 bp, Homo sapiens
agtccaagcat

SEQ ID NO: 2643924 - DNA, 23 bp, Homo sapiens
agtccaaggaaaccacagctgct

SEQ ID NO: 2643925 - DNA, 18 bp, Homo sapiens
agtccaatgtctttttaa

SEQ ID NO: 2643926 - DNA, 18 bp, Homo sapiens
agtccagatttacactgg

SEQ ID NO: 2643927 - DNA, 12 bp, Homo sapiens
agtccaggcccc

SEQ ID NO: 2643928 - DNA, 17 bp, Homo sapiens
agtccagtgacctgctg

SEQ ID NO: 2643929 - DNA, 23 bp, Homo sapiens
agtccatatttcaatttccaaga

SEQ ID NO: 2643930 - DNA, 17 bp, Homo sapiens
agtcccaaggaaagccc

SEQ ID NO: 2643931 - DNA, 17 bp, Homo sapiens
agtcccactgcctcagg

SEQ ID NO: 2643932 - DNA, 20 bp, Homo sapiens
agtcccactgcctcaggttc

SEQ ID NO: 2643933 - DNA, 12 bp, Homo sapiens
agtcccagagca

SEQ ID NO: 2643934 - DNA, 16 bp, Homo sapiens
agtccccaggccccag

SEQ ID NO: 2643935 - DNA, 19 bp, Homo sapiens
agtccccaggccccaggaa

SEQ ID NO: 2643936 - DNA, 19 bp, Homo sapiens
agtccccgagtttccccag

SEQ ID NO: 2643937 - DNA, 18 bp, Homo sapiens
agtcccctccccggccct

SEQ ID NO: 2643938 - DNA, 14 bp, Homo sapiens
agtcccctgtttgt

SEQ ID NO: 2643939 - DNA, 15 bp, Homo sapiens
agtcccgtcaggacg

SEQ ID NO: 2643940 - DNA, 15 bp, Homo sapiens
agtccctatgtattt

SEQ ID NO: 2643941 - DNA, 14 bp, Homo sapiens
agtccctgccaatg

SEQ ID NO: 2643942 - DNA, 16 bp, Homo sapiens
agtccctgccaatgga

SEQ ID NO: 2643943 - DNA, 18 bp, Homo sapiens
agtccctgtaattgttgt

SEQ ID NO: 2643944 - DNA, 23 bp, Homo sapiens
agtccctgtaattgttgtttgta

SEQ ID NO: 2643945 - DNA, 19 bp, Homo sapiens
agtccctgttttctgagcc

SEQ ID NO: 2643946 - DNA, 15 bp, Homo sapiens
agtcccttcccctcc

SEQ ID NO: 2643947 - DNA, 20 bp, Homo sapiens
agtgttaatactagttgtga

SEQ ID NO: 2643948 - DNA, 15 bp, Homo sapiens
agtgttagggaaggg

SEQ ID NO: 2643949 - DNA, 23 bp, Homo sapiens
agtgttagggaagggcctgccac

SEQ ID NO: 2643950 - DNA, 16 bp, Homo sapiens
agtgttgaaaatgttc

SEQ ID NO: 2643951 - DNA, 17 bp, Homo sapiens
agtgttgaaaatgttca

SEQ ID NO: 2643952 - DNA, 17 bp, Homo sapiens
agtgttgagccttttcc

SEQ ID NO: 2643953 - DNA, 16 bp, Homo sapiens
agtgttgcatggatgt

SEQ ID NO: 2643954 - DNA, 15 bp, Homo sapiens
agtgtttatttttca

SEQ ID NO: 2643955 - DNA, 15 bp, Homo sapiens
agtgtttcccataat

SEQ ID NO: 2643956 - DNA, 14 bp, Homo sapiens
agtgtttctgtgca

SEQ ID NO: 2643957 - DNA, 17 bp, Homo sapiens
agtgtttctgtgcatgg

SEQ ID NO: 2643958 - DNA, 12 bp, Homo sapiens
agtgtttctgtt

SEQ ID NO: 2643959 - DNA, 15 bp, Homo sapiens
agtgtttctgttatt

SEQ ID NO: 2643960 - DNA, 21 bp, Homo sapiens
agtgtttctgttattaacaaa

SEQ ID NO: 2643961 - DNA, 20 bp, Homo sapiens
agtgttttaagataaattat

SEQ ID NO: 2643962 - DNA, 13 bp, Homo sapiens
agtgttttctggg

SEQ ID NO: 2643963 - DNA, 15 bp, Homo sapiens
agtgttttctgggat

SEQ ID NO: 2643964 - DNA, 17 bp, Homo sapiens
agtgtttttacctctgt

SEQ ID NO: 2643965 - DNA, 15 bp, Homo sapiens
agtgtttttgtaaag

SEQ ID NO: 2643966 - DNA, 23 bp, Homo sapiens
agttaaatagagtatatgcactt

SEQ ID NO: 2643967 - DNA, 17 bp, Homo sapiens
agttaacaatgatatat

SEQ ID NO: 2643968 - DNA, 12 bp, Homo sapiens
agttaacagaga

SEQ ID NO: 2643969 - DNA, 17 bp, Homo sapiens
agttaagaagctgttgt

SEQ ID NO: 2643970 - DNA, 18 bp, Homo sapiens
agttaagaagctgttgta

SEQ ID NO: 2643971 - DNA, 20 bp, Homo sapiens
agttaatatatcccagaaat

SEQ ID NO: 2643972 - DNA, 20 bp, Homo sapiens
agttaattacatcctcatgc

SEQ ID NO: 2643973 - DNA, 21 bp, Homo sapiens
agttacaacttcctaatttta

SEQ ID NO: 2643974 - DNA, 18 bp, Homo sapiens
agttacactaaaaggtga

SEQ ID NO: 2643975 - DNA, 12 bp, Homo sapiens
agttacagaaag

SEQ ID NO: 2643976 - DNA, 13 bp, Homo sapiens
agttacagaaagt

SEQ ID NO: 2643977 - DNA, 22 bp, Homo sapiens
agttacagcgagaggcagagaa

SEQ ID NO: 2643978 - DNA, 23 bp, Homo sapiens
agttacagcgagaggcagagaaa

SEQ ID NO: 2643979 - DNA, 23 bp, Homo sapiens
agttactatcatgtcaaacgtga

SEQ ID NO: 2643980 - DNA, 15 bp, Homo sapiens
agttactctgaaggg

SEQ ID NO: 2643981 - DNA, 13 bp, Homo sapiens
agttactgaatgc

SEQ ID NO: 2643982 - DNA, 14 bp, Homo sapiens
agttactgaatgca

SEQ ID NO: 2643983 - DNA, 13 bp, Homo sapiens
agttactgttgtg

SEQ ID NO: 2643984 - DNA, 12 bp, Homo sapiens
agttagagctga

SEQ ID NO: 2643985 - DNA, 19 bp, Homo sapiens
agttagaggccagcctggc

SEQ ID NO: 2643986 - DNA, 11 bp, Homo sapiens
agttagcacca

SEQ ID NO: 2643987 - DNA, 18 bp, Homo sapiens
agttaggaaataaaacct

SEQ ID NO: 2643988 - DNA, 22 bp, Homo sapiens
agttaggaaataaaacctttca

SEQ ID NO: 2643989 - DNA, 20 bp, Homo sapiens
agttagtggattactgccat

SEQ ID NO: 2643990 - DNA, 17 bp, Homo sapiens
agttagtttctttggga

SEQ ID NO: 2643991 - DNA, 15 bp, Homo sapiens
agttatagatgtcta

SEQ ID NO: 2643992 - DNA, 17 bp, Homo sapiens
agttatagatgtctagg

SEQ ID NO: 2643993 - DNA, 23 bp, Homo sapiens
agttatcagacactctggctggt

SEQ ID NO: 2643994 - DNA, 21 bp, Homo sapiens
agttatggcctatacactatt

SEQ ID NO: 2643995 - DNA, 13 bp, Homo sapiens
agttatgtgaatg

SEQ ID NO: 2643996 - DNA, 13 bp, Homo sapiens
agttattgcagtt

SEQ ID NO: 2643997 - DNA, 13 bp, Homo sapiens
agttattgtacag

SEQ ID NO: 2643998 - DNA, 19 bp, Homo sapiens
agttattgtacagctgttt

SEQ ID NO: 2643999 - DNA, 19 bp, Homo sapiens
agttcaataaatgtctgtt

SEQ ID NO: 2644000 - DNA, 21 bp, Homo sapiens
agttcaataaatgtctgttga

SEQ ID NO: 2644001 - DNA, 15 bp, Homo sapiens
agttcaatctcccgc

SEQ ID NO: 2644002 - DNA, 10 bp, Homo sapiens
agttcaatga

SEQ ID NO: 2644003 - DNA, 11 bp, Homo sapiens
agttcaatgat

SEQ ID NO: 2644004 - DNA, 20 bp, Homo sapiens
agttcaatgatctaggttta

SEQ ID NO: 2644005 - DNA, 21 bp, Homo sapiens
agttcaatgatctaggtttaa

SEQ ID NO: 2644006 - DNA, 17 bp, Homo sapiens
agttcaatggctgctga

SEQ ID NO: 2644007 - DNA, 18 bp, Homo sapiens
agttcaatggctgctgaa

SEQ ID NO: 2644008 - DNA, 16 bp, Homo sapiens
agttcaattctcattt

SEQ ID NO: 2644009 - DNA, 19 bp, Homo sapiens
agttcaggagtcccaagga

SEQ ID NO: 2644010 - DNA, 14 bp, Homo sapiens
agttcagtacctgg

SEQ ID NO: 2644011 - DNA, 19 bp, Homo sapiens
agttcagtggcagggctca

SEQ ID NO: 2644012 - DNA, 21 bp, Homo sapiens
agttcagtggcagggctcagg

SEQ ID NO: 2644013 - DNA, 18 bp, Homo sapiens
agttcatatgtaccatgt

SEQ ID NO: 2644014 - DNA, 16 bp, Homo sapiens
agttcatccaatcctc

SEQ ID NO: 2644015 - DNA, 18 bp, Homo sapiens
agttcatccaatcctcac

SEQ ID NO: 2644016 - DNA, 14 bp, Homo sapiens
agttccactgagct

SEQ ID NO: 2644017 - DNA, 22 bp, Homo sapiens
agttccatgaagaccacatcca

SEQ ID NO: 2644018 - DNA, 17 bp, Homo sapiens
agttccccatgcagaca

SEQ ID NO: 2644019 - DNA, 17 bp, Homo sapiens
agttccctacttcctgt

SEQ ID NO: 2644020 - DNA, 13 bp, Homo sapiens
agttcccttggcc

SEQ ID NO: 2644021 - DNA, 16 bp, Homo sapiens
agttcccttggcctca

SEQ ID NO: 2644022 - DNA, 23 bp, Homo sapiens
agttcctcattagcattttgcta

SEQ ID NO: 2644023 - DNA, 21 bp, Homo sapiens
agttcctgcggagtgaagagg

SEQ ID NO: 2644024 - DNA, 20 bp, Homo sapiens
agttcctgtcccttctctta

SEQ ID NO: 2644025 - DNA, 21 bp, Homo sapiens
agttcctgtcccttctcttaa

SEQ ID NO: 2644026 - DNA, 14 bp, Homo sapiens
agttccttatgtat

SEQ ID NO: 2644027 - DNA, 19 bp, Homo sapiens
agttcgagaccagcctggc

SEQ ID NO: 2644028 - DNA, 20 bp, Homo sapiens
agttctacctcaggcagctc

SEQ ID NO: 2644029 - DNA, 17 bp, Homo sapiens
agttctagagaagaggc

SEQ ID NO: 2644030 - DNA, 14 bp, Homo sapiens
agttctcagggctc

SEQ ID NO: 2644031 - DNA, 23 bp, Homo sapiens
agttctcagggctcctgccttct

SEQ ID NO: 2644032 - DNA, 16 bp, Homo sapiens
agttctctcgtaactg

SEQ ID NO: 2644033 - DNA, 14 bp, Homo sapiens
agttctgctcctct

SEQ ID NO: 2644034 - DNA, 15 bp, Homo sapiens
agttctgctcctctc

SEQ ID NO: 2644035 - DNA, 11 bp, Homo sapiens
agttctgggca

SEQ ID NO: 2644036 - DNA, 17 bp, Homo sapiens
agttctgggtgctccct

SEQ ID NO: 2644037 - DNA, 22 bp, Homo sapiens
agttcttaaggattgtgatatt

SEQ ID NO: 2644038 - DNA, 18 bp, Homo sapiens
agttcttcgggaagagag

SEQ ID NO: 2644039 - DNA, 19 bp, Homo sapiens
agttcttcgggaagagagg

SEQ ID NO: 2644040 - DNA, 20 bp, Homo sapiens
agttcttcgggaagagagga

SEQ ID NO: 2644041 - DNA, 20 bp, Homo sapiens
agttgaaaagactccaaaga

SEQ ID NO: 2644042 - DNA, 13 bp, Homo sapiens
agttgaactgata

SEQ ID NO: 2644043 - DNA, 23 bp, Homo sapiens
agttgaactgatagttactgttg

SEQ ID NO: 2644044 - DNA, 22 bp, Homo sapiens
agttgacttgacagaacactgt

SEQ ID NO: 2644045 - DNA, 11 bp, Homo sapiens
agttgagcccc

SEQ ID NO: 2644046 - DNA, 16 bp, Homo sapiens
agttgatactacagtt

SEQ ID NO: 2644047 - DNA, 15 bp, Homo sapiens
agttgatagcacaga

SEQ ID NO: 2644048 - DNA, 20 bp, Homo sapiens
agttgatagcacagaccctg

SEQ ID NO: 2644049 - DNA, 22 bp, Homo sapiens
agttgatagcacagaccctgcc

SEQ ID NO: 2644050 - DNA, 18 bp, Homo sapiens
agttgattcagctctgca

SEQ ID NO: 2644051 - DNA, 18 bp, Homo sapiens
agttgatttagtgttttt

SEQ ID NO: 2644052 - DNA, 21 bp, Homo sapiens
agttgattttacaattgaaat

SEQ ID NO: 2644053 - DNA, 15 bp, Homo sapiens
agttgcaatagaaca

SEQ ID NO: 2644054 - DNA, 20 bp, Homo sapiens
agttgcaattgaattaaatt

SEQ ID NO: 2644055 - DNA, 16 bp, Homo sapiens
agttgcacggctgctg

SEQ ID NO: 2644056 - DNA, 16 bp, Homo sapiens
agttgcagactcagtt

SEQ ID NO: 2644057 - DNA, 16 bp, Homo sapiens
agttgcagattcattt

SEQ ID NO: 2644058 - DNA, 21 bp, Homo sapiens
agttgcatggcatcacctcca

SEQ ID NO: 2644059 - DNA, 20 bp, Homo sapiens
agttgccagtcaccccggcc

SEQ ID NO: 2644060 - DNA, 23 bp, Homo sapiens
agttgccagtcaccccggccacc

SEQ ID NO: 2644061 - DNA, 17 bp, Homo sapiens
agttgctgcaaacctga

SEQ ID NO: 2644062 - DNA, 14 bp, Homo sapiens
agttgctgtcataa

SEQ ID NO: 2644063 - DNA, 15 bp, Homo sapiens
agttgggagcactgg

SEQ ID NO: 2644064 - DNA, 19 bp, Homo sapiens
agttgggcttcctcatagt

SEQ ID NO: 2644065 - DNA, 17 bp, Homo sapiens
agttgggtggatgcctg

SEQ ID NO: 2644066 - DNA, 16 bp, Homo sapiens
agttgtagaatgtatt

SEQ ID NO: 2644067 - DNA, 23 bp, Homo sapiens
agttgtatcagcacgtgtggcct

SEQ ID NO: 2644068 - DNA, 16 bp, Homo sapiens
agttgtatctcttttg

SEQ ID NO: 2644069 - DNA, 17 bp, Homo sapiens
agttgtatctcttttga

SEQ ID NO: 2644070 - DNA, 22 bp, Homo sapiens
agttgtatctcttttgaatcca

SEQ ID NO: 2644071 - DNA, 13 bp, Homo sapiens
agttgtcttgtcc

SEQ ID NO: 2644072 - DNA, 19 bp, Homo sapiens
agttgtgcttgtttacagc

SEQ ID NO: 2644073 - DNA, 13 bp, Homo sapiens
agttgttggcctc

SEQ ID NO: 2644074 - DNA, 19 bp, Homo sapiens
agttgttggcctccggcct

SEQ ID NO: 2644075 - DNA, 16 bp, Homo sapiens
agttgtttcattgact

SEQ ID NO: 2644076 - DNA, 20 bp, Homo sapiens
agttgtttgattcagacagc

SEQ ID NO: 2644077 - DNA, 21 bp, Homo sapiens
agttgtttgattcagacagct

SEQ ID NO: 2644078 - DNA, 12 bp, Homo sapiens
agtttaaagcaa

SEQ ID NO: 2644079 - DNA, 12 bp, Homo sapiens
agtttaacacaa

SEQ ID NO: 2644080 - DNA, 15 bp, Homo sapiens
agtttaattgactta

SEQ ID NO: 2644081 - DNA, 17 bp, Homo sapiens
agtttacaagtgtatat

SEQ ID NO: 2644082 - DNA, 21 bp, Homo sapiens
agtttacaagtgtatatcaga

SEQ ID NO: 2644083 - DNA, 20 bp, Homo sapiens
agtttacctctttaaaaaca

SEQ ID NO: 2644084 - DNA, 14 bp, Homo sapiens
agtttactatttta

SEQ ID NO: 2644085 - DNA, 14 bp, Homo sapiens
agtttagaggaaaa

SEQ ID NO: 2644086 - DNA, 21 bp, Homo sapiens
agtttagaggaaaaaaatgac

SEQ ID NO: 2644087 - DNA, 17 bp, Homo sapiens
agtttagtaaggctgtg

SEQ ID NO: 2644088 - DNA, 16 bp, Homo sapiens
agtttatcattcaagt

SEQ ID NO: 2644089 - DNA, 14 bp, Homo sapiens
agtttcaatgtgat

SEQ ID NO: 2644090 - DNA, 15 bp, Homo sapiens
agtttcactgactta

SEQ ID NO: 2644091 - DNA, 17 bp, Homo sapiens
agtttcactgccatata

SEQ ID NO: 2644092 - DNA, 16 bp, Homo sapiens
atactgtacttaataa

SEQ ID NO: 2644093 - DNA, 17 bp, Homo sapiens
atactgtacttaataaa

SEQ ID NO: 2644094 - DNA, 16 bp, Homo sapiens
atactgtgctggagcc

SEQ ID NO: 2644095 - DNA, 16 bp, Homo sapiens
atactgtttgaggttt

SEQ ID NO: 2644096 - DNA, 22 bp, Homo sapiens
atacttagcaaagttttacctg

SEQ ID NO: 2644097 - DNA, 17 bp, Homo sapiens
atacttatctctctgtg

SEQ ID NO: 2644098 - DNA, 18 bp, Homo sapiens
atacttatctctctgtgc

SEQ ID NO: 2644099 - DNA, 15 bp, Homo sapiens
atactttaaaggaaa

SEQ ID NO: 2644100 - DNA, 13 bp, Homo sapiens
atactttgtctga

SEQ ID NO: 2644101 - DNA, 19 bp, Homo sapiens
atacttttttcttatttaa

SEQ ID NO: 2644102 - DNA, 13 bp, Homo sapiens
atagaacagtgct

SEQ ID NO: 2644103 - DNA, 18 bp, Homo sapiens
atagaactctgaaatgaa

SEQ ID NO: 2644104 - DNA, 19 bp, Homo sapiens
atagaagaactgcaaaggt

SEQ ID NO: 2644105 - DNA, 14 bp, Homo sapiens
atagaagctgtagt

SEQ ID NO: 2644106 - DNA, 19 bp, Homo sapiens
atagaaggctatggggata

SEQ ID NO: 2644107 - DNA, 16 bp, Homo sapiens
atagacaatttattat

SEQ ID NO: 2644108 - DNA, 22 bp, Homo sapiens
atagacaatttattatggcaca

SEQ ID NO: 2644109 - DNA, 20 bp, Homo sapiens
atagacagtatatttatagt

SEQ ID NO: 2644110 - DNA, 18 bp, Homo sapiens
atagagagggagaagaag

SEQ ID NO: 2644111 - DNA, 16 bp, Homo sapiens
atagagatgtttttaa

SEQ ID NO: 2644112 - DNA, 21 bp, Homo sapiens
atagagcacctagtccagtga

SEQ ID NO: 2644113 - DNA, 13 bp, Homo sapiens
atagagcctgagg

SEQ ID NO: 2644114 - DNA, 16 bp, Homo sapiens
atagaggtaccagcaa

SEQ ID NO: 2644115 - DNA, 22 bp, Homo sapiens
atagaggtgagggaagcctgaa

SEQ ID NO: 2644116 - DNA, 14 bp, Homo sapiens
atagagtatatgca

SEQ ID NO: 2644117 - DNA, 15 bp, Homo sapiens
atagatcccccagac

SEQ ID NO: 2644118 - DNA, 16 bp, Homo sapiens
atagatcccccagact

SEQ ID NO: 2644119 - DNA, 16 bp, Homo sapiens
atagatgcaagatatt

SEQ ID NO: 2644120 - DNA, 11 bp, Homo sapiens
atagatgtgtg

SEQ ID NO: 2644121 - DNA, 12 bp, Homo sapiens
atagatgtgtgg

SEQ ID NO: 2644122 - DNA, 19 bp, Homo sapiens
atagcaaatgttttgacat

SEQ ID NO: 2644123 - DNA, 23 bp, Homo sapiens
atagcaaatgttttgacatgaaa

SEQ ID NO: 2644124 - DNA, 19 bp, Homo sapiens
atagcaagtgaatttttct

SEQ ID NO: 2644125 - DNA, 22 bp, Homo sapiens
atagcaagtgaatttttctcta

SEQ ID NO: 2644126 - DNA, 22 bp, Homo sapiens
atagcaatccatgttagttttt

SEQ ID NO: 2644127 - DNA, 17 bp, Homo sapiens
atagcacagaccctgcc

SEQ ID NO: 2644128 - DNA, 13 bp, Homo sapiens
atagcattaacta

SEQ ID NO: 2644129 - DNA, 16 bp, Homo sapiens
atagcattctctatca

SEQ ID NO: 2644130 - DNA, 19 bp, Homo sapiens
atagcatttttgatttatg

SEQ ID NO: 2644131 - DNA, 12 bp, Homo sapiens
atagcccagaca

SEQ ID NO: 2644132 - DNA, 15 bp, Homo sapiens
atagcctaggtgaca

SEQ ID NO: 2644133 - DNA, 17 bp, Homo sapiens
atagctatatccatgta

SEQ ID NO: 2644134 - DNA, 22 bp, Homo sapiens
atagctatatccatgtactgta

SEQ ID NO: 2644135 - DNA, 23 bp, Homo sapiens
atagctatatccatgtactgtag

SEQ ID NO: 2644136 - DNA, 22 bp, Homo sapiens
atagctattactgtctggtttt

SEQ ID NO: 2644137 - DNA, 12 bp, Homo sapiens
atagctattttt

SEQ ID NO: 2644138 - DNA, 21 bp, Homo sapiens
atagctgagattcctggttcg

SEQ ID NO: 2644139 - DNA, 13 bp, Homo sapiens
atagctgtattga

SEQ ID NO: 2644140 - DNA, 15 bp, Homo sapiens
atagctgtattgaat

SEQ ID NO: 2644141 - DNA, 16 bp, Homo sapiens
atagctgtattgaatc

SEQ ID NO: 2644142 - DNA, 17 bp, Homo sapiens
atagcttgtatagtgta

SEQ ID NO: 2644143 - DNA, 20 bp, Homo sapiens
atagcttgtatagtgtaaaa

SEQ ID NO: 2644144 - DNA, 19 bp, Homo sapiens
atagctttattttttaagt

SEQ ID NO: 2644145 - DNA, 21 bp, Homo sapiens
ataggaattgacccacaagaa

SEQ ID NO: 2644146 - DNA, 22 bp, Homo sapiens
ataggaattgacccacaagaaa

SEQ ID NO: 2644147 - DNA, 20 bp, Homo sapiens
ataggagaggatgagagccc

SEQ ID NO: 2644148 - DNA, 22 bp, Homo sapiens
ataggctctgcacagatggatt

SEQ ID NO: 2644149 - DNA, 14 bp, Homo sapiens
ataggctggagaag

SEQ ID NO: 2644150 - DNA, 21 bp, Homo sapiens
ataggctggagaagctcaccc

SEQ ID NO: 2644151 - DNA, 15 bp, Homo sapiens
atagggagaaaccaa

SEQ ID NO: 2644152 - DNA, 22 bp, Homo sapiens
atagggcctggtccctgggagg

SEQ ID NO: 2644153 - DNA, 14 bp, Homo sapiens
atagggtctaactc

SEQ ID NO: 2644154 - DNA, 16 bp, Homo sapiens
ataggtcactcctggg

SEQ ID NO: 2644155 - DNA, 23 bp, Homo sapiens
ataggtcagtgaggcccagggag

SEQ ID NO: 2644156 - DNA, 21 bp, Homo sapiens
ataggtgctacaaaaacacag

SEQ ID NO: 2644157 - DNA, 21 bp, Homo sapiens
ataggttttgtttgctatctt

SEQ ID NO: 2644158 - DNA, 13 bp, Homo sapiens
atagtaaaaataa

SEQ ID NO: 2644159 - DNA, 16 bp, Homo sapiens
atagtaacctgggtaa

SEQ ID NO: 2644160 - DNA, 17 bp, Homo sapiens
atagtaccaatcatttt

SEQ ID NO: 2644161 - DNA, 16 bp, Homo sapiens
atagtagcatacattt

SEQ ID NO: 2644162 - DNA, 18 bp, Homo sapiens
atagtatcctccaggttt

SEQ ID NO: 2644163 - DNA, 20 bp, Homo sapiens
atagtatcctccaggttttt

SEQ ID NO: 2644164 - DNA, 15 bp, Homo sapiens
atagtatggtggctg

SEQ ID NO: 2644165 - DNA, 16 bp, Homo sapiens
atagtatggtggctgg

SEQ ID NO: 2644166 - DNA, 17 bp, Homo sapiens
atagtatggtggctggg

SEQ ID NO: 2644167 - DNA, 19 bp, Homo sapiens
atagtcaaaccataaactt

SEQ ID NO: 2644168 - DNA, 14 bp, Homo sapiens
atagtcacaagagc

SEQ ID NO: 2644169 - DNA, 12 bp, Homo sapiens
atagtgtgttct

SEQ ID NO: 2644170 - DNA, 19 bp, Homo sapiens
atagtgtgttctgattaga

SEQ ID NO: 2644171 - DNA, 12 bp, Homo sapiens
atagtgttaatc

SEQ ID NO: 2644172 - DNA, 22 bp, Homo sapiens
atagttaagcgtgcataagtta

SEQ ID NO: 2644173 - DNA, 16 bp, Homo sapiens
atagttactgttgtga

SEQ ID NO: 2644174 - DNA, 13 bp, Homo sapiens
atagttgtaacta

SEQ ID NO: 2644175 - DNA, 20 bp, Homo sapiens
atagttgtaccgcaatgtga

SEQ ID NO: 2644176 - DNA, 17 bp, Homo sapiens
atagttgtggacattta

SEQ ID NO: 2644177 - DNA, 18 bp, Homo sapiens
atagttgtgggtgggaga

SEQ ID NO: 2644178 - DNA, 14 bp, Homo sapiens
atagtttacatgta

SEQ ID NO: 2644179 - DNA, 17 bp, Homo sapiens
atagtttacctgaataa

SEQ ID NO: 2644180 - DNA, 15 bp, Homo sapiens
atagtttactatttt

SEQ ID NO: 2644181 - DNA, 14 bp, Homo sapiens
atagtttcagatat

SEQ ID NO: 2644182 - DNA, 15 bp, Homo sapiens
atagttttactttta

SEQ ID NO: 2644183 - DNA, 21 bp, Homo sapiens
atagttttacttttaaactgt

SEQ ID NO: 2644184 - DNA, 16 bp, Homo sapiens
atagttttattaataa

SEQ ID NO: 2644185 - DNA, 23 bp, Homo sapiens
atataaaaaccccaaactgttga

SEQ ID NO: 2644186 - DNA, 20 bp, Homo sapiens
atataaaaagaaaagataaa

SEQ ID NO: 2644187 - DNA, 20 bp, Homo sapiens
atataaaaggcaaatgtgta

SEQ ID NO: 2644188 - DNA, 21 bp, Homo sapiens
atataaaaggcaaatgtgtac

SEQ ID NO: 2644189 - DNA, 13 bp, Homo sapiens
atataaacactat

SEQ ID NO: 2644190 - DNA, 15 bp, Homo sapiens
atataaacactatat

SEQ ID NO: 2644191 - DNA, 14 bp, Homo sapiens
atataaagatgtta

SEQ ID NO: 2644192 - DNA, 15 bp, Homo sapiens
atataaataaaacat

SEQ ID NO: 2644193 - DNA, 22 bp, Homo sapiens
atataaatattagaaacagctt

SEQ ID NO: 2644194 - DNA, 17 bp, Homo sapiens
atataaattttttttgt

SEQ ID NO: 2644195 - DNA, 22 bp, Homo sapiens
atataaattttttttgtttcat

SEQ ID NO: 2644196 - DNA, 22 bp, Homo sapiens
atataacttatattgtaagaaa

SEQ ID NO: 2644197 - DNA, 19 bp, Homo sapiens
atataagtttgaaggaaac

SEQ ID NO: 2644198 - DNA, 20 bp, Homo sapiens
atataatatatttgtgtatt

SEQ ID NO: 2644199 - DNA, 23 bp, Homo sapiens
atataatatgcacacagtgcttt

SEQ ID NO: 2644200 - DNA, 21 bp, Homo sapiens
atataatgttgttatttaaag

SEQ ID NO: 2644201 - DNA, 22 bp, Homo sapiens
atataatgttgttatttaaaga

SEQ ID NO: 2644202 - DNA, 14 bp, Homo sapiens
atataattctgtaa

SEQ ID NO: 2644203 - DNA, 20 bp, Homo sapiens
atataattttttagagagct

SEQ ID NO: 2644204 - DNA, 23 bp, Homo sapiens
atatacagtaactttatgtgtaa

SEQ ID NO: 2644205 - DNA, 18 bp, Homo sapiens
atatactgtaaagaaaga

SEQ ID NO: 2644206 - DNA, 22 bp, Homo sapiens
atatactgtaaagaaagagaga

SEQ ID NO: 2644207 - DNA, 24 bp, Homo sapiens
atatactgtaaagaaagagagaaa

SEQ ID NO: 2644208 - DNA, 22 bp, Homo sapiens
atatacttttttcttatttaac

SEQ ID NO: 2644209 - DNA, 15 bp, Homo sapiens
atatagattataact

SEQ ID NO: 2644210 - DNA, 21 bp, Homo sapiens
atatagctatttttatggaat

SEQ ID NO: 2644211 - DNA, 16 bp, Homo sapiens
atataggttgtgcaaa

SEQ ID NO: 2644212 - DNA, 16 bp, Homo sapiens
atatagttttactttt

SEQ ID NO: 2644213 - DNA, 23 bp, Homo sapiens
atatagttttacttttaaactgt

SEQ ID NO: 2644214 - DNA, 13 bp, Homo sapiens
atatataaccagt

SEQ ID NO: 2644215 - DNA, 15 bp, Homo sapiens
atatataattctgta

SEQ ID NO: 2644216 - DNA, 18 bp, Homo sapiens
atatatacagtaacttta

SEQ ID NO: 2644217 - DNA, 20 bp, Homo sapiens
atatatacagtaactttatg

SEQ ID NO: 2644218 - DNA, 14 bp, Homo sapiens
atatatacatatat

SEQ ID NO: 2644219 - DNA, 21 bp, Homo sapiens
atatatatctgctgtccagac

SEQ ID NO: 2644220 - DNA, 10 bp, Homo sapiens
atatatattt

SEQ ID NO: 2644221 - DNA, 13 bp, Homo sapiens
atatatcatattg

SEQ ID NO: 2644222 - DNA, 17 bp, Homo sapiens
atatatctgcttcagtg

SEQ ID NO: 2644223 - DNA, 16 bp, Homo sapiens
atatatgtgtgtgtat

SEQ ID NO: 2644224 - DNA, 18 bp, Homo sapiens
atatatgtgtgtttaaat

SEQ ID NO: 2644225 - DNA, 20 bp, Homo sapiens
atatatgtgtgtttaaataa

SEQ ID NO: 2644226 - DNA, 21 bp, Homo sapiens
atatatgtgtgtttaaataaa

SEQ ID NO: 2644227 - DNA, 23 bp, Homo sapiens
atatatgtgtttttcacatttgc

SEQ ID NO: 2644228 - DNA, 14 bp, Homo sapiens
atatatgtttacct

SEQ ID NO: 2644229 - DNA, 21 bp, Homo sapiens
atatatgttttaagaggcagg

SEQ ID NO: 2644230 - DNA, 22 bp, Homo sapiens
atatatgttttaagaggcaggg

SEQ ID NO: 2644231 - DNA, 14 bp, Homo sapiens
atatatttctttgt

SEQ ID NO: 2644232 - DNA, 18 bp, Homo sapiens
atatattttacaattttt

SEQ ID NO: 2644233 - DNA, 14 bp, Homo sapiens
atatatttttatat

SEQ ID NO: 2644234 - DNA, 14 bp, Homo sapiens
atatcaaaaagact

SEQ ID NO: 2644235 - DNA, 18 bp, Homo sapiens
atatcacatgttttctct

SEQ ID NO: 2644236 - DNA, 22 bp, Homo sapiens
atccaatggactgcataaataa

SEQ ID NO: 2644237 - DNA, 20 bp, Homo sapiens
atccacacacagaggaagag

SEQ ID NO: 2644238 - DNA, 19 bp, Homo sapiens
atccacagagagtcccact

SEQ ID NO: 2644239 - DNA, 20 bp, Homo sapiens
atccacagagagtcccactg

SEQ ID NO: 2644240 - DNA, 21 bp, Homo sapiens
atccacagagagtcccactgc

SEQ ID NO: 2644241 - DNA, 15 bp, Homo sapiens
atccacattgtttta

SEQ ID NO: 2644242 - DNA, 13 bp, Homo sapiens
atccacctccttc

SEQ ID NO: 2644243 - DNA, 13 bp, Homo sapiens
atccacctgtctc

SEQ ID NO: 2644244 - DNA, 18 bp, Homo sapiens
atccacctgtctcagcct

SEQ ID NO: 2644245 - DNA, 19 bp, Homo sapiens
atccactctaccctcccac

SEQ ID NO: 2644246 - DNA, 23 bp, Homo sapiens
atccactctaccctcccaccccc

SEQ ID NO: 2644247 - DNA, 21 bp, Homo sapiens
atccactgtgccatgtgccag

SEQ ID NO: 2644248 - DNA, 12 bp, Homo sapiens
atccactttgca

SEQ ID NO: 2644249 - DNA, 15 bp, Homo sapiens
atccagacccggctg

SEQ ID NO: 2644250 - DNA, 22 bp, Homo sapiens
atccagagtttagaggaaaaaa

SEQ ID NO: 2644251 - DNA, 20 bp, Homo sapiens
atccagatacacccaaagta

SEQ ID NO: 2644252 - DNA, 15 bp, Homo sapiens
atccagctatgttat

SEQ ID NO: 2644253 - DNA, 22 bp, Homo sapiens
atccagctccccttctgaatca

SEQ ID NO: 2644254 - DNA, 16 bp, Homo sapiens
atccagtaggatccag

SEQ ID NO: 2644255 - DNA, 13 bp, Homo sapiens
atccataaagaag

SEQ ID NO: 2644256 - DNA, 16 bp, Homo sapiens
atccataaagaagcaa

SEQ ID NO: 2644257 - DNA, 21 bp, Homo sapiens
atccataaagaagcaataaag

SEQ ID NO: 2644258 - DNA, 19 bp, Homo sapiens
atccatagcacctccacat

SEQ ID NO: 2644259 - DNA, 13 bp, Homo sapiens
atccatcaggcca

SEQ ID NO: 2644260 - DNA, 21 bp, Homo sapiens
atccatctaaatacctgccct

SEQ ID NO: 2644261 - DNA, 19 bp, Homo sapiens
atccatgtaaggtatcagt

SEQ ID NO: 2644262 - DNA, 20 bp, Homo sapiens
atccatgtactgtagttttt

SEQ ID NO: 2644263 - DNA, 19 bp, Homo sapiens
atccatgttagtttttact

SEQ ID NO: 2644264 - DNA, 20 bp, Homo sapiens
atccatttcatctatttctg

SEQ ID NO: 2644265 - DNA, 19 bp, Homo sapiens
atcccaagatctgtgcagc

SEQ ID NO: 2644266 - DNA, 14 bp, Homo sapiens
atcccacccacatg

SEQ ID NO: 2644267 - DNA, 16 bp, Homo sapiens
atcccacgcttctctt

SEQ ID NO: 2644268 - DNA, 14 bp, Homo sapiens
atcccagcactttg

SEQ ID NO: 2644269 - DNA, 17 bp, Homo sapiens
atcccagcactttggga

SEQ ID NO: 2644270 - DNA, 22 bp, Homo sapiens
atcccagcactttgggaggctg

SEQ ID NO: 2644271 - DNA, 23 bp, Homo sapiens
atcccaggatcgcaagagccatg

SEQ ID NO: 2644272 - DNA, 12 bp, Homo sapiens
atcccaggggac

SEQ ID NO: 2644273 - DNA, 19 bp, Homo sapiens
atcccaggggaccacacct

SEQ ID NO: 2644274 - DNA, 17 bp, Homo sapiens
atcccaggggcccaagg

SEQ ID NO: 2644275 - DNA, 13 bp, Homo sapiens
atcccatgtaaca

SEQ ID NO: 2644276 - DNA, 16 bp, Homo sapiens
atcccatgtaacagaa

SEQ ID NO: 2644277 - DNA, 18 bp, Homo sapiens
atcccatgtaacagaaag

SEQ ID NO: 2644278 - DNA, 19 bp, Homo sapiens
atcccatgtaacagaaagg

SEQ ID NO: 2644279 - DNA, 15 bp, Homo sapiens
atcccatgtatttat

SEQ ID NO: 2644280 - DNA, 14 bp, Homo sapiens
atccccaccctggg

SEQ ID NO: 2644281 - DNA, 13 bp, Homo sapiens
atccccacccttg

SEQ ID NO: 2644282 - DNA, 19 bp, Homo sapiens
atccccaggggtcccagcc

SEQ ID NO: 2644283 - DNA, 21 bp, Homo sapiens
atccccaggggtcccagccac

SEQ ID NO: 2644284 - DNA, 20 bp, Homo sapiens
atccccatcctccagcttct

SEQ ID NO: 2644285 - DNA, 15 bp, Homo sapiens
atcccctccctgtca

SEQ ID NO: 2644286 - DNA, 23 bp, Homo sapiens
atcccctctcccccccccctcca

SEQ ID NO: 2644287 - DNA, 14 bp, Homo sapiens
atcccgagcacctc

SEQ ID NO: 2644288 - DNA, 19 bp, Homo sapiens
atcccgagcacctccacat

SEQ ID NO: 2644289 - DNA, 16 bp, Homo sapiens
atccctaatgctgcag

SEQ ID NO: 2644290 - DNA, 14 bp, Homo sapiens
atccctacccccta

SEQ ID NO: 2644291 - DNA, 22 bp, Homo sapiens
atccctaccccctaagagccat

SEQ ID NO: 2644292 - DNA, 21 bp, Homo sapiens
atccctagtcttcaagcagat

SEQ ID NO: 2644293 - DNA, 21 bp, Homo sapiens
atccctcatcctcatacccac

SEQ ID NO: 2644294 - DNA, 20 bp, Homo sapiens
atccctctacagagcttccc

SEQ ID NO: 2644295 - DNA, 14 bp, Homo sapiens
atccctctctggat

SEQ ID NO: 2644296 - DNA, 22 bp, Homo sapiens
atccctgaatcccccttgccac

SEQ ID NO: 2644297 - DNA, 19 bp, Homo sapiens
atccctgttacccagagaa

SEQ ID NO: 2644298 - DNA, 18 bp, Homo sapiens
atccctgtttaatattta

SEQ ID NO: 2644299 - DNA, 20 bp, Homo sapiens
atccctgtttaatatttaaa

SEQ ID NO: 2644300 - DNA, 19 bp, Homo sapiens
atcccttccttttagccta

SEQ ID NO: 2644301 - DNA, 20 bp, Homo sapiens
atccgaacctcctctgtgaa

SEQ ID NO: 2644302 - DNA, 14 bp, Homo sapiens
atccgaatctcttt

SEQ ID NO: 2644303 - DNA, 12 bp, Homo sapiens
atccgaggcagg

SEQ ID NO: 2644304 - DNA, 14 bp, Homo sapiens
atccgccagggccc

SEQ ID NO: 2644305 - DNA, 19 bp, Homo sapiens
atccgccagggcccacacc

SEQ ID NO: 2644306 - DNA, 23 bp, Homo sapiens
atcctaaaacaaaagctcatcca

SEQ ID NO: 2644307 - DNA, 19 bp, Homo sapiens
atcctaatgaatgcataaa

SEQ ID NO: 2644308 - DNA, 21 bp, Homo sapiens
atcctaatgacttctaaaaat

SEQ ID NO: 2644309 - DNA, 14 bp, Homo sapiens
atcctaccaatgca

SEQ ID NO: 2644310 - DNA, 16 bp, Homo sapiens
atcctaccaatgcatg

SEQ ID NO: 2644311 - DNA, 17 bp, Homo sapiens
atcctaccaatgcatgc

SEQ ID NO: 2644312 - DNA, 21 bp, Homo sapiens
atcctaccccaattccttgta

SEQ ID NO: 2644313 - DNA, 21 bp, Homo sapiens
atcctagagatttggtgtaca

SEQ ID NO: 2644314 - DNA, 23 bp, Homo sapiens
atcctagagatttggtgtacaat

SEQ ID NO: 2644315 - DNA, 23 bp, Homo sapiens
atcctagccttatcctctgatct

SEQ ID NO: 2644316 - DNA, 16 bp, Homo sapiens
atcctaggcatttgct

SEQ ID NO: 2644317 - DNA, 19 bp, Homo sapiens
atcctagttccaccatcaa

SEQ ID NO: 2644318 - DNA, 13 bp, Homo sapiens
atcctatgcaata

SEQ ID NO: 2644319 - DNA, 19 bp, Homo sapiens
atcctcaaacactgcaggc

SEQ ID NO: 2644320 - DNA, 23 bp, Homo sapiens
atcctcatacccacccccaccca

SEQ ID NO: 2644321 - DNA, 12 bp, Homo sapiens
atcctccagctt

SEQ ID NO: 2644322 - DNA, 14 bp, Homo sapiens
atcctccagcttct

SEQ ID NO: 2644323 - DNA, 23 bp, Homo sapiens
atcctccagcttctggtactctc

SEQ ID NO: 2644324 - DNA, 14 bp, Homo sapiens
atcctccaggtgca

SEQ ID NO: 2644325 - DNA, 11 bp, Homo sapiens
atcctcccctt

SEQ ID NO: 2644326 - DNA, 13 bp, Homo sapiens
atcctccccttcc

SEQ ID NO: 2644327 - DNA, 19 bp, Homo sapiens
atcctccccttccctgcaa

SEQ ID NO: 2644328 - DNA, 16 bp, Homo sapiens
atcctccgtccagccg

SEQ ID NO: 2644329 - DNA, 18 bp, Homo sapiens
atcctctgagtgtgacca

SEQ ID NO: 2644330 - DNA, 12 bp, Homo sapiens
atcctctgatct

SEQ ID NO: 2644331 - DNA, 16 bp, Homo sapiens
atcctctgtacagagc

SEQ ID NO: 2644332 - DNA, 13 bp, Homo sapiens
atcctcttcctct

SEQ ID NO: 2644333 - DNA, 16 bp, Homo sapiens
atcctcttcctctgag

SEQ ID NO: 2644334 - DNA, 18 bp, Homo sapiens
atcctgactctgccccct

SEQ ID NO: 2644335 - DNA, 19 bp, Homo sapiens
atcctgactctgccccctg

SEQ ID NO: 2644336 - DNA, 12 bp, Homo sapiens
atcctgagccat

SEQ ID NO: 2644337 - DNA, 24 bp, Homo sapiens
atcctgagccatcggtgaaactaa

SEQ ID NO: 2644338 - DNA, 19 bp, Homo sapiens
atcctgatgaggtttctac

SEQ ID NO: 2644339 - DNA, 22 bp, Homo sapiens
atcctgccccctgaaacttatt

SEQ ID NO: 2644340 - DNA, 14 bp, Homo sapiens
atcctgctgctgtg

SEQ ID NO: 2644341 - DNA, 21 bp, Homo sapiens
atcctgcttctgatatgcagt

SEQ ID NO: 2644342 - DNA, 22 bp, Homo sapiens
atcctggacatgaagattcttt

SEQ ID NO: 2644343 - DNA, 17 bp, Homo sapiens
atcctggcacccggccc

SEQ ID NO: 2644344 - DNA, 22 bp, Homo sapiens
atcctggcacccggcccctgct

SEQ ID NO: 2644345 - DNA, 23 bp, Homo sapiens
atcctggcacccggcccctgctg

SEQ ID NO: 2644346 - DNA, 20 bp, Homo sapiens
atcctggggctcccttcatc

SEQ ID NO: 2644347 - DNA, 18 bp, Homo sapiens
atcctgtctttctgagca

SEQ ID NO: 2644348 - DNA, 16 bp, Homo sapiens
atcctgtgacatgtaa

SEQ ID NO: 2644349 - DNA, 18 bp, Homo sapiens
atcctgtgacatgtaaca

SEQ ID NO: 2644350 - DNA, 16 bp, Homo sapiens
atccttgtttcaaaca

SEQ ID NO: 2644351 - DNA, 23 bp, Homo sapiens
atccttgtttcaaacacaaatgc

SEQ ID NO: 2644352 - DNA, 13 bp, Homo sapiens
atccttttatgtt

SEQ ID NO: 2644353 - DNA, 19 bp, Homo sapiens
atccttttatgttatttat

SEQ ID NO: 2644354 - DNA, 18 bp, Homo sapiens
atcctttttctttataaa

SEQ ID NO: 2644355 - DNA, 18 bp, Homo sapiens
atcgaaataacaatgtta

SEQ ID NO: 2644356 - DNA, 19 bp, Homo sapiens
atcgaaataacaatgttaa

SEQ ID NO: 2644357 - DNA, 15 bp, Homo sapiens
atcgaggaaccagag

SEQ ID NO: 2644358 - DNA, 23 bp, Homo sapiens
atcgatgggggagtctgaagcag

SEQ ID NO: 2644359 - DNA, 13 bp, Homo sapiens
atcgatgttatgt

SEQ ID NO: 2644360 - DNA, 20 bp, Homo sapiens
atcgcggcggagctggcccc

SEQ ID NO: 2644361 - DNA, 14 bp, Homo sapiens
atcggaagcagtgc

SEQ ID NO: 2644362 - DNA, 18 bp, Homo sapiens
atcggaagcagtgccttc

SEQ ID NO: 2644363 - DNA, 21 bp, Homo sapiens
atcggaggcttgtcagagctg

SEQ ID NO: 2644364 - DNA, 18 bp, Homo sapiens
atcgggagcagtgtcttc

SEQ ID NO: 2644365 - DNA, 21 bp, Homo sapiens
atcgggagcagtgtcttccat

SEQ ID NO: 2644366 - DNA, 19 bp, Homo sapiens
atcggtcttgcccagagga

SEQ ID NO: 2644367 - DNA, 14 bp, Homo sapiens
atcgtatagctgta

SEQ ID NO: 2644368 - DNA, 14 bp, Homo sapiens
atcgtcactgctta

SEQ ID NO: 2644369 - DNA, 18 bp, Homo sapiens
atcgtcactgcttaactt

SEQ ID NO: 2644370 - DNA, 12 bp, Homo sapiens
atcgtgaaaccc

SEQ ID NO: 2644371 - DNA, 15 bp, Homo sapiens
atcgtgacaacactt

SEQ ID NO: 2644372 - DNA, 18 bp, Homo sapiens
atcgtgacgctgaataaa

SEQ ID NO: 2644373 - DNA, 12 bp, Homo sapiens
atcgtgctaaat

SEQ ID NO: 2644374 - DNA, 15 bp, Homo sapiens
atcgtgctaaatttt

SEQ ID NO: 2644375 - DNA, 17 bp, Homo sapiens
atcgtgctaaattttca

SEQ ID NO: 2644376 - DNA, 12 bp, Homo sapiens
atcgtggagaca

SEQ ID NO: 2644377 - DNA, 14 bp, Homo sapiens
atcgttatgtgtgt

SEQ ID NO: 2644378 - DNA, 18 bp, Homo sapiens
atcgttatgtgtgtatat

SEQ ID NO: 2644379 - DNA, 15 bp, Homo sapiens
atcgttccagttccc

SEQ ID NO: 2644380 - DNA, 21 bp, Homo sapiens
atgagcctcagcatcctggca

SEQ ID NO: 2644381 - DNA, 11 bp, Homo sapiens
atgagcctggc

SEQ ID NO: 2644382 - DNA, 20 bp, Homo sapiens
atgagctatttccattccag

SEQ ID NO: 2644383 - DNA, 21 bp, Homo sapiens
atgagctatttccattccaga

SEQ ID NO: 2644384 - DNA, 13 bp, Homo sapiens
atgagctggaagg

SEQ ID NO: 2644385 - DNA, 21 bp, Homo sapiens
atgagctggaaggagtgagag

SEQ ID NO: 2644386 - DNA, 18 bp, Homo sapiens
atgagctttatgtaataa

SEQ ID NO: 2644387 - DNA, 14 bp, Homo sapiens
atgaggaataatta

SEQ ID NO: 2644388 - DNA, 22 bp, Homo sapiens
atgaggatgcagagtcagcaga

SEQ ID NO: 2644389 - DNA, 18 bp, Homo sapiens
atgaggcaatgtcaggaa

SEQ ID NO: 2644390 - DNA, 13 bp, Homo sapiens
atgaggcagagga

SEQ ID NO: 2644391 - DNA, 13 bp, Homo sapiens
atgaggcatttgt

SEQ ID NO: 2644392 - DNA, 14 bp, Homo sapiens
atgaggcatttgtt

SEQ ID NO: 2644393 - DNA, 23 bp, Homo sapiens
atgaggccactgctgcttctcca

SEQ ID NO: 2644394 - DNA, 21 bp, Homo sapiens
atgaggcctcttggacctctg

SEQ ID NO: 2644395 - DNA, 20 bp, Homo sapiens
atgagggtatcaaataaaat

SEQ ID NO: 2644396 - DNA, 18 bp, Homo sapiens
atgaggtactgagagtga

SEQ ID NO: 2644397 - DNA, 19 bp, Homo sapiens
atgaggtcagagcctgcag

SEQ ID NO: 2644398 - DNA, 20 bp, Homo sapiens
atgaggtcagagcctgcagt

SEQ ID NO: 2644399 - DNA, 22 bp, Homo sapiens
atgaggtcagagcctgcagtta

SEQ ID NO: 2644400 - DNA, 15 bp, Homo sapiens
atgaggtctgaaatg

SEQ ID NO: 2644401 - DNA, 23 bp, Homo sapiens
atgagtcccctgtttgtttctga

SEQ ID NO: 2644402 - DNA, 16 bp, Homo sapiens
atgagtgcgtgctcag

SEQ ID NO: 2644403 - DNA, 23 bp, Homo sapiens
atgagtgcttcagaatgtgattt

SEQ ID NO: 2644404 - DNA, 18 bp, Homo sapiens
atgagttggctgggaata

SEQ ID NO: 2644405 - DNA, 20 bp, Homo sapiens
atgagtttcatagctaagaa

SEQ ID NO: 2644406 - DNA, 20 bp, Homo sapiens
atgagtttttgatagcttta

SEQ ID NO: 2644407 - DNA, 22 bp, Homo sapiens
atgataccctgaatttggcctg

SEQ ID NO: 2644408 - DNA, 22 bp, Homo sapiens
atgatatgtaaacataattctt

SEQ ID NO: 2644409 - DNA, 18 bp, Homo sapiens
atgatattgcatatgcat

SEQ ID NO: 2644410 - DNA, 23 bp, Homo sapiens
atgatcacggctcactgcagcct

SEQ ID NO: 2644411 - DNA, 19 bp, Homo sapiens
atgatcagctgtttgtcat

SEQ ID NO: 2644412 - DNA, 20 bp, Homo sapiens
atgatcagctgtttgtcata

SEQ ID NO: 2644413 - DNA, 21 bp, Homo sapiens
atgatccaactaatgccttac

SEQ ID NO: 2644414 - DNA, 23 bp, Homo sapiens
atgatctaccagcctccctattt

SEQ ID NO: 2644415 - DNA, 15 bp, Homo sapiens
atgatctactcagaa

SEQ ID NO: 2644416 - DNA, 21 bp, Homo sapiens
atgatctaggtttaactcaga

SEQ ID NO: 2644417 - DNA, 22 bp, Homo sapiens
atgatctcttcttttggcttcc

SEQ ID NO: 2644418 - DNA, 15 bp, Homo sapiens
atgatcttctttata

SEQ ID NO: 2644419 - DNA, 21 bp, Homo sapiens
atgatctttgcagacaggcaa

SEQ ID NO: 2644420 - DNA, 23 bp, Homo sapiens
atgatgaaatgaggtcagagcct

SEQ ID NO: 2644421 - DNA, 21 bp, Homo sapiens
atgatgatctttaaaatacac

SEQ ID NO: 2644422 - DNA, 15 bp, Homo sapiens
atgatgatgggaatt

SEQ ID NO: 2644423 - DNA, 17 bp, Homo sapiens
atgatggagcgcacctg

SEQ ID NO: 2644424 - DNA, 15 bp, Homo sapiens
atgatggagtcaggt

SEQ ID NO: 2644425 - DNA, 16 bp, Homo sapiens
atgatgggtcagttgt

SEQ ID NO: 2644426 - DNA, 16 bp, Homo sapiens
atgatggtgctgacct

SEQ ID NO: 2644427 - DNA, 19 bp, Homo sapiens
atgatgtccagaagaatat

SEQ ID NO: 2644428 - DNA, 14 bp, Homo sapiens
atgatgtgcctggg

SEQ ID NO: 2644429 - DNA, 16 bp, Homo sapiens
atgatgtgcctgggtg

SEQ ID NO: 2644430 - DNA, 19 bp, Homo sapiens
atgatgtggagtggggcag

SEQ ID NO: 2644431 - DNA, 23 bp, Homo sapiens
atgatgtggtgcctgaggtctgt

SEQ ID NO: 2644432 - DNA, 15 bp, Homo sapiens
atgatgtgttgtgat

SEQ ID NO: 2644433 - DNA, 21 bp, Homo sapiens
atgattaaccacttcagctga

SEQ ID NO: 2644434 - DNA, 14 bp, Homo sapiens
atgattagcaagtt

SEQ ID NO: 2644435 - DNA, 15 bp, Homo sapiens
atgattagtaaagaa

SEQ ID NO: 2644436 - DNA, 17 bp, Homo sapiens
atgattcagaaattgga

SEQ ID NO: 2644437 - DNA, 15 bp, Homo sapiens
atgattggattattc

SEQ ID NO: 2644438 - DNA, 16 bp, Homo sapiens
atgattggattattca

SEQ ID NO: 2644439 - DNA, 13 bp, Homo sapiens
atgatttaaaaca

SEQ ID NO: 2644440 - DNA, 16 bp, Homo sapiens
atgatttaataaaata

SEQ ID NO: 2644441 - DNA, 19 bp, Homo sapiens
atgatttaataaaataatt

SEQ ID NO: 2644442 - DNA, 14 bp, Homo sapiens
atgatttatagttt

SEQ ID NO: 2644443 - DNA, 14 bp, Homo sapiens
atgatttcatttca

SEQ ID NO: 2644444 - DNA, 23 bp, Homo sapiens
atgattttatttgacaaaatttg

SEQ ID NO: 2644445 - DNA, 17 bp, Homo sapiens
atgatttttttttcata

SEQ ID NO: 2644446 - DNA, 23 bp, Homo sapiens
atgcaaaaggttcactaaagcag

SEQ ID NO: 2644447 - DNA, 15 bp, Homo sapiens
atgcaaaggctggga

SEQ ID NO: 2644448 - DNA, 18 bp, Homo sapiens
atgcaaatcaattactgg

SEQ ID NO: 2644449 - DNA, 23 bp, Homo sapiens
atgcaagctagtggcttcaaaat

SEQ ID NO: 2644450 - DNA, 13 bp, Homo sapiens
atgcaaggaagga

SEQ ID NO: 2644451 - DNA, 15 bp, Homo sapiens
atgcaaggaaggaaa

SEQ ID NO: 2644452 - DNA, 16 bp, Homo sapiens
atgcaaggaaggaaag

SEQ ID NO: 2644453 - DNA, 20 bp, Homo sapiens
atgcaatatatctaaattga

SEQ ID NO: 2644454 - DNA, 13 bp, Homo sapiens
atgcaatatgtat

SEQ ID NO: 2644455 - DNA, 16 bp, Homo sapiens
atgcaatgtgctactg

SEQ ID NO: 2644456 - DNA, 18 bp, Homo sapiens
atgcaatgtgctactgat

SEQ ID NO: 2644457 - DNA, 19 bp, Homo sapiens
atgcaatttattaaaatga

SEQ ID NO: 2644458 - DNA, 17 bp, Homo sapiens
atgcaatttcctttttt

SEQ ID NO: 2644459 - DNA, 21 bp, Homo sapiens
atgcacacagtgctttccgtg

SEQ ID NO: 2644460 - DNA, 14 bp, Homo sapiens
atgcacacattttt

SEQ ID NO: 2644461 - DNA, 15 bp, Homo sapiens
atgcacacatttttt

SEQ ID NO: 2644462 - DNA, 16 bp, Homo sapiens
atgcacagagttgtta

SEQ ID NO: 2644463 - DNA, 22 bp, Homo sapiens
atgcacagagttgttacatttt

SEQ ID NO: 2644464 - DNA, 13 bp, Homo sapiens
atgcacctggaat

SEQ ID NO: 2644465 - DNA, 19 bp, Homo sapiens
atgcacctggaatatataa

SEQ ID NO: 2644466 - DNA, 16 bp, Homo sapiens
atgcaccttgtgtctg

SEQ ID NO: 2644467 - DNA, 19 bp, Homo sapiens
atgcaccttgtgtctgtac

SEQ ID NO: 2644468 - DNA, 14 bp, Homo sapiens
atgcacgaccttgg

SEQ ID NO: 2644469 - DNA, 15 bp, Homo sapiens
atgcactttgttctg

SEQ ID NO: 2644470 - DNA, 19 bp, Homo sapiens
atgcactttgttctggctc

SEQ ID NO: 2644471 - DNA, 20 bp, Homo sapiens
atgcactttgttctggctct

SEQ ID NO: 2644472 - DNA, 14 bp, Homo sapiens
atgcagagagccat

SEQ ID NO: 2644473 - DNA, 19 bp, Homo sapiens
atgcagagagccattttgt

SEQ ID NO: 2644474 - DNA, 17 bp, Homo sapiens
atgcagagtcagcagaa

SEQ ID NO: 2644475 - DNA, 23 bp, Homo sapiens
atgcagatggggctcccgcccgt

SEQ ID NO: 2644476 - DNA, 21 bp, Homo sapiens
atgcagcccatgcccacctgc

SEQ ID NO: 2644477 - DNA, 20 bp, Homo sapiens
atgcagcgaaccaatatttg

SEQ ID NO: 2644478 - DNA, 16 bp, Homo sapiens
atgcagtgaattgtga

SEQ ID NO: 2644479 - DNA, 15 bp, Homo sapiens
atgcagttttcctta

SEQ ID NO: 2644480 - DNA, 17 bp, Homo sapiens
atgcataaatatgcagt

SEQ ID NO: 2644481 - DNA, 15 bp, Homo sapiens
atgcatacacacaca

SEQ ID NO: 2644482 - DNA, 17 bp, Homo sapiens
atgcatacacacacaca

SEQ ID NO: 2644483 - DNA, 17 bp, Homo sapiens
atgcatacttcaaaagt

SEQ ID NO: 2644484 - DNA, 18 bp, Homo sapiens
atgcatacttcaaaagta

SEQ ID NO: 2644485 - DNA, 21 bp, Homo sapiens
atgcatacttcaaaagtattt

SEQ ID NO: 2644486 - DNA, 19 bp, Homo sapiens
atgcatcctttgcactgtc

SEQ ID NO: 2644487 - DNA, 22 bp, Homo sapiens
atgcatctcactggatgcaaag

SEQ ID NO: 2644488 - DNA, 17 bp, Homo sapiens
atgcatctccacctgct

SEQ ID NO: 2644489 - DNA, 15 bp, Homo sapiens
atgcatctgtcctca

SEQ ID NO: 2644490 - DNA, 13 bp, Homo sapiens
atgcatgtgaaga

SEQ ID NO: 2644491 - DNA, 16 bp, Homo sapiens
atgcatgtgaagaaag

SEQ ID NO: 2644492 - DNA, 19 bp, Homo sapiens
atgcatgttttccagctcc

SEQ ID NO: 2644493 - DNA, 15 bp, Homo sapiens
atgcattaaaagaaa

SEQ ID NO: 2644494 - DNA, 20 bp, Homo sapiens
atgcattaaaagaaaataaa

SEQ ID NO: 2644495 - DNA, 21 bp, Homo sapiens
atgcattataggatcatttgt

SEQ ID NO: 2644496 - DNA, 22 bp, Homo sapiens
atgcattataggatcatttgtt

SEQ ID NO: 2644497 - DNA, 16 bp, Homo sapiens
atgcattgttgaggtg

SEQ ID NO: 2644498 - DNA, 13 bp, Homo sapiens
atgcatttgaggt

SEQ ID NO: 2644499 - DNA, 23 bp, Homo sapiens
atgcattttattttagacacaaa

SEQ ID NO: 2644500 - DNA, 12 bp, Homo sapiens
atgcattttgca

SEQ ID NO: 2644501 - DNA, 18 bp, Homo sapiens
atgcattttgcagcagtg

SEQ ID NO: 2644502 - DNA, 23 bp, Homo sapiens
atgccaagaagtttaaggaatat

SEQ ID NO: 2644503 - DNA, 16 bp, Homo sapiens
atgccaagcactgtgc

SEQ ID NO: 2644504 - DNA, 14 bp, Homo sapiens
atgccaagttgttt

SEQ ID NO: 2644505 - DNA, 17 bp, Homo sapiens
atgccactaaattgaca

SEQ ID NO: 2644506 - DNA, 18 bp, Homo sapiens
atgccagctcagtcccat

SEQ ID NO: 2644507 - DNA, 19 bp, Homo sapiens
atgccaggttctatttgga

SEQ ID NO: 2644508 - DNA, 12 bp, Homo sapiens
atgccatcctca

SEQ ID NO: 2644509 - DNA, 23 bp, Homo sapiens
atgccatcctcaaacactgcagg

SEQ ID NO: 2644510 - DNA, 16 bp, Homo sapiens
atgcccacctgcccat

SEQ ID NO: 2644511 - DNA, 20 bp, Homo sapiens
atgcccacctgcccatcaca

SEQ ID NO: 2644512 - DNA, 11 bp, Homo sapiens
atgcccagccc

SEQ ID NO: 2644513 - DNA, 13 bp, Homo sapiens
atgcccagcccct

SEQ ID NO: 2644514 - DNA, 15 bp, Homo sapiens
atgcccagcgtttga

SEQ ID NO: 2644515 - DNA, 21 bp, Homo sapiens
atgcccagggccactctgcct

SEQ ID NO: 2644516 - DNA, 14 bp, Homo sapiens
atgcccccagctgg

SEQ ID NO: 2644517 - DNA, 13 bp, Homo sapiens
atgccccctttca

SEQ ID NO: 2644518 - DNA, 21 bp, Homo sapiens
atgccccctttcagatgtctt

SEQ ID NO: 2644519 - DNA, 14 bp, Homo sapiens
atgccctggatcca

SEQ ID NO: 2644520 - DNA, 15 bp, Homo sapiens
atgcctgagggtgga

SEQ ID NO: 2644521 - DNA, 16 bp, Homo sapiens
atgcctgagtgcctgg

SEQ ID NO: 2644522 - DNA, 20 bp, Homo sapiens
atgcctgagtgcctggccaa

SEQ ID NO: 2644523 - DNA, 20 bp, Homo sapiens
atgcctggatggggctgcac

SEQ ID NO: 2644524 - DNA, 21 bp, Homo sapiens
atgttttctgaaaatataacc

SEQ ID NO: 2644525 - DNA, 18 bp, Homo sapiens
atgttttctttgctttaa

SEQ ID NO: 2644526 - DNA, 18 bp, Homo sapiens
atgttttgataaagtagt

SEQ ID NO: 2644527 - DNA, 23 bp, Homo sapiens
atgttttggtatctgttctttaa

SEQ ID NO: 2644528 - DNA, 14 bp, Homo sapiens
atgttttgtgacta

SEQ ID NO: 2644529 - DNA, 15 bp, Homo sapiens
atgtttttcatgaaa

SEQ ID NO: 2644530 - DNA, 19 bp, Homo sapiens
atgttttttagatcaaata

SEQ ID NO: 2644531 - DNA, 14 bp, Homo sapiens
attaaaaatatgga

SEQ ID NO: 2644532 - DNA, 15 bp, Homo sapiens
attaaaaatctcaaa

SEQ ID NO: 2644533 - DNA, 20 bp, Homo sapiens
attaaaacaatattgtttct

SEQ ID NO: 2644534 - DNA, 15 bp, Homo sapiens
attaaaagaatattt

SEQ ID NO: 2644535 - DNA, 14 bp, Homo sapiens
attaaaagaatttt

SEQ ID NO: 2644536 - DNA, 14 bp, Homo sapiens
attaaaccctggat

SEQ ID NO: 2644537 - DNA, 18 bp, Homo sapiens
attaaacgtatgcatgtg

SEQ ID NO: 2644538 - DNA, 16 bp, Homo sapiens
attaaacttaatctaa

SEQ ID NO: 2644539 - DNA, 15 bp, Homo sapiens
attaaagcatttact

SEQ ID NO: 2644540 - DNA, 14 bp, Homo sapiens
attaaaggaataaa

SEQ ID NO: 2644541 - DNA, 21 bp, Homo sapiens
attaaagttctgtaaaatata

SEQ ID NO: 2644542 - DNA, 22 bp, Homo sapiens
attaaatatgttagcaaagagt

SEQ ID NO: 2644543 - DNA, 14 bp, Homo sapiens
attaaatgcccagc

SEQ ID NO: 2644544 - DNA, 18 bp, Homo sapiens
attaaattcttgcaaagt

SEQ ID NO: 2644545 - DNA, 20 bp, Homo sapiens
attaacaaattatgttacat

SEQ ID NO: 2644546 - DNA, 12 bp, Homo sapiens
attaacagtttt

SEQ ID NO: 2644547 - DNA, 18 bp, Homo sapiens
attaacagttttccatga

SEQ ID NO: 2644548 - DNA, 19 bp, Homo sapiens
attaacagttttccatgaa

SEQ ID NO: 2644549 - DNA, 17 bp, Homo sapiens
attaaccaaaaaagtta

SEQ ID NO: 2644550 - DNA, 16 bp, Homo sapiens
attaacctggtgctgg

SEQ ID NO: 2644551 - DNA, 17 bp, Homo sapiens
attaacctggtgctgga

SEQ ID NO: 2644552 - DNA, 12 bp, Homo sapiens
attaacttttat

SEQ ID NO: 2644553 - DNA, 15 bp, Homo sapiens
attaagaaaatctat

SEQ ID NO: 2644554 - DNA, 21 bp, Homo sapiens
attaagatatgggacattttt

SEQ ID NO: 2644555 - DNA, 20 bp, Homo sapiens
attaagccacttaaaatgtt

SEQ ID NO: 2644556 - DNA, 13 bp, Homo sapiens
attaaggaagaca

SEQ ID NO: 2644557 - DNA, 15 bp, Homo sapiens
attaaggattttatg

SEQ ID NO: 2644558 - DNA, 17 bp, Homo sapiens
attaaggattttatgct

SEQ ID NO: 2644559 - DNA, 13 bp, Homo sapiens
attaagttatctt

SEQ ID NO: 2644560 - DNA, 16 bp, Homo sapiens
attaataaaaaatgga

SEQ ID NO: 2644561 - DNA, 19 bp, Homo sapiens
attaataaaaaatggaaag

SEQ ID NO: 2644562 - DNA, 22 bp, Homo sapiens
attaataaaaaatggaaagaat

SEQ ID NO: 2644563 - DNA, 17 bp, Homo sapiens
attaatattcctcagtt

SEQ ID NO: 2644564 - DNA, 19 bp, Homo sapiens
attaatcatgaatgtgtaa

SEQ ID NO: 2644565 - DNA, 19 bp, Homo sapiens
attaatgaaaataagaatt

SEQ ID NO: 2644566 - DNA, 15 bp, Homo sapiens
attaatgcactttct

SEQ ID NO: 2644567 - DNA, 16 bp, Homo sapiens
attaatgcactttcta

SEQ ID NO: 2644568 - DNA, 20 bp, Homo sapiens
attaatgccattatccctga

SEQ ID NO: 2644569 - DNA, 22 bp, Homo sapiens
attacaaattgcttactttgga

SEQ ID NO: 2644570 - DNA, 22 bp, Homo sapiens
attacaagcgtgagccactgca

SEQ ID NO: 2644571 - DNA, 18 bp, Homo sapiens
attacacaaaacaaatgc

SEQ ID NO: 2644572 - DNA, 19 bp, Homo sapiens
attacactgtatttgtatc

SEQ ID NO: 2644573 - DNA, 17 bp, Homo sapiens
attacagagaggagaaa

SEQ ID NO: 2644574 - DNA, 18 bp, Homo sapiens
attacagagaggagaaac

SEQ ID NO: 2644575 - DNA, 15 bp, Homo sapiens
attacagtgggtgcc

SEQ ID NO: 2644576 - DNA, 16 bp, Homo sapiens
attacatctttcacat

SEQ ID NO: 2644577 - DNA, 18 bp, Homo sapiens
attaccaaaaatcttggg

SEQ ID NO: 2644578 - DNA, 20 bp, Homo sapiens
attaccagacggttcaccag

SEQ ID NO: 2644579 - DNA, 12 bp, Homo sapiens
attacctcctga

SEQ ID NO: 2644580 - DNA, 14 bp, Homo sapiens
attacgtgagccag

SEQ ID NO: 2644581 - DNA, 16 bp, Homo sapiens
attacgtgagccaggt

SEQ ID NO: 2644582 - DNA, 20 bp, Homo sapiens
attactacaaaatttgaaat

SEQ ID NO: 2644583 - DNA, 18 bp, Homo sapiens
attactatgactgctccc

SEQ ID NO: 2644584 - DNA, 13 bp, Homo sapiens
attactgccattc

SEQ ID NO: 2644585 - DNA, 18 bp, Homo sapiens
attactgtctggttttaa

SEQ ID NO: 2644586 - DNA, 23 bp, Homo sapiens
attactgtttgtcttctccccag

SEQ ID NO: 2644587 - DNA, 15 bp, Homo sapiens
attacttatcatcca

SEQ ID NO: 2644588 - DNA, 15 bp, Homo sapiens
attacttatttttga

SEQ ID NO: 2644589 - DNA, 12 bp, Homo sapiens
attacttctgct

SEQ ID NO: 2644590 - DNA, 13 bp, Homo sapiens
attacttctgcta

SEQ ID NO: 2644591 - DNA, 23 bp, Homo sapiens
attagaaattagctgtgtgaaat

SEQ ID NO: 2644592 - DNA, 18 bp, Homo sapiens
attagaacaggcaagtga

SEQ ID NO: 2644593 - DNA, 21 bp, Homo sapiens
attagaagatattagtcttgg

SEQ ID NO: 2644594 - DNA, 18 bp, Homo sapiens
attagaagtgttaactta

SEQ ID NO: 2644595 - DNA, 20 bp, Homo sapiens
attagaagtgttaacttagc

SEQ ID NO: 2644596 - DNA, 20 bp, Homo sapiens
attagagattacctcctgag

SEQ ID NO: 2644597 - DNA, 19 bp, Homo sapiens
attagagggaggagaatga

SEQ ID NO: 2644598 - DNA, 15 bp, Homo sapiens
attagagtcagcctt

SEQ ID NO: 2644599 - DNA, 23 bp, Homo sapiens
attagagtgtctttccacggagc

SEQ ID NO: 2644600 - DNA, 13 bp, Homo sapiens
attagatgtgatt

SEQ ID NO: 2644601 - DNA, 14 bp, Homo sapiens
attagcatttagtc

SEQ ID NO: 2644602 - DNA, 17 bp, Homo sapiens
attagccacaaaattgg

SEQ ID NO: 2644603 - DNA, 13 bp, Homo sapiens
attagccaggatc

SEQ ID NO: 2644604 - DNA, 20 bp, Homo sapiens
attagctggttggagagcta

SEQ ID NO: 2644605 - DNA, 15 bp, Homo sapiens
attagctttactgtt

SEQ ID NO: 2644606 - DNA, 20 bp, Homo sapiens
attaggaagtgtaacagctg

SEQ ID NO: 2644607 - DNA, 18 bp, Homo sapiens
attagggcatttgagaaa

SEQ ID NO: 2644608 - DNA, 18 bp, Homo sapiens
attaggtgtgactgaatt

SEQ ID NO: 2644609 - DNA, 21 bp, Homo sapiens
attaggtgtgactgaatttct

SEQ ID NO: 2644610 - DNA, 15 bp, Homo sapiens
attaggttttgtaca

SEQ ID NO: 2644611 - DNA, 16 bp, Homo sapiens
attagtaaatgcttat

SEQ ID NO: 2644612 - DNA, 22 bp, Homo sapiens
attagtgtatgctttgaatgta

SEQ ID NO: 2644613 - DNA, 14 bp, Homo sapiens
attagttaatatat

SEQ ID NO: 2644614 - DNA, 13 bp, Homo sapiens
attagttttgatt

SEQ ID NO: 2644615 - DNA, 15 bp, Homo sapiens
attataaattatgtt

SEQ ID NO: 2644616 - DNA, 22 bp, Homo sapiens
attataacttaaaaaaatgaca

SEQ ID NO: 2644617 - DNA, 16 bp, Homo sapiens
attataacttaaaata

SEQ ID NO: 2644618 - DNA, 20 bp, Homo sapiens
attataagaggctgataatt

SEQ ID NO: 2644619 - DNA, 22 bp, Homo sapiens
attataatttttttcaatattt

SEQ ID NO: 2644620 - DNA, 12 bp, Homo sapiens
attatcatgtgt

SEQ ID NO: 2644621 - DNA, 17 bp, Homo sapiens
attatcatgtgtaatca

SEQ ID NO: 2644622 - DNA, 17 bp, Homo sapiens
attatccaggtaatcca

SEQ ID NO: 2644623 - DNA, 12 bp, Homo sapiens
attatccctgaa

SEQ ID NO: 2644624 - DNA, 17 bp, Homo sapiens
attatcgggaacagtgt

SEQ ID NO: 2644625 - DNA, 21 bp, Homo sapiens
attatcgggagcagtgtcttc

SEQ ID NO: 2644626 - DNA, 23 bp, Homo sapiens
attatctaaagtgtgttgttgct

SEQ ID NO: 2644627 - DNA, 12 bp, Homo sapiens
attatgacagtt

SEQ ID NO: 2644628 - DNA, 23 bp, Homo sapiens
attatgcatgaagtaatatgcac

SEQ ID NO: 2644629 - DNA, 18 bp, Homo sapiens
attatgggaatcaagatt

SEQ ID NO: 2644630 - DNA, 19 bp, Homo sapiens
attatgtccactgtgtata

SEQ ID NO: 2644631 - DNA, 22 bp, Homo sapiens
attattaatgaaaataagaatt

SEQ ID NO: 2644632 - DNA, 20 bp, Homo sapiens
attattaccttacagaagtt

SEQ ID NO: 2644633 - DNA, 15 bp, Homo sapiens
attattattcttcat

SEQ ID NO: 2644634 - DNA, 14 bp, Homo sapiens
attattcagtgtca

SEQ ID NO: 2644635 - DNA, 13 bp, Homo sapiens
attattcttgtag

SEQ ID NO: 2644636 - DNA, 13 bp, Homo sapiens
attattgtattta

SEQ ID NO: 2644637 - DNA, 16 bp, Homo sapiens
attattgtatttattc

SEQ ID NO: 2644638 - DNA, 12 bp, Homo sapiens
attatttaataa

SEQ ID NO: 2644639 - DNA, 15 bp, Homo sapiens
attatttaataacat

SEQ ID NO: 2644640 - DNA, 17 bp, Homo sapiens
attatttatttaataac

SEQ ID NO: 2644641 - DNA, 11 bp, Homo sapiens
attatttcaga

SEQ ID NO: 2644642 - DNA, 22 bp, Homo sapiens
attatttctaggaagaatttta

SEQ ID NO: 2644643 - DNA, 23 bp, Homo sapiens
attatttgaaaacatataaagca

SEQ ID NO: 2644644 - DNA, 22 bp, Homo sapiens
attatttgtgttttaatttaaa

SEQ ID NO: 2644645 - DNA, 13 bp, Homo sapiens
attattttaaaca

SEQ ID NO: 2644646 - DNA, 14 bp, Homo sapiens
attattttaaacaa

SEQ ID NO: 2644647 - DNA, 12 bp, Homo sapiens
attattttgatg

SEQ ID NO: 2644648 - DNA, 19 bp, Homo sapiens
attatttttccactttgtt

SEQ ID NO: 2644649 - DNA, 22 bp, Homo sapiens
attatttttccactttgttctt

SEQ ID NO: 2644650 - DNA, 13 bp, Homo sapiens
attattttttcag

SEQ ID NO: 2644651 - DNA, 14 bp, Homo sapiens
attattttttcaga

SEQ ID NO: 2644652 - DNA, 19 bp, Homo sapiens
attattttttcagaccgaa

SEQ ID NO: 2644653 - DNA, 14 bp, Homo sapiens
attcaaaaagtgtt

SEQ ID NO: 2644654 - DNA, 16 bp, Homo sapiens
attcaaaagttgaaat

SEQ ID NO: 2644655 - DNA, 14 bp, Homo sapiens
attcaaacagtctc

SEQ ID NO: 2644656 - DNA, 18 bp, Homo sapiens
attcaaacagtctcagga

SEQ ID NO: 2644657 - DNA, 19 bp, Homo sapiens
attcaaagcaccaaaataa

SEQ ID NO: 2644658 - DNA, 17 bp, Homo sapiens
attcaaagctctattaa

SEQ ID NO: 2644659 - DNA, 16 bp, Homo sapiens
attcaaccactgtaaa

SEQ ID NO: 2644660 - DNA, 21 bp, Homo sapiens
attcaagtctatgatgctgtt

SEQ ID NO: 2644661 - DNA, 21 bp, Homo sapiens
attcaagtgtaaaatattttg

SEQ ID NO: 2644662 - DNA, 14 bp, Homo sapiens
attcaagttattgt

SEQ ID NO: 2644663 - DNA, 13 bp, Homo sapiens
attcaataagcat

SEQ ID NO: 2644664 - DNA, 14 bp, Homo sapiens
attcaattcctctg

SEQ ID NO: 2644665 - DNA, 19 bp, Homo sapiens
attcaatttattcaagaaa

SEQ ID NO: 2644666 - DNA, 13 bp, Homo sapiens
attcacaatagaa

SEQ ID NO: 2644667 - DNA, 14 bp, Homo sapiens
attcacaatagaaa

SEQ ID NO: 2644668 - DNA, 11 bp, Homo sapiens
attcacactgt

SEQ ID NO: 2644669 - DNA, 17 bp, Homo sapiens
attcacatctaacctca

SEQ ID NO: 2644670 - DNA, 21 bp, Homo sapiens
atttaaaagggaagtctagag

SEQ ID NO: 2644671 - DNA, 14 bp, Homo sapiens
atttaaaatgatta

SEQ ID NO: 2644672 - DNA, 19 bp, Homo sapiens
atttaaaattgtgatgtgt

SEQ ID NO: 2644673 - DNA, 15 bp, Homo sapiens
atttaaacaggccca

SEQ ID NO: 2644674 - DNA, 13 bp, Homo sapiens
atttaaacccatt

SEQ ID NO: 2644675 - DNA, 15 bp, Homo sapiens
atttaaacccatttt

SEQ ID NO: 2644676 - DNA, 17 bp, Homo sapiens
atttaaacccattttag

SEQ ID NO: 2644677 - DNA, 16 bp, Homo sapiens
atttaaagacaaagac

SEQ ID NO: 2644678 - DNA, 21 bp, Homo sapiens
atttaaatacagtcttccatt

SEQ ID NO: 2644679 - DNA, 19 bp, Homo sapiens
atttaaattttacccttta

SEQ ID NO: 2644680 - DNA, 12 bp, Homo sapiens
atttaacagaaa

SEQ ID NO: 2644681 - DNA, 19 bp, Homo sapiens
atttaacagaaatgtacag

SEQ ID NO: 2644682 - DNA, 17 bp, Homo sapiens
atttaacttgtttccaa

SEQ ID NO: 2644683 - DNA, 17 bp, Homo sapiens
atttaagcctcatattt

SEQ ID NO: 2644684 - DNA, 21 bp, Homo sapiens
atttaagcctcatatttaaag

SEQ ID NO: 2644685 - DNA, 18 bp, Homo sapiens
atttaagcttatgtcaga

SEQ ID NO: 2644686 - DNA, 19 bp, Homo sapiens
atttaagtgcgtgtgtaga

SEQ ID NO: 2644687 - DNA, 20 bp, Homo sapiens
atttaagtgcgtgtgtagag

SEQ ID NO: 2644688 - DNA, 16 bp, Homo sapiens
atttaataaaaaaaca

SEQ ID NO: 2644689 - DNA, 14 bp, Homo sapiens
atttaataacatta

SEQ ID NO: 2644690 - DNA, 17 bp, Homo sapiens
atttaataacattacct

SEQ ID NO: 2644691 - DNA, 13 bp, Homo sapiens
atttaatacagca

SEQ ID NO: 2644692 - DNA, 17 bp, Homo sapiens
atttaatagtgttaatc

SEQ ID NO: 2644693 - DNA, 20 bp, Homo sapiens
atttaatagtgttaatcaat

SEQ ID NO: 2644694 - DNA, 18 bp, Homo sapiens
atttaatcttttttatgt

SEQ ID NO: 2644695 - DNA, 13 bp, Homo sapiens
atttaattttgac

SEQ ID NO: 2644696 - DNA, 14 bp, Homo sapiens
atttaattttgaca

SEQ ID NO: 2644697 - DNA, 18 bp, Homo sapiens
atttaattttgacactat

SEQ ID NO: 2644698 - DNA, 23 bp, Homo sapiens
atttacaaaaatataaaatatga

SEQ ID NO: 2644699 - DNA, 22 bp, Homo sapiens
atttacaactgggggagggtga

SEQ ID NO: 2644700 - DNA, 21 bp, Homo sapiens
atttacagcctcacttgaatg

SEQ ID NO: 2644701 - DNA, 21 bp, Homo sapiens
atttacagtgaaaatgtaagc

SEQ ID NO: 2644702 - DNA, 16 bp, Homo sapiens
atttacatatgaaatt

SEQ ID NO: 2644703 - DNA, 20 bp, Homo sapiens
atttacatgaattgcatttt

SEQ ID NO: 2644704 - DNA, 15 bp, Homo sapiens
atttaccacagcagc

SEQ ID NO: 2644705 - DNA, 17 bp, Homo sapiens
atttaccacagcagctg

SEQ ID NO: 2644706 - DNA, 22 bp, Homo sapiens
atttactaagccacaagaaatt

SEQ ID NO: 2644707 - DNA, 22 bp, Homo sapiens
atttactcattcatttattcat

SEQ ID NO: 2644708 - DNA, 14 bp, Homo sapiens
atttacttcttata

SEQ ID NO: 2644709 - DNA, 16 bp, Homo sapiens
atttacttcttataca

SEQ ID NO: 2644710 - DNA, 17 bp, Homo sapiens
atttacttcttatacat

SEQ ID NO: 2644711 - DNA, 19 bp, Homo sapiens
atttacttcttatacattt

SEQ ID NO: 2644712 - DNA, 15 bp, Homo sapiens
atttactttgaattt

SEQ ID NO: 2644713 - DNA, 14 bp, Homo sapiens
atttagaactgtat

SEQ ID NO: 2644714 - DNA, 20 bp, Homo sapiens
atttagagaactgtggccgt

SEQ ID NO: 2644715 - DNA, 17 bp, Homo sapiens
atttagattgaaaactt

SEQ ID NO: 2644716 - DNA, 18 bp, Homo sapiens
atttagcaaataatttcc

SEQ ID NO: 2644717 - DNA, 18 bp, Homo sapiens
atttagccaccatctttg

SEQ ID NO: 2644718 - DNA, 21 bp, Homo sapiens
atttagggaaaggtagtgtat

SEQ ID NO: 2644719 - DNA, 16 bp, Homo sapiens
atttagggaactgctt

SEQ ID NO: 2644720 - DNA, 18 bp, Homo sapiens
atttagggaactgcttga

SEQ ID NO: 2644721 - DNA, 13 bp, Homo sapiens
atttagttatagt

SEQ ID NO: 2644722 - DNA, 14 bp, Homo sapiens
atttagttatagtt

SEQ ID NO: 2644723 - DNA, 13 bp, Homo sapiens
atttagttattga

SEQ ID NO: 2644724 - DNA, 17 bp, Homo sapiens
atttagttctttgttat

SEQ ID NO: 2644725 - DNA, 22 bp, Homo sapiens
atttagtttgattattcagtgt

SEQ ID NO: 2644726 - DNA, 20 bp, Homo sapiens
atttagtttttgtaatttat

SEQ ID NO: 2644727 - DNA, 22 bp, Homo sapiens
atttataaatatatttaagata

SEQ ID NO: 2644728 - DNA, 14 bp, Homo sapiens
atttataaatgcta

SEQ ID NO: 2644729 - DNA, 15 bp, Homo sapiens
atttataaatgctat

SEQ ID NO: 2644730 - DNA, 16 bp, Homo sapiens
atttataaatgctatt

SEQ ID NO: 2644731 - DNA, 13 bp, Homo sapiens
atttataactcat

SEQ ID NO: 2644732 - DNA, 22 bp, Homo sapiens
atttataactcatcataaaata

SEQ ID NO: 2644733 - DNA, 22 bp, Homo sapiens
atttataagcagatttaacaat

SEQ ID NO: 2644734 - DNA, 16 bp, Homo sapiens
atttataaggttttaa

SEQ ID NO: 2644735 - DNA, 23 bp, Homo sapiens
atttataatcacttttttccaca

SEQ ID NO: 2644736 - DNA, 15 bp, Homo sapiens
atttatatatttata

SEQ ID NO: 2644737 - DNA, 15 bp, Homo sapiens
atttatcagtgacag

SEQ ID NO: 2644738 - DNA, 18 bp, Homo sapiens
atttatcagtgacagagt

SEQ ID NO: 2644739 - DNA, 20 bp, Homo sapiens
atttatctgtgtttttgaaa

SEQ ID NO: 2644740 - DNA, 13 bp, Homo sapiens
atttatgaaaaga

SEQ ID NO: 2644741 - DNA, 23 bp, Homo sapiens
atttatgaattgaattatcttgg

SEQ ID NO: 2644742 - DNA, 19 bp, Homo sapiens
atttatgatttaataaaat

SEQ ID NO: 2644743 - DNA, 22 bp, Homo sapiens
atttatgtctatttaagcctca

SEQ ID NO: 2644744 - DNA, 18 bp, Homo sapiens
atttatgtgtgaggagct

SEQ ID NO: 2644745 - DNA, 20 bp, Homo sapiens
atttattaaatgcccagccc

SEQ ID NO: 2644746 - DNA, 21 bp, Homo sapiens
atttattaagatggattctca

SEQ ID NO: 2644747 - DNA, 14 bp, Homo sapiens
atttattacctctg

SEQ ID NO: 2644748 - DNA, 13 bp, Homo sapiens
atttattatggca

SEQ ID NO: 2644749 - DNA, 12 bp, Homo sapiens
atttattattga

SEQ ID NO: 2644750 - DNA, 12 bp, Homo sapiens
atttattcaaga

SEQ ID NO: 2644751 - DNA, 18 bp, Homo sapiens
atttattcaattcctctg

SEQ ID NO: 2644752 - DNA, 19 bp, Homo sapiens
atttattccatattcatgt

SEQ ID NO: 2644753 - DNA, 13 bp, Homo sapiens
atttattctgctc

SEQ ID NO: 2644754 - DNA, 19 bp, Homo sapiens
atttattgtttatttatca

SEQ ID NO: 2644755 - DNA, 21 bp, Homo sapiens
atttattgtttatttatcagt

SEQ ID NO: 2644756 - DNA, 16 bp, Homo sapiens
atttatttaaaagatt

SEQ ID NO: 2644757 - DNA, 20 bp, Homo sapiens
atttatttaaaagattcatt

SEQ ID NO: 2644758 - DNA, 12 bp, Homo sapiens
atttatttaaat

SEQ ID NO: 2644759 - DNA, 13 bp, Homo sapiens
atttatttaataa

SEQ ID NO: 2644760 - DNA, 16 bp, Homo sapiens
atttatttaataacaa

SEQ ID NO: 2644761 - DNA, 20 bp, Homo sapiens
atttatttaataacaattgt

SEQ ID NO: 2644762 - DNA, 24 bp, Homo sapiens
atttatttactgagcttctctgtg

SEQ ID NO: 2644763 - DNA, 16 bp, Homo sapiens
atttatttattaagat

SEQ ID NO: 2644764 - DNA, 17 bp, Homo sapiens
atttatttattaagatg

SEQ ID NO: 2644765 - DNA, 14 bp, Homo sapiens
atttatttatttaa

SEQ ID NO: 2644766 - DNA, 14 bp, Homo sapiens
atttatttcatcat

SEQ ID NO: 2644767 - DNA, 20 bp, Homo sapiens
atttcaaaaaaataaaataa

SEQ ID NO: 2644768 - DNA, 15 bp, Homo sapiens
atttcaaaaatataa

SEQ ID NO: 2644769 - DNA, 19 bp, Homo sapiens
atttcaaaaatataactta

SEQ ID NO: 2644770 - DNA, 21 bp, Homo sapiens
atttcaagacattaaatctat

SEQ ID NO: 2644771 - DNA, 20 bp, Homo sapiens
atttcaagagatttaattaa

SEQ ID NO: 2644772 - DNA, 11 bp, Homo sapiens
atttcaagttc

SEQ ID NO: 2644773 - DNA, 14 bp, Homo sapiens
atttcaattctcaa

SEQ ID NO: 2644774 - DNA, 13 bp, Homo sapiens
atttcacattaat

SEQ ID NO: 2644775 - DNA, 14 bp, Homo sapiens
atttcactattttt

SEQ ID NO: 2644776 - DNA, 22 bp, Homo sapiens
atttcactatttttatttatat

SEQ ID NO: 2644777 - DNA, 18 bp, Homo sapiens
atttcagattcccagagc

SEQ ID NO: 2644778 - DNA, 15 bp, Homo sapiens
atttcaggagggatt

SEQ ID NO: 2644779 - DNA, 22 bp, Homo sapiens
atttcaggatactctgtcagat

SEQ ID NO: 2644780 - DNA, 20 bp, Homo sapiens
atttcaggttttgtaaagat

SEQ ID NO: 2644781 - DNA, 21 bp, Homo sapiens
atttcaggttttgtaaagatg

SEQ ID NO: 2644782 - DNA, 12 bp, Homo sapiens
atttcattgtat

SEQ ID NO: 2644783 - DNA, 15 bp, Homo sapiens
atttcattgtatgat

SEQ ID NO: 2644784 - DNA, 19 bp, Homo sapiens
atttcatttttacccttac

SEQ ID NO: 2644785 - DNA, 23 bp, Homo sapiens
atttccaacaccacagacacaca

SEQ ID NO: 2644786 - DNA, 10 bp, Homo sapiens
atttccagag

SEQ ID NO: 2644787 - DNA, 13 bp, Homo sapiens
atttccagtacct

SEQ ID NO: 2644788 - DNA, 17 bp, Homo sapiens
atttccatatggatttt

SEQ ID NO: 2644789 - DNA, 15 bp, Homo sapiens
atttccattatttat

SEQ ID NO: 2644790 - DNA, 15 bp, Homo sapiens
atttccattccagaa

SEQ ID NO: 2644791 - DNA, 23 bp, Homo sapiens
atttcccacaccgtgtaaaccaa

SEQ ID NO: 2644792 - DNA, 15 bp, Homo sapiens
atttcccagggttaa

SEQ ID NO: 2644793 - DNA, 16 bp, Homo sapiens
atttccccaacagtgt

SEQ ID NO: 2644794 - DNA, 21 bp, Homo sapiens
atttccccaggggaaaatgaa

SEQ ID NO: 2644795 - DNA, 18 bp, Homo sapiens
atttccctgactcctcta

SEQ ID NO: 2644796 - DNA, 16 bp, Homo sapiens
atttccgttaaaatac

SEQ ID NO: 2644797 - DNA, 19 bp, Homo sapiens
atttcctaattttgagaaa

SEQ ID NO: 2644798 - DNA, 20 bp, Homo sapiens
atttcctatgtaactgcatt

SEQ ID NO: 2644799 - DNA, 11 bp, Homo sapiens
atttcctctat

SEQ ID NO: 2644800 - DNA, 19 bp, Homo sapiens
atttcctctattgatgtac

SEQ ID NO: 2644801 - DNA, 16 bp, Homo sapiens
atttcctgttggattt

SEQ ID NO: 2644802 - DNA, 21 bp, Homo sapiens
atttcctgttggatttgttta

SEQ ID NO: 2644803 - DNA, 18 bp, Homo sapiens
atttcctttggagctttt

SEQ ID NO: 2644804 - DNA, 19 bp, Homo sapiens
atttccttttttgttatta

SEQ ID NO: 2644805 - DNA, 22 bp, Homo sapiens
atttcgtgggtctgttttcctt

SEQ ID NO: 2644806 - DNA, 20 bp, Homo sapiens
atttctaaaaaacagaggcc

SEQ ID NO: 2644807 - DNA, 12 bp, Homo sapiens
atttctaaatct

SEQ ID NO: 2644808 - DNA, 21 bp, Homo sapiens
atttctactctcccatggctt

SEQ ID NO: 2644809 - DNA, 21 bp, Homo sapiens
atttctactcttaagtttctc

SEQ ID NO: 2644810 - DNA, 16 bp, Homo sapiens
atttctactgtgactg

SEQ ID NO: 2644811 - DNA, 19 bp, Homo sapiens
atttctaggaagaatttta

SEQ ID NO: 2644812 - DNA, 20 bp, Homo sapiens
atttctaggaagaattttaa

SEQ ID NO: 2644813 - DNA, 13 bp, Homo sapiens
atttctatttatt

SEQ ID NO: 2644814 - DNA, 19 bp, Homo sapiens
atttctcaacaaagcacag

SEQ ID NO: 2644815 - DNA, 18 bp, Homo sapiens
caaagcttagcaggagag

SEQ ID NO: 2644816 - DNA, 19 bp, Homo sapiens
caaagcttgaagatcgtta

SEQ ID NO: 2644817 - DNA, 19 bp, Homo sapiens
caaagcttggaagagcctg

SEQ ID NO: 2644818 - DNA, 16 bp, Homo sapiens
caaagctttttccaga

SEQ ID NO: 2644819 - DNA, 22 bp, Homo sapiens
caaaggaaaatagtaatgtttt

SEQ ID NO: 2644820 - DNA, 13 bp, Homo sapiens
caaaggccatgga

SEQ ID NO: 2644821 - DNA, 21 bp, Homo sapiens
caaaggccatggagagctgga

SEQ ID NO: 2644822 - DNA, 11 bp, Homo sapiens
caaaggctggg

SEQ ID NO: 2644823 - DNA, 22 bp, Homo sapiens
caaagggagcactgggttgact

SEQ ID NO: 2644824 - DNA, 14 bp, Homo sapiens
caaagggctgaaag

SEQ ID NO: 2644825 - DNA, 16 bp, Homo sapiens
caaagggtatcaggtg

SEQ ID NO: 2644826 - DNA, 19 bp, Homo sapiens
caaagggtatcaggtgctg

SEQ ID NO: 2644827 - DNA, 21 bp, Homo sapiens
caaagggtatcaggtgctgcc

SEQ ID NO: 2644828 - DNA, 20 bp, Homo sapiens
caaagggtgaagctatttat

SEQ ID NO: 2644829 - DNA, 19 bp, Homo sapiens
caaagggttttaatgtaga

SEQ ID NO: 2644830 - DNA, 14 bp, Homo sapiens
caaaggtataattt

SEQ ID NO: 2644831 - DNA, 16 bp, Homo sapiens
caaagtaaaacttgct

SEQ ID NO: 2644832 - DNA, 16 bp, Homo sapiens
caaagtacactgtttc

SEQ ID NO: 2644833 - DNA, 20 bp, Homo sapiens
caaagtacactgtttcaaac

SEQ ID NO: 2644834 - DNA, 21 bp, Homo sapiens
caaagtacactgtttcaaact

SEQ ID NO: 2644835 - DNA, 22 bp, Homo sapiens
caaagtacactgtttcaaactt

SEQ ID NO: 2644836 - DNA, 20 bp, Homo sapiens
caaagtcatgcaaaggctgg

SEQ ID NO: 2644837 - DNA, 19 bp, Homo sapiens
caaagtgctgggattacaa

SEQ ID NO: 2644838 - DNA, 23 bp, Homo sapiens
caaagtgctgggattacaagcgt

SEQ ID NO: 2644839 - DNA, 20 bp, Homo sapiens
caaagtgctgggattacagg

SEQ ID NO: 2644840 - DNA, 23 bp, Homo sapiens
caaagtgctgggattacaggtgt

SEQ ID NO: 2644841 - DNA, 22 bp, Homo sapiens
caaagttccctacttcctgtga

SEQ ID NO: 2644842 - DNA, 14 bp, Homo sapiens
caaagttttgaaaa

SEQ ID NO: 2644843 - DNA, 20 bp, Homo sapiens
caaagttttgaaaagctatt

SEQ ID NO: 2644844 - DNA, 23 bp, Homo sapiens
caaataaaataaaaataaaaaca

SEQ ID NO: 2644845 - DNA, 14 bp, Homo sapiens
caaataataagcaa

SEQ ID NO: 2644846 - DNA, 14 bp, Homo sapiens
caaatactcttagg

SEQ ID NO: 2644847 - DNA, 12 bp, Homo sapiens
caaatactttaa

SEQ ID NO: 2644848 - DNA, 20 bp, Homo sapiens
caaatagtttataaatgtga

SEQ ID NO: 2644849 - DNA, 17 bp, Homo sapiens
caaatatgcaaagcact

SEQ ID NO: 2644850 - DNA, 18 bp, Homo sapiens
caaatatgcaaagcactg

SEQ ID NO: 2644851 - DNA, 15 bp, Homo sapiens
caaatattagatgtg

SEQ ID NO: 2644852 - DNA, 16 bp, Homo sapiens
caaatattagatgtga

SEQ ID NO: 2644853 - DNA, 17 bp, Homo sapiens
caaatattagatgtgat

SEQ ID NO: 2644854 - DNA, 14 bp, Homo sapiens
caaatatttatttt

SEQ ID NO: 2644855 - DNA, 16 bp, Homo sapiens
caaatatttattttct

SEQ ID NO: 2644856 - DNA, 20 bp, Homo sapiens
caaatatttattttctttct

SEQ ID NO: 2644857 - DNA, 14 bp, Homo sapiens
caaatcaagcttca

SEQ ID NO: 2644858 - DNA, 13 bp, Homo sapiens
caaatcagccatg

SEQ ID NO: 2644859 - DNA, 16 bp, Homo sapiens
caaatccgaacctcct

SEQ ID NO: 2644860 - DNA, 21 bp, Homo sapiens
caaatccgaacctcctctgtg

SEQ ID NO: 2644861 - DNA, 22 bp, Homo sapiens
caaatcctatgtgattttaact

SEQ ID NO: 2644862 - DNA, 21 bp, Homo sapiens
caaatcgtccagcgaccttcc

SEQ ID NO: 2644863 - DNA, 14 bp, Homo sapiens
caaatctattcaga

SEQ ID NO: 2644864 - DNA, 21 bp, Homo sapiens
caaatctgctttttaaagaat

SEQ ID NO: 2644865 - DNA, 22 bp, Homo sapiens
caaatgaatgttgtctgtttgt

SEQ ID NO: 2644866 - DNA, 22 bp, Homo sapiens
caaatgaccagcagattcaaat

SEQ ID NO: 2644867 - DNA, 20 bp, Homo sapiens
caaatggaaatgggcagagc

SEQ ID NO: 2644868 - DNA, 15 bp, Homo sapiens
caaatggaagacaca

SEQ ID NO: 2644869 - DNA, 14 bp, Homo sapiens
caaatggaggaata

SEQ ID NO: 2644870 - DNA, 21 bp, Homo sapiens
caaatgtaattgaataaagtt

SEQ ID NO: 2644871 - DNA, 19 bp, Homo sapiens
caaatgtcagatacaatgt

SEQ ID NO: 2644872 - DNA, 20 bp, Homo sapiens
caaatgtgtatcggatgctt

SEQ ID NO: 2644873 - DNA, 18 bp, Homo sapiens
caaatgttcatcaatgaa

SEQ ID NO: 2644874 - DNA, 20 bp, Homo sapiens
caaatgttcatcaatgaatg

SEQ ID NO: 2644875 - DNA, 15 bp, Homo sapiens
caaatgttttgacat

SEQ ID NO: 2644876 - DNA, 18 bp, Homo sapiens
caaattactttgtgaata

SEQ ID NO: 2644877 - DNA, 18 bp, Homo sapiens
caaattaggttttgtaca

SEQ ID NO: 2644878 - DNA, 19 bp, Homo sapiens
caaattaggttttgtacaa

SEQ ID NO: 2644879 - DNA, 17 bp, Homo sapiens
caaattattaatgaaaa

SEQ ID NO: 2644880 - DNA, 12 bp, Homo sapiens
caaattatttgt

SEQ ID NO: 2644881 - DNA, 16 bp, Homo sapiens
caaattatttgtgtaa

SEQ ID NO: 2644882 - DNA, 16 bp, Homo sapiens
caaattcgcaaacttt

SEQ ID NO: 2644883 - DNA, 14 bp, Homo sapiens
caaattcttctgaa

SEQ ID NO: 2644884 - DNA, 20 bp, Homo sapiens
caaattgcttactttggaat

SEQ ID NO: 2644885 - DNA, 19 bp, Homo sapiens
caaattgtatctagtgcag

SEQ ID NO: 2644886 - DNA, 11 bp, Homo sapiens
caaatttcaca

SEQ ID NO: 2644887 - DNA, 11 bp, Homo sapiens
caaatttctaa

SEQ ID NO: 2644888 - DNA, 15 bp, Homo sapiens
caaatttctaaatct

SEQ ID NO: 2644889 - DNA, 16 bp, Homo sapiens
caacaaaaagcttccc

SEQ ID NO: 2644890 - DNA, 19 bp, Homo sapiens
caacaaagccaacagtcaa

SEQ ID NO: 2644891 - DNA, 16 bp, Homo sapiens
caacaaagctgttgat

SEQ ID NO: 2644892 - DNA, 19 bp, Homo sapiens
caacaaagggttttaatgt

SEQ ID NO: 2644893 - DNA, 21 bp, Homo sapiens
caacaaattaggttttgtaca

SEQ ID NO: 2644894 - DNA, 18 bp, Homo sapiens
caacaacctcaactgcct

SEQ ID NO: 2644895 - DNA, 15 bp, Homo sapiens
caacaagagtttatt

SEQ ID NO: 2644896 - DNA, 17 bp, Homo sapiens
caacaatcctagtgctt

SEQ ID NO: 2644897 - DNA, 14 bp, Homo sapiens
caacaatttatgaa

SEQ ID NO: 2644898 - DNA, 17 bp, Homo sapiens
caacaatttatgaattg

SEQ ID NO: 2644899 - DNA, 17 bp, Homo sapiens
caacacaagctggaagc

SEQ ID NO: 2644900 - DNA, 11 bp, Homo sapiens
caacacacaga

SEQ ID NO: 2644901 - DNA, 16 bp, Homo sapiens
caacaccacagacaca

SEQ ID NO: 2644902 - DNA, 17 bp, Homo sapiens
caacaccacagacacac

SEQ ID NO: 2644903 - DNA, 20 bp, Homo sapiens
caacaccacagacacacaca

SEQ ID NO: 2644904 - DNA, 23 bp, Homo sapiens
caacacgagcaggctactgtcag

SEQ ID NO: 2644905 - DNA, 18 bp, Homo sapiens
caacactcattgacctga

SEQ ID NO: 2644906 - DNA, 22 bp, Homo sapiens
caacactcattgacctgaggcc

SEQ ID NO: 2644907 - DNA, 18 bp, Homo sapiens
caacactgtgccctggtg

SEQ ID NO: 2644908 - DNA, 19 bp, Homo sapiens
caacactgtgccctggtgg

SEQ ID NO: 2644909 - DNA, 12 bp, Homo sapiens
caacagaagcag

SEQ ID NO: 2644910 - DNA, 17 bp, Homo sapiens
caacagaagcttcagaa

SEQ ID NO: 2644911 - DNA, 22 bp, Homo sapiens
caacagaagtcatgaagcccaa

SEQ ID NO: 2644912 - DNA, 23 bp, Homo sapiens
caacagaagtcatgaagcccaag

SEQ ID NO: 2644913 - DNA, 16 bp, Homo sapiens
caacagatttgtgaac

SEQ ID NO: 2644914 - DNA, 17 bp, Homo sapiens
caacagcaaatcacgac

SEQ ID NO: 2644915 - DNA, 14 bp, Homo sapiens
caacaggaggacaa

SEQ ID NO: 2644916 - DNA, 22 bp, Homo sapiens
caacaggaggacaattcatgaa

SEQ ID NO: 2644917 - DNA, 14 bp, Homo sapiens
caacaggctgggct

SEQ ID NO: 2644918 - DNA, 21 bp, Homo sapiens
caacaggtggcaggaccagga

SEQ ID NO: 2644919 - DNA, 23 bp, Homo sapiens
caacaggtggcaggaccaggact

SEQ ID NO: 2644920 - DNA, 13 bp, Homo sapiens
caacaggttttat

SEQ ID NO: 2644921 - DNA, 14 bp, Homo sapiens
caacagtcaaaaca

SEQ ID NO: 2644922 - DNA, 18 bp, Homo sapiens
caacagtcaaaacagaga

SEQ ID NO: 2644923 - DNA, 14 bp, Homo sapiens
caacagtgtgaagt

SEQ ID NO: 2644924 - DNA, 18 bp, Homo sapiens
caacagtgtgaagttaga

SEQ ID NO: 2644925 - DNA, 19 bp, Homo sapiens
caacagtgtgaagttagaa

SEQ ID NO: 2644926 - DNA, 16 bp, Homo sapiens
caacatactcccatct

SEQ ID NO: 2644927 - DNA, 17 bp, Homo sapiens
caacatactcccatctg

SEQ ID NO: 2644928 - DNA, 13 bp, Homo sapiens
caacatcaatgtt

SEQ ID NO: 2644929 - DNA, 18 bp, Homo sapiens
caacatgtataatatttt

SEQ ID NO: 2644930 - DNA, 23 bp, Homo sapiens
caacatgtataatatttttaatt

SEQ ID NO: 2644931 - DNA, 18 bp, Homo sapiens
caacatgttactgaccag

SEQ ID NO: 2644932 - DNA, 20 bp, Homo sapiens
caacatgttactgaccagca

SEQ ID NO: 2644933 - DNA, 21 bp, Homo sapiens
caaccaccgctccccagccca

SEQ ID NO: 2644934 - DNA, 22 bp, Homo sapiens
caaccagcatcccttgaccagg

SEQ ID NO: 2644935 - DNA, 18 bp, Homo sapiens
caaccatgagaccactgt

SEQ ID NO: 2644936 - DNA, 23 bp, Homo sapiens
caaccatgagaccactgttatca

SEQ ID NO: 2644937 - DNA, 23 bp, Homo sapiens
caaccatgagtggcatggccacc

SEQ ID NO: 2644938 - DNA, 13 bp, Homo sapiens
caaccattccaga

SEQ ID NO: 2644939 - DNA, 22 bp, Homo sapiens
caaccattccagactgcttcca

SEQ ID NO: 2644940 - DNA, 19 bp, Homo sapiens
caacccaaatgttcatcaa

SEQ ID NO: 2644941 - DNA, 15 bp, Homo sapiens
caacccaaggactga

SEQ ID NO: 2644942 - DNA, 22 bp, Homo sapiens
caacccaggagcatccacctcc

SEQ ID NO: 2644943 - DNA, 11 bp, Homo sapiens
caacccccacc

SEQ ID NO: 2644944 - DNA, 14 bp, Homo sapiens
caacccccacccca

SEQ ID NO: 2644945 - DNA, 23 bp, Homo sapiens
caacccccaccccacacttgttc

SEQ ID NO: 2644946 - DNA, 16 bp, Homo sapiens
caacccccatttctat

SEQ ID NO: 2644947 - DNA, 16 bp, Homo sapiens
caaccccccacctgcc

SEQ ID NO: 2644948 - DNA, 17 bp, Homo sapiens
caaccccccacctgcca

SEQ ID NO: 2644949 - DNA, 14 bp, Homo sapiens
caacccctgtggag

SEQ ID NO: 2644950 - DNA, 21 bp, Homo sapiens
caacccctgtggagcccgcac

SEQ ID NO: 2644951 - DNA, 22 bp, Homo sapiens
caacccctgtggagcccgcacc

SEQ ID NO: 2644952 - DNA, 14 bp, Homo sapiens
caaccccttcgctc

SEQ ID NO: 2644953 - DNA, 18 bp, Homo sapiens
caaccccttcgctcctgt

SEQ ID NO: 2644954 - DNA, 21 bp, Homo sapiens
caaccccttcgctcctgtgtc

SEQ ID NO: 2644955 - DNA, 16 bp, Homo sapiens
caacccgaggcccgca

SEQ ID NO: 2644956 - DNA, 15 bp, Homo sapiens
caaccctcatcacca

SEQ ID NO: 2644957 - DNA, 14 bp, Homo sapiens
caaccctccctcag

SEQ ID NO: 2644958 - DNA, 21 bp, Homo sapiens
caaccctccctcagcccctct

SEQ ID NO: 2644959 - DNA, 13 bp, Homo sapiens
cacacagctctgt

SEQ ID NO: 2644960 - DNA, 14 bp, Homo sapiens
cacacagctctgtc

SEQ ID NO: 2644961 - DNA, 13 bp, Homo sapiens
cacacaggcaact

SEQ ID NO: 2644962 - DNA, 16 bp, Homo sapiens
cacacaggcaactgag

SEQ ID NO: 2644963 - DNA, 18 bp, Homo sapiens
cacacagtgagtcgagga

SEQ ID NO: 2644964 - DNA, 21 bp, Homo sapiens
cacacagtgagtcgaggacag

SEQ ID NO: 2644965 - DNA, 14 bp, Homo sapiens
cacacatgcataca

SEQ ID NO: 2644966 - DNA, 19 bp, Homo sapiens
cacacatgcatacacacac

SEQ ID NO: 2644967 - DNA, 10 bp, Homo sapiens
cacacatttt

SEQ ID NO: 2644968 - DNA, 12 bp, Homo sapiens
cacacatttttt

SEQ ID NO: 2644969 - DNA, 20 bp, Homo sapiens
cacacattttttaaatgcac

SEQ ID NO: 2644970 - DNA, 21 bp, Homo sapiens
cacaccagagcccaccttggc

SEQ ID NO: 2644971 - DNA, 22 bp, Homo sapiens
cacaccaggccgtcctcccggg

SEQ ID NO: 2644972 - DNA, 22 bp, Homo sapiens
cacaccaggctgtgggcctcaa

SEQ ID NO: 2644973 - DNA, 14 bp, Homo sapiens
cacacccaccgtcc

SEQ ID NO: 2644974 - DNA, 13 bp, Homo sapiens
cacacccagccca

SEQ ID NO: 2644975 - DNA, 13 bp, Homo sapiens
cacacccccaccc

SEQ ID NO: 2644976 - DNA, 18 bp, Homo sapiens
cacaccctctcccaggac

SEQ ID NO: 2644977 - DNA, 14 bp, Homo sapiens
cacaccctgtttta

SEQ ID NO: 2644978 - DNA, 23 bp, Homo sapiens
cacacctaagggacatgttttga

SEQ ID NO: 2644979 - DNA, 18 bp, Homo sapiens
cacacctcagttcccttg

SEQ ID NO: 2644980 - DNA, 20 bp, Homo sapiens
cacacctcagttcccttggc

SEQ ID NO: 2644981 - DNA, 13 bp, Homo sapiens
cacacctccacag

SEQ ID NO: 2644982 - DNA, 16 bp, Homo sapiens
cacacctccctgaacc

SEQ ID NO: 2644983 - DNA, 13 bp, Homo sapiens
cacacctctgcca

SEQ ID NO: 2644984 - DNA, 14 bp, Homo sapiens
cacacctctgccag

SEQ ID NO: 2644985 - DNA, 15 bp, Homo sapiens
cacacgcacacacac

SEQ ID NO: 2644986 - DNA, 16 bp, Homo sapiens
cacacgcacacacaca

SEQ ID NO: 2644987 - DNA, 13 bp, Homo sapiens
cacacgcacgcac

SEQ ID NO: 2644988 - DNA, 17 bp, Homo sapiens
cacacgcacgcacacac

SEQ ID NO: 2644989 - DNA, 19 bp, Homo sapiens
cacacgcacgcacacacac

SEQ ID NO: 2644990 - DNA, 20 bp, Homo sapiens
cacacggtttgaagcctgga

SEQ ID NO: 2644991 - DNA, 17 bp, Homo sapiens
cacacgtacttaaatga

SEQ ID NO: 2644992 - DNA, 17 bp, Homo sapiens
cacactagcctctccag

SEQ ID NO: 2644993 - DNA, 18 bp, Homo sapiens
cacactattaccatgaga

SEQ ID NO: 2644994 - DNA, 19 bp, Homo sapiens
cacactcaaatcaagaaac

SEQ ID NO: 2644995 - DNA, 17 bp, Homo sapiens
cacactcactcctgaga

SEQ ID NO: 2644996 - DNA, 14 bp, Homo sapiens
cacactgaggcagg

SEQ ID NO: 2644997 - DNA, 13 bp, Homo sapiens
cacactggactcc

SEQ ID NO: 2644998 - DNA, 22 bp, Homo sapiens
cacactggggtgccgcctgccc

SEQ ID NO: 2644999 - DNA, 19 bp, Homo sapiens
cacacttcctgtccagaga

SEQ ID NO: 2645000 - DNA, 23 bp, Homo sapiens
cacacttcctgtccagagagaga

SEQ ID NO: 2645001 - DNA, 13 bp, Homo sapiens
cacacttgtgtgt

SEQ ID NO: 2645002 - DNA, 23 bp, Homo sapiens
cacacttgtgtgtgggctgtgag

SEQ ID NO: 2645003 - DNA, 19 bp, Homo sapiens
cacacttgttccagctctt

SEQ ID NO: 2645004 - DNA, 20 bp, Homo sapiens
cacacttgttccagctcttt

SEQ ID NO: 2645005 - DNA, 12 bp, Homo sapiens
cacagaaaatat

SEQ ID NO: 2645006 - DNA, 14 bp, Homo sapiens
cacagaaaatatac

SEQ ID NO: 2645007 - DNA, 16 bp, Homo sapiens
cacagaaaatatactg

SEQ ID NO: 2645008 - DNA, 17 bp, Homo sapiens
cacagaaaatatactgt

SEQ ID NO: 2645009 - DNA, 18 bp, Homo sapiens
cacagaaaatatactgta

SEQ ID NO: 2645010 - DNA, 21 bp, Homo sapiens
cacagaaaatatactgtaaag

SEQ ID NO: 2645011 - DNA, 21 bp, Homo sapiens
cacagaaacacaatattttgt

SEQ ID NO: 2645012 - DNA, 18 bp, Homo sapiens
cacagaaagactgagctc

SEQ ID NO: 2645013 - DNA, 22 bp, Homo sapiens
cacagaaagactgagctcaagg

SEQ ID NO: 2645014 - DNA, 17 bp, Homo sapiens
cacagaaatgagatcag

SEQ ID NO: 2645015 - DNA, 22 bp, Homo sapiens
cacagaaatgagatcaggctct

SEQ ID NO: 2645016 - DNA, 14 bp, Homo sapiens
cacagaagccagga

SEQ ID NO: 2645017 - DNA, 16 bp, Homo sapiens
cacagaagccaggagc

SEQ ID NO: 2645018 - DNA, 14 bp, Homo sapiens
cacagacacacaca

SEQ ID NO: 2645019 - DNA, 20 bp, Homo sapiens
cacagacacacacacgcacg

SEQ ID NO: 2645020 - DNA, 20 bp, Homo sapiens
cacagacattctgccaggcc

SEQ ID NO: 2645021 - DNA, 16 bp, Homo sapiens
cacagaccctgccctg

SEQ ID NO: 2645022 - DNA, 18 bp, Homo sapiens
cacagaccctgccctgtg

SEQ ID NO: 2645023 - DNA, 20 bp, Homo sapiens
cacagaccctgccctgtggg

SEQ ID NO: 2645024 - DNA, 21 bp, Homo sapiens
cacagaccctgccctgtgggc

SEQ ID NO: 2645025 - DNA, 16 bp, Homo sapiens
cacagacctggagccc

SEQ ID NO: 2645026 - DNA, 21 bp, Homo sapiens
cacagacctggagcccctggg

SEQ ID NO: 2645027 - DNA, 24 bp, Homo sapiens
cacagacctggagcccctgggtgg

SEQ ID NO: 2645028 - DNA, 18 bp, Homo sapiens
cacagactcaaatgctca

SEQ ID NO: 2645029 - DNA, 12 bp, Homo sapiens
cacagagaaagt

SEQ ID NO: 2645030 - DNA, 20 bp, Homo sapiens
cacagagaaagtacttctcc

SEQ ID NO: 2645031 - DNA, 14 bp, Homo sapiens
cacagagaagacaa

SEQ ID NO: 2645032 - DNA, 17 bp, Homo sapiens
cacagagaagacaaaat

SEQ ID NO: 2645033 - DNA, 22 bp, Homo sapiens
cacagagaagacaaaattagca

SEQ ID NO: 2645034 - DNA, 18 bp, Homo sapiens
cacagagagtcccactgc

SEQ ID NO: 2645035 - DNA, 14 bp, Homo sapiens
cacagagcaggact

SEQ ID NO: 2645036 - DNA, 21 bp, Homo sapiens
cacagagcaggactgcacagc

SEQ ID NO: 2645037 - DNA, 13 bp, Homo sapiens
cacagagcgggga

SEQ ID NO: 2645038 - DNA, 17 bp, Homo sapiens
cacagagctctccagct

SEQ ID NO: 2645039 - DNA, 17 bp, Homo sapiens
cacagaggaagagcagg

SEQ ID NO: 2645040 - DNA, 16 bp, Homo sapiens
cacagagttgttacat

SEQ ID NO: 2645041 - DNA, 20 bp, Homo sapiens
cacagagttgttacattttt

SEQ ID NO: 2645042 - DNA, 19 bp, Homo sapiens
cacagatcacagcttcagc

SEQ ID NO: 2645043 - DNA, 22 bp, Homo sapiens
cacagatcacagcttcagccag

SEQ ID NO: 2645044 - DNA, 17 bp, Homo sapiens
cacagatgaaacacaaa

SEQ ID NO: 2645045 - DNA, 14 bp, Homo sapiens
cacagatgggtgct

SEQ ID NO: 2645046 - DNA, 19 bp, Homo sapiens
cacagcagcttcaccagag

SEQ ID NO: 2645047 - DNA, 23 bp, Homo sapiens
cacagcatcattttgcattcaaa

SEQ ID NO: 2645048 - DNA, 11 bp, Homo sapiens
cacagccacac

SEQ ID NO: 2645049 - DNA, 12 bp, Homo sapiens
cacagccacaca

SEQ ID NO: 2645050 - DNA, 15 bp, Homo sapiens
cacagccacacacac

SEQ ID NO: 2645051 - DNA, 22 bp, Homo sapiens
cacagccacacacacagaaaat

SEQ ID NO: 2645052 - DNA, 16 bp, Homo sapiens
cacagccaggtgcctt

SEQ ID NO: 2645053 - DNA, 17 bp, Homo sapiens
cacagccaggtgccttg

SEQ ID NO: 2645054 - DNA, 19 bp, Homo sapiens
cacagccatcccagccttg

SEQ ID NO: 2645055 - DNA, 11 bp, Homo sapiens
cacagccctgt

SEQ ID NO: 2645056 - DNA, 14 bp, Homo sapiens
cacagcctcccctg

SEQ ID NO: 2645057 - DNA, 19 bp, Homo sapiens
cacagcctcccctgccagg

SEQ ID NO: 2645058 - DNA, 21 bp, Homo sapiens
cacagcctcccctgccagggc

SEQ ID NO: 2645059 - DNA, 20 bp, Homo sapiens
cacagcggggccccagggct

SEQ ID NO: 2645060 - DNA, 19 bp, Homo sapiens
cacagctctgtcctgggag

SEQ ID NO: 2645061 - DNA, 23 bp, Homo sapiens
cacagctctgtcctgggagtgag

SEQ ID NO: 2645062 - DNA, 17 bp, Homo sapiens
cacagctcttctccagg

SEQ ID NO: 2645063 - DNA, 18 bp, Homo sapiens
cacagctgagagactttt

SEQ ID NO: 2645064 - DNA, 14 bp, Homo sapiens
cacagctgctggag

SEQ ID NO: 2645065 - DNA, 14 bp, Homo sapiens
cacagctgctttct

SEQ ID NO: 2645066 - DNA, 15 bp, Homo sapiens
cacagctgggctgtg

SEQ ID NO: 2645067 - DNA, 18 bp, Homo sapiens
cacagcttcagccaggag

SEQ ID NO: 2645068 - DNA, 16 bp, Homo sapiens
cacagcttcccctctc

SEQ ID NO: 2645069 - DNA, 15 bp, Homo sapiens
cacaggaagtagagg

SEQ ID NO: 2645070 - DNA, 17 bp, Homo sapiens
cacaggacccccttccc

SEQ ID NO: 2645071 - DNA, 18 bp, Homo sapiens
cacaggagtgggaaaaca

SEQ ID NO: 2645072 - DNA, 12 bp, Homo sapiens
cacaggatcagt

SEQ ID NO: 2645073 - DNA, 24 bp, Homo sapiens
cacaggatcctattctcaccagga

SEQ ID NO: 2645074 - DNA, 14 bp, Homo sapiens
cacaggcaactgag

SEQ ID NO: 2645075 - DNA, 19 bp, Homo sapiens
cacaggcaactgaggcaga

SEQ ID NO: 2645076 - DNA, 23 bp, Homo sapiens
cacaggcaactgaggcagacagc

SEQ ID NO: 2645077 - DNA, 11 bp, Homo sapiens
cacaggcagct

SEQ ID NO: 2645078 - DNA, 11 bp, Homo sapiens
cacaggcaggt

SEQ ID NO: 2645079 - DNA, 13 bp, Homo sapiens
cacaggccccctt

SEQ ID NO: 2645080 - DNA, 22 bp, Homo sapiens
cacaggcccccttgagtggggt

SEQ ID NO: 2645081 - DNA, 16 bp, Homo sapiens
cacaggcccggctcca

SEQ ID NO: 2645082 - DNA, 17 bp, Homo sapiens
cacaggcccggctccag

SEQ ID NO: 2645083 - DNA, 18 bp, Homo sapiens
cacagggcagctgggccc

SEQ ID NO: 2645084 - DNA, 22 bp, Homo sapiens
cacagggcagctgggcccaacc

SEQ ID NO: 2645085 - DNA, 19 bp, Homo sapiens
cacagggccccagaaggca

SEQ ID NO: 2645086 - DNA, 13 bp, Homo sapiens
cacagggcgagac

SEQ ID NO: 2645087 - DNA, 18 bp, Homo sapiens
cacaggtgggcttcccag

SEQ ID NO: 2645088 - DNA, 15 bp, Homo sapiens
cacaggtgtttatac

SEQ ID NO: 2645089 - DNA, 18 bp, Homo sapiens
cacagtattacttctgct

SEQ ID NO: 2645090 - DNA, 14 bp, Homo sapiens
cacagtctctctct

SEQ ID NO: 2645091 - DNA, 22 bp, Homo sapiens
cacagtgagtcgaggacaggga

SEQ ID NO: 2645092 - DNA, 18 bp, Homo sapiens
cacagtgccttcaataaa

SEQ ID NO: 2645093 - DNA, 19 bp, Homo sapiens
cacagtgccttcaataaat

SEQ ID NO: 2645094 - DNA, 22 bp, Homo sapiens
cacagtgctttccgtggcactg

SEQ ID NO: 2645095 - DNA, 15 bp, Homo sapiens
cacagtggtggcagg

SEQ ID NO: 2645096 - DNA, 16 bp, Homo sapiens
cacagtgtgtttgtga

SEQ ID NO: 2645097 - DNA, 23 bp, Homo sapiens
cacagtgttaaatgaaattgtaa

SEQ ID NO: 2645098 - DNA, 19 bp, Homo sapiens
cacagtgttgcccaggctg

SEQ ID NO: 2645099 - DNA, 10 bp, Homo sapiens
cacagtgttt

SEQ ID NO: 2645100 - DNA, 19 bp, Homo sapiens
cacagtgtttttgtaaagt

SEQ ID NO: 2645101 - DNA, 22 bp, Homo sapiens
cacagtgtttttgtaaagtgtg

SEQ ID NO: 2645102 - DNA, 19 bp, Homo sapiens
cacagttcgacctgcggct

SEQ ID NO: 2645103 - DNA, 21 bp, Homo sapiens
cacagtttcctcatctgtcca

SEQ ID NO: 2645104 - DNA, 14 bp, Homo sapiens
cacctttaaagtgt

SEQ ID NO: 2645105 - DNA, 15 bp, Homo sapiens
cacctttattaaaat

SEQ ID NO: 2645106 - DNA, 22 bp, Homo sapiens
cacctttcagataactgttatt

SEQ ID NO: 2645107 - DNA, 19 bp, Homo sapiens
cacgaactttagctgcatc

SEQ ID NO: 2645108 - DNA, 18 bp, Homo sapiens
cacgaagtgttgcatgga

SEQ ID NO: 2645109 - DNA, 13 bp, Homo sapiens
cacgagagcccgg

SEQ ID NO: 2645110 - DNA, 19 bp, Homo sapiens
cacgagcaggctactgtca

SEQ ID NO: 2645111 - DNA, 13 bp, Homo sapiens
cacgcacacacac

SEQ ID NO: 2645112 - DNA, 14 bp, Homo sapiens
cacgcacacacaca

SEQ ID NO: 2645113 - DNA, 15 bp, Homo sapiens
cacgcacacacacaa

SEQ ID NO: 2645114 - DNA, 14 bp, Homo sapiens
cacgcacctcccat

SEQ ID NO: 2645115 - DNA, 12 bp, Homo sapiens
cacgcacgcaca

SEQ ID NO: 2645116 - DNA, 17 bp, Homo sapiens
cacgcacttcgggaggt

SEQ ID NO: 2645117 - DNA, 13 bp, Homo sapiens
cacgcaggaactc

SEQ ID NO: 2645118 - DNA, 17 bp, Homo sapiens
cacgcaggaactcccag

SEQ ID NO: 2645119 - DNA, 15 bp, Homo sapiens
cacgccactgcacta

SEQ ID NO: 2645120 - DNA, 23 bp, Homo sapiens
cacgccagattctttcctgaggc

SEQ ID NO: 2645121 - DNA, 14 bp, Homo sapiens
cacgcccatgtgtg

SEQ ID NO: 2645122 - DNA, 17 bp, Homo sapiens
cacgcccccactggtga

SEQ ID NO: 2645123 - DNA, 22 bp, Homo sapiens
cacgcctcccactggggtccag

SEQ ID NO: 2645124 - DNA, 20 bp, Homo sapiens
cacgcctgtaatcctagcac

SEQ ID NO: 2645125 - DNA, 15 bp, Homo sapiens
cacgcgtgcacacac

SEQ ID NO: 2645126 - DNA, 20 bp, Homo sapiens
cacgctggaccttgaactgg

SEQ ID NO: 2645127 - DNA, 16 bp, Homo sapiens
cacgctggagtgcagt

SEQ ID NO: 2645128 - DNA, 21 bp, Homo sapiens
cacgctggagtgcagtgagcc

SEQ ID NO: 2645129 - DNA, 17 bp, Homo sapiens
cacgctgtctccagacc

SEQ ID NO: 2645130 - DNA, 20 bp, Homo sapiens
cacgctgtctccagaccccc

SEQ ID NO: 2645131 - DNA, 20 bp, Homo sapiens
cacgcttcttcttttgagca

SEQ ID NO: 2645132 - DNA, 19 bp, Homo sapiens
cacgcttgcgtatgtctgt

SEQ ID NO: 2645133 - DNA, 14 bp, Homo sapiens
cacgctttcctgaa

SEQ ID NO: 2645134 - DNA, 22 bp, Homo sapiens
cacggcaggacaacgaggaagc

SEQ ID NO: 2645135 - DNA, 17 bp, Homo sapiens
cacggccaacaaagctg

SEQ ID NO: 2645136 - DNA, 14 bp, Homo sapiens
cacggccaggccag

SEQ ID NO: 2645137 - DNA, 16 bp, Homo sapiens
cacggccaggccagag

SEQ ID NO: 2645138 - DNA, 15 bp, Homo sapiens
cacggccgctccagg

SEQ ID NO: 2645139 - DNA, 17 bp, Homo sapiens
cacggccgctccagggg

SEQ ID NO: 2645140 - DNA, 14 bp, Homo sapiens
cacggctcactgca

SEQ ID NO: 2645141 - DNA, 17 bp, Homo sapiens
cacggctcactgcagcc

SEQ ID NO: 2645142 - DNA, 13 bp, Homo sapiens
cacggctgctgag

SEQ ID NO: 2645143 - DNA, 15 bp, Homo sapiens
cacgggagatttctt

SEQ ID NO: 2645144 - DNA, 21 bp, Homo sapiens
cacggtcgccacctggcattc

SEQ ID NO: 2645145 - DNA, 17 bp, Homo sapiens
cacggtttgaagcctgg

SEQ ID NO: 2645146 - DNA, 20 bp, Homo sapiens
cacggtttgaagcctggaac

SEQ ID NO: 2645147 - DNA, 21 bp, Homo sapiens
cacgtgagaatccctggcaaa

SEQ ID NO: 2645148 - DNA, 19 bp, Homo sapiens
cacgtgctacccccatgct

SEQ ID NO: 2645149 - DNA, 23 bp, Homo sapiens
cacgtggagagctggtgcccgga

SEQ ID NO: 2645150 - DNA, 18 bp, Homo sapiens
cacgtggaggagcagtgc

SEQ ID NO: 2645151 - DNA, 20 bp, Homo sapiens
cacgtggaggagcagtgcag

SEQ ID NO: 2645152 - DNA, 21 bp, Homo sapiens
cacgtggaggagcagtgcagg

SEQ ID NO: 2645153 - DNA, 19 bp, Homo sapiens
cacgtggcatgtggcctgt

SEQ ID NO: 2645154 - DNA, 23 bp, Homo sapiens
cacgtgttttattcctgtatgtt

SEQ ID NO: 2645155 - DNA, 18 bp, Homo sapiens
cacgttctcacacccacc

SEQ ID NO: 2645156 - DNA, 23 bp, Homo sapiens
cacgtttctaaaggctacctttg

SEQ ID NO: 2645157 - DNA, 13 bp, Homo sapiens
cactaaagcagtg

SEQ ID NO: 2645158 - DNA, 15 bp, Homo sapiens
cactaaagtatgtaa

SEQ ID NO: 2645159 - DNA, 14 bp, Homo sapiens
cactaacctgaccg

SEQ ID NO: 2645160 - DNA, 19 bp, Homo sapiens
cactaacgacttcagggca

SEQ ID NO: 2645161 - DNA, 17 bp, Homo sapiens
cactaaggtgtgctctg

SEQ ID NO: 2645162 - DNA, 17 bp, Homo sapiens
cactaagttatagtata

SEQ ID NO: 2645163 - DNA, 16 bp, Homo sapiens
cactacactccagcct

SEQ ID NO: 2645164 - DNA, 18 bp, Homo sapiens
cactacactccagcctga

SEQ ID NO: 2645165 - DNA, 14 bp, Homo sapiens
cactacataaactg

SEQ ID NO: 2645166 - DNA, 19 bp, Homo sapiens
cactacataaactgacttt

SEQ ID NO: 2645167 - DNA, 21 bp, Homo sapiens
cactacatgcagcccatgccc

SEQ ID NO: 2645168 - DNA, 19 bp, Homo sapiens
cactacatgtggtttatag

SEQ ID NO: 2645169 - DNA, 20 bp, Homo sapiens
cactacatgtggtttataga

SEQ ID NO: 2645170 - DNA, 13 bp, Homo sapiens
cactacattctgt

SEQ ID NO: 2645171 - DNA, 15 bp, Homo sapiens
cactacattctgtta

SEQ ID NO: 2645172 - DNA, 17 bp, Homo sapiens
cactacattctgttaat

SEQ ID NO: 2645173 - DNA, 21 bp, Homo sapiens
cactacattctgttaatcatt

SEQ ID NO: 2645174 - DNA, 23 bp, Homo sapiens
cactacggaatagttggctagga

SEQ ID NO: 2645175 - DNA, 21 bp, Homo sapiens
cactagggcagggacaggata

SEQ ID NO: 2645176 - DNA, 20 bp, Homo sapiens
cactaggggatataggagag

SEQ ID NO: 2645177 - DNA, 21 bp, Homo sapiens
cactaggggatataggagagg

SEQ ID NO: 2645178 - DNA, 12 bp, Homo sapiens
cactagttttgt

SEQ ID NO: 2645179 - DNA, 12 bp, Homo sapiens
cactataaatgg

SEQ ID NO: 2645180 - DNA, 23 bp, Homo sapiens
cactatataggcatcacattttt

SEQ ID NO: 2645181 - DNA, 11 bp, Homo sapiens
cactatctggg

SEQ ID NO: 2645182 - DNA, 13 bp, Homo sapiens
cactatggtgcca

SEQ ID NO: 2645183 - DNA, 22 bp, Homo sapiens
cactatggtgccaatggaacct

SEQ ID NO: 2645184 - DNA, 15 bp, Homo sapiens
cactatgttgcccag

SEQ ID NO: 2645185 - DNA, 16 bp, Homo sapiens
cactatgttgcccagg

SEQ ID NO: 2645186 - DNA, 22 bp, Homo sapiens
cactatttttatttatattttt

SEQ ID NO: 2645187 - DNA, 23 bp, Homo sapiens
cactatttttatttatatttttg

SEQ ID NO: 2645188 - DNA, 15 bp, Homo sapiens
cactcaaaagctggg

SEQ ID NO: 2645189 - DNA, 16 bp, Homo sapiens
cactcaaatcaagaaa

SEQ ID NO: 2645190 - DNA, 19 bp, Homo sapiens
cactcaaattaatctttct

SEQ ID NO: 2645191 - DNA, 14 bp, Homo sapiens
cactcaacatgagt

SEQ ID NO: 2645192 - DNA, 15 bp, Homo sapiens
cactcaagaagcagg

SEQ ID NO: 2645193 - DNA, 22 bp, Homo sapiens
cactcaatgcagccagacctat

SEQ ID NO: 2645194 - DNA, 14 bp, Homo sapiens
cactcacacaggac

SEQ ID NO: 2645195 - DNA, 20 bp, Homo sapiens
cactcacatttattctgctc

SEQ ID NO: 2645196 - DNA, 21 bp, Homo sapiens
cactcacccatgtgccaaggt

SEQ ID NO: 2645197 - DNA, 12 bp, Homo sapiens
cactcagaagac

SEQ ID NO: 2645198 - DNA, 16 bp, Homo sapiens
cactcagtccatagca

SEQ ID NO: 2645199 - DNA, 18 bp, Homo sapiens
cactcattgacctgaggc

SEQ ID NO: 2645200 - DNA, 15 bp, Homo sapiens
cactccaattaagga

SEQ ID NO: 2645201 - DNA, 12 bp, Homo sapiens
cactccagcctg

SEQ ID NO: 2645202 - DNA, 14 bp, Homo sapiens
cactccagcctggg

SEQ ID NO: 2645203 - DNA, 16 bp, Homo sapiens
cactccagcctgggtg

SEQ ID NO: 2645204 - DNA, 16 bp, Homo sapiens
cactccagtgccagca

SEQ ID NO: 2645205 - DNA, 17 bp, Homo sapiens
cactccagtgccagcaa

SEQ ID NO: 2645206 - DNA, 14 bp, Homo sapiens
cactcccaggcagc

SEQ ID NO: 2645207 - DNA, 13 bp, Homo sapiens
cactcccctgcac

SEQ ID NO: 2645208 - DNA, 14 bp, Homo sapiens
cactccctccatca

SEQ ID NO: 2645209 - DNA, 16 bp, Homo sapiens
cactccctgcaacctg

SEQ ID NO: 2645210 - DNA, 17 bp, Homo sapiens
cactccctgcaacctga

SEQ ID NO: 2645211 - DNA, 13 bp, Homo sapiens
cactcccttgggc

SEQ ID NO: 2645212 - DNA, 16 bp, Homo sapiens
cactcccttgggctcc

SEQ ID NO: 2645213 - DNA, 20 bp, Homo sapiens
cactcccttgggctccctgt

SEQ ID NO: 2645214 - DNA, 21 bp, Homo sapiens
cactcccttggtggcaagagc

SEQ ID NO: 2645215 - DNA, 20 bp, Homo sapiens
cactccggcctgatgacaga

SEQ ID NO: 2645216 - DNA, 20 bp, Homo sapiens
cactccggtgtgcctgcagc

SEQ ID NO: 2645217 - DNA, 13 bp, Homo sapiens
cactcctctgact

SEQ ID NO: 2645218 - DNA, 21 bp, Homo sapiens
cactcctgagacccctggcct

SEQ ID NO: 2645219 - DNA, 22 bp, Homo sapiens
cactcctgagacccctggcctc

SEQ ID NO: 2645220 - DNA, 13 bp, Homo sapiens
cactcctgtacac

SEQ ID NO: 2645221 - DNA, 19 bp, Homo sapiens
cactctaaaaggttcaggg

SEQ ID NO: 2645222 - DNA, 15 bp, Homo sapiens
cactctaccctccca

SEQ ID NO: 2645223 - DNA, 21 bp, Homo sapiens
cactctaccctcccaccccct

SEQ ID NO: 2645224 - DNA, 13 bp, Homo sapiens
cactctagcctgg

SEQ ID NO: 2645225 - DNA, 15 bp, Homo sapiens
cactctagggcagtg

SEQ ID NO: 2645226 - DNA, 19 bp, Homo sapiens
cactctagggcagtggagt

SEQ ID NO: 2645227 - DNA, 21 bp, Homo sapiens
cactctccttgctacccagaa

SEQ ID NO: 2645228 - DNA, 15 bp, Homo sapiens
cactctgcctctgcc

SEQ ID NO: 2645229 - DNA, 19 bp, Homo sapiens
cactctgcctctgcctgca

SEQ ID NO: 2645230 - DNA, 11 bp, Homo sapiens
cactctgctgc

SEQ ID NO: 2645231 - DNA, 14 bp, Homo sapiens
cactctgctgctta

SEQ ID NO: 2645232 - DNA, 14 bp, Homo sapiens
cactctggcagctc

SEQ ID NO: 2645233 - DNA, 16 bp, Homo sapiens
cactctggcagctcag

SEQ ID NO: 2645234 - DNA, 17 bp, Homo sapiens
cactctggcagctcaga

SEQ ID NO: 2645235 - DNA, 21 bp, Homo sapiens
cactctggcagctcagagagg

SEQ ID NO: 2645236 - DNA, 19 bp, Homo sapiens
cactctggctggtttggaa

SEQ ID NO: 2645237 - DNA, 16 bp, Homo sapiens
cactctgggctccaga

SEQ ID NO: 2645238 - DNA, 19 bp, Homo sapiens
cactctgtcgcccagtctg

SEQ ID NO: 2645239 - DNA, 20 bp, Homo sapiens
cactctgtcgcccagtctgg

SEQ ID NO: 2645240 - DNA, 16 bp, Homo sapiens
cactcttaagcttccg

SEQ ID NO: 2645241 - DNA, 11 bp, Homo sapiens
cactcttccaa

SEQ ID NO: 2645242 - DNA, 12 bp, Homo sapiens
cactctttgtaa

SEQ ID NO: 2645243 - DNA, 18 bp, Homo sapiens
cactgaaggcctggccca

SEQ ID NO: 2645244 - DNA, 19 bp, Homo sapiens
cactgaagtagtgtgcagt

SEQ ID NO: 2645245 - DNA, 22 bp, Homo sapiens
cactgaagttaacagagacaga

SEQ ID NO: 2645246 - DNA, 14 bp, Homo sapiens
cactgaatatttat

SEQ ID NO: 2645247 - DNA, 15 bp, Homo sapiens
cactgaattaatcat

SEQ ID NO: 2645248 - DNA, 23 bp, Homo sapiens
cactgaattaatgacagagccag

SEQ ID NO: 2645249 - DNA, 18 bp, Homo sapiens
cagactgcgatttgtccc

SEQ ID NO: 2645250 - DNA, 20 bp, Homo sapiens
cagactgctgggactggcca

SEQ ID NO: 2645251 - DNA, 20 bp, Homo sapiens
cagactgcttccaattttct

SEQ ID NO: 2645252 - DNA, 18 bp, Homo sapiens
cagactggaagcacagct

SEQ ID NO: 2645253 - DNA, 22 bp, Homo sapiens
cagactggcacagttttctgag

SEQ ID NO: 2645254 - DNA, 21 bp, Homo sapiens
cagactgtgtaaaaagagagc

SEQ ID NO: 2645255 - DNA, 23 bp, Homo sapiens
cagactgtgtattcattgaagtc

SEQ ID NO: 2645256 - DNA, 23 bp, Homo sapiens
cagactgttagaaaatggacact

SEQ ID NO: 2645257 - DNA, 14 bp, Homo sapiens
cagacttaccagga

SEQ ID NO: 2645258 - DNA, 20 bp, Homo sapiens
cagactttacatgacacagc

SEQ ID NO: 2645259 - DNA, 20 bp, Homo sapiens
cagactttgcttcccattgt

SEQ ID NO: 2645260 - DNA, 15 bp, Homo sapiens
cagagaaagaggaag

SEQ ID NO: 2645261 - DNA, 19 bp, Homo sapiens
cagagaaagtacttctcca

SEQ ID NO: 2645262 - DNA, 20 bp, Homo sapiens
cagagaagccaaaagattgg

SEQ ID NO: 2645263 - DNA, 15 bp, Homo sapiens
cagagaagccccttc

SEQ ID NO: 2645264 - DNA, 18 bp, Homo sapiens
cagagaagtgacagggaa

SEQ ID NO: 2645265 - DNA, 20 bp, Homo sapiens
cagagaagtgacagggaagc

SEQ ID NO: 2645266 - DNA, 21 bp, Homo sapiens
cagagaagtgacagggaagct

SEQ ID NO: 2645267 - DNA, 11 bp, Homo sapiens
cagagaagttc

SEQ ID NO: 2645268 - DNA, 11 bp, Homo sapiens
cagagaatata

SEQ ID NO: 2645269 - DNA, 19 bp, Homo sapiens
cagagaatcatacttagca

SEQ ID NO: 2645270 - DNA, 15 bp, Homo sapiens
cagagaattctctta

SEQ ID NO: 2645271 - DNA, 14 bp, Homo sapiens
cagagaattcttag

SEQ ID NO: 2645272 - DNA, 22 bp, Homo sapiens
cagagaatttctaccatttcag

SEQ ID NO: 2645273 - DNA, 18 bp, Homo sapiens
cagagacctcctgcctcc

SEQ ID NO: 2645274 - DNA, 14 bp, Homo sapiens
cagagactgctgtg

SEQ ID NO: 2645275 - DNA, 12 bp, Homo sapiens
cagagagaagcc

SEQ ID NO: 2645276 - DNA, 19 bp, Homo sapiens
cagagagagaagtgcccct

SEQ ID NO: 2645277 - DNA, 20 bp, Homo sapiens
cagagagagaagtgcccctg

SEQ ID NO: 2645278 - DNA, 21 bp, Homo sapiens
cagagagagaagtgcccctgc

SEQ ID NO: 2645279 - DNA, 23 bp, Homo sapiens
cagagagagaagtgcccctgctg

SEQ ID NO: 2645280 - DNA, 19 bp, Homo sapiens
cagagagccattttgtgaa

SEQ ID NO: 2645281 - DNA, 19 bp, Homo sapiens
cagagagcctggtgctgct

SEQ ID NO: 2645282 - DNA, 20 bp, Homo sapiens
cagagagcctggtgctgctg

SEQ ID NO: 2645283 - DNA, 19 bp, Homo sapiens
cagagagctggtagttagt

SEQ ID NO: 2645284 - DNA, 16 bp, Homo sapiens
cagagaggagaaacac

SEQ ID NO: 2645285 - DNA, 18 bp, Homo sapiens
cagagaggagaaacacat

SEQ ID NO: 2645286 - DNA, 22 bp, Homo sapiens
cagagaggagaaacacatcttc

SEQ ID NO: 2645287 - DNA, 20 bp, Homo sapiens
cagagaggagtcagagagaa

SEQ ID NO: 2645288 - DNA, 20 bp, Homo sapiens
cagagaggccttttggaatg

SEQ ID NO: 2645289 - DNA, 15 bp, Homo sapiens
cagagagggcaggca

SEQ ID NO: 2645290 - DNA, 13 bp, Homo sapiens
cagagagggtggg

SEQ ID NO: 2645291 - DNA, 17 bp, Homo sapiens
cagagagggtggtgacc

SEQ ID NO: 2645292 - DNA, 23 bp, Homo sapiens
cagagagggtggtgacctctgcc

SEQ ID NO: 2645293 - DNA, 18 bp, Homo sapiens
cagagagtcccactgcct

SEQ ID NO: 2645294 - DNA, 16 bp, Homo sapiens
cagagagtcctctgga

SEQ ID NO: 2645295 - DNA, 17 bp, Homo sapiens
cagagagtcctctggat

SEQ ID NO: 2645296 - DNA, 14 bp, Homo sapiens
cagagatgtgcacc

SEQ ID NO: 2645297 - DNA, 22 bp, Homo sapiens
cagagattggaatgggcagctc

SEQ ID NO: 2645298 - DNA, 20 bp, Homo sapiens
cagagcaagatcctgtcttt

SEQ ID NO: 2645299 - DNA, 19 bp, Homo sapiens
cagagcaccttagacagtc

SEQ ID NO: 2645300 - DNA, 12 bp, Homo sapiens
cagagcagagac

SEQ ID NO: 2645301 - DNA, 21 bp, Homo sapiens
cagagcagagaccatccctga

SEQ ID NO: 2645302 - DNA, 13 bp, Homo sapiens
cagagcagatgca

SEQ ID NO: 2645303 - DNA, 16 bp, Homo sapiens
cagagcagatgcagag

SEQ ID NO: 2645304 - DNA, 19 bp, Homo sapiens
cagagcagatgcagagagc

SEQ ID NO: 2645305 - DNA, 21 bp, Homo sapiens
cagagcaggaagcattcagag

SEQ ID NO: 2645306 - DNA, 14 bp, Homo sapiens
cagagcaggaggcc

SEQ ID NO: 2645307 - DNA, 15 bp, Homo sapiens
cagagcaggaggccc

SEQ ID NO: 2645308 - DNA, 23 bp, Homo sapiens
cagagcaggaggcccctggccca

SEQ ID NO: 2645309 - DNA, 19 bp, Homo sapiens
cagagcattacgtgagcca

SEQ ID NO: 2645310 - DNA, 23 bp, Homo sapiens
cagagcattacgtgagccaggta

SEQ ID NO: 2645311 - DNA, 11 bp, Homo sapiens
cagagccatgg

SEQ ID NO: 2645312 - DNA, 15 bp, Homo sapiens
cagagcccaccttgg

SEQ ID NO: 2645313 - DNA, 19 bp, Homo sapiens
cagagcccacgcccccact

SEQ ID NO: 2645314 - DNA, 23 bp, Homo sapiens
cagagccccacacggaggcatct

SEQ ID NO: 2645315 - DNA, 18 bp, Homo sapiens
cagagcctttggatgacc

SEQ ID NO: 2645316 - DNA, 20 bp, Homo sapiens
cagagcctttggatgaccag

SEQ ID NO: 2645317 - DNA, 19 bp, Homo sapiens
cagagcgccgtgagttctc

SEQ ID NO: 2645318 - DNA, 14 bp, Homo sapiens
cagagctgacacag

SEQ ID NO: 2645319 - DNA, 19 bp, Homo sapiens
cagagctgacacaggatga

SEQ ID NO: 2645320 - DNA, 9 bp, Homo sapiens
cagagctgg

SEQ ID NO: 2645321 - DNA, 15 bp, Homo sapiens
cagagctgggaggca

SEQ ID NO: 2645322 - DNA, 20 bp, Homo sapiens
cagagctgggatgtttctgt

SEQ ID NO: 2645323 - DNA, 22 bp, Homo sapiens
cagagctgtggactttgttcac

SEQ ID NO: 2645324 - DNA, 22 bp, Homo sapiens
cagaggaactgtccagagagca

SEQ ID NO: 2645325 - DNA, 13 bp, Homo sapiens
cagaggaaggaga

SEQ ID NO: 2645326 - DNA, 19 bp, Homo sapiens
cagaggaaggggccagagg

SEQ ID NO: 2645327 - DNA, 20 bp, Homo sapiens
cagaggaaggggccagaggc

SEQ ID NO: 2645328 - DNA, 23 bp, Homo sapiens
cagaggacagatcaatggcgcag

SEQ ID NO: 2645329 - DNA, 22 bp, Homo sapiens
cagaggagagtcccagagcagg

SEQ ID NO: 2645330 - DNA, 12 bp, Homo sapiens
cagaggcagccc

SEQ ID NO: 2645331 - DNA, 15 bp, Homo sapiens
cagaggcagccccat

SEQ ID NO: 2645332 - DNA, 19 bp, Homo sapiens
cagaggccatgggcctcct

SEQ ID NO: 2645333 - DNA, 20 bp, Homo sapiens
cagaggcctataatgaagct

SEQ ID NO: 2645334 - DNA, 13 bp, Homo sapiens
cagaggcctgccc

SEQ ID NO: 2645335 - DNA, 21 bp, Homo sapiens
cagagggagtgacagaggcag

SEQ ID NO: 2645336 - DNA, 14 bp, Homo sapiens
cagagggcactctg

SEQ ID NO: 2645337 - DNA, 15 bp, Homo sapiens
cagagggcccaggca

SEQ ID NO: 2645338 - DNA, 18 bp, Homo sapiens
cagaggggctttctggag

SEQ ID NO: 2645339 - DNA, 13 bp, Homo sapiens
cagagggggtggc

SEQ ID NO: 2645340 - DNA, 14 bp, Homo sapiens
cagagggggtggcc

SEQ ID NO: 2645341 - DNA, 22 bp, Homo sapiens
cagagggggtggcctcccaact

SEQ ID NO: 2645342 - DNA, 20 bp, Homo sapiens
cagaggggtaggcagagcct

SEQ ID NO: 2645343 - DNA, 21 bp, Homo sapiens
cagaggtaaaagtgtgagcag

SEQ ID NO: 2645344 - DNA, 17 bp, Homo sapiens
cagaggtaacagaacag

SEQ ID NO: 2645345 - DNA, 19 bp, Homo sapiens
cagaggtaacagaacagct

SEQ ID NO: 2645346 - DNA, 12 bp, Homo sapiens
cagaggtgggca

SEQ ID NO: 2645347 - DNA, 15 bp, Homo sapiens
cagaggtgggcaggt

SEQ ID NO: 2645348 - DNA, 20 bp, Homo sapiens
cagaggtgggcaggtggtgg

SEQ ID NO: 2645349 - DNA, 18 bp, Homo sapiens
cagaggttatctgtccca

SEQ ID NO: 2645350 - DNA, 16 bp, Homo sapiens
cagaggttgcagtgag

SEQ ID NO: 2645351 - DNA, 20 bp, Homo sapiens
cagagtatggagctcagaga

SEQ ID NO: 2645352 - DNA, 20 bp, Homo sapiens
cagagtatttgaaaaatgta

SEQ ID NO: 2645353 - DNA, 13 bp, Homo sapiens
cagagtcagcaga

SEQ ID NO: 2645354 - DNA, 15 bp, Homo sapiens
cagagtccaggcccc

SEQ ID NO: 2645355 - DNA, 15 bp, Homo sapiens
cagagtcctttccaa

SEQ ID NO: 2645356 - DNA, 23 bp, Homo sapiens
cagagtcggaacggagaaaggtg

SEQ ID NO: 2645357 - DNA, 17 bp, Homo sapiens
cagagtctcactgttgc

SEQ ID NO: 2645358 - DNA, 19 bp, Homo sapiens
cagagtctcactgttgccc

SEQ ID NO: 2645359 - DNA, 20 bp, Homo sapiens
cagagtctcactgttgccca

SEQ ID NO: 2645360 - DNA, 23 bp, Homo sapiens
cagagtctcactgttgcccaggc

SEQ ID NO: 2645361 - DNA, 23 bp, Homo sapiens
cagagtctcgctctgttgcccag

SEQ ID NO: 2645362 - DNA, 20 bp, Homo sapiens
cagagtctggtgaagctcac

SEQ ID NO: 2645363 - DNA, 17 bp, Homo sapiens
cagagtgagacccagcc

SEQ ID NO: 2645364 - DNA, 13 bp, Homo sapiens
cagagtgcccaga

SEQ ID NO: 2645365 - DNA, 14 bp, Homo sapiens
cagagtggaatgct

SEQ ID NO: 2645366 - DNA, 13 bp, Homo sapiens
cagagtggcctgg

SEQ ID NO: 2645367 - DNA, 16 bp, Homo sapiens
cagagtggcctggcca

SEQ ID NO: 2645368 - DNA, 17 bp, Homo sapiens
cagagtggcctggccag

SEQ ID NO: 2645369 - DNA, 18 bp, Homo sapiens
cagagtggcctggccagg

SEQ ID NO: 2645370 - DNA, 21 bp, Homo sapiens
cagagtggcctggccaggagc

SEQ ID NO: 2645371 - DNA, 22 bp, Homo sapiens
cagagtggcctggccaggagct

SEQ ID NO: 2645372 - DNA, 21 bp, Homo sapiens
cagagtggtctttctggagag

SEQ ID NO: 2645373 - DNA, 16 bp, Homo sapiens
cagagttccccatgca

SEQ ID NO: 2645374 - DNA, 17 bp, Homo sapiens
cagagttcctgcggagt

SEQ ID NO: 2645375 - DNA, 20 bp, Homo sapiens
cagagttgacatgagattta

SEQ ID NO: 2645376 - DNA, 23 bp, Homo sapiens
cagagttgtgcacatggcttagt

SEQ ID NO: 2645377 - DNA, 23 bp, Homo sapiens
cagagtttagaggaaaaaaatga

SEQ ID NO: 2645378 - DNA, 17 bp, Homo sapiens
cagagtttgtgtgttgt

SEQ ID NO: 2645379 - DNA, 16 bp, Homo sapiens
cagataactgttattt

SEQ ID NO: 2645380 - DNA, 22 bp, Homo sapiens
cagataagcaagagagatgttt

SEQ ID NO: 2645381 - DNA, 17 bp, Homo sapiens
cagataatcagcctctt

SEQ ID NO: 2645382 - DNA, 13 bp, Homo sapiens
cagataatgtgaa

SEQ ID NO: 2645383 - DNA, 21 bp, Homo sapiens
cagatacaggaaaagctgctg

SEQ ID NO: 2645384 - DNA, 17 bp, Homo sapiens
cagatacatatgagtgt

SEQ ID NO: 2645385 - DNA, 22 bp, Homo sapiens
cagatactggaagttttgcatt

SEQ ID NO: 2645386 - DNA, 19 bp, Homo sapiens
cagatatattaagtgactg

SEQ ID NO: 2645387 - DNA, 13 bp, Homo sapiens
cagatatattttt

SEQ ID NO: 2645388 - DNA, 12 bp, Homo sapiens
cagatatttata

SEQ ID NO: 2645389 - DNA, 14 bp, Homo sapiens
cagatatttatatt

SEQ ID NO: 2645390 - DNA, 15 bp, Homo sapiens
cagatcaagctgtga

SEQ ID NO: 2645391 - DNA, 19 bp, Homo sapiens
cagatcaagctgtgagaca

SEQ ID NO: 2645392 - DNA, 17 bp, Homo sapiens
cagcttgttatttataa

SEQ ID NO: 2645393 - DNA, 15 bp, Homo sapiens
cagctttaaacaaat

SEQ ID NO: 2645394 - DNA, 17 bp, Homo sapiens
cagctttaaactcaggg

SEQ ID NO: 2645395 - DNA, 15 bp, Homo sapiens
cagctttaaccatta

SEQ ID NO: 2645396 - DNA, 20 bp, Homo sapiens
cagctttaaccattaaaact

SEQ ID NO: 2645397 - DNA, 19 bp, Homo sapiens
cagctttccctgcctctca

SEQ ID NO: 2645398 - DNA, 23 bp, Homo sapiens
cagctttcctcaaaacttcagac

SEQ ID NO: 2645399 - DNA, 14 bp, Homo sapiens
cagctttgccttcc

SEQ ID NO: 2645400 - DNA, 16 bp, Homo sapiens
cagctttgccttccac

SEQ ID NO: 2645401 - DNA, 18 bp, Homo sapiens
cagctttgccttccacgc

SEQ ID NO: 2645402 - DNA, 11 bp, Homo sapiens
cagctttgcta

SEQ ID NO: 2645403 - DNA, 22 bp, Homo sapiens
cagctttgctaccaaagcacct

SEQ ID NO: 2645404 - DNA, 23 bp, Homo sapiens
cagctttgtttgttgtcagctga

SEQ ID NO: 2645405 - DNA, 18 bp, Homo sapiens
cagcttttcccaaaagcc

SEQ ID NO: 2645406 - DNA, 16 bp, Homo sapiens
cagcttttcctccctt

SEQ ID NO: 2645407 - DNA, 19 bp, Homo sapiens
cagctttttaaagtgggtt

SEQ ID NO: 2645408 - DNA, 16 bp, Homo sapiens
cagctttttgtctttt

SEQ ID NO: 2645409 - DNA, 21 bp, Homo sapiens
caggaaaaaaaaaaaaaagac

SEQ ID NO: 2645410 - DNA, 19 bp, Homo sapiens
caggaaaagctgctgacag

SEQ ID NO: 2645411 - DNA, 15 bp, Homo sapiens
caggaaaggaatcat

SEQ ID NO: 2645412 - DNA, 16 bp, Homo sapiens
caggaaatatatatgt

SEQ ID NO: 2645413 - DNA, 17 bp, Homo sapiens
caggaaatatatatgtg

SEQ ID NO: 2645414 - DNA, 19 bp, Homo sapiens
caggaaatcaaatatgcaa

SEQ ID NO: 2645415 - DNA, 20 bp, Homo sapiens
caggaaatgaaaatgtcttg

SEQ ID NO: 2645416 - DNA, 14 bp, Homo sapiens
caggaacagaagga

SEQ ID NO: 2645417 - DNA, 22 bp, Homo sapiens
caggaacagctatgggagcccc

SEQ ID NO: 2645418 - DNA, 23 bp, Homo sapiens
caggaacagctatgggagcccca

SEQ ID NO: 2645419 - DNA, 14 bp, Homo sapiens
caggaagagagcat

SEQ ID NO: 2645420 - DNA, 18 bp, Homo sapiens
caggaagcattcagagag

SEQ ID NO: 2645421 - DNA, 19 bp, Homo sapiens
caggaagcattcagagagc

SEQ ID NO: 2645422 - DNA, 20 bp, Homo sapiens
caggaagcattcagagagca

SEQ ID NO: 2645423 - DNA, 22 bp, Homo sapiens
caggaagcattcagagagcagc

SEQ ID NO: 2645424 - DNA, 13 bp, Homo sapiens
caggaagccccca

SEQ ID NO: 2645425 - DNA, 21 bp, Homo sapiens
caggaagccgtgccctgcccc

SEQ ID NO: 2645426 - DNA, 23 bp, Homo sapiens
caggaagctcagggcctggctca

SEQ ID NO: 2645427 - DNA, 15 bp, Homo sapiens
caggaaggagagcct

SEQ ID NO: 2645428 - DNA, 17 bp, Homo sapiens
caggaaggagagcctgc

SEQ ID NO: 2645429 - DNA, 18 bp, Homo sapiens
caggaaggatgagcattt

SEQ ID NO: 2645430 - DNA, 22 bp, Homo sapiens
caggaagggcctacagcccatt

SEQ ID NO: 2645431 - DNA, 21 bp, Homo sapiens
caggaagggggtccacccagc

SEQ ID NO: 2645432 - DNA, 23 bp, Homo sapiens
caggaagggggtccacccagcaa

SEQ ID NO: 2645433 - DNA, 17 bp, Homo sapiens
caggaatcaagagctgc

SEQ ID NO: 2645434 - DNA, 23 bp, Homo sapiens
caggaatcaagagctgccctcct

SEQ ID NO: 2645435 - DNA, 14 bp, Homo sapiens
caggaatgatctct

SEQ ID NO: 2645436 - DNA, 21 bp, Homo sapiens
caggaatgccaaggagacatc

SEQ ID NO: 2645437 - DNA, 15 bp, Homo sapiens
caggacaacgaggaa

SEQ ID NO: 2645438 - DNA, 15 bp, Homo sapiens
caggacacggggcag

SEQ ID NO: 2645439 - DNA, 20 bp, Homo sapiens
caggacagtgcttcagcctg

SEQ ID NO: 2645440 - DNA, 21 bp, Homo sapiens
caggacagtgcttcagcctga

SEQ ID NO: 2645441 - DNA, 22 bp, Homo sapiens
caggacagtgcttcagcctgag

SEQ ID NO: 2645442 - DNA, 14 bp, Homo sapiens
caggacatttctct

SEQ ID NO: 2645443 - DNA, 12 bp, Homo sapiens
caggaccacaaa

SEQ ID NO: 2645444 - DNA, 12 bp, Homo sapiens
caggaccagctg

SEQ ID NO: 2645445 - DNA, 13 bp, Homo sapiens
caggaccaggact

SEQ ID NO: 2645446 - DNA, 18 bp, Homo sapiens
caggaccaggcaatgtga

SEQ ID NO: 2645447 - DNA, 13 bp, Homo sapiens
caggacccagagg

SEQ ID NO: 2645448 - DNA, 16 bp, Homo sapiens
caggacccagaggaag

SEQ ID NO: 2645449 - DNA, 15 bp, Homo sapiens
caggacccccttccc

SEQ ID NO: 2645450 - DNA, 21 bp, Homo sapiens
caggacctaggatatcttctc

SEQ ID NO: 2645451 - DNA, 22 bp, Homo sapiens
caggacctaggatatcttctcc

SEQ ID NO: 2645452 - DNA, 23 bp, Homo sapiens
caggacctaggatatcttctcca

SEQ ID NO: 2645453 - DNA, 20 bp, Homo sapiens
caggacctcagagtccaggc

SEQ ID NO: 2645454 - DNA, 16 bp, Homo sapiens
caggacctcaggtgag

SEQ ID NO: 2645455 - DNA, 23 bp, Homo sapiens
caggacctcaggtgagaagcaga

SEQ ID NO: 2645456 - DNA, 13 bp, Homo sapiens
caggacctgacta

SEQ ID NO: 2645457 - DNA, 20 bp, Homo sapiens
caggaccttttgaagtagtt

SEQ ID NO: 2645458 - DNA, 15 bp, Homo sapiens
caggacgcttctgaa

SEQ ID NO: 2645459 - DNA, 16 bp, Homo sapiens
caggacgcttctgaat

SEQ ID NO: 2645460 - DNA, 16 bp, Homo sapiens
caggactatagcccag

SEQ ID NO: 2645461 - DNA, 16 bp, Homo sapiens
caggactccccaggcc

SEQ ID NO: 2645462 - DNA, 18 bp, Homo sapiens
caggactccccaggccag

SEQ ID NO: 2645463 - DNA, 16 bp, Homo sapiens
caggactccctcctca

SEQ ID NO: 2645464 - DNA, 13 bp, Homo sapiens
caggactctgcct

SEQ ID NO: 2645465 - DNA, 18 bp, Homo sapiens
caggactcttgtgaaaag

SEQ ID NO: 2645466 - DNA, 13 bp, Homo sapiens
caggactgcacag

SEQ ID NO: 2645467 - DNA, 23 bp, Homo sapiens
caggacttggtctgatttcagga

SEQ ID NO: 2645468 - DNA, 11 bp, Homo sapiens
caggagaacca

SEQ ID NO: 2645469 - DNA, 17 bp, Homo sapiens
caggagaggagagccag

SEQ ID NO: 2645470 - DNA, 18 bp, Homo sapiens
caggagaggagagccaga

SEQ ID NO: 2645471 - DNA, 19 bp, Homo sapiens
caggagaggagagccagag

SEQ ID NO: 2645472 - DNA, 22 bp, Homo sapiens
caggagaggagagccagagaag

SEQ ID NO: 2645473 - DNA, 15 bp, Homo sapiens
caggagcacaggcag

SEQ ID NO: 2645474 - DNA, 12 bp, Homo sapiens
caggagcagcca

SEQ ID NO: 2645475 - DNA, 23 bp, Homo sapiens
caggagcagcctcagaacaaagt

SEQ ID NO: 2645476 - DNA, 20 bp, Homo sapiens
caggagcatccacctccttc

SEQ ID NO: 2645477 - DNA, 20 bp, Homo sapiens
caggagccccgaggccttct

SEQ ID NO: 2645478 - DNA, 22 bp, Homo sapiens
caggagccccgaggccttctct

SEQ ID NO: 2645479 - DNA, 16 bp, Homo sapiens
caggagcctgtgcctc

SEQ ID NO: 2645480 - DNA, 18 bp, Homo sapiens
caggagctcttcaggcct

SEQ ID NO: 2645481 - DNA, 19 bp, Homo sapiens
caggagctcttcaggcctc

SEQ ID NO: 2645482 - DNA, 22 bp, Homo sapiens
caggagctcttcaggcctccct

SEQ ID NO: 2645483 - DNA, 23 bp, Homo sapiens
caggagctcttcaggcctccctc

SEQ ID NO: 2645484 - DNA, 23 bp, Homo sapiens
caggagctgggcagaaggccaag

SEQ ID NO: 2645485 - DNA, 17 bp, Homo sapiens
caggagctttggaccta

SEQ ID NO: 2645486 - DNA, 12 bp, Homo sapiens
caggaggccagc

SEQ ID NO: 2645487 - DNA, 16 bp, Homo sapiens
caggaggccagccttg

SEQ ID NO: 2645488 - DNA, 18 bp, Homo sapiens
caggaggccagccttgac

SEQ ID NO: 2645489 - DNA, 16 bp, Homo sapiens
caggaggcccctggcc

SEQ ID NO: 2645490 - DNA, 15 bp, Homo sapiens
caggaggctgagggg

SEQ ID NO: 2645491 - DNA, 22 bp, Homo sapiens
caggagggattggccgcttggc

SEQ ID NO: 2645492 - DNA, 16 bp, Homo sapiens
caggagggcaagggcc

SEQ ID NO: 2645493 - DNA, 18 bp, Homo sapiens
caggagggcactggagct

SEQ ID NO: 2645494 - DNA, 22 bp, Homo sapiens
caggaggtggctatggccaccc

SEQ ID NO: 2645495 - DNA, 15 bp, Homo sapiens
caggagtcccaagga

SEQ ID NO: 2645496 - DNA, 21 bp, Homo sapiens
caggagtcccaaggaaagccc

SEQ ID NO: 2645497 - DNA, 14 bp, Homo sapiens
caggagtccctgcc

SEQ ID NO: 2645498 - DNA, 15 bp, Homo sapiens
caggagtccctgcca

SEQ ID NO: 2645499 - DNA, 22 bp, Homo sapiens
caggagtgggaaaacactgcca

SEQ ID NO: 2645500 - DNA, 20 bp, Homo sapiens
caggagttagaggccagcct

SEQ ID NO: 2645501 - DNA, 22 bp, Homo sapiens
caggagttagaggccagcctgg

SEQ ID NO: 2645502 - DNA, 23 bp, Homo sapiens
caggagttcaataaatgtctgtt

SEQ ID NO: 2645503 - DNA, 18 bp, Homo sapiens
caggagttcgaggctgca

SEQ ID NO: 2645504 - DNA, 19 bp, Homo sapiens
caggagttcgaggctgcag

SEQ ID NO: 2645505 - DNA, 22 bp, Homo sapiens
caggagtttgagaccaacctgg

SEQ ID NO: 2645506 - DNA, 16 bp, Homo sapiens
caggatcatggtgtaa

SEQ ID NO: 2645507 - DNA, 22 bp, Homo sapiens
caggatcccaggggcccaaggc

SEQ ID NO: 2645508 - DNA, 17 bp, Homo sapiens
caggatgaacccaggac

SEQ ID NO: 2645509 - DNA, 14 bp, Homo sapiens
caggatgcccaggg

SEQ ID NO: 2645510 - DNA, 24 bp, Homo sapiens
caggatgcccagggccactctgcc

SEQ ID NO: 2645511 - DNA, 24 bp, Homo sapiens
caggatggcctggccagggcctgg

SEQ ID NO: 2645512 - DNA, 18 bp, Homo sapiens
caggcaaaatccttgctt

SEQ ID NO: 2645513 - DNA, 19 bp, Homo sapiens
caggcaactgaggcagaca

SEQ ID NO: 2645514 - DNA, 20 bp, Homo sapiens
caggcaactgaggcagacag

SEQ ID NO: 2645515 - DNA, 22 bp, Homo sapiens
caggcaactgaggcagacagca

SEQ ID NO: 2645516 - DNA, 16 bp, Homo sapiens
caggcaagcacctcct

SEQ ID NO: 2645517 - DNA, 21 bp, Homo sapiens
caggcaagcacctcctgcctc

SEQ ID NO: 2645518 - DNA, 18 bp, Homo sapiens
caggcaagtgaagaaaag

SEQ ID NO: 2645519 - DNA, 21 bp, Homo sapiens
caggcaatgctggctgttggc

SEQ ID NO: 2645520 - DNA, 14 bp, Homo sapiens
caggcacaaaatga

SEQ ID NO: 2645521 - DNA, 17 bp, Homo sapiens
caggcaccccctggaga

SEQ ID NO: 2645522 - DNA, 13 bp, Homo sapiens
caggcacccttct

SEQ ID NO: 2645523 - DNA, 21 bp, Homo sapiens
caggcacccttctttcctctt

SEQ ID NO: 2645524 - DNA, 23 bp, Homo sapiens
caggcacccttctttcctcttcc

SEQ ID NO: 2645525 - DNA, 15 bp, Homo sapiens
caggcacctcacaga

SEQ ID NO: 2645526 - DNA, 16 bp, Homo sapiens
caggcacctcacagaa

SEQ ID NO: 2645527 - DNA, 22 bp, Homo sapiens
caggcactgagataccagcgag

SEQ ID NO: 2645528 - DNA, 23 bp, Homo sapiens
caggcactgagataccagcgagg

SEQ ID NO: 2645529 - DNA, 23 bp, Homo sapiens
caggcactgctgcccagcctcca

SEQ ID NO: 2645530 - DNA, 23 bp, Homo sapiens
caggcagagaatcatacttagca

SEQ ID NO: 2645531 - DNA, 15 bp, Homo sapiens
caggcagatctgtgc

SEQ ID NO: 2645532 - DNA, 17 bp, Homo sapiens
caggcagccaggccaca

SEQ ID NO: 2645533 - DNA, 13 bp, Homo sapiens
caggcagcctgga

SEQ ID NO: 2645534 - DNA, 20 bp, Homo sapiens
cagtataattctgtactgat

SEQ ID NO: 2645535 - DNA, 13 bp, Homo sapiens
cagtatatttata

SEQ ID NO: 2645536 - DNA, 15 bp, Homo sapiens
cagtatcatgaagcc

SEQ ID NO: 2645537 - DNA, 18 bp, Homo sapiens
cagtatctatatatgtgt

SEQ ID NO: 2645538 - DNA, 22 bp, Homo sapiens
cagtatctatatatgtgtatgt

SEQ ID NO: 2645539 - DNA, 23 bp, Homo sapiens
cagtatctatatatgtgtatgta

SEQ ID NO: 2645540 - DNA, 23 bp, Homo sapiens
cagtatgagtcaatgtgcagtgt

SEQ ID NO: 2645541 - DNA, 21 bp, Homo sapiens
cagtatgggttagggaaaaca

SEQ ID NO: 2645542 - DNA, 12 bp, Homo sapiens
cagtatgtggaa

SEQ ID NO: 2645543 - DNA, 19 bp, Homo sapiens
cagtattacttctgctaca

SEQ ID NO: 2645544 - DNA, 16 bp, Homo sapiens
cagtattgaagcattt

SEQ ID NO: 2645545 - DNA, 16 bp, Homo sapiens
cagtattttccctgct

SEQ ID NO: 2645546 - DNA, 23 bp, Homo sapiens
cagtattttggagaaattattta

SEQ ID NO: 2645547 - DNA, 14 bp, Homo sapiens
cagtcaacctgggc

SEQ ID NO: 2645548 - DNA, 15 bp, Homo sapiens
cagtcaacctgggca

SEQ ID NO: 2645549 - DNA, 16 bp, Homo sapiens
cagtcaacctgggcaa

SEQ ID NO: 2645550 - DNA, 21 bp, Homo sapiens
cagtcaacctgggcaaagcct

SEQ ID NO: 2645551 - DNA, 22 bp, Homo sapiens
cagtcaacctgggcaaagccta

SEQ ID NO: 2645552 - DNA, 17 bp, Homo sapiens
cagtcaccccaggactc

SEQ ID NO: 2645553 - DNA, 18 bp, Homo sapiens
cagtcaccccggccacct

SEQ ID NO: 2645554 - DNA, 20 bp, Homo sapiens
cagtcaccccggccacctgc

SEQ ID NO: 2645555 - DNA, 13 bp, Homo sapiens
cagtcagcctctc

SEQ ID NO: 2645556 - DNA, 21 bp, Homo sapiens
cagtcaggaaaggaatcattt

SEQ ID NO: 2645557 - DNA, 17 bp, Homo sapiens
cagtcaggggcagctga

SEQ ID NO: 2645558 - DNA, 17 bp, Homo sapiens
cagtcagtgcaaatgtc

SEQ ID NO: 2645559 - DNA, 15 bp, Homo sapiens
cagtcataactaaat

SEQ ID NO: 2645560 - DNA, 17 bp, Homo sapiens
cagtcatgcataaatat

SEQ ID NO: 2645561 - DNA, 18 bp, Homo sapiens
cagtcatgcataaatatg

SEQ ID NO: 2645562 - DNA, 23 bp, Homo sapiens
cagtcattatgagaggcaatgat

SEQ ID NO: 2645563 - DNA, 11 bp, Homo sapiens
cagtcatttaa

SEQ ID NO: 2645564 - DNA, 18 bp, Homo sapiens
cagtccaaatgtcctcca

SEQ ID NO: 2645565 - DNA, 13 bp, Homo sapiens
cagtccagcctgg

SEQ ID NO: 2645566 - DNA, 15 bp, Homo sapiens
cagtccagcctggag

SEQ ID NO: 2645567 - DNA, 13 bp, Homo sapiens
cagtccatgaaga

SEQ ID NO: 2645568 - DNA, 13 bp, Homo sapiens
cagtcctagctgc

SEQ ID NO: 2645569 - DNA, 12 bp, Homo sapiens
cagtcctcccat

SEQ ID NO: 2645570 - DNA, 13 bp, Homo sapiens
cagtcctcccatc

SEQ ID NO: 2645571 - DNA, 16 bp, Homo sapiens
cagtcctcccatctca

SEQ ID NO: 2645572 - DNA, 13 bp, Homo sapiens
cagtcctctttca

SEQ ID NO: 2645573 - DNA, 22 bp, Homo sapiens
cagtcctgatcagagccgtggt

SEQ ID NO: 2645574 - DNA, 12 bp, Homo sapiens
cagtcctgcctg

SEQ ID NO: 2645575 - DNA, 13 bp, Homo sapiens
cagtcctgcctgg

SEQ ID NO: 2645576 - DNA, 15 bp, Homo sapiens
cagtcctgcctggcc

SEQ ID NO: 2645577 - DNA, 16 bp, Homo sapiens
cagtcctgcctggcca

SEQ ID NO: 2645578 - DNA, 21 bp, Homo sapiens
cagtcctgcctggccaggcag

SEQ ID NO: 2645579 - DNA, 17 bp, Homo sapiens
cagtcctggaagccagc

SEQ ID NO: 2645580 - DNA, 11 bp, Homo sapiens
cagtcctggcc

SEQ ID NO: 2645581 - DNA, 13 bp, Homo sapiens
cagtcctggcctg

SEQ ID NO: 2645582 - DNA, 21 bp, Homo sapiens
cagtcctgggagaacctcagg

SEQ ID NO: 2645583 - DNA, 22 bp, Homo sapiens
cagtcctgggagaacctcaggc

SEQ ID NO: 2645584 - DNA, 18 bp, Homo sapiens
cagtccttaccagcagag

SEQ ID NO: 2645585 - DNA, 19 bp, Homo sapiens
cagtccttaccagcagagc

SEQ ID NO: 2645586 - DNA, 14 bp, Homo sapiens
cagtcgggggctgg

SEQ ID NO: 2645587 - DNA, 17 bp, Homo sapiens
cagtcgggggctggcct

SEQ ID NO: 2645588 - DNA, 19 bp, Homo sapiens
cagtcgggggctggcctag

SEQ ID NO: 2645589 - DNA, 13 bp, Homo sapiens
cagtcgtcgcaca

SEQ ID NO: 2645590 - DNA, 14 bp, Homo sapiens
cagtctctgagcag

SEQ ID NO: 2645591 - DNA, 20 bp, Homo sapiens
cagtctctgagggcttcctt

SEQ ID NO: 2645592 - DNA, 15 bp, Homo sapiens
cagtctctttaatct

SEQ ID NO: 2645593 - DNA, 20 bp, Homo sapiens
cagtctctttaatcttcagt

SEQ ID NO: 2645594 - DNA, 22 bp, Homo sapiens
cagtctctttaatcttcagttt

SEQ ID NO: 2645595 - DNA, 22 bp, Homo sapiens
cagtctgattcccaagctctgc

SEQ ID NO: 2645596 - DNA, 12 bp, Homo sapiens
cagtctgctgcc

SEQ ID NO: 2645597 - DNA, 13 bp, Homo sapiens
cagtctgctgccc

SEQ ID NO: 2645598 - DNA, 15 bp, Homo sapiens
cagtctgctgccctc

SEQ ID NO: 2645599 - DNA, 18 bp, Homo sapiens
cagtctgctgccctccat

SEQ ID NO: 2645600 - DNA, 17 bp, Homo sapiens
cagtctggaatgcagtg

SEQ ID NO: 2645601 - DNA, 18 bp, Homo sapiens
cagtctggctgagccctg

SEQ ID NO: 2645602 - DNA, 23 bp, Homo sapiens
cagtctgtcatgaacatgttcct

SEQ ID NO: 2645603 - DNA, 21 bp, Homo sapiens
cagtctgttccccatggccac

SEQ ID NO: 2645604 - DNA, 13 bp, Homo sapiens
cagtcttcctgac

SEQ ID NO: 2645605 - DNA, 17 bp, Homo sapiens
cagtcttgtattaagtt

SEQ ID NO: 2645606 - DNA, 22 bp, Homo sapiens
cagtctttttggtgagggtaac

SEQ ID NO: 2645607 - DNA, 16 bp, Homo sapiens
cagtgaaaacaagtgc

SEQ ID NO: 2645608 - DNA, 20 bp, Homo sapiens
cagtgaaaacaagtgctggc

SEQ ID NO: 2645609 - DNA, 12 bp, Homo sapiens
cagtgaaaatgt

SEQ ID NO: 2645610 - DNA, 18 bp, Homo sapiens
cagtgaaaatgtaagctg

SEQ ID NO: 2645611 - DNA, 13 bp, Homo sapiens
cagtgaaagcatc

SEQ ID NO: 2645612 - DNA, 19 bp, Homo sapiens
cagtgacctgctgggtaaa

SEQ ID NO: 2645613 - DNA, 16 bp, Homo sapiens
cagtgacgtgcacctg

SEQ ID NO: 2645614 - DNA, 18 bp, Homo sapiens
cagtgacgtgcacctgta

SEQ ID NO: 2645615 - DNA, 13 bp, Homo sapiens
cagtgactccagg

SEQ ID NO: 2645616 - DNA, 16 bp, Homo sapiens
cagtgactccaggaga

SEQ ID NO: 2645617 - DNA, 17 bp, Homo sapiens
cagtgactccaggagag

SEQ ID NO: 2645618 - DNA, 22 bp, Homo sapiens
cagtgagaaaaagctcctgtcc

SEQ ID NO: 2645619 - DNA, 13 bp, Homo sapiens
cagtgagccaaga

SEQ ID NO: 2645620 - DNA, 17 bp, Homo sapiens
cagtgagcggagatcgc

SEQ ID NO: 2645621 - DNA, 21 bp, Homo sapiens
cagtgaggcccagggagaggc

SEQ ID NO: 2645622 - DNA, 16 bp, Homo sapiens
cagtgagggtcttctt

SEQ ID NO: 2645623 - DNA, 22 bp, Homo sapiens
cagtgagtcgaggacagggagg

SEQ ID NO: 2645624 - DNA, 18 bp, Homo sapiens
cagtgagttacagcgaga

SEQ ID NO: 2645625 - DNA, 20 bp, Homo sapiens
cagtgatatggcagaagaca

SEQ ID NO: 2645626 - DNA, 21 bp, Homo sapiens
cagtgatatggcagaagacac

SEQ ID NO: 2645627 - DNA, 22 bp, Homo sapiens
cagtgatatggcagaagacacc

SEQ ID NO: 2645628 - DNA, 18 bp, Homo sapiens
cagtgatgctggatgctc

SEQ ID NO: 2645629 - DNA, 23 bp, Homo sapiens
cagtgatgtaccatgaaacaaag

SEQ ID NO: 2645630 - DNA, 19 bp, Homo sapiens
cagtgatttttttcttgta

SEQ ID NO: 2645631 - DNA, 15 bp, Homo sapiens
cagtgcaaatgtcag

SEQ ID NO: 2645632 - DNA, 21 bp, Homo sapiens
cagtgcaagagactctggcct

SEQ ID NO: 2645633 - DNA, 18 bp, Homo sapiens
cagtgcatattcctttct

SEQ ID NO: 2645634 - DNA, 15 bp, Homo sapiens
cagtgccaagcacag

SEQ ID NO: 2645635 - DNA, 21 bp, Homo sapiens
cagtgccagcaatgacatctc

SEQ ID NO: 2645636 - DNA, 18 bp, Homo sapiens
cagtgcccacaggatcag

SEQ ID NO: 2645637 - DNA, 15 bp, Homo sapiens
cagtgccgagaagga

SEQ ID NO: 2645638 - DNA, 17 bp, Homo sapiens
cagtgccttccataatt

SEQ ID NO: 2645639 - DNA, 18 bp, Homo sapiens
cagtgcgattctggataa

SEQ ID NO: 2645640 - DNA, 19 bp, Homo sapiens
cagtgctaaaaatgggact

SEQ ID NO: 2645641 - DNA, 23 bp, Homo sapiens
cagtgctattttgtgcccactgt

SEQ ID NO: 2645642 - DNA, 15 bp, Homo sapiens
cagtgcttcagcctg

SEQ ID NO: 2645643 - DNA, 19 bp, Homo sapiens
cagtgcttcagcctgaggc

SEQ ID NO: 2645644 - DNA, 19 bp, Homo sapiens
cagtgcttgattgcgtgga

SEQ ID NO: 2645645 - DNA, 14 bp, Homo sapiens
cagtgcttgccaca

SEQ ID NO: 2645646 - DNA, 19 bp, Homo sapiens
cagtggactttccaccccc

SEQ ID NO: 2645647 - DNA, 20 bp, Homo sapiens
cagtggactttccaccccct

SEQ ID NO: 2645648 - DNA, 21 bp, Homo sapiens
cagtggactttccaccccctc

SEQ ID NO: 2645649 - DNA, 23 bp, Homo sapiens
cagtggactttccaccccctccc

SEQ ID NO: 2645650 - DNA, 16 bp, Homo sapiens
cagtggattgcatttc

SEQ ID NO: 2645651 - DNA, 19 bp, Homo sapiens
cagtggcactcaacatgag

SEQ ID NO: 2645652 - DNA, 16 bp, Homo sapiens
cagtggcatggctcca

SEQ ID NO: 2645653 - DNA, 16 bp, Homo sapiens
cagtggcctcaaccct

SEQ ID NO: 2645654 - DNA, 20 bp, Homo sapiens
cagtggcctcaaccctccct

SEQ ID NO: 2645655 - DNA, 13 bp, Homo sapiens
cagtggctgctgc

SEQ ID NO: 2645656 - DNA, 16 bp, Homo sapiens
cagtgggagctgcctg

SEQ ID NO: 2645657 - DNA, 18 bp, Homo sapiens
cagtgggagctgcctgtt

SEQ ID NO: 2645658 - DNA, 11 bp, Homo sapiens
cagtgggaggg

SEQ ID NO: 2645659 - DNA, 16 bp, Homo sapiens
cagtgggaggggcagg

SEQ ID NO: 2645660 - DNA, 18 bp, Homo sapiens
cagtgggaggggcaggct

SEQ ID NO: 2645661 - DNA, 19 bp, Homo sapiens
cagtggtccatggaatgct

SEQ ID NO: 2645662 - DNA, 14 bp, Homo sapiens
cagtggtgaagaaa

SEQ ID NO: 2645663 - DNA, 17 bp, Homo sapiens
cagtggtgaagaaaact

SEQ ID NO: 2645664 - DNA, 20 bp, Homo sapiens
cagtggtgcgatctgggttc

SEQ ID NO: 2645665 - DNA, 22 bp, Homo sapiens
cagtggtggttttctgttcttt

SEQ ID NO: 2645666 - DNA, 19 bp, Homo sapiens
cagtgtaaatagttactcc

SEQ ID NO: 2645667 - DNA, 17 bp, Homo sapiens
cagtgtacagtcttgta

SEQ ID NO: 2645668 - DNA, 17 bp, Homo sapiens
cagtgtatggaaataaa

SEQ ID NO: 2645669 - DNA, 16 bp, Homo sapiens
cagtgtctcacactgg

SEQ ID NO: 2645670 - DNA, 18 bp, Homo sapiens
cagtgtctcacactggcg

SEQ ID NO: 2645671 - DNA, 15 bp, Homo sapiens
cagtgtctcacagcc

SEQ ID NO: 2645672 - DNA, 14 bp, Homo sapiens
cagtgtctcggagg

SEQ ID NO: 2645673 - DNA, 24 bp, Homo sapiens
cagtgtctgtatcggagacagtga

SEQ ID NO: 2645674 - DNA, 16 bp, Homo sapiens
cagtgtcttccataat

SEQ ID NO: 2645675 - DNA, 22 bp, Homo sapiens
cagtgtcttccataatgtataa

SEQ ID NO: 2645676 - DNA, 13 bp, Homo sapiens
cagtgtgaagtta

SEQ ID NO: 2645677 - DNA, 20 bp, Homo sapiens
cagtgtgaagttagaattcc

SEQ ID NO: 2645678 - DNA, 22 bp, Homo sapiens
catgcattgttgaggtggtctg

SEQ ID NO: 2645679 - DNA, 14 bp, Homo sapiens
catgcattttgcag

SEQ ID NO: 2645680 - DNA, 20 bp, Homo sapiens
catgccagcttatctcaggg

SEQ ID NO: 2645681 - DNA, 13 bp, Homo sapiens
catgcccacctgc

SEQ ID NO: 2645682 - DNA, 16 bp, Homo sapiens
catgcccacctgccca

SEQ ID NO: 2645683 - DNA, 21 bp, Homo sapiens
catgcccacctgcccatcaca

SEQ ID NO: 2645684 - DNA, 22 bp, Homo sapiens
catgcccagtcgatatctcact

SEQ ID NO: 2645685 - DNA, 14 bp, Homo sapiens
catgcccccctcaa

SEQ ID NO: 2645686 - DNA, 13 bp, Homo sapiens
catgcccctgaac

SEQ ID NO: 2645687 - DNA, 13 bp, Homo sapiens
catgcctggatgg

SEQ ID NO: 2645688 - DNA, 18 bp, Homo sapiens
catgcctggatggggctg

SEQ ID NO: 2645689 - DNA, 21 bp, Homo sapiens
catgcctggatggggctgcac

SEQ ID NO: 2645690 - DNA, 23 bp, Homo sapiens
catgcctggatggggctgcaccg

SEQ ID NO: 2645691 - DNA, 13 bp, Homo sapiens
catgcctggcttc

SEQ ID NO: 2645692 - DNA, 16 bp, Homo sapiens
catgcctgtccagcct

SEQ ID NO: 2645693 - DNA, 13 bp, Homo sapiens
catgccttccagc

SEQ ID NO: 2645694 - DNA, 19 bp, Homo sapiens
catgccttccagcaccctg

SEQ ID NO: 2645695 - DNA, 20 bp, Homo sapiens
catgccttccagcaccctgc

SEQ ID NO: 2645696 - DNA, 21 bp, Homo sapiens
catgccttccagcaccctgca

SEQ ID NO: 2645697 - DNA, 14 bp, Homo sapiens
catgcggagaacaa

SEQ ID NO: 2645698 - DNA, 17 bp, Homo sapiens
catgcgtgtttctgact

SEQ ID NO: 2645699 - DNA, 20 bp, Homo sapiens
catgctacacactgcatgtt

SEQ ID NO: 2645700 - DNA, 15 bp, Homo sapiens
catgctgccctgtga

SEQ ID NO: 2645701 - DNA, 12 bp, Homo sapiens
catgctgcctcc

SEQ ID NO: 2645702 - DNA, 17 bp, Homo sapiens
catgctgggttctgcac

SEQ ID NO: 2645703 - DNA, 17 bp, Homo sapiens
catgctgtgtgactcaa

SEQ ID NO: 2645704 - DNA, 21 bp, Homo sapiens
catgctgtgtgactcaaacca

SEQ ID NO: 2645705 - DNA, 22 bp, Homo sapiens
catgctgtgtgactcaaaccaa

SEQ ID NO: 2645706 - DNA, 14 bp, Homo sapiens
catgcttcttcctt

SEQ ID NO: 2645707 - DNA, 17 bp, Homo sapiens
catggaaacctgaaaaa

SEQ ID NO: 2645708 - DNA, 18 bp, Homo sapiens
catggaaacctgaaaaaa

SEQ ID NO: 2645709 - DNA, 21 bp, Homo sapiens
catggaaattcccttcatctg

SEQ ID NO: 2645710 - DNA, 15 bp, Homo sapiens
catggaatgcttgaa

SEQ ID NO: 2645711 - DNA, 17 bp, Homo sapiens
catggaatggttataaa

SEQ ID NO: 2645712 - DNA, 21 bp, Homo sapiens
catggaatggttataaaagtg

SEQ ID NO: 2645713 - DNA, 23 bp, Homo sapiens
catggacaccccttatccaggac

SEQ ID NO: 2645714 - DNA, 12 bp, Homo sapiens
catggacactcc

SEQ ID NO: 2645715 - DNA, 18 bp, Homo sapiens
catggacactccagtgcc

SEQ ID NO: 2645716 - DNA, 15 bp, Homo sapiens
catggacagaagaag

SEQ ID NO: 2645717 - DNA, 19 bp, Homo sapiens
catggacgttcggggcatg

SEQ ID NO: 2645718 - DNA, 17 bp, Homo sapiens
catggacttgtatattt

SEQ ID NO: 2645719 - DNA, 11 bp, Homo sapiens
catggactttg

SEQ ID NO: 2645720 - DNA, 15 bp, Homo sapiens
catggagaagcagaa

SEQ ID NO: 2645721 - DNA, 15 bp, Homo sapiens
catggagactcctgc

SEQ ID NO: 2645722 - DNA, 16 bp, Homo sapiens
catggagactcctgcc

SEQ ID NO: 2645723 - DNA, 20 bp, Homo sapiens
catggagactcctgccctgt

SEQ ID NO: 2645724 - DNA, 15 bp, Homo sapiens
catggagccccagcc

SEQ ID NO: 2645725 - DNA, 13 bp, Homo sapiens
catggagctggcc

SEQ ID NO: 2645726 - DNA, 14 bp, Homo sapiens
catggaggagcttg

SEQ ID NO: 2645727 - DNA, 17 bp, Homo sapiens
catggaggtttgaagat

SEQ ID NO: 2645728 - DNA, 16 bp, Homo sapiens
catggagtatatgtca

SEQ ID NO: 2645729 - DNA, 15 bp, Homo sapiens
catggatgagagtcc

SEQ ID NO: 2645730 - DNA, 16 bp, Homo sapiens
catggcacttgcatct

SEQ ID NO: 2645731 - DNA, 21 bp, Homo sapiens
catggcagaataatctttggg

SEQ ID NO: 2645732 - DNA, 17 bp, Homo sapiens
catggcagagtttgtgt

SEQ ID NO: 2645733 - DNA, 18 bp, Homo sapiens
catggcagagtttgtgtg

SEQ ID NO: 2645734 - DNA, 18 bp, Homo sapiens
catggcatcacctccacc

SEQ ID NO: 2645735 - DNA, 16 bp, Homo sapiens
catggcccctctgacc

SEQ ID NO: 2645736 - DNA, 17 bp, Homo sapiens
catggcccctctgacct

SEQ ID NO: 2645737 - DNA, 14 bp, Homo sapiens
catggccctggggt

SEQ ID NO: 2645738 - DNA, 20 bp, Homo sapiens
catggcctattatattaaaa

SEQ ID NO: 2645739 - DNA, 22 bp, Homo sapiens
catggcctcttcagatctctaa

SEQ ID NO: 2645740 - DNA, 22 bp, Homo sapiens
catggcctttgcttgaaagaaa

SEQ ID NO: 2645741 - DNA, 14 bp, Homo sapiens
catggcgtgtccct

SEQ ID NO: 2645742 - DNA, 16 bp, Homo sapiens
catggctaactggcga

SEQ ID NO: 2645743 - DNA, 17 bp, Homo sapiens
catggcttaatgtttat

SEQ ID NO: 2645744 - DNA, 20 bp, Homo sapiens
catgggaagacgaggccctc

SEQ ID NO: 2645745 - DNA, 15 bp, Homo sapiens
catgggcagagccca

SEQ ID NO: 2645746 - DNA, 15 bp, Homo sapiens
catgggcctcctgtg

SEQ ID NO: 2645747 - DNA, 16 bp, Homo sapiens
catgggcctcctgtgt

SEQ ID NO: 2645748 - DNA, 17 bp, Homo sapiens
catgggcctcctgtgtg

SEQ ID NO: 2645749 - DNA, 23 bp, Homo sapiens
catgggcctggccacctctctcc

SEQ ID NO: 2645750 - DNA, 13 bp, Homo sapiens
catgggcttcact

SEQ ID NO: 2645751 - DNA, 14 bp, Homo sapiens
catgggcttcactg

SEQ ID NO: 2645752 - DNA, 17 bp, Homo sapiens
catgggcttcactgtat

SEQ ID NO: 2645753 - DNA, 17 bp, Homo sapiens
catggggtgggcctctg

SEQ ID NO: 2645754 - DNA, 18 bp, Homo sapiens
catggggtgggcctctgg

SEQ ID NO: 2645755 - DNA, 21 bp, Homo sapiens
catggggtggggtagggctga

SEQ ID NO: 2645756 - DNA, 22 bp, Homo sapiens
catgggtgaagggagagccagc

SEQ ID NO: 2645757 - DNA, 18 bp, Homo sapiens
catggtgaaaatgtactg

SEQ ID NO: 2645758 - DNA, 16 bp, Homo sapiens
catggtgaattaatca

SEQ ID NO: 2645759 - DNA, 19 bp, Homo sapiens
catggtgggttcaggggac

SEQ ID NO: 2645760 - DNA, 22 bp, Homo sapiens
catggtgtaataagacataacg

SEQ ID NO: 2645761 - DNA, 21 bp, Homo sapiens
catggttacaatcattgctga

SEQ ID NO: 2645762 - DNA, 16 bp, Homo sapiens
catgtaaactgtgcac

SEQ ID NO: 2645763 - DNA, 18 bp, Homo sapiens
catgtaagctgaaaatat

SEQ ID NO: 2645764 - DNA, 21 bp, Homo sapiens
catgtaataaaaagtatatgt

SEQ ID NO: 2645765 - DNA, 14 bp, Homo sapiens
catgtaatcagttt

SEQ ID NO: 2645766 - DNA, 21 bp, Homo sapiens
catgtaattaagtactatgta

SEQ ID NO: 2645767 - DNA, 15 bp, Homo sapiens
catgtacatgaagaa

SEQ ID NO: 2645768 - DNA, 13 bp, Homo sapiens
catgtactgtagt

SEQ ID NO: 2645769 - DNA, 20 bp, Homo sapiens
catgtagaaaatttgttatt

SEQ ID NO: 2645770 - DNA, 15 bp, Homo sapiens
catgtagaagctgca

SEQ ID NO: 2645771 - DNA, 14 bp, Homo sapiens
catgtagctgagtt

SEQ ID NO: 2645772 - DNA, 15 bp, Homo sapiens
catgtagctgagttt

SEQ ID NO: 2645773 - DNA, 17 bp, Homo sapiens
catgtagtatcaaatat

SEQ ID NO: 2645774 - DNA, 20 bp, Homo sapiens
catgtataatatttttaatt

SEQ ID NO: 2645775 - DNA, 13 bp, Homo sapiens
catgtatgtcttg

SEQ ID NO: 2645776 - DNA, 21 bp, Homo sapiens
catgtatgtcttggacactgt

SEQ ID NO: 2645777 - DNA, 21 bp, Homo sapiens
catgtatgttttggtatctgt

SEQ ID NO: 2645778 - DNA, 15 bp, Homo sapiens
catgtattatttcat

SEQ ID NO: 2645779 - DNA, 20 bp, Homo sapiens
catgtatttatctctattta

SEQ ID NO: 2645780 - DNA, 18 bp, Homo sapiens
catgtcaacttctggctc

SEQ ID NO: 2645781 - DNA, 22 bp, Homo sapiens
catgtcaacttctggctcctca

SEQ ID NO: 2645782 - DNA, 20 bp, Homo sapiens
catgtcaccggatcctgggt

SEQ ID NO: 2645783 - DNA, 22 bp, Homo sapiens
catgtcaccgtggaccttcctg

SEQ ID NO: 2645784 - DNA, 21 bp, Homo sapiens
catgtcaggcctgtgtgtgaa

SEQ ID NO: 2645785 - DNA, 18 bp, Homo sapiens
catgtccaagaagcccag

SEQ ID NO: 2645786 - DNA, 20 bp, Homo sapiens
catgtccaagaagcccagga

SEQ ID NO: 2645787 - DNA, 21 bp, Homo sapiens
catgtccccaaacctgcaagg

SEQ ID NO: 2645788 - DNA, 15 bp, Homo sapiens
catgtcctgtaaagg

SEQ ID NO: 2645789 - DNA, 19 bp, Homo sapiens
catgtccttgtgtgttttg

SEQ ID NO: 2645790 - DNA, 22 bp, Homo sapiens
catgtccttgtgtgttttgaga

SEQ ID NO: 2645791 - DNA, 18 bp, Homo sapiens
catgtcgcctctgcattc

SEQ ID NO: 2645792 - DNA, 20 bp, Homo sapiens
catgtcgcctctgcattcag

SEQ ID NO: 2645793 - DNA, 22 bp, Homo sapiens
catgtctataatcccagcactt

SEQ ID NO: 2645794 - DNA, 12 bp, Homo sapiens
catgtctggcta

SEQ ID NO: 2645795 - DNA, 23 bp, Homo sapiens
catgtcttgtacatgtgtagcct

SEQ ID NO: 2645796 - DNA, 14 bp, Homo sapiens
catgtcttttcttg

SEQ ID NO: 2645797 - DNA, 21 bp, Homo sapiens
catgtcttttcttgcatgagg

SEQ ID NO: 2645798 - DNA, 23 bp, Homo sapiens
catgtcttttcttgcatgaggct

SEQ ID NO: 2645799 - DNA, 13 bp, Homo sapiens
catgtgaaacctt

SEQ ID NO: 2645800 - DNA, 14 bp, Homo sapiens
catgtgaaaccttt

SEQ ID NO: 2645801 - DNA, 24 bp, Homo sapiens
catgtgaaaccttttttaagattt

SEQ ID NO: 2645802 - DNA, 14 bp, Homo sapiens
catgtgacacatat

SEQ ID NO: 2645803 - DNA, 15 bp, Homo sapiens
catgtgacacatatg

SEQ ID NO: 2645804 - DNA, 12 bp, Homo sapiens
catgtgatcctt

SEQ ID NO: 2645805 - DNA, 22 bp, Homo sapiens
catgtgatccttttatgttatt

SEQ ID NO: 2645806 - DNA, 17 bp, Homo sapiens
catgtgccccctctacc

SEQ ID NO: 2645807 - DNA, 15 bp, Homo sapiens
catgtgcctgatcca

SEQ ID NO: 2645808 - DNA, 17 bp, Homo sapiens
catgtggaaagtgaatt

SEQ ID NO: 2645809 - DNA, 15 bp, Homo sapiens
catgtggagaaagga

SEQ ID NO: 2645810 - DNA, 17 bp, Homo sapiens
catgtgtaatcaataaa

SEQ ID NO: 2645811 - DNA, 22 bp, Homo sapiens
catgtgtaatcaataaacgatt

SEQ ID NO: 2645812 - DNA, 16 bp, Homo sapiens
catgtgtagcctgtgc

SEQ ID NO: 2645813 - DNA, 17 bp, Homo sapiens
catgtgtgcgagtgtgt

SEQ ID NO: 2645814 - DNA, 15 bp, Homo sapiens
catgtgtgtgctcag

SEQ ID NO: 2645815 - DNA, 14 bp, Homo sapiens
catgtgttgaaaaa

SEQ ID NO: 2645816 - DNA, 19 bp, Homo sapiens
catgtgtttggttctgggg

SEQ ID NO: 2645817 - DNA, 13 bp, Homo sapiens
catgttaatttca

SEQ ID NO: 2645818 - DNA, 21 bp, Homo sapiens
catgttacataagataaatgt

SEQ ID NO: 2645819 - DNA, 13 bp, Homo sapiens
catgttatatatt

SEQ ID NO: 2645820 - DNA, 14 bp, Homo sapiens
catgttatatattt

SEQ ID NO: 2645821 - DNA, 21 bp, Homo sapiens
catgttcctcaaaagcaccct

SEQ ID NO: 2645822 - DNA, 19 bp, Homo sapiens
ccaacccccaccccacact

SEQ ID NO: 2645823 - DNA, 15 bp, Homo sapiens
ccaaccctcatcacc

SEQ ID NO: 2645824 - DNA, 14 bp, Homo sapiens
ccaaccctgcccct

SEQ ID NO: 2645825 - DNA, 15 bp, Homo sapiens
ccaaccctgcccctg

SEQ ID NO: 2645826 - DNA, 13 bp, Homo sapiens
ccaaccctgtctg

SEQ ID NO: 2645827 - DNA, 16 bp, Homo sapiens
ccaaccctgtttcctg

SEQ ID NO: 2645828 - DNA, 13 bp, Homo sapiens
ccaacctctggag

SEQ ID NO: 2645829 - DNA, 16 bp, Homo sapiens
ccaacgtctgtgccat

SEQ ID NO: 2645830 - DNA, 19 bp, Homo sapiens
ccaactaatgccttactct

SEQ ID NO: 2645831 - DNA, 17 bp, Homo sapiens
ccaactagacattctgt

SEQ ID NO: 2645832 - DNA, 14 bp, Homo sapiens
ccaactcaccccag

SEQ ID NO: 2645833 - DNA, 17 bp, Homo sapiens
ccaactcaccccagccc

SEQ ID NO: 2645834 - DNA, 18 bp, Homo sapiens
ccaactcaccccagcccc

SEQ ID NO: 2645835 - DNA, 12 bp, Homo sapiens
ccaactctcctg

SEQ ID NO: 2645836 - DNA, 17 bp, Homo sapiens
ccaactgggcccaagac

SEQ ID NO: 2645837 - DNA, 21 bp, Homo sapiens
ccaacttcatttgatgctaaa

SEQ ID NO: 2645838 - DNA, 13 bp, Homo sapiens
ccaacttcccagt

SEQ ID NO: 2645839 - DNA, 18 bp, Homo sapiens
ccaacttcttcagagctg

SEQ ID NO: 2645840 - DNA, 20 bp, Homo sapiens
ccaacttgagggcccagagc

SEQ ID NO: 2645841 - DNA, 23 bp, Homo sapiens
ccaacttgtattaaagacagagg

SEQ ID NO: 2645842 - DNA, 18 bp, Homo sapiens
ccaagaaactgagaccaa

SEQ ID NO: 2645843 - DNA, 13 bp, Homo sapiens
ccaagaaagcagg

SEQ ID NO: 2645844 - DNA, 20 bp, Homo sapiens
ccaagaagcccaggaaaggc

SEQ ID NO: 2645845 - DNA, 13 bp, Homo sapiens
ccaagaagttgga

SEQ ID NO: 2645846 - DNA, 19 bp, Homo sapiens
ccaagacagatgccccaga

SEQ ID NO: 2645847 - DNA, 21 bp, Homo sapiens
ccaagacagatgccccagagc

SEQ ID NO: 2645848 - DNA, 24 bp, Homo sapiens
ccaagacagatgccccagagctgt

SEQ ID NO: 2645849 - DNA, 21 bp, Homo sapiens
ccaagacatgtctgttctaca

SEQ ID NO: 2645850 - DNA, 17 bp, Homo sapiens
ccaagacattgtcaata

SEQ ID NO: 2645851 - DNA, 20 bp, Homo sapiens
ccaagagacatgctgacttt

SEQ ID NO: 2645852 - DNA, 21 bp, Homo sapiens
ccaagaggctgttcccaccag

SEQ ID NO: 2645853 - DNA, 16 bp, Homo sapiens
ccaagagtctgatgat

SEQ ID NO: 2645854 - DNA, 20 bp, Homo sapiens
ccaagcaaaggtgaagagac

SEQ ID NO: 2645855 - DNA, 18 bp, Homo sapiens
ccaagcaacctgggtcca

SEQ ID NO: 2645856 - DNA, 23 bp, Homo sapiens
ccaagcaacctgggtccaaataa

SEQ ID NO: 2645857 - DNA, 19 bp, Homo sapiens
ccaagcacagtggtggcag

SEQ ID NO: 2645858 - DNA, 21 bp, Homo sapiens
ccaagcacagtggtggcaggg

SEQ ID NO: 2645859 - DNA, 22 bp, Homo sapiens
ccaagcacagtggtggcagggc

SEQ ID NO: 2645860 - DNA, 21 bp, Homo sapiens
ccaagcactgtgctcagggct

SEQ ID NO: 2645861 - DNA, 22 bp, Homo sapiens
ccaagcactgtgctcagggcta

SEQ ID NO: 2645862 - DNA, 18 bp, Homo sapiens
ccaagcagccaagctcct

SEQ ID NO: 2645863 - DNA, 12 bp, Homo sapiens
ccaagcaggaag

SEQ ID NO: 2645864 - DNA, 13 bp, Homo sapiens
ccaagcaggaagc

SEQ ID NO: 2645865 - DNA, 16 bp, Homo sapiens
ccaagctcccaggcat

SEQ ID NO: 2645866 - DNA, 17 bp, Homo sapiens
ccaagctccttgggagg

SEQ ID NO: 2645867 - DNA, 19 bp, Homo sapiens
ccaagctgggccccagccc

SEQ ID NO: 2645868 - DNA, 20 bp, Homo sapiens
ccaagctgggccccagccca

SEQ ID NO: 2645869 - DNA, 19 bp, Homo sapiens
ccaaggaaaccacagctgc

SEQ ID NO: 2645870 - DNA, 23 bp, Homo sapiens
ccaaggaaaccacagctgctgga

SEQ ID NO: 2645871 - DNA, 13 bp, Homo sapiens
ccaaggaccaggt

SEQ ID NO: 2645872 - DNA, 18 bp, Homo sapiens
ccaaggacccctcacctt

SEQ ID NO: 2645873 - DNA, 15 bp, Homo sapiens
ccaaggagaaacaga

SEQ ID NO: 2645874 - DNA, 14 bp, Homo sapiens
ccaaggagacacaa

SEQ ID NO: 2645875 - DNA, 13 bp, Homo sapiens
ccaaggcaaggca

SEQ ID NO: 2645876 - DNA, 16 bp, Homo sapiens
ccaaggcaaggcaggt

SEQ ID NO: 2645877 - DNA, 17 bp, Homo sapiens
ccaaggcaaggcaggtg

SEQ ID NO: 2645878 - DNA, 17 bp, Homo sapiens
ccaaggccgaagctctg

SEQ ID NO: 2645879 - DNA, 18 bp, Homo sapiens
ccaaggctagaaccacct

SEQ ID NO: 2645880 - DNA, 14 bp, Homo sapiens
ccaaggctggggga

SEQ ID NO: 2645881 - DNA, 24 bp, Homo sapiens
ccaagggagttaggctattcacaa

SEQ ID NO: 2645882 - DNA, 22 bp, Homo sapiens
ccaagggcaaaattcccaggga

SEQ ID NO: 2645883 - DNA, 15 bp, Homo sapiens
ccaagggcctggcct

SEQ ID NO: 2645884 - DNA, 16 bp, Homo sapiens
ccaagggcctggcctg

SEQ ID NO: 2645885 - DNA, 14 bp, Homo sapiens
ccaagggcttctgc

SEQ ID NO: 2645886 - DNA, 15 bp, Homo sapiens
ccaaggtggcacggt

SEQ ID NO: 2645887 - DNA, 13 bp, Homo sapiens
ccaaggtgggagg

SEQ ID NO: 2645888 - DNA, 17 bp, Homo sapiens
ccaaggtgggctgagcc

SEQ ID NO: 2645889 - DNA, 18 bp, Homo sapiens
ccaaggtgggctgagccc

SEQ ID NO: 2645890 - DNA, 20 bp, Homo sapiens
ccaaggtgggtagatcacga

SEQ ID NO: 2645891 - DNA, 20 bp, Homo sapiens
ccaaggtttaaacttctctg

SEQ ID NO: 2645892 - DNA, 15 bp, Homo sapiens
ccaagtccctgtttt

SEQ ID NO: 2645893 - DNA, 23 bp, Homo sapiens
ccaagtccctgttttctgagccc

SEQ ID NO: 2645894 - DNA, 19 bp, Homo sapiens
ccaagtcctgaagaggcgg

SEQ ID NO: 2645895 - DNA, 17 bp, Homo sapiens
ccaagtctacagagtga

SEQ ID NO: 2645896 - DNA, 14 bp, Homo sapiens
ccaagtctcagtgg

SEQ ID NO: 2645897 - DNA, 15 bp, Homo sapiens
ccaagtgccagaggt

SEQ ID NO: 2645898 - DNA, 15 bp, Homo sapiens
ccaagtggcagagct

SEQ ID NO: 2645899 - DNA, 13 bp, Homo sapiens
ccaagtggctccc

SEQ ID NO: 2645900 - DNA, 16 bp, Homo sapiens
ccaagtggctcccaca

SEQ ID NO: 2645901 - DNA, 14 bp, Homo sapiens
ccaagtgtgaacaa

SEQ ID NO: 2645902 - DNA, 19 bp, Homo sapiens
ccaagtgtgcatattgtac

SEQ ID NO: 2645903 - DNA, 20 bp, Homo sapiens
ccaagtgtgcatattgtaca

SEQ ID NO: 2645904 - DNA, 19 bp, Homo sapiens
ccaagttccgtcagtccaa

SEQ ID NO: 2645905 - DNA, 22 bp, Homo sapiens
ccaagttgatttagtgttttta

SEQ ID NO: 2645906 - DNA, 22 bp, Homo sapiens
ccaagttgtggtgctgacaaag

SEQ ID NO: 2645907 - DNA, 17 bp, Homo sapiens
ccaagtttactcaaccc

SEQ ID NO: 2645908 - DNA, 23 bp, Homo sapiens
ccaataaaagcaattccaacctt

SEQ ID NO: 2645909 - DNA, 22 bp, Homo sapiens
ccaataaatgtgaaattctgtc

SEQ ID NO: 2645910 - DNA, 22 bp, Homo sapiens
ccaatagttgttgattggcagg

SEQ ID NO: 2645911 - DNA, 15 bp, Homo sapiens
ccaatatgtattgta

SEQ ID NO: 2645912 - DNA, 12 bp, Homo sapiens
ccaatattataa

SEQ ID NO: 2645913 - DNA, 14 bp, Homo sapiens
ccaatatttgtaga

SEQ ID NO: 2645914 - DNA, 21 bp, Homo sapiens
ccaatcccctccttgggcact

SEQ ID NO: 2645915 - DNA, 12 bp, Homo sapiens
ccaatcctgccc

SEQ ID NO: 2645916 - DNA, 23 bp, Homo sapiens
ccaatgaaatacacaagtaaaca

SEQ ID NO: 2645917 - DNA, 20 bp, Homo sapiens
ccaatgcactttgttctggc

SEQ ID NO: 2645918 - DNA, 22 bp, Homo sapiens
ccaatgcactttgttctggctc

SEQ ID NO: 2645919 - DNA, 17 bp, Homo sapiens
ccaatgcatgcagccac

SEQ ID NO: 2645920 - DNA, 18 bp, Homo sapiens
ccaatgccccactggcag

SEQ ID NO: 2645921 - DNA, 14 bp, Homo sapiens
ccaatgctgatgtc

SEQ ID NO: 2645922 - DNA, 17 bp, Homo sapiens
ccaatgctgatgtcctc

SEQ ID NO: 2645923 - DNA, 18 bp, Homo sapiens
ccaatgcttttatcaaac

SEQ ID NO: 2645924 - DNA, 18 bp, Homo sapiens
ccaatggaacctcctttc

SEQ ID NO: 2645925 - DNA, 19 bp, Homo sapiens
ccaatggaacctcctttct

SEQ ID NO: 2645926 - DNA, 15 bp, Homo sapiens
ccaattaaccagaaa

SEQ ID NO: 2645927 - DNA, 18 bp, Homo sapiens
ccaattaaggattttatg

SEQ ID NO: 2645928 - DNA, 22 bp, Homo sapiens
ccaattaaggattttatgcttt

SEQ ID NO: 2645929 - DNA, 20 bp, Homo sapiens
ccaattccttgcacatagta

SEQ ID NO: 2645930 - DNA, 11 bp, Homo sapiens
ccaattcttac

SEQ ID NO: 2645931 - DNA, 21 bp, Homo sapiens
ccaattgttgacagttctgaa

SEQ ID NO: 2645932 - DNA, 18 bp, Homo sapiens
ccacaaaggagagctagc

SEQ ID NO: 2645933 - DNA, 18 bp, Homo sapiens
ccacaaccctgttttata

SEQ ID NO: 2645934 - DNA, 16 bp, Homo sapiens
ccacaagaaatgaaag

SEQ ID NO: 2645935 - DNA, 20 bp, Homo sapiens
ccacaagttaaataaatcat

SEQ ID NO: 2645936 - DNA, 21 bp, Homo sapiens
ccacaataaagatcgccccca

SEQ ID NO: 2645937 - DNA, 22 bp, Homo sapiens
ccacacacagaggaagagcagg

SEQ ID NO: 2645938 - DNA, 18 bp, Homo sapiens
ccacacacgcaggaactc

SEQ ID NO: 2645939 - DNA, 15 bp, Homo sapiens
ccacacactcgcccg

SEQ ID NO: 2645940 - DNA, 13 bp, Homo sapiens
ccacacagagtgg

SEQ ID NO: 2645941 - DNA, 14 bp, Homo sapiens
ccacaccaggccgt

SEQ ID NO: 2645942 - DNA, 14 bp, Homo sapiens
ccacacccagccca

SEQ ID NO: 2645943 - DNA, 16 bp, Homo sapiens
ccacacccagctcagc

SEQ ID NO: 2645944 - DNA, 15 bp, Homo sapiens
ccacacccccacccc

SEQ ID NO: 2645945 - DNA, 21 bp, Homo sapiens
ccacaccctcccccgccactc

SEQ ID NO: 2645946 - DNA, 16 bp, Homo sapiens
ccacaccctgtactgt

SEQ ID NO: 2645947 - DNA, 14 bp, Homo sapiens
ccacaccgcagaag

SEQ ID NO: 2645948 - DNA, 19 bp, Homo sapiens
ccacacctcagttcccttg

SEQ ID NO: 2645949 - DNA, 22 bp, Homo sapiens
ccacacctcagttcccttggcc

SEQ ID NO: 2645950 - DNA, 15 bp, Homo sapiens
ccacacctccacagt

SEQ ID NO: 2645951 - DNA, 17 bp, Homo sapiens
ccacacctccacagttc

SEQ ID NO: 2645952 - DNA, 16 bp, Homo sapiens
ccacacctccctgaac

SEQ ID NO: 2645953 - DNA, 12 bp, Homo sapiens
ccacacctgagc

SEQ ID NO: 2645954 - DNA, 18 bp, Homo sapiens
ccacacctggcactgctg

SEQ ID NO: 2645955 - DNA, 19 bp, Homo sapiens
ccacacctggcactgctgt

SEQ ID NO: 2645956 - DNA, 16 bp, Homo sapiens
ccacactaacctgggt

SEQ ID NO: 2645957 - DNA, 22 bp, Homo sapiens
ccacactaacctgggttccctt

SEQ ID NO: 2645958 - DNA, 23 bp, Homo sapiens
ccacactaacctgggttcccttt

SEQ ID NO: 2645959 - DNA, 20 bp, Homo sapiens
ccacactattaccatgagaa

SEQ ID NO: 2645960 - DNA, 24 bp, Homo sapiens
ccacactcactcctgagacccctg

SEQ ID NO: 2645961 - DNA, 13 bp, Homo sapiens
ccacactggactc

SEQ ID NO: 2645962 - DNA, 22 bp, Homo sapiens
ccacactggggtgccgcctgcc

SEQ ID NO: 2645963 - DNA, 16 bp, Homo sapiens
ccacacttcctgtcca

SEQ ID NO: 2645964 - DNA, 21 bp, Homo sapiens
ccacacttcctgtccagagag

SEQ ID NO: 2645965 - DNA, 17 bp, Homo sapiens
ccacacttgagaggatg

SEQ ID NO: 2645966 - DNA, 14 bp, Homo sapiens
ccagcagcctggac

SEQ ID NO: 2645967 - DNA, 22 bp, Homo sapiens
ccagcagttgaatgacaacaga

SEQ ID NO: 2645968 - DNA, 15 bp, Homo sapiens
ccagcatcccttgac

SEQ ID NO: 2645969 - DNA, 13 bp, Homo sapiens
ccagcattgctgg

SEQ ID NO: 2645970 - DNA, 19 bp, Homo sapiens
ccagccaaaccctgtctga

SEQ ID NO: 2645971 - DNA, 15 bp, Homo sapiens
ccagccaaagcctcc

SEQ ID NO: 2645972 - DNA, 19 bp, Homo sapiens
ccagccaaagcctcctcca

SEQ ID NO: 2645973 - DNA, 22 bp, Homo sapiens
ccagccaacttttgcatgtttt

SEQ ID NO: 2645974 - DNA, 21 bp, Homo sapiens
ccagccaccccgggctctctg

SEQ ID NO: 2645975 - DNA, 20 bp, Homo sapiens
ccagccactcgggaggctga

SEQ ID NO: 2645976 - DNA, 22 bp, Homo sapiens
ccagccagcaatgatgtccaga

SEQ ID NO: 2645977 - DNA, 14 bp, Homo sapiens
ccagccaggctctg

SEQ ID NO: 2645978 - DNA, 19 bp, Homo sapiens
ccagccaggctctgtgctg

SEQ ID NO: 2645979 - DNA, 13 bp, Homo sapiens
ccagccagggctg

SEQ ID NO: 2645980 - DNA, 15 bp, Homo sapiens
ccagccagggctgct

SEQ ID NO: 2645981 - DNA, 17 bp, Homo sapiens
ccagccatctgcccagg

SEQ ID NO: 2645982 - DNA, 18 bp, Homo sapiens
ccagccatctgcccaggg

SEQ ID NO: 2645983 - DNA, 21 bp, Homo sapiens
ccagccatctgcccaggggtg

SEQ ID NO: 2645984 - DNA, 14 bp, Homo sapiens
ccagcccaccctcc

SEQ ID NO: 2645985 - DNA, 15 bp, Homo sapiens
ccagcccagatgttt

SEQ ID NO: 2645986 - DNA, 15 bp, Homo sapiens
ccagccccagtgccc

SEQ ID NO: 2645987 - DNA, 16 bp, Homo sapiens
ccagccccatcaggac

SEQ ID NO: 2645988 - DNA, 15 bp, Homo sapiens
ccagccccatcctct

SEQ ID NO: 2645989 - DNA, 17 bp, Homo sapiens
ccagccccatcctctgt

SEQ ID NO: 2645990 - DNA, 13 bp, Homo sapiens
ccagcccccacag

SEQ ID NO: 2645991 - DNA, 16 bp, Homo sapiens
ccagcccccacagtgc

SEQ ID NO: 2645992 - DNA, 17 bp, Homo sapiens
ccagccccggccctggg

SEQ ID NO: 2645993 - DNA, 11 bp, Homo sapiens
ccagcccctcc

SEQ ID NO: 2645994 - DNA, 11 bp, Homo sapiens
ccagcccctgg

SEQ ID NO: 2645995 - DNA, 13 bp, Homo sapiens
ccagcccctggat

SEQ ID NO: 2645996 - DNA, 15 bp, Homo sapiens
ccagccccttctgac

SEQ ID NO: 2645997 - DNA, 23 bp, Homo sapiens
ccagccccttctgacccatgctg

SEQ ID NO: 2645998 - DNA, 14 bp, Homo sapiens
ccagccccttgaga

SEQ ID NO: 2645999 - DNA, 13 bp, Homo sapiens
ccagcccggcctg

SEQ ID NO: 2646000 - DNA, 17 bp, Homo sapiens
ccagcccggcctgctcc

SEQ ID NO: 2646001 - DNA, 19 bp, Homo sapiens
ccagcccggcctgctccca

SEQ ID NO: 2646002 - DNA, 17 bp, Homo sapiens
ccagcccggctggtttt

SEQ ID NO: 2646003 - DNA, 16 bp, Homo sapiens
ccagccctatggatgt

SEQ ID NO: 2646004 - DNA, 13 bp, Homo sapiens
ccagccctcatcc

SEQ ID NO: 2646005 - DNA, 15 bp, Homo sapiens
ccagccctgctggcc

SEQ ID NO: 2646006 - DNA, 18 bp, Homo sapiens
ccagccctgctggccgcc

SEQ ID NO: 2646007 - DNA, 13 bp, Homo sapiens
ccagccctggctc

SEQ ID NO: 2646008 - DNA, 17 bp, Homo sapiens
ccagccctggctctgca

SEQ ID NO: 2646009 - DNA, 13 bp, Homo sapiens
ccagccctggtct

SEQ ID NO: 2646010 - DNA, 18 bp, Homo sapiens
ccagccctgtggaaggga

SEQ ID NO: 2646011 - DNA, 17 bp, Homo sapiens
ccagcccttagcaggga

SEQ ID NO: 2646012 - DNA, 14 bp, Homo sapiens
ccagccgccatgct

SEQ ID NO: 2646013 - DNA, 19 bp, Homo sapiens
ccagccgccatgctcctgg

SEQ ID NO: 2646014 - DNA, 14 bp, Homo sapiens
ccagccggcctctc

SEQ ID NO: 2646015 - DNA, 20 bp, Homo sapiens
ccagccggcctctctggcct

SEQ ID NO: 2646016 - DNA, 23 bp, Homo sapiens
ccagccggcctctctggcctccc

SEQ ID NO: 2646017 - DNA, 23 bp, Homo sapiens
ccagccgtgatgctcaggcttga

SEQ ID NO: 2646018 - DNA, 17 bp, Homo sapiens
ccagcctaagatgaaga

SEQ ID NO: 2646019 - DNA, 19 bp, Homo sapiens
ccagcctccgtatttcaga

SEQ ID NO: 2646020 - DNA, 17 bp, Homo sapiens
ccagcctctagggaccc

SEQ ID NO: 2646021 - DNA, 20 bp, Homo sapiens
ccagcctctagggacccctc

SEQ ID NO: 2646022 - DNA, 15 bp, Homo sapiens
ccagcctctcccctg

SEQ ID NO: 2646023 - DNA, 21 bp, Homo sapiens
ccagcctctcttggtttcctt

SEQ ID NO: 2646024 - DNA, 11 bp, Homo sapiens
ccagcctctgt

SEQ ID NO: 2646025 - DNA, 19 bp, Homo sapiens
ccagcctgagcgacagtga

SEQ ID NO: 2646026 - DNA, 16 bp, Homo sapiens
ccagcctgcctggcag

SEQ ID NO: 2646027 - DNA, 18 bp, Homo sapiens
ccagcctgcctggcaggc

SEQ ID NO: 2646028 - DNA, 19 bp, Homo sapiens
ccagcctgggcaacagagc

SEQ ID NO: 2646029 - DNA, 13 bp, Homo sapiens
ccagcctgggtga

SEQ ID NO: 2646030 - DNA, 19 bp, Homo sapiens
ccagcctgtcccatggaca

SEQ ID NO: 2646031 - DNA, 21 bp, Homo sapiens
ccagccttcctctgcagctga

SEQ ID NO: 2646032 - DNA, 22 bp, Homo sapiens
ccagccttcctctgcagctgac

SEQ ID NO: 2646033 - DNA, 22 bp, Homo sapiens
ccagccttgaccattctccacc

SEQ ID NO: 2646034 - DNA, 18 bp, Homo sapiens
ccagcctttctcccaggc

SEQ ID NO: 2646035 - DNA, 21 bp, Homo sapiens
ccagcctttctcccaggccag

SEQ ID NO: 2646036 - DNA, 21 bp, Homo sapiens
ccagcgagccctggtggcagt

SEQ ID NO: 2646037 - DNA, 17 bp, Homo sapiens
ccagcgcccgctgggct

SEQ ID NO: 2646038 - DNA, 18 bp, Homo sapiens
ccagcgcccgctgggctg

SEQ ID NO: 2646039 - DNA, 22 bp, Homo sapiens
ccagcgcccgctgggctgagcc

SEQ ID NO: 2646040 - DNA, 13 bp, Homo sapiens
ccagcggcccctc

SEQ ID NO: 2646041 - DNA, 14 bp, Homo sapiens
ccagcggcccctcc

SEQ ID NO: 2646042 - DNA, 15 bp, Homo sapiens
ccagcggcccctccc

SEQ ID NO: 2646043 - DNA, 15 bp, Homo sapiens
ccagcgtcccagtct

SEQ ID NO: 2646044 - DNA, 22 bp, Homo sapiens
ccagcgtcccagtctctggcag

SEQ ID NO: 2646045 - DNA, 13 bp, Homo sapiens
ccagcgtcctcct

SEQ ID NO: 2646046 - DNA, 19 bp, Homo sapiens
ccagcgtcctcctctgtga

SEQ ID NO: 2646047 - DNA, 17 bp, Homo sapiens
ccagctaatctgtaggg

SEQ ID NO: 2646048 - DNA, 22 bp, Homo sapiens
ccagctaatctgtagggctgga

SEQ ID NO: 2646049 - DNA, 23 bp, Homo sapiens
ccagctaatctgtagggctggac

SEQ ID NO: 2646050 - DNA, 23 bp, Homo sapiens
ccagctactcagaagcctgaggc

SEQ ID NO: 2646051 - DNA, 13 bp, Homo sapiens
ccagctcaccccc

SEQ ID NO: 2646052 - DNA, 23 bp, Homo sapiens
ccagctcaccccccacactcact

SEQ ID NO: 2646053 - DNA, 14 bp, Homo sapiens
ccagctcacccctg

SEQ ID NO: 2646054 - DNA, 14 bp, Homo sapiens
ccagctccctagga

SEQ ID NO: 2646055 - DNA, 23 bp, Homo sapiens
ccagctcctcatccagggctctg

SEQ ID NO: 2646056 - DNA, 17 bp, Homo sapiens
ccagctctagacaaccc

SEQ ID NO: 2646057 - DNA, 18 bp, Homo sapiens
ccagctctagacaaccct

SEQ ID NO: 2646058 - DNA, 21 bp, Homo sapiens
ccagctctagacaaccctgca

SEQ ID NO: 2646059 - DNA, 12 bp, Homo sapiens
ccagctctcagc

SEQ ID NO: 2646060 - DNA, 20 bp, Homo sapiens
ccagctctgaaaccagtgtt

SEQ ID NO: 2646061 - DNA, 14 bp, Homo sapiens
ccagctctggcttc

SEQ ID NO: 2646062 - DNA, 11 bp, Homo sapiens
ccagctctggt

SEQ ID NO: 2646063 - DNA, 24 bp, Homo sapiens
ccagctggagaaatatggtactca

SEQ ID NO: 2646064 - DNA, 14 bp, Homo sapiens
ccagctggcagcag

SEQ ID NO: 2646065 - DNA, 15 bp, Homo sapiens
ccagctggcagcaga

SEQ ID NO: 2646066 - DNA, 16 bp, Homo sapiens
ccagctggcagcagag

SEQ ID NO: 2646067 - DNA, 20 bp, Homo sapiens
ccagctggcagcagagtgtg

SEQ ID NO: 2646068 - DNA, 19 bp, Homo sapiens
ccagctggcccgtgacaga

SEQ ID NO: 2646069 - DNA, 16 bp, Homo sapiens
ccagctgggaggcaag

SEQ ID NO: 2646070 - DNA, 21 bp, Homo sapiens
ccagctgggctctgccaccct

SEQ ID NO: 2646071 - DNA, 16 bp, Homo sapiens
ccagctggggcgtggg

SEQ ID NO: 2646072 - DNA, 21 bp, Homo sapiens
ccagctggggcgtggggaggg

SEQ ID NO: 2646073 - DNA, 22 bp, Homo sapiens
ccagctggggcgtggggagggc

SEQ ID NO: 2646074 - DNA, 21 bp, Homo sapiens
ccagctggtgagtgatgcggc

SEQ ID NO: 2646075 - DNA, 18 bp, Homo sapiens
ccagctgtgctctggaca

SEQ ID NO: 2646076 - DNA, 20 bp, Homo sapiens
ccagctgtgctctggacagg

SEQ ID NO: 2646077 - DNA, 21 bp, Homo sapiens
ccagctgtgctctggacaggc

SEQ ID NO: 2646078 - DNA, 23 bp, Homo sapiens
ccagctgtgctctggacaggcat

SEQ ID NO: 2646079 - DNA, 19 bp, Homo sapiens
ccagcttaaaggggctaga

SEQ ID NO: 2646080 - DNA, 16 bp, Homo sapiens
ccagcttatctcaggg

SEQ ID NO: 2646081 - DNA, 14 bp, Homo sapiens
ccagcttctccagg

SEQ ID NO: 2646082 - DNA, 18 bp, Homo sapiens
ccagcttctccaggctct

SEQ ID NO: 2646083 - DNA, 19 bp, Homo sapiens
ccagcttgggcccagctgg

SEQ ID NO: 2646084 - DNA, 21 bp, Homo sapiens
ccagcttgggcccagctgggc

SEQ ID NO: 2646085 - DNA, 23 bp, Homo sapiens
ccagcttgggcccagctgggctc

SEQ ID NO: 2646086 - DNA, 18 bp, Homo sapiens
ccagcttttcctcccttg

SEQ ID NO: 2646087 - DNA, 23 bp, Homo sapiens
ccaggaaaggctccaggagcagc

SEQ ID NO: 2646088 - DNA, 21 bp, Homo sapiens
ccaggaacaatcgatggcctt

SEQ ID NO: 2646089 - DNA, 22 bp, Homo sapiens
ccaggaagggggtccacccagc

SEQ ID NO: 2646090 - DNA, 15 bp, Homo sapiens
ccaggaccagctggg

SEQ ID NO: 2646091 - DNA, 20 bp, Homo sapiens
ccaggacgcttctgaatgct

SEQ ID NO: 2646092 - DNA, 18 bp, Homo sapiens
ccaggactatagcccagg

SEQ ID NO: 2646093 - DNA, 19 bp, Homo sapiens
ccaggactatagcccaggt

SEQ ID NO: 2646094 - DNA, 23 bp, Homo sapiens
ccaggactccctcctcacctctg

SEQ ID NO: 2646095 - DNA, 19 bp, Homo sapiens
ccaggagaaccactacatg

SEQ ID NO: 2646096 - DNA, 20 bp, Homo sapiens
ccaggagaaggccaattcct

SEQ ID NO: 2646097 - DNA, 12 bp, Homo sapiens
ccaggagcaaat

SEQ ID NO: 2646098 - DNA, 19 bp, Homo sapiens
ccaggagcaaatgtttctg

SEQ ID NO: 2646099 - DNA, 13 bp, Homo sapiens
ccaggagcagcca

SEQ ID NO: 2646100 - DNA, 18 bp, Homo sapiens
ccaggagcatccacctcc

SEQ ID NO: 2646101 - DNA, 20 bp, Homo sapiens
ccaggagcatccacctcctt

SEQ ID NO: 2646102 - DNA, 16 bp, Homo sapiens
ccaggagccccgaggc

SEQ ID NO: 2646103 - DNA, 15 bp, Homo sapiens
ccaggagggcactgg

SEQ ID NO: 2646104 - DNA, 17 bp, Homo sapiens
ccaggagggcactggag

SEQ ID NO: 2646105 - DNA, 23 bp, Homo sapiens
ccaggatagtgggcaccccactg

SEQ ID NO: 2646106 - DNA, 19 bp, Homo sapiens
ccaggatcagattgcatgt

SEQ ID NO: 2646107 - DNA, 14 bp, Homo sapiens
ccaggatcatggtg

SEQ ID NO: 2646108 - DNA, 15 bp, Homo sapiens
ccaggatcatggtgt

SEQ ID NO: 2646109 - DNA, 20 bp, Homo sapiens
ccaggatcatggtgtaataa

SEQ ID NO: 2646110 - DNA, 18 bp, Homo sapiens
ccatgttttgtttacggt

SEQ ID NO: 2646111 - DNA, 21 bp, Homo sapiens
ccattaaaactgaagtctgaa

SEQ ID NO: 2646112 - DNA, 22 bp, Homo sapiens
ccattaaaactgaagtctgaaa

SEQ ID NO: 2646113 - DNA, 22 bp, Homo sapiens
ccattaaagtcgagcttttcta

SEQ ID NO: 2646114 - DNA, 23 bp, Homo sapiens
ccattagaagatattagtcttgg

SEQ ID NO: 2646115 - DNA, 19 bp, Homo sapiens
ccattagctttcaattccg

SEQ ID NO: 2646116 - DNA, 22 bp, Homo sapiens
ccattaggacaatcagtcccct

SEQ ID NO: 2646117 - DNA, 14 bp, Homo sapiens
ccattatcatgtgt

SEQ ID NO: 2646118 - DNA, 14 bp, Homo sapiens
ccattatccctgaa

SEQ ID NO: 2646119 - DNA, 20 bp, Homo sapiens
ccattcacttcataatccag

SEQ ID NO: 2646120 - DNA, 13 bp, Homo sapiens
ccattcattccat

SEQ ID NO: 2646121 - DNA, 18 bp, Homo sapiens
ccattcattccattctgg

SEQ ID NO: 2646122 - DNA, 15 bp, Homo sapiens
ccattccctgcctgg

SEQ ID NO: 2646123 - DNA, 20 bp, Homo sapiens
ccattccctgcctggggcgg

SEQ ID NO: 2646124 - DNA, 21 bp, Homo sapiens
ccattcctggtacccagccat

SEQ ID NO: 2646125 - DNA, 18 bp, Homo sapiens
ccattctcaagccctgca

SEQ ID NO: 2646126 - DNA, 16 bp, Homo sapiens
ccattctccacctgcc

SEQ ID NO: 2646127 - DNA, 18 bp, Homo sapiens
ccattctccacctgccag

SEQ ID NO: 2646128 - DNA, 19 bp, Homo sapiens
ccattctccacctgccagg

SEQ ID NO: 2646129 - DNA, 17 bp, Homo sapiens
ccattctgaccatttca

SEQ ID NO: 2646130 - DNA, 18 bp, Homo sapiens
ccattctgcctgcccagg

SEQ ID NO: 2646131 - DNA, 19 bp, Homo sapiens
ccattctgcctgcccaggc

SEQ ID NO: 2646132 - DNA, 13 bp, Homo sapiens
ccattgaattctt

SEQ ID NO: 2646133 - DNA, 22 bp, Homo sapiens
ccattgaattcttggttgagga

SEQ ID NO: 2646134 - DNA, 15 bp, Homo sapiens
ccattgcctcctcct

SEQ ID NO: 2646135 - DNA, 21 bp, Homo sapiens
ccattggctatttaaaacttg

SEQ ID NO: 2646136 - DNA, 22 bp, Homo sapiens
ccattgtggtcacaggaagtag

SEQ ID NO: 2646137 - DNA, 15 bp, Homo sapiens
ccattgtttgaaaca

SEQ ID NO: 2646138 - DNA, 21 bp, Homo sapiens
ccattgtttgaaacaaagaag

SEQ ID NO: 2646139 - DNA, 17 bp, Homo sapiens
ccatttcaattctcaaa

SEQ ID NO: 2646140 - DNA, 14 bp, Homo sapiens
ccatttctatttat

SEQ ID NO: 2646141 - DNA, 14 bp, Homo sapiens
ccatttctcactga

SEQ ID NO: 2646142 - DNA, 12 bp, Homo sapiens
ccatttctcatg

SEQ ID NO: 2646143 - DNA, 20 bp, Homo sapiens
ccattttggggtacccactg

SEQ ID NO: 2646144 - DNA, 21 bp, Homo sapiens
ccattttgtattttactaata

SEQ ID NO: 2646145 - DNA, 17 bp, Homo sapiens
cccaaacaaatatgcaa

SEQ ID NO: 2646146 - DNA, 22 bp, Homo sapiens
cccaaacaccttccagctcctg

SEQ ID NO: 2646147 - DNA, 18 bp, Homo sapiens
cccaaagagcctggagaa

SEQ ID NO: 2646148 - DNA, 19 bp, Homo sapiens
cccaaagagcctggagaag

SEQ ID NO: 2646149 - DNA, 14 bp, Homo sapiens
cccaaaggactcca

SEQ ID NO: 2646150 - DNA, 21 bp, Homo sapiens
cccaaagtggtatagaaatgc

SEQ ID NO: 2646151 - DNA, 15 bp, Homo sapiens
cccaaatccgaacct

SEQ ID NO: 2646152 - DNA, 22 bp, Homo sapiens
cccaaatggaaatgggcagagc

SEQ ID NO: 2646153 - DNA, 13 bp, Homo sapiens
cccaacactgtgc

SEQ ID NO: 2646154 - DNA, 18 bp, Homo sapiens
cccaacactgtgccctgg

SEQ ID NO: 2646155 - DNA, 21 bp, Homo sapiens
cccaacactgtgccctggtgg

SEQ ID NO: 2646156 - DNA, 16 bp, Homo sapiens
cccaacaggaggacaa

SEQ ID NO: 2646157 - DNA, 20 bp, Homo sapiens
cccaacaggaggacaattca

SEQ ID NO: 2646158 - DNA, 12 bp, Homo sapiens
cccaacagtgtg

SEQ ID NO: 2646159 - DNA, 16 bp, Homo sapiens
cccaacagtgtgaagt

SEQ ID NO: 2646160 - DNA, 19 bp, Homo sapiens
cccaacagtgtgaagttag

SEQ ID NO: 2646161 - DNA, 14 bp, Homo sapiens
cccaaccctgtctg

SEQ ID NO: 2646162 - DNA, 15 bp, Homo sapiens
cccaacccttcccca

SEQ ID NO: 2646163 - DNA, 14 bp, Homo sapiens
cccaacctgctgaa

SEQ ID NO: 2646164 - DNA, 20 bp, Homo sapiens
cccaactcaccccagcccca

SEQ ID NO: 2646165 - DNA, 12 bp, Homo sapiens
cccaactgttat

SEQ ID NO: 2646166 - DNA, 23 bp, Homo sapiens
cccaagattcacacctgactctg

SEQ ID NO: 2646167 - DNA, 23 bp, Homo sapiens
cccaagcccgacttgctgttttg

SEQ ID NO: 2646168 - DNA, 15 bp, Homo sapiens
cccaagctctgctcc

SEQ ID NO: 2646169 - DNA, 17 bp, Homo sapiens
cccaagctcttgtggta

SEQ ID NO: 2646170 - DNA, 18 bp, Homo sapiens
cccaagctgggccccagc

SEQ ID NO: 2646171 - DNA, 20 bp, Homo sapiens
cccaagcttggcagccgagc

SEQ ID NO: 2646172 - DNA, 22 bp, Homo sapiens
cccaagcttggcagccgagctc

SEQ ID NO: 2646173 - DNA, 14 bp, Homo sapiens
cccaaggaaagccc

SEQ ID NO: 2646174 - DNA, 15 bp, Homo sapiens
cccaaggactgaggg

SEQ ID NO: 2646175 - DNA, 16 bp, Homo sapiens
cccaaggactgaggga

SEQ ID NO: 2646176 - DNA, 22 bp, Homo sapiens
cccaaggcgtccgcgcgccagc

SEQ ID NO: 2646177 - DNA, 14 bp, Homo sapiens
cccaagggcctggc

SEQ ID NO: 2646178 - DNA, 18 bp, Homo sapiens
cccaagggcctggcctga

SEQ ID NO: 2646179 - DNA, 15 bp, Homo sapiens
cccaagtgccagtct

SEQ ID NO: 2646180 - DNA, 12 bp, Homo sapiens
cccaatattata

SEQ ID NO: 2646181 - DNA, 17 bp, Homo sapiens
cccaatattataatttt

SEQ ID NO: 2646182 - DNA, 23 bp, Homo sapiens
cccaatgcactttgttctggctc

SEQ ID NO: 2646183 - DNA, 14 bp, Homo sapiens
cccaattggaggaa

SEQ ID NO: 2646184 - DNA, 18 bp, Homo sapiens
cccaattttgcagggagc

SEQ ID NO: 2646185 - DNA, 17 bp, Homo sapiens
cccacaactcctgtcta

SEQ ID NO: 2646186 - DNA, 11 bp, Homo sapiens
cccacacacac

SEQ ID NO: 2646187 - DNA, 19 bp, Homo sapiens
cccacacacacacacatgc

SEQ ID NO: 2646188 - DNA, 13 bp, Homo sapiens
cccacacacagat

SEQ ID NO: 2646189 - DNA, 13 bp, Homo sapiens
cccacacactcgc

SEQ ID NO: 2646190 - DNA, 12 bp, Homo sapiens
cccacaccctgg

SEQ ID NO: 2646191 - DNA, 15 bp, Homo sapiens
cccacaccgtgtaaa

SEQ ID NO: 2646192 - DNA, 16 bp, Homo sapiens
cccacacctctgccag

SEQ ID NO: 2646193 - DNA, 22 bp, Homo sapiens
cccacacggaggcatctgcacc

SEQ ID NO: 2646194 - DNA, 23 bp, Homo sapiens
cccacacggaggcatctgcaccc

SEQ ID NO: 2646195 - DNA, 14 bp, Homo sapiens
cccacactcactcc

SEQ ID NO: 2646196 - DNA, 11 bp, Homo sapiens
cccacactcct

SEQ ID NO: 2646197 - DNA, 23 bp, Homo sapiens
cccacagactcaaatgctcagac

SEQ ID NO: 2646198 - DNA, 13 bp, Homo sapiens
cccacagcgctgg

SEQ ID NO: 2646199 - DNA, 22 bp, Homo sapiens
cccacaggaagcctgcagtcct

SEQ ID NO: 2646200 - DNA, 13 bp, Homo sapiens
cccacaggcagct

SEQ ID NO: 2646201 - DNA, 16 bp, Homo sapiens
cccacatcccaggctt

SEQ ID NO: 2646202 - DNA, 23 bp, Homo sapiens
cccaccactaggactctgaggct

SEQ ID NO: 2646203 - DNA, 17 bp, Homo sapiens
cccaccaggctgctcag

SEQ ID NO: 2646204 - DNA, 18 bp, Homo sapiens
cccaccatgtctgcccca

SEQ ID NO: 2646205 - DNA, 18 bp, Homo sapiens
cccacccaagcttggcag

SEQ ID NO: 2646206 - DNA, 22 bp, Homo sapiens
cccacccaagcttggcagccga

SEQ ID NO: 2646207 - DNA, 14 bp, Homo sapiens
cccacccacatgtg

SEQ ID NO: 2646208 - DNA, 15 bp, Homo sapiens
cccacccacatgtga

SEQ ID NO: 2646209 - DNA, 12 bp, Homo sapiens
cccacccaggag

SEQ ID NO: 2646210 - DNA, 12 bp, Homo sapiens
cccaccccacac

SEQ ID NO: 2646211 - DNA, 17 bp, Homo sapiens
cccacccccacccaagg

SEQ ID NO: 2646212 - DNA, 13 bp, Homo sapiens
cccacccccagct

SEQ ID NO: 2646213 - DNA, 16 bp, Homo sapiens
cccacccccttctctg

SEQ ID NO: 2646214 - DNA, 19 bp, Homo sapiens
cccacccccttctctgctc

SEQ ID NO: 2646215 - DNA, 22 bp, Homo sapiens
cccacccccttctctgctccac

SEQ ID NO: 2646216 - DNA, 15 bp, Homo sapiens
cccaccccgctctgc

SEQ ID NO: 2646217 - DNA, 13 bp, Homo sapiens
cccaccccttccc

SEQ ID NO: 2646218 - DNA, 16 bp, Homo sapiens
cccacccgatgctgct

SEQ ID NO: 2646219 - DNA, 13 bp, Homo sapiens
cccaccctcagca

SEQ ID NO: 2646220 - DNA, 14 bp, Homo sapiens
cccaccctcagcac

SEQ ID NO: 2646221 - DNA, 16 bp, Homo sapiens
cccaccctcagcaccc

SEQ ID NO: 2646222 - DNA, 16 bp, Homo sapiens
cccaccctccctggag

SEQ ID NO: 2646223 - DNA, 13 bp, Homo sapiens
cccaccctcctgt

SEQ ID NO: 2646224 - DNA, 18 bp, Homo sapiens
cccaccctgaaagccctg

SEQ ID NO: 2646225 - DNA, 14 bp, Homo sapiens
cccaccctgggacc

SEQ ID NO: 2646226 - DNA, 19 bp, Homo sapiens
cccaccgtccgccctgctc

SEQ ID NO: 2646227 - DNA, 15 bp, Homo sapiens
cccacctcagcctcc

SEQ ID NO: 2646228 - DNA, 11 bp, Homo sapiens
cccacctccac

SEQ ID NO: 2646229 - DNA, 17 bp, Homo sapiens
cccacctctctcactcc

SEQ ID NO: 2646230 - DNA, 12 bp, Homo sapiens
cccacctcttct

SEQ ID NO: 2646231 - DNA, 16 bp, Homo sapiens
cccacctggccacctg

SEQ ID NO: 2646232 - DNA, 20 bp, Homo sapiens
cccacctggccacctgaggt

SEQ ID NO: 2646233 - DNA, 12 bp, Homo sapiens
cccacctggcct

SEQ ID NO: 2646234 - DNA, 17 bp, Homo sapiens
cccacctggcctctgca

SEQ ID NO: 2646235 - DNA, 21 bp, Homo sapiens
cccaccttcaattcctgggcc

SEQ ID NO: 2646236 - DNA, 22 bp, Homo sapiens
cccaccttcaattcctgggccc

SEQ ID NO: 2646237 - DNA, 15 bp, Homo sapiens
cccaccttggctcaa

SEQ ID NO: 2646238 - DNA, 14 bp, Homo sapiens
cccaccttggctgc

SEQ ID NO: 2646239 - DNA, 16 bp, Homo sapiens
cccaccttggctgcag

SEQ ID NO: 2646240 - DNA, 20 bp, Homo sapiens
cccaccttggctgcagggag

SEQ ID NO: 2646241 - DNA, 20 bp, Homo sapiens
cccacgactgcccggcaggg

SEQ ID NO: 2646242 - DNA, 21 bp, Homo sapiens
cccacgactgcccggcagggt

SEQ ID NO: 2646243 - DNA, 13 bp, Homo sapiens
cccacgcttctct

SEQ ID NO: 2646244 - DNA, 17 bp, Homo sapiens
cccacggccgctccagg

SEQ ID NO: 2646245 - DNA, 16 bp, Homo sapiens
cccacgttctcacacc

SEQ ID NO: 2646246 - DNA, 17 bp, Homo sapiens
cccacgttctcacaccc

SEQ ID NO: 2646247 - DNA, 17 bp, Homo sapiens
cccactcaagccaagca

SEQ ID NO: 2646248 - DNA, 19 bp, Homo sapiens
cccactcaagccaagcagc

SEQ ID NO: 2646249 - DNA, 17 bp, Homo sapiens
cccactctccccacact

SEQ ID NO: 2646250 - DNA, 12 bp, Homo sapiens
cccactctgtgc

SEQ ID NO: 2646251 - DNA, 12 bp, Homo sapiens
cccactgcccac

SEQ ID NO: 2646252 - DNA, 22 bp, Homo sapiens
cccactgcccaccccctcaagc

SEQ ID NO: 2646253 - DNA, 13 bp, Homo sapiens
cccactgcctgcc

SEQ ID NO: 2646254 - DNA, 16 bp, Homo sapiens
cccactgcctgcccac

SEQ ID NO: 2646255 - DNA, 14 bp, Homo sapiens
cccactgcctttga

SEQ ID NO: 2646256 - DNA, 15 bp, Homo sapiens
ccccattctgcctgc

SEQ ID NO: 2646257 - DNA, 23 bp, Homo sapiens
ccccattcttcctagttttctcc

SEQ ID NO: 2646258 - DNA, 15 bp, Homo sapiens
ccccattttctgtgg

SEQ ID NO: 2646259 - DNA, 22 bp, Homo sapiens
cccccaaatggaaatgggcaga

SEQ ID NO: 2646260 - DNA, 14 bp, Homo sapiens
cccccaagcctgca

SEQ ID NO: 2646261 - DNA, 13 bp, Homo sapiens
cccccaatccatg

SEQ ID NO: 2646262 - DNA, 13 bp, Homo sapiens
cccccacccaagg

SEQ ID NO: 2646263 - DNA, 14 bp, Homo sapiens
cccccacccccagc

SEQ ID NO: 2646264 - DNA, 15 bp, Homo sapiens
cccccacccccagct

SEQ ID NO: 2646265 - DNA, 17 bp, Homo sapiens
cccccacccccagctca

SEQ ID NO: 2646266 - DNA, 15 bp, Homo sapiens
cccccagcctctggc

SEQ ID NO: 2646267 - DNA, 19 bp, Homo sapiens
cccccatcctccccttccc

SEQ ID NO: 2646268 - DNA, 13 bp, Homo sapiens
ccccccactctgt

SEQ ID NO: 2646269 - DNA, 12 bp, Homo sapiens
cccccccttcca

SEQ ID NO: 2646270 - DNA, 13 bp, Homo sapiens
cccccccttccac

SEQ ID NO: 2646271 - DNA, 21 bp, Homo sapiens
cccccgagctgggggccatga

SEQ ID NO: 2646272 - DNA, 21 bp, Homo sapiens
cccccgcgcgcgtccccctgc

SEQ ID NO: 2646273 - DNA, 15 bp, Homo sapiens
ccccctccaatcctg

SEQ ID NO: 2646274 - DNA, 16 bp, Homo sapiens
ccccctccaatcctgc

SEQ ID NO: 2646275 - DNA, 12 bp, Homo sapiens
ccccctcctctc

SEQ ID NO: 2646276 - DNA, 13 bp, Homo sapiens
ccccctgccctcc

SEQ ID NO: 2646277 - DNA, 20 bp, Homo sapiens
ccccctgccctcgtggccag

SEQ ID NO: 2646278 - DNA, 15 bp, Homo sapiens
ccccctgctggctct

SEQ ID NO: 2646279 - DNA, 12 bp, Homo sapiens
ccccctggagag

SEQ ID NO: 2646280 - DNA, 16 bp, Homo sapiens
ccccctggtctctggt

SEQ ID NO: 2646281 - DNA, 20 bp, Homo sapiens
ccccctggtggacagtcctg

SEQ ID NO: 2646282 - DNA, 23 bp, Homo sapiens
ccccctggtggacagtcctggga

SEQ ID NO: 2646283 - DNA, 12 bp, Homo sapiens
ccccctgtcctc

SEQ ID NO: 2646284 - DNA, 13 bp, Homo sapiens
cccccttctccca

SEQ ID NO: 2646285 - DNA, 15 bp, Homo sapiens
cccccttctcccaca

SEQ ID NO: 2646286 - DNA, 15 bp, Homo sapiens
cccccttctctgctc

SEQ ID NO: 2646287 - DNA, 16 bp, Homo sapiens
cccccttctctgctcc

SEQ ID NO: 2646288 - DNA, 15 bp, Homo sapiens
cccccttgccacccc

SEQ ID NO: 2646289 - DNA, 19 bp, Homo sapiens
ccccctttgggcccaggga

SEQ ID NO: 2646290 - DNA, 20 bp, Homo sapiens
ccccctttgggcccagggac

SEQ ID NO: 2646291 - DNA, 14 bp, Homo sapiens
ccccctttgtgctg

SEQ ID NO: 2646292 - DNA, 18 bp, Homo sapiens
ccccctttgtgctgtggg

SEQ ID NO: 2646293 - DNA, 12 bp, Homo sapiens
ccccgagctggg

SEQ ID NO: 2646294 - DNA, 13 bp, Homo sapiens
ccccgagctgggg

SEQ ID NO: 2646295 - DNA, 17 bp, Homo sapiens
ccccgccccacattccg

SEQ ID NO: 2646296 - DNA, 20 bp, Homo sapiens
ccccgccccacattccgaca

SEQ ID NO: 2646297 - DNA, 13 bp, Homo sapiens
ccccgccccctgc

SEQ ID NO: 2646298 - DNA, 17 bp, Homo sapiens
ccccgccccctgccctc

SEQ ID NO: 2646299 - DNA, 18 bp, Homo sapiens
ccccgccccctgccctcc

SEQ ID NO: 2646300 - DNA, 21 bp, Homo sapiens
ccccgccccctgccctcccct

SEQ ID NO: 2646301 - DNA, 18 bp, Homo sapiens
ccccgcctgccctcatgg

SEQ ID NO: 2646302 - DNA, 13 bp, Homo sapiens
ccccgctctgcat

SEQ ID NO: 2646303 - DNA, 14 bp, Homo sapiens
ccccgctctgcatg

SEQ ID NO: 2646304 - DNA, 14 bp, Homo sapiens
ccccggcagacgcc

SEQ ID NO: 2646305 - DNA, 18 bp, Homo sapiens
ccccggccacctgcggtg

SEQ ID NO: 2646306 - DNA, 18 bp, Homo sapiens
ccccggccccagccagag

SEQ ID NO: 2646307 - DNA, 18 bp, Homo sapiens
ccccggccccggccccag

SEQ ID NO: 2646308 - DNA, 14 bp, Homo sapiens
ccccggcctcagca

SEQ ID NO: 2646309 - DNA, 16 bp, Homo sapiens
ccccgggctctctgct

SEQ ID NO: 2646310 - DNA, 17 bp, Homo sapiens
ccccgggctctctgctg

SEQ ID NO: 2646311 - DNA, 14 bp, Homo sapiens
ccccgtcacagcct

SEQ ID NO: 2646312 - DNA, 20 bp, Homo sapiens
cccctcagggtccctggtgg

SEQ ID NO: 2646313 - DNA, 17 bp, Homo sapiens
cccctccaatcctgccc

SEQ ID NO: 2646314 - DNA, 16 bp, Homo sapiens
cccctcccaccacagc

SEQ ID NO: 2646315 - DNA, 11 bp, Homo sapiens
cccctcccaga

SEQ ID NO: 2646316 - DNA, 12 bp, Homo sapiens
cccctcccaggg

SEQ ID NO: 2646317 - DNA, 14 bp, Homo sapiens
cccctcccatctgg

SEQ ID NO: 2646318 - DNA, 15 bp, Homo sapiens
cccctcccccaaccc

SEQ ID NO: 2646319 - DNA, 17 bp, Homo sapiens
cccctcccgccccttcc

SEQ ID NO: 2646320 - DNA, 15 bp, Homo sapiens
cccctccctggcctg

SEQ ID NO: 2646321 - DNA, 16 bp, Homo sapiens
cccctccctggcctgt

SEQ ID NO: 2646322 - DNA, 13 bp, Homo sapiens
cccctccctggct

SEQ ID NO: 2646323 - DNA, 15 bp, Homo sapiens
cccctccctggctcc

SEQ ID NO: 2646324 - DNA, 14 bp, Homo sapiens
cccctccctgggtt

SEQ ID NO: 2646325 - DNA, 22 bp, Homo sapiens
cccctcctccctttttccttgt

SEQ ID NO: 2646326 - DNA, 23 bp, Homo sapiens
cccctcctctcccctaccactgt

SEQ ID NO: 2646327 - DNA, 20 bp, Homo sapiens
cccctccttgcctcctgtgt

SEQ ID NO: 2646328 - DNA, 15 bp, Homo sapiens
cccctccttgggcac

SEQ ID NO: 2646329 - DNA, 16 bp, Homo sapiens
cccctctgctgctgtc

SEQ ID NO: 2646330 - DNA, 22 bp, Homo sapiens
cccctctgtccaggcactgaga

SEQ ID NO: 2646331 - DNA, 12 bp, Homo sapiens
cccctcttgccc

SEQ ID NO: 2646332 - DNA, 15 bp, Homo sapiens
cccctgacaacactc

SEQ ID NO: 2646333 - DNA, 21 bp, Homo sapiens
cccctgagacaaatggaggcc

SEQ ID NO: 2646334 - DNA, 18 bp, Homo sapiens
cccctgccacctccctga

SEQ ID NO: 2646335 - DNA, 23 bp, Homo sapiens
cccctgccagggcagggccccag

SEQ ID NO: 2646336 - DNA, 18 bp, Homo sapiens
cccctgcccatctgggaa

SEQ ID NO: 2646337 - DNA, 14 bp, Homo sapiens
cccctgccccgtca

SEQ ID NO: 2646338 - DNA, 17 bp, Homo sapiens
cccctgcccggctgcgg

SEQ ID NO: 2646339 - DNA, 19 bp, Homo sapiens
cccctgcccggctgcggaa

SEQ ID NO: 2646340 - DNA, 14 bp, Homo sapiens
cccctgccctcgtg

SEQ ID NO: 2646341 - DNA, 15 bp, Homo sapiens
cccctgccctcgtgg

SEQ ID NO: 2646342 - DNA, 21 bp, Homo sapiens
cccctgccctcgtggccagcc

SEQ ID NO: 2646343 - DNA, 22 bp, Homo sapiens
cccctgccctcgtggccagccc

SEQ ID NO: 2646344 - DNA, 15 bp, Homo sapiens
cccctgccctgctgc

SEQ ID NO: 2646345 - DNA, 18 bp, Homo sapiens
cccctgcctccaccctct

SEQ ID NO: 2646346 - DNA, 21 bp, Homo sapiens
cccctgcctccaccctctgag

SEQ ID NO: 2646347 - DNA, 14 bp, Homo sapiens
cccctgctgcctcc

SEQ ID NO: 2646348 - DNA, 18 bp, Homo sapiens
cccctgctgcctccccaa

SEQ ID NO: 2646349 - DNA, 20 bp, Homo sapiens
cccctggaggcactgaagtg

SEQ ID NO: 2646350 - DNA, 15 bp, Homo sapiens
cccctggatgcagcc

SEQ ID NO: 2646351 - DNA, 18 bp, Homo sapiens
cccctggatgcagcctca

SEQ ID NO: 2646352 - DNA, 20 bp, Homo sapiens
cccctgggtcagtctggtgg

SEQ ID NO: 2646353 - DNA, 20 bp, Homo sapiens
cccctggtggacagtcctgg

SEQ ID NO: 2646354 - DNA, 11 bp, Homo sapiens
cccctgtgcag

SEQ ID NO: 2646355 - DNA, 20 bp, Homo sapiens
cccctgtgcagccgctgagc

SEQ ID NO: 2646356 - DNA, 11 bp, Homo sapiens
cccctgtgctc

SEQ ID NO: 2646357 - DNA, 15 bp, Homo sapiens
ccccttatccaggac

SEQ ID NO: 2646358 - DNA, 19 bp, Homo sapiens
ccccttcacttctgaccac

SEQ ID NO: 2646359 - DNA, 14 bp, Homo sapiens
ccccttccactgag

SEQ ID NO: 2646360 - DNA, 13 bp, Homo sapiens
ccccttccatgga

SEQ ID NO: 2646361 - DNA, 20 bp, Homo sapiens
ccccttccatggactttgtt

SEQ ID NO: 2646362 - DNA, 13 bp, Homo sapiens
ccccttccccact

SEQ ID NO: 2646363 - DNA, 15 bp, Homo sapiens
ccccttccccactgc

SEQ ID NO: 2646364 - DNA, 16 bp, Homo sapiens
ccccttccccatggga

SEQ ID NO: 2646365 - DNA, 19 bp, Homo sapiens
ccccttcgctcctgtgtct

SEQ ID NO: 2646366 - DNA, 21 bp, Homo sapiens
ccccttctacatttcttagac

SEQ ID NO: 2646367 - DNA, 12 bp, Homo sapiens
ccccttctccca

SEQ ID NO: 2646368 - DNA, 16 bp, Homo sapiens
ccccttctctgctcca

SEQ ID NO: 2646369 - DNA, 14 bp, Homo sapiens
ccccttgccacccc

SEQ ID NO: 2646370 - DNA, 23 bp, Homo sapiens
ccccttgcccagggctcagcctg

SEQ ID NO: 2646371 - DNA, 19 bp, Homo sapiens
ccccttgcccttgccctga

SEQ ID NO: 2646372 - DNA, 24 bp, Homo sapiens
ccccttgcccttgccctgacctcc

SEQ ID NO: 2646373 - DNA, 15 bp, Homo sapiens
ccccttgggcggctg

SEQ ID NO: 2646374 - DNA, 24 bp, Homo sapiens
cccctttcagatgtcttctgcctg

SEQ ID NO: 2646375 - DNA, 22 bp, Homo sapiens
cccctttcctggacactcagac

SEQ ID NO: 2646376 - DNA, 19 bp, Homo sapiens
cccctttttactccccttg

SEQ ID NO: 2646377 - DNA, 14 bp, Homo sapiens
cccgaatacaaaca

SEQ ID NO: 2646378 - DNA, 23 bp, Homo sapiens
cccgaatacaaacacctggactt

SEQ ID NO: 2646379 - DNA, 22 bp, Homo sapiens
cccgaatagctgggactacagg

SEQ ID NO: 2646380 - DNA, 12 bp, Homo sapiens
cccgacagaggg

SEQ ID NO: 2646381 - DNA, 13 bp, Homo sapiens
cccgagcctggct

SEQ ID NO: 2646382 - DNA, 15 bp, Homo sapiens
cccgagcctggctcc

SEQ ID NO: 2646383 - DNA, 22 bp, Homo sapiens
cccgaggacgctccctgctcca

SEQ ID NO: 2646384 - DNA, 12 bp, Homo sapiens
cccgaggcccgc

SEQ ID NO: 2646385 - DNA, 15 bp, Homo sapiens
cccgaggccttctct

SEQ ID NO: 2646386 - DNA, 20 bp, Homo sapiens
cccgaggccttctctgaagg

SEQ ID NO: 2646387 - DNA, 14 bp, Homo sapiens
cccgaggctgccca

SEQ ID NO: 2646388 - DNA, 15 bp, Homo sapiens
cccgagtagctggga

SEQ ID NO: 2646389 - DNA, 17 bp, Homo sapiens
cccgagtagctgggact

SEQ ID NO: 2646390 - DNA, 21 bp, Homo sapiens
cccgagtagctgggactacag

SEQ ID NO: 2646391 - DNA, 16 bp, Homo sapiens
cccgagtttccccaga

SEQ ID NO: 2646392 - DNA, 22 bp, Homo sapiens
cccgatgctgctttcccctgtg

SEQ ID NO: 2646393 - DNA, 17 bp, Homo sapiens
cccgcacccccaccctt

SEQ ID NO: 2646394 - DNA, 19 bp, Homo sapiens
cccgcaccccccaagctgt

SEQ ID NO: 2646395 - DNA, 15 bp, Homo sapiens
cccgccaaaagctgc

SEQ ID NO: 2646396 - DNA, 22 bp, Homo sapiens
cccgcccaggcttagtcactga

SEQ ID NO: 2646397 - DNA, 17 bp, Homo sapiens
cccgccccctgccctcc

SEQ ID NO: 2646398 - DNA, 18 bp, Homo sapiens
cccgccgcctggtactca

SEQ ID NO: 2646399 - DNA, 12 bp, Homo sapiens
cccgcctctccc

SEQ ID NO: 2646400 - DNA, 13 bp, Homo sapiens
cccgcctctcccg

SEQ ID NO: 2646401 - DNA, 12 bp, Homo sapiens
cccgcctgccag

SEQ ID NO: 2646402 - DNA, 13 bp, Homo sapiens
cccgcctgccagt

SEQ ID NO: 2646403 - DNA, 21 bp, Homo sapiens
cccttgcagttcagcaccacc

SEQ ID NO: 2646404 - DNA, 15 bp, Homo sapiens
cccttgcccagggct

SEQ ID NO: 2646405 - DNA, 21 bp, Homo sapiens
cccttgcccagggctcagcct

SEQ ID NO: 2646406 - DNA, 12 bp, Homo sapiens
cccttgccctga

SEQ ID NO: 2646407 - DNA, 20 bp, Homo sapiens
cccttgccctgacctcccag

SEQ ID NO: 2646408 - DNA, 16 bp, Homo sapiens
cccttgcccttgccct

SEQ ID NO: 2646409 - DNA, 17 bp, Homo sapiens
cccttgcccttgccctg

SEQ ID NO: 2646410 - DNA, 13 bp, Homo sapiens
cccttggaaacct

SEQ ID NO: 2646411 - DNA, 23 bp, Homo sapiens
cccttggaaacctgccctgcctg

SEQ ID NO: 2646412 - DNA, 15 bp, Homo sapiens
cccttggaggccagc

SEQ ID NO: 2646413 - DNA, 13 bp, Homo sapiens
cccttggcctcag

SEQ ID NO: 2646414 - DNA, 12 bp, Homo sapiens
cccttggcctgt

SEQ ID NO: 2646415 - DNA, 15 bp, Homo sapiens
cccttggctcaatcc

SEQ ID NO: 2646416 - DNA, 22 bp, Homo sapiens
cccttggctgtgaggcccctgg

SEQ ID NO: 2646417 - DNA, 15 bp, Homo sapiens
cccttgggttctgat

SEQ ID NO: 2646418 - DNA, 23 bp, Homo sapiens
cccttggttaggcattgtgggaa

SEQ ID NO: 2646419 - DNA, 16 bp, Homo sapiens
cccttgtggtcccacc

SEQ ID NO: 2646420 - DNA, 18 bp, Homo sapiens
cccttgtggtcccacccc

SEQ ID NO: 2646421 - DNA, 22 bp, Homo sapiens
cccttgtggtcccaccccacac

SEQ ID NO: 2646422 - DNA, 21 bp, Homo sapiens
ccctttagccaaacccttgtc

SEQ ID NO: 2646423 - DNA, 17 bp, Homo sapiens
ccctttcagatgtcttc

SEQ ID NO: 2646424 - DNA, 19 bp, Homo sapiens
ccctttcagatgtcttctg

SEQ ID NO: 2646425 - DNA, 20 bp, Homo sapiens
ccctttcagatgtcttctgc

SEQ ID NO: 2646426 - DNA, 13 bp, Homo sapiens
ccctttccttcca

SEQ ID NO: 2646427 - DNA, 14 bp, Homo sapiens
ccctttgtgctgtg

SEQ ID NO: 2646428 - DNA, 14 bp, Homo sapiens
cccttttggccccc

SEQ ID NO: 2646429 - DNA, 23 bp, Homo sapiens
ccctttttccttgtccccacact

SEQ ID NO: 2646430 - DNA, 22 bp, Homo sapiens
cccttttttggctgctgaaggc

SEQ ID NO: 2646431 - DNA, 23 bp, Homo sapiens
cccttttttggctgctgaaggct

SEQ ID NO: 2646432 - DNA, 19 bp, Homo sapiens
ccgaaagggacttggaagc

SEQ ID NO: 2646433 - DNA, 17 bp, Homo sapiens
ccgaagctctggctgaa

SEQ ID NO: 2646434 - DNA, 19 bp, Homo sapiens
ccgaagctctggctgaacc

SEQ ID NO: 2646435 - DNA, 17 bp, Homo sapiens
ccgaatagctgggacta

SEQ ID NO: 2646436 - DNA, 20 bp, Homo sapiens
ccgaatagctgggactacag

SEQ ID NO: 2646437 - DNA, 18 bp, Homo sapiens
ccgaatcccctccctgtc

SEQ ID NO: 2646438 - DNA, 23 bp, Homo sapiens
ccgaatctctttttgctttcgaa

SEQ ID NO: 2646439 - DNA, 15 bp, Homo sapiens
ccgacaaccgatgct

SEQ ID NO: 2646440 - DNA, 13 bp, Homo sapiens
ccgacagagggaa

SEQ ID NO: 2646441 - DNA, 13 bp, Homo sapiens
ccgacctcagcct

SEQ ID NO: 2646442 - DNA, 14 bp, Homo sapiens
ccgacctcagcctt

SEQ ID NO: 2646443 - DNA, 15 bp, Homo sapiens
ccgacctcagccttc

SEQ ID NO: 2646444 - DNA, 17 bp, Homo sapiens
ccgacgcgtctcctgtt

SEQ ID NO: 2646445 - DNA, 23 bp, Homo sapiens
ccgactgcacagcggcccctgca

SEQ ID NO: 2646446 - DNA, 13 bp, Homo sapiens
ccgagaagcaaga

SEQ ID NO: 2646447 - DNA, 19 bp, Homo sapiens
ccgagaagcaagaaagaaa

SEQ ID NO: 2646448 - DNA, 17 bp, Homo sapiens
ccgagaaggaagcctcc

SEQ ID NO: 2646449 - DNA, 23 bp, Homo sapiens
ccgagagagcacccctctctgca

SEQ ID NO: 2646450 - DNA, 15 bp, Homo sapiens
ccgagattgcaccac

SEQ ID NO: 2646451 - DNA, 21 bp, Homo sapiens
ccgagattgcaccactgcact

SEQ ID NO: 2646452 - DNA, 18 bp, Homo sapiens
ccgagcgctttctggaaa

SEQ ID NO: 2646453 - DNA, 23 bp, Homo sapiens
ccgagctcgtgtatcctggggct

SEQ ID NO: 2646454 - DNA, 16 bp, Homo sapiens
ccgagctgggggccat

SEQ ID NO: 2646455 - DNA, 19 bp, Homo sapiens
ccgagctgggggccatgag

SEQ ID NO: 2646456 - DNA, 13 bp, Homo sapiens
ccgaggacccaga

SEQ ID NO: 2646457 - DNA, 15 bp, Homo sapiens
ccgaggacccagacc

SEQ ID NO: 2646458 - DNA, 16 bp, Homo sapiens
ccgaggacccagaccc

SEQ ID NO: 2646459 - DNA, 11 bp, Homo sapiens
ccgaggccagt

SEQ ID NO: 2646460 - DNA, 14 bp, Homo sapiens
ccgaggccttctct

SEQ ID NO: 2646461 - DNA, 14 bp, Homo sapiens
ccgaggctggagct

SEQ ID NO: 2646462 - DNA, 17 bp, Homo sapiens
ccgaggctggagctggc

SEQ ID NO: 2646463 - DNA, 16 bp, Homo sapiens
ccgagggcgaccccgt

SEQ ID NO: 2646464 - DNA, 16 bp, Homo sapiens
ccgagggtcctggctc

SEQ ID NO: 2646465 - DNA, 17 bp, Homo sapiens
ccgagggtcctggctcc

SEQ ID NO: 2646466 - DNA, 23 bp, Homo sapiens
ccgagggtcctggctcctgaggg

SEQ ID NO: 2646467 - DNA, 13 bp, Homo sapiens
ccgatccttcctc

SEQ ID NO: 2646468 - DNA, 15 bp, Homo sapiens
ccgatgctccagcca

SEQ ID NO: 2646469 - DNA, 22 bp, Homo sapiens
ccgatgctccagccaacccctg

SEQ ID NO: 2646470 - DNA, 21 bp, Homo sapiens
ccgatgctgctttcccctgtg

SEQ ID NO: 2646471 - DNA, 13 bp, Homo sapiens
ccgattcaccctg

SEQ ID NO: 2646472 - DNA, 21 bp, Homo sapiens
ccgcaaaccccctttgtgctg

SEQ ID NO: 2646473 - DNA, 15 bp, Homo sapiens
ccgcaatacaggaac

SEQ ID NO: 2646474 - DNA, 15 bp, Homo sapiens
ccgcacccccaccct

SEQ ID NO: 2646475 - DNA, 14 bp, Homo sapiens
ccgcactcacccat

SEQ ID NO: 2646476 - DNA, 16 bp, Homo sapiens
ccgcagaagcctcccc

SEQ ID NO: 2646477 - DNA, 20 bp, Homo sapiens
ccgcagaagcctccccagct

SEQ ID NO: 2646478 - DNA, 15 bp, Homo sapiens
ccgcagacaggacca

SEQ ID NO: 2646479 - DNA, 16 bp, Homo sapiens
ccgcagacaggaccag

SEQ ID NO: 2646480 - DNA, 17 bp, Homo sapiens
ccgcagacaggaccagg

SEQ ID NO: 2646481 - DNA, 18 bp, Homo sapiens
ccgcagctcttgcccttc

SEQ ID NO: 2646482 - DNA, 15 bp, Homo sapiens
ccgcaggaagctgct

SEQ ID NO: 2646483 - DNA, 19 bp, Homo sapiens
ccgcaggaagctgctccgt

SEQ ID NO: 2646484 - DNA, 16 bp, Homo sapiens
ccgccactcctgaacc

SEQ ID NO: 2646485 - DNA, 21 bp, Homo sapiens
ccgccattctcaagccctgca

SEQ ID NO: 2646486 - DNA, 16 bp, Homo sapiens
ccgccattgccaccag

SEQ ID NO: 2646487 - DNA, 13 bp, Homo sapiens
ccgcccactgtcc

SEQ ID NO: 2646488 - DNA, 16 bp, Homo sapiens
ccgcccactgtcctgg

SEQ ID NO: 2646489 - DNA, 19 bp, Homo sapiens
ccgcccactgtcctgggcg

SEQ ID NO: 2646490 - DNA, 14 bp, Homo sapiens
ccgccctgctcctc

SEQ ID NO: 2646491 - DNA, 14 bp, Homo sapiens
ccgcctcccagcct

SEQ ID NO: 2646492 - DNA, 22 bp, Homo sapiens
ccgcctgccagtcctagctgca

SEQ ID NO: 2646493 - DNA, 16 bp, Homo sapiens
ccgcctgccctcatgg

SEQ ID NO: 2646494 - DNA, 16 bp, Homo sapiens
ccgcctggcagaactg

SEQ ID NO: 2646495 - DNA, 21 bp, Homo sapiens
ccgctaagagggagggagggc

SEQ ID NO: 2646496 - DNA, 14 bp, Homo sapiens
ccgctccccagccc

SEQ ID NO: 2646497 - DNA, 16 bp, Homo sapiens
ccgctccccagcccag

SEQ ID NO: 2646498 - DNA, 21 bp, Homo sapiens
ccgctctgcatgcggcccagc

SEQ ID NO: 2646499 - DNA, 23 bp, Homo sapiens
ccgctgagcgaggagatgctcct

SEQ ID NO: 2646500 - DNA, 11 bp, Homo sapiens
ccgctggaggt

SEQ ID NO: 2646501 - DNA, 19 bp, Homo sapiens
ccgctggaggtggggcctg

SEQ ID NO: 2646502 - DNA, 19 bp, Homo sapiens
ccgctgggctgagccccta

SEQ ID NO: 2646503 - DNA, 23 bp, Homo sapiens
ccgctttctacccagcgagccct

SEQ ID NO: 2646504 - DNA, 22 bp, Homo sapiens
ccggaagccaaacctctgtgag

SEQ ID NO: 2646505 - DNA, 17 bp, Homo sapiens
ccggacactcctagaga

SEQ ID NO: 2646506 - DNA, 18 bp, Homo sapiens
ccggagatgtagcaaaac

SEQ ID NO: 2646507 - DNA, 19 bp, Homo sapiens
ccggagattggacggcctg

SEQ ID NO: 2646508 - DNA, 20 bp, Homo sapiens
ccggagattggacggcctga

SEQ ID NO: 2646509 - DNA, 17 bp, Homo sapiens
ccggagctaacactggc

SEQ ID NO: 2646510 - DNA, 19 bp, Homo sapiens
ccggagctaacactggccc

SEQ ID NO: 2646511 - DNA, 18 bp, Homo sapiens
ccggagggtgtttatgta

SEQ ID NO: 2646512 - DNA, 15 bp, Homo sapiens
ccggagtgagaagct

SEQ ID NO: 2646513 - DNA, 16 bp, Homo sapiens
ccggattggcttgtgt

SEQ ID NO: 2646514 - DNA, 22 bp, Homo sapiens
ccggattggcttgtgtgtttca

SEQ ID NO: 2646515 - DNA, 17 bp, Homo sapiens
ccggcaaccccagttct

SEQ ID NO: 2646516 - DNA, 20 bp, Homo sapiens
ccggcaaccccagttctgct

SEQ ID NO: 2646517 - DNA, 21 bp, Homo sapiens
ccggcaaccccagttctgctc

SEQ ID NO: 2646518 - DNA, 13 bp, Homo sapiens
ccggcagaaggga

SEQ ID NO: 2646519 - DNA, 19 bp, Homo sapiens
ccggccccctggtctctgg

SEQ ID NO: 2646520 - DNA, 14 bp, Homo sapiens
ccggcccctgctgg

SEQ ID NO: 2646521 - DNA, 12 bp, Homo sapiens
ccggccctgggg

SEQ ID NO: 2646522 - DNA, 15 bp, Homo sapiens
ccggcctctctggcc

SEQ ID NO: 2646523 - DNA, 20 bp, Homo sapiens
ccggcctctctggcctccca

SEQ ID NO: 2646524 - DNA, 19 bp, Homo sapiens
ccggcggcccaagcccgac

SEQ ID NO: 2646525 - DNA, 19 bp, Homo sapiens
ccggcgtcagcctccagcc

SEQ ID NO: 2646526 - DNA, 17 bp, Homo sapiens
ccggctatgggggcact

SEQ ID NO: 2646527 - DNA, 22 bp, Homo sapiens
ccggctatgggggcactgagga

SEQ ID NO: 2646528 - DNA, 23 bp, Homo sapiens
ccggctatgggggcactgaggac

SEQ ID NO: 2646529 - DNA, 14 bp, Homo sapiens
ccggctccaggctc

SEQ ID NO: 2646530 - DNA, 15 bp, Homo sapiens
ccggctccaggctcc

SEQ ID NO: 2646531 - DNA, 17 bp, Homo sapiens
ccggctctttccttgct

SEQ ID NO: 2646532 - DNA, 12 bp, Homo sapiens
ccggctggaaat

SEQ ID NO: 2646533 - DNA, 20 bp, Homo sapiens
ccgggaagggggctgggaca

SEQ ID NO: 2646534 - DNA, 15 bp, Homo sapiens
ccgggcactcagaag

SEQ ID NO: 2646535 - DNA, 13 bp, Homo sapiens
ccgggccctccct

SEQ ID NO: 2646536 - DNA, 17 bp, Homo sapiens
ccgggccctcccttgga

SEQ ID NO: 2646537 - DNA, 14 bp, Homo sapiens
ccgggctctctgct

SEQ ID NO: 2646538 - DNA, 13 bp, Homo sapiens
ccgggctctgcct

SEQ ID NO: 2646539 - DNA, 15 bp, Homo sapiens
ccgggctgcctgggc

SEQ ID NO: 2646540 - DNA, 21 bp, Homo sapiens
ccggggtcctgtggcaggcag

SEQ ID NO: 2646541 - DNA, 22 bp, Homo sapiens
ccgggtcatctgtacctctgcc

SEQ ID NO: 2646542 - DNA, 17 bp, Homo sapiens
ccggtctgcaagtcaga

SEQ ID NO: 2646543 - DNA, 19 bp, Homo sapiens
ccggtctgcaagtcagagg

SEQ ID NO: 2646544 - DNA, 21 bp, Homo sapiens
ccggtctgcaagtcagaggat

SEQ ID NO: 2646545 - DNA, 17 bp, Homo sapiens
ccggtgtgcctgcagcc

SEQ ID NO: 2646546 - DNA, 18 bp, Homo sapiens
ccgtacattcaatgttta

SEQ ID NO: 2646547 - DNA, 14 bp, Homo sapiens
ccgtaccccaccct

SEQ ID NO: 2646548 - DNA, 21 bp, Homo sapiens
cctccctgttgaagctctggt

SEQ ID NO: 2646549 - DNA, 22 bp, Homo sapiens
cctccctgttgacgaagtctct

SEQ ID NO: 2646550 - DNA, 23 bp, Homo sapiens
cctccctgttgacgaagtctctt

SEQ ID NO: 2646551 - DNA, 13 bp, Homo sapiens
cctcccttagctc

SEQ ID NO: 2646552 - DNA, 16 bp, Homo sapiens
cctcccttctcttcac

SEQ ID NO: 2646553 - DNA, 22 bp, Homo sapiens
cctcccttggaaacctgccctg

SEQ ID NO: 2646554 - DNA, 17 bp, Homo sapiens
cctccctttttccttgt

SEQ ID NO: 2646555 - DNA, 22 bp, Homo sapiens
cctccgacagccccctctgccg

SEQ ID NO: 2646556 - DNA, 21 bp, Homo sapiens
cctccgagccggggagtttct

SEQ ID NO: 2646557 - DNA, 14 bp, Homo sapiens
cctccgaggccagt

SEQ ID NO: 2646558 - DNA, 15 bp, Homo sapiens
cctccgatccttcct

SEQ ID NO: 2646559 - DNA, 16 bp, Homo sapiens
cctccgccaggcgaga

SEQ ID NO: 2646560 - DNA, 14 bp, Homo sapiens
cctccgcctcttgg

SEQ ID NO: 2646561 - DNA, 12 bp, Homo sapiens
cctccggcctcc

SEQ ID NO: 2646562 - DNA, 16 bp, Homo sapiens
cctccgttgggcccca

SEQ ID NO: 2646563 - DNA, 20 bp, Homo sapiens
cctcctagggaaaagttcat

SEQ ID NO: 2646564 - DNA, 19 bp, Homo sapiens
cctcctatcagaagtttct

SEQ ID NO: 2646565 - DNA, 16 bp, Homo sapiens
cctcctcacccccagc

SEQ ID NO: 2646566 - DNA, 14 bp, Homo sapiens
cctcctcacctctg

SEQ ID NO: 2646567 - DNA, 14 bp, Homo sapiens
cctcctcactccct

SEQ ID NO: 2646568 - DNA, 13 bp, Homo sapiens
cctcctcatcccg

SEQ ID NO: 2646569 - DNA, 12 bp, Homo sapiens
cctcctcatgta

SEQ ID NO: 2646570 - DNA, 14 bp, Homo sapiens
cctcctccccactt

SEQ ID NO: 2646571 - DNA, 12 bp, Homo sapiens
cctcctccctta

SEQ ID NO: 2646572 - DNA, 16 bp, Homo sapiens
cctcctcccttagctc

SEQ ID NO: 2646573 - DNA, 14 bp, Homo sapiens
cctcctcccttttt

SEQ ID NO: 2646574 - DNA, 15 bp, Homo sapiens
cctcctccctttttc

SEQ ID NO: 2646575 - DNA, 13 bp, Homo sapiens
cctcctccttccc

SEQ ID NO: 2646576 - DNA, 19 bp, Homo sapiens
cctcctctaaggttgggca

SEQ ID NO: 2646577 - DNA, 16 bp, Homo sapiens
cctcctctcccatccc

SEQ ID NO: 2646578 - DNA, 14 bp, Homo sapiens
cctcctctgtctgc

SEQ ID NO: 2646579 - DNA, 17 bp, Homo sapiens
cctcctctgtctgccct

SEQ ID NO: 2646580 - DNA, 20 bp, Homo sapiens
cctcctgaaacttacacaca

SEQ ID NO: 2646581 - DNA, 16 bp, Homo sapiens
cctcctgacctgaggc

SEQ ID NO: 2646582 - DNA, 15 bp, Homo sapiens
cctcctgacctgtca

SEQ ID NO: 2646583 - DNA, 19 bp, Homo sapiens
cctcctgccgactcctggg

SEQ ID NO: 2646584 - DNA, 21 bp, Homo sapiens
cctcctgggccctctctgctc

SEQ ID NO: 2646585 - DNA, 15 bp, Homo sapiens
cctcctgtctctggc

SEQ ID NO: 2646586 - DNA, 19 bp, Homo sapiens
cctcctgtcttcccagggt

SEQ ID NO: 2646587 - DNA, 23 bp, Homo sapiens
cctcctgtgtgtgcgcctacagg

SEQ ID NO: 2646588 - DNA, 15 bp, Homo sapiens
cctcctgttgcaccc

SEQ ID NO: 2646589 - DNA, 18 bp, Homo sapiens
cctcctgttgcacccagc

SEQ ID NO: 2646590 - DNA, 23 bp, Homo sapiens
cctcctgttgcacccagccctgg

SEQ ID NO: 2646591 - DNA, 19 bp, Homo sapiens
cctccttccacctccctcc

SEQ ID NO: 2646592 - DNA, 14 bp, Homo sapiens
cctccttcccaaag

SEQ ID NO: 2646593 - DNA, 14 bp, Homo sapiens
cctccttccttgac

SEQ ID NO: 2646594 - DNA, 15 bp, Homo sapiens
cctccttccttgacc

SEQ ID NO: 2646595 - DNA, 18 bp, Homo sapiens
cctccttccttgaccagc

SEQ ID NO: 2646596 - DNA, 20 bp, Homo sapiens
cctccttccttgaccagcag

SEQ ID NO: 2646597 - DNA, 15 bp, Homo sapiens
cctccttctctgtct

SEQ ID NO: 2646598 - DNA, 17 bp, Homo sapiens
cctccttgcctcctgtg

SEQ ID NO: 2646599 - DNA, 18 bp, Homo sapiens
cctccttgcctcctgtgt

SEQ ID NO: 2646600 - DNA, 19 bp, Homo sapiens
cctccttgcctcctgtgta

SEQ ID NO: 2646601 - DNA, 12 bp, Homo sapiens
cctccttgggca

SEQ ID NO: 2646602 - DNA, 15 bp, Homo sapiens
cctccttggtgcctg

SEQ ID NO: 2646603 - DNA, 16 bp, Homo sapiens
cctccttgtccaccca

SEQ ID NO: 2646604 - DNA, 21 bp, Homo sapiens
cctcctttctcttctctgttc

SEQ ID NO: 2646605 - DNA, 18 bp, Homo sapiens
cctcctttgtgaggaagc

SEQ ID NO: 2646606 - DNA, 14 bp, Homo sapiens
cctcgagggcaggg

SEQ ID NO: 2646607 - DNA, 17 bp, Homo sapiens
cctcgagggcagggact

SEQ ID NO: 2646608 - DNA, 14 bp, Homo sapiens
cctcgcaagctggg

SEQ ID NO: 2646609 - DNA, 13 bp, Homo sapiens
cctcgctgccagc

SEQ ID NO: 2646610 - DNA, 14 bp, Homo sapiens
cctcgctgccagct

SEQ ID NO: 2646611 - DNA, 21 bp, Homo sapiens
cctcgctggggcagtgccctc

SEQ ID NO: 2646612 - DNA, 14 bp, Homo sapiens
cctcggagaagagc

SEQ ID NO: 2646613 - DNA, 13 bp, Homo sapiens
cctcggagcctca

SEQ ID NO: 2646614 - DNA, 14 bp, Homo sapiens
cctcggagcctcat

SEQ ID NO: 2646615 - DNA, 16 bp, Homo sapiens
cctcggagcctcatcc

SEQ ID NO: 2646616 - DNA, 23 bp, Homo sapiens
cctcggagcctcatccgaggcag

SEQ ID NO: 2646617 - DNA, 13 bp, Homo sapiens
cctcgggcccacc

SEQ ID NO: 2646618 - DNA, 18 bp, Homo sapiens
cctcgggtctcctcactc

SEQ ID NO: 2646619 - DNA, 16 bp, Homo sapiens
cctcggtgccttcctc

SEQ ID NO: 2646620 - DNA, 16 bp, Homo sapiens
cctcgtggccagcccg

SEQ ID NO: 2646621 - DNA, 18 bp, Homo sapiens
cctcgtggccagcccggc

SEQ ID NO: 2646622 - DNA, 19 bp, Homo sapiens
cctcgtggccttccccagc

SEQ ID NO: 2646623 - DNA, 22 bp, Homo sapiens
cctcgtggccttccccagcctc

SEQ ID NO: 2646624 - DNA, 13 bp, Homo sapiens
cctctaaccccag

SEQ ID NO: 2646625 - DNA, 15 bp, Homo sapiens
cctctaaccccaggc

SEQ ID NO: 2646626 - DNA, 16 bp, Homo sapiens
cctctaaccccaggcc

SEQ ID NO: 2646627 - DNA, 19 bp, Homo sapiens
cctctaaccccaggccccg

SEQ ID NO: 2646628 - DNA, 19 bp, Homo sapiens
cctctaaggttgggcaggg

SEQ ID NO: 2646629 - DNA, 24 bp, Homo sapiens
cctctacagagcttccctgactca

SEQ ID NO: 2646630 - DNA, 19 bp, Homo sapiens
cctctagaaatttttcaga

SEQ ID NO: 2646631 - DNA, 14 bp, Homo sapiens
cctctagtgccctc

SEQ ID NO: 2646632 - DNA, 15 bp, Homo sapiens
cctctagtgccctcc

SEQ ID NO: 2646633 - DNA, 17 bp, Homo sapiens
cctctcacctgtactct

SEQ ID NO: 2646634 - DNA, 16 bp, Homo sapiens
cctctcactaaacttt

SEQ ID NO: 2646635 - DNA, 13 bp, Homo sapiens
cctctcactgtct

SEQ ID NO: 2646636 - DNA, 15 bp, Homo sapiens
cctctcagagctact

SEQ ID NO: 2646637 - DNA, 16 bp, Homo sapiens
cctctcagctccaggt

SEQ ID NO: 2646638 - DNA, 14 bp, Homo sapiens
cctctcaggcatgc

SEQ ID NO: 2646639 - DNA, 20 bp, Homo sapiens
cctctcaggcatgcctgtgt

SEQ ID NO: 2646640 - DNA, 12 bp, Homo sapiens
cctctccaaggg

SEQ ID NO: 2646641 - DNA, 13 bp, Homo sapiens
cctctccaagggc

SEQ ID NO: 2646642 - DNA, 18 bp, Homo sapiens
cctctccaagggcttctg

SEQ ID NO: 2646643 - DNA, 14 bp, Homo sapiens
cctctccatcttca

SEQ ID NO: 2646644 - DNA, 19 bp, Homo sapiens
cctctccatcttcagcttc

SEQ ID NO: 2646645 - DNA, 12 bp, Homo sapiens
cctctcccatca

SEQ ID NO: 2646646 - DNA, 15 bp, Homo sapiens
cctctcccatccccc

SEQ ID NO: 2646647 - DNA, 16 bp, Homo sapiens
cctctcccatccccct

SEQ ID NO: 2646648 - DNA, 19 bp, Homo sapiens
cctctcccatccccctgcc

SEQ ID NO: 2646649 - DNA, 15 bp, Homo sapiens
cctctccccagcaag

SEQ ID NO: 2646650 - DNA, 20 bp, Homo sapiens
cctctccccagcaagtgaga

SEQ ID NO: 2646651 - DNA, 18 bp, Homo sapiens
cctctcccctaccactgt

SEQ ID NO: 2646652 - DNA, 14 bp, Homo sapiens
cctctcctttgtat

SEQ ID NO: 2646653 - DNA, 16 bp, Homo sapiens
cctctcctttgtatat

SEQ ID NO: 2646654 - DNA, 12 bp, Homo sapiens
cctctctcactc

SEQ ID NO: 2646655 - DNA, 13 bp, Homo sapiens
cctctctcactcc

SEQ ID NO: 2646656 - DNA, 15 bp, Homo sapiens
cctctctcactcctt

SEQ ID NO: 2646657 - DNA, 12 bp, Homo sapiens
cctctctcccag

SEQ ID NO: 2646658 - DNA, 12 bp, Homo sapiens
cctctctctccg

SEQ ID NO: 2646659 - DNA, 17 bp, Homo sapiens
cctctctctgactctca

SEQ ID NO: 2646660 - DNA, 12 bp, Homo sapiens
cctctctgctct

SEQ ID NO: 2646661 - DNA, 19 bp, Homo sapiens
cctctctggcctcccaccc

SEQ ID NO: 2646662 - DNA, 23 bp, Homo sapiens
cctctcttgcacccgcctctccc

SEQ ID NO: 2646663 - DNA, 18 bp, Homo sapiens
cctctgaaaacggccctc

SEQ ID NO: 2646664 - DNA, 20 bp, Homo sapiens
cctctgaaaacggccctctt

SEQ ID NO: 2646665 - DNA, 16 bp, Homo sapiens
cctctgacacacagct

SEQ ID NO: 2646666 - DNA, 21 bp, Homo sapiens
cctctgacacacagctctgtc

SEQ ID NO: 2646667 - DNA, 16 bp, Homo sapiens
cctctgacctgcactg

SEQ ID NO: 2646668 - DNA, 15 bp, Homo sapiens
cctctgacctgcagg

SEQ ID NO: 2646669 - DNA, 19 bp, Homo sapiens
cctctgacctgcaggccaa

SEQ ID NO: 2646670 - DNA, 16 bp, Homo sapiens
cctctgactcagggct

SEQ ID NO: 2646671 - DNA, 19 bp, Homo sapiens
cctctgactcagggctcct

SEQ ID NO: 2646672 - DNA, 19 bp, Homo sapiens
cctctgagaattccaagga

SEQ ID NO: 2646673 - DNA, 14 bp, Homo sapiens
cctctgagctttgc

SEQ ID NO: 2646674 - DNA, 15 bp, Homo sapiens
cctctgagctttgca

SEQ ID NO: 2646675 - DNA, 17 bp, Homo sapiens
cctctgaggctgtagga

SEQ ID NO: 2646676 - DNA, 20 bp, Homo sapiens
cctctgagggaaagcccaga

SEQ ID NO: 2646677 - DNA, 21 bp, Homo sapiens
cctctgagggaaagcccagaa

SEQ ID NO: 2646678 - DNA, 19 bp, Homo sapiens
cctctgatacccagagcat

SEQ ID NO: 2646679 - DNA, 14 bp, Homo sapiens
cctctgatacctca

SEQ ID NO: 2646680 - DNA, 15 bp, Homo sapiens
cctctgatacctcaa

SEQ ID NO: 2646681 - DNA, 11 bp, Homo sapiens
cctctgcacaa

SEQ ID NO: 2646682 - DNA, 19 bp, Homo sapiens
cctctgcactcccctgctg

SEQ ID NO: 2646683 - DNA, 22 bp, Homo sapiens
cctctgcactcccctgctgggt

SEQ ID NO: 2646684 - DNA, 23 bp, Homo sapiens
cctctgccagaagatcccctcag

SEQ ID NO: 2646685 - DNA, 13 bp, Homo sapiens
cctctgcccactc

SEQ ID NO: 2646686 - DNA, 16 bp, Homo sapiens
cctctgcccactccct

SEQ ID NO: 2646687 - DNA, 20 bp, Homo sapiens
cctctgcccactccctgcaa

SEQ ID NO: 2646688 - DNA, 11 bp, Homo sapiens
cctctgcccag

SEQ ID NO: 2646689 - DNA, 14 bp, Homo sapiens
cctctgcccagctt

SEQ ID NO: 2646690 - DNA, 11 bp, Homo sapiens
cctctgcctca

SEQ ID NO: 2646691 - DNA, 15 bp, Homo sapiens
cctctgcctgtccct

SEQ ID NO: 2646692 - DNA, 17 bp, Homo sapiens
cctctgcctgtccctct

SEQ ID NO: 2646693 - DNA, 19 bp, Homo sapiens
cctctgcctgtccctctca

SEQ ID NO: 2646694 - DNA, 22 bp, Homo sapiens
cctctgcctgtccctctcaggc

SEQ ID NO: 2646695 - DNA, 12 bp, Homo sapiens
cctggagggcta

SEQ ID NO: 2646696 - DNA, 19 bp, Homo sapiens
cctggagggctagaaccta

SEQ ID NO: 2646697 - DNA, 20 bp, Homo sapiens
cctggagggctagaacctag

SEQ ID NO: 2646698 - DNA, 21 bp, Homo sapiens
cctggagggctagaacctgga

SEQ ID NO: 2646699 - DNA, 22 bp, Homo sapiens
cctggagggctagaacctggag

SEQ ID NO: 2646700 - DNA, 23 bp, Homo sapiens
cctggagggctagaacctggaga

SEQ ID NO: 2646701 - DNA, 18 bp, Homo sapiens
cctggagggctagaactg

SEQ ID NO: 2646702 - DNA, 22 bp, Homo sapiens
cctggaggggctagaacctaga

SEQ ID NO: 2646703 - DNA, 19 bp, Homo sapiens
cctggagtgtggctgagga

SEQ ID NO: 2646704 - DNA, 21 bp, Homo sapiens
cctggagtgtggctgaggagg

SEQ ID NO: 2646705 - DNA, 19 bp, Homo sapiens
cctggatctccccactcta

SEQ ID NO: 2646706 - DNA, 13 bp, Homo sapiens
cctggatgcagcc

SEQ ID NO: 2646707 - DNA, 17 bp, Homo sapiens
cctggatgcagcctcac

SEQ ID NO: 2646708 - DNA, 19 bp, Homo sapiens
cctggcaaagggagcagaa

SEQ ID NO: 2646709 - DNA, 23 bp, Homo sapiens
cctggcaaagggagcagaactga

SEQ ID NO: 2646710 - DNA, 19 bp, Homo sapiens
cctggcaatagtgtgttct

SEQ ID NO: 2646711 - DNA, 13 bp, Homo sapiens
cctggcacacatc

SEQ ID NO: 2646712 - DNA, 23 bp, Homo sapiens
cctggcacccggcccctgctggt

SEQ ID NO: 2646713 - DNA, 23 bp, Homo sapiens
cctggcactaacgttgagcccct

SEQ ID NO: 2646714 - DNA, 12 bp, Homo sapiens
cctggcactgct

SEQ ID NO: 2646715 - DNA, 13 bp, Homo sapiens
cctggcactgctt

SEQ ID NO: 2646716 - DNA, 16 bp, Homo sapiens
cctggcactgcttcca

SEQ ID NO: 2646717 - DNA, 21 bp, Homo sapiens
cctggcactgcttccagtgag

SEQ ID NO: 2646718 - DNA, 20 bp, Homo sapiens
cctggcagaactgagctcct

SEQ ID NO: 2646719 - DNA, 22 bp, Homo sapiens
cctggcaggatgaccctgcgaa

SEQ ID NO: 2646720 - DNA, 19 bp, Homo sapiens
cctggcaggttagaaccta

SEQ ID NO: 2646721 - DNA, 12 bp, Homo sapiens
cctggccacctg

SEQ ID NO: 2646722 - DNA, 16 bp, Homo sapiens
cctggccacctgaggt

SEQ ID NO: 2646723 - DNA, 17 bp, Homo sapiens
cctggccacctgaggtg

SEQ ID NO: 2646724 - DNA, 20 bp, Homo sapiens
cctggccagatgcaccagcc

SEQ ID NO: 2646725 - DNA, 15 bp, Homo sapiens
cctggccaggagctc

SEQ ID NO: 2646726 - DNA, 18 bp, Homo sapiens
cctggccaggagctcttc

SEQ ID NO: 2646727 - DNA, 20 bp, Homo sapiens
cctggccaggagctcttcag

SEQ ID NO: 2646728 - DNA, 22 bp, Homo sapiens
cctggccaggagctcttcaggc

SEQ ID NO: 2646729 - DNA, 19 bp, Homo sapiens
cctggccagggcctggaag

SEQ ID NO: 2646730 - DNA, 20 bp, Homo sapiens
cctggccagggcctggaaga

SEQ ID NO: 2646731 - DNA, 13 bp, Homo sapiens
cctggcccactgc

SEQ ID NO: 2646732 - DNA, 21 bp, Homo sapiens
cctggcccagcggcccctccc

SEQ ID NO: 2646733 - DNA, 21 bp, Homo sapiens
cctggcccccaccctctgcca

SEQ ID NO: 2646734 - DNA, 14 bp, Homo sapiens
cctggcccctcagg

SEQ ID NO: 2646735 - DNA, 16 bp, Homo sapiens
cctggccctgaggtgt

SEQ ID NO: 2646736 - DNA, 22 bp, Homo sapiens
cctggcctagcatacgtacaca

SEQ ID NO: 2646737 - DNA, 13 bp, Homo sapiens
cctggcctccggc

SEQ ID NO: 2646738 - DNA, 22 bp, Homo sapiens
cctggcctccggcgtcagcctc

SEQ ID NO: 2646739 - DNA, 24 bp, Homo sapiens
cctggcctccggcgtcagcctcca

SEQ ID NO: 2646740 - DNA, 13 bp, Homo sapiens
cctggcctggcac

SEQ ID NO: 2646741 - DNA, 15 bp, Homo sapiens
cctggcctttcatat

SEQ ID NO: 2646742 - DNA, 20 bp, Homo sapiens
cctggcgactgcccctgcct

SEQ ID NO: 2646743 - DNA, 13 bp, Homo sapiens
cctggctcagagc

SEQ ID NO: 2646744 - DNA, 17 bp, Homo sapiens
cctggctcagagccagt

SEQ ID NO: 2646745 - DNA, 22 bp, Homo sapiens
cctggctccaaaccctcgaggc

SEQ ID NO: 2646746 - DNA, 14 bp, Homo sapiens
cctggctcccatga

SEQ ID NO: 2646747 - DNA, 23 bp, Homo sapiens
cctggctcctgaggggcatctgc

SEQ ID NO: 2646748 - DNA, 16 bp, Homo sapiens
cctggctctcagaagg

SEQ ID NO: 2646749 - DNA, 13 bp, Homo sapiens
cctggctgaagga

SEQ ID NO: 2646750 - DNA, 14 bp, Homo sapiens
cctggctgaaggac

SEQ ID NO: 2646751 - DNA, 19 bp, Homo sapiens
cctggctgaaggactgtga

SEQ ID NO: 2646752 - DNA, 13 bp, Homo sapiens
cctggctgccctg

SEQ ID NO: 2646753 - DNA, 15 bp, Homo sapiens
cctggctgccctggc

SEQ ID NO: 2646754 - DNA, 16 bp, Homo sapiens
cctggcttctggagcc

SEQ ID NO: 2646755 - DNA, 20 bp, Homo sapiens
cctggcttctggagcccttg

SEQ ID NO: 2646756 - DNA, 17 bp, Homo sapiens
cctgggaaatattccct

SEQ ID NO: 2646757 - DNA, 18 bp, Homo sapiens
cctgggagaacctcaggc

SEQ ID NO: 2646758 - DNA, 16 bp, Homo sapiens
cctgggagtgagctgg

SEQ ID NO: 2646759 - DNA, 18 bp, Homo sapiens
cctgggagtgagctggtt

SEQ ID NO: 2646760 - DNA, 23 bp, Homo sapiens
cctgggagttttgtattcatctt

SEQ ID NO: 2646761 - DNA, 13 bp, Homo sapiens
cctgggcaaagcc

SEQ ID NO: 2646762 - DNA, 23 bp, Homo sapiens
cctgggcaaatgaatggctcact

SEQ ID NO: 2646763 - DNA, 20 bp, Homo sapiens
cctgggcacctggggagtgg

SEQ ID NO: 2646764 - DNA, 14 bp, Homo sapiens
cctgggcattgctt

SEQ ID NO: 2646765 - DNA, 16 bp, Homo sapiens
cctgggcattgctttc

SEQ ID NO: 2646766 - DNA, 16 bp, Homo sapiens
cctgggcgccctggaa

SEQ ID NO: 2646767 - DNA, 15 bp, Homo sapiens
cctgggctcggaggc

SEQ ID NO: 2646768 - DNA, 18 bp, Homo sapiens
cctgggctgttggcactc

SEQ ID NO: 2646769 - DNA, 20 bp, Homo sapiens
cctgggctgttggcactcac

SEQ ID NO: 2646770 - DNA, 21 bp, Homo sapiens
cctgggctgttggcactcaca

SEQ ID NO: 2646771 - DNA, 22 bp, Homo sapiens
cctgggctgttggcactcacag

SEQ ID NO: 2646772 - DNA, 14 bp, Homo sapiens
cctggggagccagg

SEQ ID NO: 2646773 - DNA, 18 bp, Homo sapiens
cctggggagtgggacaga

SEQ ID NO: 2646774 - DNA, 23 bp, Homo sapiens
cctggggagtgggacagagtctg

SEQ ID NO: 2646775 - DNA, 12 bp, Homo sapiens
cctggggcctcg

SEQ ID NO: 2646776 - DNA, 13 bp, Homo sapiens
cctggggcctctt

SEQ ID NO: 2646777 - DNA, 21 bp, Homo sapiens
cctggggcctggacctgcctc

SEQ ID NO: 2646778 - DNA, 13 bp, Homo sapiens
cctggggctccct

SEQ ID NO: 2646779 - DNA, 20 bp, Homo sapiens
cctggggctcctttctccag

SEQ ID NO: 2646780 - DNA, 15 bp, Homo sapiens
cctgggggtgccagg

SEQ ID NO: 2646781 - DNA, 21 bp, Homo sapiens
cctgggggttctttcttcctc

SEQ ID NO: 2646782 - DNA, 21 bp, Homo sapiens
cctggggtggggatagggagc

SEQ ID NO: 2646783 - DNA, 22 bp, Homo sapiens
cctgggtaaatgcagcgtgaag

SEQ ID NO: 2646784 - DNA, 17 bp, Homo sapiens
cctgggtctgtgtctct

SEQ ID NO: 2646785 - DNA, 17 bp, Homo sapiens
cctgggtgggtggtggg

SEQ ID NO: 2646786 - DNA, 14 bp, Homo sapiens
cctgggtggtctgc

SEQ ID NO: 2646787 - DNA, 18 bp, Homo sapiens
cctgggtggtctgcaggc

SEQ ID NO: 2646788 - DNA, 20 bp, Homo sapiens
cctgggtggtctgcaggcag

SEQ ID NO: 2646789 - DNA, 22 bp, Homo sapiens
cctgggtggtctgcaggcaggg

SEQ ID NO: 2646790 - DNA, 13 bp, Homo sapiens
cctgggttccctt

SEQ ID NO: 2646791 - DNA, 23 bp, Homo sapiens
cctgggttttgtattctctgagc

SEQ ID NO: 2646792 - DNA, 13 bp, Homo sapiens
cctggtacccagc

SEQ ID NO: 2646793 - DNA, 15 bp, Homo sapiens
cctggtacccagcca

SEQ ID NO: 2646794 - DNA, 14 bp, Homo sapiens
cctggtccagggaa

SEQ ID NO: 2646795 - DNA, 22 bp, Homo sapiens
cctggtccagggaagctggccg

SEQ ID NO: 2646796 - DNA, 18 bp, Homo sapiens
cctggtccttccaggccc

SEQ ID NO: 2646797 - DNA, 23 bp, Homo sapiens
cctggtctcagcagcgaccaccc

SEQ ID NO: 2646798 - DNA, 16 bp, Homo sapiens
cctggtctttcctctg

SEQ ID NO: 2646799 - DNA, 13 bp, Homo sapiens
cctggtgctggat

SEQ ID NO: 2646800 - DNA, 18 bp, Homo sapiens
cctggtggacagtcctgg

SEQ ID NO: 2646801 - DNA, 19 bp, Homo sapiens
cctggtggacagtcctggg

SEQ ID NO: 2646802 - DNA, 22 bp, Homo sapiens
cctggtggagaaagcactgacc

SEQ ID NO: 2646803 - DNA, 12 bp, Homo sapiens
cctggtggcagc

SEQ ID NO: 2646804 - DNA, 14 bp, Homo sapiens
cctggtggcagctc

SEQ ID NO: 2646805 - DNA, 16 bp, Homo sapiens
cctggtggcagctcac

SEQ ID NO: 2646806 - DNA, 21 bp, Homo sapiens
cctggtggcagctcacctctc

SEQ ID NO: 2646807 - DNA, 18 bp, Homo sapiens
cctggtggcagctgcggt

SEQ ID NO: 2646808 - DNA, 14 bp, Homo sapiens
cctggtgggcctcc

SEQ ID NO: 2646809 - DNA, 20 bp, Homo sapiens
cctggtgtgaaggtcctgct

SEQ ID NO: 2646810 - DNA, 19 bp, Homo sapiens
cctggtgtttctagcactg

SEQ ID NO: 2646811 - DNA, 13 bp, Homo sapiens
cctggttcccgtt

SEQ ID NO: 2646812 - DNA, 19 bp, Homo sapiens
cctgtaaaaaaaaaaaagt

SEQ ID NO: 2646813 - DNA, 18 bp, Homo sapiens
cctgtaacacaagccaca

SEQ ID NO: 2646814 - DNA, 22 bp, Homo sapiens
cctgtaacacaagccacagaag

SEQ ID NO: 2646815 - DNA, 23 bp, Homo sapiens
cctgtaacacaagccacagaagc

SEQ ID NO: 2646816 - DNA, 16 bp, Homo sapiens
cctgtaacctcttcag

SEQ ID NO: 2646817 - DNA, 13 bp, Homo sapiens
cctgtaatcccag

SEQ ID NO: 2646818 - DNA, 17 bp, Homo sapiens
cctgtaatcccagcact

SEQ ID NO: 2646819 - DNA, 21 bp, Homo sapiens
cctgtacaatatttaaaattt

SEQ ID NO: 2646820 - DNA, 14 bp, Homo sapiens
cctgtaccccagca

SEQ ID NO: 2646821 - DNA, 17 bp, Homo sapiens
cctgtaccccagcactt

SEQ ID NO: 2646822 - DNA, 10 bp, Homo sapiens
cctgtacctc

SEQ ID NO: 2646823 - DNA, 12 bp, Homo sapiens
cctgtacctctt

SEQ ID NO: 2646824 - DNA, 22 bp, Homo sapiens
cctgtaccttttgaggagcccc

SEQ ID NO: 2646825 - DNA, 17 bp, Homo sapiens
cctgtactgttctgtgt

SEQ ID NO: 2646826 - DNA, 20 bp, Homo sapiens
cctgtactgttctgtgtctt

SEQ ID NO: 2646827 - DNA, 15 bp, Homo sapiens
cctgtagagtgggag

SEQ ID NO: 2646828 - DNA, 23 bp, Homo sapiens
cctgtagagtgggagctgagtgg

SEQ ID NO: 2646829 - DNA, 13 bp, Homo sapiens
cctgtagcatctt

SEQ ID NO: 2646830 - DNA, 15 bp, Homo sapiens
cctgtagtcccagct

SEQ ID NO: 2646831 - DNA, 13 bp, Homo sapiens
cctgtagtcctag

SEQ ID NO: 2646832 - DNA, 21 bp, Homo sapiens
cctgtagttgcgtggactctg

SEQ ID NO: 2646833 - DNA, 18 bp, Homo sapiens
cctgtcatgcccccctca

SEQ ID NO: 2646834 - DNA, 16 bp, Homo sapiens
cctgtccacacccagc

SEQ ID NO: 2646835 - DNA, 18 bp, Homo sapiens
cctgtccacacccagctc

SEQ ID NO: 2646836 - DNA, 23 bp, Homo sapiens
cctgtcccatggacactccagtg

SEQ ID NO: 2646837 - DNA, 14 bp, Homo sapiens
cctgtcccccagct

SEQ ID NO: 2646838 - DNA, 15 bp, Homo sapiens
cctgtcccccagctc

SEQ ID NO: 2646839 - DNA, 16 bp, Homo sapiens
cctttgtgaggaagcc

SEQ ID NO: 2646840 - DNA, 13 bp, Homo sapiens
cctttgtgctgtg

SEQ ID NO: 2646841 - DNA, 19 bp, Homo sapiens
cctttgtttttatgaagaa

SEQ ID NO: 2646842 - DNA, 20 bp, Homo sapiens
cctttgtttttatgaagaaa

SEQ ID NO: 2646843 - DNA, 11 bp, Homo sapiens
ccttttatagc

SEQ ID NO: 2646844 - DNA, 22 bp, Homo sapiens
ccttttcttttctaccctagcc

SEQ ID NO: 2646845 - DNA, 23 bp, Homo sapiens
ccttttgaagtagtttgtataac

SEQ ID NO: 2646846 - DNA, 16 bp, Homo sapiens
ccttttgaggagcccc

SEQ ID NO: 2646847 - DNA, 21 bp, Homo sapiens
ccttttgaggagccccagcta

SEQ ID NO: 2646848 - DNA, 14 bp, Homo sapiens
ccttttgcacccct

SEQ ID NO: 2646849 - DNA, 16 bp, Homo sapiens
ccttttgcacccctcc

SEQ ID NO: 2646850 - DNA, 19 bp, Homo sapiens
ccttttgcggatgggaggg

SEQ ID NO: 2646851 - DNA, 20 bp, Homo sapiens
ccttttggcccccgagctgg

SEQ ID NO: 2646852 - DNA, 19 bp, Homo sapiens
ccttttgtaccatggtgtg

SEQ ID NO: 2646853 - DNA, 22 bp, Homo sapiens
cctttttcatatgttgctcagt

SEQ ID NO: 2646854 - DNA, 17 bp, Homo sapiens
cctttttccttgtcccc

SEQ ID NO: 2646855 - DNA, 14 bp, Homo sapiens
cctttttctccagc

SEQ ID NO: 2646856 - DNA, 16 bp, Homo sapiens
ccttttttaaaaatgc

SEQ ID NO: 2646857 - DNA, 18 bp, Homo sapiens
ccttttttaagatttttc

SEQ ID NO: 2646858 - DNA, 19 bp, Homo sapiens
ccttttttaagatttttct

SEQ ID NO: 2646859 - DNA, 21 bp, Homo sapiens
ccttttttagagttgatacta

SEQ ID NO: 2646860 - DNA, 15 bp, Homo sapiens
ccttttttggctgct

SEQ ID NO: 2646861 - DNA, 22 bp, Homo sapiens
cgaaaaccaggccttatctcca

SEQ ID NO: 2646862 - DNA, 22 bp, Homo sapiens
cgaaaagttggtgtcaatgaat

SEQ ID NO: 2646863 - DNA, 14 bp, Homo sapiens
cgaaaccccatctc

SEQ ID NO: 2646864 - DNA, 12 bp, Homo sapiens
cgaaagaacagt

SEQ ID NO: 2646865 - DNA, 20 bp, Homo sapiens
cgaaaggatgaaagtgacca

SEQ ID NO: 2646866 - DNA, 22 bp, Homo sapiens
cgaaatgttattttttaattat

SEQ ID NO: 2646867 - DNA, 14 bp, Homo sapiens
cgaaccaatatttg

SEQ ID NO: 2646868 - DNA, 15 bp, Homo sapiens
cgaacctcctctgtg

SEQ ID NO: 2646869 - DNA, 13 bp, Homo sapiens
cgaagctcagccc

SEQ ID NO: 2646870 - DNA, 17 bp, Homo sapiens
cgaagctcagcccaccc

SEQ ID NO: 2646871 - DNA, 18 bp, Homo sapiens
cgaagctcagcccacccc

SEQ ID NO: 2646872 - DNA, 12 bp, Homo sapiens
cgaagctctggc

SEQ ID NO: 2646873 - DNA, 13 bp, Homo sapiens
cgaaggggccctg

SEQ ID NO: 2646874 - DNA, 13 bp, Homo sapiens
cgaatagctggga

SEQ ID NO: 2646875 - DNA, 14 bp, Homo sapiens
cgaatagctgggac

SEQ ID NO: 2646876 - DNA, 21 bp, Homo sapiens
cgaatattatgcccagtttct

SEQ ID NO: 2646877 - DNA, 15 bp, Homo sapiens
cgaatgatctttctt

SEQ ID NO: 2646878 - DNA, 13 bp, Homo sapiens
cgaatgtgcaggt

SEQ ID NO: 2646879 - DNA, 21 bp, Homo sapiens
cgaatgtgcaggtttgttaca

SEQ ID NO: 2646880 - DNA, 16 bp, Homo sapiens
cgaattaatagctttt

SEQ ID NO: 2646881 - DNA, 22 bp, Homo sapiens
cgaattaatagcttttattgta

SEQ ID NO: 2646882 - DNA, 18 bp, Homo sapiens
cgacaaccgatgctccag

SEQ ID NO: 2646883 - DNA, 15 bp, Homo sapiens
cgacagccccctctg

SEQ ID NO: 2646884 - DNA, 15 bp, Homo sapiens
cgacagtgagactct

SEQ ID NO: 2646885 - DNA, 14 bp, Homo sapiens
cgaccacagggtct

SEQ ID NO: 2646886 - DNA, 23 bp, Homo sapiens
cgaccacagggtctgcactctaa

SEQ ID NO: 2646887 - DNA, 15 bp, Homo sapiens
cgaccacccctgcct

SEQ ID NO: 2646888 - DNA, 23 bp, Homo sapiens
cgaccacccctgcctccaccctc

SEQ ID NO: 2646889 - DNA, 12 bp, Homo sapiens
cgaccacctgcc

SEQ ID NO: 2646890 - DNA, 23 bp, Homo sapiens
cgaccagacaccttgacagggca

SEQ ID NO: 2646891 - DNA, 15 bp, Homo sapiens
cgaccagagccccac

SEQ ID NO: 2646892 - DNA, 19 bp, Homo sapiens
cgaccccgtcacagcctca

SEQ ID NO: 2646893 - DNA, 20 bp, Homo sapiens
cgacccttgccgtctacctg

SEQ ID NO: 2646894 - DNA, 13 bp, Homo sapiens
cgaccgccccctc

SEQ ID NO: 2646895 - DNA, 12 bp, Homo sapiens
cgacctcagcct

SEQ ID NO: 2646896 - DNA, 20 bp, Homo sapiens
cgacctctccatcttcagct

SEQ ID NO: 2646897 - DNA, 11 bp, Homo sapiens
cgactcaggat

SEQ ID NO: 2646898 - DNA, 18 bp, Homo sapiens
cgactctatagactctag

SEQ ID NO: 2646899 - DNA, 17 bp, Homo sapiens
cgactgccatcttggac

SEQ ID NO: 2646900 - DNA, 11 bp, Homo sapiens
cgactgtctcc

SEQ ID NO: 2646901 - DNA, 15 bp, Homo sapiens
cgagaagcaagaaag

SEQ ID NO: 2646902 - DNA, 15 bp, Homo sapiens
cgagaccagcctggc

SEQ ID NO: 2646903 - DNA, 13 bp, Homo sapiens
cgagaccagtctg

SEQ ID NO: 2646904 - DNA, 22 bp, Homo sapiens
cgagaggggaagagtgtactgg

SEQ ID NO: 2646905 - DNA, 20 bp, Homo sapiens
cgagatcacgccactgcact

SEQ ID NO: 2646906 - DNA, 15 bp, Homo sapiens
cgagcaaagatcaaa

SEQ ID NO: 2646907 - DNA, 20 bp, Homo sapiens
cgagcaaagatcaaaataaa

SEQ ID NO: 2646908 - DNA, 13 bp, Homo sapiens
cgagcacctccac

SEQ ID NO: 2646909 - DNA, 18 bp, Homo sapiens
cgagcaggctactgtcag

SEQ ID NO: 2646910 - DNA, 21 bp, Homo sapiens
cgagcagtcctgcctcagcct

SEQ ID NO: 2646911 - DNA, 14 bp, Homo sapiens
cgagcatgcctgga

SEQ ID NO: 2646912 - DNA, 18 bp, Homo sapiens
cgagccatgatgtggagt

SEQ ID NO: 2646913 - DNA, 17 bp, Homo sapiens
cgagccgggcctggggc

SEQ ID NO: 2646914 - DNA, 22 bp, Homo sapiens
cgagccggggagtttctttcct

SEQ ID NO: 2646915 - DNA, 19 bp, Homo sapiens
cgagcctctgtcactgcag

SEQ ID NO: 2646916 - DNA, 23 bp, Homo sapiens
cgagcctctgtcactgcaggcac

SEQ ID NO: 2646917 - DNA, 21 bp, Homo sapiens
cgagctcgtgtatcctggggc

SEQ ID NO: 2646918 - DNA, 15 bp, Homo sapiens
cgagctggtgcatta

SEQ ID NO: 2646919 - DNA, 11 bp, Homo sapiens
cgaggaagccc

SEQ ID NO: 2646920 - DNA, 14 bp, Homo sapiens
cgaggacccagacc

SEQ ID NO: 2646921 - DNA, 19 bp, Homo sapiens
cgaggccagtacctttcca

SEQ ID NO: 2646922 - DNA, 20 bp, Homo sapiens
cgaggccctcgggcccagcc

SEQ ID NO: 2646923 - DNA, 19 bp, Homo sapiens
cgaggccttctctgaagga

SEQ ID NO: 2646924 - DNA, 22 bp, Homo sapiens
cgaggctgcccactatggtcat

SEQ ID NO: 2646925 - DNA, 16 bp, Homo sapiens
cgaggggctcaggaaa

SEQ ID NO: 2646926 - DNA, 17 bp, Homo sapiens
cgaggggctcaggaaaa

SEQ ID NO: 2646927 - DNA, 20 bp, Homo sapiens
cgaggtagagtttgaaggag

SEQ ID NO: 2646928 - DNA, 12 bp, Homo sapiens
cgagtcactgcc

SEQ ID NO: 2646929 - DNA, 14 bp, Homo sapiens
cgagtcactgcctc

SEQ ID NO: 2646930 - DNA, 18 bp, Homo sapiens
cgagtcactgcctctccc

SEQ ID NO: 2646931 - DNA, 18 bp, Homo sapiens
cgagtgtgtgcatgtgtg

SEQ ID NO: 2646932 - DNA, 22 bp, Homo sapiens
cgagttgtggaaagcctctgct

SEQ ID NO: 2646933 - DNA, 14 bp, Homo sapiens
cgagtttccccaga

SEQ ID NO: 2646934 - DNA, 17 bp, Homo sapiens
cgagtttggtccctggg

SEQ ID NO: 2646935 - DNA, 19 bp, Homo sapiens
cgatcggggcactgcaggg

SEQ ID NO: 2646936 - DNA, 20 bp, Homo sapiens
cgatgctccagccaacccct

SEQ ID NO: 2646937 - DNA, 23 bp, Homo sapiens
cgatgctccagccaacccctgtg

SEQ ID NO: 2646938 - DNA, 20 bp, Homo sapiens
cgatgctgctttcccctgtg

SEQ ID NO: 2646939 - DNA, 21 bp, Homo sapiens
cgatgggcccaattcttacaa

SEQ ID NO: 2646940 - DNA, 18 bp, Homo sapiens
cgatgtaggcattctgga

SEQ ID NO: 2646941 - DNA, 20 bp, Homo sapiens
cgatgtatgcagctatctgg

SEQ ID NO: 2646942 - DNA, 23 bp, Homo sapiens
cgatgtggaaaaatgagagaagg

SEQ ID NO: 2646943 - DNA, 13 bp, Homo sapiens
cgattcttctgct

SEQ ID NO: 2646944 - DNA, 14 bp, Homo sapiens
cgatttgtcccagg

SEQ ID NO: 2646945 - DNA, 16 bp, Homo sapiens
cgcaaaccacactgga

SEQ ID NO: 2646946 - DNA, 20 bp, Homo sapiens
cgcaaaccccctttgtgctg

SEQ ID NO: 2646947 - DNA, 11 bp, Homo sapiens
cgcaatgtgac

SEQ ID NO: 2646948 - DNA, 16 bp, Homo sapiens
cgcacaaggctgacca

SEQ ID NO: 2646949 - DNA, 10 bp, Homo sapiens
cgcacacaca

SEQ ID NO: 2646950 - DNA, 12 bp, Homo sapiens
cgcacctcccat

SEQ ID NO: 2646951 - DNA, 17 bp, Homo sapiens
cgcacctgccccctggt

SEQ ID NO: 2646952 - DNA, 11 bp, Homo sapiens
cgcacgcacac

SEQ ID NO: 2646953 - DNA, 13 bp, Homo sapiens
cgcacgcacacac

SEQ ID NO: 2646954 - DNA, 16 bp, Homo sapiens
cgcactccatgagcac

SEQ ID NO: 2646955 - DNA, 12 bp, Homo sapiens
cgcagagaggcc

SEQ ID NO: 2646956 - DNA, 13 bp, Homo sapiens
cgcagccaaggcc

SEQ ID NO: 2646957 - DNA, 19 bp, Homo sapiens
cgcagccctagagcctgcc

SEQ ID NO: 2646958 - DNA, 17 bp, Homo sapiens
cgcagctcttgcccttc

SEQ ID NO: 2646959 - DNA, 19 bp, Homo sapiens
cgcagctcttgcccttccc

SEQ ID NO: 2646960 - DNA, 15 bp, Homo sapiens
cgcaggaactcccag

SEQ ID NO: 2646961 - DNA, 18 bp, Homo sapiens
cgcaggaactcccagcaa

SEQ ID NO: 2646962 - DNA, 12 bp, Homo sapiens
cgcaggaagctg

SEQ ID NO: 2646963 - DNA, 18 bp, Homo sapiens
cgcaggcccccaggtgcc

SEQ ID NO: 2646964 - DNA, 22 bp, Homo sapiens
cgcagtcgtcgcacagtctctc

SEQ ID NO: 2646965 - DNA, 22 bp, Homo sapiens
cgcatggagtgtgtattgttcc

SEQ ID NO: 2646966 - DNA, 13 bp, Homo sapiens
cgccaaggctggg

SEQ ID NO: 2646967 - DNA, 16 bp, Homo sapiens
cgccaaggctggggga

SEQ ID NO: 2646968 - DNA, 22 bp, Homo sapiens
cgccacatggcttcctcctgcg

SEQ ID NO: 2646969 - DNA, 23 bp, Homo sapiens
cgccacatggcttcctcctgcgc

SEQ ID NO: 2646970 - DNA, 21 bp, Homo sapiens
cgccactacactccagcctga

SEQ ID NO: 2646971 - DNA, 22 bp, Homo sapiens
cgccactacactccagcctgag

SEQ ID NO: 2646972 - DNA, 23 bp, Homo sapiens
cgccactgcactccagcctgggc

SEQ ID NO: 2646973 - DNA, 20 bp, Homo sapiens
cgccactgcactccggcctg

SEQ ID NO: 2646974 - DNA, 19 bp, Homo sapiens
cgccagattctttcctgag

SEQ ID NO: 2646975 - DNA, 22 bp, Homo sapiens
cgccagcacagaaacagaggag

SEQ ID NO: 2646976 - DNA, 22 bp, Homo sapiens
cgccaggggaaaatcagcctgc

SEQ ID NO: 2646977 - DNA, 16 bp, Homo sapiens
cgccatcccagcccca

SEQ ID NO: 2646978 - DNA, 17 bp, Homo sapiens
cgccatcccagccccaa

SEQ ID NO: 2646979 - DNA, 17 bp, Homo sapiens
cgcccaaagccagacag

SEQ ID NO: 2646980 - DNA, 12 bp, Homo sapiens
cgcccaaggccc

SEQ ID NO: 2646981 - DNA, 18 bp, Homo sapiens
cgcccacaggaagcctgc

SEQ ID NO: 2646982 - DNA, 21 bp, Homo sapiens
cgcccacaggaagcctgcagt

SEQ ID NO: 2646983 - DNA, 18 bp, Homo sapiens
cgcccaccccgctctgca

SEQ ID NO: 2646984 - DNA, 11 bp, Homo sapiens
cgtgtgatttt

SEQ ID NO: 2646985 - DNA, 18 bp, Homo sapiens
cgtgtgatttttctggag

SEQ ID NO: 2646986 - DNA, 15 bp, Homo sapiens
cgtgtgtagagttaa

SEQ ID NO: 2646987 - DNA, 22 bp, Homo sapiens
cgtgtgtagagttaagaagctg

SEQ ID NO: 2646988 - DNA, 22 bp, Homo sapiens
cgtgttgccttgaaccacttcc

SEQ ID NO: 2646989 - DNA, 12 bp, Homo sapiens
cgtgtttgtgtt

SEQ ID NO: 2646990 - DNA, 14 bp, Homo sapiens
cgttaccaggcagg

SEQ ID NO: 2646991 - DNA, 16 bp, Homo sapiens
cgttatggtgtttctc

SEQ ID NO: 2646992 - DNA, 17 bp, Homo sapiens
cgttcctattgtcatta

SEQ ID NO: 2646993 - DNA, 16 bp, Homo sapiens
cgttctcacacccacc

SEQ ID NO: 2646994 - DNA, 18 bp, Homo sapiens
cgttctgctggcctggat

SEQ ID NO: 2646995 - DNA, 18 bp, Homo sapiens
cgttgatgttggctggga

SEQ ID NO: 2646996 - DNA, 12 bp, Homo sapiens
cgttgcatgtcg

SEQ ID NO: 2646997 - DNA, 21 bp, Homo sapiens
cgttgggccccagccttcttt

SEQ ID NO: 2646998 - DNA, 23 bp, Homo sapiens
cgtttacaagcccccccttccac

SEQ ID NO: 2646999 - DNA, 15 bp, Homo sapiens
cgtttattttcaaga

SEQ ID NO: 2647000 - DNA, 20 bp, Homo sapiens
cgtttctatgacacatgcaa

SEQ ID NO: 2647001 - DNA, 22 bp, Homo sapiens
cgtttctccacctagactgtaa

SEQ ID NO: 2647002 - DNA, 12 bp, Homo sapiens
cgttttattgtg

SEQ ID NO: 2647003 - DNA, 18 bp, Homo sapiens
cgttttattgtgttttta

SEQ ID NO: 2647004 - DNA, 18 bp, Homo sapiens
ctaaaaaaaaaaaagtat

SEQ ID NO: 2647005 - DNA, 11 bp, Homo sapiens
ctaaaaataaa

SEQ ID NO: 2647006 - DNA, 22 bp, Homo sapiens
ctaaaaatattataacttaaaa

SEQ ID NO: 2647007 - DNA, 22 bp, Homo sapiens
ctaaaaatgggacttcttttca

SEQ ID NO: 2647008 - DNA, 12 bp, Homo sapiens
ctaaaacaataa

SEQ ID NO: 2647009 - DNA, 15 bp, Homo sapiens
ctaaaacctgagcta

SEQ ID NO: 2647010 - DNA, 12 bp, Homo sapiens
ctaaaagcacac

SEQ ID NO: 2647011 - DNA, 13 bp, Homo sapiens
ctaaaagtcttcg

SEQ ID NO: 2647012 - DNA, 14 bp, Homo sapiens
ctaaaatatttatt

SEQ ID NO: 2647013 - DNA, 23 bp, Homo sapiens
ctaaaatgattttatctgtgaat

SEQ ID NO: 2647014 - DNA, 21 bp, Homo sapiens
ctaaaatttgccctcccatcc

SEQ ID NO: 2647015 - DNA, 13 bp, Homo sapiens
ctaaacagatata

SEQ ID NO: 2647016 - DNA, 19 bp, Homo sapiens
ctaaaccttagtactgagt

SEQ ID NO: 2647017 - DNA, 14 bp, Homo sapiens
ctaaactttcacac

SEQ ID NO: 2647018 - DNA, 21 bp, Homo sapiens
ctaaagaaggtttcagaaaga

SEQ ID NO: 2647019 - DNA, 19 bp, Homo sapiens
ctaaagagagaatgtagat

SEQ ID NO: 2647020 - DNA, 18 bp, Homo sapiens
ctaaagagtttattttaa

SEQ ID NO: 2647021 - DNA, 11 bp, Homo sapiens
ctaaagcagtg

SEQ ID NO: 2647022 - DNA, 18 bp, Homo sapiens
ctaaagcagtggacacca

SEQ ID NO: 2647023 - DNA, 20 bp, Homo sapiens
ctaaataaaatttgttgcat

SEQ ID NO: 2647024 - DNA, 14 bp, Homo sapiens
ctaaatatttcctt

SEQ ID NO: 2647025 - DNA, 22 bp, Homo sapiens
ctaaatatttccttaaactgtg

SEQ ID NO: 2647026 - DNA, 22 bp, Homo sapiens
ctaaatgaaaatcgtgacaaca

SEQ ID NO: 2647027 - DNA, 14 bp, Homo sapiens
ctaaatgaatgttt

SEQ ID NO: 2647028 - DNA, 22 bp, Homo sapiens
ctaaatgcatatcctgagccat

SEQ ID NO: 2647029 - DNA, 17 bp, Homo sapiens
ctaaatggaaccactct

SEQ ID NO: 2647030 - DNA, 20 bp, Homo sapiens
ctaaatggtcgcccaggaga

SEQ ID NO: 2647031 - DNA, 14 bp, Homo sapiens
ctaaatgtaacagt

SEQ ID NO: 2647032 - DNA, 17 bp, Homo sapiens
ctaaattgaaacctgga

SEQ ID NO: 2647033 - DNA, 22 bp, Homo sapiens
ctaacaatcagctccttcctgg

SEQ ID NO: 2647034 - DNA, 16 bp, Homo sapiens
ctaacacagcatgtgt

SEQ ID NO: 2647035 - DNA, 17 bp, Homo sapiens
ctaacacattatcggga

SEQ ID NO: 2647036 - DNA, 15 bp, Homo sapiens
ctaacactggcccct

SEQ ID NO: 2647037 - DNA, 16 bp, Homo sapiens
ctaacactggccccta

SEQ ID NO: 2647038 - DNA, 12 bp, Homo sapiens
ctaacatataat

SEQ ID NO: 2647039 - DNA, 12 bp, Homo sapiens
ctaacatcagaa

SEQ ID NO: 2647040 - DNA, 15 bp, Homo sapiens
ctaacattatttatt

SEQ ID NO: 2647041 - DNA, 21 bp, Homo sapiens
ctaacattttaaataaaagaa

SEQ ID NO: 2647042 - DNA, 12 bp, Homo sapiens
ctaaccacgctg

SEQ ID NO: 2647043 - DNA, 17 bp, Homo sapiens
ctaaccagcagaaatgc

SEQ ID NO: 2647044 - DNA, 21 bp, Homo sapiens
ctaaccagggaagctgtccct

SEQ ID NO: 2647045 - DNA, 15 bp, Homo sapiens
ctaacctcatcttct

SEQ ID NO: 2647046 - DNA, 20 bp, Homo sapiens
ctaacgaagtatccttcagc

SEQ ID NO: 2647047 - DNA, 15 bp, Homo sapiens
ctaacgtaaatacac

SEQ ID NO: 2647048 - DNA, 21 bp, Homo sapiens
ctaactagagcagccctggag

SEQ ID NO: 2647049 - DNA, 15 bp, Homo sapiens
ctaactcacctaact

SEQ ID NO: 2647050 - DNA, 19 bp, Homo sapiens
ctaactcagaaacatcagt

SEQ ID NO: 2647051 - DNA, 20 bp, Homo sapiens
ctaactgctacaaatactct

SEQ ID NO: 2647052 - DNA, 14 bp, Homo sapiens
ctaacttgtctttg

SEQ ID NO: 2647053 - DNA, 22 bp, Homo sapiens
ctaagaaagcccttaggaagaa

SEQ ID NO: 2647054 - DNA, 15 bp, Homo sapiens
ctaagagggagggag

SEQ ID NO: 2647055 - DNA, 23 bp, Homo sapiens
ctaagagggagggagggctccag

SEQ ID NO: 2647056 - DNA, 22 bp, Homo sapiens
ctaagagtgctgggcattttta

SEQ ID NO: 2647057 - DNA, 12 bp, Homo sapiens
ctaagagtgtcc

SEQ ID NO: 2647058 - DNA, 18 bp, Homo sapiens
ctaagagtgtcctaggag

SEQ ID NO: 2647059 - DNA, 19 bp, Homo sapiens
ctaagatgacattgctaag

SEQ ID NO: 2647060 - DNA, 22 bp, Homo sapiens
ctaagcccccgctgtaatgaaa

SEQ ID NO: 2647061 - DNA, 14 bp, Homo sapiens
ctaagcctacctgc

SEQ ID NO: 2647062 - DNA, 20 bp, Homo sapiens
ctaagcctacctgctctcca

SEQ ID NO: 2647063 - DNA, 14 bp, Homo sapiens
ctaagcctcctttt

SEQ ID NO: 2647064 - DNA, 22 bp, Homo sapiens
ctaagctaggaatgaaatcctg

SEQ ID NO: 2647065 - DNA, 13 bp, Homo sapiens
ctaaggacacact

SEQ ID NO: 2647066 - DNA, 16 bp, Homo sapiens
ctaaggacacactaat

SEQ ID NO: 2647067 - DNA, 17 bp, Homo sapiens
ctaaggacatttcccag

SEQ ID NO: 2647068 - DNA, 17 bp, Homo sapiens
ctaaggcgtggagctgc

SEQ ID NO: 2647069 - DNA, 18 bp, Homo sapiens
ctaaggcgtggagctgcc

SEQ ID NO: 2647070 - DNA, 19 bp, Homo sapiens
ctaaggcgtggagctgcct

SEQ ID NO: 2647071 - DNA, 21 bp, Homo sapiens
ctaaggcgtggagctgcctga

SEQ ID NO: 2647072 - DNA, 20 bp, Homo sapiens
ctaagtaaaaccacagcagt

SEQ ID NO: 2647073 - DNA, 22 bp, Homo sapiens
ctaagtaaaaccacagcagttg

SEQ ID NO: 2647074 - DNA, 23 bp, Homo sapiens
ctaagtaaaaccacagcagttga

SEQ ID NO: 2647075 - DNA, 20 bp, Homo sapiens
ctaagtgaaataagccagac

SEQ ID NO: 2647076 - DNA, 18 bp, Homo sapiens
ctaagttccactgagctc

SEQ ID NO: 2647077 - DNA, 20 bp, Homo sapiens
ctaagttccactgagctcca

SEQ ID NO: 2647078 - DNA, 14 bp, Homo sapiens
ctaagtttttatgg

SEQ ID NO: 2647079 - DNA, 20 bp, Homo sapiens
ctaagtttttatggcttttg

SEQ ID NO: 2647080 - DNA, 23 bp, Homo sapiens
ctaagtttttatggcttttgtgc

SEQ ID NO: 2647081 - DNA, 10 bp, Homo sapiens
ctaataaaac

SEQ ID NO: 2647082 - DNA, 21 bp, Homo sapiens
ctaataaaatttaaaagtctt

SEQ ID NO: 2647083 - DNA, 12 bp, Homo sapiens
ctaatacaccag

SEQ ID NO: 2647084 - DNA, 23 bp, Homo sapiens
ctaatacagcaacaatttatgaa

SEQ ID NO: 2647085 - DNA, 13 bp, Homo sapiens
ctaatacctctgt

SEQ ID NO: 2647086 - DNA, 16 bp, Homo sapiens
ctaatacctctgtgtg

SEQ ID NO: 2647087 - DNA, 20 bp, Homo sapiens
ctaatagaactcagttttaa

SEQ ID NO: 2647088 - DNA, 23 bp, Homo sapiens
ctaatagacaatttattatggca

SEQ ID NO: 2647089 - DNA, 23 bp, Homo sapiens
ctaatagcgggttactttcacat

SEQ ID NO: 2647090 - DNA, 15 bp, Homo sapiens
ctaatatatttttat

SEQ ID NO: 2647091 - DNA, 16 bp, Homo sapiens
ctaatattaaaaatat

SEQ ID NO: 2647092 - DNA, 14 bp, Homo sapiens
ctaatattttatgt

SEQ ID NO: 2647093 - DNA, 20 bp, Homo sapiens
ctaatcagggaggtcatttt

SEQ ID NO: 2647094 - DNA, 16 bp, Homo sapiens
ctaatcagtgtctcac

SEQ ID NO: 2647095 - DNA, 21 bp, Homo sapiens
ctaatcagtgtctcacactgg

SEQ ID NO: 2647096 - DNA, 16 bp, Homo sapiens
ctaatcatccaatgct

SEQ ID NO: 2647097 - DNA, 15 bp, Homo sapiens
ctaatccaacccatg

SEQ ID NO: 2647098 - DNA, 19 bp, Homo sapiens
ctaatccctgggcattgct

SEQ ID NO: 2647099 - DNA, 22 bp, Homo sapiens
ctaatccctgggcattgctttc

SEQ ID NO: 2647100 - DNA, 15 bp, Homo sapiens
ctaatcgaactatga

SEQ ID NO: 2647101 - DNA, 14 bp, Homo sapiens
ctaatctattgggt

SEQ ID NO: 2647102 - DNA, 22 bp, Homo sapiens
ctaatctattgggttcattatt

SEQ ID NO: 2647103 - DNA, 21 bp, Homo sapiens
ctaatctgtagggctggacct

SEQ ID NO: 2647104 - DNA, 22 bp, Homo sapiens
ctaatgacatcaccacagttta

SEQ ID NO: 2647105 - DNA, 12 bp, Homo sapiens
ctaatgggacac

SEQ ID NO: 2647106 - DNA, 13 bp, Homo sapiens
ctaatgggacact

SEQ ID NO: 2647107 - DNA, 19 bp, Homo sapiens
ctaatgtgcctagttcttt

SEQ ID NO: 2647108 - DNA, 17 bp, Homo sapiens
ctaatgtttatgagcca

SEQ ID NO: 2647109 - DNA, 16 bp, Homo sapiens
ctaattatataatatt

SEQ ID NO: 2647110 - DNA, 17 bp, Homo sapiens
ctaattcccattttgca

SEQ ID NO: 2647111 - DNA, 21 bp, Homo sapiens
ctaattctttgacctgttggg

SEQ ID NO: 2647112 - DNA, 13 bp, Homo sapiens
ctaattgtataac

SEQ ID NO: 2647113 - DNA, 18 bp, Homo sapiens
ctaattgtataacaggtt

SEQ ID NO: 2647114 - DNA, 23 bp, Homo sapiens
ctaatttatcctgaaatttcaga

SEQ ID NO: 2647115 - DNA, 15 bp, Homo sapiens
ctaatttgatgttta

SEQ ID NO: 2647116 - DNA, 20 bp, Homo sapiens
ctacaaaacctgatgttaaa

SEQ ID NO: 2647117 - DNA, 20 bp, Homo sapiens
ctacaaagaagacatgtttt

SEQ ID NO: 2647118 - DNA, 14 bp, Homo sapiens
ctacaactgagtcc

SEQ ID NO: 2647119 - DNA, 14 bp, Homo sapiens
ctacaacttcagca

SEQ ID NO: 2647120 - DNA, 20 bp, Homo sapiens
ctacaagagcagcctgtggc

SEQ ID NO: 2647121 - DNA, 20 bp, Homo sapiens
ctacaattttctcccaggaa

SEQ ID NO: 2647122 - DNA, 21 bp, Homo sapiens
ctacacatatgtattcctgat

SEQ ID NO: 2647123 - DNA, 22 bp, Homo sapiens
ctacacccctcccctgccctag

SEQ ID NO: 2647124 - DNA, 13 bp, Homo sapiens
ctacacctaactc

SEQ ID NO: 2647125 - DNA, 14 bp, Homo sapiens
ctacacctaactca

SEQ ID NO: 2647126 - DNA, 15 bp, Homo sapiens
ctacactgacactgg

SEQ ID NO: 2647127 - DNA, 16 bp, Homo sapiens
ctacactgacactggt

SEQ ID NO: 2647128 - DNA, 22 bp, Homo sapiens
ctatgtcctaaggacacactaa

SEQ ID NO: 2647129 - DNA, 16 bp, Homo sapiens
ctatgtgattttaact

SEQ ID NO: 2647130 - DNA, 20 bp, Homo sapiens
ctatgtgattttaactctgt

SEQ ID NO: 2647131 - DNA, 14 bp, Homo sapiens
ctatgttgcccagg

SEQ ID NO: 2647132 - DNA, 21 bp, Homo sapiens
ctatgttgcccaggcaggtct

SEQ ID NO: 2647133 - DNA, 22 bp, Homo sapiens
ctatgttgcccaggcaggtctt

SEQ ID NO: 2647134 - DNA, 18 bp, Homo sapiens
ctatgttttgacattttt

SEQ ID NO: 2647135 - DNA, 19 bp, Homo sapiens
ctatgttttgacattttta

SEQ ID NO: 2647136 - DNA, 16 bp, Homo sapiens
ctattaagatttccaa

SEQ ID NO: 2647137 - DNA, 17 bp, Homo sapiens
ctattaccatgagaaga

SEQ ID NO: 2647138 - DNA, 23 bp, Homo sapiens
ctattactgtctggttttaacaa

SEQ ID NO: 2647139 - DNA, 16 bp, Homo sapiens
ctattagccaggatca

SEQ ID NO: 2647140 - DNA, 21 bp, Homo sapiens
ctattataatttaatgcatgt

SEQ ID NO: 2647141 - DNA, 16 bp, Homo sapiens
ctattatactgtatta

SEQ ID NO: 2647142 - DNA, 20 bp, Homo sapiens
ctattattttcactgtagaa

SEQ ID NO: 2647143 - DNA, 23 bp, Homo sapiens
ctattcaaacagtctcaggaaat

SEQ ID NO: 2647144 - DNA, 17 bp, Homo sapiens
ctattcagtaataactc

SEQ ID NO: 2647145 - DNA, 23 bp, Homo sapiens
ctattcagtaataactctaccct

SEQ ID NO: 2647146 - DNA, 15 bp, Homo sapiens
ctattctcaccagga

SEQ ID NO: 2647147 - DNA, 17 bp, Homo sapiens
ctattgacaagtcattt

SEQ ID NO: 2647148 - DNA, 13 bp, Homo sapiens
ctattgacttcaa

SEQ ID NO: 2647149 - DNA, 16 bp, Homo sapiens
ctattgacttcaatga

SEQ ID NO: 2647150 - DNA, 21 bp, Homo sapiens
ctattgatataaataaaacat

SEQ ID NO: 2647151 - DNA, 20 bp, Homo sapiens
ctattgatgtacagtctgtc

SEQ ID NO: 2647152 - DNA, 23 bp, Homo sapiens
ctattgatgtacagtctgtcatg

SEQ ID NO: 2647153 - DNA, 22 bp, Homo sapiens
ctattgcaaaggttccaactgt

SEQ ID NO: 2647154 - DNA, 19 bp, Homo sapiens
ctattgtgatttgactgtt

SEQ ID NO: 2647155 - DNA, 20 bp, Homo sapiens
ctattgtgatttgactgttt

SEQ ID NO: 2647156 - DNA, 15 bp, Homo sapiens
ctatttaaaaaagag

SEQ ID NO: 2647157 - DNA, 15 bp, Homo sapiens
ctatttaatatttat

SEQ ID NO: 2647158 - DNA, 11 bp, Homo sapiens
ctatttaatgg

SEQ ID NO: 2647159 - DNA, 23 bp, Homo sapiens
ctatttagcatgacaagccccag

SEQ ID NO: 2647160 - DNA, 17 bp, Homo sapiens
ctatttagtttttgtaa

SEQ ID NO: 2647161 - DNA, 20 bp, Homo sapiens
ctatttagtttttgtaattt

SEQ ID NO: 2647162 - DNA, 23 bp, Homo sapiens
ctatttagtttttgtaatttatt

SEQ ID NO: 2647163 - DNA, 16 bp, Homo sapiens
ctatttatctgtgttt

SEQ ID NO: 2647164 - DNA, 22 bp, Homo sapiens
ctatttatctgtgtttttgaaa

SEQ ID NO: 2647165 - DNA, 22 bp, Homo sapiens
ctatttccccaggggaaaatga

SEQ ID NO: 2647166 - DNA, 23 bp, Homo sapiens
ctatttccccaggggaaaatgaa

SEQ ID NO: 2647167 - DNA, 16 bp, Homo sapiens
ctatttctcctccatg

SEQ ID NO: 2647168 - DNA, 22 bp, Homo sapiens
ctatttgccatgggcttcactg

SEQ ID NO: 2647169 - DNA, 22 bp, Homo sapiens
ctatttgttgatgcttgtgtca

SEQ ID NO: 2647170 - DNA, 16 bp, Homo sapiens
ctatttgttttcatgg

SEQ ID NO: 2647171 - DNA, 18 bp, Homo sapiens
ctattttcattgtaaaac

SEQ ID NO: 2647172 - DNA, 12 bp, Homo sapiens
ctattttgtaaa

SEQ ID NO: 2647173 - DNA, 12 bp, Homo sapiens
ctatttttactg

SEQ ID NO: 2647174 - DNA, 14 bp, Homo sapiens
ctatttttccccct

SEQ ID NO: 2647175 - DNA, 21 bp, Homo sapiens
ctatttttggcagtctgaatt

SEQ ID NO: 2647176 - DNA, 22 bp, Homo sapiens
ctatttttggcagtctgaattt

SEQ ID NO: 2647177 - DNA, 14 bp, Homo sapiens
ctatttttgtagaa

SEQ ID NO: 2647178 - DNA, 15 bp, Homo sapiens
ctatttttgtagaag

SEQ ID NO: 2647179 - DNA, 20 bp, Homo sapiens
ctattttttattttactttt

SEQ ID NO: 2647180 - DNA, 20 bp, Homo sapiens
ctattttttttctgttatat

SEQ ID NO: 2647181 - DNA, 16 bp, Homo sapiens
ctcaaaacttaacata

SEQ ID NO: 2647182 - DNA, 18 bp, Homo sapiens
ctcaaaatatttgtacat

SEQ ID NO: 2647183 - DNA, 17 bp, Homo sapiens
ctcaaactgccttggct

SEQ ID NO: 2647184 - DNA, 15 bp, Homo sapiens
ctcaaagtctgcaac

SEQ ID NO: 2647185 - DNA, 18 bp, Homo sapiens
ctcaaagttttgaaaagc

SEQ ID NO: 2647186 - DNA, 23 bp, Homo sapiens
ctcaaagttttgaaaagctatta

SEQ ID NO: 2647187 - DNA, 21 bp, Homo sapiens
ctcaaatcttttagtcattat

SEQ ID NO: 2647188 - DNA, 16 bp, Homo sapiens
ctcaaatgctcagacc

SEQ ID NO: 2647189 - DNA, 15 bp, Homo sapiens
ctcaaatttctaaat

SEQ ID NO: 2647190 - DNA, 17 bp, Homo sapiens
ctcaaatttctaaatct

SEQ ID NO: 2647191 - DNA, 15 bp, Homo sapiens
ctcaacaagggagag

SEQ ID NO: 2647192 - DNA, 16 bp, Homo sapiens
ctcaacatgttactga

SEQ ID NO: 2647193 - DNA, 20 bp, Homo sapiens
ctcaacatgttactgaccag

SEQ ID NO: 2647194 - DNA, 18 bp, Homo sapiens
ctcaaccacctttcagat

SEQ ID NO: 2647195 - DNA, 15 bp, Homo sapiens
ctcaaccatcccctc

SEQ ID NO: 2647196 - DNA, 19 bp, Homo sapiens
ctcaacccccatttctatt

SEQ ID NO: 2647197 - DNA, 16 bp, Homo sapiens
ctcaaccctccctcag

SEQ ID NO: 2647198 - DNA, 19 bp, Homo sapiens
ctcaaccctccctcagccc

SEQ ID NO: 2647199 - DNA, 13 bp, Homo sapiens
ctcaaccctctca

SEQ ID NO: 2647200 - DNA, 15 bp, Homo sapiens
ctcaacctcctgggc

SEQ ID NO: 2647201 - DNA, 23 bp, Homo sapiens
ctcaactgcctactccaaaatgt

SEQ ID NO: 2647202 - DNA, 20 bp, Homo sapiens
ctcaagaagacatggagact

SEQ ID NO: 2647203 - DNA, 21 bp, Homo sapiens
ctcaagaagacatggagactc

SEQ ID NO: 2647204 - DNA, 13 bp, Homo sapiens
ctcaagaagcagg

SEQ ID NO: 2647205 - DNA, 14 bp, Homo sapiens
ctcaagaagcaggc

SEQ ID NO: 2647206 - DNA, 17 bp, Homo sapiens
ctcaagatcaatgaaat

SEQ ID NO: 2647207 - DNA, 18 bp, Homo sapiens
ctcaagatcaatgaaatg

SEQ ID NO: 2647208 - DNA, 16 bp, Homo sapiens
ctcaagatgaaggcaa

SEQ ID NO: 2647209 - DNA, 16 bp, Homo sapiens
ctcaagccaagcagcc

SEQ ID NO: 2647210 - DNA, 18 bp, Homo sapiens
ctcaagccaagcagccaa

SEQ ID NO: 2647211 - DNA, 21 bp, Homo sapiens
ctcaagccaagcagccaagct

SEQ ID NO: 2647212 - DNA, 12 bp, Homo sapiens
ctcaagccctgc

SEQ ID NO: 2647213 - DNA, 10 bp, Homo sapiens
ctcaaggact

SEQ ID NO: 2647214 - DNA, 16 bp, Homo sapiens
ctcaaggcgtgaggat

SEQ ID NO: 2647215 - DNA, 21 bp, Homo sapiens
ctcaagggctagcatccctga

SEQ ID NO: 2647216 - DNA, 23 bp, Homo sapiens
ctcaaggggccatcctgtcccac

SEQ ID NO: 2647217 - DNA, 19 bp, Homo sapiens
ctcaagtcactcccaagcc

SEQ ID NO: 2647218 - DNA, 14 bp, Homo sapiens
ctcaagtcctcttt

SEQ ID NO: 2647219 - DNA, 21 bp, Homo sapiens
ctcaagtcctcttttctgaga

SEQ ID NO: 2647220 - DNA, 9 bp, Homo sapiens
ctcaagtgc

SEQ ID NO: 2647221 - DNA, 13 bp, Homo sapiens
ctcaataaaatca

SEQ ID NO: 2647222 - DNA, 14 bp, Homo sapiens
ctcaataagccttg

SEQ ID NO: 2647223 - DNA, 15 bp, Homo sapiens
ctcaataagccttgt

SEQ ID NO: 2647224 - DNA, 22 bp, Homo sapiens
ctcaatattttccatgaaaatg

SEQ ID NO: 2647225 - DNA, 13 bp, Homo sapiens
ctcaatgcactga

SEQ ID NO: 2647226 - DNA, 15 bp, Homo sapiens
ctcaatgcactgaca

SEQ ID NO: 2647227 - DNA, 18 bp, Homo sapiens
ctcaattccccctggcca

SEQ ID NO: 2647228 - DNA, 19 bp, Homo sapiens
ctcaattcttccctatctt

SEQ ID NO: 2647229 - DNA, 13 bp, Homo sapiens
ctcaatttctccc

SEQ ID NO: 2647230 - DNA, 16 bp, Homo sapiens
ctcaatttctccccag

SEQ ID NO: 2647231 - DNA, 22 bp, Homo sapiens
ctcacaataaaaatggctcaga

SEQ ID NO: 2647232 - DNA, 12 bp, Homo sapiens
ctcacacagcca

SEQ ID NO: 2647233 - DNA, 15 bp, Homo sapiens
ctcacacagccaggt

SEQ ID NO: 2647234 - DNA, 20 bp, Homo sapiens
ctcacacagccaggtgcctt

SEQ ID NO: 2647235 - DNA, 13 bp, Homo sapiens
ctcacacaggacc

SEQ ID NO: 2647236 - DNA, 12 bp, Homo sapiens
ctcacacccacc

SEQ ID NO: 2647237 - DNA, 15 bp, Homo sapiens
ctcacacccaccgtc

SEQ ID NO: 2647238 - DNA, 19 bp, Homo sapiens
ctcacaccgcgtctggtga

SEQ ID NO: 2647239 - DNA, 22 bp, Homo sapiens
ctcacagacctggagcccctgg

SEQ ID NO: 2647240 - DNA, 13 bp, Homo sapiens
ctcacagcacaga

SEQ ID NO: 2647241 - DNA, 15 bp, Homo sapiens
ctcacagcacagaga

SEQ ID NO: 2647242 - DNA, 15 bp, Homo sapiens
ctcacagtccttacc

SEQ ID NO: 2647243 - DNA, 19 bp, Homo sapiens
ctcacagtccttaccagca

SEQ ID NO: 2647244 - DNA, 22 bp, Homo sapiens
ctcacagtccttaccagcagag

SEQ ID NO: 2647245 - DNA, 20 bp, Homo sapiens
ctcacagtctctttaatctt

SEQ ID NO: 2647246 - DNA, 22 bp, Homo sapiens
ctcacagtgggagccagggctg

SEQ ID NO: 2647247 - DNA, 12 bp, Homo sapiens
ctcacatttatg

SEQ ID NO: 2647248 - DNA, 19 bp, Homo sapiens
ctcacatttattctgctca

SEQ ID NO: 2647249 - DNA, 22 bp, Homo sapiens
ctcacatttattctgctcacat

SEQ ID NO: 2647250 - DNA, 13 bp, Homo sapiens
ctcaccaggaagg

SEQ ID NO: 2647251 - DNA, 14 bp, Homo sapiens
ctcaccatgtaaaa

SEQ ID NO: 2647252 - DNA, 12 bp, Homo sapiens
ctcaccccagcc

SEQ ID NO: 2647253 - DNA, 19 bp, Homo sapiens
ctcacccccagctttgcta

SEQ ID NO: 2647254 - DNA, 16 bp, Homo sapiens
ctcaccccccacactc

SEQ ID NO: 2647255 - DNA, 13 bp, Homo sapiens
ctcaccccctcgg

SEQ ID NO: 2647256 - DNA, 14 bp, Homo sapiens
ctcaccccctcggg

SEQ ID NO: 2647257 - DNA, 21 bp, Homo sapiens
ctcaccccctcgggtctcctc

SEQ ID NO: 2647258 - DNA, 17 bp, Homo sapiens
ctcacccccttctccat

SEQ ID NO: 2647259 - DNA, 19 bp, Homo sapiens
ctcacccccttctccatcc

SEQ ID NO: 2647260 - DNA, 20 bp, Homo sapiens
ctcacccccttctccatcca

SEQ ID NO: 2647261 - DNA, 21 bp, Homo sapiens
ctcacccccttctccatccac

SEQ ID NO: 2647262 - DNA, 17 bp, Homo sapiens
ctcaccccttgccataa

SEQ ID NO: 2647263 - DNA, 21 bp, Homo sapiens
ctcaccgcagtcgtcgcacag

SEQ ID NO: 2647264 - DNA, 16 bp, Homo sapiens
ctcacctctcccttgg

SEQ ID NO: 2647265 - DNA, 17 bp, Homo sapiens
ctcacctctcccttgga

SEQ ID NO: 2647266 - DNA, 14 bp, Homo sapiens
ctcacctctggact

SEQ ID NO: 2647267 - DNA, 18 bp, Homo sapiens
ctcacctgctggcccctc

SEQ ID NO: 2647268 - DNA, 17 bp, Homo sapiens
ctcacctggggctgctg

SEQ ID NO: 2647269 - DNA, 21 bp, Homo sapiens
ctcacctggggtgtgggaggc

SEQ ID NO: 2647270 - DNA, 14 bp, Homo sapiens
ctcacctgtactct

SEQ ID NO: 2647271 - DNA, 15 bp, Homo sapiens
ctcacctgttgctta

SEQ ID NO: 2647272 - DNA, 14 bp, Homo sapiens
ctccatgctgcctc

SEQ ID NO: 2647273 - DNA, 17 bp, Homo sapiens
ctccatgctgcctccag

SEQ ID NO: 2647274 - DNA, 19 bp, Homo sapiens
ctccatggcttcctcctcc

SEQ ID NO: 2647275 - DNA, 22 bp, Homo sapiens
ctccattaggatttgccccttc

SEQ ID NO: 2647276 - DNA, 23 bp, Homo sapiens
ctcccaaagtgctgggattacag

SEQ ID NO: 2647277 - DNA, 15 bp, Homo sapiens
ctcccaactcacccc

SEQ ID NO: 2647278 - DNA, 22 bp, Homo sapiens
ctcccaactcaccccagcccca

SEQ ID NO: 2647279 - DNA, 14 bp, Homo sapiens
ctcccaagggatgg

SEQ ID NO: 2647280 - DNA, 21 bp, Homo sapiens
ctcccaaggggcccaaattct

SEQ ID NO: 2647281 - DNA, 17 bp, Homo sapiens
ctcccaagtctacagag

SEQ ID NO: 2647282 - DNA, 18 bp, Homo sapiens
ctcccaagtggtgcctaa

SEQ ID NO: 2647283 - DNA, 15 bp, Homo sapiens
ctcccacaggcagct

SEQ ID NO: 2647284 - DNA, 23 bp, Homo sapiens
ctcccacccgatgctgctttccc

SEQ ID NO: 2647285 - DNA, 12 bp, Homo sapiens
ctcccacctcag

SEQ ID NO: 2647286 - DNA, 17 bp, Homo sapiens
ctcccacctcagcctcc

SEQ ID NO: 2647287 - DNA, 14 bp, Homo sapiens
ctcccacgtgggag

SEQ ID NO: 2647288 - DNA, 15 bp, Homo sapiens
ctcccacgtgggaga

SEQ ID NO: 2647289 - DNA, 21 bp, Homo sapiens
ctcccacgtgggagacaagaa

SEQ ID NO: 2647290 - DNA, 11 bp, Homo sapiens
ctcccagcctg

SEQ ID NO: 2647291 - DNA, 18 bp, Homo sapiens
ctcccagctctagacaac

SEQ ID NO: 2647292 - DNA, 11 bp, Homo sapiens
ctcccaggaag

SEQ ID NO: 2647293 - DNA, 21 bp, Homo sapiens
ctcccaggcattccccaggag

SEQ ID NO: 2647294 - DNA, 22 bp, Homo sapiens
ctcccaggccagtaagggaaat

SEQ ID NO: 2647295 - DNA, 12 bp, Homo sapiens
ctcccaggctct

SEQ ID NO: 2647296 - DNA, 16 bp, Homo sapiens
ctcccagggccagggc

SEQ ID NO: 2647297 - DNA, 22 bp, Homo sapiens
ctcccagggccagggccctgca

SEQ ID NO: 2647298 - DNA, 16 bp, Homo sapiens
ctcccagtacctcctg

SEQ ID NO: 2647299 - DNA, 18 bp, Homo sapiens
ctcccagtctacccagag

SEQ ID NO: 2647300 - DNA, 14 bp, Homo sapiens
ctcccatccccctg

SEQ ID NO: 2647301 - DNA, 24 bp, Homo sapiens
ctcccatccccctgccctcgtggc

SEQ ID NO: 2647302 - DNA, 23 bp, Homo sapiens
ctcccatcccctggactgggagg

SEQ ID NO: 2647303 - DNA, 15 bp, Homo sapiens
ctcccatctcacaca

SEQ ID NO: 2647304 - DNA, 13 bp, Homo sapiens
ctcccatctggga

SEQ ID NO: 2647305 - DNA, 20 bp, Homo sapiens
ctcccatctgggagtcccct

SEQ ID NO: 2647306 - DNA, 21 bp, Homo sapiens
ctcccatgaccatactgaggg

SEQ ID NO: 2647307 - DNA, 18 bp, Homo sapiens
ctcccatggagccccagc

SEQ ID NO: 2647308 - DNA, 19 bp, Homo sapiens
ctcccatggagccccagcc

SEQ ID NO: 2647309 - DNA, 20 bp, Homo sapiens
ctcccatggagccccagccc

SEQ ID NO: 2647310 - DNA, 23 bp, Homo sapiens
ctcccatggagccccagccccct

SEQ ID NO: 2647311 - DNA, 20 bp, Homo sapiens
ctcccatggcttaatgcttc

SEQ ID NO: 2647312 - DNA, 15 bp, Homo sapiens
ctccccaaccctgcc

SEQ ID NO: 2647313 - DNA, 14 bp, Homo sapiens
ctccccacccgccc

SEQ ID NO: 2647314 - DNA, 17 bp, Homo sapiens
ctccccacggccgctcc

SEQ ID NO: 2647315 - DNA, 22 bp, Homo sapiens
ctccccacggccgctccagggg

SEQ ID NO: 2647316 - DNA, 23 bp, Homo sapiens
ctccccacggggcctcgggacct

SEQ ID NO: 2647317 - DNA, 19 bp, Homo sapiens
ctccccactgcctactgca

SEQ ID NO: 2647318 - DNA, 12 bp, Homo sapiens
ctccccagcaag

SEQ ID NO: 2647319 - DNA, 15 bp, Homo sapiens
ctccccagcaggtgg

SEQ ID NO: 2647320 - DNA, 15 bp, Homo sapiens
ctccccagcccaggg

SEQ ID NO: 2647321 - DNA, 16 bp, Homo sapiens
ctccccagcccagggt

SEQ ID NO: 2647322 - DNA, 15 bp, Homo sapiens
ctccccagccctggc

SEQ ID NO: 2647323 - DNA, 12 bp, Homo sapiens
ctccccagctca

SEQ ID NO: 2647324 - DNA, 20 bp, Homo sapiens
ctccccatgtgtcctggttc

SEQ ID NO: 2647325 - DNA, 16 bp, Homo sapiens
ctccccattagctttc

SEQ ID NO: 2647326 - DNA, 17 bp, Homo sapiens
ctcccccatcctcccct

SEQ ID NO: 2647327 - DNA, 11 bp, Homo sapiens
ctcccccttct

SEQ ID NO: 2647328 - DNA, 13 bp, Homo sapiens
ctcccccttctcc

SEQ ID NO: 2647329 - DNA, 13 bp, Homo sapiens
ctcccctcagagt

SEQ ID NO: 2647330 - DNA, 22 bp, Homo sapiens
ctcccctgaggctcagggaaag

SEQ ID NO: 2647331 - DNA, 15 bp, Homo sapiens
ctcccctgccagggc

SEQ ID NO: 2647332 - DNA, 14 bp, Homo sapiens
ctcccctgctgggt

SEQ ID NO: 2647333 - DNA, 19 bp, Homo sapiens
ctcccctgtgcagtcctgg

SEQ ID NO: 2647334 - DNA, 19 bp, Homo sapiens
ctccccttcctcactgccc

SEQ ID NO: 2647335 - DNA, 12 bp, Homo sapiens
ctccccttgggc

SEQ ID NO: 2647336 - DNA, 15 bp, Homo sapiens
ctccccttgggcggc

SEQ ID NO: 2647337 - DNA, 18 bp, Homo sapiens
ctcccgaatagctgggac

SEQ ID NO: 2647338 - DNA, 19 bp, Homo sapiens
ctcccgaatagctgggact

SEQ ID NO: 2647339 - DNA, 18 bp, Homo sapiens
ctcccgagtagctgggac

SEQ ID NO: 2647340 - DNA, 19 bp, Homo sapiens
ctcccgagtagctgggact

SEQ ID NO: 2647341 - DNA, 15 bp, Homo sapiens
ctcccggagggccct

SEQ ID NO: 2647342 - DNA, 20 bp, Homo sapiens
ctcccggaggttgggtgggc

SEQ ID NO: 2647343 - DNA, 12 bp, Homo sapiens
ctcccggcgtgg

SEQ ID NO: 2647344 - DNA, 15 bp, Homo sapiens
ctcccgggccctccc

SEQ ID NO: 2647345 - DNA, 22 bp, Homo sapiens
ctcccgggccctcccttggaaa

SEQ ID NO: 2647346 - DNA, 14 bp, Homo sapiens
ctcccgtcagggcc

SEQ ID NO: 2647347 - DNA, 16 bp, Homo sapiens
ctcccgtcagggccca

SEQ ID NO: 2647348 - DNA, 19 bp, Homo sapiens
ctcccgtcagggcccaagt

SEQ ID NO: 2647349 - DNA, 22 bp, Homo sapiens
ctccctagtgacccggaggcca

SEQ ID NO: 2647350 - DNA, 19 bp, Homo sapiens
ctccctattttttttctgt

SEQ ID NO: 2647351 - DNA, 20 bp, Homo sapiens
ctccctattttttttctgtt

SEQ ID NO: 2647352 - DNA, 14 bp, Homo sapiens
ctccctcaacccca

SEQ ID NO: 2647353 - DNA, 12 bp, Homo sapiens
ctccctcagccc

SEQ ID NO: 2647354 - DNA, 13 bp, Homo sapiens
ctccctcattcca

SEQ ID NO: 2647355 - DNA, 22 bp, Homo sapiens
ctccctcatttcaggagcagcc

SEQ ID NO: 2647356 - DNA, 19 bp, Homo sapiens
ctccctcctcacctctgga

SEQ ID NO: 2647357 - DNA, 17 bp, Homo sapiens
ctccctcctgccgactc

SEQ ID NO: 2647358 - DNA, 19 bp, Homo sapiens
ctccctcctgccgactcct

SEQ ID NO: 2647359 - DNA, 10 bp, Homo sapiens
ctccctctca

SEQ ID NO: 2647360 - DNA, 21 bp, Homo sapiens
ctccctctcactgtctgagag

SEQ ID NO: 2647361 - DNA, 22 bp, Homo sapiens
ctccctctcactgtctgagagt

SEQ ID NO: 2647362 - DNA, 16 bp, Homo sapiens
ctccctctctcttctg

SEQ ID NO: 2647363 - DNA, 20 bp, Homo sapiens
ctccctctctcttctgctcc

SEQ ID NO: 2647364 - DNA, 21 bp, Homo sapiens
ctccctctctcttctgctcca

SEQ ID NO: 2647365 - DNA, 17 bp, Homo sapiens
ctccctctgacctgcag

SEQ ID NO: 2647366 - DNA, 18 bp, Homo sapiens
ctccctctgacctgcagg

SEQ ID NO: 2647367 - DNA, 16 bp, Homo sapiens
ctccctctggatcaaa

SEQ ID NO: 2647368 - DNA, 23 bp, Homo sapiens
ctccctgaaaatgtttttctgcc

SEQ ID NO: 2647369 - DNA, 20 bp, Homo sapiens
ctccctgaagtaagcaaaga

SEQ ID NO: 2647370 - DNA, 12 bp, Homo sapiens
ctccctggagcc

SEQ ID NO: 2647371 - DNA, 19 bp, Homo sapiens
ctccctggagccagactct

SEQ ID NO: 2647372 - DNA, 15 bp, Homo sapiens
ctccctggcctgttc

SEQ ID NO: 2647373 - DNA, 19 bp, Homo sapiens
ctccctggcctgttctgtt

SEQ ID NO: 2647374 - DNA, 11 bp, Homo sapiens
ctccctggctc

SEQ ID NO: 2647375 - DNA, 12 bp, Homo sapiens
ctccctggctcc

SEQ ID NO: 2647376 - DNA, 15 bp, Homo sapiens
ctccctggctcccat

SEQ ID NO: 2647377 - DNA, 17 bp, Homo sapiens
ctccctggctgccctgg

SEQ ID NO: 2647378 - DNA, 22 bp, Homo sapiens
ctccctggctgccctggccctg

SEQ ID NO: 2647379 - DNA, 17 bp, Homo sapiens
ctccctgttcttgggta

SEQ ID NO: 2647380 - DNA, 22 bp, Homo sapiens
ctccctgttgacgaagtctctt

SEQ ID NO: 2647381 - DNA, 14 bp, Homo sapiens
ctcccttcccacct

SEQ ID NO: 2647382 - DNA, 16 bp, Homo sapiens
ctcccttcccacctct

SEQ ID NO: 2647383 - DNA, 17 bp, Homo sapiens
ctcccttcccacctctc

SEQ ID NO: 2647384 - DNA, 23 bp, Homo sapiens
ctcccttcccacctctctcactc

SEQ ID NO: 2647385 - DNA, 14 bp, Homo sapiens
ctcccttctcccat

SEQ ID NO: 2647386 - DNA, 19 bp, Homo sapiens
ctcccttggaaacctgccc

SEQ ID NO: 2647387 - DNA, 20 bp, Homo sapiens
ctcccttggaaacctgccct

SEQ ID NO: 2647388 - DNA, 14 bp, Homo sapiens
ctcccttgggctcc

SEQ ID NO: 2647389 - DNA, 20 bp, Homo sapiens
ctcccttggtggcaagagcc

SEQ ID NO: 2647390 - DNA, 17 bp, Homo sapiens
ctcccttgttctctaag

SEQ ID NO: 2647391 - DNA, 15 bp, Homo sapiens
ctccctttcccttct

SEQ ID NO: 2647392 - DNA, 14 bp, Homo sapiens
ctccctttgaaatg

SEQ ID NO: 2647393 - DNA, 21 bp, Homo sapiens
ctccctttttccttgtcccca

SEQ ID NO: 2647394 - DNA, 22 bp, Homo sapiens
ctccctttttccttgtccccac

SEQ ID NO: 2647395 - DNA, 16 bp, Homo sapiens
ctccgactgctaggga

SEQ ID NO: 2647396 - DNA, 15 bp, Homo sapiens
ctccgatccttcctc

SEQ ID NO: 2647397 - DNA, 15 bp, Homo sapiens
ctccgcagttcctgt

SEQ ID NO: 2647398 - DNA, 21 bp, Homo sapiens
ctccgccttcactccggtgtg

SEQ ID NO: 2647399 - DNA, 20 bp, Homo sapiens
ctccgctttctacccagcga

SEQ ID NO: 2647400 - DNA, 22 bp, Homo sapiens
ctccggagtgagaagctttgcc

SEQ ID NO: 2647401 - DNA, 21 bp, Homo sapiens
ctccggccctcctaccctgcg

SEQ ID NO: 2647402 - DNA, 20 bp, Homo sapiens
ctccggcctgatgacagagc

SEQ ID NO: 2647403 - DNA, 16 bp, Homo sapiens
ctccggcgtcagcctc

SEQ ID NO: 2647404 - DNA, 18 bp, Homo sapiens
ctccggcgtcagcctcca

SEQ ID NO: 2647405 - DNA, 20 bp, Homo sapiens
ctccggcgtcagcctccagc

SEQ ID NO: 2647406 - DNA, 23 bp, Homo sapiens
ctccggcgtcagcctccagcctc

SEQ ID NO: 2647407 - DNA, 18 bp, Homo sapiens
ctccggggagcgcccgcg

SEQ ID NO: 2647408 - DNA, 20 bp, Homo sapiens
ctccggtaaaacaccggaga

SEQ ID NO: 2647409 - DNA, 13 bp, Homo sapiens
ctccggtgtgcct

SEQ ID NO: 2647410 - DNA, 13 bp, Homo sapiens
ctccgtatttcag

SEQ ID NO: 2647411 - DNA, 19 bp, Homo sapiens
ctccgtccaggagcctggc

SEQ ID NO: 2647412 - DNA, 20 bp, Homo sapiens
ctccgtccaggagcctgtgc

SEQ ID NO: 2647413 - DNA, 13 bp, Homo sapiens
ctccgtgcctcca

SEQ ID NO: 2647414 - DNA, 12 bp, Homo sapiens
ctcctaagagag

SEQ ID NO: 2647415 - DNA, 15 bp, Homo sapiens
ctcctaccctgcgcc

SEQ ID NO: 2647416 - DNA, 18 bp, Homo sapiens
ctcctacctcagcctaga

SEQ ID NO: 2647417 - DNA, 16 bp, Homo sapiens
ctctgcactcccctgc

SEQ ID NO: 2647418 - DNA, 21 bp, Homo sapiens
ctctgcactcccctgctgggt

SEQ ID NO: 2647419 - DNA, 19 bp, Homo sapiens
ctctgcagcaataaagcag

SEQ ID NO: 2647420 - DNA, 23 bp, Homo sapiens
ctctgcagcaataaagcagcgtt

SEQ ID NO: 2647421 - DNA, 14 bp, Homo sapiens
ctctgcagctgacc

SEQ ID NO: 2647422 - DNA, 15 bp, Homo sapiens
ctctgcagctgacct

SEQ ID NO: 2647423 - DNA, 16 bp, Homo sapiens
ctctgcagctgacctc

SEQ ID NO: 2647424 - DNA, 14 bp, Homo sapiens
ctctgcaggcacct

SEQ ID NO: 2647425 - DNA, 13 bp, Homo sapiens
ctctgcagtgcct

SEQ ID NO: 2647426 - DNA, 14 bp, Homo sapiens
ctctgcagtgcctt

SEQ ID NO: 2647427 - DNA, 23 bp, Homo sapiens
ctctgcatactcattaggatggc

SEQ ID NO: 2647428 - DNA, 13 bp, Homo sapiens
ctctgcatctgac

SEQ ID NO: 2647429 - DNA, 17 bp, Homo sapiens
ctctgcatgcggcccag

SEQ ID NO: 2647430 - DNA, 20 bp, Homo sapiens
ctctgcatgcggcccagccc

SEQ ID NO: 2647431 - DNA, 16 bp, Homo sapiens
ctctgcccactccctg

SEQ ID NO: 2647432 - DNA, 14 bp, Homo sapiens
ctctgcccagcttg

SEQ ID NO: 2647433 - DNA, 18 bp, Homo sapiens
ctctgcccagcttgggcc

SEQ ID NO: 2647434 - DNA, 12 bp, Homo sapiens
ctctgccccagc

SEQ ID NO: 2647435 - DNA, 21 bp, Homo sapiens
ctctgccccagctctggcttc

SEQ ID NO: 2647436 - DNA, 15 bp, Homo sapiens
ctctgccctccaaga

SEQ ID NO: 2647437 - DNA, 12 bp, Homo sapiens
ctctgcccttgg

SEQ ID NO: 2647438 - DNA, 20 bp, Homo sapiens
ctctgccggctctttccttg

SEQ ID NO: 2647439 - DNA, 21 bp, Homo sapiens
ctctgcctccctcaccctgag

SEQ ID NO: 2647440 - DNA, 14 bp, Homo sapiens
ctctgcctctgaca

SEQ ID NO: 2647441 - DNA, 16 bp, Homo sapiens
ctctgcctctgacaca

SEQ ID NO: 2647442 - DNA, 19 bp, Homo sapiens
ctctgcctctgacacacag

SEQ ID NO: 2647443 - DNA, 22 bp, Homo sapiens
ctctgcctgaagtcacacagtg

SEQ ID NO: 2647444 - DNA, 16 bp, Homo sapiens
ctctgcctgcattctg

SEQ ID NO: 2647445 - DNA, 22 bp, Homo sapiens
ctctgcctgcattctgccgtgt

SEQ ID NO: 2647446 - DNA, 12 bp, Homo sapiens
ctctgctccacc

SEQ ID NO: 2647447 - DNA, 14 bp, Homo sapiens
ctctgctccaccac

SEQ ID NO: 2647448 - DNA, 15 bp, Homo sapiens
ctctgctccaccaca

SEQ ID NO: 2647449 - DNA, 16 bp, Homo sapiens
ctctgctccaccacat

SEQ ID NO: 2647450 - DNA, 13 bp, Homo sapiens
ctctgctcctctc

SEQ ID NO: 2647451 - DNA, 20 bp, Homo sapiens
ctctgctcctctccccagca

SEQ ID NO: 2647452 - DNA, 21 bp, Homo sapiens
ctctgctcctctccccagcaa

SEQ ID NO: 2647453 - DNA, 15 bp, Homo sapiens
ctctgctctgaggct

SEQ ID NO: 2647454 - DNA, 21 bp, Homo sapiens
ctctgctgacagacacaggcc

SEQ ID NO: 2647455 - DNA, 21 bp, Homo sapiens
ctctgctgccgccccacccag

SEQ ID NO: 2647456 - DNA, 16 bp, Homo sapiens
ctctgctgctggctgg

SEQ ID NO: 2647457 - DNA, 18 bp, Homo sapiens
ctctgctggcccagccaa

SEQ ID NO: 2647458 - DNA, 23 bp, Homo sapiens
ctctgctgtacatatttgagact

SEQ ID NO: 2647459 - DNA, 14 bp, Homo sapiens
ctctgcttctcacg

SEQ ID NO: 2647460 - DNA, 19 bp, Homo sapiens
ctctggaaaatgtgaccca

SEQ ID NO: 2647461 - DNA, 21 bp, Homo sapiens
ctctggaaaatgtgacccaga

SEQ ID NO: 2647462 - DNA, 21 bp, Homo sapiens
ctctggaagagaggaatgcct

SEQ ID NO: 2647463 - DNA, 20 bp, Homo sapiens
ctctggaatttgcaagtcat

SEQ ID NO: 2647464 - DNA, 16 bp, Homo sapiens
ctctggacaaagcgtt

SEQ ID NO: 2647465 - DNA, 14 bp, Homo sapiens
ctctggacaggcat

SEQ ID NO: 2647466 - DNA, 16 bp, Homo sapiens
ctctggacaggcatgt

SEQ ID NO: 2647467 - DNA, 14 bp, Homo sapiens
ctctggaccagcct

SEQ ID NO: 2647468 - DNA, 20 bp, Homo sapiens
ctctggaccagcctgttgga

SEQ ID NO: 2647469 - DNA, 20 bp, Homo sapiens
ctctggaggggtgtggctcc

SEQ ID NO: 2647470 - DNA, 22 bp, Homo sapiens
ctctggatcaaagtaggcagga

SEQ ID NO: 2647471 - DNA, 20 bp, Homo sapiens
ctctggatggcaccagaggc

SEQ ID NO: 2647472 - DNA, 14 bp, Homo sapiens
ctctggcagctcag

SEQ ID NO: 2647473 - DNA, 16 bp, Homo sapiens
ctctggcagctcagag

SEQ ID NO: 2647474 - DNA, 20 bp, Homo sapiens
ctctggcattagaattattt

SEQ ID NO: 2647475 - DNA, 15 bp, Homo sapiens
ctctggccaggatgg

SEQ ID NO: 2647476 - DNA, 13 bp, Homo sapiens
ctctggccccaag

SEQ ID NO: 2647477 - DNA, 24 bp, Homo sapiens
ctctggccctctacccctgatctg

SEQ ID NO: 2647478 - DNA, 18 bp, Homo sapiens
ctctggcctcagccgact

SEQ ID NO: 2647479 - DNA, 20 bp, Homo sapiens
ctctggctagaggccagccc

SEQ ID NO: 2647480 - DNA, 12 bp, Homo sapiens
ctctggctctca

SEQ ID NO: 2647481 - DNA, 18 bp, Homo sapiens
ctctggctgaaccctgtg

SEQ ID NO: 2647482 - DNA, 20 bp, Homo sapiens
ctctggctgaaccctgtgct

SEQ ID NO: 2647483 - DNA, 13 bp, Homo sapiens
ctctggctgggga

SEQ ID NO: 2647484 - DNA, 15 bp, Homo sapiens
ctctggctggggagc

SEQ ID NO: 2647485 - DNA, 23 bp, Homo sapiens
ctctgggaaatgagaaggcagcc

SEQ ID NO: 2647486 - DNA, 17 bp, Homo sapiens
ctctggggccacacaga

SEQ ID NO: 2647487 - DNA, 21 bp, Homo sapiens
ctctggtgagtcttggcggca

SEQ ID NO: 2647488 - DNA, 23 bp, Homo sapiens
ctctggtgagtcttggcggcagc

SEQ ID NO: 2647489 - DNA, 15 bp, Homo sapiens
ctctggttatctaat

SEQ ID NO: 2647490 - DNA, 18 bp, Homo sapiens
ctctgtagggaactctgg

SEQ ID NO: 2647491 - DNA, 21 bp, Homo sapiens
ctctgtccagggccctgagct

SEQ ID NO: 2647492 - DNA, 15 bp, Homo sapiens
ctctgtcctgggagt

SEQ ID NO: 2647493 - DNA, 13 bp, Homo sapiens
ctctgtcgcccag

SEQ ID NO: 2647494 - DNA, 17 bp, Homo sapiens
ctctgtcgcccagtctg

SEQ ID NO: 2647495 - DNA, 22 bp, Homo sapiens
ctctgtctgagtaagaaacaga

SEQ ID NO: 2647496 - DNA, 22 bp, Homo sapiens
ctctgtctgcccttcaccccag

SEQ ID NO: 2647497 - DNA, 21 bp, Homo sapiens
ctctgtgaacgatttagaaag

SEQ ID NO: 2647498 - DNA, 18 bp, Homo sapiens
ctctgtgagcatcacagt

SEQ ID NO: 2647499 - DNA, 20 bp, Homo sapiens
ctctgtgctgaccctcctgt

SEQ ID NO: 2647500 - DNA, 14 bp, Homo sapiens
ctctgtgctgtgga

SEQ ID NO: 2647501 - DNA, 21 bp, Homo sapiens
ctctgtgctttgactcacctg

SEQ ID NO: 2647502 - DNA, 21 bp, Homo sapiens
ctctgtgtcaggtggggcagc

SEQ ID NO: 2647503 - DNA, 22 bp, Homo sapiens
ctctgtgtcaggtggggcagct

SEQ ID NO: 2647504 - DNA, 14 bp, Homo sapiens
ctctgtgtccttcc

SEQ ID NO: 2647505 - DNA, 16 bp, Homo sapiens
ctctgtgtccttccct

SEQ ID NO: 2647506 - DNA, 20 bp, Homo sapiens
ctctgtgttgtgaatgtcat

SEQ ID NO: 2647507 - DNA, 15 bp, Homo sapiens
ctctgttcagtgtaa

SEQ ID NO: 2647508 - DNA, 17 bp, Homo sapiens
ctctgttcagtgtaaat

SEQ ID NO: 2647509 - DNA, 22 bp, Homo sapiens
ctctgttccttcacatcctgtg

SEQ ID NO: 2647510 - DNA, 12 bp, Homo sapiens
ctctgttgtcct

SEQ ID NO: 2647511 - DNA, 20 bp, Homo sapiens
ctctgttgtcctccccttgg

SEQ ID NO: 2647512 - DNA, 21 bp, Homo sapiens
ctctgttgtcctccccttggg

SEQ ID NO: 2647513 - DNA, 16 bp, Homo sapiens
ctcttaaaaaataaaa

SEQ ID NO: 2647514 - DNA, 20 bp, Homo sapiens
ctcttaaagctgcctgtagt

SEQ ID NO: 2647515 - DNA, 17 bp, Homo sapiens
ctcttaacaatttctgt

SEQ ID NO: 2647516 - DNA, 22 bp, Homo sapiens
ctcttaagccatcttggtaaat

SEQ ID NO: 2647517 - DNA, 22 bp, Homo sapiens
ctcttaagcttccgccgtctca

SEQ ID NO: 2647518 - DNA, 19 bp, Homo sapiens
ctcttaagtttctcagctc

SEQ ID NO: 2647519 - DNA, 18 bp, Homo sapiens
ctcttacgcccaaccctt

SEQ ID NO: 2647520 - DNA, 14 bp, Homo sapiens
ctcttactgcaaat

SEQ ID NO: 2647521 - DNA, 16 bp, Homo sapiens
ctcttactgcaaatgt

SEQ ID NO: 2647522 - DNA, 19 bp, Homo sapiens
ctcttactgcaaatgtcat

SEQ ID NO: 2647523 - DNA, 14 bp, Homo sapiens
ctcttactgctaac

SEQ ID NO: 2647524 - DNA, 15 bp, Homo sapiens
ctcttagaaaaacca

SEQ ID NO: 2647525 - DNA, 16 bp, Homo sapiens
ctcttagaaatgaagg

SEQ ID NO: 2647526 - DNA, 12 bp, Homo sapiens
ctcttagctgag

SEQ ID NO: 2647527 - DNA, 13 bp, Homo sapiens
ctcttagctgagt

SEQ ID NO: 2647528 - DNA, 19 bp, Homo sapiens
ctcttaggaagagaaacca

SEQ ID NO: 2647529 - DNA, 21 bp, Homo sapiens
ctcttatagaatatttattac

SEQ ID NO: 2647530 - DNA, 22 bp, Homo sapiens
ctcttatagaatatttattacc

SEQ ID NO: 2647531 - DNA, 11 bp, Homo sapiens
ctcttatctca

SEQ ID NO: 2647532 - DNA, 15 bp, Homo sapiens
ctcttatctcagtca

SEQ ID NO: 2647533 - DNA, 13 bp, Homo sapiens
ctcttattgccca

SEQ ID NO: 2647534 - DNA, 14 bp, Homo sapiens
ctcttattgcccac

SEQ ID NO: 2647535 - DNA, 15 bp, Homo sapiens
ctcttattgcccacg

SEQ ID NO: 2647536 - DNA, 20 bp, Homo sapiens
ctcttattgcccacgctgga

SEQ ID NO: 2647537 - DNA, 17 bp, Homo sapiens
ctcttcaactgaccagc

SEQ ID NO: 2647538 - DNA, 18 bp, Homo sapiens
ctcttcaaggactttctg

SEQ ID NO: 2647539 - DNA, 11 bp, Homo sapiens
ctcttcagaaa

SEQ ID NO: 2647540 - DNA, 17 bp, Homo sapiens
ctcttcagaggccctcg

SEQ ID NO: 2647541 - DNA, 18 bp, Homo sapiens
ctcttcagatctctaact

SEQ ID NO: 2647542 - DNA, 13 bp, Homo sapiens
ctcttcaggcctc

SEQ ID NO: 2647543 - DNA, 20 bp, Homo sapiens
ctcttcaggcctccctctct

SEQ ID NO: 2647544 - DNA, 22 bp, Homo sapiens
ctcttcaggttcttagtgtcac

SEQ ID NO: 2647545 - DNA, 17 bp, Homo sapiens
ctcttccactctccttg

SEQ ID NO: 2647546 - DNA, 13 bp, Homo sapiens
ctcttccaggctg

SEQ ID NO: 2647547 - DNA, 14 bp, Homo sapiens
ctcttccaggctgg

SEQ ID NO: 2647548 - DNA, 15 bp, Homo sapiens
ctcttccaggctggg

SEQ ID NO: 2647549 - DNA, 21 bp, Homo sapiens
ctcttccaggctgggagagcc

SEQ ID NO: 2647550 - DNA, 16 bp, Homo sapiens
ctcttccatcatgtcc

SEQ ID NO: 2647551 - DNA, 14 bp, Homo sapiens
ctcttcccctctca

SEQ ID NO: 2647552 - DNA, 16 bp, Homo sapiens
ctcttccccttgccct

SEQ ID NO: 2647553 - DNA, 22 bp, Homo sapiens
ctcttccgaaaaatcctcttcc

SEQ ID NO: 2647554 - DNA, 12 bp, Homo sapiens
ctcttcctctga

SEQ ID NO: 2647555 - DNA, 13 bp, Homo sapiens
ctcttctccaggc

SEQ ID NO: 2647556 - DNA, 15 bp, Homo sapiens
ctcttctccaggctg

SEQ ID NO: 2647557 - DNA, 16 bp, Homo sapiens
ctcttctccaggctgt

SEQ ID NO: 2647558 - DNA, 17 bp, Homo sapiens
ctcttctgacgtgcctt

SEQ ID NO: 2647559 - DNA, 22 bp, Homo sapiens
ctcttctgacgtgccttttgca

SEQ ID NO: 2647560 - DNA, 21 bp, Homo sapiens
ctcttctgccggccctggggc

SEQ ID NO: 2647561 - DNA, 12 bp, Homo sapiens
ctcttctgctcc

SEQ ID NO: 2647562 - DNA, 13 bp, Homo sapiens
ctgagggaggagg

SEQ ID NO: 2647563 - DNA, 16 bp, Homo sapiens
ctgagggaggaggcca

SEQ ID NO: 2647564 - DNA, 18 bp, Homo sapiens
ctgagggaggaggccacc

SEQ ID NO: 2647565 - DNA, 20 bp, Homo sapiens
ctgagggaggaggccacctc

SEQ ID NO: 2647566 - DNA, 13 bp, Homo sapiens
ctgagggccacac

SEQ ID NO: 2647567 - DNA, 16 bp, Homo sapiens
ctgagggccacactat

SEQ ID NO: 2647568 - DNA, 18 bp, Homo sapiens
ctgagggcccctctgccc

SEQ ID NO: 2647569 - DNA, 20 bp, Homo sapiens
ctgagggcccctctgcccag

SEQ ID NO: 2647570 - DNA, 16 bp, Homo sapiens
ctgagggcgaggggag

SEQ ID NO: 2647571 - DNA, 22 bp, Homo sapiens
ctgaggggaggatcactggagc

SEQ ID NO: 2647572 - DNA, 18 bp, Homo sapiens
ctgagggtccccacctgg

SEQ ID NO: 2647573 - DNA, 21 bp, Homo sapiens
ctgagggtccccacctgggac

SEQ ID NO: 2647574 - DNA, 19 bp, Homo sapiens
ctgaggtctcttgagggag

SEQ ID NO: 2647575 - DNA, 22 bp, Homo sapiens
ctgaggtgggaggatctcttga

SEQ ID NO: 2647576 - DNA, 20 bp, Homo sapiens
ctgaggtgggcccaggacca

SEQ ID NO: 2647577 - DNA, 22 bp, Homo sapiens
ctgaggtgggcccaggaccagc

SEQ ID NO: 2647578 - DNA, 14 bp, Homo sapiens
ctgaggtgtggggg

SEQ ID NO: 2647579 - DNA, 16 bp, Homo sapiens
ctgaggtgtgggggct

SEQ ID NO: 2647580 - DNA, 19 bp, Homo sapiens
ctgaggtgtgggggctgca

SEQ ID NO: 2647581 - DNA, 17 bp, Homo sapiens
ctgagtacgttgtgcat

SEQ ID NO: 2647582 - DNA, 18 bp, Homo sapiens
ctgagtacgttgtgcatt

SEQ ID NO: 2647583 - DNA, 20 bp, Homo sapiens
ctgagtacgttgtgcatttg

SEQ ID NO: 2647584 - DNA, 19 bp, Homo sapiens
ctgagtagctggattacag

SEQ ID NO: 2647585 - DNA, 22 bp, Homo sapiens
ctgagtatctcctcgcaagctg

SEQ ID NO: 2647586 - DNA, 23 bp, Homo sapiens
ctgagtcaccctacctgtgcctg

SEQ ID NO: 2647587 - DNA, 21 bp, Homo sapiens
ctgagtccaagagggtccttt

SEQ ID NO: 2647588 - DNA, 16 bp, Homo sapiens
ctgagtctgaaggctg

SEQ ID NO: 2647589 - DNA, 16 bp, Homo sapiens
ctgagtgcctggccaa

SEQ ID NO: 2647590 - DNA, 19 bp, Homo sapiens
ctgagtgcctggccaaagg

SEQ ID NO: 2647591 - DNA, 22 bp, Homo sapiens
ctgagtgggggatcacagcctc

SEQ ID NO: 2647592 - DNA, 20 bp, Homo sapiens
ctgagttgacttgacagaac

SEQ ID NO: 2647593 - DNA, 17 bp, Homo sapiens
ctgagtttcattctcct

SEQ ID NO: 2647594 - DNA, 18 bp, Homo sapiens
ctgagtttcattctcctg

SEQ ID NO: 2647595 - DNA, 19 bp, Homo sapiens
ctgataaaaccatgtagaa

SEQ ID NO: 2647596 - DNA, 16 bp, Homo sapiens
ctgataacaacctgga

SEQ ID NO: 2647597 - DNA, 17 bp, Homo sapiens
ctgataacaacctggag

SEQ ID NO: 2647598 - DNA, 19 bp, Homo sapiens
ctgataagagaatcaacat

SEQ ID NO: 2647599 - DNA, 15 bp, Homo sapiens
ctgataattccagtg

SEQ ID NO: 2647600 - DNA, 15 bp, Homo sapiens
ctgatacccagagca

SEQ ID NO: 2647601 - DNA, 22 bp, Homo sapiens
ctgatagctctttggcagtcta

SEQ ID NO: 2647602 - DNA, 16 bp, Homo sapiens
ctgatagttactgttg

SEQ ID NO: 2647603 - DNA, 18 bp, Homo sapiens
ctgatagttactgttgtg

SEQ ID NO: 2647604 - DNA, 19 bp, Homo sapiens
ctgatagttactgttgtga

SEQ ID NO: 2647605 - DNA, 22 bp, Homo sapiens
ctgatagttactgttgtgacct

SEQ ID NO: 2647606 - DNA, 16 bp, Homo sapiens
ctgatatgatttaaaa

SEQ ID NO: 2647607 - DNA, 19 bp, Homo sapiens
ctgatatgatttaaaacat

SEQ ID NO: 2647608 - DNA, 19 bp, Homo sapiens
ctgatattgccgcactagg

SEQ ID NO: 2647609 - DNA, 23 bp, Homo sapiens
ctgatattttacctcttattgca

SEQ ID NO: 2647610 - DNA, 14 bp, Homo sapiens
ctgatcaatgacag

SEQ ID NO: 2647611 - DNA, 15 bp, Homo sapiens
ctgatcaatgacaga

SEQ ID NO: 2647612 - DNA, 14 bp, Homo sapiens
ctgatcagagccgt

SEQ ID NO: 2647613 - DNA, 20 bp, Homo sapiens
ctgatcagagccgtggtcct

SEQ ID NO: 2647614 - DNA, 22 bp, Homo sapiens
ctgatcagtgggcctccaagga

SEQ ID NO: 2647615 - DNA, 16 bp, Homo sapiens
ctgatcatgcattgtt

SEQ ID NO: 2647616 - DNA, 18 bp, Homo sapiens
ctgatccagcctctcccc

SEQ ID NO: 2647617 - DNA, 20 bp, Homo sapiens
ctgatcctgtgaagtaagga

SEQ ID NO: 2647618 - DNA, 15 bp, Homo sapiens
ctgatcgtgctaaat

SEQ ID NO: 2647619 - DNA, 20 bp, Homo sapiens
ctgatctccatggcttcctc

SEQ ID NO: 2647620 - DNA, 19 bp, Homo sapiens
ctgatctgacatccccact

SEQ ID NO: 2647621 - DNA, 20 bp, Homo sapiens
ctgatctgatgcaagcaaga

SEQ ID NO: 2647622 - DNA, 23 bp, Homo sapiens
ctgatctgtgctttccagctcac

SEQ ID NO: 2647623 - DNA, 21 bp, Homo sapiens
ctgatgaactcttaatcaaat

SEQ ID NO: 2647624 - DNA, 17 bp, Homo sapiens
ctgatgctccctcccct

SEQ ID NO: 2647625 - DNA, 19 bp, Homo sapiens
ctgatgctccctcccctgc

SEQ ID NO: 2647626 - DNA, 22 bp, Homo sapiens
ctgatgctccctcccctgccct

SEQ ID NO: 2647627 - DNA, 17 bp, Homo sapiens
ctgatgctttgcttcaa

SEQ ID NO: 2647628 - DNA, 23 bp, Homo sapiens
ctgatgggcaacccccagcctgc

SEQ ID NO: 2647629 - DNA, 16 bp, Homo sapiens
ctgatggtacaggaaa

SEQ ID NO: 2647630 - DNA, 15 bp, Homo sapiens
ctgatgtcctcacca

SEQ ID NO: 2647631 - DNA, 20 bp, Homo sapiens
ctgatgttacatcacagtgt

SEQ ID NO: 2647632 - DNA, 14 bp, Homo sapiens
ctgatgttcagtgt

SEQ ID NO: 2647633 - DNA, 16 bp, Homo sapiens
ctgatgttcagtgtaa

SEQ ID NO: 2647634 - DNA, 21 bp, Homo sapiens
ctgatgttcagtgtaatttct

SEQ ID NO: 2647635 - DNA, 18 bp, Homo sapiens
ctgatgttcctagtgaaa

SEQ ID NO: 2647636 - DNA, 11 bp, Homo sapiens
ctgattagaaa

SEQ ID NO: 2647637 - DNA, 14 bp, Homo sapiens
ctgattcaactaaa

SEQ ID NO: 2647638 - DNA, 17 bp, Homo sapiens
ctgattcaactaaaaaa

SEQ ID NO: 2647639 - DNA, 15 bp, Homo sapiens
ctgattcactgcatg

SEQ ID NO: 2647640 - DNA, 18 bp, Homo sapiens
ctgattcccaagctctgc

SEQ ID NO: 2647641 - DNA, 20 bp, Homo sapiens
ctgattcccaagctctgctc

SEQ ID NO: 2647642 - DNA, 21 bp, Homo sapiens
ctgattctcagggtctctgct

SEQ ID NO: 2647643 - DNA, 17 bp, Homo sapiens
ctgattggtgcaaccct

SEQ ID NO: 2647644 - DNA, 20 bp, Homo sapiens
ctgattgtaacgttgctgtg

SEQ ID NO: 2647645 - DNA, 13 bp, Homo sapiens
ctgattttaacaa

SEQ ID NO: 2647646 - DNA, 18 bp, Homo sapiens
ctgattttcaaagctttt

SEQ ID NO: 2647647 - DNA, 23 bp, Homo sapiens
ctgcaaaatttgatgccaggaca

SEQ ID NO: 2647648 - DNA, 15 bp, Homo sapiens
ctgcaaaggaaatac

SEQ ID NO: 2647649 - DNA, 13 bp, Homo sapiens
ctgcaaaggactg

SEQ ID NO: 2647650 - DNA, 21 bp, Homo sapiens
ctgcaaagggtatcaggtgct

SEQ ID NO: 2647651 - DNA, 21 bp, Homo sapiens
ctgcaaatcagccatgtgctg

SEQ ID NO: 2647652 - DNA, 15 bp, Homo sapiens
ctgcaaatgtcatca

SEQ ID NO: 2647653 - DNA, 21 bp, Homo sapiens
ctgcaacctgattgtgtctct

SEQ ID NO: 2647654 - DNA, 18 bp, Homo sapiens
ctgcaacttgtaaatgtg

SEQ ID NO: 2647655 - DNA, 17 bp, Homo sapiens
ctgcaactttaagcagc

SEQ ID NO: 2647656 - DNA, 19 bp, Homo sapiens
ctgcaactttaagcagctc

SEQ ID NO: 2647657 - DNA, 18 bp, Homo sapiens
ctgcaagaattgaagcag

SEQ ID NO: 2647658 - DNA, 20 bp, Homo sapiens
ctgcaagcacatctgcattt

SEQ ID NO: 2647659 - DNA, 14 bp, Homo sapiens
ctgcaagcagggct

SEQ ID NO: 2647660 - DNA, 19 bp, Homo sapiens
ctgcaagcagggctctgcc

SEQ ID NO: 2647661 - DNA, 12 bp, Homo sapiens
ctgcaagggagt

SEQ ID NO: 2647662 - DNA, 22 bp, Homo sapiens
ctgcaagggcagaacactaacc

SEQ ID NO: 2647663 - DNA, 22 bp, Homo sapiens
ctgcaagggctccccactgcct

SEQ ID NO: 2647664 - DNA, 13 bp, Homo sapiens
ctgcaagtcagag

SEQ ID NO: 2647665 - DNA, 16 bp, Homo sapiens
ctgcaagtcagaggat

SEQ ID NO: 2647666 - DNA, 15 bp, Homo sapiens
ctgcaatcctgtctt

SEQ ID NO: 2647667 - DNA, 16 bp, Homo sapiens
ctgcaatcctgtcttt

SEQ ID NO: 2647668 - DNA, 21 bp, Homo sapiens
ctgcaatgaagtctctgaagt

SEQ ID NO: 2647669 - DNA, 17 bp, Homo sapiens
ctgcaatgggcactggg

SEQ ID NO: 2647670 - DNA, 16 bp, Homo sapiens
ctgcaatgttttcctt

SEQ ID NO: 2647671 - DNA, 23 bp, Homo sapiens
ctgcaattaaagtgatactgaaa

SEQ ID NO: 2647672 - DNA, 15 bp, Homo sapiens
ctgcaattcccctct

SEQ ID NO: 2647673 - DNA, 18 bp, Homo sapiens
ctgcacaaagcccttcca

SEQ ID NO: 2647674 - DNA, 18 bp, Homo sapiens
ctgcacaagctgcaccct

SEQ ID NO: 2647675 - DNA, 22 bp, Homo sapiens
ctgcacaagctgcaccctcagg

SEQ ID NO: 2647676 - DNA, 15 bp, Homo sapiens
ctgcacaataaaaat

SEQ ID NO: 2647677 - DNA, 13 bp, Homo sapiens
ctgcacagagctc

SEQ ID NO: 2647678 - DNA, 14 bp, Homo sapiens
ctgcacagagctct

SEQ ID NO: 2647679 - DNA, 13 bp, Homo sapiens
ctgcacagatgga

SEQ ID NO: 2647680 - DNA, 16 bp, Homo sapiens
ctgcacagggcagctg

SEQ ID NO: 2647681 - DNA, 20 bp, Homo sapiens
ctgcacagggcagctgggcc

SEQ ID NO: 2647682 - DNA, 21 bp, Homo sapiens
ctgcacagggcagctgggccc

SEQ ID NO: 2647683 - DNA, 23 bp, Homo sapiens
ctgcacatgtcttgtacatgtgt

SEQ ID NO: 2647684 - DNA, 11 bp, Homo sapiens
ctgcacccagg

SEQ ID NO: 2647685 - DNA, 13 bp, Homo sapiens
ctgcacccagggg

SEQ ID NO: 2647686 - DNA, 16 bp, Homo sapiens
ctgcacccccctgggc

SEQ ID NO: 2647687 - DNA, 13 bp, Homo sapiens
ctgcaccctcagg

SEQ ID NO: 2647688 - DNA, 16 bp, Homo sapiens
ctgcaccctcaggcag

SEQ ID NO: 2647689 - DNA, 15 bp, Homo sapiens
ctgcaccctccaccc

SEQ ID NO: 2647690 - DNA, 17 bp, Homo sapiens
ctgcaccctccaccctg

SEQ ID NO: 2647691 - DNA, 21 bp, Homo sapiens
ctgcaccctccaccctgtccc

SEQ ID NO: 2647692 - DNA, 17 bp, Homo sapiens
ctgcaccctccctccga

SEQ ID NO: 2647693 - DNA, 21 bp, Homo sapiens
ctgcaccctggggcctggacc

SEQ ID NO: 2647694 - DNA, 14 bp, Homo sapiens
ctgcaccggctggc

SEQ ID NO: 2647695 - DNA, 23 bp, Homo sapiens
ctgcaccggctggcctggcccct

SEQ ID NO: 2647696 - DNA, 12 bp, Homo sapiens
ctgcaccgggcc

SEQ ID NO: 2647697 - DNA, 14 bp, Homo sapiens
ctgcaccgggccac

SEQ ID NO: 2647698 - DNA, 17 bp, Homo sapiens
ctgcaccgtactgtgga

SEQ ID NO: 2647699 - DNA, 13 bp, Homo sapiens
ctgcacctgccag

SEQ ID NO: 2647700 - DNA, 18 bp, Homo sapiens
ctgcacctgccagcctgg

SEQ ID NO: 2647701 - DNA, 20 bp, Homo sapiens
ctgcacctgccagcctggct

SEQ ID NO: 2647702 - DNA, 19 bp, Homo sapiens
ctgcacggtgggccttgct

SEQ ID NO: 2647703 - DNA, 19 bp, Homo sapiens
ctgcactactcctctgcag

SEQ ID NO: 2647704 - DNA, 23 bp, Homo sapiens
ctgcactactcctctgcagtgcc

SEQ ID NO: 2647705 - DNA, 22 bp, Homo sapiens
ctggcagtcctggaagccagct

SEQ ID NO: 2647706 - DNA, 15 bp, Homo sapiens
ctggcagttttccat

SEQ ID NO: 2647707 - DNA, 19 bp, Homo sapiens
ctggcattagaattattta

SEQ ID NO: 2647708 - DNA, 20 bp, Homo sapiens
ctggcattagaattatttaa

SEQ ID NO: 2647709 - DNA, 14 bp, Homo sapiens
ctggccaccacccc

SEQ ID NO: 2647710 - DNA, 20 bp, Homo sapiens
ctggccactgcacagagctc

SEQ ID NO: 2647711 - DNA, 14 bp, Homo sapiens
ctggccagatgcac

SEQ ID NO: 2647712 - DNA, 18 bp, Homo sapiens
ctggccagatgcaccagc

SEQ ID NO: 2647713 - DNA, 22 bp, Homo sapiens
ctggccaggagctcttcaggcc

SEQ ID NO: 2647714 - DNA, 23 bp, Homo sapiens
ctggccaggatggaggggtggtc

SEQ ID NO: 2647715 - DNA, 21 bp, Homo sapiens
ctggccaggcagatctgtgcc

SEQ ID NO: 2647716 - DNA, 21 bp, Homo sapiens
ctggccagtggctggatctgt

SEQ ID NO: 2647717 - DNA, 16 bp, Homo sapiens
ctggccatctccaccc

SEQ ID NO: 2647718 - DNA, 12 bp, Homo sapiens
ctggcccactgc

SEQ ID NO: 2647719 - DNA, 16 bp, Homo sapiens
ctggcccagccctgct

SEQ ID NO: 2647720 - DNA, 15 bp, Homo sapiens
ctggcccagccggcc

SEQ ID NO: 2647721 - DNA, 19 bp, Homo sapiens
ctggcccagcggcccctcc

SEQ ID NO: 2647722 - DNA, 23 bp, Homo sapiens
ctggccccgccgcctggtactca

SEQ ID NO: 2647723 - DNA, 20 bp, Homo sapiens
ctggcccctagaatcagcct

SEQ ID NO: 2647724 - DNA, 21 bp, Homo sapiens
ctggcccctcagggtccctgg

SEQ ID NO: 2647725 - DNA, 18 bp, Homo sapiens
ctggcccgtgacagactc

SEQ ID NO: 2647726 - DNA, 23 bp, Homo sapiens
ctggccctatgcttccggcctcc

SEQ ID NO: 2647727 - DNA, 21 bp, Homo sapiens
ctggccctcacccctgccctg

SEQ ID NO: 2647728 - DNA, 16 bp, Homo sapiens
ctggccctcagtttcc

SEQ ID NO: 2647729 - DNA, 13 bp, Homo sapiens
ctggccctctgtg

SEQ ID NO: 2647730 - DNA, 17 bp, Homo sapiens
ctggccctgaggtgtgg

SEQ ID NO: 2647731 - DNA, 17 bp, Homo sapiens
ctggccgagggtcctgg

SEQ ID NO: 2647732 - DNA, 22 bp, Homo sapiens
ctggccgccccctgccccccag

SEQ ID NO: 2647733 - DNA, 14 bp, Homo sapiens
ctggccgcctcacc

SEQ ID NO: 2647734 - DNA, 18 bp, Homo sapiens
ctggccggagtcagtgcc

SEQ ID NO: 2647735 - DNA, 23 bp, Homo sapiens
ctggccggagtcagtgccaggtc

SEQ ID NO: 2647736 - DNA, 16 bp, Homo sapiens
ctggccggtctgcaag

SEQ ID NO: 2647737 - DNA, 15 bp, Homo sapiens
ctggccgtgggcctg

SEQ ID NO: 2647738 - DNA, 23 bp, Homo sapiens
ctggccgttgatgttggctggga

SEQ ID NO: 2647739 - DNA, 14 bp, Homo sapiens
ctggcctagcatac

SEQ ID NO: 2647740 - DNA, 23 bp, Homo sapiens
ctggcctaggagatatctgaggg

SEQ ID NO: 2647741 - DNA, 12 bp, Homo sapiens
ctggcctagtcc

SEQ ID NO: 2647742 - DNA, 22 bp, Homo sapiens
ctggcctcaagtgattctcctg

SEQ ID NO: 2647743 - DNA, 13 bp, Homo sapiens
ctggcctcccacc

SEQ ID NO: 2647744 - DNA, 23 bp, Homo sapiens
ctggcctcccacccgatgctgct

SEQ ID NO: 2647745 - DNA, 14 bp, Homo sapiens
ctggcctctgcact

SEQ ID NO: 2647746 - DNA, 16 bp, Homo sapiens
ctggcctctgcactcc

SEQ ID NO: 2647747 - DNA, 15 bp, Homo sapiens
ctggcctgagctggg

SEQ ID NO: 2647748 - DNA, 18 bp, Homo sapiens
ctggcctgagctgggatg

SEQ ID NO: 2647749 - DNA, 19 bp, Homo sapiens
ctggcctgcacggtgggcc

SEQ ID NO: 2647750 - DNA, 14 bp, Homo sapiens
ctggcctggactgt

SEQ ID NO: 2647751 - DNA, 22 bp, Homo sapiens
ctggcctggactgttttctctc

SEQ ID NO: 2647752 - DNA, 16 bp, Homo sapiens
ctggcctggcacacat

SEQ ID NO: 2647753 - DNA, 17 bp, Homo sapiens
ctggcctggcacacatc

SEQ ID NO: 2647754 - DNA, 18 bp, Homo sapiens
ctggcctggcacacatca

SEQ ID NO: 2647755 - DNA, 14 bp, Homo sapiens
ctggcctggcccct

SEQ ID NO: 2647756 - DNA, 16 bp, Homo sapiens
ctggcctggcccctca

SEQ ID NO: 2647757 - DNA, 19 bp, Homo sapiens
ctggcctggcccctcaggg

SEQ ID NO: 2647758 - DNA, 14 bp, Homo sapiens
ctggcctggcttct

SEQ ID NO: 2647759 - DNA, 13 bp, Homo sapiens
ctggccttttcct

SEQ ID NO: 2647760 - DNA, 14 bp, Homo sapiens
ctggcgcctctgca

SEQ ID NO: 2647761 - DNA, 20 bp, Homo sapiens
ctggctagaggccagcccca

SEQ ID NO: 2647762 - DNA, 18 bp, Homo sapiens
ctggctagagtcctcact

SEQ ID NO: 2647763 - DNA, 20 bp, Homo sapiens
ctggctagagtcctcactcc

SEQ ID NO: 2647764 - DNA, 15 bp, Homo sapiens
ctggctatgcatttg

SEQ ID NO: 2647765 - DNA, 20 bp, Homo sapiens
ctggctccaaaccctcgagg

SEQ ID NO: 2647766 - DNA, 19 bp, Homo sapiens
ctggctcccacaggcagct

SEQ ID NO: 2647767 - DNA, 12 bp, Homo sapiens
ctggctcctcaa

SEQ ID NO: 2647768 - DNA, 14 bp, Homo sapiens
ctggctcctgaggg

SEQ ID NO: 2647769 - DNA, 16 bp, Homo sapiens
ctggctctccaagtgc

SEQ ID NO: 2647770 - DNA, 17 bp, Homo sapiens
ctggctctccaagtgcc

SEQ ID NO: 2647771 - DNA, 19 bp, Homo sapiens
ctggctctccaagtgccag

SEQ ID NO: 2647772 - DNA, 17 bp, Homo sapiens
ctggctcttccaggctg

SEQ ID NO: 2647773 - DNA, 22 bp, Homo sapiens
ctggctcttccaggctgggaga

SEQ ID NO: 2647774 - DNA, 21 bp, Homo sapiens
ctggctcttgatacccccctc

SEQ ID NO: 2647775 - DNA, 13 bp, Homo sapiens
ctggctgaaccct

SEQ ID NO: 2647776 - DNA, 20 bp, Homo sapiens
ctggctgaaccctgtgctgg

SEQ ID NO: 2647777 - DNA, 21 bp, Homo sapiens
ctggctgaaccctgtgctggt

SEQ ID NO: 2647778 - DNA, 12 bp, Homo sapiens
ctggctgagccc

SEQ ID NO: 2647779 - DNA, 13 bp, Homo sapiens
ctggctgagctga

SEQ ID NO: 2647780 - DNA, 21 bp, Homo sapiens
ctggctgaggatttcaagcct

SEQ ID NO: 2647781 - DNA, 13 bp, Homo sapiens
ctggctgcagtga

SEQ ID NO: 2647782 - DNA, 12 bp, Homo sapiens
ctggctgcccag

SEQ ID NO: 2647783 - DNA, 19 bp, Homo sapiens
ctggctgccccaacctgct

SEQ ID NO: 2647784 - DNA, 21 bp, Homo sapiens
ctggctgccccaacctgctga

SEQ ID NO: 2647785 - DNA, 18 bp, Homo sapiens
ctggctgccctggccctg

SEQ ID NO: 2647786 - DNA, 17 bp, Homo sapiens
ctggctggctgcagtga

SEQ ID NO: 2647787 - DNA, 21 bp, Homo sapiens
ctggctgggtggcaccagcag

SEQ ID NO: 2647788 - DNA, 22 bp, Homo sapiens
ctggctgggtggcaccagcagc

SEQ ID NO: 2647789 - DNA, 16 bp, Homo sapiens
ctggctgttggctggg

SEQ ID NO: 2647790 - DNA, 14 bp, Homo sapiens
ctggcttcacagat

SEQ ID NO: 2647791 - DNA, 12 bp, Homo sapiens
ctggcttccagg

SEQ ID NO: 2647792 - DNA, 14 bp, Homo sapiens
ctggctttgagaag

SEQ ID NO: 2647793 - DNA, 22 bp, Homo sapiens
ctggcttttattaatgcacttt

SEQ ID NO: 2647794 - DNA, 14 bp, Homo sapiens
ctgggaaaataccc

SEQ ID NO: 2647795 - DNA, 19 bp, Homo sapiens
ctgggaaagacatccataa

SEQ ID NO: 2647796 - DNA, 20 bp, Homo sapiens
ctgggaactcacctggggct

SEQ ID NO: 2647797 - DNA, 15 bp, Homo sapiens
ctgggaactgcagac

SEQ ID NO: 2647798 - DNA, 18 bp, Homo sapiens
ctgggaactgcagacctg

SEQ ID NO: 2647799 - DNA, 13 bp, Homo sapiens
ctgggaatgtatt

SEQ ID NO: 2647800 - DNA, 12 bp, Homo sapiens
ctgggacacagt

SEQ ID NO: 2647801 - DNA, 13 bp, Homo sapiens
ctgggacacagtt

SEQ ID NO: 2647802 - DNA, 19 bp, Homo sapiens
ctgggacacttaacagatg

SEQ ID NO: 2647803 - DNA, 23 bp, Homo sapiens
ctgggacacttaacagatgcaat

SEQ ID NO: 2647804 - DNA, 18 bp, Homo sapiens
ctgggacatgggaaaggg

SEQ ID NO: 2647805 - DNA, 22 bp, Homo sapiens
ctgggacatgggaaaggggaag

SEQ ID NO: 2647806 - DNA, 22 bp, Homo sapiens
ctgggaccacaggttcatgcca

SEQ ID NO: 2647807 - DNA, 20 bp, Homo sapiens
ctgggacctcccctgaggct

SEQ ID NO: 2647808 - DNA, 13 bp, Homo sapiens
ctgggactacagg

SEQ ID NO: 2647809 - DNA, 17 bp, Homo sapiens
ctgggactacaggtgtg

SEQ ID NO: 2647810 - DNA, 14 bp, Homo sapiens
ctgggactgagcca

SEQ ID NO: 2647811 - DNA, 20 bp, Homo sapiens
ctgggactgagccagtccca

SEQ ID NO: 2647812 - DNA, 14 bp, Homo sapiens
ctgggacttccttg

SEQ ID NO: 2647813 - DNA, 18 bp, Homo sapiens
ctgggacttccttgctct

SEQ ID NO: 2647814 - DNA, 21 bp, Homo sapiens
ctgggacttccttgctctccc

SEQ ID NO: 2647815 - DNA, 18 bp, Homo sapiens
ctgggacttgcaaaaagg

SEQ ID NO: 2647816 - DNA, 15 bp, Homo sapiens
ctgggagaacctcag

SEQ ID NO: 2647817 - DNA, 16 bp, Homo sapiens
ctgggagaacctcagg

SEQ ID NO: 2647818 - DNA, 17 bp, Homo sapiens
ctgggagaacctcaggc

SEQ ID NO: 2647819 - DNA, 19 bp, Homo sapiens
ctgggagagccttccaggg

SEQ ID NO: 2647820 - DNA, 20 bp, Homo sapiens
ctgggagagccttccagggg

SEQ ID NO: 2647821 - DNA, 14 bp, Homo sapiens
ctgggagctctgca

SEQ ID NO: 2647822 - DNA, 15 bp, Homo sapiens
ctgggaggaagcagg

SEQ ID NO: 2647823 - DNA, 21 bp, Homo sapiens
ctgggaggaagcaggttgagg

SEQ ID NO: 2647824 - DNA, 13 bp, Homo sapiens
ctgggaggcatgg

SEQ ID NO: 2647825 - DNA, 19 bp, Homo sapiens
ctgggagggcagcagggct

SEQ ID NO: 2647826 - DNA, 22 bp, Homo sapiens
ctgggagggcagcagggctacc

SEQ ID NO: 2647827 - DNA, 21 bp, Homo sapiens
ctgggagtagttgtctttcct

SEQ ID NO: 2647828 - DNA, 23 bp, Homo sapiens
ctgggagtagttgtctttcctgg

SEQ ID NO: 2647829 - DNA, 21 bp, Homo sapiens
ctgggatgagccgctgtgagc

SEQ ID NO: 2647830 - DNA, 20 bp, Homo sapiens
ctgggatgggaggagaggac

SEQ ID NO: 2647831 - DNA, 14 bp, Homo sapiens
ctgggatgtccaca

SEQ ID NO: 2647832 - DNA, 20 bp, Homo sapiens
ctgggatgtggctgcagcag

SEQ ID NO: 2647833 - DNA, 21 bp, Homo sapiens
ctgggattacaagcgtgagcc

SEQ ID NO: 2647834 - DNA, 17 bp, Homo sapiens
ctgggattacaggtgtg

SEQ ID NO: 2647835 - DNA, 16 bp, Homo sapiens
ctgggcacacgcctcc

SEQ ID NO: 2647836 - DNA, 23 bp, Homo sapiens
ctgggcacacgcctcccactggg

SEQ ID NO: 2647837 - DNA, 20 bp, Homo sapiens
ctgggcacctggggagtggg

SEQ ID NO: 2647838 - DNA, 13 bp, Homo sapiens
ctgggcagaaggc

SEQ ID NO: 2647839 - DNA, 14 bp, Homo sapiens
ctgggcagaaggcc

SEQ ID NO: 2647840 - DNA, 17 bp, Homo sapiens
ctgggcagaaggccaag

SEQ ID NO: 2647841 - DNA, 11 bp, Homo sapiens
ctgggcagcta

SEQ ID NO: 2647842 - DNA, 17 bp, Homo sapiens
ctgggcaggactcagct

SEQ ID NO: 2647843 - DNA, 12 bp, Homo sapiens
ctgggcattgct

SEQ ID NO: 2647844 - DNA, 17 bp, Homo sapiens
ctgggcccaaccctgtc

SEQ ID NO: 2647845 - DNA, 14 bp, Homo sapiens
ctgggcccagaagg

SEQ ID NO: 2647846 - DNA, 13 bp, Homo sapiens
ctgggccccagcc

SEQ ID NO: 2647847 - DNA, 13 bp, Homo sapiens
ctgggccctctct

SEQ ID NO: 2647848 - DNA, 18 bp, Homo sapiens
ctgggccctctctgctct

SEQ ID NO: 2647849 - DNA, 15 bp, Homo sapiens
ctggttttgtaagat

SEQ ID NO: 2647850 - DNA, 20 bp, Homo sapiens
ctgtaaacctctcgagggca

SEQ ID NO: 2647851 - DNA, 19 bp, Homo sapiens
ctgtaaactcaaaacttaa

SEQ ID NO: 2647852 - DNA, 22 bp, Homo sapiens
ctgtaaactcaaaacttaacat

SEQ ID NO: 2647853 - DNA, 12 bp, Homo sapiens
ctgtaaactgtg

SEQ ID NO: 2647854 - DNA, 13 bp, Homo sapiens
ctgtaaactgtgt

SEQ ID NO: 2647855 - DNA, 14 bp, Homo sapiens
ctgtaaactgtgta

SEQ ID NO: 2647856 - DNA, 20 bp, Homo sapiens
ctgtaaactgtgtattccaa

SEQ ID NO: 2647857 - DNA, 22 bp, Homo sapiens
ctgtaaagagacctacctcagg

SEQ ID NO: 2647858 - DNA, 18 bp, Homo sapiens
ctgtaaatggtgtacata

SEQ ID NO: 2647859 - DNA, 23 bp, Homo sapiens
ctgtaaatggtgtacataatgta

SEQ ID NO: 2647860 - DNA, 19 bp, Homo sapiens
ctgtaacacaagccacaga

SEQ ID NO: 2647861 - DNA, 21 bp, Homo sapiens
ctgtaacacagctgagagact

SEQ ID NO: 2647862 - DNA, 23 bp, Homo sapiens
ctgtaacctcttcagaggccctc

SEQ ID NO: 2647863 - DNA, 20 bp, Homo sapiens
ctgtaagaagagactgggaa

SEQ ID NO: 2647864 - DNA, 17 bp, Homo sapiens
ctgtaaggcatgaagga

SEQ ID NO: 2647865 - DNA, 23 bp, Homo sapiens
ctgtaatcacagctacttgggag

SEQ ID NO: 2647866 - DNA, 18 bp, Homo sapiens
ctgtaatcccagctactt

SEQ ID NO: 2647867 - DNA, 16 bp, Homo sapiens
ctgtaatttagttatt

SEQ ID NO: 2647868 - DNA, 21 bp, Homo sapiens
ctgtaatttgtgatacaatgc

SEQ ID NO: 2647869 - DNA, 14 bp, Homo sapiens
ctgtacaatattta

SEQ ID NO: 2647870 - DNA, 18 bp, Homo sapiens
ctgtacaatatttaaaat

SEQ ID NO: 2647871 - DNA, 15 bp, Homo sapiens
ctgtacaatgacttt

SEQ ID NO: 2647872 - DNA, 19 bp, Homo sapiens
ctgtacactgaatatttat

SEQ ID NO: 2647873 - DNA, 13 bp, Homo sapiens
ctgtacagagccc

SEQ ID NO: 2647874 - DNA, 18 bp, Homo sapiens
ctgtacagagcccacgcc

SEQ ID NO: 2647875 - DNA, 16 bp, Homo sapiens
ctgtacatagcctata

SEQ ID NO: 2647876 - DNA, 22 bp, Homo sapiens
ctgtacctcttgagccttgaac

SEQ ID NO: 2647877 - DNA, 20 bp, Homo sapiens
ctgtactcaggaggctgagg

SEQ ID NO: 2647878 - DNA, 22 bp, Homo sapiens
ctgtactgatttttgtaagaca

SEQ ID NO: 2647879 - DNA, 13 bp, Homo sapiens
ctgtacttaataa

SEQ ID NO: 2647880 - DNA, 18 bp, Homo sapiens
ctgtacttaataaattca

SEQ ID NO: 2647881 - DNA, 20 bp, Homo sapiens
ctgtacttcaagttaaagtg

SEQ ID NO: 2647882 - DNA, 21 bp, Homo sapiens
ctgtagagctagaacatggag

SEQ ID NO: 2647883 - DNA, 13 bp, Homo sapiens
ctgtagagtggga

SEQ ID NO: 2647884 - DNA, 12 bp, Homo sapiens
ctgtagcatctt

SEQ ID NO: 2647885 - DNA, 17 bp, Homo sapiens
ctgtagcatcttctgga

SEQ ID NO: 2647886 - DNA, 19 bp, Homo sapiens
ctgtagcatcttctggagt

SEQ ID NO: 2647887 - DNA, 14 bp, Homo sapiens
ctgtagggaactct

SEQ ID NO: 2647888 - DNA, 24 bp, Homo sapiens
ctgtagggtaattagtaacatgtg

SEQ ID NO: 2647889 - DNA, 18 bp, Homo sapiens
ctgtagtaaactatttat

SEQ ID NO: 2647890 - DNA, 19 bp, Homo sapiens
ctgtagtagccctttctgt

SEQ ID NO: 2647891 - DNA, 23 bp, Homo sapiens
ctgtagtcccagccactcgggag

SEQ ID NO: 2647892 - DNA, 23 bp, Homo sapiens
ctgtagtcctagccactcaggag

SEQ ID NO: 2647893 - DNA, 20 bp, Homo sapiens
ctgtagtgagatagcattgt

SEQ ID NO: 2647894 - DNA, 13 bp, Homo sapiens
ctgtagttaggaa

SEQ ID NO: 2647895 - DNA, 15 bp, Homo sapiens
ctgtagttaggaaat

SEQ ID NO: 2647896 - DNA, 17 bp, Homo sapiens
ctgtagttaggaaataa

SEQ ID NO: 2647897 - DNA, 18 bp, Homo sapiens
ctgtagttaggaaataaa

SEQ ID NO: 2647898 - DNA, 20 bp, Homo sapiens
ctgtagttgcgtggactctg

SEQ ID NO: 2647899 - DNA, 12 bp, Homo sapiens
ctgtagttttat

SEQ ID NO: 2647900 - DNA, 22 bp, Homo sapiens
ctgtagttttatcacatgtatg

SEQ ID NO: 2647901 - DNA, 14 bp, Homo sapiens
ctgtataaatagga

SEQ ID NO: 2647902 - DNA, 19 bp, Homo sapiens
ctgtataaataggagagga

SEQ ID NO: 2647903 - DNA, 15 bp, Homo sapiens
ctgtatagtactggc

SEQ ID NO: 2647904 - DNA, 19 bp, Homo sapiens
ctgtatatacaataacata

SEQ ID NO: 2647905 - DNA, 22 bp, Homo sapiens
ctgtatcaggacccagaggaag

SEQ ID NO: 2647906 - DNA, 23 bp, Homo sapiens
ctgtatcaggacccagaggaagg

SEQ ID NO: 2647907 - DNA, 14 bp, Homo sapiens
ctgtatcccatgag

SEQ ID NO: 2647908 - DNA, 21 bp, Homo sapiens
ctgtatcccatgagcctcagc

SEQ ID NO: 2647909 - DNA, 18 bp, Homo sapiens
ctgtatcggagacagtga

SEQ ID NO: 2647910 - DNA, 18 bp, Homo sapiens
ctgtatcttgtttttcca

SEQ ID NO: 2647911 - DNA, 19 bp, Homo sapiens
ctgtattaagagtgaaaat

SEQ ID NO: 2647912 - DNA, 17 bp, Homo sapiens
ctgtatttatgtgtgag

SEQ ID NO: 2647913 - DNA, 18 bp, Homo sapiens
ctgtatttatgtgtgagg

SEQ ID NO: 2647914 - DNA, 13 bp, Homo sapiens
ctgtatttgtgac

SEQ ID NO: 2647915 - DNA, 21 bp, Homo sapiens
ctgtatttttacctttttcct

SEQ ID NO: 2647916 - DNA, 19 bp, Homo sapiens
ctgtcaaaacaagtttttc

SEQ ID NO: 2647917 - DNA, 21 bp, Homo sapiens
ctgtcaaaacaagtttttctg

SEQ ID NO: 2647918 - DNA, 17 bp, Homo sapiens
ctgtcaaaataatttta

SEQ ID NO: 2647919 - DNA, 18 bp, Homo sapiens
ctgtcaatttccctgact

SEQ ID NO: 2647920 - DNA, 14 bp, Homo sapiens
ctgtcaccctccac

SEQ ID NO: 2647921 - DNA, 13 bp, Homo sapiens
ctgtcactgcagg

SEQ ID NO: 2647922 - DNA, 18 bp, Homo sapiens
ctgtcactttgctctggg

SEQ ID NO: 2647923 - DNA, 21 bp, Homo sapiens
ctgtcagctcccctcggagaa

SEQ ID NO: 2647924 - DNA, 23 bp, Homo sapiens
ctgtcagctcccctcggagaaga

SEQ ID NO: 2647925 - DNA, 16 bp, Homo sapiens
ctgtcagtatgacatt

SEQ ID NO: 2647926 - DNA, 14 bp, Homo sapiens
ctgtcatagaaatt

SEQ ID NO: 2647927 - DNA, 23 bp, Homo sapiens
ctgtcattcccaccaccctgagg

SEQ ID NO: 2647928 - DNA, 16 bp, Homo sapiens
ctgtcatttgagcagg

SEQ ID NO: 2647929 - DNA, 18 bp, Homo sapiens
ctgtcatttgagcagggc

SEQ ID NO: 2647930 - DNA, 20 bp, Homo sapiens
ctgtcatttgagcagggctc

SEQ ID NO: 2647931 - DNA, 17 bp, Homo sapiens
ctgtccaaaggaggctg

SEQ ID NO: 2647932 - DNA, 19 bp, Homo sapiens
ctgtccaaaggaggctggc

SEQ ID NO: 2647933 - DNA, 11 bp, Homo sapiens
ctgtccaagga

SEQ ID NO: 2647934 - DNA, 12 bp, Homo sapiens
ctgtccagacag

SEQ ID NO: 2647935 - DNA, 21 bp, Homo sapiens
ctgtccagacagcctgtatct

SEQ ID NO: 2647936 - DNA, 19 bp, Homo sapiens
ctgtccaggcactgagata

SEQ ID NO: 2647937 - DNA, 19 bp, Homo sapiens
ctgtccaggcactgctgcc

SEQ ID NO: 2647938 - DNA, 18 bp, Homo sapiens
ctgtccagggccctgagc

SEQ ID NO: 2647939 - DNA, 20 bp, Homo sapiens
ctgtccagggccctgagctc

SEQ ID NO: 2647940 - DNA, 23 bp, Homo sapiens
ctgtccagggccctgagctcggt

SEQ ID NO: 2647941 - DNA, 15 bp, Homo sapiens
ctgtccagttcccag

SEQ ID NO: 2647942 - DNA, 19 bp, Homo sapiens
ctgtccagttcccagaagg

SEQ ID NO: 2647943 - DNA, 21 bp, Homo sapiens
ctgtccagttcccagaaggca

SEQ ID NO: 2647944 - DNA, 14 bp, Homo sapiens
ctgtcccaccccca

SEQ ID NO: 2647945 - DNA, 18 bp, Homo sapiens
ctgtcccatggacactcc

SEQ ID NO: 2647946 - DNA, 13 bp, Homo sapiens
ctgtccctcactg

SEQ ID NO: 2647947 - DNA, 17 bp, Homo sapiens
ctgtccctccgggacct

SEQ ID NO: 2647948 - DNA, 15 bp, Homo sapiens
ctgtccctctcaggc

SEQ ID NO: 2647949 - DNA, 16 bp, Homo sapiens
ctgtccctctcaggca

SEQ ID NO: 2647950 - DNA, 14 bp, Homo sapiens
ctgtccctgcctca

SEQ ID NO: 2647951 - DNA, 16 bp, Homo sapiens
ctgtcccttctcttaa

SEQ ID NO: 2647952 - DNA, 21 bp, Homo sapiens
ctgtcccttctcttaatttaa

SEQ ID NO: 2647953 - DNA, 13 bp, Homo sapiens
ctgtcccttggag

SEQ ID NO: 2647954 - DNA, 22 bp, Homo sapiens
ctgtcccttggagctgtaaacc

SEQ ID NO: 2647955 - DNA, 14 bp, Homo sapiens
ctgtcctacccacc

SEQ ID NO: 2647956 - DNA, 16 bp, Homo sapiens
ctgtcctactctgtgt

SEQ ID NO: 2647957 - DNA, 20 bp, Homo sapiens
ctgtcctactctgtgtcagg

SEQ ID NO: 2647958 - DNA, 17 bp, Homo sapiens
ctgtcctccaagccagc

SEQ ID NO: 2647959 - DNA, 20 bp, Homo sapiens
ctgtcctctctggctgggga

SEQ ID NO: 2647960 - DNA, 15 bp, Homo sapiens
ctgtcctcttctgca

SEQ ID NO: 2647961 - DNA, 20 bp, Homo sapiens
ctgtcctgggagtgagctgg

SEQ ID NO: 2647962 - DNA, 12 bp, Homo sapiens
ctgtcctgggcg

SEQ ID NO: 2647963 - DNA, 13 bp, Homo sapiens
ctgtcctgggcgc

SEQ ID NO: 2647964 - DNA, 23 bp, Homo sapiens
ctgtcctgggcgccctggaagcc

SEQ ID NO: 2647965 - DNA, 17 bp, Homo sapiens
ctgtcctggtgtcactt

SEQ ID NO: 2647966 - DNA, 12 bp, Homo sapiens
ctgtccttaccc

SEQ ID NO: 2647967 - DNA, 17 bp, Homo sapiens
ctgtccttacccatctg

SEQ ID NO: 2647968 - DNA, 14 bp, Homo sapiens
ctgtccttcagatg

SEQ ID NO: 2647969 - DNA, 16 bp, Homo sapiens
ctgtccttcagatgga

SEQ ID NO: 2647970 - DNA, 15 bp, Homo sapiens
ctgtcgatgtaggca

SEQ ID NO: 2647971 - DNA, 13 bp, Homo sapiens
ctgtctaactgct

SEQ ID NO: 2647972 - DNA, 16 bp, Homo sapiens
ctgtctcaaaaaaaga

SEQ ID NO: 2647973 - DNA, 12 bp, Homo sapiens
ctgtctcagcct

SEQ ID NO: 2647974 - DNA, 17 bp, Homo sapiens
ctgtctcagcctcccag

SEQ ID NO: 2647975 - DNA, 12 bp, Homo sapiens
ctgtctcatcca

SEQ ID NO: 2647976 - DNA, 16 bp, Homo sapiens
ctgtctcatccccagg

SEQ ID NO: 2647977 - DNA, 19 bp, Homo sapiens
ctgtctcatccccaggggt

SEQ ID NO: 2647978 - DNA, 20 bp, Homo sapiens
ctgtctcatccccaggggtc

SEQ ID NO: 2647979 - DNA, 12 bp, Homo sapiens
ctgtctccagac

SEQ ID NO: 2647980 - DNA, 19 bp, Homo sapiens
ctgtctccagacccccacc

SEQ ID NO: 2647981 - DNA, 18 bp, Homo sapiens
ctgtctctactaaaaata

SEQ ID NO: 2647982 - DNA, 15 bp, Homo sapiens
ctgtctctagccact

SEQ ID NO: 2647983 - DNA, 13 bp, Homo sapiens
ctgtctctccatc

SEQ ID NO: 2647984 - DNA, 16 bp, Homo sapiens
ctgtctctccatctgt

SEQ ID NO: 2647985 - DNA, 13 bp, Homo sapiens
ctgtctctgcctc

SEQ ID NO: 2647986 - DNA, 14 bp, Homo sapiens
ctgtctctgtcatg

SEQ ID NO: 2647987 - DNA, 15 bp, Homo sapiens
ctgtctcttccatat

SEQ ID NO: 2647988 - DNA, 16 bp, Homo sapiens
ctgtctgaagccaatg

SEQ ID NO: 2647989 - DNA, 16 bp, Homo sapiens
ctgtctgccagccagc

SEQ ID NO: 2647990 - DNA, 15 bp, Homo sapiens
ctgtctgctcagaca

SEQ ID NO: 2647991 - DNA, 15 bp, Homo sapiens
ctgtctggccaggcc

SEQ ID NO: 2647992 - DNA, 23 bp, Homo sapiens
ctgtctggtttcaccgaggacat

SEQ ID NO: 2647993 - DNA, 16 bp, Homo sapiens
ctgtctggttttaaca

SEQ ID NO: 2647994 - DNA, 23 bp, Homo sapiens
cttagagcctccctcaattcccc

SEQ ID NO: 2647995 - DNA, 13 bp, Homo sapiens
cttagatgtatat

SEQ ID NO: 2647996 - DNA, 19 bp, Homo sapiens
cttagatgtatatatttcc

SEQ ID NO: 2647997 - DNA, 14 bp, Homo sapiens
cttagcaggagagg

SEQ ID NO: 2647998 - DNA, 22 bp, Homo sapiens
cttagcaggagaggagagccag

SEQ ID NO: 2647999 - DNA, 18 bp, Homo sapiens
cttagcagggaaacagct

SEQ ID NO: 2648000 - DNA, 13 bp, Homo sapiens
cttagcccccacc

SEQ ID NO: 2648001 - DNA, 17 bp, Homo sapiens
cttagcccccacccact

SEQ ID NO: 2648002 - DNA, 14 bp, Homo sapiens
cttagcctcctgac

SEQ ID NO: 2648003 - DNA, 21 bp, Homo sapiens
cttagcctcctgacctgaggc

SEQ ID NO: 2648004 - DNA, 22 bp, Homo sapiens
cttagcctcctgacctgaggct

SEQ ID NO: 2648005 - DNA, 14 bp, Homo sapiens
cttagctatcagaa

SEQ ID NO: 2648006 - DNA, 23 bp, Homo sapiens
cttagctcattctccttgtgtta

SEQ ID NO: 2648007 - DNA, 15 bp, Homo sapiens
cttagcttagacctc

SEQ ID NO: 2648008 - DNA, 17 bp, Homo sapiens
cttagcttagacctcag

SEQ ID NO: 2648009 - DNA, 19 bp, Homo sapiens
cttagcttagacctcagcc

SEQ ID NO: 2648010 - DNA, 22 bp, Homo sapiens
cttaggaagagaaaccagggag

SEQ ID NO: 2648011 - DNA, 11 bp, Homo sapiens
cttaggaagga

SEQ ID NO: 2648012 - DNA, 15 bp, Homo sapiens
cttaggagagaccga

SEQ ID NO: 2648013 - DNA, 14 bp, Homo sapiens
cttaggcagggaag

SEQ ID NO: 2648014 - DNA, 17 bp, Homo sapiens
cttaggttggcaaaaag

SEQ ID NO: 2648015 - DNA, 20 bp, Homo sapiens
cttagtaatgctacgtgtga

SEQ ID NO: 2648016 - DNA, 23 bp, Homo sapiens
cttagtaatgctacgtgtgattt

SEQ ID NO: 2648017 - DNA, 14 bp, Homo sapiens
cttagtcactgaga

SEQ ID NO: 2648018 - DNA, 18 bp, Homo sapiens
cttagtcactgagacagc

SEQ ID NO: 2648019 - DNA, 18 bp, Homo sapiens
cttagtctcagtttgtgt

SEQ ID NO: 2648020 - DNA, 19 bp, Homo sapiens
cttagtctcagtttgtgtg

SEQ ID NO: 2648021 - DNA, 16 bp, Homo sapiens
cttagtcttctcatag

SEQ ID NO: 2648022 - DNA, 13 bp, Homo sapiens
cttagtgtttctg

SEQ ID NO: 2648023 - DNA, 17 bp, Homo sapiens
cttagtgtttctgtgca

SEQ ID NO: 2648024 - DNA, 18 bp, Homo sapiens
cttagtgtttctgtgcat

SEQ ID NO: 2648025 - DNA, 12 bp, Homo sapiens
cttataaatatg

SEQ ID NO: 2648026 - DNA, 13 bp, Homo sapiens
cttataaatatga

SEQ ID NO: 2648027 - DNA, 15 bp, Homo sapiens
cttatagaatattta

SEQ ID NO: 2648028 - DNA, 19 bp, Homo sapiens
cttataggaattgacccac

SEQ ID NO: 2648029 - DNA, 19 bp, Homo sapiens
cttatatagtttactattt

SEQ ID NO: 2648030 - DNA, 21 bp, Homo sapiens
cttatatcatcagcatacctt

SEQ ID NO: 2648031 - DNA, 18 bp, Homo sapiens
cttatatgtgtattgcta

SEQ ID NO: 2648032 - DNA, 18 bp, Homo sapiens
cttatattgtaagaaata

SEQ ID NO: 2648033 - DNA, 11 bp, Homo sapiens
cttatcaagtg

SEQ ID NO: 2648034 - DNA, 17 bp, Homo sapiens
cttatcaagtgtcttcc

SEQ ID NO: 2648035 - DNA, 19 bp, Homo sapiens
cttatcaccagctgcctct

SEQ ID NO: 2648036 - DNA, 15 bp, Homo sapiens
cttatccagctggtg

SEQ ID NO: 2648037 - DNA, 19 bp, Homo sapiens
cttatccaggactctgtca

SEQ ID NO: 2648038 - DNA, 21 bp, Homo sapiens
cttatcctaaaacaaatagtt

SEQ ID NO: 2648039 - DNA, 14 bp, Homo sapiens
cttatcctctgatc

SEQ ID NO: 2648040 - DNA, 22 bp, Homo sapiens
cttatcctctgatctccatggc

SEQ ID NO: 2648041 - DNA, 12 bp, Homo sapiens
cttatctctctg

SEQ ID NO: 2648042 - DNA, 17 bp, Homo sapiens
cttatctgtgcgtgaaa

SEQ ID NO: 2648043 - DNA, 19 bp, Homo sapiens
cttatctgtgcgtgaaaca

SEQ ID NO: 2648044 - DNA, 21 bp, Homo sapiens
cttatctgtgcgtgaaacaca

SEQ ID NO: 2648045 - DNA, 14 bp, Homo sapiens
cttatcttatgcca

SEQ ID NO: 2648046 - DNA, 23 bp, Homo sapiens
cttatgattcagattgttatcta

SEQ ID NO: 2648047 - DNA, 14 bp, Homo sapiens
cttatgccacggga

SEQ ID NO: 2648048 - DNA, 23 bp, Homo sapiens
cttatgggctgggttctacccag

SEQ ID NO: 2648049 - DNA, 12 bp, Homo sapiens
cttattgttcca

SEQ ID NO: 2648050 - DNA, 13 bp, Homo sapiens
cttattgttccaa

SEQ ID NO: 2648051 - DNA, 13 bp, Homo sapiens
cttatttattatt

SEQ ID NO: 2648052 - DNA, 21 bp, Homo sapiens
cttatttattcatattttctt

SEQ ID NO: 2648053 - DNA, 15 bp, Homo sapiens
cttatttcatttctt

SEQ ID NO: 2648054 - DNA, 12 bp, Homo sapiens
cttattttcaag

SEQ ID NO: 2648055 - DNA, 15 bp, Homo sapiens
cttattttcaagaaa

SEQ ID NO: 2648056 - DNA, 18 bp, Homo sapiens
cttattttcaagaaactg

SEQ ID NO: 2648057 - DNA, 19 bp, Homo sapiens
cttattttcaagaaactga

SEQ ID NO: 2648058 - DNA, 21 bp, Homo sapiens
cttatttttaaaattttaata

SEQ ID NO: 2648059 - DNA, 18 bp, Homo sapiens
cttatttttttctgattg

SEQ ID NO: 2648060 - DNA, 21 bp, Homo sapiens
cttcaaaagtattttcctgta

SEQ ID NO: 2648061 - DNA, 23 bp, Homo sapiens
cttcaaactagggccaagcccag

SEQ ID NO: 2648062 - DNA, 15 bp, Homo sapiens
cttcaaatatttccc

SEQ ID NO: 2648063 - DNA, 14 bp, Homo sapiens
cttcaaatccatcc

SEQ ID NO: 2648064 - DNA, 19 bp, Homo sapiens
cttcaacatcaatgttcat

SEQ ID NO: 2648065 - DNA, 20 bp, Homo sapiens
cttcaacatcaatgttcatt

SEQ ID NO: 2648066 - DNA, 20 bp, Homo sapiens
cttcaactgaccagcctcca

SEQ ID NO: 2648067 - DNA, 23 bp, Homo sapiens
cttcaactgaccagcctccatgc

SEQ ID NO: 2648068 - DNA, 18 bp, Homo sapiens
cttcaagaactctgggct

SEQ ID NO: 2648069 - DNA, 18 bp, Homo sapiens
cttcaagttaaagtgaat

SEQ ID NO: 2648070 - DNA, 22 bp, Homo sapiens
cttcaatacccaaatcctctcc

SEQ ID NO: 2648071 - DNA, 15 bp, Homo sapiens
cttcaattaataaaa

SEQ ID NO: 2648072 - DNA, 15 bp, Homo sapiens
cttcaattcctgggc

SEQ ID NO: 2648073 - DNA, 20 bp, Homo sapiens
cttcacagagtgtgctggag

SEQ ID NO: 2648074 - DNA, 23 bp, Homo sapiens
cttcacagatgggtgcttggagg

SEQ ID NO: 2648075 - DNA, 12 bp, Homo sapiens
cttcacagtgtt

SEQ ID NO: 2648076 - DNA, 14 bp, Homo sapiens
cttcacatattgat

SEQ ID NO: 2648077 - DNA, 23 bp, Homo sapiens
cttcacatattgatttccgttaa

SEQ ID NO: 2648078 - DNA, 18 bp, Homo sapiens
cttcaccccaatcccagc

SEQ ID NO: 2648079 - DNA, 19 bp, Homo sapiens
cttcaccccagtggccact

SEQ ID NO: 2648080 - DNA, 23 bp, Homo sapiens
cttcaccccagtggccactcagc

SEQ ID NO: 2648081 - DNA, 14 bp, Homo sapiens
cttcacctttgtcc

SEQ ID NO: 2648082 - DNA, 22 bp, Homo sapiens
cttcacctttgtccccaccgca

SEQ ID NO: 2648083 - DNA, 18 bp, Homo sapiens
cttcacgaagtgttgcat

SEQ ID NO: 2648084 - DNA, 14 bp, Homo sapiens
cttcactccggtgt

SEQ ID NO: 2648085 - DNA, 19 bp, Homo sapiens
cttcactccggtgtgcctg

SEQ ID NO: 2648086 - DNA, 15 bp, Homo sapiens
cttcactgcctttgc

SEQ ID NO: 2648087 - DNA, 19 bp, Homo sapiens
cttcactgttgaaaattat

SEQ ID NO: 2648088 - DNA, 16 bp, Homo sapiens
cttcacttctgaccac

SEQ ID NO: 2648089 - DNA, 21 bp, Homo sapiens
cttcacttctgaccacacttc

SEQ ID NO: 2648090 - DNA, 17 bp, Homo sapiens
cttcagaagacactgca

SEQ ID NO: 2648091 - DNA, 18 bp, Homo sapiens
cttcagactttgcttccc

SEQ ID NO: 2648092 - DNA, 18 bp, Homo sapiens
cttcagagactcctgcag

SEQ ID NO: 2648093 - DNA, 20 bp, Homo sapiens
cttcagagactcctgcaggc

SEQ ID NO: 2648094 - DNA, 21 bp, Homo sapiens
cttcagagactcctgcaggca

SEQ ID NO: 2648095 - DNA, 23 bp, Homo sapiens
cttcagagactcctgcaggcagc

SEQ ID NO: 2648096 - DNA, 11 bp, Homo sapiens
cttcagagagc

SEQ ID NO: 2648097 - DNA, 14 bp, Homo sapiens
cttcagagagctgg

SEQ ID NO: 2648098 - DNA, 14 bp, Homo sapiens
cttcagccatcaac

SEQ ID NO: 2648099 - DNA, 21 bp, Homo sapiens
cttcagcctagccgacctcag

SEQ ID NO: 2648100 - DNA, 16 bp, Homo sapiens
cttcagcctcccgagt

SEQ ID NO: 2648101 - DNA, 20 bp, Homo sapiens
cttcagcctcccgagtagct

SEQ ID NO: 2648102 - DNA, 15 bp, Homo sapiens
cttcagcctgaaaga

SEQ ID NO: 2648103 - DNA, 20 bp, Homo sapiens
cttcagcctgaggctgagac

SEQ ID NO: 2648104 - DNA, 15 bp, Homo sapiens
cttcaggcctccctc

SEQ ID NO: 2648105 - DNA, 19 bp, Homo sapiens
cttcagggcagggctctga

SEQ ID NO: 2648106 - DNA, 17 bp, Homo sapiens
cttcaggggcacttcat

SEQ ID NO: 2648107 - DNA, 18 bp, Homo sapiens
cttcagggtgatgccagg

SEQ ID NO: 2648108 - DNA, 19 bp, Homo sapiens
cttcaggttcttagtgtca

SEQ ID NO: 2648109 - DNA, 19 bp, Homo sapiens
cttcagtgcatctgggaag

SEQ ID NO: 2648110 - DNA, 13 bp, Homo sapiens
cttcagtggcagc

SEQ ID NO: 2648111 - DNA, 15 bp, Homo sapiens
cttcagtggcagctg

SEQ ID NO: 2648112 - DNA, 18 bp, Homo sapiens
cttcagtggcagctgctt

SEQ ID NO: 2648113 - DNA, 17 bp, Homo sapiens
cttcagtttcctggtct

SEQ ID NO: 2648114 - DNA, 14 bp, Homo sapiens
cttcataaatgaag

SEQ ID NO: 2648115 - DNA, 19 bp, Homo sapiens
cttcataacaattttagga

SEQ ID NO: 2648116 - DNA, 21 bp, Homo sapiens
cttcatactttttttcacagt

SEQ ID NO: 2648117 - DNA, 19 bp, Homo sapiens
cttcatccggcagcctgga

SEQ ID NO: 2648118 - DNA, 13 bp, Homo sapiens
cttcatctccagg

SEQ ID NO: 2648119 - DNA, 17 bp, Homo sapiens
cttcatctccagggagt

SEQ ID NO: 2648120 - DNA, 12 bp, Homo sapiens
cttcatctggaa

SEQ ID NO: 2648121 - DNA, 13 bp, Homo sapiens
cttcatctggaac

SEQ ID NO: 2648122 - DNA, 23 bp, Homo sapiens
cttcatctggcaacatctttatc

SEQ ID NO: 2648123 - DNA, 16 bp, Homo sapiens
cttcatttcattgtat

SEQ ID NO: 2648124 - DNA, 19 bp, Homo sapiens
cttcatttcattgtatgat

SEQ ID NO: 2648125 - DNA, 13 bp, Homo sapiens
cttcatttggaga

SEQ ID NO: 2648126 - DNA, 14 bp, Homo sapiens
cttcatttgtgtca

SEQ ID NO: 2648127 - DNA, 19 bp, Homo sapiens
cttccaaatcccctaagca

SEQ ID NO: 2648128 - DNA, 20 bp, Homo sapiens
cttccaaatcccctaagcag

SEQ ID NO: 2648129 - DNA, 19 bp, Homo sapiens
cttccaacccattagccat

SEQ ID NO: 2648130 - DNA, 14 bp, Homo sapiens
cttccacaccccca

SEQ ID NO: 2648131 - DNA, 16 bp, Homo sapiens
cttccaccagcctgca

SEQ ID NO: 2648132 - DNA, 17 bp, Homo sapiens
cttccaccagcctgcac

SEQ ID NO: 2648133 - DNA, 21 bp, Homo sapiens
cttccaccagcctgcactact

SEQ ID NO: 2648134 - DNA, 14 bp, Homo sapiens
cttccacctccctc

SEQ ID NO: 2648135 - DNA, 20 bp, Homo sapiens
cttccacgctgtctccagac

SEQ ID NO: 2648136 - DNA, 21 bp, Homo sapiens
cttccacttttttttgtatgt

SEQ ID NO: 2648137 - DNA, 15 bp, Homo sapiens
cttccagaagtgtga

SEQ ID NO: 2648138 - DNA, 14 bp, Homo sapiens
cttgttttcttgcc

SEQ ID NO: 2648139 - DNA, 18 bp, Homo sapiens
cttgtttttccactactg

SEQ ID NO: 2648140 - DNA, 19 bp, Homo sapiens
ctttaaaaaaatttaagtg

SEQ ID NO: 2648141 - DNA, 16 bp, Homo sapiens
ctttaaactcagggac

SEQ ID NO: 2648142 - DNA, 22 bp, Homo sapiens
ctttaaactcagggacagagcc

SEQ ID NO: 2648143 - DNA, 18 bp, Homo sapiens
ctttaaaggaaaaaatgt

SEQ ID NO: 2648144 - DNA, 19 bp, Homo sapiens
ctttaaaggaaaaaatgtt

SEQ ID NO: 2648145 - DNA, 19 bp, Homo sapiens
ctttaagcactacataaac

SEQ ID NO: 2648146 - DNA, 14 bp, Homo sapiens
ctttaatcttcagt

SEQ ID NO: 2648147 - DNA, 22 bp, Homo sapiens
ctttaatcttcagttttatctt

SEQ ID NO: 2648148 - DNA, 18 bp, Homo sapiens
ctttaatgtcacaggcag

SEQ ID NO: 2648149 - DNA, 19 bp, Homo sapiens
ctttaatgtcacaggcagg

SEQ ID NO: 2648150 - DNA, 23 bp, Homo sapiens
ctttaatgtcacaggcaggtcca

SEQ ID NO: 2648151 - DNA, 18 bp, Homo sapiens
ctttaattaccaacctgt

SEQ ID NO: 2648152 - DNA, 17 bp, Homo sapiens
ctttaattctcatgtga

SEQ ID NO: 2648153 - DNA, 19 bp, Homo sapiens
ctttaatttatttttgcat

SEQ ID NO: 2648154 - DNA, 23 bp, Homo sapiens
ctttacacattcggctccctgga

SEQ ID NO: 2648155 - DNA, 17 bp, Homo sapiens
ctttacatgacacagct

SEQ ID NO: 2648156 - DNA, 16 bp, Homo sapiens
ctttaccttttttctt

SEQ ID NO: 2648157 - DNA, 18 bp, Homo sapiens
ctttacggacaccccctc

SEQ ID NO: 2648158 - DNA, 22 bp, Homo sapiens
ctttactaagatgacattgcta

SEQ ID NO: 2648159 - DNA, 14 bp, Homo sapiens
ctttactgtttgtt

SEQ ID NO: 2648160 - DNA, 17 bp, Homo sapiens
ctttagagcattgccat

SEQ ID NO: 2648161 - DNA, 19 bp, Homo sapiens
ctttagagcattgccattc

SEQ ID NO: 2648162 - DNA, 23 bp, Homo sapiens
ctttagagcattgccattccctg

SEQ ID NO: 2648163 - DNA, 13 bp, Homo sapiens
ctttagagtagca

SEQ ID NO: 2648164 - DNA, 13 bp, Homo sapiens
ctttagatgctga

SEQ ID NO: 2648165 - DNA, 15 bp, Homo sapiens
ctttagccaaaccct

SEQ ID NO: 2648166 - DNA, 21 bp, Homo sapiens
ctttagggactcaatttctcc

SEQ ID NO: 2648167 - DNA, 14 bp, Homo sapiens
ctttagggcagctt

SEQ ID NO: 2648168 - DNA, 16 bp, Homo sapiens
ctttagggcagcttgc

SEQ ID NO: 2648169 - DNA, 22 bp, Homo sapiens
ctttagtacctgaaaagtaact

SEQ ID NO: 2648170 - DNA, 13 bp, Homo sapiens
ctttataaacttt

SEQ ID NO: 2648171 - DNA, 13 bp, Homo sapiens
ctttatacaacag

SEQ ID NO: 2648172 - DNA, 17 bp, Homo sapiens
ctttatacaacagtgct

SEQ ID NO: 2648173 - DNA, 18 bp, Homo sapiens
ctttatacgtgtagctat

SEQ ID NO: 2648174 - DNA, 13 bp, Homo sapiens
ctttatatgaaga

SEQ ID NO: 2648175 - DNA, 13 bp, Homo sapiens
ctttatctgttct

SEQ ID NO: 2648176 - DNA, 16 bp, Homo sapiens
ctttatgtaataatgt

SEQ ID NO: 2648177 - DNA, 23 bp, Homo sapiens
ctttatgtggaaaacagaacatc

SEQ ID NO: 2648178 - DNA, 22 bp, Homo sapiens
ctttatgttgcggtgagaactc

SEQ ID NO: 2648179 - DNA, 13 bp, Homo sapiens
ctttattaaaatc

SEQ ID NO: 2648180 - DNA, 18 bp, Homo sapiens
ctttattaaaatcttaaa

SEQ ID NO: 2648181 - DNA, 18 bp, Homo sapiens
ctttattggctgagatat

SEQ ID NO: 2648182 - DNA, 13 bp, Homo sapiens
ctttattttctgg

SEQ ID NO: 2648183 - DNA, 18 bp, Homo sapiens
ctttattttttaagtatt

SEQ ID NO: 2648184 - DNA, 21 bp, Homo sapiens
ctttattttttaagtatttat

SEQ ID NO: 2648185 - DNA, 21 bp, Homo sapiens
ctttcaaagaaggaattctag

SEQ ID NO: 2648186 - DNA, 21 bp, Homo sapiens
ctttcaaattgagagaatgga

SEQ ID NO: 2648187 - DNA, 22 bp, Homo sapiens
ctttcaatggtttgcaaggaag

SEQ ID NO: 2648188 - DNA, 17 bp, Homo sapiens
ctttcacatagagatca

SEQ ID NO: 2648189 - DNA, 16 bp, Homo sapiens
ctttcacatagatgtc

SEQ ID NO: 2648190 - DNA, 15 bp, Homo sapiens
ctttcagatgtcttc

SEQ ID NO: 2648191 - DNA, 21 bp, Homo sapiens
ctttcaggggggttgtgaggc

SEQ ID NO: 2648192 - DNA, 19 bp, Homo sapiens
ctttcatcctgactctgcc

SEQ ID NO: 2648193 - DNA, 20 bp, Homo sapiens
ctttcatcctgactctgccc

SEQ ID NO: 2648194 - DNA, 21 bp, Homo sapiens
ctttcatggggtgatgctggg

SEQ ID NO: 2648195 - DNA, 19 bp, Homo sapiens
ctttcatgtaaactgtgca

SEQ ID NO: 2648196 - DNA, 21 bp, Homo sapiens
ctttcatgtaaactgtgcacc

SEQ ID NO: 2648197 - DNA, 16 bp, Homo sapiens
ctttcatttactgtgg

SEQ ID NO: 2648198 - DNA, 18 bp, Homo sapiens
ctttcatttcttgaggta

SEQ ID NO: 2648199 - DNA, 17 bp, Homo sapiens
ctttcattttctgtttg

SEQ ID NO: 2648200 - DNA, 16 bp, Homo sapiens
ctttccaaagtacact

SEQ ID NO: 2648201 - DNA, 22 bp, Homo sapiens
ctttccaaatgcccagcttaaa

SEQ ID NO: 2648202 - DNA, 21 bp, Homo sapiens
ctttccacacctggcactgct

SEQ ID NO: 2648203 - DNA, 14 bp, Homo sapiens
ctttccaccccctc

SEQ ID NO: 2648204 - DNA, 9 bp, Homo sapiens
ctttccaga

SEQ ID NO: 2648205 - DNA, 12 bp, Homo sapiens
ctttccagctca

SEQ ID NO: 2648206 - DNA, 21 bp, Homo sapiens
ctttccagctcaccccccaca

SEQ ID NO: 2648207 - DNA, 19 bp, Homo sapiens
ctttcccccaccagctaag

SEQ ID NO: 2648208 - DNA, 13 bp, Homo sapiens
ctttcccctgtgg

SEQ ID NO: 2648209 - DNA, 16 bp, Homo sapiens
ctttcctctttggtct

SEQ ID NO: 2648210 - DNA, 20 bp, Homo sapiens
ctttcctgaggctgggctcc

SEQ ID NO: 2648211 - DNA, 21 bp, Homo sapiens
ctttcctgaggctgggctccc

SEQ ID NO: 2648212 - DNA, 11 bp, Homo sapiens
ctttcctgcct

SEQ ID NO: 2648213 - DNA, 15 bp, Homo sapiens
ctttccttccatccc

SEQ ID NO: 2648214 - DNA, 15 bp, Homo sapiens
ctttccttgctcaac

SEQ ID NO: 2648215 - DNA, 22 bp, Homo sapiens
ctttcggggagaggctgaggac

SEQ ID NO: 2648216 - DNA, 23 bp, Homo sapiens
ctttctacagtattatgtactct

SEQ ID NO: 2648217 - DNA, 18 bp, Homo sapiens
ctttctagtggtctttgt

SEQ ID NO: 2648218 - DNA, 23 bp, Homo sapiens
ctttctagtggtctttgtaagag

SEQ ID NO: 2648219 - DNA, 15 bp, Homo sapiens
ctttctattccaaag

SEQ ID NO: 2648220 - DNA, 20 bp, Homo sapiens
ctttctcagcctctgaatat

SEQ ID NO: 2648221 - DNA, 15 bp, Homo sapiens
ctttctcagttttca

SEQ ID NO: 2648222 - DNA, 20 bp, Homo sapiens
ctttctcagttttcataagt

SEQ ID NO: 2648223 - DNA, 14 bp, Homo sapiens
ctttctccagccag

SEQ ID NO: 2648224 - DNA, 18 bp, Homo sapiens
ctttctcccactgagttt

SEQ ID NO: 2648225 - DNA, 19 bp, Homo sapiens
ctttctcccaggccaggct

SEQ ID NO: 2648226 - DNA, 20 bp, Homo sapiens
ctttctcccaggccaggctc

SEQ ID NO: 2648227 - DNA, 15 bp, Homo sapiens
ctttctccttagtct

SEQ ID NO: 2648228 - DNA, 18 bp, Homo sapiens
ctttctcgattttatctt

SEQ ID NO: 2648229 - DNA, 17 bp, Homo sapiens
ctttctgagcacacttt

SEQ ID NO: 2648230 - DNA, 13 bp, Homo sapiens
ctttctgtaaact

SEQ ID NO: 2648231 - DNA, 19 bp, Homo sapiens
ctttctgtccttttggcac

SEQ ID NO: 2648232 - DNA, 21 bp, Homo sapiens
ctttctgtgtgcaccttacca

SEQ ID NO: 2648233 - DNA, 11 bp, Homo sapiens
ctttcttcctc

SEQ ID NO: 2648234 - DNA, 13 bp, Homo sapiens
ctttcttcctctg

SEQ ID NO: 2648235 - DNA, 16 bp, Homo sapiens
ctttcttcctctgctg

SEQ ID NO: 2648236 - DNA, 16 bp, Homo sapiens
ctttcttgctggttgt

SEQ ID NO: 2648237 - DNA, 14 bp, Homo sapiens
ctttcttggccagt

SEQ ID NO: 2648238 - DNA, 22 bp, Homo sapiens
ctttcttggttcataaatgaat

SEQ ID NO: 2648239 - DNA, 17 bp, Homo sapiens
ctttctttacctgagac

SEQ ID NO: 2648240 - DNA, 20 bp, Homo sapiens
ctttctttttcttcttccct

SEQ ID NO: 2648241 - DNA, 17 bp, Homo sapiens
ctttgaataaaaatgca

SEQ ID NO: 2648242 - DNA, 13 bp, Homo sapiens
ctttgacctctgc

SEQ ID NO: 2648243 - DNA, 14 bp, Homo sapiens
ctttgacctgttgg

SEQ ID NO: 2648244 - DNA, 18 bp, Homo sapiens
ctttgacgccatcccagc

SEQ ID NO: 2648245 - DNA, 13 bp, Homo sapiens
ctttgagacagtt

SEQ ID NO: 2648246 - DNA, 17 bp, Homo sapiens
ctttgagacagtttctt

SEQ ID NO: 2648247 - DNA, 18 bp, Homo sapiens
ctttgagatagaagaact

SEQ ID NO: 2648248 - DNA, 19 bp, Homo sapiens
ctttgagatagaagaactg

SEQ ID NO: 2648249 - DNA, 20 bp, Homo sapiens
ctttgagatagaagaactgc

SEQ ID NO: 2648250 - DNA, 13 bp, Homo sapiens
ctttgaggaaacc

SEQ ID NO: 2648251 - DNA, 14 bp, Homo sapiens
ctttgataaaataa

SEQ ID NO: 2648252 - DNA, 17 bp, Homo sapiens
ctttgataaaataaatg

SEQ ID NO: 2648253 - DNA, 13 bp, Homo sapiens
ctttgataatgtt

SEQ ID NO: 2648254 - DNA, 16 bp, Homo sapiens
ctttgataatgttaaa

SEQ ID NO: 2648255 - DNA, 21 bp, Homo sapiens
ctttgataatgttaaatttgt

SEQ ID NO: 2648256 - DNA, 17 bp, Homo sapiens
ctttgatgttaacacat

SEQ ID NO: 2648257 - DNA, 20 bp, Homo sapiens
ctttgatgttaacacatttt

SEQ ID NO: 2648258 - DNA, 15 bp, Homo sapiens
ctttgcaaaggagct

SEQ ID NO: 2648259 - DNA, 15 bp, Homo sapiens
ctttgcactgagggc

SEQ ID NO: 2648260 - DNA, 22 bp, Homo sapiens
ctttgcactgagggccacacta

SEQ ID NO: 2648261 - DNA, 16 bp, Homo sapiens
ctttgcagacaggcaa

SEQ ID NO: 2648262 - DNA, 17 bp, Homo sapiens
ctttgcaggttgctttg

SEQ ID NO: 2648263 - DNA, 12 bp, Homo sapiens
ctttgcatttta

SEQ ID NO: 2648264 - DNA, 22 bp, Homo sapiens
ctttgcattttaaaaatgaaat

SEQ ID NO: 2648265 - DNA, 17 bp, Homo sapiens
ctttgccaccctcatgc

SEQ ID NO: 2648266 - DNA, 21 bp, Homo sapiens
ctttgccaccctcatgctgtg

SEQ ID NO: 2648267 - DNA, 20 bp, Homo sapiens
ctttgccagcttttcctccc

SEQ ID NO: 2648268 - DNA, 14 bp, Homo sapiens
ctttgcccacaatg

SEQ ID NO: 2648269 - DNA, 20 bp, Homo sapiens
ctttgccctggtagggcagt

SEQ ID NO: 2648270 - DNA, 22 bp, Homo sapiens
ctttgcctgttcagttacagaa

SEQ ID NO: 2648271 - DNA, 22 bp, Homo sapiens
ctttgccttccacgctgtctcc

SEQ ID NO: 2648272 - DNA, 23 bp, Homo sapiens
ctttgccttgggctgctcctcat

SEQ ID NO: 2648273 - DNA, 14 bp, Homo sapiens
ctttgccttttgca

SEQ ID NO: 2648274 - DNA, 17 bp, Homo sapiens
ctttgctcttcaagaaa

SEQ ID NO: 2648275 - DNA, 18 bp, Homo sapiens
ctttgctgagcctgtaaa

SEQ ID NO: 2648276 - DNA, 11 bp, Homo sapiens
ctttgctgcca

SEQ ID NO: 2648277 - DNA, 17 bp, Homo sapiens
ctttgcttgcctctctg

SEQ ID NO: 2648278 - DNA, 11 bp, Homo sapiens
ctttggaagga

SEQ ID NO: 2648279 - DNA, 20 bp, Homo sapiens
ctttggacagaagcagctct

SEQ ID NO: 2648280 - DNA, 21 bp, Homo sapiens
ctttggacagaagcagctctt

SEQ ID NO: 2648281 - DNA, 17 bp, Homo sapiens
ctttggaccctgaggcc

SEQ ID NO: 2648282 - DNA, 15 bp, Homo sapiens
gaagagcaggcacat

SEQ ID NO: 2648283 - DNA, 12 bp, Homo sapiens
gaagagccttgc

SEQ ID NO: 2648284 - DNA, 19 bp, Homo sapiens
gaagaggcgggccagccag

SEQ ID NO: 2648285 - DNA, 11 bp, Homo sapiens
gaagaggggca

SEQ ID NO: 2648286 - DNA, 13 bp, Homo sapiens
gaagaggggcagc

SEQ ID NO: 2648287 - DNA, 15 bp, Homo sapiens
gaagaggggcagccc

SEQ ID NO: 2648288 - DNA, 17 bp, Homo sapiens
gaagaggggcagccctt

SEQ ID NO: 2648289 - DNA, 18 bp, Homo sapiens
gaagaggggcagcccttg

SEQ ID NO: 2648290 - DNA, 23 bp, Homo sapiens
gaagagtaagtcaacctgcctga

SEQ ID NO: 2648291 - DNA, 16 bp, Homo sapiens
gaagagtagcatttca

SEQ ID NO: 2648292 - DNA, 14 bp, Homo sapiens
gaagagtcctctga

SEQ ID NO: 2648293 - DNA, 14 bp, Homo sapiens
gaagagtgagaggg

SEQ ID NO: 2648294 - DNA, 18 bp, Homo sapiens
gaagagtgggtttcacaa

SEQ ID NO: 2648295 - DNA, 20 bp, Homo sapiens
gaagataatattaaggaaga

SEQ ID NO: 2648296 - DNA, 20 bp, Homo sapiens
gaagataggctctgcacaga

SEQ ID NO: 2648297 - DNA, 14 bp, Homo sapiens
gaagatatcttgaa

SEQ ID NO: 2648298 - DNA, 14 bp, Homo sapiens
gaagatatttttcc

SEQ ID NO: 2648299 - DNA, 15 bp, Homo sapiens
gaagatcccctcagg

SEQ ID NO: 2648300 - DNA, 16 bp, Homo sapiens
gaagatcccctcagga

SEQ ID NO: 2648301 - DNA, 15 bp, Homo sapiens
gaagatcttaaattt

SEQ ID NO: 2648302 - DNA, 15 bp, Homo sapiens
gaagatgtttcaaaa

SEQ ID NO: 2648303 - DNA, 13 bp, Homo sapiens
gaagattgtgaat

SEQ ID NO: 2648304 - DNA, 16 bp, Homo sapiens
gaagcaccataacttt

SEQ ID NO: 2648305 - DNA, 16 bp, Homo sapiens
gaagcaccccatgcca

SEQ ID NO: 2648306 - DNA, 21 bp, Homo sapiens
gaagcaccccatgccaaagct

SEQ ID NO: 2648307 - DNA, 19 bp, Homo sapiens
gaagcactgttccagcctg

SEQ ID NO: 2648308 - DNA, 17 bp, Homo sapiens
gaagcagtgccttccat

SEQ ID NO: 2648309 - DNA, 14 bp, Homo sapiens
gaagcagttgtgtc

SEQ ID NO: 2648310 - DNA, 16 bp, Homo sapiens
gaagcatgaaaaagca

SEQ ID NO: 2648311 - DNA, 13 bp, Homo sapiens
gaagcatgtttca

SEQ ID NO: 2648312 - DNA, 19 bp, Homo sapiens
gaagcatgtttcatgtttt

SEQ ID NO: 2648313 - DNA, 16 bp, Homo sapiens
gaagcattcagagagc

SEQ ID NO: 2648314 - DNA, 17 bp, Homo sapiens
gaagcattcagagagca

SEQ ID NO: 2648315 - DNA, 18 bp, Homo sapiens
gaagcattccttctttga

SEQ ID NO: 2648316 - DNA, 18 bp, Homo sapiens
gaagccaacttggctttc

SEQ ID NO: 2648317 - DNA, 14 bp, Homo sapiens
gaagccaggagcaa

SEQ ID NO: 2648318 - DNA, 14 bp, Homo sapiens
gaagccattgtctt

SEQ ID NO: 2648319 - DNA, 16 bp, Homo sapiens
gaagccattgtcttcg

SEQ ID NO: 2648320 - DNA, 13 bp, Homo sapiens
gaagcccaggaaa

SEQ ID NO: 2648321 - DNA, 23 bp, Homo sapiens
gaagcccaggaaaggctccagga

SEQ ID NO: 2648322 - DNA, 19 bp, Homo sapiens
gaagccccttccccatggg

SEQ ID NO: 2648323 - DNA, 14 bp, Homo sapiens
gaagccgctggggc

SEQ ID NO: 2648324 - DNA, 18 bp, Homo sapiens
gaagccgctggggccagt

SEQ ID NO: 2648325 - DNA, 20 bp, Homo sapiens
gaagccgctggggccagttg

SEQ ID NO: 2648326 - DNA, 21 bp, Homo sapiens
gaagccgctggggccagttgg

SEQ ID NO: 2648327 - DNA, 15 bp, Homo sapiens
gaagccggcggccca

SEQ ID NO: 2648328 - DNA, 20 bp, Homo sapiens
gaagccggcggcccaagccc

SEQ ID NO: 2648329 - DNA, 12 bp, Homo sapiens
gaagcctctggc

SEQ ID NO: 2648330 - DNA, 17 bp, Homo sapiens
gaagcctctggctagag

SEQ ID NO: 2648331 - DNA, 13 bp, Homo sapiens
gaagcctggaaca

SEQ ID NO: 2648332 - DNA, 14 bp, Homo sapiens
gaagctacaggtta

SEQ ID NO: 2648333 - DNA, 15 bp, Homo sapiens
gaagctacaggttac

SEQ ID NO: 2648334 - DNA, 19 bp, Homo sapiens
gaagctacaggttacaaca

SEQ ID NO: 2648335 - DNA, 21 bp, Homo sapiens
gaagctacaggttacaacaga

SEQ ID NO: 2648336 - DNA, 16 bp, Homo sapiens
gaagctagctcccctc

SEQ ID NO: 2648337 - DNA, 20 bp, Homo sapiens
gaagctcacctgttgcttac

SEQ ID NO: 2648338 - DNA, 12 bp, Homo sapiens
gaagctcagccc

SEQ ID NO: 2648339 - DNA, 13 bp, Homo sapiens
gaagctcagccca

SEQ ID NO: 2648340 - DNA, 15 bp, Homo sapiens
gaagctcagcccacc

SEQ ID NO: 2648341 - DNA, 17 bp, Homo sapiens
gaagctcagcccacccc

SEQ ID NO: 2648342 - DNA, 17 bp, Homo sapiens
gaagctcagggcctggc

SEQ ID NO: 2648343 - DNA, 23 bp, Homo sapiens
gaagctcagggcctggctcaggt

SEQ ID NO: 2648344 - DNA, 16 bp, Homo sapiens
gaagctccactgtcac

SEQ ID NO: 2648345 - DNA, 18 bp, Homo sapiens
gaagctccactgtcaccc

SEQ ID NO: 2648346 - DNA, 19 bp, Homo sapiens
gaagctccactgtcaccct

SEQ ID NO: 2648347 - DNA, 15 bp, Homo sapiens
gaagctcccaggaac

SEQ ID NO: 2648348 - DNA, 22 bp, Homo sapiens
gaagctccgctttctacccagc

SEQ ID NO: 2648349 - DNA, 19 bp, Homo sapiens
gaagctctggctgaaccct

SEQ ID NO: 2648350 - DNA, 14 bp, Homo sapiens
gaagctgagcacca

SEQ ID NO: 2648351 - DNA, 19 bp, Homo sapiens
gaagctgagcaccagggga

SEQ ID NO: 2648352 - DNA, 14 bp, Homo sapiens
gaagctgcctgctt

SEQ ID NO: 2648353 - DNA, 13 bp, Homo sapiens
gaagctgttgtac

SEQ ID NO: 2648354 - DNA, 21 bp, Homo sapiens
gaagctgttgtacatttatga

SEQ ID NO: 2648355 - DNA, 22 bp, Homo sapiens
gaagcttgtgtatccattatca

SEQ ID NO: 2648356 - DNA, 17 bp, Homo sapiens
gaaggaaacccagctct

SEQ ID NO: 2648357 - DNA, 18 bp, Homo sapiens
gaaggaaacccagctctg

SEQ ID NO: 2648358 - DNA, 15 bp, Homo sapiens
gaaggaactctggct

SEQ ID NO: 2648359 - DNA, 20 bp, Homo sapiens
gaaggaactctggcttccag

SEQ ID NO: 2648360 - DNA, 22 bp, Homo sapiens
gaaggaactctggcttccaggt

SEQ ID NO: 2648361 - DNA, 23 bp, Homo sapiens
gaaggaactctggcttccaggta

SEQ ID NO: 2648362 - DNA, 15 bp, Homo sapiens
gaaggaattgacttc

SEQ ID NO: 2648363 - DNA, 20 bp, Homo sapiens
gaaggacattgcggacagcc

SEQ ID NO: 2648364 - DNA, 21 bp, Homo sapiens
gaaggacattgcggacagcca

SEQ ID NO: 2648365 - DNA, 18 bp, Homo sapiens
gaaggactgtgacaggca

SEQ ID NO: 2648366 - DNA, 23 bp, Homo sapiens
gaaggactgtgacaggcagcaga

SEQ ID NO: 2648367 - DNA, 16 bp, Homo sapiens
gaaggagagcctgctg

SEQ ID NO: 2648368 - DNA, 13 bp, Homo sapiens
gaaggagttttat

SEQ ID NO: 2648369 - DNA, 10 bp, Homo sapiens
gaaggatccg

SEQ ID NO: 2648370 - DNA, 10 bp, Homo sapiens
gaaggatcct

SEQ ID NO: 2648371 - DNA, 22 bp, Homo sapiens
gaaggatctgtttttaaaaatc

SEQ ID NO: 2648372 - DNA, 16 bp, Homo sapiens
gaaggatgccaagaag

SEQ ID NO: 2648373 - DNA, 20 bp, Homo sapiens
gaaggatgtacatttccaaa

SEQ ID NO: 2648374 - DNA, 14 bp, Homo sapiens
gaaggattgtaaaa

SEQ ID NO: 2648375 - DNA, 24 bp, Homo sapiens
gaaggcactaaaaagagctgtcct

SEQ ID NO: 2648376 - DNA, 21 bp, Homo sapiens
gaaggcagggggaaggtgggg

SEQ ID NO: 2648377 - DNA, 21 bp, Homo sapiens
gaaggcatatcagtctctgag

SEQ ID NO: 2648378 - DNA, 17 bp, Homo sapiens
gaaggcatcagtcccta

SEQ ID NO: 2648379 - DNA, 13 bp, Homo sapiens
gaaggccacatgt

SEQ ID NO: 2648380 - DNA, 18 bp, Homo sapiens
gaaggccccgcccaggct

SEQ ID NO: 2648381 - DNA, 17 bp, Homo sapiens
gaaggccgagaagcaag

SEQ ID NO: 2648382 - DNA, 22 bp, Homo sapiens
gaaggccgagaagcaagaaaga

SEQ ID NO: 2648383 - DNA, 15 bp, Homo sapiens
gaaggctatggggat

SEQ ID NO: 2648384 - DNA, 19 bp, Homo sapiens
gaaggctcgagcatgcctg

SEQ ID NO: 2648385 - DNA, 17 bp, Homo sapiens
gaagggaccttgaaggg

SEQ ID NO: 2648386 - DNA, 18 bp, Homo sapiens
gaagggaccttgaagggt

SEQ ID NO: 2648387 - DNA, 21 bp, Homo sapiens
gaagggactaggagcactgta

SEQ ID NO: 2648388 - DNA, 21 bp, Homo sapiens
gaagggagaaggatctagaat

SEQ ID NO: 2648389 - DNA, 10 bp, Homo sapiens
gaagggaggt

SEQ ID NO: 2648390 - DNA, 14 bp, Homo sapiens
gaagggccagtctg

SEQ ID NO: 2648391 - DNA, 20 bp, Homo sapiens
gaagggccagtctgggctgc

SEQ ID NO: 2648392 - DNA, 20 bp, Homo sapiens
gaagggctagaacctggaga

SEQ ID NO: 2648393 - DNA, 16 bp, Homo sapiens
gaaggggacccccgcc

SEQ ID NO: 2648394 - DNA, 23 bp, Homo sapiens
gaaggggaggcagccggcaccca

SEQ ID NO: 2648395 - DNA, 14 bp, Homo sapiens
gaaggggccagagg

SEQ ID NO: 2648396 - DNA, 16 bp, Homo sapiens
gaagggggatatgaat

SEQ ID NO: 2648397 - DNA, 20 bp, Homo sapiens
gaagggggccatgaggcctc

SEQ ID NO: 2648398 - DNA, 15 bp, Homo sapiens
gaagggggctgggac

SEQ ID NO: 2648399 - DNA, 18 bp, Homo sapiens
gaagggggtccacccagc

SEQ ID NO: 2648400 - DNA, 13 bp, Homo sapiens
gaagggtaaagaa

SEQ ID NO: 2648401 - DNA, 15 bp, Homo sapiens
gaagggtttgtggct

SEQ ID NO: 2648402 - DNA, 21 bp, Homo sapiens
gaagggtttgtggctgggggc

SEQ ID NO: 2648403 - DNA, 18 bp, Homo sapiens
gaaggtcggaggcttggg

SEQ ID NO: 2648404 - DNA, 20 bp, Homo sapiens
gaaggttctggtgtgaacta

SEQ ID NO: 2648405 - DNA, 17 bp, Homo sapiens
gaagtaagtggggttgc

SEQ ID NO: 2648406 - DNA, 19 bp, Homo sapiens
gaagtaatatgcacacatt

SEQ ID NO: 2648407 - DNA, 23 bp, Homo sapiens
gaagtattataaattatgtttat

SEQ ID NO: 2648408 - DNA, 19 bp, Homo sapiens
gaagtattttgctggaata

SEQ ID NO: 2648409 - DNA, 15 bp, Homo sapiens
gaagtcaaagcaagg

SEQ ID NO: 2648410 - DNA, 13 bp, Homo sapiens
gaagtcacacagt

SEQ ID NO: 2648411 - DNA, 18 bp, Homo sapiens
gaagtcataccaatgaaa

SEQ ID NO: 2648412 - DNA, 16 bp, Homo sapiens
gaagtccccaggcccc

SEQ ID NO: 2648413 - DNA, 21 bp, Homo sapiens
gaagtctctgaagtgaaactg

SEQ ID NO: 2648414 - DNA, 18 bp, Homo sapiens
gaagtgacaaggccccag

SEQ ID NO: 2648415 - DNA, 24 bp, Homo sapiens
gaagtgacaaggccccagagactc

SEQ ID NO: 2648416 - DNA, 14 bp, Homo sapiens
gaagtgacagggaa

SEQ ID NO: 2648417 - DNA, 20 bp, Homo sapiens
gaagtgacagggaagctaca

SEQ ID NO: 2648418 - DNA, 13 bp, Homo sapiens
gaagtgactttgg

SEQ ID NO: 2648419 - DNA, 16 bp, Homo sapiens
gaagtgagcacagcct

SEQ ID NO: 2648420 - DNA, 14 bp, Homo sapiens
gaagtgcatccaaa

SEQ ID NO: 2648421 - DNA, 13 bp, Homo sapiens
gaagtgcccctgc

SEQ ID NO: 2648422 - DNA, 18 bp, Homo sapiens
gaagtgcccctgctgcct

SEQ ID NO: 2648423 - DNA, 20 bp, Homo sapiens
gaagtggactggcccctggg

SEQ ID NO: 2648424 - DNA, 14 bp, Homo sapiens
gaagtgtaacagct

SEQ ID NO: 2648425 - DNA, 19 bp, Homo sapiens
gaagtgtgggtctgtgtgt

SEQ ID NO: 2648426 - DNA, 17 bp, Homo sapiens
gaagtgttaatactagt

SEQ ID NO: 2648427 - DNA, 20 bp, Homo sapiens
gacctggagcccctgggtgg

SEQ ID NO: 2648428 - DNA, 18 bp, Homo sapiens
gacctggcaaggacacag

SEQ ID NO: 2648429 - DNA, 18 bp, Homo sapiens
gacctggcactggatgca

SEQ ID NO: 2648430 - DNA, 17 bp, Homo sapiens
gacctggtaccctcctg

SEQ ID NO: 2648431 - DNA, 17 bp, Homo sapiens
gacctggtgctgcctct

SEQ ID NO: 2648432 - DNA, 22 bp, Homo sapiens
gacctggtgctgcctctacctg

SEQ ID NO: 2648433 - DNA, 20 bp, Homo sapiens
gacctgtcatgcccccctca

SEQ ID NO: 2648434 - DNA, 21 bp, Homo sapiens
gacctgtcatgcccccctcaa

SEQ ID NO: 2648435 - DNA, 12 bp, Homo sapiens
gacctgtgacca

SEQ ID NO: 2648436 - DNA, 20 bp, Homo sapiens
gaccttagtgtttctgtgca

SEQ ID NO: 2648437 - DNA, 21 bp, Homo sapiens
gaccttagtgtttctgtgcat

SEQ ID NO: 2648438 - DNA, 14 bp, Homo sapiens
gaccttcctcatcc

SEQ ID NO: 2648439 - DNA, 22 bp, Homo sapiens
gaccttcctcatccaccccatc

SEQ ID NO: 2648440 - DNA, 23 bp, Homo sapiens
gaccttcctcatccaccccatcc

SEQ ID NO: 2648441 - DNA, 17 bp, Homo sapiens
gaccttcctcgcagaga

SEQ ID NO: 2648442 - DNA, 23 bp, Homo sapiens
gaccttcctcgcagagaggccag

SEQ ID NO: 2648443 - DNA, 14 bp, Homo sapiens
gaccttcctgccac

SEQ ID NO: 2648444 - DNA, 19 bp, Homo sapiens
gaccttcctgccaccagtc

SEQ ID NO: 2648445 - DNA, 20 bp, Homo sapiens
gaccttctccttcacctttg

SEQ ID NO: 2648446 - DNA, 14 bp, Homo sapiens
gaccttgaactggg

SEQ ID NO: 2648447 - DNA, 23 bp, Homo sapiens
gaccttgaactgggtacttgtgg

SEQ ID NO: 2648448 - DNA, 16 bp, Homo sapiens
gaccttgcaacttcat

SEQ ID NO: 2648449 - DNA, 15 bp, Homo sapiens
gaccttgttcacact

SEQ ID NO: 2648450 - DNA, 20 bp, Homo sapiens
gaccttgttgttgttaaata

SEQ ID NO: 2648451 - DNA, 21 bp, Homo sapiens
gacctttgtcatctttcttct

SEQ ID NO: 2648452 - DNA, 14 bp, Homo sapiens
gacgaacttccatg

SEQ ID NO: 2648453 - DNA, 21 bp, Homo sapiens
gacgaggccctcgggcccagc

SEQ ID NO: 2648454 - DNA, 22 bp, Homo sapiens
gacgaggccctcgggcccagcc

SEQ ID NO: 2648455 - DNA, 15 bp, Homo sapiens
gacgccatcccagcc

SEQ ID NO: 2648456 - DNA, 16 bp, Homo sapiens
gacgccatcccagccc

SEQ ID NO: 2648457 - DNA, 19 bp, Homo sapiens
gacgccatcccagccccaa

SEQ ID NO: 2648458 - DNA, 21 bp, Homo sapiens
gacgccatcccagccccaatg

SEQ ID NO: 2648459 - DNA, 22 bp, Homo sapiens
gacgccggggacagaggcctgc

SEQ ID NO: 2648460 - DNA, 13 bp, Homo sapiens
gacgcctgaggaa

SEQ ID NO: 2648461 - DNA, 19 bp, Homo sapiens
gacgcctgggggtgccagg

SEQ ID NO: 2648462 - DNA, 18 bp, Homo sapiens
gacgctacccgggaaggg

SEQ ID NO: 2648463 - DNA, 22 bp, Homo sapiens
gacgctacccgggaagggggct

SEQ ID NO: 2648464 - DNA, 22 bp, Homo sapiens
gacgctgtgctgccctgcccac

SEQ ID NO: 2648465 - DNA, 21 bp, Homo sapiens
gacggaagcctttttccccaa

SEQ ID NO: 2648466 - DNA, 19 bp, Homo sapiens
gacggagtctcgctctgtc

SEQ ID NO: 2648467 - DNA, 23 bp, Homo sapiens
gacggcctgatgctccctcccct

SEQ ID NO: 2648468 - DNA, 13 bp, Homo sapiens
gacggctgggcac

SEQ ID NO: 2648469 - DNA, 22 bp, Homo sapiens
gacggctgggcacacgcctccc

SEQ ID NO: 2648470 - DNA, 16 bp, Homo sapiens
gacggggactggggat

SEQ ID NO: 2648471 - DNA, 16 bp, Homo sapiens
gacggtgcagtctggg

SEQ ID NO: 2648472 - DNA, 17 bp, Homo sapiens
gacgtgattttgctgta

SEQ ID NO: 2648473 - DNA, 23 bp, Homo sapiens
gacgtgcactgagagtgaagtga

SEQ ID NO: 2648474 - DNA, 23 bp, Homo sapiens
gacgtgccttttgcacccctccc

SEQ ID NO: 2648475 - DNA, 18 bp, Homo sapiens
gacgtttacaagcccccc

SEQ ID NO: 2648476 - DNA, 18 bp, Homo sapiens
gactaaaaatattataac

SEQ ID NO: 2648477 - DNA, 16 bp, Homo sapiens
gactaacttgtctttg

SEQ ID NO: 2648478 - DNA, 23 bp, Homo sapiens
gactaacttgtctttggaccctg

SEQ ID NO: 2648479 - DNA, 22 bp, Homo sapiens
gactaagccctgtcgagacact

SEQ ID NO: 2648480 - DNA, 21 bp, Homo sapiens
gactaagcctacctgctctcc

SEQ ID NO: 2648481 - DNA, 17 bp, Homo sapiens
gactaatatattaatat

SEQ ID NO: 2648482 - DNA, 21 bp, Homo sapiens
gactaattcctgccctgccca

SEQ ID NO: 2648483 - DNA, 18 bp, Homo sapiens
gactacaggcacccacca

SEQ ID NO: 2648484 - DNA, 13 bp, Homo sapiens
gactacaggtgtg

SEQ ID NO: 2648485 - DNA, 18 bp, Homo sapiens
gactacagtcaggaaagg

SEQ ID NO: 2648486 - DNA, 15 bp, Homo sapiens
gactagaacctggag

SEQ ID NO: 2648487 - DNA, 16 bp, Homo sapiens
gactagaacctggagg

SEQ ID NO: 2648488 - DNA, 20 bp, Homo sapiens
gactagaacctggagggctg

SEQ ID NO: 2648489 - DNA, 16 bp, Homo sapiens
gactagaggcagggag

SEQ ID NO: 2648490 - DNA, 20 bp, Homo sapiens
gactagaggcagggagggga

SEQ ID NO: 2648491 - DNA, 22 bp, Homo sapiens
gactagaggcagggaggggact

SEQ ID NO: 2648492 - DNA, 19 bp, Homo sapiens
gactagagggacctctccc

SEQ ID NO: 2648493 - DNA, 17 bp, Homo sapiens
gactagggattcaggct

SEQ ID NO: 2648494 - DNA, 19 bp, Homo sapiens
gactatatagagatgtttt

SEQ ID NO: 2648495 - DNA, 18 bp, Homo sapiens
gactatcaaactgaagcc

SEQ ID NO: 2648496 - DNA, 19 bp, Homo sapiens
gactatgaacttctctcag

SEQ ID NO: 2648497 - DNA, 14 bp, Homo sapiens
gactattcagtttt

SEQ ID NO: 2648498 - DNA, 23 bp, Homo sapiens
gactcaaaacccatctgggctcc

SEQ ID NO: 2648499 - DNA, 15 bp, Homo sapiens
gactcaataaaatca

SEQ ID NO: 2648500 - DNA, 21 bp, Homo sapiens
gactcacaagaagaccagact

SEQ ID NO: 2648501 - DNA, 14 bp, Homo sapiens
gactcagctcccca

SEQ ID NO: 2648502 - DNA, 18 bp, Homo sapiens
gactcagctccccagagt

SEQ ID NO: 2648503 - DNA, 18 bp, Homo sapiens
gactcaggatgcccaggg

SEQ ID NO: 2648504 - DNA, 20 bp, Homo sapiens
gactcagggccatgcctgcc

SEQ ID NO: 2648505 - DNA, 13 bp, Homo sapiens
gactcagggctcc

SEQ ID NO: 2648506 - DNA, 14 bp, Homo sapiens
gactcagggctcct

SEQ ID NO: 2648507 - DNA, 17 bp, Homo sapiens
gactcagggctcctggg

SEQ ID NO: 2648508 - DNA, 23 bp, Homo sapiens
gactcaggttgtagtaaagaaat

SEQ ID NO: 2648509 - DNA, 11 bp, Homo sapiens
gactccaaaga

SEQ ID NO: 2648510 - DNA, 16 bp, Homo sapiens
gactccacccatccta

SEQ ID NO: 2648511 - DNA, 16 bp, Homo sapiens
gactccccaggccagg

SEQ ID NO: 2648512 - DNA, 18 bp, Homo sapiens
gactccccaggccaggcc

SEQ ID NO: 2648513 - DNA, 14 bp, Homo sapiens
gactccctcctcac

SEQ ID NO: 2648514 - DNA, 16 bp, Homo sapiens
gactccctcctcacct

SEQ ID NO: 2648515 - DNA, 20 bp, Homo sapiens
gactccctcctcacctctgg

SEQ ID NO: 2648516 - DNA, 14 bp, Homo sapiens
gactccggccctcc

SEQ ID NO: 2648517 - DNA, 17 bp, Homo sapiens
gactcctaggcaggaca

SEQ ID NO: 2648518 - DNA, 19 bp, Homo sapiens
gactcctaggcaggacatg

SEQ ID NO: 2648519 - DNA, 23 bp, Homo sapiens
gactcctaggcaggacatgctga

SEQ ID NO: 2648520 - DNA, 11 bp, Homo sapiens
gactcctctgt

SEQ ID NO: 2648521 - DNA, 14 bp, Homo sapiens
gactcctctgtcca

SEQ ID NO: 2648522 - DNA, 18 bp, Homo sapiens
gactcctgcaggcagcca

SEQ ID NO: 2648523 - DNA, 21 bp, Homo sapiens
gactcctgcaggcagccaggc

SEQ ID NO: 2648524 - DNA, 14 bp, Homo sapiens
gactcctgccctgt

SEQ ID NO: 2648525 - DNA, 22 bp, Homo sapiens
gactccttgagagaccaggcaa

SEQ ID NO: 2648526 - DNA, 14 bp, Homo sapiens
gactctcagtctct

SEQ ID NO: 2648527 - DNA, 18 bp, Homo sapiens
gactctcagtctctgagc

SEQ ID NO: 2648528 - DNA, 13 bp, Homo sapiens
gactctctgtgac

SEQ ID NO: 2648529 - DNA, 19 bp, Homo sapiens
gactctctgtgacctgccc

SEQ ID NO: 2648530 - DNA, 14 bp, Homo sapiens
gactctgaaatctg

SEQ ID NO: 2648531 - DNA, 15 bp, Homo sapiens
gactctgaaatctga

SEQ ID NO: 2648532 - DNA, 15 bp, Homo sapiens
gactctgaagcctct

SEQ ID NO: 2648533 - DNA, 20 bp, Homo sapiens
gactctgaatctttttcaga

SEQ ID NO: 2648534 - DNA, 17 bp, Homo sapiens
gactctgacctcttggc

SEQ ID NO: 2648535 - DNA, 19 bp, Homo sapiens
gactctgaggctctttctg

SEQ ID NO: 2648536 - DNA, 22 bp, Homo sapiens
gactctgaggctctttctgggc

SEQ ID NO: 2648537 - DNA, 12 bp, Homo sapiens
gactctgcacat

SEQ ID NO: 2648538 - DNA, 14 bp, Homo sapiens
gactctgcacatga

SEQ ID NO: 2648539 - DNA, 15 bp, Homo sapiens
gactctgcacatgtc

SEQ ID NO: 2648540 - DNA, 20 bp, Homo sapiens
gactctgcacatgtcttgta

SEQ ID NO: 2648541 - DNA, 13 bp, Homo sapiens
gactctgccccct

SEQ ID NO: 2648542 - DNA, 19 bp, Homo sapiens
gactctgccccctgctggc

SEQ ID NO: 2648543 - DNA, 22 bp, Homo sapiens
gactctgccccctgctggctct

SEQ ID NO: 2648544 - DNA, 12 bp, Homo sapiens
gactcttgctct

SEQ ID NO: 2648545 - DNA, 9 bp, Homo sapiens
gactcttgt

SEQ ID NO: 2648546 - DNA, 14 bp, Homo sapiens
gactcttgttttca

SEQ ID NO: 2648547 - DNA, 20 bp, Homo sapiens
gactctttggtggctttgca

SEQ ID NO: 2648548 - DNA, 21 bp, Homo sapiens
gactctttggtggctttgcat

SEQ ID NO: 2648549 - DNA, 22 bp, Homo sapiens
gactctttttagggccaggcag

SEQ ID NO: 2648550 - DNA, 16 bp, Homo sapiens
gactgaaaacctctcc

SEQ ID NO: 2648551 - DNA, 16 bp, Homo sapiens
gactgaagcctgcagg

SEQ ID NO: 2648552 - DNA, 22 bp, Homo sapiens
gactgaccaatattgtacagtt

SEQ ID NO: 2648553 - DNA, 17 bp, Homo sapiens
gactgagccagtcccag

SEQ ID NO: 2648554 - DNA, 13 bp, Homo sapiens
gactgagctcaag

SEQ ID NO: 2648555 - DNA, 16 bp, Homo sapiens
gactgaggggagggga

SEQ ID NO: 2648556 - DNA, 21 bp, Homo sapiens
gactgagtaagaaatgctgcc

SEQ ID NO: 2648557 - DNA, 18 bp, Homo sapiens
gactgagtacgttgtgca

SEQ ID NO: 2648558 - DNA, 21 bp, Homo sapiens
gactgagtacgttgtgcattt

SEQ ID NO: 2648559 - DNA, 23 bp, Homo sapiens
gactgagtacgttgtgcatttgg

SEQ ID NO: 2648560 - DNA, 20 bp, Homo sapiens
gactgccagtccccctgccc

SEQ ID NO: 2648561 - DNA, 13 bp, Homo sapiens
gactgcccggcag

SEQ ID NO: 2648562 - DNA, 15 bp, Homo sapiens
gactgcccggcaggg

SEQ ID NO: 2648563 - DNA, 17 bp, Homo sapiens
gactgctaaataaaatt

SEQ ID NO: 2648564 - DNA, 13 bp, Homo sapiens
gactgcttcccat

SEQ ID NO: 2648565 - DNA, 22 bp, Homo sapiens
gactgcttcccatcctaccctc

SEQ ID NO: 2648566 - DNA, 17 bp, Homo sapiens
gactggaaccagggaga

SEQ ID NO: 2648567 - DNA, 14 bp, Homo sapiens
gactggaagcacag

SEQ ID NO: 2648568 - DNA, 16 bp, Homo sapiens
gactggaagcacagct

SEQ ID NO: 2648569 - DNA, 22 bp, Homo sapiens
gactggatactgcccggggcag

SEQ ID NO: 2648570 - DNA, 15 bp, Homo sapiens
gaggatgtctgggcc

SEQ ID NO: 2648571 - DNA, 17 bp, Homo sapiens
gaggatgttctgggaca

SEQ ID NO: 2648572 - DNA, 16 bp, Homo sapiens
gaggattctatgaggc

SEQ ID NO: 2648573 - DNA, 17 bp, Homo sapiens
gaggattctatgaggca

SEQ ID NO: 2648574 - DNA, 17 bp, Homo sapiens
gaggatttttttctgag

SEQ ID NO: 2648575 - DNA, 21 bp, Homo sapiens
gaggcaatgtcaggaacagaa

SEQ ID NO: 2648576 - DNA, 16 bp, Homo sapiens
gaggcagaaaattgca

SEQ ID NO: 2648577 - DNA, 20 bp, Homo sapiens
gaggcagaaaattgcacaat

SEQ ID NO: 2648578 - DNA, 19 bp, Homo sapiens
gaggcagacagcagctcag

SEQ ID NO: 2648579 - DNA, 21 bp, Homo sapiens
gaggcagacagcagctcaggc

SEQ ID NO: 2648580 - DNA, 19 bp, Homo sapiens
gaggcagagaaagaagaga

SEQ ID NO: 2648581 - DNA, 21 bp, Homo sapiens
gaggcagagaaagaagagaca

SEQ ID NO: 2648582 - DNA, 20 bp, Homo sapiens
gaggcagcagtgtgaggcca

SEQ ID NO: 2648583 - DNA, 9 bp, Homo sapiens
gaggcaggg

SEQ ID NO: 2648584 - DNA, 16 bp, Homo sapiens
gaggcagggaggggac

SEQ ID NO: 2648585 - DNA, 20 bp, Homo sapiens
gaggcagggtctcactctgt

SEQ ID NO: 2648586 - DNA, 14 bp, Homo sapiens
gaggcatggccctg

SEQ ID NO: 2648587 - DNA, 17 bp, Homo sapiens
gaggcatggccctgggg

SEQ ID NO: 2648588 - DNA, 21 bp, Homo sapiens
gaggcatttgtttgaactgat

SEQ ID NO: 2648589 - DNA, 12 bp, Homo sapiens
gaggccaaggtg

SEQ ID NO: 2648590 - DNA, 15 bp, Homo sapiens
gaggccaagtgcagg

SEQ ID NO: 2648591 - DNA, 17 bp, Homo sapiens
gaggccacatgagtccc

SEQ ID NO: 2648592 - DNA, 12 bp, Homo sapiens
gaggccacctct

SEQ ID NO: 2648593 - DNA, 14 bp, Homo sapiens
gaggccacctctcc

SEQ ID NO: 2648594 - DNA, 17 bp, Homo sapiens
gaggccacctctccaag

SEQ ID NO: 2648595 - DNA, 18 bp, Homo sapiens
gaggccacctctccaagg

SEQ ID NO: 2648596 - DNA, 14 bp, Homo sapiens
gaggccagccccac

SEQ ID NO: 2648597 - DNA, 22 bp, Homo sapiens
gaggccagccccacccaggagg

SEQ ID NO: 2648598 - DNA, 14 bp, Homo sapiens
gaggccaggtgcag

SEQ ID NO: 2648599 - DNA, 20 bp, Homo sapiens
gaggccatgattcgcccaaa

SEQ ID NO: 2648600 - DNA, 23 bp, Homo sapiens
gaggccatgggcctcctgtgtgt

SEQ ID NO: 2648601 - DNA, 14 bp, Homo sapiens
gaggcccagagggc

SEQ ID NO: 2648602 - DNA, 12 bp, Homo sapiens
gaggcccaggga

SEQ ID NO: 2648603 - DNA, 14 bp, Homo sapiens
gaggccccactggg

SEQ ID NO: 2648604 - DNA, 19 bp, Homo sapiens
gaggccccttctaggtggc

SEQ ID NO: 2648605 - DNA, 18 bp, Homo sapiens
gaggccctcgggcccagc

SEQ ID NO: 2648606 - DNA, 20 bp, Homo sapiens
gaggccctcgggcccagccc

SEQ ID NO: 2648607 - DNA, 16 bp, Homo sapiens
gaggccggggccgggt

SEQ ID NO: 2648608 - DNA, 21 bp, Homo sapiens
gaggcctcagtggactttcca

SEQ ID NO: 2648609 - DNA, 18 bp, Homo sapiens
gaggcctcttggacctct

SEQ ID NO: 2648610 - DNA, 13 bp, Homo sapiens
gaggcctgcccgg

SEQ ID NO: 2648611 - DNA, 13 bp, Homo sapiens
gaggcctggccag

SEQ ID NO: 2648612 - DNA, 14 bp, Homo sapiens
gaggcctggccagg

SEQ ID NO: 2648613 - DNA, 15 bp, Homo sapiens
gaggcctggccaggc

SEQ ID NO: 2648614 - DNA, 14 bp, Homo sapiens
gaggcgcgggggcc

SEQ ID NO: 2648615 - DNA, 19 bp, Homo sapiens
gaggcggacgttccagccg

SEQ ID NO: 2648616 - DNA, 13 bp, Homo sapiens
gaggcgggccagc

SEQ ID NO: 2648617 - DNA, 14 bp, Homo sapiens
gaggcgggccagcc

SEQ ID NO: 2648618 - DNA, 16 bp, Homo sapiens
gaggcgggccagccag

SEQ ID NO: 2648619 - DNA, 22 bp, Homo sapiens
gaggctcctgtgctactttgcc

SEQ ID NO: 2648620 - DNA, 14 bp, Homo sapiens
gaggctctgccctt

SEQ ID NO: 2648621 - DNA, 15 bp, Homo sapiens
gaggctctgcccttg

SEQ ID NO: 2648622 - DNA, 16 bp, Homo sapiens
gaggctgaggcaggag

SEQ ID NO: 2648623 - DNA, 12 bp, Homo sapiens
gaggctgaggcg

SEQ ID NO: 2648624 - DNA, 20 bp, Homo sapiens
gaggctgcagaaggccaaga

SEQ ID NO: 2648625 - DNA, 14 bp, Homo sapiens
gaggctgcagtcag

SEQ ID NO: 2648626 - DNA, 12 bp, Homo sapiens
gaggctgccccc

SEQ ID NO: 2648627 - DNA, 17 bp, Homo sapiens
gaggctgcccccggccc

SEQ ID NO: 2648628 - DNA, 19 bp, Homo sapiens
gaggctgcccccggccccc

SEQ ID NO: 2648629 - DNA, 20 bp, Homo sapiens
gaggctgcccccggccccct

SEQ ID NO: 2648630 - DNA, 15 bp, Homo sapiens
gaggctggagctggc

SEQ ID NO: 2648631 - DNA, 14 bp, Homo sapiens
gaggctgggctccc

SEQ ID NO: 2648632 - DNA, 15 bp, Homo sapiens
gaggctgggctccct

SEQ ID NO: 2648633 - DNA, 20 bp, Homo sapiens
gaggctggtgctgtggccag

SEQ ID NO: 2648634 - DNA, 22 bp, Homo sapiens
gaggctgtcttctcaggctctg

SEQ ID NO: 2648635 - DNA, 22 bp, Homo sapiens
gaggcttccagagagtcctctg

SEQ ID NO: 2648636 - DNA, 20 bp, Homo sapiens
gaggcttgctgagaggggct

SEQ ID NO: 2648637 - DNA, 21 bp, Homo sapiens
gaggcttgtcagagctgggag

SEQ ID NO: 2648638 - DNA, 16 bp, Homo sapiens
gagggaatgaacctgg

SEQ ID NO: 2648639 - DNA, 18 bp, Homo sapiens
gagggaattgaggtctgc

SEQ ID NO: 2648640 - DNA, 17 bp, Homo sapiens
gagggaccaactgggcc

SEQ ID NO: 2648641 - DNA, 15 bp, Homo sapiens
gagggacctctccca

SEQ ID NO: 2648642 - DNA, 18 bp, Homo sapiens
gagggacctctcccaggg

SEQ ID NO: 2648643 - DNA, 14 bp, Homo sapiens
gagggacgcctggg

SEQ ID NO: 2648644 - DNA, 23 bp, Homo sapiens
gagggacgcctgggggtgccagg

SEQ ID NO: 2648645 - DNA, 19 bp, Homo sapiens
gagggactctgaagcctct

SEQ ID NO: 2648646 - DNA, 20 bp, Homo sapiens
gagggactctgaagcctctg

SEQ ID NO: 2648647 - DNA, 13 bp, Homo sapiens
gagggagaagaag

SEQ ID NO: 2648648 - DNA, 21 bp, Homo sapiens
gagggagacactggcccctca

SEQ ID NO: 2648649 - DNA, 14 bp, Homo sapiens
gagggagaggtgga

SEQ ID NO: 2648650 - DNA, 23 bp, Homo sapiens
gagggagaggtggagcaaagtga

SEQ ID NO: 2648651 - DNA, 20 bp, Homo sapiens
gagggagcagacaggaggaa

SEQ ID NO: 2648652 - DNA, 19 bp, Homo sapiens
gagggagggctccagacac

SEQ ID NO: 2648653 - DNA, 14 bp, Homo sapiens
gagggagtgacaga

SEQ ID NO: 2648654 - DNA, 18 bp, Homo sapiens
gagggagtgacagaggca

SEQ ID NO: 2648655 - DNA, 15 bp, Homo sapiens
gagggatcacagggc

SEQ ID NO: 2648656 - DNA, 15 bp, Homo sapiens
gagggatgctgcctg

SEQ ID NO: 2648657 - DNA, 19 bp, Homo sapiens
gagggattggccgcttggc

SEQ ID NO: 2648658 - DNA, 22 bp, Homo sapiens
gagggcaagggccatgctgaag

SEQ ID NO: 2648659 - DNA, 12 bp, Homo sapiens
gagggcagcagg

SEQ ID NO: 2648660 - DNA, 16 bp, Homo sapiens
gagggcccaggcaggc

SEQ ID NO: 2648661 - DNA, 16 bp, Homo sapiens
gagggcccctctgccc

SEQ ID NO: 2648662 - DNA, 15 bp, Homo sapiens
gagggccctacctga

SEQ ID NO: 2648663 - DNA, 21 bp, Homo sapiens
gagggccgtaccccaccctca

SEQ ID NO: 2648664 - DNA, 19 bp, Homo sapiens
gagggcctgtgggagcctg

SEQ ID NO: 2648665 - DNA, 18 bp, Homo sapiens
gagggctagaacctggag

SEQ ID NO: 2648666 - DNA, 21 bp, Homo sapiens
gagggctagaacctggagagc

SEQ ID NO: 2648667 - DNA, 19 bp, Homo sapiens
gagggctagaactggagag

SEQ ID NO: 2648668 - DNA, 13 bp, Homo sapiens
gagggctccagac

SEQ ID NO: 2648669 - DNA, 15 bp, Homo sapiens
gagggctccagacac

SEQ ID NO: 2648670 - DNA, 12 bp, Homo sapiens
gaggggagaagc

SEQ ID NO: 2648671 - DNA, 22 bp, Homo sapiens
gaggggcctcttatgggctggg

SEQ ID NO: 2648672 - DNA, 14 bp, Homo sapiens
gaggggctcctgga

SEQ ID NO: 2648673 - DNA, 17 bp, Homo sapiens
gaggggctttctggaga

SEQ ID NO: 2648674 - DNA, 21 bp, Homo sapiens
gagggggctatagctacagga

SEQ ID NO: 2648675 - DNA, 19 bp, Homo sapiens
gaggggggatttccagcca

SEQ ID NO: 2648676 - DNA, 18 bp, Homo sapiens
gaggggtaggcagagcct

SEQ ID NO: 2648677 - DNA, 21 bp, Homo sapiens
gaggggtgtggctccttccca

SEQ ID NO: 2648678 - DNA, 19 bp, Homo sapiens
gagggtcaggactgtgact

SEQ ID NO: 2648679 - DNA, 15 bp, Homo sapiens
gagggtcctggctcc

SEQ ID NO: 2648680 - DNA, 14 bp, Homo sapiens
gagggtctgaggaa

SEQ ID NO: 2648681 - DNA, 20 bp, Homo sapiens
gagggtggagactaagccct

SEQ ID NO: 2648682 - DNA, 15 bp, Homo sapiens
gagggtgggagtggg

SEQ ID NO: 2648683 - DNA, 14 bp, Homo sapiens
gagggtggtgacct

SEQ ID NO: 2648684 - DNA, 15 bp, Homo sapiens
gaggtaacagaacag

SEQ ID NO: 2648685 - DNA, 21 bp, Homo sapiens
gaggtaacagaacagcttcag

SEQ ID NO: 2648686 - DNA, 21 bp, Homo sapiens
gaggtaaggaatacctgtccc

SEQ ID NO: 2648687 - DNA, 17 bp, Homo sapiens
gaggtcaaggctgcagt

SEQ ID NO: 2648688 - DNA, 19 bp, Homo sapiens
gaggtcacattcaggaaga

SEQ ID NO: 2648689 - DNA, 21 bp, Homo sapiens
gaggtcacattcaggaagatg

SEQ ID NO: 2648690 - DNA, 13 bp, Homo sapiens
gaggtcagagcct

SEQ ID NO: 2648691 - DNA, 19 bp, Homo sapiens
gaggtccagccctggctga

SEQ ID NO: 2648692 - DNA, 23 bp, Homo sapiens
gaggtccagccctggctgaagga

SEQ ID NO: 2648693 - DNA, 15 bp, Homo sapiens
gaggtcgaggcagga

SEQ ID NO: 2648694 - DNA, 16 bp, Homo sapiens
gaggtctctgccggct

SEQ ID NO: 2648695 - DNA, 15 bp, Homo sapiens
gaggtctcttgaggg

SEQ ID NO: 2648696 - DNA, 14 bp, Homo sapiens
gaggtctgaaatgg

SEQ ID NO: 2648697 - DNA, 13 bp, Homo sapiens
gaggtctgttctt

SEQ ID NO: 2648698 - DNA, 19 bp, Homo sapiens
gaggtcttttgacatgtgg

SEQ ID NO: 2648699 - DNA, 15 bp, Homo sapiens
gaggtgaaagggagc

SEQ ID NO: 2648700 - DNA, 23 bp, Homo sapiens
gaggtgaccccaggtttctatgt

SEQ ID NO: 2648701 - DNA, 18 bp, Homo sapiens
gaggtgcagagtgcccag

SEQ ID NO: 2648702 - DNA, 20 bp, Homo sapiens
gaggtgccagcaactgaata

SEQ ID NO: 2648703 - DNA, 22 bp, Homo sapiens
gaggtgccagcaactgaataaa

SEQ ID NO: 2648704 - DNA, 16 bp, Homo sapiens
gaggtggcagccctgt

SEQ ID NO: 2648705 - DNA, 18 bp, Homo sapiens
gaggtggcagccctgtag

SEQ ID NO: 2648706 - DNA, 19 bp, Homo sapiens
gaggtggccagagctggga

SEQ ID NO: 2648707 - DNA, 13 bp, Homo sapiens
gaggtgggatcct

SEQ ID NO: 2648708 - DNA, 16 bp, Homo sapiens
gaggtgggatcctcca

SEQ ID NO: 2648709 - DNA, 21 bp, Homo sapiens
gaggtgggcaggtggtggcac

SEQ ID NO: 2648710 - DNA, 23 bp, Homo sapiens
gaggtgggcaggtggtggcactg

SEQ ID NO: 2648711 - DNA, 14 bp, Homo sapiens
gaggtgggcccagg

SEQ ID NO: 2648712 - DNA, 22 bp, Homo sapiens
gaggtgggcccaggaccagctg

SEQ ID NO: 2648713 - DNA, 16 bp, Homo sapiens
gaggtggtctgaatgt

SEQ ID NO: 2648714 - DNA, 19 bp, Homo sapiens
gaggtggtctgaatgttct

SEQ ID NO: 2648715 - DNA, 22 bp, Homo sapiens
gattgaggcctgccctcaggga

SEQ ID NO: 2648716 - DNA, 15 bp, Homo sapiens
gattgataattgcat

SEQ ID NO: 2648717 - DNA, 19 bp, Homo sapiens
gattgatagagtgttatca

SEQ ID NO: 2648718 - DNA, 22 bp, Homo sapiens
gattgatcggagcctcctctct

SEQ ID NO: 2648719 - DNA, 20 bp, Homo sapiens
gattgcaacaggctgggctt

SEQ ID NO: 2648720 - DNA, 22 bp, Homo sapiens
gattgcaatttgcacaagtttt

SEQ ID NO: 2648721 - DNA, 16 bp, Homo sapiens
gattgcaccactgcac

SEQ ID NO: 2648722 - DNA, 22 bp, Homo sapiens
gattgcattagaaatagacagt

SEQ ID NO: 2648723 - DNA, 16 bp, Homo sapiens
gattgctaaatgtaac

SEQ ID NO: 2648724 - DNA, 20 bp, Homo sapiens
gattgctaaatgtaacagtc

SEQ ID NO: 2648725 - DNA, 22 bp, Homo sapiens
gattgctgccactttttaacta

SEQ ID NO: 2648726 - DNA, 14 bp, Homo sapiens
gattgcttaaaata

SEQ ID NO: 2648727 - DNA, 11 bp, Homo sapiens
gattggattat

SEQ ID NO: 2648728 - DNA, 20 bp, Homo sapiens
gattggattatttaataaca

SEQ ID NO: 2648729 - DNA, 22 bp, Homo sapiens
gattggattatttaataacatt

SEQ ID NO: 2648730 - DNA, 19 bp, Homo sapiens
gattggcttgtgtgtttca

SEQ ID NO: 2648731 - DNA, 13 bp, Homo sapiens
gattgggacagag

SEQ ID NO: 2648732 - DNA, 18 bp, Homo sapiens
gattgggggctggtgcca

SEQ ID NO: 2648733 - DNA, 13 bp, Homo sapiens
gattgtaaaaaaa

SEQ ID NO: 2648734 - DNA, 12 bp, Homo sapiens
gattgtaaaata

SEQ ID NO: 2648735 - DNA, 20 bp, Homo sapiens
gattgtccccgacccttgcc

SEQ ID NO: 2648736 - DNA, 21 bp, Homo sapiens
gattgtgaatatttccatatg

SEQ ID NO: 2648737 - DNA, 20 bp, Homo sapiens
gattgtgtctcttggtcctg

SEQ ID NO: 2648738 - DNA, 16 bp, Homo sapiens
gattgttaaaataact

SEQ ID NO: 2648739 - DNA, 14 bp, Homo sapiens
gatttaacagaaat

SEQ ID NO: 2648740 - DNA, 18 bp, Homo sapiens
gatttaacagaaatgtac

SEQ ID NO: 2648741 - DNA, 19 bp, Homo sapiens
gatttaacagaaatgtaca

SEQ ID NO: 2648742 - DNA, 17 bp, Homo sapiens
gatttaataaaataatt

SEQ ID NO: 2648743 - DNA, 19 bp, Homo sapiens
gatttaataaaataattct

SEQ ID NO: 2648744 - DNA, 18 bp, Homo sapiens
gatttaatagtgttaatc

SEQ ID NO: 2648745 - DNA, 20 bp, Homo sapiens
gatttaatagtgttaatcaa

SEQ ID NO: 2648746 - DNA, 21 bp, Homo sapiens
gatttaattaatcatgaatgt

SEQ ID NO: 2648747 - DNA, 13 bp, Homo sapiens
gatttaattctct

SEQ ID NO: 2648748 - DNA, 15 bp, Homo sapiens
gatttagaactgtat

SEQ ID NO: 2648749 - DNA, 21 bp, Homo sapiens
gatttagtgtttttacctctg

SEQ ID NO: 2648750 - DNA, 13 bp, Homo sapiens
gatttatcaaatc

SEQ ID NO: 2648751 - DNA, 22 bp, Homo sapiens
gatttatttcatcatattatac

SEQ ID NO: 2648752 - DNA, 13 bp, Homo sapiens
gatttcatgattt

SEQ ID NO: 2648753 - DNA, 16 bp, Homo sapiens
gatttcatgctatctc

SEQ ID NO: 2648754 - DNA, 15 bp, Homo sapiens
gatttccagccaggg

SEQ ID NO: 2648755 - DNA, 22 bp, Homo sapiens
gatttccgttaaaataccagcc

SEQ ID NO: 2648756 - DNA, 20 bp, Homo sapiens
gatttcgtgggtctgttttc

SEQ ID NO: 2648757 - DNA, 13 bp, Homo sapiens
gatttctgccttc

SEQ ID NO: 2648758 - DNA, 15 bp, Homo sapiens
gatttctttccagag

SEQ ID NO: 2648759 - DNA, 22 bp, Homo sapiens
gatttgaactcagatctgtctg

SEQ ID NO: 2648760 - DNA, 15 bp, Homo sapiens
gatttgcctgtgcca

SEQ ID NO: 2648761 - DNA, 15 bp, Homo sapiens
gatttggaagggaaa

SEQ ID NO: 2648762 - DNA, 12 bp, Homo sapiens
gatttgggctgg

SEQ ID NO: 2648763 - DNA, 20 bp, Homo sapiens
gatttggggctcagagtggg

SEQ ID NO: 2648764 - DNA, 14 bp, Homo sapiens
gatttgtactgaaa

SEQ ID NO: 2648765 - DNA, 19 bp, Homo sapiens
gatttgtttttgtattttt

SEQ ID NO: 2648766 - DNA, 21 bp, Homo sapiens
gattttaaattcacaatagaa

SEQ ID NO: 2648767 - DNA, 14 bp, Homo sapiens
gattttaacaataa

SEQ ID NO: 2648768 - DNA, 19 bp, Homo sapiens
gattttacaattgaaatga

SEQ ID NO: 2648769 - DNA, 13 bp, Homo sapiens
gattttatgcttt

SEQ ID NO: 2648770 - DNA, 19 bp, Homo sapiens
gattttatgctttaaacat

SEQ ID NO: 2648771 - DNA, 13 bp, Homo sapiens
gattttctttaaa

SEQ ID NO: 2648772 - DNA, 21 bp, Homo sapiens
gattttgaaatttttattaaa

SEQ ID NO: 2648773 - DNA, 19 bp, Homo sapiens
gattttggcctcattactt

SEQ ID NO: 2648774 - DNA, 21 bp, Homo sapiens
gattttggtattacactgtat

SEQ ID NO: 2648775 - DNA, 20 bp, Homo sapiens
gatttttaccgtttcttccc

SEQ ID NO: 2648776 - DNA, 14 bp, Homo sapiens
gatttttttctgag

SEQ ID NO: 2648777 - DNA, 21 bp, Homo sapiens
gcaaaaccactagaactctcc

SEQ ID NO: 2648778 - DNA, 20 bp, Homo sapiens
gcaaaacgcatggagtgtgt

SEQ ID NO: 2648779 - DNA, 17 bp, Homo sapiens
gcaaaagggtgtctgag

SEQ ID NO: 2648780 - DNA, 13 bp, Homo sapiens
gcaaaatagcatt

SEQ ID NO: 2648781 - DNA, 23 bp, Homo sapiens
gcaaacagaggaagaatttgtta

SEQ ID NO: 2648782 - DNA, 17 bp, Homo sapiens
gcaaaccacactggact

SEQ ID NO: 2648783 - DNA, 19 bp, Homo sapiens
gcaaacctgacccctgctc

SEQ ID NO: 2648784 - DNA, 21 bp, Homo sapiens
gcaaagactattcccttctaa

SEQ ID NO: 2648785 - DNA, 22 bp, Homo sapiens
gcaaagactattcccttctaac

SEQ ID NO: 2648786 - DNA, 13 bp, Homo sapiens
gcaaagaggcaag

SEQ ID NO: 2648787 - DNA, 14 bp, Homo sapiens
gcaaagaggcaaga

SEQ ID NO: 2648788 - DNA, 14 bp, Homo sapiens
gcaaagatcaaaat

SEQ ID NO: 2648789 - DNA, 18 bp, Homo sapiens
gcaaagatcaaaataaaa

SEQ ID NO: 2648790 - DNA, 18 bp, Homo sapiens
gcaaagggagcactgggt

SEQ ID NO: 2648791 - DNA, 15 bp, Homo sapiens
gcaaagggctgaaag

SEQ ID NO: 2648792 - DNA, 20 bp, Homo sapiens
gcaaaggggtcccatagagg

SEQ ID NO: 2648793 - DNA, 16 bp, Homo sapiens
gcaaagtcatgcaaag

SEQ ID NO: 2648794 - DNA, 22 bp, Homo sapiens
gcaaagtcatgcaaaggctggg

SEQ ID NO: 2648795 - DNA, 22 bp, Homo sapiens
gcaaataatttcctggtgtgaa

SEQ ID NO: 2648796 - DNA, 12 bp, Homo sapiens
gcaaatcaatgc

SEQ ID NO: 2648797 - DNA, 13 bp, Homo sapiens
gcaaatcagaaac

SEQ ID NO: 2648798 - DNA, 20 bp, Homo sapiens
gcaaatgcccaagggaaaga

SEQ ID NO: 2648799 - DNA, 18 bp, Homo sapiens
gcaaatgtcatcagaact

SEQ ID NO: 2648800 - DNA, 14 bp, Homo sapiens
gcaacaatttatga

SEQ ID NO: 2648801 - DNA, 16 bp, Homo sapiens
gcaacacaagctggaa

SEQ ID NO: 2648802 - DNA, 12 bp, Homo sapiens
gcaacacacaga

SEQ ID NO: 2648803 - DNA, 13 bp, Homo sapiens
gcaacacacagac

SEQ ID NO: 2648804 - DNA, 19 bp, Homo sapiens
gcaacagcaaatcacgacc

SEQ ID NO: 2648805 - DNA, 18 bp, Homo sapiens
gcaacaggaatcaagagc

SEQ ID NO: 2648806 - DNA, 13 bp, Homo sapiens
gcaacaggctggg

SEQ ID NO: 2648807 - DNA, 15 bp, Homo sapiens
gcaacaggctgggct

SEQ ID NO: 2648808 - DNA, 16 bp, Homo sapiens
gcaacaggctgggctt

SEQ ID NO: 2648809 - DNA, 19 bp, Homo sapiens
gcaacaggctgggcttcag

SEQ ID NO: 2648810 - DNA, 20 bp, Homo sapiens
gcaacaggttttataatttt

SEQ ID NO: 2648811 - DNA, 14 bp, Homo sapiens
gcaacccacgtgta

SEQ ID NO: 2648812 - DNA, 14 bp, Homo sapiens
gcaacccccagcct

SEQ ID NO: 2648813 - DNA, 16 bp, Homo sapiens
gcaacccccagcctgc

SEQ ID NO: 2648814 - DNA, 23 bp, Homo sapiens
gcaaccctcctatcacctcccct

SEQ ID NO: 2648815 - DNA, 21 bp, Homo sapiens
gcaacccttaccccttagcct

SEQ ID NO: 2648816 - DNA, 18 bp, Homo sapiens
gcaacggggaggccaagt

SEQ ID NO: 2648817 - DNA, 19 bp, Homo sapiens
gcaactgaataaatacctc

SEQ ID NO: 2648818 - DNA, 21 bp, Homo sapiens
gcaactgaataaatacctctt

SEQ ID NO: 2648819 - DNA, 21 bp, Homo sapiens
gcaacttgtctttttctggac

SEQ ID NO: 2648820 - DNA, 22 bp, Homo sapiens
gcaacttgtctttttctggact

SEQ ID NO: 2648821 - DNA, 23 bp, Homo sapiens
gcaacttgtctttttctggactg

SEQ ID NO: 2648822 - DNA, 23 bp, Homo sapiens
gcaagacgctgtgctgccctgcc

SEQ ID NO: 2648823 - DNA, 19 bp, Homo sapiens
gcaagagaattgcttgaac

SEQ ID NO: 2648824 - DNA, 13 bp, Homo sapiens
gcaagaggggtgg

SEQ ID NO: 2648825 - DNA, 16 bp, Homo sapiens
gcaagatatttatata

SEQ ID NO: 2648826 - DNA, 17 bp, Homo sapiens
gcaagcttggctgtaga

SEQ ID NO: 2648827 - DNA, 21 bp, Homo sapiens
gcaagcttggctgtagaagga

SEQ ID NO: 2648828 - DNA, 22 bp, Homo sapiens
gcaagcttggctgtagaaggag

SEQ ID NO: 2648829 - DNA, 15 bp, Homo sapiens
gcaaggaaggaaaga

SEQ ID NO: 2648830 - DNA, 21 bp, Homo sapiens
gcaaggacacagatgaaacac

SEQ ID NO: 2648831 - DNA, 22 bp, Homo sapiens
gcaaggactacgttaagggaag

SEQ ID NO: 2648832 - DNA, 13 bp, Homo sapiens
gcaaggcaggtgc

SEQ ID NO: 2648833 - DNA, 20 bp, Homo sapiens
gcaaggcaggtgcctccagg

SEQ ID NO: 2648834 - DNA, 15 bp, Homo sapiens
gcaaggggaaaatct

SEQ ID NO: 2648835 - DNA, 18 bp, Homo sapiens
gcaagtatgtgagtgtgt

SEQ ID NO: 2648836 - DNA, 15 bp, Homo sapiens
gcaagtcagaggatg

SEQ ID NO: 2648837 - DNA, 21 bp, Homo sapiens
gcaagtcagaggatggccagt

SEQ ID NO: 2648838 - DNA, 17 bp, Homo sapiens
gcaagtcatggctgtgc

SEQ ID NO: 2648839 - DNA, 19 bp, Homo sapiens
gcaagtctctttatatggc

SEQ ID NO: 2648840 - DNA, 17 bp, Homo sapiens
gcaagtgagagagatgg

SEQ ID NO: 2648841 - DNA, 22 bp, Homo sapiens
gcaagtgagagagatgggagct

SEQ ID NO: 2648842 - DNA, 15 bp, Homo sapiens
gcaagtgtctgtgtg

SEQ ID NO: 2648843 - DNA, 17 bp, Homo sapiens
gcaagtgtctgtgtgca

SEQ ID NO: 2648844 - DNA, 23 bp, Homo sapiens
gcaagtgtgtgcacatgtgtgcg

SEQ ID NO: 2648845 - DNA, 22 bp, Homo sapiens
gcaagtgtgtgcatgtgtgcga

SEQ ID NO: 2648846 - DNA, 17 bp, Homo sapiens
gcaagttctagagaaga

SEQ ID NO: 2648847 - DNA, 20 bp, Homo sapiens
gcaagttctagagaagaggc

SEQ ID NO: 2648848 - DNA, 21 bp, Homo sapiens
gcaagttctagagaagaggct

SEQ ID NO: 2648849 - DNA, 12 bp, Homo sapiens
gcaataaatgaa

SEQ ID NO: 2648850 - DNA, 17 bp, Homo sapiens
gcaatagtgtgttctga

SEQ ID NO: 2648851 - DNA, 14 bp, Homo sapiens
gcaatatagaaaca

SEQ ID NO: 2648852 - DNA, 20 bp, Homo sapiens
gcaatccatgttagttttta

SEQ ID NO: 2648853 - DNA, 23 bp, Homo sapiens
gcaatctattaatagctgcctta

SEQ ID NO: 2648854 - DNA, 14 bp, Homo sapiens
gcaatgaacactta

SEQ ID NO: 2648855 - DNA, 16 bp, Homo sapiens
gcaatgattactcttt

SEQ ID NO: 2648856 - DNA, 18 bp, Homo sapiens
gcaatgccatcatctcct

SEQ ID NO: 2648857 - DNA, 13 bp, Homo sapiens
gcaatgctggctg

SEQ ID NO: 2648858 - DNA, 14 bp, Homo sapiens
gcaatggcagcctt

SEQ ID NO: 2648859 - DNA, 15 bp, Homo sapiens
gcagaaatctagaag

SEQ ID NO: 2648860 - DNA, 15 bp, Homo sapiens
gcagaacactaacct

SEQ ID NO: 2648861 - DNA, 18 bp, Homo sapiens
gcagaacagccgctcctg

SEQ ID NO: 2648862 - DNA, 23 bp, Homo sapiens
gcagaacagccgctcctgtctgc

SEQ ID NO: 2648863 - DNA, 20 bp, Homo sapiens
gcagaagacaccagagcaga

SEQ ID NO: 2648864 - DNA, 14 bp, Homo sapiens
gcagaaggccaaga

SEQ ID NO: 2648865 - DNA, 15 bp, Homo sapiens
gcagaaggccaagaa

SEQ ID NO: 2648866 - DNA, 17 bp, Homo sapiens
gcagaatgtttttaaaa

SEQ ID NO: 2648867 - DNA, 13 bp, Homo sapiens
gcagacagcagct

SEQ ID NO: 2648868 - DNA, 19 bp, Homo sapiens
gcagacagcagctcaggca

SEQ ID NO: 2648869 - DNA, 17 bp, Homo sapiens
gcagacaggaggaatca

SEQ ID NO: 2648870 - DNA, 20 bp, Homo sapiens
gcagacctgtcctcctggtg

SEQ ID NO: 2648871 - DNA, 15 bp, Homo sapiens
gcagactatgcaaac

SEQ ID NO: 2648872 - DNA, 17 bp, Homo sapiens
gcagactcagtttgtca

SEQ ID NO: 2648873 - DNA, 19 bp, Homo sapiens
gcagactctacagaggcca

SEQ ID NO: 2648874 - DNA, 21 bp, Homo sapiens
gcagactgctgctagagccag

SEQ ID NO: 2648875 - DNA, 18 bp, Homo sapiens
gcagagaaagaagagaca

SEQ ID NO: 2648876 - DNA, 22 bp, Homo sapiens
gcagagaaagaagagacaggag

SEQ ID NO: 2648877 - DNA, 20 bp, Homo sapiens
gcagagaccatccctgaagg

SEQ ID NO: 2648878 - DNA, 21 bp, Homo sapiens
gcagagaccatccctgaaggc

SEQ ID NO: 2648879 - DNA, 22 bp, Homo sapiens
gcagagaccatccctgaaggcc

SEQ ID NO: 2648880 - DNA, 14 bp, Homo sapiens
gcagagagaagcct

SEQ ID NO: 2648881 - DNA, 23 bp, Homo sapiens
gcagagcaccttagacagtccct

SEQ ID NO: 2648882 - DNA, 12 bp, Homo sapiens
gcagagcagaga

SEQ ID NO: 2648883 - DNA, 22 bp, Homo sapiens
gcagagcgccgtgagttctcag

SEQ ID NO: 2648884 - DNA, 23 bp, Homo sapiens
gcagagcgccgtgagttctcagg

SEQ ID NO: 2648885 - DNA, 11 bp, Homo sapiens
gcagaggacag

SEQ ID NO: 2648886 - DNA, 12 bp, Homo sapiens
gcagaggcagcg

SEQ ID NO: 2648887 - DNA, 19 bp, Homo sapiens
gcagaggggctttctggag

SEQ ID NO: 2648888 - DNA, 21 bp, Homo sapiens
gcagaggtaaaagtgtgagca

SEQ ID NO: 2648889 - DNA, 15 bp, Homo sapiens
gcagaggtggccaga

SEQ ID NO: 2648890 - DNA, 18 bp, Homo sapiens
gcagaggttgcagtgagc

SEQ ID NO: 2648891 - DNA, 12 bp, Homo sapiens
gcagagtcagca

SEQ ID NO: 2648892 - DNA, 24 bp, Homo sapiens
gcagagtttgtgtgttgtcttgaa

SEQ ID NO: 2648893 - DNA, 18 bp, Homo sapiens
gcagataatcagcctctt

SEQ ID NO: 2648894 - DNA, 13 bp, Homo sapiens
gcagatctgtgcc

SEQ ID NO: 2648895 - DNA, 14 bp, Homo sapiens
gcagatctgtgccc

SEQ ID NO: 2648896 - DNA, 22 bp, Homo sapiens
gcagatctgtgccccatgcctg

SEQ ID NO: 2648897 - DNA, 14 bp, Homo sapiens
gcagatgaggttgc

SEQ ID NO: 2648898 - DNA, 16 bp, Homo sapiens
gcagatgcaaagaggc

SEQ ID NO: 2648899 - DNA, 17 bp, Homo sapiens
gcagatgcaaagaggca

SEQ ID NO: 2648900 - DNA, 15 bp, Homo sapiens
gcagatgcagagagc

SEQ ID NO: 2648901 - DNA, 18 bp, Homo sapiens
gcagatgcagagagccat

SEQ ID NO: 2648902 - DNA, 14 bp, Homo sapiens
gcagattggagaaa

SEQ ID NO: 2648903 - DNA, 19 bp, Homo sapiens
gcagattggagaaaccctt

SEQ ID NO: 2648904 - DNA, 20 bp, Homo sapiens
gcagattgtgtaacaatttt

SEQ ID NO: 2648905 - DNA, 21 bp, Homo sapiens
gcagattttcagcaaactctt

SEQ ID NO: 2648906 - DNA, 14 bp, Homo sapiens
gcagcagccatcat

SEQ ID NO: 2648907 - DNA, 22 bp, Homo sapiens
gcagcagccatcataggaaggg

SEQ ID NO: 2648908 - DNA, 23 bp, Homo sapiens
gcagcagcttttaatacagggta

SEQ ID NO: 2648909 - DNA, 18 bp, Homo sapiens
gcagcagggagggcttct

SEQ ID NO: 2648910 - DNA, 20 bp, Homo sapiens
gcagcaggtggcagaatggg

SEQ ID NO: 2648911 - DNA, 16 bp, Homo sapiens
gcagcagtgaaaacaa

SEQ ID NO: 2648912 - DNA, 21 bp, Homo sapiens
gcagcagtgaaaacaagtgct

SEQ ID NO: 2648913 - DNA, 21 bp, Homo sapiens
gcagcagtgtgaggccagggc

SEQ ID NO: 2648914 - DNA, 19 bp, Homo sapiens
gcagcatattcaggaagct

SEQ ID NO: 2648915 - DNA, 15 bp, Homo sapiens
gcagcatctgctaat

SEQ ID NO: 2648916 - DNA, 19 bp, Homo sapiens
gcagcatcttcacttctaa

SEQ ID NO: 2648917 - DNA, 22 bp, Homo sapiens
gcagcatgttgctgaggagtga

SEQ ID NO: 2648918 - DNA, 13 bp, Homo sapiens
gcagccaagctcc

SEQ ID NO: 2648919 - DNA, 20 bp, Homo sapiens
gcagccaagctccttgggag

SEQ ID NO: 2648920 - DNA, 13 bp, Homo sapiens
gcagccaccagcg

SEQ ID NO: 2648921 - DNA, 23 bp, Homo sapiens
gcagccagacctattcctcctgg

SEQ ID NO: 2648922 - DNA, 15 bp, Homo sapiens
gcagccagctctcag

SEQ ID NO: 2648923 - DNA, 14 bp, Homo sapiens
gcagccaggccaca

SEQ ID NO: 2648924 - DNA, 16 bp, Homo sapiens
gcagccaggccacaag

SEQ ID NO: 2648925 - DNA, 13 bp, Homo sapiens
gcagcccatgccc

SEQ ID NO: 2648926 - DNA, 20 bp, Homo sapiens
gcagcccatgcccacctgcc

SEQ ID NO: 2648927 - DNA, 22 bp, Homo sapiens
gcagcccatgcccacctgccca

SEQ ID NO: 2648928 - DNA, 18 bp, Homo sapiens
gcagccccattctgcctg

SEQ ID NO: 2648929 - DNA, 19 bp, Homo sapiens
gcagccccattctgcctgc

SEQ ID NO: 2648930 - DNA, 20 bp, Homo sapiens
gcagccccgtggggttcctc

SEQ ID NO: 2648931 - DNA, 19 bp, Homo sapiens
gcagcccgtgtggcccctt

SEQ ID NO: 2648932 - DNA, 23 bp, Homo sapiens
gcagccctaaggatctctcagga

SEQ ID NO: 2648933 - DNA, 19 bp, Homo sapiens
gcagccctagagcctgcct

SEQ ID NO: 2648934 - DNA, 14 bp, Homo sapiens
gcagccctggagtc

SEQ ID NO: 2648935 - DNA, 16 bp, Homo sapiens
gcagccctggagtcat

SEQ ID NO: 2648936 - DNA, 21 bp, Homo sapiens
gcagcctcaacctcctgggct

SEQ ID NO: 2648937 - DNA, 17 bp, Homo sapiens
gcagcctcacagtcctt

SEQ ID NO: 2648938 - DNA, 23 bp, Homo sapiens
gcagcctccctctgacctgcagg

SEQ ID NO: 2648939 - DNA, 14 bp, Homo sapiens
gcagcctggaccct

SEQ ID NO: 2648940 - DNA, 19 bp, Homo sapiens
gcagcctgtcctgggctgg

SEQ ID NO: 2648941 - DNA, 16 bp, Homo sapiens
gcagcctgtggcatct

SEQ ID NO: 2648942 - DNA, 16 bp, Homo sapiens
gcagcgaccacccctg

SEQ ID NO: 2648943 - DNA, 17 bp, Homo sapiens
gcagcgaccgccccctc

SEQ ID NO: 2648944 - DNA, 15 bp, Homo sapiens
gcagcgccaagcaac

SEQ ID NO: 2648945 - DNA, 18 bp, Homo sapiens
gcagcgccaagcaacctg

SEQ ID NO: 2648946 - DNA, 20 bp, Homo sapiens
gcagctcacctctcccttgg

SEQ ID NO: 2648947 - DNA, 16 bp, Homo sapiens
gcagctcactacccta

SEQ ID NO: 2648948 - DNA, 21 bp, Homo sapiens
gcagctcatctctgtcccact

SEQ ID NO: 2648949 - DNA, 14 bp, Homo sapiens
gcagctctccagtc

SEQ ID NO: 2648950 - DNA, 14 bp, Homo sapiens
gcagctcttgccct

SEQ ID NO: 2648951 - DNA, 23 bp, Homo sapiens
gcagctcttgctaatcagtgtct

SEQ ID NO: 2648952 - DNA, 14 bp, Homo sapiens
gcagctgacctctg

SEQ ID NO: 2648953 - DNA, 23 bp, Homo sapiens
gcagctgcggtccacccaggagc

SEQ ID NO: 2648954 - DNA, 13 bp, Homo sapiens
gcagctgcttttg

SEQ ID NO: 2648955 - DNA, 15 bp, Homo sapiens
gcagctgggcccaac

SEQ ID NO: 2648956 - DNA, 22 bp, Homo sapiens
gcagctgggcccaaccctgtct

SEQ ID NO: 2648957 - DNA, 16 bp, Homo sapiens
gcagctgtttaaatgt

SEQ ID NO: 2648958 - DNA, 14 bp, Homo sapiens
gcagcttctgtcct

SEQ ID NO: 2648959 - DNA, 16 bp, Homo sapiens
gcagcttgagggttgg

SEQ ID NO: 2648960 - DNA, 17 bp, Homo sapiens
gcagctttaaactcagg

SEQ ID NO: 2648961 - DNA, 21 bp, Homo sapiens
gcagctttaaactcagggaca

SEQ ID NO: 2648962 - DNA, 16 bp, Homo sapiens
gcaggaactcccagca

SEQ ID NO: 2648963 - DNA, 20 bp, Homo sapiens
gcaggaagcattcagagagc

SEQ ID NO: 2648964 - DNA, 14 bp, Homo sapiens
gcaggaagctcaga

SEQ ID NO: 2648965 - DNA, 12 bp, Homo sapiens
gcaggaaggaga

SEQ ID NO: 2648966 - DNA, 15 bp, Homo sapiens
gcaggaaggagagcc

SEQ ID NO: 2648967 - DNA, 17 bp, Homo sapiens
gcaggaaggagagcctg

SEQ ID NO: 2648968 - DNA, 23 bp, Homo sapiens
gcaggaaggagagcctgctgcat

SEQ ID NO: 2648969 - DNA, 17 bp, Homo sapiens
gcaggacaacgaggaag

SEQ ID NO: 2648970 - DNA, 15 bp, Homo sapiens
gcaggaccaggacta

SEQ ID NO: 2648971 - DNA, 14 bp, Homo sapiens
gcaggacctcagag

SEQ ID NO: 2648972 - DNA, 15 bp, Homo sapiens
gcaggacctcagagt

SEQ ID NO: 2648973 - DNA, 23 bp, Homo sapiens
gcaggacctcagagtccaggccc

SEQ ID NO: 2648974 - DNA, 23 bp, Homo sapiens
gcaggagaggagagccagagaag

SEQ ID NO: 2648975 - DNA, 17 bp, Homo sapiens
gcaggagcagtatcatg

SEQ ID NO: 2648976 - DNA, 23 bp, Homo sapiens
gcaggaggatcacttgagtccag

SEQ ID NO: 2648977 - DNA, 14 bp, Homo sapiens
gcaggaggcccctg

SEQ ID NO: 2648978 - DNA, 15 bp, Homo sapiens
gcaggcaccttagtg

SEQ ID NO: 2648979 - DNA, 12 bp, Homo sapiens
gcaggcagccag

SEQ ID NO: 2648980 - DNA, 13 bp, Homo sapiens
gcaggcagccagg

SEQ ID NO: 2648981 - DNA, 17 bp, Homo sapiens
gcaggcagccaggccac

SEQ ID NO: 2648982 - DNA, 18 bp, Homo sapiens
gcaggcagccaggccaca

SEQ ID NO: 2648983 - DNA, 21 bp, Homo sapiens
gcaggcagcgccaagcaacct

SEQ ID NO: 2648984 - DNA, 9 bp, Homo sapiens
gcaggcagt

SEQ ID NO: 2648985 - DNA, 23 bp, Homo sapiens
gcaggccaaggccttctcctccc

SEQ ID NO: 2648986 - DNA, 16 bp, Homo sapiens
gcaggccaggccagct

SEQ ID NO: 2648987 - DNA, 17 bp, Homo sapiens
gcaggccaggccagctg

SEQ ID NO: 2648988 - DNA, 23 bp, Homo sapiens
gcaggcctcgaaaaccatcacat

SEQ ID NO: 2648989 - DNA, 16 bp, Homo sapiens
gcaggcggtgggcacc

SEQ ID NO: 2648990 - DNA, 21 bp, Homo sapiens
gcaggctaaggcgtggagctg

SEQ ID NO: 2648991 - DNA, 15 bp, Homo sapiens
gcaggctactgtcag

SEQ ID NO: 2648992 - DNA, 16 bp, Homo sapiens
gcaggctagaacctgg

SEQ ID NO: 2648993 - DNA, 17 bp, Homo sapiens
gcaggctggcagctctc

SEQ ID NO: 2648994 - DNA, 22 bp, Homo sapiens
gcaggctggcagctctccagtc

SEQ ID NO: 2648995 - DNA, 23 bp, Homo sapiens
gcaggctggcagctctccagtca

SEQ ID NO: 2648996 - DNA, 17 bp, Homo sapiens
gcaggctgtctggccag

SEQ ID NO: 2648997 - DNA, 22 bp, Homo sapiens
gcaggctttgtttatagcttgc

SEQ ID NO: 2648998 - DNA, 21 bp, Homo sapiens
gcagggaaaattatttgcata

SEQ ID NO: 2648999 - DNA, 13 bp, Homo sapiens
gcagggaaacagc

SEQ ID NO: 2649000 - DNA, 22 bp, Homo sapiens
gcagggaaaggctctgaaagcc

SEQ ID NO: 2649001 - DNA, 14 bp, Homo sapiens
gcagggatcctggt

SEQ ID NO: 2649002 - DNA, 19 bp, Homo sapiens
gcagggcatctcctgtgca

SEQ ID NO: 2649003 - DNA, 14 bp, Homo sapiens
gccatgctgaaggg

SEQ ID NO: 2649004 - DNA, 16 bp, Homo sapiens
gccatgctgggaagac

SEQ ID NO: 2649005 - DNA, 20 bp, Homo sapiens
gccatggactctacactgtg

SEQ ID NO: 2649006 - DNA, 16 bp, Homo sapiens
gccatggagagctgga

SEQ ID NO: 2649007 - DNA, 18 bp, Homo sapiens
gccatggagagctggagc

SEQ ID NO: 2649008 - DNA, 21 bp, Homo sapiens
gccatgggaccaaacctagcc

SEQ ID NO: 2649009 - DNA, 16 bp, Homo sapiens
gccatgtagaagctgc

SEQ ID NO: 2649010 - DNA, 23 bp, Homo sapiens
gccatgttaatgtaatctgatgg

SEQ ID NO: 2649011 - DNA, 19 bp, Homo sapiens
gccatgttggccaggctgg

SEQ ID NO: 2649012 - DNA, 20 bp, Homo sapiens
gccatgttggccaggctggt

SEQ ID NO: 2649013 - DNA, 22 bp, Homo sapiens
gccatgttggccaggctggtct

SEQ ID NO: 2649014 - DNA, 24 bp, Homo sapiens
gccatgttggccaggctggtctca

SEQ ID NO: 2649015 - DNA, 18 bp, Homo sapiens
gccattcactgcccccag

SEQ ID NO: 2649016 - DNA, 22 bp, Homo sapiens
gccattcacttcataatccagt

SEQ ID NO: 2649017 - DNA, 20 bp, Homo sapiens
gccattcctggtacccagcc

SEQ ID NO: 2649018 - DNA, 22 bp, Homo sapiens
gccattcctggtacccagccat

SEQ ID NO: 2649019 - DNA, 19 bp, Homo sapiens
gccattgcactccagcctg

SEQ ID NO: 2649020 - DNA, 21 bp, Homo sapiens
gccattgcactccagcctggg

SEQ ID NO: 2649021 - DNA, 21 bp, Homo sapiens
gccattgtcttcggaaacctt

SEQ ID NO: 2649022 - DNA, 21 bp, Homo sapiens
gccatttagccaccatctttg

SEQ ID NO: 2649023 - DNA, 23 bp, Homo sapiens
gccatttgcaccctccgccttca

SEQ ID NO: 2649024 - DNA, 13 bp, Homo sapiens
gccattttgtgaa

SEQ ID NO: 2649025 - DNA, 18 bp, Homo sapiens
gccattttgtgaatggat

SEQ ID NO: 2649026 - DNA, 19 bp, Homo sapiens
gcccaaagtggtatagaaa

SEQ ID NO: 2649027 - DNA, 15 bp, Homo sapiens
gcccaaccctgtctg

SEQ ID NO: 2649028 - DNA, 14 bp, Homo sapiens
gcccaacctgctct

SEQ ID NO: 2649029 - DNA, 19 bp, Homo sapiens
gcccaagacagatgcccca

SEQ ID NO: 2649030 - DNA, 21 bp, Homo sapiens
gcccaagacagatgccccaga

SEQ ID NO: 2649031 - DNA, 13 bp, Homo sapiens
gcccaagatgctt

SEQ ID NO: 2649032 - DNA, 16 bp, Homo sapiens
gcccaaggcggcccct

SEQ ID NO: 2649033 - DNA, 17 bp, Homo sapiens
gcccaagtccctgtttt

SEQ ID NO: 2649034 - DNA, 20 bp, Homo sapiens
gcccaagtggcagagcttgg

SEQ ID NO: 2649035 - DNA, 18 bp, Homo sapiens
gcccaagttgtggtgctg

SEQ ID NO: 2649036 - DNA, 19 bp, Homo sapiens
gcccaatatgcagttctgc

SEQ ID NO: 2649037 - DNA, 21 bp, Homo sapiens
gcccaatgcactttgttctgg

SEQ ID NO: 2649038 - DNA, 13 bp, Homo sapiens
gcccacaccccct

SEQ ID NO: 2649039 - DNA, 12 bp, Homo sapiens
gcccacagggaa

SEQ ID NO: 2649040 - DNA, 14 bp, Homo sapiens
gcccacatcccagg

SEQ ID NO: 2649041 - DNA, 16 bp, Homo sapiens
gcccacattggaccca

SEQ ID NO: 2649042 - DNA, 22 bp, Homo sapiens
gcccaccccctcaagccaatcc

SEQ ID NO: 2649043 - DNA, 18 bp, Homo sapiens
gcccaccctcctgtcttc

SEQ ID NO: 2649044 - DNA, 15 bp, Homo sapiens
gcccacctgcccatc

SEQ ID NO: 2649045 - DNA, 13 bp, Homo sapiens
gcccacctggcca

SEQ ID NO: 2649046 - DNA, 14 bp, Homo sapiens
gcccacctggccac

SEQ ID NO: 2649047 - DNA, 16 bp, Homo sapiens
gcccacctggccacct

SEQ ID NO: 2649048 - DNA, 20 bp, Homo sapiens
gcccacctggcctctgcact

SEQ ID NO: 2649049 - DNA, 24 bp, Homo sapiens
gcccacctggcctctgcactcccc

SEQ ID NO: 2649050 - DNA, 13 bp, Homo sapiens
gcccacgccccca

SEQ ID NO: 2649051 - DNA, 21 bp, Homo sapiens
gcccacgcccccactggtgac

SEQ ID NO: 2649052 - DNA, 16 bp, Homo sapiens
gcccacgctggagtgc

SEQ ID NO: 2649053 - DNA, 21 bp, Homo sapiens
gcccacgctggagtgcagtga

SEQ ID NO: 2649054 - DNA, 23 bp, Homo sapiens
gcccacgctggagtgcagtgagc

SEQ ID NO: 2649055 - DNA, 16 bp, Homo sapiens
gcccacgtagggcggc

SEQ ID NO: 2649056 - DNA, 15 bp, Homo sapiens
gcccactccctgcaa

SEQ ID NO: 2649057 - DNA, 16 bp, Homo sapiens
gcccactgcccacccc

SEQ ID NO: 2649058 - DNA, 13 bp, Homo sapiens
gcccactgtcctg

SEQ ID NO: 2649059 - DNA, 14 bp, Homo sapiens
gcccactgtcctgg

SEQ ID NO: 2649060 - DNA, 15 bp, Homo sapiens
gcccactgtcctggg

SEQ ID NO: 2649061 - DNA, 21 bp, Homo sapiens
gcccactgtcctgggcgccct

SEQ ID NO: 2649062 - DNA, 23 bp, Homo sapiens
gcccactgtcctgggcgccctgg

SEQ ID NO: 2649063 - DNA, 16 bp, Homo sapiens
gcccagaaaaggacag

SEQ ID NO: 2649064 - DNA, 13 bp, Homo sapiens
gcccagagaagcc

SEQ ID NO: 2649065 - DNA, 16 bp, Homo sapiens
gcccagagcaggaagc

SEQ ID NO: 2649066 - DNA, 16 bp, Homo sapiens
gcccagagggcccagg

SEQ ID NO: 2649067 - DNA, 20 bp, Homo sapiens
gcccagagggcccaggcagg

SEQ ID NO: 2649068 - DNA, 15 bp, Homo sapiens
gcccagagggcctgc

SEQ ID NO: 2649069 - DNA, 16 bp, Homo sapiens
gcccagaggtaacaga

SEQ ID NO: 2649070 - DNA, 18 bp, Homo sapiens
gcccagaggtaacagaac

SEQ ID NO: 2649071 - DNA, 20 bp, Homo sapiens
gcccagaggtaacagaacag

SEQ ID NO: 2649072 - DNA, 17 bp, Homo sapiens
gcccagatcagctccta

SEQ ID NO: 2649073 - DNA, 21 bp, Homo sapiens
gcccagatgttttacgtctgg

SEQ ID NO: 2649074 - DNA, 18 bp, Homo sapiens
gcccagcattgctggttc

SEQ ID NO: 2649075 - DNA, 19 bp, Homo sapiens
gcccagcattgctggttct

SEQ ID NO: 2649076 - DNA, 17 bp, Homo sapiens
gcccagccaaaccctgt

SEQ ID NO: 2649077 - DNA, 21 bp, Homo sapiens
gcccagccattaccatggaga

SEQ ID NO: 2649078 - DNA, 23 bp, Homo sapiens
gcccagccattaccatggagaca

SEQ ID NO: 2649079 - DNA, 18 bp, Homo sapiens
gcccagcccggaccttgg

SEQ ID NO: 2649080 - DNA, 11 bp, Homo sapiens
gcccagccctg

SEQ ID NO: 2649081 - DNA, 12 bp, Homo sapiens
gcccagccctgc

SEQ ID NO: 2649082 - DNA, 16 bp, Homo sapiens
gcccagccctgctggc

SEQ ID NO: 2649083 - DNA, 17 bp, Homo sapiens
gcccagccctgctggcc

SEQ ID NO: 2649084 - DNA, 16 bp, Homo sapiens
gcccagcggcccctcc

SEQ ID NO: 2649085 - DNA, 15 bp, Homo sapiens
gcccagctagctgca

SEQ ID NO: 2649086 - DNA, 13 bp, Homo sapiens
gcccagctctgaa

SEQ ID NO: 2649087 - DNA, 18 bp, Homo sapiens
gcccagctgcacctgcca

SEQ ID NO: 2649088 - DNA, 23 bp, Homo sapiens
gcccagctgcacctgccagcctg

SEQ ID NO: 2649089 - DNA, 16 bp, Homo sapiens
gcccagctgggctctg

SEQ ID NO: 2649090 - DNA, 19 bp, Homo sapiens
gcccagctgggctctgcca

SEQ ID NO: 2649091 - DNA, 23 bp, Homo sapiens
gcccagctgggctctgccaccct

SEQ ID NO: 2649092 - DNA, 18 bp, Homo sapiens
gcccagcttgggcccagc

SEQ ID NO: 2649093 - DNA, 20 bp, Homo sapiens
gcccagcttgggcccagctg

SEQ ID NO: 2649094 - DNA, 12 bp, Homo sapiens
gcccaggaaagg

SEQ ID NO: 2649095 - DNA, 19 bp, Homo sapiens
gcccaggaaaggctccagg

SEQ ID NO: 2649096 - DNA, 22 bp, Homo sapiens
gcccaggaaaggctccaggagc

SEQ ID NO: 2649097 - DNA, 17 bp, Homo sapiens
gcccaggaccagctggg

SEQ ID NO: 2649098 - DNA, 22 bp, Homo sapiens
gcccaggagtttgaggctgcag

SEQ ID NO: 2649099 - DNA, 15 bp, Homo sapiens
gcccaggatggcttt

SEQ ID NO: 2649100 - DNA, 11 bp, Homo sapiens
gcccaggcagg

SEQ ID NO: 2649101 - DNA, 20 bp, Homo sapiens
gcccaggcccctgccaccct

SEQ ID NO: 2649102 - DNA, 22 bp, Homo sapiens
gcccaggcccctgccaccctgg

SEQ ID NO: 2649103 - DNA, 23 bp, Homo sapiens
gcccaggccggggtggagcatgg

SEQ ID NO: 2649104 - DNA, 12 bp, Homo sapiens
gcccaggctggc

SEQ ID NO: 2649105 - DNA, 14 bp, Homo sapiens
gcccaggctggcgt

SEQ ID NO: 2649106 - DNA, 15 bp, Homo sapiens
gcccaggctggcgtg

SEQ ID NO: 2649107 - DNA, 16 bp, Homo sapiens
gcccaggctggcgtgc

SEQ ID NO: 2649108 - DNA, 23 bp, Homo sapiens
gcccaggcttagtcactgagaca

SEQ ID NO: 2649109 - DNA, 18 bp, Homo sapiens
gcccagggacaccagcca

SEQ ID NO: 2649110 - DNA, 20 bp, Homo sapiens
gcccagggacaccagccagg

SEQ ID NO: 2649111 - DNA, 18 bp, Homo sapiens
gcccagggagaggccatg

SEQ ID NO: 2649112 - DNA, 20 bp, Homo sapiens
gcccagggagcggaaagcag

SEQ ID NO: 2649113 - DNA, 21 bp, Homo sapiens
gcccagggagcggaaagcagc

SEQ ID NO: 2649114 - DNA, 13 bp, Homo sapiens
gcccagggccact

SEQ ID NO: 2649115 - DNA, 18 bp, Homo sapiens
gcccagggccactctgcc

SEQ ID NO: 2649116 - DNA, 20 bp, Homo sapiens
gcccagggccactctgcctc

SEQ ID NO: 2649117 - DNA, 16 bp, Homo sapiens
gcccagggctcagcct

SEQ ID NO: 2649118 - DNA, 14 bp, Homo sapiens
gcccaggggtgccc

SEQ ID NO: 2649119 - DNA, 22 bp, Homo sapiens
gcccaggggtgccccctcctct

SEQ ID NO: 2649120 - DNA, 20 bp, Homo sapiens
gcccagggttcccccagccc

SEQ ID NO: 2649121 - DNA, 23 bp, Homo sapiens
gcccagggttcccccagccctgt

SEQ ID NO: 2649122 - DNA, 15 bp, Homo sapiens
gcccaggtcctctga

SEQ ID NO: 2649123 - DNA, 13 bp, Homo sapiens
gcccagtcctggc

SEQ ID NO: 2649124 - DNA, 16 bp, Homo sapiens
gcccagtcctggcctg

SEQ ID NO: 2649125 - DNA, 20 bp, Homo sapiens
gcccagtctggaatgcagtg

SEQ ID NO: 2649126 - DNA, 22 bp, Homo sapiens
gcccagtgtcaagttgtgcttg

SEQ ID NO: 2649127 - DNA, 21 bp, Homo sapiens
gcccagtttctgcctctgagg

SEQ ID NO: 2649128 - DNA, 17 bp, Homo sapiens
gcccatcaattatagaa

SEQ ID NO: 2649129 - DNA, 21 bp, Homo sapiens
gcccatccctggaaggtgctg

SEQ ID NO: 2649130 - DNA, 19 bp, Homo sapiens
gcccatgcccacctgccca

SEQ ID NO: 2649131 - DNA, 20 bp, Homo sapiens
gcccatgtcgcgctcagcat

SEQ ID NO: 2649132 - DNA, 13 bp, Homo sapiens
gcccatgtgtgag

SEQ ID NO: 2649133 - DNA, 23 bp, Homo sapiens
gcccattcattccattctggaag

SEQ ID NO: 2649134 - DNA, 18 bp, Homo sapiens
gcccatttcaattctcaa

SEQ ID NO: 2649135 - DNA, 15 bp, Homo sapiens
gccccaaaaccacag

SEQ ID NO: 2649136 - DNA, 20 bp, Homo sapiens
gccccaaaaccacagccctg

SEQ ID NO: 2649137 - DNA, 19 bp, Homo sapiens
gccccaaacaaatatgcaa

SEQ ID NO: 2649138 - DNA, 14 bp, Homo sapiens
gccccaacctgctg

SEQ ID NO: 2649139 - DNA, 21 bp, Homo sapiens
gccccaagtcctgaagaggcg

SEQ ID NO: 2649140 - DNA, 20 bp, Homo sapiens
gccccacacggaggcatctg

SEQ ID NO: 2649141 - DNA, 19 bp, Homo sapiens
gccccacactggggtgccg

SEQ ID NO: 2649142 - DNA, 23 bp, Homo sapiens
gccccacactggggtgccgcctg

SEQ ID NO: 2649143 - DNA, 11 bp, Homo sapiens
gccccacccag

SEQ ID NO: 2649144 - DNA, 12 bp, Homo sapiens
gccccacccaga

SEQ ID NO: 2649145 - DNA, 22 bp, Homo sapiens
gccccacccagatgggggaaag

SEQ ID NO: 2649146 - DNA, 13 bp, Homo sapiens
gcctgctcccagc

SEQ ID NO: 2649147 - DNA, 16 bp, Homo sapiens
gcctgctcccagcagc

SEQ ID NO: 2649148 - DNA, 21 bp, Homo sapiens
gcctgctggtcacagcctcct

SEQ ID NO: 2649149 - DNA, 22 bp, Homo sapiens
gcctgctggtcacagcctcctc

SEQ ID NO: 2649150 - DNA, 22 bp, Homo sapiens
gcctgcttttcactgctgcaag

SEQ ID NO: 2649151 - DNA, 13 bp, Homo sapiens
gcctggaagacag

SEQ ID NO: 2649152 - DNA, 19 bp, Homo sapiens
gcctggacctgcctcctgc

SEQ ID NO: 2649153 - DNA, 23 bp, Homo sapiens
gcctggacctgcctcctgcctgc

SEQ ID NO: 2649154 - DNA, 21 bp, Homo sapiens
gcctggatattattcttgtag

SEQ ID NO: 2649155 - DNA, 12 bp, Homo sapiens
gcctggatctcc

SEQ ID NO: 2649156 - DNA, 14 bp, Homo sapiens
gcctggatggggct

SEQ ID NO: 2649157 - DNA, 15 bp, Homo sapiens
gcctggatggggctg

SEQ ID NO: 2649158 - DNA, 18 bp, Homo sapiens
gcctggcaagtgggtgaa

SEQ ID NO: 2649159 - DNA, 16 bp, Homo sapiens
gcctggcacacatcag

SEQ ID NO: 2649160 - DNA, 13 bp, Homo sapiens
gcctggcagaact

SEQ ID NO: 2649161 - DNA, 19 bp, Homo sapiens
gcctggcagaactgagctc

SEQ ID NO: 2649162 - DNA, 15 bp, Homo sapiens
gcctggccagatgca

SEQ ID NO: 2649163 - DNA, 15 bp, Homo sapiens
gcctggccaggcaga

SEQ ID NO: 2649164 - DNA, 17 bp, Homo sapiens
gcctggccaggcagatc

SEQ ID NO: 2649165 - DNA, 21 bp, Homo sapiens
gcctggcccacagcaggtgct

SEQ ID NO: 2649166 - DNA, 22 bp, Homo sapiens
gcctggcccacagcaggtgctg

SEQ ID NO: 2649167 - DNA, 13 bp, Homo sapiens
gcctggcccctca

SEQ ID NO: 2649168 - DNA, 15 bp, Homo sapiens
gcctggcccctcagg

SEQ ID NO: 2649169 - DNA, 17 bp, Homo sapiens
gcctggcccctcagggt

SEQ ID NO: 2649170 - DNA, 10 bp, Homo sapiens
gcctggcctg

SEQ ID NO: 2649171 - DNA, 14 bp, Homo sapiens
gcctggcctgagct

SEQ ID NO: 2649172 - DNA, 19 bp, Homo sapiens
gcctggcgacagagcgaga

SEQ ID NO: 2649173 - DNA, 17 bp, Homo sapiens
gcctggctcagagccag

SEQ ID NO: 2649174 - DNA, 18 bp, Homo sapiens
gcctggctcagagccagt

SEQ ID NO: 2649175 - DNA, 22 bp, Homo sapiens
gcctggctcccacaggcagctt

SEQ ID NO: 2649176 - DNA, 23 bp, Homo sapiens
gcctggctcccacaggcagcttt

SEQ ID NO: 2649177 - DNA, 16 bp, Homo sapiens
gcctggcttctccttt

SEQ ID NO: 2649178 - DNA, 16 bp, Homo sapiens
gcctggcttctggagc

SEQ ID NO: 2649179 - DNA, 22 bp, Homo sapiens
gcctgggaggtcaaggctgcag

SEQ ID NO: 2649180 - DNA, 21 bp, Homo sapiens
gcctgggatccctcatcctca

SEQ ID NO: 2649181 - DNA, 18 bp, Homo sapiens
gcctgggcagccaggctg

SEQ ID NO: 2649182 - DNA, 13 bp, Homo sapiens
gcctgggccagag

SEQ ID NO: 2649183 - DNA, 20 bp, Homo sapiens
gcctgggctgttggcactca

SEQ ID NO: 2649184 - DNA, 17 bp, Homo sapiens
gcctggggcgggcccct

SEQ ID NO: 2649185 - DNA, 22 bp, Homo sapiens
gcctggggctcctttctccagc

SEQ ID NO: 2649186 - DNA, 21 bp, Homo sapiens
gcctgggggtgccaggaccag

SEQ ID NO: 2649187 - DNA, 23 bp, Homo sapiens
gcctgggtgacaaagtgagactc

SEQ ID NO: 2649188 - DNA, 17 bp, Homo sapiens
gcctgggtgctggctgc

SEQ ID NO: 2649189 - DNA, 20 bp, Homo sapiens
gcctggtatatccaaaagct

SEQ ID NO: 2649190 - DNA, 22 bp, Homo sapiens
gcctggtccatgatggagtcag

SEQ ID NO: 2649191 - DNA, 13 bp, Homo sapiens
gcctggtgcagtg

SEQ ID NO: 2649192 - DNA, 13 bp, Homo sapiens
gcctggtgctgct

SEQ ID NO: 2649193 - DNA, 20 bp, Homo sapiens
gcctggtggaaggaggcgca

SEQ ID NO: 2649194 - DNA, 14 bp, Homo sapiens
gcctggtggcagct

SEQ ID NO: 2649195 - DNA, 15 bp, Homo sapiens
gcctggtggcagctg

SEQ ID NO: 2649196 - DNA, 19 bp, Homo sapiens
gcctggtggcagctgcggt

SEQ ID NO: 2649197 - DNA, 13 bp, Homo sapiens
gcctggtgggcct

SEQ ID NO: 2649198 - DNA, 15 bp, Homo sapiens
gcctgtaatcccagc

SEQ ID NO: 2649199 - DNA, 14 bp, Homo sapiens
gcctgtagcagtga

SEQ ID NO: 2649200 - DNA, 19 bp, Homo sapiens
gcctgtagtcccagccact

SEQ ID NO: 2649201 - DNA, 14 bp, Homo sapiens
gcctgtagttagga

SEQ ID NO: 2649202 - DNA, 22 bp, Homo sapiens
gcctgtagttaggaaataaaac

SEQ ID NO: 2649203 - DNA, 23 bp, Homo sapiens
gcctgtagttaggaaataaaacc

SEQ ID NO: 2649204 - DNA, 13 bp, Homo sapiens
gcctgtcctgggc

SEQ ID NO: 2649205 - DNA, 12 bp, Homo sapiens
gcctgtctgtct

SEQ ID NO: 2649206 - DNA, 19 bp, Homo sapiens
gcctgtgccacccaccagg

SEQ ID NO: 2649207 - DNA, 15 bp, Homo sapiens
gcctgtgctgcccgt

SEQ ID NO: 2649208 - DNA, 20 bp, Homo sapiens
gcctgtgtcccatgacccac

SEQ ID NO: 2649209 - DNA, 21 bp, Homo sapiens
gcctgtgtgacatcagtggca

SEQ ID NO: 2649210 - DNA, 19 bp, Homo sapiens
gcctgttataactctgcac

SEQ ID NO: 2649211 - DNA, 14 bp, Homo sapiens
gcctgttcagctcc

SEQ ID NO: 2649212 - DNA, 15 bp, Homo sapiens
gcctgttcagctcca

SEQ ID NO: 2649213 - DNA, 16 bp, Homo sapiens
gcctgttcagctccag

SEQ ID NO: 2649214 - DNA, 19 bp, Homo sapiens
gccttaccctcatgttctt

SEQ ID NO: 2649215 - DNA, 19 bp, Homo sapiens
gccttagaagtcacacagt

SEQ ID NO: 2649216 - DNA, 20 bp, Homo sapiens
gccttagaagtcacacagta

SEQ ID NO: 2649217 - DNA, 17 bp, Homo sapiens
gccttagcatgtttgct

SEQ ID NO: 2649218 - DNA, 15 bp, Homo sapiens
gccttagtctcagtt

SEQ ID NO: 2649219 - DNA, 18 bp, Homo sapiens
gccttagtctcagtttgt

SEQ ID NO: 2649220 - DNA, 13 bp, Homo sapiens
gccttatcaagtg

SEQ ID NO: 2649221 - DNA, 14 bp, Homo sapiens
gccttatcaagtgt

SEQ ID NO: 2649222 - DNA, 15 bp, Homo sapiens
gccttcaataaatgg

SEQ ID NO: 2649223 - DNA, 19 bp, Homo sapiens
gccttccacgctgtctcca

SEQ ID NO: 2649224 - DNA, 18 bp, Homo sapiens
gccttccagcaccctgca

SEQ ID NO: 2649225 - DNA, 20 bp, Homo sapiens
gccttccatgtcggcctcta

SEQ ID NO: 2649226 - DNA, 23 bp, Homo sapiens
gccttccccctcccagggccagg

SEQ ID NO: 2649227 - DNA, 16 bp, Homo sapiens
gccttccccttgccca

SEQ ID NO: 2649228 - DNA, 11 bp, Homo sapiens
gccttccttgc

SEQ ID NO: 2649229 - DNA, 19 bp, Homo sapiens
gccttcggacaactcagtc

SEQ ID NO: 2649230 - DNA, 15 bp, Homo sapiens
gccttctctgaagga

SEQ ID NO: 2649231 - DNA, 19 bp, Homo sapiens
gccttctgaggacattcca

SEQ ID NO: 2649232 - DNA, 20 bp, Homo sapiens
gccttcttctttttgctgtt

SEQ ID NO: 2649233 - DNA, 15 bp, Homo sapiens
gccttctttgcttgc

SEQ ID NO: 2649234 - DNA, 18 bp, Homo sapiens
gccttctttgcttgcctc

SEQ ID NO: 2649235 - DNA, 23 bp, Homo sapiens
gccttgaactttgacctctgcag

SEQ ID NO: 2649236 - DNA, 21 bp, Homo sapiens
gccttgaatatcccctcccag

SEQ ID NO: 2649237 - DNA, 19 bp, Homo sapiens
gccttgaccattctccacc

SEQ ID NO: 2649238 - DNA, 21 bp, Homo sapiens
gccttgcagcactcacacagg

SEQ ID NO: 2649239 - DNA, 22 bp, Homo sapiens
gccttgcggtatccgcccccaa

SEQ ID NO: 2649240 - DNA, 19 bp, Homo sapiens
gccttggaagttgcatggc

SEQ ID NO: 2649241 - DNA, 20 bp, Homo sapiens
gccttggagggtcccaagct

SEQ ID NO: 2649242 - DNA, 20 bp, Homo sapiens
gccttggcctcccctgctga

SEQ ID NO: 2649243 - DNA, 16 bp, Homo sapiens
gccttgggctgctcct

SEQ ID NO: 2649244 - DNA, 20 bp, Homo sapiens
gccttgtaattctaaatgaa

SEQ ID NO: 2649245 - DNA, 17 bp, Homo sapiens
gccttgtcccagaggct

SEQ ID NO: 2649246 - DNA, 18 bp, Homo sapiens
gccttgtcccctgcctgt

SEQ ID NO: 2649247 - DNA, 22 bp, Homo sapiens
gcctttccataaggaatgtagc

SEQ ID NO: 2649248 - DNA, 22 bp, Homo sapiens
gcctttctcccaggccaggctc

SEQ ID NO: 2649249 - DNA, 14 bp, Homo sapiens
gcctttgagacagt

SEQ ID NO: 2649250 - DNA, 19 bp, Homo sapiens
gcctttgagacagtttctt

SEQ ID NO: 2649251 - DNA, 18 bp, Homo sapiens
gcctttgagcccacaaag

SEQ ID NO: 2649252 - DNA, 16 bp, Homo sapiens
gcctttggcagagttc

SEQ ID NO: 2649253 - DNA, 20 bp, Homo sapiens
gccttttccctctttggctc

SEQ ID NO: 2649254 - DNA, 15 bp, Homo sapiens
gccttttgcacccct

SEQ ID NO: 2649255 - DNA, 16 bp, Homo sapiens
gccttttgcacccctc

SEQ ID NO: 2649256 - DNA, 15 bp, Homo sapiens
gcgaaccaatatttg

SEQ ID NO: 2649257 - DNA, 16 bp, Homo sapiens
gcgaaggggccctggt

SEQ ID NO: 2649258 - DNA, 19 bp, Homo sapiens
gcgacagagcgagagtctg

SEQ ID NO: 2649259 - DNA, 12 bp, Homo sapiens
gcgacagtgaga

SEQ ID NO: 2649260 - DNA, 15 bp, Homo sapiens
gcgaccacccctgcc

SEQ ID NO: 2649261 - DNA, 17 bp, Homo sapiens
gcgaccccgtcacagcc

SEQ ID NO: 2649262 - DNA, 14 bp, Homo sapiens
gcgaccgccccctc

SEQ ID NO: 2649263 - DNA, 18 bp, Homo sapiens
gcgagactccgtctcaaa

SEQ ID NO: 2649264 - DNA, 16 bp, Homo sapiens
gcgagaggcagagaaa

SEQ ID NO: 2649265 - DNA, 16 bp, Homo sapiens
gcgagagtctgtctca

SEQ ID NO: 2649266 - DNA, 21 bp, Homo sapiens
gcgagctatgatcgcgccact

SEQ ID NO: 2649267 - DNA, 15 bp, Homo sapiens
gcgaggaggctccag

SEQ ID NO: 2649268 - DNA, 16 bp, Homo sapiens
gcgaggaggctccaga

SEQ ID NO: 2649269 - DNA, 18 bp, Homo sapiens
gcgaggaggctccagagg

SEQ ID NO: 2649270 - DNA, 14 bp, Homo sapiens
gcgaggggagggtg

SEQ ID NO: 2649271 - DNA, 16 bp, Homo sapiens
gcgatccacctgtctc

SEQ ID NO: 2649272 - DNA, 22 bp, Homo sapiens
gcgatctgggttcactgcaacc

SEQ ID NO: 2649273 - DNA, 13 bp, Homo sapiens
gcgattcttctgc

SEQ ID NO: 2649274 - DNA, 17 bp, Homo sapiens
gcgcacaaggctgacca

SEQ ID NO: 2649275 - DNA, 17 bp, Homo sapiens
gcgcacctgccccctgg

SEQ ID NO: 2649276 - DNA, 19 bp, Homo sapiens
gcgcacctgccccctggtg

SEQ ID NO: 2649277 - DNA, 21 bp, Homo sapiens
gcgcagcatattcaggaagct

SEQ ID NO: 2649278 - DNA, 21 bp, Homo sapiens
gcgccaagcaacctgggtcca

SEQ ID NO: 2649279 - DNA, 21 bp, Homo sapiens
gcgccactacactccagcctg

SEQ ID NO: 2649280 - DNA, 24 bp, Homo sapiens
gcgccactacactccagcctgagc

SEQ ID NO: 2649281 - DNA, 17 bp, Homo sapiens
gcgcccagtccttccac

SEQ ID NO: 2649282 - DNA, 15 bp, Homo sapiens
gcgcccgctgggctg

SEQ ID NO: 2649283 - DNA, 17 bp, Homo sapiens
gcgccggcgggcgggcc

SEQ ID NO: 2649284 - DNA, 15 bp, Homo sapiens
gcgcctacaggagtg

SEQ ID NO: 2649285 - DNA, 18 bp, Homo sapiens
gcgcctacaggagtgagc

SEQ ID NO: 2649286 - DNA, 21 bp, Homo sapiens
gcgcctacaggagtgagcact

SEQ ID NO: 2649287 - DNA, 16 bp, Homo sapiens
gcgcggccagccccgg

SEQ ID NO: 2649288 - DNA, 21 bp, Homo sapiens
gcgcggccagccccggccctg

SEQ ID NO: 2649289 - DNA, 23 bp, Homo sapiens
gcgcggccagccccggccctggg

SEQ ID NO: 2649290 - DNA, 19 bp, Homo sapiens
gctgcaccggctggcctgg

SEQ ID NO: 2649291 - DNA, 19 bp, Homo sapiens
gctgcacctgccagcctgg

SEQ ID NO: 2649292 - DNA, 16 bp, Homo sapiens
gctgcagaaggccaag

SEQ ID NO: 2649293 - DNA, 17 bp, Homo sapiens
gctgcagaaggccaaga

SEQ ID NO: 2649294 - DNA, 13 bp, Homo sapiens
gctgcagagccac

SEQ ID NO: 2649295 - DNA, 18 bp, Homo sapiens
gctgcagcagaggcactg

SEQ ID NO: 2649296 - DNA, 22 bp, Homo sapiens
gctgcagcatgttgctgaggag

SEQ ID NO: 2649297 - DNA, 22 bp, Homo sapiens
gctgcatctgggattcccacca

SEQ ID NO: 2649298 - DNA, 18 bp, Homo sapiens
gctgcatgcctggtcttt

SEQ ID NO: 2649299 - DNA, 17 bp, Homo sapiens
gctgcatttaaaagata

SEQ ID NO: 2649300 - DNA, 17 bp, Homo sapiens
gctgccaaattttggcc

SEQ ID NO: 2649301 - DNA, 16 bp, Homo sapiens
gctgccaaggccagag

SEQ ID NO: 2649302 - DNA, 17 bp, Homo sapiens
gctgccagctctgtatc

SEQ ID NO: 2649303 - DNA, 13 bp, Homo sapiens
gctgccatccagg

SEQ ID NO: 2649304 - DNA, 13 bp, Homo sapiens
gctgccatgtgaa

SEQ ID NO: 2649305 - DNA, 21 bp, Homo sapiens
gctgccatgtgaagagggaga

SEQ ID NO: 2649306 - DNA, 19 bp, Homo sapiens
gctgcccaggggagccctc

SEQ ID NO: 2649307 - DNA, 16 bp, Homo sapiens
gctgccccaacctgct

SEQ ID NO: 2649308 - DNA, 17 bp, Homo sapiens
gctgccccaacctgctg

SEQ ID NO: 2649309 - DNA, 19 bp, Homo sapiens
gctgcccccggccccctgg

SEQ ID NO: 2649310 - DNA, 16 bp, Homo sapiens
gctgccctccttgtcc

SEQ ID NO: 2649311 - DNA, 20 bp, Homo sapiens
gctgccctccttgtccaccc

SEQ ID NO: 2649312 - DNA, 14 bp, Homo sapiens
gctgccctgcccac

SEQ ID NO: 2649313 - DNA, 24 bp, Homo sapiens
gctgccctgcccacctggcctctg

SEQ ID NO: 2649314 - DNA, 15 bp, Homo sapiens
gctgccctggccctg

SEQ ID NO: 2649315 - DNA, 17 bp, Homo sapiens
gctgccctggccctgag

SEQ ID NO: 2649316 - DNA, 15 bp, Homo sapiens
gctgcctccccaacc

SEQ ID NO: 2649317 - DNA, 17 bp, Homo sapiens
gctgcctccccaaccct

SEQ ID NO: 2649318 - DNA, 20 bp, Homo sapiens
gctgcctccccaaccctgcc

SEQ ID NO: 2649319 - DNA, 23 bp, Homo sapiens
gctgcctccccaaccctgcccct

SEQ ID NO: 2649320 - DNA, 18 bp, Homo sapiens
gctgcctctcggtggcca

SEQ ID NO: 2649321 - DNA, 11 bp, Homo sapiens
gctgcctgcct

SEQ ID NO: 2649322 - DNA, 15 bp, Homo sapiens
gctgcctgcctgtct

SEQ ID NO: 2649323 - DNA, 13 bp, Homo sapiens
gctgcctgggatc

SEQ ID NO: 2649324 - DNA, 20 bp, Homo sapiens
gctgcctgggatccctcatc

SEQ ID NO: 2649325 - DNA, 21 bp, Homo sapiens
gctgcctgggatccctcatcc

SEQ ID NO: 2649326 - DNA, 12 bp, Homo sapiens
gctgcctgggct

SEQ ID NO: 2649327 - DNA, 16 bp, Homo sapiens
gctgcctgggctgttg

SEQ ID NO: 2649328 - DNA, 19 bp, Homo sapiens
gctgcctgggctgttggca

SEQ ID NO: 2649329 - DNA, 22 bp, Homo sapiens
gctgcctgggctgttggcactc

SEQ ID NO: 2649330 - DNA, 17 bp, Homo sapiens
gctgcctgttcagctcc

SEQ ID NO: 2649331 - DNA, 19 bp, Homo sapiens
gctgcctgttcagctccag

SEQ ID NO: 2649332 - DNA, 22 bp, Homo sapiens
gctgcctgttcagctccagctc

SEQ ID NO: 2649333 - DNA, 19 bp, Homo sapiens
gctgcgcccttaccttccc

SEQ ID NO: 2649334 - DNA, 16 bp, Homo sapiens
gctgcggtccacccag

SEQ ID NO: 2649335 - DNA, 17 bp, Homo sapiens
gctgcggtccacccagg

SEQ ID NO: 2649336 - DNA, 22 bp, Homo sapiens
gctgcggtccacccaggagccc

SEQ ID NO: 2649337 - DNA, 16 bp, Homo sapiens
gctgctacaaagaaga

SEQ ID NO: 2649338 - DNA, 19 bp, Homo sapiens
gctgctacaaagaagacat

SEQ ID NO: 2649339 - DNA, 16 bp, Homo sapiens
gctgctagagccagca

SEQ ID NO: 2649340 - DNA, 23 bp, Homo sapiens
gctgctagcacttggagccaagg

SEQ ID NO: 2649341 - DNA, 12 bp, Homo sapiens
gctgctgacagt

SEQ ID NO: 2649342 - DNA, 12 bp, Homo sapiens
gctgctgcccag

SEQ ID NO: 2649343 - DNA, 13 bp, Homo sapiens
gctgctgccctgc

SEQ ID NO: 2649344 - DNA, 16 bp, Homo sapiens
gctgctggcgcctctg

SEQ ID NO: 2649345 - DNA, 18 bp, Homo sapiens
gctgctgtccctccccct

SEQ ID NO: 2649346 - DNA, 22 bp, Homo sapiens
gctgctgtccctcccccttgtc

SEQ ID NO: 2649347 - DNA, 18 bp, Homo sapiens
gctgcttagacataacaa

SEQ ID NO: 2649348 - DNA, 14 bp, Homo sapiens
gctgcttccctctg

SEQ ID NO: 2649349 - DNA, 22 bp, Homo sapiens
gctgcttgtgtccctcctggga

SEQ ID NO: 2649350 - DNA, 16 bp, Homo sapiens
gctgctttcccctgtg

SEQ ID NO: 2649351 - DNA, 17 bp, Homo sapiens
gctgctttcccctgtgg

SEQ ID NO: 2649352 - DNA, 19 bp, Homo sapiens
gctgctttcccctgtgggg

SEQ ID NO: 2649353 - DNA, 20 bp, Homo sapiens
gctgctttcccctgtgggga

SEQ ID NO: 2649354 - DNA, 21 bp, Homo sapiens
gctgctttcccctgtggggat

SEQ ID NO: 2649355 - DNA, 20 bp, Homo sapiens
gctggaaacagactcgattc

SEQ ID NO: 2649356 - DNA, 16 bp, Homo sapiens
gctggaccttgaactg

SEQ ID NO: 2649357 - DNA, 18 bp, Homo sapiens
gctggaccttgaactggg

SEQ ID NO: 2649358 - DNA, 15 bp, Homo sapiens
gctggagaccatgca

SEQ ID NO: 2649359 - DNA, 22 bp, Homo sapiens
gctggagaccatgcagagcgcc

SEQ ID NO: 2649360 - DNA, 13 bp, Homo sapiens
gctggagactcct

SEQ ID NO: 2649361 - DNA, 12 bp, Homo sapiens
gctggagaggtt

SEQ ID NO: 2649362 - DNA, 15 bp, Homo sapiens
gctggagatgtttta

SEQ ID NO: 2649363 - DNA, 15 bp, Homo sapiens
gctggagccactaac

SEQ ID NO: 2649364 - DNA, 16 bp, Homo sapiens
gctggagccactaact

SEQ ID NO: 2649365 - DNA, 22 bp, Homo sapiens
gctggagcccagggagcggaaa

SEQ ID NO: 2649366 - DNA, 21 bp, Homo sapiens
gctggagcctagaacaggcct

SEQ ID NO: 2649367 - DNA, 14 bp, Homo sapiens
gctggagctctgcc

SEQ ID NO: 2649368 - DNA, 17 bp, Homo sapiens
gctggagctctgcccat

SEQ ID NO: 2649369 - DNA, 18 bp, Homo sapiens
gctggagtgcagtgagcc

SEQ ID NO: 2649370 - DNA, 20 bp, Homo sapiens
gctggagttcagtggtgtga

SEQ ID NO: 2649371 - DNA, 19 bp, Homo sapiens
gctggatcacagctgcttt

SEQ ID NO: 2649372 - DNA, 13 bp, Homo sapiens
gctggatctgtga

SEQ ID NO: 2649373 - DNA, 22 bp, Homo sapiens
gctggatgtctgccaatttttg

SEQ ID NO: 2649374 - DNA, 16 bp, Homo sapiens
gctggattacaggcat

SEQ ID NO: 2649375 - DNA, 18 bp, Homo sapiens
gctggcagctctccagtc

SEQ ID NO: 2649376 - DNA, 16 bp, Homo sapiens
gctggcatttgcacct

SEQ ID NO: 2649377 - DNA, 13 bp, Homo sapiens
gctggcccagccg

SEQ ID NO: 2649378 - DNA, 22 bp, Homo sapiens
gctggccccgccgcctggtact

SEQ ID NO: 2649379 - DNA, 11 bp, Homo sapiens
gctggcccctc

SEQ ID NO: 2649380 - DNA, 19 bp, Homo sapiens
gctggcccctcacctgggc

SEQ ID NO: 2649381 - DNA, 19 bp, Homo sapiens
gctggcccgtgacagactc

SEQ ID NO: 2649382 - DNA, 20 bp, Homo sapiens
gctggccgagggtcctggct

SEQ ID NO: 2649383 - DNA, 20 bp, Homo sapiens
gctggccgcctcaccccctc

SEQ ID NO: 2649384 - DNA, 12 bp, Homo sapiens
gctggcctggcc

SEQ ID NO: 2649385 - DNA, 14 bp, Homo sapiens
gctggcctggcccc

SEQ ID NO: 2649386 - DNA, 17 bp, Homo sapiens
gctggcctggccggcaa

SEQ ID NO: 2649387 - DNA, 12 bp, Homo sapiens
gctggccttcct

SEQ ID NO: 2649388 - DNA, 14 bp, Homo sapiens
gctggcgcagccaa

SEQ ID NO: 2649389 - DNA, 13 bp, Homo sapiens
gctggcgcctctg

SEQ ID NO: 2649390 - DNA, 15 bp, Homo sapiens
gctggcgcctctgca

SEQ ID NO: 2649391 - DNA, 18 bp, Homo sapiens
gctggcgtgcagtggtgc

SEQ ID NO: 2649392 - DNA, 20 bp, Homo sapiens
gctggcgtgcagtggtgcga

SEQ ID NO: 2649393 - DNA, 14 bp, Homo sapiens
gctggctgcagtga

SEQ ID NO: 2649394 - DNA, 15 bp, Homo sapiens
gctggctgggcatgg

SEQ ID NO: 2649395 - DNA, 16 bp, Homo sapiens
gctggctgggcatgga

SEQ ID NO: 2649396 - DNA, 16 bp, Homo sapiens
gctggctgttggctgg

SEQ ID NO: 2649397 - DNA, 17 bp, Homo sapiens
gctggctgttggctggg

SEQ ID NO: 2649398 - DNA, 18 bp, Homo sapiens
gctgggaactcacctggg

SEQ ID NO: 2649399 - DNA, 14 bp, Homo sapiens
gctgggactgagcc

SEQ ID NO: 2649400 - DNA, 17 bp, Homo sapiens
gctgggagagccttcca

SEQ ID NO: 2649401 - DNA, 22 bp, Homo sapiens
gctgggagagccttccaggggt

SEQ ID NO: 2649402 - DNA, 15 bp, Homo sapiens
gctgggagctctgca

SEQ ID NO: 2649403 - DNA, 16 bp, Homo sapiens
gctgggagctctgcag

SEQ ID NO: 2649404 - DNA, 16 bp, Homo sapiens
gctgggaggcaagagg

SEQ ID NO: 2649405 - DNA, 16 bp, Homo sapiens
gctgggattacaggtg

SEQ ID NO: 2649406 - DNA, 19 bp, Homo sapiens
gctgggcagaaggccaaga

SEQ ID NO: 2649407 - DNA, 13 bp, Homo sapiens
gctgggcagctac

SEQ ID NO: 2649408 - DNA, 14 bp, Homo sapiens
gctgggccccagcc

SEQ ID NO: 2649409 - DNA, 12 bp, Homo sapiens
gctgggctccct

SEQ ID NO: 2649410 - DNA, 21 bp, Homo sapiens
gctgggctcccttcccacctc

SEQ ID NO: 2649411 - DNA, 15 bp, Homo sapiens
gctgggctctgccac

SEQ ID NO: 2649412 - DNA, 14 bp, Homo sapiens
gctgggctgagccc

SEQ ID NO: 2649413 - DNA, 18 bp, Homo sapiens
gctgggcttcagtggcag

SEQ ID NO: 2649414 - DNA, 20 bp, Homo sapiens
gctgggcttcagtggcagct

SEQ ID NO: 2649415 - DNA, 23 bp, Homo sapiens
gctggggacctggtaccctcctg

SEQ ID NO: 2649416 - DNA, 23 bp, Homo sapiens
gctggggacggggggccccagtc

SEQ ID NO: 2649417 - DNA, 14 bp, Homo sapiens
gctggggatgtctc

SEQ ID NO: 2649418 - DNA, 23 bp, Homo sapiens
gctgggggaagaagctctctcct

SEQ ID NO: 2649419 - DNA, 13 bp, Homo sapiens
gctgggggcagga

SEQ ID NO: 2649420 - DNA, 20 bp, Homo sapiens
gctgggggcaggagggccct

SEQ ID NO: 2649421 - DNA, 23 bp, Homo sapiens
gctgggggcaggagggccctacc

SEQ ID NO: 2649422 - DNA, 23 bp, Homo sapiens
gctgggggccatgagctccagac

SEQ ID NO: 2649423 - DNA, 19 bp, Homo sapiens
gctgggggcctcagtgcca

SEQ ID NO: 2649424 - DNA, 21 bp, Homo sapiens
gctgggtaaactgtggatgat

SEQ ID NO: 2649425 - DNA, 15 bp, Homo sapiens
gctgggtggcactgc

SEQ ID NO: 2649426 - DNA, 17 bp, Homo sapiens
gctgggttctacccagg

SEQ ID NO: 2649427 - DNA, 18 bp, Homo sapiens
gctgggttctacccaggt

SEQ ID NO: 2649428 - DNA, 20 bp, Homo sapiens
gctgggttctacccaggtgc

SEQ ID NO: 2649429 - DNA, 21 bp, Homo sapiens
gctgggttctacccaggtgct

SEQ ID NO: 2649430 - DNA, 14 bp, Homo sapiens
gctgggttctgcac

SEQ ID NO: 2649431 - DNA, 21 bp, Homo sapiens
gctgggttggagggtgtccca

SEQ ID NO: 2649432 - DNA, 14 bp, Homo sapiens
gctggtaaactatt

SEQ ID NO: 2649433 - DNA, 14 bp, Homo sapiens
gctggtagctcagg

SEQ ID NO: 2649434 - DNA, 15 bp, Homo sapiens
gctggtagctcaggt

SEQ ID NO: 2649435 - DNA, 22 bp, Homo sapiens
ggaagagaggagttcaatgatc

SEQ ID NO: 2649436 - DNA, 18 bp, Homo sapiens
ggaagataggctctgcac

SEQ ID NO: 2649437 - DNA, 20 bp, Homo sapiens
ggaagcagtgccttccataa

SEQ ID NO: 2649438 - DNA, 21 bp, Homo sapiens
ggaagcagtgccttccataat

SEQ ID NO: 2649439 - DNA, 18 bp, Homo sapiens
ggaagcattcagagagca

SEQ ID NO: 2649440 - DNA, 16 bp, Homo sapiens
ggaagccagctttccc

SEQ ID NO: 2649441 - DNA, 15 bp, Homo sapiens
ggaagccgctggggc

SEQ ID NO: 2649442 - DNA, 14 bp, Homo sapiens
ggaagcctgcagtc

SEQ ID NO: 2649443 - DNA, 21 bp, Homo sapiens
ggaagcgtgaaggccgagaag

SEQ ID NO: 2649444 - DNA, 22 bp, Homo sapiens
ggaagcgtgaaggccgagaagc

SEQ ID NO: 2649445 - DNA, 23 bp, Homo sapiens
ggaagctacaggttacaacagat

SEQ ID NO: 2649446 - DNA, 16 bp, Homo sapiens
ggaagctcagggcctg

SEQ ID NO: 2649447 - DNA, 17 bp, Homo sapiens
ggaagctcagggcctgg

SEQ ID NO: 2649448 - DNA, 21 bp, Homo sapiens
ggaagctcagggcctggctca

SEQ ID NO: 2649449 - DNA, 23 bp, Homo sapiens
ggaagctcagggcctggctcagg

SEQ ID NO: 2649450 - DNA, 23 bp, Homo sapiens
ggaagctccactgtcaccctcca

SEQ ID NO: 2649451 - DNA, 18 bp, Homo sapiens
ggaagctctgaagtcaca

SEQ ID NO: 2649452 - DNA, 13 bp, Homo sapiens
ggaagctgaggcg

SEQ ID NO: 2649453 - DNA, 17 bp, Homo sapiens
ggaagctgccctgccca

SEQ ID NO: 2649454 - DNA, 15 bp, Homo sapiens
ggaagctgctccgtg

SEQ ID NO: 2649455 - DNA, 13 bp, Homo sapiens
ggaaggagggagg

SEQ ID NO: 2649456 - DNA, 13 bp, Homo sapiens
ggaaggattgtaa

SEQ ID NO: 2649457 - DNA, 16 bp, Homo sapiens
ggaaggcaggaagaga

SEQ ID NO: 2649458 - DNA, 17 bp, Homo sapiens
ggaaggctgagaggaga

SEQ ID NO: 2649459 - DNA, 17 bp, Homo sapiens
ggaaggctggctgggca

SEQ ID NO: 2649460 - DNA, 23 bp, Homo sapiens
ggaagggaccaaggcaaggcagg

SEQ ID NO: 2649461 - DNA, 15 bp, Homo sapiens
ggaagggcaggaagg

SEQ ID NO: 2649462 - DNA, 23 bp, Homo sapiens
ggaaggggagataagggtatctg

SEQ ID NO: 2649463 - DNA, 16 bp, Homo sapiens
ggaagggggtccaccc

SEQ ID NO: 2649464 - DNA, 19 bp, Homo sapiens
ggaaggtttggtgtgtgga

SEQ ID NO: 2649465 - DNA, 17 bp, Homo sapiens
ggaagtgacaaggcccc

SEQ ID NO: 2649466 - DNA, 20 bp, Homo sapiens
ggaagtgacggtttaatggg

SEQ ID NO: 2649467 - DNA, 14 bp, Homo sapiens
ggaagtgaggaagc

SEQ ID NO: 2649468 - DNA, 16 bp, Homo sapiens
ggaagtgtaacagctg

SEQ ID NO: 2649469 - DNA, 18 bp, Homo sapiens
ggaagtttcatatattgt

SEQ ID NO: 2649470 - DNA, 12 bp, Homo sapiens
ggaataaaatac

SEQ ID NO: 2649471 - DNA, 12 bp, Homo sapiens
ggaataaatatg

SEQ ID NO: 2649472 - DNA, 22 bp, Homo sapiens
ggaataaatatgcctctccttt

SEQ ID NO: 2649473 - DNA, 18 bp, Homo sapiens
ggaataacatgtaattaa

SEQ ID NO: 2649474 - DNA, 12 bp, Homo sapiens
ggaatacagtgt

SEQ ID NO: 2649475 - DNA, 16 bp, Homo sapiens
ggaatacctgtccccc

SEQ ID NO: 2649476 - DNA, 18 bp, Homo sapiens
ggaatagtatcctccagg

SEQ ID NO: 2649477 - DNA, 13 bp, Homo sapiens
ggaatatgagctt

SEQ ID NO: 2649478 - DNA, 16 bp, Homo sapiens
ggaatcaagagctgcc

SEQ ID NO: 2649479 - DNA, 12 bp, Homo sapiens
ggaatcaagatt

SEQ ID NO: 2649480 - DNA, 15 bp, Homo sapiens
ggaatcatgtcaggc

SEQ ID NO: 2649481 - DNA, 19 bp, Homo sapiens
ggaatcatgtcaggcctgt

SEQ ID NO: 2649482 - DNA, 16 bp, Homo sapiens
ggaatccactcccagg

SEQ ID NO: 2649483 - DNA, 21 bp, Homo sapiens
ggaatcgaggaaccagagcca

SEQ ID NO: 2649484 - DNA, 12 bp, Homo sapiens
ggaatgaagctt

SEQ ID NO: 2649485 - DNA, 15 bp, Homo sapiens
ggaatgaagcttgtg

SEQ ID NO: 2649486 - DNA, 14 bp, Homo sapiens
ggaatgcctgagtg

SEQ ID NO: 2649487 - DNA, 23 bp, Homo sapiens
ggaatgctgcccgctctgcagac

SEQ ID NO: 2649488 - DNA, 15 bp, Homo sapiens
ggaatggcacagccc

SEQ ID NO: 2649489 - DNA, 19 bp, Homo sapiens
ggaatgtttgggcagaagg

SEQ ID NO: 2649490 - DNA, 14 bp, Homo sapiens
ggaattaacctggt

SEQ ID NO: 2649491 - DNA, 22 bp, Homo sapiens
ggaattaagttatctttaaaat

SEQ ID NO: 2649492 - DNA, 19 bp, Homo sapiens
ggaattacatgtaaaacat

SEQ ID NO: 2649493 - DNA, 20 bp, Homo sapiens
ggaattcatctctctttaat

SEQ ID NO: 2649494 - DNA, 23 bp, Homo sapiens
ggacaaatcaagcttcagtttcc

SEQ ID NO: 2649495 - DNA, 15 bp, Homo sapiens
ggacaacgaggaagc

SEQ ID NO: 2649496 - DNA, 20 bp, Homo sapiens
ggacaagcagaggtggccag

SEQ ID NO: 2649497 - DNA, 20 bp, Homo sapiens
ggacaagccaacttgtaaat

SEQ ID NO: 2649498 - DNA, 22 bp, Homo sapiens
ggacaaggatgatctaggaaga

SEQ ID NO: 2649499 - DNA, 18 bp, Homo sapiens
ggacaatcagtcccctcc

SEQ ID NO: 2649500 - DNA, 22 bp, Homo sapiens
ggacaatcagtcccctcccatc

SEQ ID NO: 2649501 - DNA, 21 bp, Homo sapiens
ggacacacaaggtgcaaatca

SEQ ID NO: 2649502 - DNA, 16 bp, Homo sapiens
ggacacagatgaaaca

SEQ ID NO: 2649503 - DNA, 15 bp, Homo sapiens
ggacacagctcttct

SEQ ID NO: 2649504 - DNA, 18 bp, Homo sapiens
ggacacagctcttctcca

SEQ ID NO: 2649505 - DNA, 21 bp, Homo sapiens
ggacacattcaaccctggaga

SEQ ID NO: 2649506 - DNA, 13 bp, Homo sapiens
ggacaccagccag

SEQ ID NO: 2649507 - DNA, 16 bp, Homo sapiens
ggacaccagccaggct

SEQ ID NO: 2649508 - DNA, 15 bp, Homo sapiens
ggacaccccctcgct

SEQ ID NO: 2649509 - DNA, 19 bp, Homo sapiens
ggacaccccttatccagga

SEQ ID NO: 2649510 - DNA, 21 bp, Homo sapiens
ggacaccccttatccaggact

SEQ ID NO: 2649511 - DNA, 13 bp, Homo sapiens
ggacaccctgtga

SEQ ID NO: 2649512 - DNA, 15 bp, Homo sapiens
ggacaccgggccagt

SEQ ID NO: 2649513 - DNA, 22 bp, Homo sapiens
ggacacggggcagtggcaacct

SEQ ID NO: 2649514 - DNA, 17 bp, Homo sapiens
ggacactaaccacgctg

SEQ ID NO: 2649515 - DNA, 22 bp, Homo sapiens
ggacactcaaaagctgggcagg

SEQ ID NO: 2649516 - DNA, 14 bp, Homo sapiens
ggacactcagacct

SEQ ID NO: 2649517 - DNA, 14 bp, Homo sapiens
ggacactccagtgc

SEQ ID NO: 2649518 - DNA, 18 bp, Homo sapiens
ggacactccagtgccagc

SEQ ID NO: 2649519 - DNA, 21 bp, Homo sapiens
ggacactccagtgccagcaat

SEQ ID NO: 2649520 - DNA, 18 bp, Homo sapiens
ggacacttaacagatgca

SEQ ID NO: 2649521 - DNA, 14 bp, Homo sapiens
ggacagaggcctgc

SEQ ID NO: 2649522 - DNA, 15 bp, Homo sapiens
ggacagaggcctgcc

SEQ ID NO: 2649523 - DNA, 15 bp, Homo sapiens
ggacagatcaatggc

SEQ ID NO: 2649524 - DNA, 21 bp, Homo sapiens
ggacagcagaagggggagacc

SEQ ID NO: 2649525 - DNA, 20 bp, Homo sapiens
ggacagccacggccaggcca

SEQ ID NO: 2649526 - DNA, 21 bp, Homo sapiens
ggacagccacggccaggccag

SEQ ID NO: 2649527 - DNA, 11 bp, Homo sapiens
ggacagctcct

SEQ ID NO: 2649528 - DNA, 19 bp, Homo sapiens
ggacagctccttctgtcct

SEQ ID NO: 2649529 - DNA, 16 bp, Homo sapiens
ggacagggctggccca

SEQ ID NO: 2649530 - DNA, 23 bp, Homo sapiens
ggacagggctggcccagccctgc

SEQ ID NO: 2649531 - DNA, 20 bp, Homo sapiens
ggacaggtgtgccgacagaa

SEQ ID NO: 2649532 - DNA, 18 bp, Homo sapiens
ggacagtatttgtgggga

SEQ ID NO: 2649533 - DNA, 15 bp, Homo sapiens
ggacagtcctgggag

SEQ ID NO: 2649534 - DNA, 16 bp, Homo sapiens
ggacagtcctgggaga

SEQ ID NO: 2649535 - DNA, 17 bp, Homo sapiens
ggacagtgcttcagcct

SEQ ID NO: 2649536 - DNA, 18 bp, Homo sapiens
ggacagtgcttcagcctg

SEQ ID NO: 2649537 - DNA, 20 bp, Homo sapiens
ggacagtgcttcagcctgag

SEQ ID NO: 2649538 - DNA, 21 bp, Homo sapiens
ggacagtgcttcagcctgagg

SEQ ID NO: 2649539 - DNA, 22 bp, Homo sapiens
ggacagttgcttttcagcatgg

SEQ ID NO: 2649540 - DNA, 22 bp, Homo sapiens
ggacatagagagggagaagaag

SEQ ID NO: 2649541 - DNA, 16 bp, Homo sapiens
ggacatgctgaagcca

SEQ ID NO: 2649542 - DNA, 19 bp, Homo sapiens
ggacatgctgaagccaaag

SEQ ID NO: 2649543 - DNA, 16 bp, Homo sapiens
ggacattccaagacag

SEQ ID NO: 2649544 - DNA, 20 bp, Homo sapiens
ggacattgcggacagccacg

SEQ ID NO: 2649545 - DNA, 11 bp, Homo sapiens
ggaccaaggca

SEQ ID NO: 2649546 - DNA, 17 bp, Homo sapiens
ggaccaaggcaaggcag

SEQ ID NO: 2649547 - DNA, 23 bp, Homo sapiens
ggaccaaggcaaggcaggtgcct

SEQ ID NO: 2649548 - DNA, 22 bp, Homo sapiens
ggaccacaaaaatgaaagcatg

SEQ ID NO: 2649549 - DNA, 14 bp, Homo sapiens
ggaccacattttat

SEQ ID NO: 2649550 - DNA, 17 bp, Homo sapiens
ggaccagcctgttggac

SEQ ID NO: 2649551 - DNA, 15 bp, Homo sapiens
ggaccagcttttccc

SEQ ID NO: 2649552 - DNA, 17 bp, Homo sapiens
ggaccagcttttcccaa

SEQ ID NO: 2649553 - DNA, 11 bp, Homo sapiens
ggaccaggact

SEQ ID NO: 2649554 - DNA, 15 bp, Homo sapiens
ggaccaggactccct

SEQ ID NO: 2649555 - DNA, 17 bp, Homo sapiens
ggaccaggactccctcc

SEQ ID NO: 2649556 - DNA, 13 bp, Homo sapiens
ggaccaggcaatg

SEQ ID NO: 2649557 - DNA, 17 bp, Homo sapiens
ggaccagggcagggcca

SEQ ID NO: 2649558 - DNA, 14 bp, Homo sapiens
ggaccatcctattt

SEQ ID NO: 2649559 - DNA, 16 bp, Homo sapiens
ggacccaatgcacaca

SEQ ID NO: 2649560 - DNA, 10 bp, Homo sapiens
ggacccagac

SEQ ID NO: 2649561 - DNA, 13 bp, Homo sapiens
ggacccagaccca

SEQ ID NO: 2649562 - DNA, 19 bp, Homo sapiens
ggacccatcacgcctgtgc

SEQ ID NO: 2649563 - DNA, 13 bp, Homo sapiens
ggaccccagctgg

SEQ ID NO: 2649564 - DNA, 14 bp, Homo sapiens
ggaccccagctggg

SEQ ID NO: 2649565 - DNA, 20 bp, Homo sapiens
ggaccccagctgggaggcaa

SEQ ID NO: 2649566 - DNA, 18 bp, Homo sapiens
ggaccccgagcctggctc

SEQ ID NO: 2649567 - DNA, 16 bp, Homo sapiens
ggacccctcctccctt

SEQ ID NO: 2649568 - DNA, 19 bp, Homo sapiens
ggacccgctctggaccaac

SEQ ID NO: 2649569 - DNA, 15 bp, Homo sapiens
ggaccctgaggccca

SEQ ID NO: 2649570 - DNA, 17 bp, Homo sapiens
ggaccgccagatggggc

SEQ ID NO: 2649571 - DNA, 23 bp, Homo sapiens
ggaccgggccgctagatgggcat

SEQ ID NO: 2649572 - DNA, 17 bp, Homo sapiens
ggacctatgtcctaagg

SEQ ID NO: 2649573 - DNA, 19 bp, Homo sapiens
ggacctcagagtccaggcc

SEQ ID NO: 2649574 - DNA, 14 bp, Homo sapiens
ggacctcccctgag

SEQ ID NO: 2649575 - DNA, 12 bp, Homo sapiens
ggacctctccca

SEQ ID NO: 2649576 - DNA, 14 bp, Homo sapiens
ggacctctcccagg

SEQ ID NO: 2649577 - DNA, 17 bp, Homo sapiens
ggacctctgctctgagg

SEQ ID NO: 2649578 - DNA, 15 bp, Homo sapiens
ggaccttatctgtgc

SEQ ID NO: 2649579 - DNA, 15 bp, Homo sapiens
ggaccttcctgccac

SEQ ID NO: 2649580 - DNA, 23 bp, Homo sapiens
ggcagtcgggggctggcctagga

SEQ ID NO: 2649581 - DNA, 19 bp, Homo sapiens
ggcagtctgaatttttaaa

SEQ ID NO: 2649582 - DNA, 16 bp, Homo sapiens
ggcagtgccagggcag

SEQ ID NO: 2649583 - DNA, 14 bp, Homo sapiens
ggcagtgggagctg

SEQ ID NO: 2649584 - DNA, 17 bp, Homo sapiens
ggcagtgggagctgcct

SEQ ID NO: 2649585 - DNA, 20 bp, Homo sapiens
ggcagtggtggttttctgtt

SEQ ID NO: 2649586 - DNA, 14 bp, Homo sapiens
ggcagttggccaga

SEQ ID NO: 2649587 - DNA, 15 bp, Homo sapiens
ggcatagcccagaca

SEQ ID NO: 2649588 - DNA, 19 bp, Homo sapiens
ggcatagcccagacacaga

SEQ ID NO: 2649589 - DNA, 21 bp, Homo sapiens
ggcatagcccagacacagaag

SEQ ID NO: 2649590 - DNA, 16 bp, Homo sapiens
ggcataggcctgggtg

SEQ ID NO: 2649591 - DNA, 17 bp, Homo sapiens
ggcataggcctgggtgc

SEQ ID NO: 2649592 - DNA, 16 bp, Homo sapiens
ggcatcacagggcaga

SEQ ID NO: 2649593 - DNA, 22 bp, Homo sapiens
ggcatcacagggcagagccggg

SEQ ID NO: 2649594 - DNA, 16 bp, Homo sapiens
ggcatcagctggcgtc

SEQ ID NO: 2649595 - DNA, 18 bp, Homo sapiens
ggcatcagtccctatgta

SEQ ID NO: 2649596 - DNA, 23 bp, Homo sapiens
ggcatcatgcatcttactgaagg

SEQ ID NO: 2649597 - DNA, 21 bp, Homo sapiens
ggcatcccagtggcctcaacc

SEQ ID NO: 2649598 - DNA, 12 bp, Homo sapiens
ggcatctccagg

SEQ ID NO: 2649599 - DNA, 15 bp, Homo sapiens
ggcatctccaggaag

SEQ ID NO: 2649600 - DNA, 21 bp, Homo sapiens
ggcatctcctgtgcatgggtg

SEQ ID NO: 2649601 - DNA, 15 bp, Homo sapiens
ggcatctgcaccctc

SEQ ID NO: 2649602 - DNA, 16 bp, Homo sapiens
ggcatctgcccctccc

SEQ ID NO: 2649603 - DNA, 19 bp, Homo sapiens
ggcatctgcccctccccca

SEQ ID NO: 2649604 - DNA, 19 bp, Homo sapiens
ggcatctttgccttgggct

SEQ ID NO: 2649605 - DNA, 14 bp, Homo sapiens
ggcatgaacatgta

SEQ ID NO: 2649606 - DNA, 18 bp, Homo sapiens
ggcatgaacatgtactgt

SEQ ID NO: 2649607 - DNA, 15 bp, Homo sapiens
ggcatgaagacagat

SEQ ID NO: 2649608 - DNA, 13 bp, Homo sapiens
ggcatgcctgtgt

SEQ ID NO: 2649609 - DNA, 12 bp, Homo sapiens
ggcatgctgggg

SEQ ID NO: 2649610 - DNA, 14 bp, Homo sapiens
ggcatgctggggca

SEQ ID NO: 2649611 - DNA, 16 bp, Homo sapiens
ggcatgctggggcaag

SEQ ID NO: 2649612 - DNA, 12 bp, Homo sapiens
ggcatggccctg

SEQ ID NO: 2649613 - DNA, 21 bp, Homo sapiens
ggcatgggaaagccacctctc

SEQ ID NO: 2649614 - DNA, 18 bp, Homo sapiens
ggcatggggtgggcctct

SEQ ID NO: 2649615 - DNA, 21 bp, Homo sapiens
ggcatgtattggcctggaggt

SEQ ID NO: 2649616 - DNA, 16 bp, Homo sapiens
ggcatgtggcctgtgg

SEQ ID NO: 2649617 - DNA, 20 bp, Homo sapiens
ggcatgttctctgaggacac

SEQ ID NO: 2649618 - DNA, 23 bp, Homo sapiens
ggcatgttctctgaggacactaa

SEQ ID NO: 2649619 - DNA, 15 bp, Homo sapiens
ggcattcctgcttat

SEQ ID NO: 2649620 - DNA, 12 bp, Homo sapiens
ggcattctctga

SEQ ID NO: 2649621 - DNA, 16 bp, Homo sapiens
ggcattgatggggaag

SEQ ID NO: 2649622 - DNA, 12 bp, Homo sapiens
ggcattgtggga

SEQ ID NO: 2649623 - DNA, 14 bp, Homo sapiens
ggcatttgctgaat

SEQ ID NO: 2649624 - DNA, 15 bp, Homo sapiens
ggcatttttatttta

SEQ ID NO: 2649625 - DNA, 15 bp, Homo sapiens
ggccaaacctctgtt

SEQ ID NO: 2649626 - DNA, 22 bp, Homo sapiens
ggccaaaggagggtcaggaagg

SEQ ID NO: 2649627 - DNA, 21 bp, Homo sapiens
ggccaaattatttgtgtaata

SEQ ID NO: 2649628 - DNA, 16 bp, Homo sapiens
ggccaacaaagctgtt

SEQ ID NO: 2649629 - DNA, 21 bp, Homo sapiens
ggccaacttgagggcccagag

SEQ ID NO: 2649630 - DNA, 22 bp, Homo sapiens
ggccaacttgagggcccagagc

SEQ ID NO: 2649631 - DNA, 13 bp, Homo sapiens
ggccaagaggctg

SEQ ID NO: 2649632 - DNA, 11 bp, Homo sapiens
ggccaaggact

SEQ ID NO: 2649633 - DNA, 13 bp, Homo sapiens
ggccaaggactgc

SEQ ID NO: 2649634 - DNA, 17 bp, Homo sapiens
ggccacaagacccttgt

SEQ ID NO: 2649635 - DNA, 22 bp, Homo sapiens
ggccacactattaccatgagaa

SEQ ID NO: 2649636 - DNA, 22 bp, Homo sapiens
ggccacagaggactcacttgcc

SEQ ID NO: 2649637 - DNA, 16 bp, Homo sapiens
ggccacatgagtccca

SEQ ID NO: 2649638 - DNA, 19 bp, Homo sapiens
ggccacatggggctgggca

SEQ ID NO: 2649639 - DNA, 17 bp, Homo sapiens
ggccaccaccccccact

SEQ ID NO: 2649640 - DNA, 12 bp, Homo sapiens
ggccaccaggct

SEQ ID NO: 2649641 - DNA, 15 bp, Homo sapiens
ggccaccaggctggc

SEQ ID NO: 2649642 - DNA, 14 bp, Homo sapiens
ggccacctctccaa

SEQ ID NO: 2649643 - DNA, 20 bp, Homo sapiens
ggccacctgaggtgggccca

SEQ ID NO: 2649644 - DNA, 23 bp, Homo sapiens
ggccacctgcccccttctcccac

SEQ ID NO: 2649645 - DNA, 18 bp, Homo sapiens
ggccacgtgatgtggagg

SEQ ID NO: 2649646 - DNA, 20 bp, Homo sapiens
ggccactgtgaagagaacca

SEQ ID NO: 2649647 - DNA, 14 bp, Homo sapiens
ggccagagctggga

SEQ ID NO: 2649648 - DNA, 21 bp, Homo sapiens
ggccagaggaactgtccagag

SEQ ID NO: 2649649 - DNA, 19 bp, Homo sapiens
ggccagagggagtgacaga

SEQ ID NO: 2649650 - DNA, 22 bp, Homo sapiens
ggccagagggagtgacagaggc

SEQ ID NO: 2649651 - DNA, 14 bp, Homo sapiens
ggccagagtggcct

SEQ ID NO: 2649652 - DNA, 15 bp, Homo sapiens
ggccagagtggcctg

SEQ ID NO: 2649653 - DNA, 20 bp, Homo sapiens
ggccagagtggcctggccag

SEQ ID NO: 2649654 - DNA, 15 bp, Homo sapiens
ggccagatgcaccag

SEQ ID NO: 2649655 - DNA, 20 bp, Homo sapiens
ggccagatgcaccagccctt

SEQ ID NO: 2649656 - DNA, 18 bp, Homo sapiens
ggccagcaccatctcttt

SEQ ID NO: 2649657 - DNA, 15 bp, Homo sapiens
ggccagccccaccca

SEQ ID NO: 2649658 - DNA, 21 bp, Homo sapiens
ggccagccccacccaggaggg

SEQ ID NO: 2649659 - DNA, 17 bp, Homo sapiens
ggccagccccggccctg

SEQ ID NO: 2649660 - DNA, 12 bp, Homo sapiens
ggccagcccctc

SEQ ID NO: 2649661 - DNA, 16 bp, Homo sapiens
ggccagcccctcccac

SEQ ID NO: 2649662 - DNA, 23 bp, Homo sapiens
ggccagcccctcccaccacagca

SEQ ID NO: 2649663 - DNA, 18 bp, Homo sapiens
ggccagcccggctggttt

SEQ ID NO: 2649664 - DNA, 13 bp, Homo sapiens
ggccagcctggat

SEQ ID NO: 2649665 - DNA, 14 bp, Homo sapiens
ggccagctggcagc

SEQ ID NO: 2649666 - DNA, 16 bp, Homo sapiens
ggccagctggcagcag

SEQ ID NO: 2649667 - DNA, 17 bp, Homo sapiens
ggccagctggcagcaga

SEQ ID NO: 2649668 - DNA, 18 bp, Homo sapiens
ggccagctggcagcagag

SEQ ID NO: 2649669 - DNA, 19 bp, Homo sapiens
ggccaggagtttgagacca

SEQ ID NO: 2649670 - DNA, 11 bp, Homo sapiens
ggccaggcagg

SEQ ID NO: 2649671 - DNA, 11 bp, Homo sapiens
ggccaggccac

SEQ ID NO: 2649672 - DNA, 14 bp, Homo sapiens
ggccaggccagagg

SEQ ID NO: 2649673 - DNA, 17 bp, Homo sapiens
ggccaggccctctgccc

SEQ ID NO: 2649674 - DNA, 11 bp, Homo sapiens
ggccaggctcc

SEQ ID NO: 2649675 - DNA, 16 bp, Homo sapiens
ggccaggctccttcct

SEQ ID NO: 2649676 - DNA, 11 bp, Homo sapiens
ggccaggctgg

SEQ ID NO: 2649677 - DNA, 12 bp, Homo sapiens
ggccaggctggt

SEQ ID NO: 2649678 - DNA, 18 bp, Homo sapiens
ggccaggctggtctcaaa

SEQ ID NO: 2649679 - DNA, 17 bp, Homo sapiens
ggccagggcctggaaga

SEQ ID NO: 2649680 - DNA, 16 bp, Homo sapiens
ggccagggtgagagct

SEQ ID NO: 2649681 - DNA, 21 bp, Homo sapiens
ggccaggtcccagcttgagct

SEQ ID NO: 2649682 - DNA, 16 bp, Homo sapiens
ggccagtacctttcca

SEQ ID NO: 2649683 - DNA, 18 bp, Homo sapiens
ggccagtcctgcctggcc

SEQ ID NO: 2649684 - DNA, 15 bp, Homo sapiens
ggccagtctgggctg

SEQ ID NO: 2649685 - DNA, 22 bp, Homo sapiens
ggccagtgtctgtcccggggtc

SEQ ID NO: 2649686 - DNA, 19 bp, Homo sapiens
ggccatccggcccccagag

SEQ ID NO: 2649687 - DNA, 15 bp, Homo sapiens
ggccatcctgtccca

SEQ ID NO: 2649688 - DNA, 23 bp, Homo sapiens
ggccatctccacccccagctgct

SEQ ID NO: 2649689 - DNA, 19 bp, Homo sapiens
ggccatctctggatgcctg

SEQ ID NO: 2649690 - DNA, 21 bp, Homo sapiens
ggccatgagctccagaccccc

SEQ ID NO: 2649691 - DNA, 13 bp, Homo sapiens
ggccatgcctgcc

SEQ ID NO: 2649692 - DNA, 16 bp, Homo sapiens
ggccatgctgaaggga

SEQ ID NO: 2649693 - DNA, 22 bp, Homo sapiens
ggccatggagagctggagcctg

SEQ ID NO: 2649694 - DNA, 13 bp, Homo sapiens
ggccatggcagaa

SEQ ID NO: 2649695 - DNA, 20 bp, Homo sapiens
ggccattctattgtggcaag

SEQ ID NO: 2649696 - DNA, 21 bp, Homo sapiens
ggcccaaaggccttggacaac

SEQ ID NO: 2649697 - DNA, 13 bp, Homo sapiens
ggcccaaggcggc

SEQ ID NO: 2649698 - DNA, 15 bp, Homo sapiens
ggcccaagtccctgt

SEQ ID NO: 2649699 - DNA, 19 bp, Homo sapiens
ggcccacagcaggtgctga

SEQ ID NO: 2649700 - DNA, 22 bp, Homo sapiens
ggcccacctggccacctgaggt

SEQ ID NO: 2649701 - DNA, 21 bp, Homo sapiens
ggcccaccttccccagaacca

SEQ ID NO: 2649702 - DNA, 14 bp, Homo sapiens
ggcccagagggcct

SEQ ID NO: 2649703 - DNA, 19 bp, Homo sapiens
ggcccagagggcctgcaag

SEQ ID NO: 2649704 - DNA, 17 bp, Homo sapiens
ggcccagcattgctggt

SEQ ID NO: 2649705 - DNA, 20 bp, Homo sapiens
ggcccagcattgctggttct

SEQ ID NO: 2649706 - DNA, 16 bp, Homo sapiens
ggcccagcccccacag

SEQ ID NO: 2649707 - DNA, 11 bp, Homo sapiens
ggcccagcccg

SEQ ID NO: 2649708 - DNA, 19 bp, Homo sapiens
ggcccagcccggctcccac

SEQ ID NO: 2649709 - DNA, 22 bp, Homo sapiens
ggcccagccctgctggccgcct

SEQ ID NO: 2649710 - DNA, 16 bp, Homo sapiens
ggcccagccggcctct

SEQ ID NO: 2649711 - DNA, 20 bp, Homo sapiens
ggcccagccggcctctctgg

SEQ ID NO: 2649712 - DNA, 21 bp, Homo sapiens
ggcccagccggcctctctggc

SEQ ID NO: 2649713 - DNA, 16 bp, Homo sapiens
ggcccagcgacctcgg

SEQ ID NO: 2649714 - DNA, 14 bp, Homo sapiens
ggcccagctgggct

SEQ ID NO: 2649715 - DNA, 17 bp, Homo sapiens
ggcccagctgggctctg

SEQ ID NO: 2649716 - DNA, 15 bp, Homo sapiens
ggcccaggaccagct

SEQ ID NO: 2649717 - DNA, 16 bp, Homo sapiens
ggcccagtcctggcct

SEQ ID NO: 2649718 - DNA, 19 bp, Homo sapiens
ggcccagtgtcaagttgtg

SEQ ID NO: 2649719 - DNA, 16 bp, Homo sapiens
ggccccaaaaccacag

SEQ ID NO: 2649720 - DNA, 21 bp, Homo sapiens
ggccccaaaaccacagccctg

SEQ ID NO: 2649721 - DNA, 11 bp, Homo sapiens
ggccccagaga

SEQ ID NO: 2649722 - DNA, 12 bp, Homo sapiens
ggccccagagac

SEQ ID NO: 2649723 - DNA, 13 bp, Homo sapiens
ggccccagagact

SEQ ID NO: 2649724 - DNA, 14 bp, Homo sapiens
ggccccagagactc

SEQ ID NO: 2649725 - DNA, 21 bp, Homo sapiens
ggccccagcactaaagcagtg

SEQ ID NO: 2649726 - DNA, 19 bp, Homo sapiens
gggagcagtgtcttccata

SEQ ID NO: 2649727 - DNA, 14 bp, Homo sapiens
gggagccccagggt

SEQ ID NO: 2649728 - DNA, 16 bp, Homo sapiens
gggagccccagggtct

SEQ ID NO: 2649729 - DNA, 19 bp, Homo sapiens
gggagctggttagaaatgc

SEQ ID NO: 2649730 - DNA, 20 bp, Homo sapiens
gggaggaggtggcagccctg

SEQ ID NO: 2649731 - DNA, 21 bp, Homo sapiens
gggaggattgcttgagctcag

SEQ ID NO: 2649732 - DNA, 23 bp, Homo sapiens
gggaggattgcttgagctcagga

SEQ ID NO: 2649733 - DNA, 18 bp, Homo sapiens
gggaggcaagaggggtgg

SEQ ID NO: 2649734 - DNA, 17 bp, Homo sapiens
gggaggcatggccctgg

SEQ ID NO: 2649735 - DNA, 19 bp, Homo sapiens
gggaggccaaggtgggagg

SEQ ID NO: 2649736 - DNA, 20 bp, Homo sapiens
gggaggcggacgttccagcc

SEQ ID NO: 2649737 - DNA, 20 bp, Homo sapiens
gggaggcggagagtacagtg

SEQ ID NO: 2649738 - DNA, 10 bp, Homo sapiens
gggaggctga

SEQ ID NO: 2649739 - DNA, 17 bp, Homo sapiens
gggaggctgagacagga

SEQ ID NO: 2649740 - DNA, 13 bp, Homo sapiens
gggaggcttcccc

SEQ ID NO: 2649741 - DNA, 15 bp, Homo sapiens
gggagggagggctcc

SEQ ID NO: 2649742 - DNA, 11 bp, Homo sapiens
gggagggcagc

SEQ ID NO: 2649743 - DNA, 13 bp, Homo sapiens
gggagggctccag

SEQ ID NO: 2649744 - DNA, 15 bp, Homo sapiens
gggagggctccagac

SEQ ID NO: 2649745 - DNA, 17 bp, Homo sapiens
gggaggggcaggctgac

SEQ ID NO: 2649746 - DNA, 16 bp, Homo sapiens
gggaggggcgctggcc

SEQ ID NO: 2649747 - DNA, 18 bp, Homo sapiens
gggaggggcgctggccca

SEQ ID NO: 2649748 - DNA, 19 bp, Homo sapiens
gggaggggcgctggcccag

SEQ ID NO: 2649749 - DNA, 18 bp, Homo sapiens
gggaggtcgaggcaggag

SEQ ID NO: 2649750 - DNA, 14 bp, Homo sapiens
gggaggtggctggg

SEQ ID NO: 2649751 - DNA, 21 bp, Homo sapiens
gggagtcatctcaaccatccc

SEQ ID NO: 2649752 - DNA, 16 bp, Homo sapiens
gggagtcccctccccg

SEQ ID NO: 2649753 - DNA, 17 bp, Homo sapiens
gggagtctgaagcagat

SEQ ID NO: 2649754 - DNA, 18 bp, Homo sapiens
gggagtgacagaggcagc

SEQ ID NO: 2649755 - DNA, 19 bp, Homo sapiens
gggagtgagacagaagtaa

SEQ ID NO: 2649756 - DNA, 11 bp, Homo sapiens
gggagtgagct

SEQ ID NO: 2649757 - DNA, 21 bp, Homo sapiens
gggagtggaatagtatcctcc

SEQ ID NO: 2649758 - DNA, 18 bp, Homo sapiens
gggagtgggacagagtct

SEQ ID NO: 2649759 - DNA, 11 bp, Homo sapiens
gggagtgtgta

SEQ ID NO: 2649760 - DNA, 22 bp, Homo sapiens
gggagttgtcaagtctctgctg

SEQ ID NO: 2649761 - DNA, 21 bp, Homo sapiens
gggatatgatttaaatcagcc

SEQ ID NO: 2649762 - DNA, 15 bp, Homo sapiens
gggatcctccaggtg

SEQ ID NO: 2649763 - DNA, 15 bp, Homo sapiens
gggatctgcccctcc

SEQ ID NO: 2649764 - DNA, 20 bp, Homo sapiens
gggatgactaaaatatttat

SEQ ID NO: 2649765 - DNA, 23 bp, Homo sapiens
gggatgactagaggcagggaggg

SEQ ID NO: 2649766 - DNA, 21 bp, Homo sapiens
gggatgagcatggagctggcc

SEQ ID NO: 2649767 - DNA, 15 bp, Homo sapiens
gggatgagccgctgt

SEQ ID NO: 2649768 - DNA, 15 bp, Homo sapiens
gggatggaaaaggaa

SEQ ID NO: 2649769 - DNA, 15 bp, Homo sapiens
gggatggtcctgggg

SEQ ID NO: 2649770 - DNA, 22 bp, Homo sapiens
gggatgtacaaggcgatcccat

SEQ ID NO: 2649771 - DNA, 16 bp, Homo sapiens
gggatgttctggccct

SEQ ID NO: 2649772 - DNA, 15 bp, Homo sapiens
gggattacaggtgtg

SEQ ID NO: 2649773 - DNA, 16 bp, Homo sapiens
gggattcaggctgctt

SEQ ID NO: 2649774 - DNA, 15 bp, Homo sapiens
gggattcccaccaag

SEQ ID NO: 2649775 - DNA, 21 bp, Homo sapiens
gggattcctgacccaggccgc

SEQ ID NO: 2649776 - DNA, 21 bp, Homo sapiens
gggattctactttaagcacta

SEQ ID NO: 2649777 - DNA, 17 bp, Homo sapiens
gggattgtaaaatggtg

SEQ ID NO: 2649778 - DNA, 14 bp, Homo sapiens
gggcaaacaggcag

SEQ ID NO: 2649779 - DNA, 13 bp, Homo sapiens
gggcaaggagacc

SEQ ID NO: 2649780 - DNA, 13 bp, Homo sapiens
gggcaagggccat

SEQ ID NO: 2649781 - DNA, 13 bp, Homo sapiens
gggcacacactgt

SEQ ID NO: 2649782 - DNA, 15 bp, Homo sapiens
gggcacacgcctccc

SEQ ID NO: 2649783 - DNA, 13 bp, Homo sapiens
gggcacagggtct

SEQ ID NO: 2649784 - DNA, 19 bp, Homo sapiens
gggcacctatagtcccagc

SEQ ID NO: 2649785 - DNA, 16 bp, Homo sapiens
gggcactcagaagaca

SEQ ID NO: 2649786 - DNA, 14 bp, Homo sapiens
gggcactggagctg

SEQ ID NO: 2649787 - DNA, 22 bp, Homo sapiens
gggcactttttaattcaccaaa

SEQ ID NO: 2649788 - DNA, 14 bp, Homo sapiens
gggcagaacactaa

SEQ ID NO: 2649789 - DNA, 14 bp, Homo sapiens
gggcagaagggaga

SEQ ID NO: 2649790 - DNA, 12 bp, Homo sapiens
gggcagagcaga

SEQ ID NO: 2649791 - DNA, 12 bp, Homo sapiens
gggcagagccca

SEQ ID NO: 2649792 - DNA, 13 bp, Homo sapiens
gggcagagccggg

SEQ ID NO: 2649793 - DNA, 14 bp, Homo sapiens
gggcagagccggga

SEQ ID NO: 2649794 - DNA, 17 bp, Homo sapiens
gggcagagccgggaagc

SEQ ID NO: 2649795 - DNA, 16 bp, Homo sapiens
gggcagagtcacacgg

SEQ ID NO: 2649796 - DNA, 17 bp, Homo sapiens
gggcagagtgagaccca

SEQ ID NO: 2649797 - DNA, 13 bp, Homo sapiens
gggcagccaggct

SEQ ID NO: 2649798 - DNA, 18 bp, Homo sapiens
gggcagctgccagagaag

SEQ ID NO: 2649799 - DNA, 17 bp, Homo sapiens
gggcagctgggcccaac

SEQ ID NO: 2649800 - DNA, 19 bp, Homo sapiens
gggcaggaaggagagcctg

SEQ ID NO: 2649801 - DNA, 21 bp, Homo sapiens
gggcaggaaggagagcctgct

SEQ ID NO: 2649802 - DNA, 23 bp, Homo sapiens
gggcaggactcagctccccagag

SEQ ID NO: 2649803 - DNA, 15 bp, Homo sapiens
gggcaggcatgaagt

SEQ ID NO: 2649804 - DNA, 13 bp, Homo sapiens
gggcaggctgaca

SEQ ID NO: 2649805 - DNA, 22 bp, Homo sapiens
gggcaggtggtggcactgagcc

SEQ ID NO: 2649806 - DNA, 17 bp, Homo sapiens
gggcaggttggtggggg

SEQ ID NO: 2649807 - DNA, 17 bp, Homo sapiens
gggcatctgcccctccc

SEQ ID NO: 2649808 - DNA, 20 bp, Homo sapiens
gggcatggacgttcggggca

SEQ ID NO: 2649809 - DNA, 20 bp, Homo sapiens
gggcatggggtgggcctctg

SEQ ID NO: 2649810 - DNA, 21 bp, Homo sapiens
gggcatggggtgggcctctgg

SEQ ID NO: 2649811 - DNA, 18 bp, Homo sapiens
gggcatgtattggcctgg

SEQ ID NO: 2649812 - DNA, 18 bp, Homo sapiens
gggcattgatggggaagg

SEQ ID NO: 2649813 - DNA, 14 bp, Homo sapiens
gggcattgctttcc

SEQ ID NO: 2649814 - DNA, 15 bp, Homo sapiens
gggccaacaccaggg

SEQ ID NO: 2649815 - DNA, 17 bp, Homo sapiens
gggccaagacttggcaa

SEQ ID NO: 2649816 - DNA, 16 bp, Homo sapiens
gggccacagagaaagt

SEQ ID NO: 2649817 - DNA, 15 bp, Homo sapiens
gggccactctgcctc

SEQ ID NO: 2649818 - DNA, 23 bp, Homo sapiens
gggccagaggaactgtccagaga

SEQ ID NO: 2649819 - DNA, 12 bp, Homo sapiens
gggccagaggct

SEQ ID NO: 2649820 - DNA, 17 bp, Homo sapiens
gggccagccaggcgggc

SEQ ID NO: 2649821 - DNA, 20 bp, Homo sapiens
gggccaggcaggtgcctgga

SEQ ID NO: 2649822 - DNA, 14 bp, Homo sapiens
gggccagggccctg

SEQ ID NO: 2649823 - DNA, 18 bp, Homo sapiens
gggccagggccctgcaga

SEQ ID NO: 2649824 - DNA, 20 bp, Homo sapiens
gggccagtcctgcctggcca

SEQ ID NO: 2649825 - DNA, 15 bp, Homo sapiens
gggccagtctgggct

SEQ ID NO: 2649826 - DNA, 17 bp, Homo sapiens
gggccatcctgtcccac

SEQ ID NO: 2649827 - DNA, 18 bp, Homo sapiens
gggcccaagacagatgcc

SEQ ID NO: 2649828 - DNA, 20 bp, Homo sapiens
gggcccaagtccctgttttc

SEQ ID NO: 2649829 - DNA, 13 bp, Homo sapiens
gggcccacctggc

SEQ ID NO: 2649830 - DNA, 12 bp, Homo sapiens
gggcccagagca

SEQ ID NO: 2649831 - DNA, 13 bp, Homo sapiens
gggcccagatctg

SEQ ID NO: 2649832 - DNA, 14 bp, Homo sapiens
gggcccagattcta

SEQ ID NO: 2649833 - DNA, 13 bp, Homo sapiens
gggcccagccccc

SEQ ID NO: 2649834 - DNA, 18 bp, Homo sapiens
gggcccagcccccacagt

SEQ ID NO: 2649835 - DNA, 15 bp, Homo sapiens
gggcccagctgggct

SEQ ID NO: 2649836 - DNA, 16 bp, Homo sapiens
gggcccagctgggctc

SEQ ID NO: 2649837 - DNA, 17 bp, Homo sapiens
gggcccaggaccagctg

SEQ ID NO: 2649838 - DNA, 24 bp, Homo sapiens
gggcccaggaccagctggggcgtg

SEQ ID NO: 2649839 - DNA, 13 bp, Homo sapiens
gggcccaggcagg

SEQ ID NO: 2649840 - DNA, 19 bp, Homo sapiens
gggccccagtcagcctctc

SEQ ID NO: 2649841 - DNA, 21 bp, Homo sapiens
gggcccctcatcgcgtcctcc

SEQ ID NO: 2649842 - DNA, 15 bp, Homo sapiens
gggcccctccagctt

SEQ ID NO: 2649843 - DNA, 16 bp, Homo sapiens
gggcccctctgcccag

SEQ ID NO: 2649844 - DNA, 18 bp, Homo sapiens
gggcccctttttactccc

SEQ ID NO: 2649845 - DNA, 22 bp, Homo sapiens
gggccctgagctcggtggaccc

SEQ ID NO: 2649846 - DNA, 21 bp, Homo sapiens
gggcccttcactgcctttgct

SEQ ID NO: 2649847 - DNA, 18 bp, Homo sapiens
gggccgaatcccctccct

SEQ ID NO: 2649848 - DNA, 13 bp, Homo sapiens
gggccgtgcccag

SEQ ID NO: 2649849 - DNA, 20 bp, Homo sapiens
gggcctagatccacacacag

SEQ ID NO: 2649850 - DNA, 19 bp, Homo sapiens
gggcctcaaaggcccgctc

SEQ ID NO: 2649851 - DNA, 20 bp, Homo sapiens
gggcctcaccgagtgggggc

SEQ ID NO: 2649852 - DNA, 16 bp, Homo sapiens
gggcctcgggacctca

SEQ ID NO: 2649853 - DNA, 18 bp, Homo sapiens
gggcctcttatgggctgg

SEQ ID NO: 2649854 - DNA, 17 bp, Homo sapiens
gggcctgagccaagcta

SEQ ID NO: 2649855 - DNA, 14 bp, Homo sapiens
gggcctggacctgc

SEQ ID NO: 2649856 - DNA, 13 bp, Homo sapiens
gggcctggcctga

SEQ ID NO: 2649857 - DNA, 18 bp, Homo sapiens
gggcctggcctgagctgg

SEQ ID NO: 2649858 - DNA, 16 bp, Homo sapiens
gggcctggctcaggtg

SEQ ID NO: 2649859 - DNA, 19 bp, Homo sapiens
gggcctggtccctgggagg

SEQ ID NO: 2649860 - DNA, 21 bp, Homo sapiens
gggccttgcggtatccgcccc

SEQ ID NO: 2649861 - DNA, 22 bp, Homo sapiens
gggccttggcctcccctgctga

SEQ ID NO: 2649862 - DNA, 19 bp, Homo sapiens
gggcgaagcccaggcccct

SEQ ID NO: 2649863 - DNA, 20 bp, Homo sapiens
gggcgaccccgtcacagcct

SEQ ID NO: 2649864 - DNA, 18 bp, Homo sapiens
gggcgagtcactgcctct

SEQ ID NO: 2649865 - DNA, 18 bp, Homo sapiens
gggcgatcgcggcggagc

SEQ ID NO: 2649866 - DNA, 23 bp, Homo sapiens
gggcgcggccagccccggccctg

SEQ ID NO: 2649867 - DNA, 16 bp, Homo sapiens
gggcgcggtggctcac

SEQ ID NO: 2649868 - DNA, 23 bp, Homo sapiens
gggcgctggcccagccggcctct

SEQ ID NO: 2649869 - DNA, 14 bp, Homo sapiens
gggctagaacctgg

SEQ ID NO: 2649870 - DNA, 15 bp, Homo sapiens
gggctagaacctgga

SEQ ID NO: 2649871 - DNA, 13 bp, Homo sapiens
ggtttaactcaga

SEQ ID NO: 2649872 - DNA, 23 bp, Homo sapiens
ggtttaactcagatcactactgc

SEQ ID NO: 2649873 - DNA, 13 bp, Homo sapiens
ggtttaagctgtt

SEQ ID NO: 2649874 - DNA, 23 bp, Homo sapiens
ggtttactctgtggccaaaggag

SEQ ID NO: 2649875 - DNA, 19 bp, Homo sapiens
ggtttcaccatgttggcca

SEQ ID NO: 2649876 - DNA, 15 bp, Homo sapiens
ggtttctggtctcta

SEQ ID NO: 2649877 - DNA, 22 bp, Homo sapiens
ggtttcttcaacaggagaattt

SEQ ID NO: 2649878 - DNA, 15 bp, Homo sapiens
ggtttgaagcctgga

SEQ ID NO: 2649879 - DNA, 14 bp, Homo sapiens
ggtttgcaaggaag

SEQ ID NO: 2649880 - DNA, 18 bp, Homo sapiens
ggtttgcagatgacaaaa

SEQ ID NO: 2649881 - DNA, 19 bp, Homo sapiens
ggtttggcgggccaaggac

SEQ ID NO: 2649882 - DNA, 15 bp, Homo sapiens
ggtttggtctgggac

SEQ ID NO: 2649883 - DNA, 20 bp, Homo sapiens
ggtttgtaaattaactttta

SEQ ID NO: 2649884 - DNA, 21 bp, Homo sapiens
ggttttaggtctcttcccctc

SEQ ID NO: 2649885 - DNA, 13 bp, Homo sapiens
ggttttcccctcc

SEQ ID NO: 2649886 - DNA, 19 bp, Homo sapiens
ggttttcgaagctcagccc

SEQ ID NO: 2649887 - DNA, 13 bp, Homo sapiens
ggttttctgttct

SEQ ID NO: 2649888 - DNA, 19 bp, Homo sapiens
ggttttgctattagactgt

SEQ ID NO: 2649889 - DNA, 13 bp, Homo sapiens
ggttttgtacaat

SEQ ID NO: 2649890 - DNA, 12 bp, Homo sapiens
ggttttgtttgc

SEQ ID NO: 2649891 - DNA, 15 bp, Homo sapiens
ggttttgtttgctat

SEQ ID NO: 2649892 - DNA, 14 bp, Homo sapiens
ggtttttactgtta

SEQ ID NO: 2649893 - DNA, 13 bp, Homo sapiens
ggtttttcaatta

SEQ ID NO: 2649894 - DNA, 20 bp, Homo sapiens
ggttttttgtgtactttttg

SEQ ID NO: 2649895 - DNA, 16 bp, Homo sapiens
gtaaaaaaaaaaaagt

SEQ ID NO: 2649896 - DNA, 14 bp, Homo sapiens
gtaaaaattaaaaa

SEQ ID NO: 2649897 - DNA, 20 bp, Homo sapiens
gtaaaacaaaaatgtaatga

SEQ ID NO: 2649898 - DNA, 18 bp, Homo sapiens
gtaaaagaacagtaaaca

SEQ ID NO: 2649899 - DNA, 16 bp, Homo sapiens
gtaaaataaaaggtcg

SEQ ID NO: 2649900 - DNA, 14 bp, Homo sapiens
gtaaaataaaatta

SEQ ID NO: 2649901 - DNA, 15 bp, Homo sapiens
gtaaaatattttgaa

SEQ ID NO: 2649902 - DNA, 19 bp, Homo sapiens
gtaaaatattttgaatcaa

SEQ ID NO: 2649903 - DNA, 16 bp, Homo sapiens
gtaaaattgaaaggca

SEQ ID NO: 2649904 - DNA, 23 bp, Homo sapiens
gtaaacaaaatttagtttttgtt

SEQ ID NO: 2649905 - DNA, 20 bp, Homo sapiens
gtaaacatgtgttttaattc

SEQ ID NO: 2649906 - DNA, 22 bp, Homo sapiens
gtaaacccctttagtggcttca

SEQ ID NO: 2649907 - DNA, 21 bp, Homo sapiens
gtaaactatttatctgtgttt

SEQ ID NO: 2649908 - DNA, 15 bp, Homo sapiens
gtaaactcaaaactt

SEQ ID NO: 2649909 - DNA, 21 bp, Homo sapiens
gtaaactcaaaacttaacata

SEQ ID NO: 2649910 - DNA, 16 bp, Homo sapiens
gtaaactcaaaatatt

SEQ ID NO: 2649911 - DNA, 24 bp, Homo sapiens
gtaaactgtgcaccaagcaggaaa

SEQ ID NO: 2649912 - DNA, 17 bp, Homo sapiens
gtaaagaaagagagaaa

SEQ ID NO: 2649913 - DNA, 20 bp, Homo sapiens
gtaaagaaagagagaaaata

SEQ ID NO: 2649914 - DNA, 21 bp, Homo sapiens
gtaaagaaatttaaaagacac

SEQ ID NO: 2649915 - DNA, 15 bp, Homo sapiens
gtaaagactggcttt

SEQ ID NO: 2649916 - DNA, 19 bp, Homo sapiens
gtaaagatatttttatctt

SEQ ID NO: 2649917 - DNA, 15 bp, Homo sapiens
gtaaagctagaaatg

SEQ ID NO: 2649918 - DNA, 21 bp, Homo sapiens
gtaaagtatgtaaacaggaga

SEQ ID NO: 2649919 - DNA, 23 bp, Homo sapiens
gtaaagtgataatttctggaatt

SEQ ID NO: 2649920 - DNA, 21 bp, Homo sapiens
gtaaagtgtggtcccaacagg

SEQ ID NO: 2649921 - DNA, 22 bp, Homo sapiens
gtaaagtgtggtcccaacagga

SEQ ID NO: 2649922 - DNA, 14 bp, Homo sapiens
gtaaagttagtcta

SEQ ID NO: 2649923 - DNA, 19 bp, Homo sapiens
gtaaatacacaacacacac

SEQ ID NO: 2649924 - DNA, 24 bp, Homo sapiens
gtaaatgcatctgtcctcatgtgt

SEQ ID NO: 2649925 - DNA, 21 bp, Homo sapiens
gtaaattaacttttataaact

SEQ ID NO: 2649926 - DNA, 23 bp, Homo sapiens
gtaaattaacttttataaacttt

SEQ ID NO: 2649927 - DNA, 17 bp, Homo sapiens
gtaaatttatgtgatgg

SEQ ID NO: 2649928 - DNA, 20 bp, Homo sapiens
gtaaatttccccaacagtgt

SEQ ID NO: 2649929 - DNA, 16 bp, Homo sapiens
gtaacaagccacccca

SEQ ID NO: 2649930 - DNA, 19 bp, Homo sapiens
gtaacaattttaatgctat

SEQ ID NO: 2649931 - DNA, 11 bp, Homo sapiens
gtaacagaaag

SEQ ID NO: 2649932 - DNA, 12 bp, Homo sapiens
gtaacagaaagg

SEQ ID NO: 2649933 - DNA, 22 bp, Homo sapiens
gtaacagaacagcttcaggtta

SEQ ID NO: 2649934 - DNA, 22 bp, Homo sapiens
gtaacaggaaaattttaaaaat

SEQ ID NO: 2649935 - DNA, 14 bp, Homo sapiens
gtaacaggtctcct

SEQ ID NO: 2649936 - DNA, 18 bp, Homo sapiens
gtaacagttcatgtttgc

SEQ ID NO: 2649937 - DNA, 22 bp, Homo sapiens
gtaacagttcatgtttgcttca

SEQ ID NO: 2649938 - DNA, 23 bp, Homo sapiens
gtaacatgtgttaagtattttca

SEQ ID NO: 2649939 - DNA, 12 bp, Homo sapiens
gtaacatgttta

SEQ ID NO: 2649940 - DNA, 22 bp, Homo sapiens
gtaacatgtttacttttcaggg

SEQ ID NO: 2649941 - DNA, 18 bp, Homo sapiens
gtaacattgggtcctggg

SEQ ID NO: 2649942 - DNA, 17 bp, Homo sapiens
gtaacccaactctcctg

SEQ ID NO: 2649943 - DNA, 15 bp, Homo sapiens
gtaacctcagctctg

SEQ ID NO: 2649944 - DNA, 18 bp, Homo sapiens
gtaacctcagctctggga

SEQ ID NO: 2649945 - DNA, 20 bp, Homo sapiens
gtaacctcttcagaggccct

SEQ ID NO: 2649946 - DNA, 17 bp, Homo sapiens
gtaactaggctcagaga

SEQ ID NO: 2649947 - DNA, 13 bp, Homo sapiens
gtaactgacaact

SEQ ID NO: 2649948 - DNA, 14 bp, Homo sapiens
gtaactgctgaaaa

SEQ ID NO: 2649949 - DNA, 15 bp, Homo sapiens
gtaactgctgaaaac

SEQ ID NO: 2649950 - DNA, 19 bp, Homo sapiens
gtaactgttaaattgctgt

SEQ ID NO: 2649951 - DNA, 22 bp, Homo sapiens
gtaactgttaaattgctgtgta

SEQ ID NO: 2649952 - DNA, 12 bp, Homo sapiens
gtaactttatgt

SEQ ID NO: 2649953 - DNA, 16 bp, Homo sapiens
gtaactttatgtgtaa

SEQ ID NO: 2649954 - DNA, 12 bp, Homo sapiens
gtaagaaatact

SEQ ID NO: 2649955 - DNA, 13 bp, Homo sapiens
gtaagaaatactg

SEQ ID NO: 2649956 - DNA, 15 bp, Homo sapiens
gtaagaagagactgg

SEQ ID NO: 2649957 - DNA, 17 bp, Homo sapiens
gtaagagcaccttcctc

SEQ ID NO: 2649958 - DNA, 20 bp, Homo sapiens
gtaagagcaccttcctcact

SEQ ID NO: 2649959 - DNA, 14 bp, Homo sapiens
gtaagagctggtgt

SEQ ID NO: 2649960 - DNA, 16 bp, Homo sapiens
gtaagagctggtgtct

SEQ ID NO: 2649961 - DNA, 15 bp, Homo sapiens
gtaagagtgtagaag

SEQ ID NO: 2649962 - DNA, 12 bp, Homo sapiens
gtaagatgctgg

SEQ ID NO: 2649963 - DNA, 16 bp, Homo sapiens
gtaagatgctgggttg

SEQ ID NO: 2649964 - DNA, 13 bp, Homo sapiens
gtaagctctggct

SEQ ID NO: 2649965 - DNA, 23 bp, Homo sapiens
gtaaggaatacctgtccccctga

SEQ ID NO: 2649966 - DNA, 23 bp, Homo sapiens
gtaaggcagggtcccatttctca

SEQ ID NO: 2649967 - DNA, 17 bp, Homo sapiens
gtaagggaaactgccag

SEQ ID NO: 2649968 - DNA, 18 bp, Homo sapiens
gtaagggaaactgccagc

SEQ ID NO: 2649969 - DNA, 22 bp, Homo sapiens
gtaagtattcttatttaatgaa

SEQ ID NO: 2649970 - DNA, 21 bp, Homo sapiens
gtaagtgtgagtaagagctgg

SEQ ID NO: 2649971 - DNA, 14 bp, Homo sapiens
gtaagtttcaggtg

SEQ ID NO: 2649972 - DNA, 22 bp, Homo sapiens
gtaagtttcaggtgacatgtga

SEQ ID NO: 2649973 - DNA, 16 bp, Homo sapiens
gtaataaactgtgttt

SEQ ID NO: 2649974 - DNA, 13 bp, Homo sapiens
gtaataagacata

SEQ ID NO: 2649975 - DNA, 17 bp, Homo sapiens
gtaataatgtgaatcat

SEQ ID NO: 2649976 - DNA, 15 bp, Homo sapiens
gtaatagaaaactga

SEQ ID NO: 2649977 - DNA, 19 bp, Homo sapiens
gtaatagaaaactgaaaat

SEQ ID NO: 2649978 - DNA, 16 bp, Homo sapiens
gtaatatgcacacatt

SEQ ID NO: 2649979 - DNA, 18 bp, Homo sapiens
gtaatcaataaacgattt

SEQ ID NO: 2649980 - DNA, 22 bp, Homo sapiens
gtaatcatttcttgggccctcc

SEQ ID NO: 2649981 - DNA, 23 bp, Homo sapiens
gtaatcatttcttgggccctcct

SEQ ID NO: 2649982 - DNA, 18 bp, Homo sapiens
gtaatcccagcactttgg

SEQ ID NO: 2649983 - DNA, 17 bp, Homo sapiens
gtaatcgcttaaagatg

SEQ ID NO: 2649984 - DNA, 16 bp, Homo sapiens
gtaatcgttatgtgtg

SEQ ID NO: 2649985 - DNA, 12 bp, Homo sapiens
gtaatctgtgta

SEQ ID NO: 2649986 - DNA, 16 bp, Homo sapiens
gtaatctgtgtacaaa

SEQ ID NO: 2649987 - DNA, 10 bp, Homo sapiens
gtaatgaaac

SEQ ID NO: 2649988 - DNA, 22 bp, Homo sapiens
gtaatgaaacaccttctctgga

SEQ ID NO: 2649989 - DNA, 20 bp, Homo sapiens
gtaatgatatagccagaaaa

SEQ ID NO: 2649990 - DNA, 16 bp, Homo sapiens
gtaatgtgaataaatt

SEQ ID NO: 2649991 - DNA, 21 bp, Homo sapiens
gtaatgttactgatcatgcat

SEQ ID NO: 2649992 - DNA, 19 bp, Homo sapiens
gtaattaaaagaattttcc

SEQ ID NO: 2649993 - DNA, 23 bp, Homo sapiens
gtaattagtaacatgtgttaagt

SEQ ID NO: 2649994 - DNA, 22 bp, Homo sapiens
gtaattatcgggaacagtgttt

SEQ ID NO: 2649995 - DNA, 21 bp, Homo sapiens
gtaattcctctcactaaactt

SEQ ID NO: 2649996 - DNA, 12 bp, Homo sapiens
gtaattctaaat

SEQ ID NO: 2649997 - DNA, 17 bp, Homo sapiens
gtaattgttgtttgtat

SEQ ID NO: 2649998 - DNA, 21 bp, Homo sapiens
gtaattgttgtttgtatgtat

SEQ ID NO: 2649999 - DNA, 16 bp, Homo sapiens
gtaatttaaacaggcc

SEQ ID NO: 2650000 - DNA, 19 bp, Homo sapiens
gtaatttaaacaggcccag

SEQ ID NO: 2650001 - DNA, 11 bp, Homo sapiens
gtaatttattt

SEQ ID NO: 2650002 - DNA, 13 bp, Homo sapiens
gtaatttctttgc

SEQ ID NO: 2650003 - DNA, 23 bp, Homo sapiens
gtaatttgagagaaatatgaaga

SEQ ID NO: 2650004 - DNA, 16 bp, Homo sapiens
gtaatttgaggacaac

SEQ ID NO: 2650005 - DNA, 21 bp, Homo sapiens
gtaatttttttatcgtcactg

SEQ ID NO: 2650006 - DNA, 12 bp, Homo sapiens
gtacaaaataaa

SEQ ID NO: 2650007 - DNA, 20 bp, Homo sapiens
gtacaaaatccagctatgaa

SEQ ID NO: 2650008 - DNA, 22 bp, Homo sapiens
gtacaataagtgtttttgtatt

SEQ ID NO: 2650009 - DNA, 16 bp, Homo sapiens
gtacacacacatacac

SEQ ID NO: 2650010 - DNA, 15 bp, Homo sapiens
gtacacgtgtcctgt

SEQ ID NO: 2650011 - DNA, 18 bp, Homo sapiens
gtacactgtttcaaactt

SEQ ID NO: 2650012 - DNA, 19 bp, Homo sapiens
gtacactgtttcaaacttt

SEQ ID NO: 2650013 - DNA, 20 bp, Homo sapiens
gtacagcaaggagatttaca

SEQ ID NO: 2650014 - DNA, 12 bp, Homo sapiens
gtacaggcagca

SEQ ID NO: 2650015 - DNA, 17 bp, Homo sapiens
gtcagctttgccttcca

SEQ ID NO: 2650016 - DNA, 23 bp, Homo sapiens
gtcagctttgccttccacgctgt

SEQ ID NO: 2650017 - DNA, 14 bp, Homo sapiens
gtcaggagagcagc

SEQ ID NO: 2650018 - DNA, 22 bp, Homo sapiens
gtcaggagttagaggccagcct

SEQ ID NO: 2650019 - DNA, 13 bp, Homo sapiens
gtcaggagttcct

SEQ ID NO: 2650020 - DNA, 12 bp, Homo sapiens
gtcaggctccat

SEQ ID NO: 2650021 - DNA, 14 bp, Homo sapiens
gtcaggctgctggc

SEQ ID NO: 2650022 - DNA, 15 bp, Homo sapiens
gtcaggctgctggcg

SEQ ID NO: 2650023 - DNA, 17 bp, Homo sapiens
gtcaggctgctggcgcc

SEQ ID NO: 2650024 - DNA, 20 bp, Homo sapiens
gtcaggctgctggcgcctct

SEQ ID NO: 2650025 - DNA, 14 bp, Homo sapiens
gtcagggaccaagg

SEQ ID NO: 2650026 - DNA, 14 bp, Homo sapiens
gtcagggacccctg

SEQ ID NO: 2650027 - DNA, 15 bp, Homo sapiens
gtcagggcccaagtc

SEQ ID NO: 2650028 - DNA, 22 bp, Homo sapiens
gtcaggtggggcagcttgaggg

SEQ ID NO: 2650029 - DNA, 20 bp, Homo sapiens
gtcagtatctgtatctctct

SEQ ID NO: 2650030 - DNA, 14 bp, Homo sapiens
gtcagtatgacatt

SEQ ID NO: 2650031 - DNA, 14 bp, Homo sapiens
gtcagtgaggccca

SEQ ID NO: 2650032 - DNA, 23 bp, Homo sapiens
gtcagtgtccaaagcagggtctg

SEQ ID NO: 2650033 - DNA, 24 bp, Homo sapiens
gtcagtgtccaaagcagggtctgg

SEQ ID NO: 2650034 - DNA, 17 bp, Homo sapiens
gtcatacaatccattct

SEQ ID NO: 2650035 - DNA, 16 bp, Homo sapiens
gtcataccaatgaaaa

SEQ ID NO: 2650036 - DNA, 18 bp, Homo sapiens
gtcatatgtaggtgtctg

SEQ ID NO: 2650037 - DNA, 14 bp, Homo sapiens
gtcatcagccacca

SEQ ID NO: 2650038 - DNA, 21 bp, Homo sapiens
gtcatcattgtatatatgtgt

SEQ ID NO: 2650039 - DNA, 18 bp, Homo sapiens
gtcatcttgaccaagcag

SEQ ID NO: 2650040 - DNA, 14 bp, Homo sapiens
gtcatgaagcccaa

SEQ ID NO: 2650041 - DNA, 17 bp, Homo sapiens
gtcatgcataaatatgc

SEQ ID NO: 2650042 - DNA, 18 bp, Homo sapiens
gtcatgcataaatatgca

SEQ ID NO: 2650043 - DNA, 15 bp, Homo sapiens
gtcatggcttaatgt

SEQ ID NO: 2650044 - DNA, 15 bp, Homo sapiens
gtcatgtgacaggta

SEQ ID NO: 2650045 - DNA, 15 bp, Homo sapiens
gtcatgtttaagaaa

SEQ ID NO: 2650046 - DNA, 14 bp, Homo sapiens
gtcattaaaataaa

SEQ ID NO: 2650047 - DNA, 22 bp, Homo sapiens
gtcattaaaataaataaatgca

SEQ ID NO: 2650048 - DNA, 22 bp, Homo sapiens
gtcattatagatcccccagact

SEQ ID NO: 2650049 - DNA, 21 bp, Homo sapiens
gtcattatgagaggcaatgat

SEQ ID NO: 2650050 - DNA, 15 bp, Homo sapiens
gtcattcaataaatt

SEQ ID NO: 2650051 - DNA, 17 bp, Homo sapiens
gtcatttgagcagggct

SEQ ID NO: 2650052 - DNA, 19 bp, Homo sapiens
gtcatttgagcagggctca

SEQ ID NO: 2650053 - DNA, 22 bp, Homo sapiens
gtcatttgagcagggctcagcg

SEQ ID NO: 2650054 - DNA, 21 bp, Homo sapiens
gtcatttgctgagcatgtact

SEQ ID NO: 2650055 - DNA, 15 bp, Homo sapiens
gtccaaataaaaact

SEQ ID NO: 2650056 - DNA, 20 bp, Homo sapiens
gtccaaataaaaactaaatt

SEQ ID NO: 2650057 - DNA, 13 bp, Homo sapiens
gtccaagaagccc

SEQ ID NO: 2650058 - DNA, 16 bp, Homo sapiens
gtccaagaagcccagg

SEQ ID NO: 2650059 - DNA, 22 bp, Homo sapiens
gtccaaggaaacttgaatcaaa

SEQ ID NO: 2650060 - DNA, 19 bp, Homo sapiens
gtccaagtgtgtgtgcgtg

SEQ ID NO: 2650061 - DNA, 20 bp, Homo sapiens
gtccacaaaataaccaatcc

SEQ ID NO: 2650062 - DNA, 15 bp, Homo sapiens
gtccacagatgcctc

SEQ ID NO: 2650063 - DNA, 16 bp, Homo sapiens
gtccacagatgcctcc

SEQ ID NO: 2650064 - DNA, 21 bp, Homo sapiens
gtccaccatggggtcctacca

SEQ ID NO: 2650065 - DNA, 15 bp, Homo sapiens
gtccacgactgtctc

SEQ ID NO: 2650066 - DNA, 15 bp, Homo sapiens
gtccacggctctagg

SEQ ID NO: 2650067 - DNA, 16 bp, Homo sapiens
gtccactcccagtgct

SEQ ID NO: 2650068 - DNA, 20 bp, Homo sapiens
gtccactgtcactgtttctc

SEQ ID NO: 2650069 - DNA, 23 bp, Homo sapiens
gtccactgtgtatagaagtagat

SEQ ID NO: 2650070 - DNA, 11 bp, Homo sapiens
gtccagacagc

SEQ ID NO: 2650071 - DNA, 21 bp, Homo sapiens
gtccagaccttgttcacactc

SEQ ID NO: 2650072 - DNA, 22 bp, Homo sapiens
gtccagagagagaagtgcccct

SEQ ID NO: 2650073 - DNA, 17 bp, Homo sapiens
gtccagatttacactgg

SEQ ID NO: 2650074 - DNA, 19 bp, Homo sapiens
gtccagatttacactggga

SEQ ID NO: 2650075 - DNA, 21 bp, Homo sapiens
gtccagatttacactgggaga

SEQ ID NO: 2650076 - DNA, 16 bp, Homo sapiens
gtccagccctggctga

SEQ ID NO: 2650077 - DNA, 18 bp, Homo sapiens
gtccagccctggctgaag

SEQ ID NO: 2650078 - DNA, 20 bp, Homo sapiens
gtccagccctggctgaagga

SEQ ID NO: 2650079 - DNA, 11 bp, Homo sapiens
gtccagcctgg

SEQ ID NO: 2650080 - DNA, 13 bp, Homo sapiens
gtccagggaagag

SEQ ID NO: 2650081 - DNA, 14 bp, Homo sapiens
gtccagggccctga

SEQ ID NO: 2650082 - DNA, 16 bp, Homo sapiens
gtccagggccctgagc

SEQ ID NO: 2650083 - DNA, 20 bp, Homo sapiens
gtccagggccctgagctcgg

SEQ ID NO: 2650084 - DNA, 21 bp, Homo sapiens
gtccaggggcccctccagctt

SEQ ID NO: 2650085 - DNA, 15 bp, Homo sapiens
gtccatggaatgctt

SEQ ID NO: 2650086 - DNA, 14 bp, Homo sapiens
gtccatgggcagag

SEQ ID NO: 2650087 - DNA, 21 bp, Homo sapiens
gtcccaacaggaggacaattc

SEQ ID NO: 2650088 - DNA, 23 bp, Homo sapiens
gtcccaagctgggccccagccca

SEQ ID NO: 2650089 - DNA, 17 bp, Homo sapiens
gtcccacactggtgact

SEQ ID NO: 2650090 - DNA, 19 bp, Homo sapiens
gtcccacccccacccccag

SEQ ID NO: 2650091 - DNA, 21 bp, Homo sapiens
gtcccacccccacccccagct

SEQ ID NO: 2650092 - DNA, 14 bp, Homo sapiens
gtcccacctcttct

SEQ ID NO: 2650093 - DNA, 22 bp, Homo sapiens
gtcccacctcttctcttcctgt

SEQ ID NO: 2650094 - DNA, 23 bp, Homo sapiens
gtcccaccttggctgcagggagt

SEQ ID NO: 2650095 - DNA, 17 bp, Homo sapiens
gtcccactatctgggtg

SEQ ID NO: 2650096 - DNA, 18 bp, Homo sapiens
gtcccactcaagccaagc

SEQ ID NO: 2650097 - DNA, 21 bp, Homo sapiens
gtcccactcaagccaagcagc

SEQ ID NO: 2650098 - DNA, 22 bp, Homo sapiens
gtcccactcaagccaagcagcc

SEQ ID NO: 2650099 - DNA, 18 bp, Homo sapiens
gtcccagagcaggaggcc

SEQ ID NO: 2650100 - DNA, 14 bp, Homo sapiens
gtcccagccacccc

SEQ ID NO: 2650101 - DNA, 15 bp, Homo sapiens
gtcccagccaccccg

SEQ ID NO: 2650102 - DNA, 21 bp, Homo sapiens
gtcccagccaccccgggctct

SEQ ID NO: 2650103 - DNA, 14 bp, Homo sapiens
gtcccagctactcg

SEQ ID NO: 2650104 - DNA, 15 bp, Homo sapiens
gtcccagtgggaggc

SEQ ID NO: 2650105 - DNA, 19 bp, Homo sapiens
gtcccagtgggaggggcag

SEQ ID NO: 2650106 - DNA, 13 bp, Homo sapiens
gtcccatccaggc

SEQ ID NO: 2650107 - DNA, 16 bp, Homo sapiens
gtcccatgacccaccc

SEQ ID NO: 2650108 - DNA, 23 bp, Homo sapiens
gtcccatgacccacccctgtgct

SEQ ID NO: 2650109 - DNA, 18 bp, Homo sapiens
gtccccaaacctgcaagg

SEQ ID NO: 2650110 - DNA, 22 bp, Homo sapiens
gtccccaaatccgaacctcctc

SEQ ID NO: 2650111 - DNA, 12 bp, Homo sapiens
gtccccacactc

SEQ ID NO: 2650112 - DNA, 18 bp, Homo sapiens
gtccccaccgcagacagg

SEQ ID NO: 2650113 - DNA, 15 bp, Homo sapiens
gtccccatcatccca

SEQ ID NO: 2650114 - DNA, 19 bp, Homo sapiens
gtccccatggcaccctgct

SEQ ID NO: 2650115 - DNA, 15 bp, Homo sapiens
gtcccccagctctgg

SEQ ID NO: 2650116 - DNA, 19 bp, Homo sapiens
gtccccctctgtccaggca

SEQ ID NO: 2650117 - DNA, 15 bp, Homo sapiens
gtcccggggctccac

SEQ ID NO: 2650118 - DNA, 16 bp, Homo sapiens
gtcccggggtcctgtg

SEQ ID NO: 2650119 - DNA, 20 bp, Homo sapiens
gtcccggggtcctgtggcag

SEQ ID NO: 2650120 - DNA, 21 bp, Homo sapiens
gtcccgtgcagcttctgtcct

SEQ ID NO: 2650121 - DNA, 16 bp, Homo sapiens
gtccctacacccctcc

SEQ ID NO: 2650122 - DNA, 22 bp, Homo sapiens
gtccctatgtatttgcagttca

SEQ ID NO: 2650123 - DNA, 23 bp, Homo sapiens
gtccctcaaatgacccaaagacc

SEQ ID NO: 2650124 - DNA, 12 bp, Homo sapiens
gtccctcctggg

SEQ ID NO: 2650125 - DNA, 13 bp, Homo sapiens
gtccctcctggga

SEQ ID NO: 2650126 - DNA, 14 bp, Homo sapiens
gtccctcctgggat

SEQ ID NO: 2650127 - DNA, 14 bp, Homo sapiens
gtccctctcaggca

SEQ ID NO: 2650128 - DNA, 21 bp, Homo sapiens
gtccctctcggaaggctggct

SEQ ID NO: 2650129 - DNA, 18 bp, Homo sapiens
gtccctgactctctgtga

SEQ ID NO: 2650130 - DNA, 11 bp, Homo sapiens
gtccctgccaa

SEQ ID NO: 2650131 - DNA, 16 bp, Homo sapiens
gtccctggtggcagct

SEQ ID NO: 2650132 - DNA, 15 bp, Homo sapiens
gtccctgtgcctaac

SEQ ID NO: 2650133 - DNA, 18 bp, Homo sapiens
gtccctgttttctgagcc

SEQ ID NO: 2650134 - DNA, 19 bp, Homo sapiens
gtccctgttttctgagccc

SEQ ID NO: 2650135 - DNA, 20 bp, Homo sapiens
gtccctgttttctgagcccg

SEQ ID NO: 2650136 - DNA, 13 bp, Homo sapiens
gtcccttcccctc

SEQ ID NO: 2650137 - DNA, 22 bp, Homo sapiens
gtcccttcccctccctggctcc

SEQ ID NO: 2650138 - DNA, 15 bp, Homo sapiens
gtccctttcttggcc

SEQ ID NO: 2650139 - DNA, 17 bp, Homo sapiens
gtccctttcttggccag

SEQ ID NO: 2650140 - DNA, 15 bp, Homo sapiens
gtccgatctttgact

SEQ ID NO: 2650141 - DNA, 22 bp, Homo sapiens
gtccgctgggtggtaccctctg

SEQ ID NO: 2650142 - DNA, 16 bp, Homo sapiens
gtcctaactggtatag

SEQ ID NO: 2650143 - DNA, 16 bp, Homo sapiens
gtcctaccaatagatt

SEQ ID NO: 2650144 - DNA, 23 bp, Homo sapiens
gtcctactctgtgtcaggtgggg

SEQ ID NO: 2650145 - DNA, 23 bp, Homo sapiens
gtcctagaaattccccaccctga

SEQ ID NO: 2650146 - DNA, 23 bp, Homo sapiens
gtcctagcttgggaggcttcccc

SEQ ID NO: 2650147 - DNA, 16 bp, Homo sapiens
gtcctcactcccagtc

SEQ ID NO: 2650148 - DNA, 14 bp, Homo sapiens
gtcctccagaagcc

SEQ ID NO: 2650149 - DNA, 16 bp, Homo sapiens
gtcctcccatcccctg

SEQ ID NO: 2650150 - DNA, 13 bp, Homo sapiens
gtcctcccatctc

SEQ ID NO: 2650151 - DNA, 15 bp, Homo sapiens
gtcctccccttgggc

SEQ ID NO: 2650152 - DNA, 12 bp, Homo sapiens
gtcctcccgggc

SEQ ID NO: 2650153 - DNA, 21 bp, Homo sapiens
gtcctcccgggccctcccttg

SEQ ID NO: 2650154 - DNA, 13 bp, Homo sapiens
gtcctcctctgtg

SEQ ID NO: 2650155 - DNA, 14 bp, Homo sapiens
gtcctcctctgtga

SEQ ID NO: 2650156 - DNA, 14 bp, Homo sapiens
gtcctcttttctga

SEQ ID NO: 2650157 - DNA, 16 bp, Homo sapiens
gtcctgaagaggcggg

SEQ ID NO: 2650158 - DNA, 12 bp, Homo sapiens
gtcctgaccacc

SEQ ID NO: 2650159 - DNA, 13 bp, Homo sapiens
gtcctgaccaccc

SEQ ID NO: 2650160 - DNA, 15 bp, Homo sapiens
gtggactggcccctg

SEQ ID NO: 2650161 - DNA, 20 bp, Homo sapiens
gtggagaaagcactgacctg

SEQ ID NO: 2650162 - DNA, 16 bp, Homo sapiens
gtggagactgcttccc

SEQ ID NO: 2650163 - DNA, 18 bp, Homo sapiens
gtggagactgcttcccat

SEQ ID NO: 2650164 - DNA, 15 bp, Homo sapiens
gtggagatgtcttcg

SEQ ID NO: 2650165 - DNA, 17 bp, Homo sapiens
gtggagatgtcttcgta

SEQ ID NO: 2650166 - DNA, 14 bp, Homo sapiens
gtggagccccacac

SEQ ID NO: 2650167 - DNA, 16 bp, Homo sapiens
gtggaggaaggattgt

SEQ ID NO: 2650168 - DNA, 23 bp, Homo sapiens
gtggaggaatgctcccccatcct

SEQ ID NO: 2650169 - DNA, 17 bp, Homo sapiens
gtggaggagcagtgcag

SEQ ID NO: 2650170 - DNA, 23 bp, Homo sapiens
gtggaggagctcaggacactaat

SEQ ID NO: 2650171 - DNA, 17 bp, Homo sapiens
gtggaggagtccaggcc

SEQ ID NO: 2650172 - DNA, 16 bp, Homo sapiens
gtggaggctgcagtga

SEQ ID NO: 2650173 - DNA, 17 bp, Homo sapiens
gtggaggtgtcaggctg

SEQ ID NO: 2650174 - DNA, 21 bp, Homo sapiens
gtggaggttaaggctgaggaa

SEQ ID NO: 2650175 - DNA, 20 bp, Homo sapiens
gtggagtcccttttgcatca

SEQ ID NO: 2650176 - DNA, 13 bp, Homo sapiens
gtggatcacctga

SEQ ID NO: 2650177 - DNA, 19 bp, Homo sapiens
gtggatctccaaggaccag

SEQ ID NO: 2650178 - DNA, 17 bp, Homo sapiens
gtggatctgtccaagga

SEQ ID NO: 2650179 - DNA, 18 bp, Homo sapiens
gtggatctgtccaaggaa

SEQ ID NO: 2650180 - DNA, 19 bp, Homo sapiens
gtggatgtcttccttggag

SEQ ID NO: 2650181 - DNA, 18 bp, Homo sapiens
gtggatttaacagaaatg

SEQ ID NO: 2650182 - DNA, 22 bp, Homo sapiens
gtggcaaagccttcattgcctt

SEQ ID NO: 2650183 - DNA, 21 bp, Homo sapiens
gtggcaagctgtgacttctcc

SEQ ID NO: 2650184 - DNA, 13 bp, Homo sapiens
gtggcaaggctgt

SEQ ID NO: 2650185 - DNA, 22 bp, Homo sapiens
gtggcacacacctgtagtccca

SEQ ID NO: 2650186 - DNA, 16 bp, Homo sapiens
gtggcacaggccccct

SEQ ID NO: 2650187 - DNA, 13 bp, Homo sapiens
gtggcaccagcag

SEQ ID NO: 2650188 - DNA, 14 bp, Homo sapiens
gtggcaccagcagc

SEQ ID NO: 2650189 - DNA, 18 bp, Homo sapiens
gtggcaccagcagcctgg

SEQ ID NO: 2650190 - DNA, 19 bp, Homo sapiens
gtggcaccagcagcctgga

SEQ ID NO: 2650191 - DNA, 14 bp, Homo sapiens
gtggcactgagccc

SEQ ID NO: 2650192 - DNA, 15 bp, Homo sapiens
gtggcactgagcccc

SEQ ID NO: 2650193 - DNA, 16 bp, Homo sapiens
gtggcactgagccccc

SEQ ID NO: 2650194 - DNA, 19 bp, Homo sapiens
gtggcactttttcatttgc

SEQ ID NO: 2650195 - DNA, 15 bp, Homo sapiens
gtggcagagcttgga

SEQ ID NO: 2650196 - DNA, 16 bp, Homo sapiens
gtggcagctcacctct

SEQ ID NO: 2650197 - DNA, 20 bp, Homo sapiens
gtggcagctcacctctccct

SEQ ID NO: 2650198 - DNA, 22 bp, Homo sapiens
gtggcagctcacctctcccttg

SEQ ID NO: 2650199 - DNA, 21 bp, Homo sapiens
gtggcagctgcggtccaccca

SEQ ID NO: 2650200 - DNA, 19 bp, Homo sapiens
gtggcagctgcttttgtct

SEQ ID NO: 2650201 - DNA, 17 bp, Homo sapiens
gtggcaggaccaggact

SEQ ID NO: 2650202 - DNA, 12 bp, Homo sapiens
gtggcaggcagc

SEQ ID NO: 2650203 - DNA, 19 bp, Homo sapiens
gtggcaggcagcgccaagc

SEQ ID NO: 2650204 - DNA, 22 bp, Homo sapiens
gtggcatcaccttaggcaggga

SEQ ID NO: 2650205 - DNA, 16 bp, Homo sapiens
gtggcatcccagtggc

SEQ ID NO: 2650206 - DNA, 20 bp, Homo sapiens
gtggcatctttgccttgggc

SEQ ID NO: 2650207 - DNA, 13 bp, Homo sapiens
gtggcatggccac

SEQ ID NO: 2650208 - DNA, 14 bp, Homo sapiens
gtggcatgtggcct

SEQ ID NO: 2650209 - DNA, 14 bp, Homo sapiens
gtggccactcagct

SEQ ID NO: 2650210 - DNA, 13 bp, Homo sapiens
gtggccagcccgg

SEQ ID NO: 2650211 - DNA, 14 bp, Homo sapiens
gtggccagcccggc

SEQ ID NO: 2650212 - DNA, 14 bp, Homo sapiens
gtggccagcctgga

SEQ ID NO: 2650213 - DNA, 15 bp, Homo sapiens
gtggccagcctggat

SEQ ID NO: 2650214 - DNA, 23 bp, Homo sapiens
gtggccatttagccaccatcttt

SEQ ID NO: 2650215 - DNA, 13 bp, Homo sapiens
gtggcctcccaac

SEQ ID NO: 2650216 - DNA, 14 bp, Homo sapiens
gtggcctcccaact

SEQ ID NO: 2650217 - DNA, 15 bp, Homo sapiens
gtggcctcccaactc

SEQ ID NO: 2650218 - DNA, 23 bp, Homo sapiens
gtggcctctccttgtggcctggg

SEQ ID NO: 2650219 - DNA, 13 bp, Homo sapiens
gtggcctctttgt

SEQ ID NO: 2650220 - DNA, 12 bp, Homo sapiens
gtggcctggcca

SEQ ID NO: 2650221 - DNA, 15 bp, Homo sapiens
gtggcctgtggcctg

SEQ ID NO: 2650222 - DNA, 19 bp, Homo sapiens
gtggcctgtgtcccatgac

SEQ ID NO: 2650223 - DNA, 15 bp, Homo sapiens
gtggccttccccagc

SEQ ID NO: 2650224 - DNA, 20 bp, Homo sapiens
gtggcgactctatagactct

SEQ ID NO: 2650225 - DNA, 14 bp, Homo sapiens
gtggctcacgcctg

SEQ ID NO: 2650226 - DNA, 23 bp, Homo sapiens
gtggctcacgcctgtaatcccag

SEQ ID NO: 2650227 - DNA, 17 bp, Homo sapiens
gtggctgaggaggcctc

SEQ ID NO: 2650228 - DNA, 17 bp, Homo sapiens
gtggctgctagcacttg

SEQ ID NO: 2650229 - DNA, 15 bp, Homo sapiens
gtggctgctgcccag

SEQ ID NO: 2650230 - DNA, 17 bp, Homo sapiens
gtggctggatctgtgag

SEQ ID NO: 2650231 - DNA, 17 bp, Homo sapiens
gtggctgggggcaggag

SEQ ID NO: 2650232 - DNA, 21 bp, Homo sapiens
gtggctgggtccaggggatgg

SEQ ID NO: 2650233 - DNA, 19 bp, Homo sapiens
gtggctgggttggagggtg

SEQ ID NO: 2650234 - DNA, 18 bp, Homo sapiens
gtggctgggtttacacgc

SEQ ID NO: 2650235 - DNA, 15 bp, Homo sapiens
gtggctgtcagcagg

SEQ ID NO: 2650236 - DNA, 19 bp, Homo sapiens
gtggctgtcagcaggaagc

SEQ ID NO: 2650237 - DNA, 12 bp, Homo sapiens
gtgggaaaacac

SEQ ID NO: 2650238 - DNA, 23 bp, Homo sapiens
gtgggaacgactgggcactgcca

SEQ ID NO: 2650239 - DNA, 14 bp, Homo sapiens
gtgggaaggccagc

SEQ ID NO: 2650240 - DNA, 15 bp, Homo sapiens
gtgggacaccctgtg

SEQ ID NO: 2650241 - DNA, 13 bp, Homo sapiens
gtgggagagccca

SEQ ID NO: 2650242 - DNA, 14 bp, Homo sapiens
gtgggagagcccag

SEQ ID NO: 2650243 - DNA, 14 bp, Homo sapiens
gtgggagctgcctg

SEQ ID NO: 2650244 - DNA, 14 bp, Homo sapiens
gtgggaggggcagg

SEQ ID NO: 2650245 - DNA, 17 bp, Homo sapiens
gtgggaggggcaggctg

SEQ ID NO: 2650246 - DNA, 13 bp, Homo sapiens
gtgggagtgggcc

SEQ ID NO: 2650247 - DNA, 18 bp, Homo sapiens
gtgggatcctccaggtgc

SEQ ID NO: 2650248 - DNA, 18 bp, Homo sapiens
gtgggatctgcccctccc

SEQ ID NO: 2650249 - DNA, 16 bp, Homo sapiens
gtgggcacccaccctg

SEQ ID NO: 2650250 - DNA, 20 bp, Homo sapiens
gtgggcattgatggggaagg

SEQ ID NO: 2650251 - DNA, 13 bp, Homo sapiens
gtgggccagcccc

SEQ ID NO: 2650252 - DNA, 15 bp, Homo sapiens
gtgggccagcccctc

SEQ ID NO: 2650253 - DNA, 22 bp, Homo sapiens
gtgggcccaggaccagctgggg

SEQ ID NO: 2650254 - DNA, 22 bp, Homo sapiens
gtgggcctctggtttggggcga

SEQ ID NO: 2650255 - DNA, 18 bp, Homo sapiens
gtgggccttgctggggac

SEQ ID NO: 2650256 - DNA, 20 bp, Homo sapiens
gtgggccttgtcccctgcct

SEQ ID NO: 2650257 - DNA, 13 bp, Homo sapiens
gtgggctccctga

SEQ ID NO: 2650258 - DNA, 18 bp, Homo sapiens
gtgggctgagccctggca

SEQ ID NO: 2650259 - DNA, 14 bp, Homo sapiens
gtgggctgtgagtg

SEQ ID NO: 2650260 - DNA, 13 bp, Homo sapiens
gtggggacagggc

SEQ ID NO: 2650261 - DNA, 13 bp, Homo sapiens
gtggggaggggcg

SEQ ID NO: 2650262 - DNA, 18 bp, Homo sapiens
gtggggatctcaggggct

SEQ ID NO: 2650263 - DNA, 13 bp, Homo sapiens
gtggggcagcttg

SEQ ID NO: 2650264 - DNA, 13 bp, Homo sapiens
gtggggccttggt

SEQ ID NO: 2650265 - DNA, 20 bp, Homo sapiens
gtggggctggtagctcaggt

SEQ ID NO: 2650266 - DNA, 20 bp, Homo sapiens
gtgggggatcacagcctctg

SEQ ID NO: 2650267 - DNA, 19 bp, Homo sapiens
gtgggggtagagctgatcc

SEQ ID NO: 2650268 - DNA, 19 bp, Homo sapiens
gtggggtaggttgggagaa

SEQ ID NO: 2650269 - DNA, 21 bp, Homo sapiens
gtggggtcactctggcagctc

SEQ ID NO: 2650270 - DNA, 17 bp, Homo sapiens
gtgggtactattctgat

SEQ ID NO: 2650271 - DNA, 14 bp, Homo sapiens
gtgggtcaaggaat

SEQ ID NO: 2650272 - DNA, 16 bp, Homo sapiens
gtgggtccaggggccc

SEQ ID NO: 2650273 - DNA, 23 bp, Homo sapiens
gtgggtccaggggcccctccagc

SEQ ID NO: 2650274 - DNA, 20 bp, Homo sapiens
gtggtacacacagattactg

SEQ ID NO: 2650275 - DNA, 15 bp, Homo sapiens
gtggtatgtgtgtgt

SEQ ID NO: 2650276 - DNA, 22 bp, Homo sapiens
gtggtcaaaccgcactcaccca

SEQ ID NO: 2650277 - DNA, 14 bp, Homo sapiens
gtggtcccacccca

SEQ ID NO: 2650278 - DNA, 16 bp, Homo sapiens
gtggtcccaccccaca

SEQ ID NO: 2650279 - DNA, 14 bp, Homo sapiens
gtggtctgaatgtt

SEQ ID NO: 2650280 - DNA, 17 bp, Homo sapiens
gtggtctgaatgttctg

SEQ ID NO: 2650281 - DNA, 20 bp, Homo sapiens
gtggtctgaatgttctgaca

SEQ ID NO: 2650282 - DNA, 16 bp, Homo sapiens
gtggtctgcaggcagg

SEQ ID NO: 2650283 - DNA, 19 bp, Homo sapiens
gtggtgatcaattaaatgt

SEQ ID NO: 2650284 - DNA, 19 bp, Homo sapiens
gtggtgcgatctgggttca

SEQ ID NO: 2650285 - DNA, 23 bp, Homo sapiens
gtggtggcagggcctagctgcta

SEQ ID NO: 2650286 - DNA, 14 bp, Homo sapiens
gtggtggttttctg

SEQ ID NO: 2650287 - DNA, 23 bp, Homo sapiens
gtggtgtgtccccctctgtccag

SEQ ID NO: 2650288 - DNA, 16 bp, Homo sapiens
gtggtgtttcctggca

SEQ ID NO: 2650289 - DNA, 23 bp, Homo sapiens
gtggttaatgccatggacagaag

SEQ ID NO: 2650290 - DNA, 14 bp, Homo sapiens
gtggttatttctca

SEQ ID NO: 2650291 - DNA, 16 bp, Homo sapiens
gtggtttggtgtgttc

SEQ ID NO: 2650292 - DNA, 19 bp, Homo sapiens
gtggttttcccctccctgg

SEQ ID NO: 2650293 - DNA, 21 bp, Homo sapiens
gtggttttcccctccctgggt

SEQ ID NO: 2650294 - DNA, 17 bp, Homo sapiens
gtggttttctgttcttt

SEQ ID NO: 2650295 - DNA, 19 bp, Homo sapiens
gtgtaaaatattttgaatc

SEQ ID NO: 2650296 - DNA, 21 bp, Homo sapiens
gtgtaaagcattccaacaaag

SEQ ID NO: 2650297 - DNA, 16 bp, Homo sapiens
gtgtaaagttagtcta

SEQ ID NO: 2650298 - DNA, 19 bp, Homo sapiens
gtgtaaatagttactccag

SEQ ID NO: 2650299 - DNA, 15 bp, Homo sapiens
gtgtaacagctgagg

SEQ ID NO: 2650300 - DNA, 21 bp, Homo sapiens
gtgtaacagctgaggtctctt

SEQ ID NO: 2650301 - DNA, 19 bp, Homo sapiens
gtgtaacaggtctcctctt

SEQ ID NO: 2650302 - DNA, 18 bp, Homo sapiens
gtgtaactggcagttttc

SEQ ID NO: 2650303 - DNA, 13 bp, Homo sapiens
gtgtaataagaca

SEQ ID NO: 2650304 - DNA, 14 bp, Homo sapiens
gtgtaataagacat

SEQ ID NO: 2650305 - DNA, 17 bp, Homo sapiens
gtttctgtgcatggtgg

SEQ ID NO: 2650306 - DNA, 14 bp, Homo sapiens
gtttctgttctgtg

SEQ ID NO: 2650307 - DNA, 22 bp, Homo sapiens
gtttctgttctgtggaaagtgt

SEQ ID NO: 2650308 - DNA, 20 bp, Homo sapiens
gtttcttcaacaggagaatt

SEQ ID NO: 2650309 - DNA, 11 bp, Homo sapiens
gtttcttccaa

SEQ ID NO: 2650310 - DNA, 21 bp, Homo sapiens
gtttctttcctgccttcttct

SEQ ID NO: 2650311 - DNA, 18 bp, Homo sapiens
gtttctttctagtggtct

SEQ ID NO: 2650312 - DNA, 23 bp, Homo sapiens
gtttctttctagtggtctttgta

SEQ ID NO: 2650313 - DNA, 15 bp, Homo sapiens
gtttgaaacaaagaa

SEQ ID NO: 2650314 - DNA, 17 bp, Homo sapiens
gtttgaatataaacact

SEQ ID NO: 2650315 - DNA, 19 bp, Homo sapiens
gtttgattaaattcttgca

SEQ ID NO: 2650316 - DNA, 23 bp, Homo sapiens
gtttgattaaattcttgcaaagt

SEQ ID NO: 2650317 - DNA, 21 bp, Homo sapiens
gtttgattcagacagctgcct

SEQ ID NO: 2650318 - DNA, 13 bp, Homo sapiens
gtttgcaaggaag

SEQ ID NO: 2650319 - DNA, 22 bp, Homo sapiens
gtttgcaaggaagccacagctg

SEQ ID NO: 2650320 - DNA, 14 bp, Homo sapiens
gtttgcataggtga

SEQ ID NO: 2650321 - DNA, 20 bp, Homo sapiens
gtttgccactttgcaaagga

SEQ ID NO: 2650322 - DNA, 16 bp, Homo sapiens
gtttgcctctgcctct

SEQ ID NO: 2650323 - DNA, 17 bp, Homo sapiens
gtttgcctctgcctctg

SEQ ID NO: 2650324 - DNA, 14 bp, Homo sapiens
gtttgcctgagggc

SEQ ID NO: 2650325 - DNA, 17 bp, Homo sapiens
gtttgctcacctggggt

SEQ ID NO: 2650326 - DNA, 18 bp, Homo sapiens
gtttgctgttgatttctt

SEQ ID NO: 2650327 - DNA, 14 bp, Homo sapiens
gtttgcttattgtt

SEQ ID NO: 2650328 - DNA, 16 bp, Homo sapiens
gtttgcttcataaatg

SEQ ID NO: 2650329 - DNA, 21 bp, Homo sapiens
gtttggaggagcaaaggctga

SEQ ID NO: 2650330 - DNA, 18 bp, Homo sapiens
gtttggattcttatgtag

SEQ ID NO: 2650331 - DNA, 20 bp, Homo sapiens
gtttggattcttatgtagca

SEQ ID NO: 2650332 - DNA, 15 bp, Homo sapiens
gtttggcaatagttt

SEQ ID NO: 2650333 - DNA, 17 bp, Homo sapiens
gtttggcaatagtttgc

SEQ ID NO: 2650334 - DNA, 19 bp, Homo sapiens
gtttggcaatagtttgcat

SEQ ID NO: 2650335 - DNA, 15 bp, Homo sapiens
gtttggccatctctg

SEQ ID NO: 2650336 - DNA, 16 bp, Homo sapiens
gtttggcgggccaagg

SEQ ID NO: 2650337 - DNA, 18 bp, Homo sapiens
gtttggcgggccaaggac

SEQ ID NO: 2650338 - DNA, 17 bp, Homo sapiens
gtttggggcgaggcaga

SEQ ID NO: 2650339 - DNA, 22 bp, Homo sapiens
gtttggtgggggtagagctgat

SEQ ID NO: 2650340 - DNA, 13 bp, Homo sapiens
gtttgtaaaacta

SEQ ID NO: 2650341 - DNA, 17 bp, Homo sapiens
gtttgtaaattaacttt

SEQ ID NO: 2650342 - DNA, 15 bp, Homo sapiens
gtttgtataacttct

SEQ ID NO: 2650343 - DNA, 16 bp, Homo sapiens
gtttgtataacttctt

SEQ ID NO: 2650344 - DNA, 13 bp, Homo sapiens
gtttgtatgtgtg

SEQ ID NO: 2650345 - DNA, 17 bp, Homo sapiens
gtttgtcacatgaaaca

SEQ ID NO: 2650346 - DNA, 17 bp, Homo sapiens
gtttgtcttctccccag

SEQ ID NO: 2650347 - DNA, 19 bp, Homo sapiens
gtttgtggaaaatgaaaat

SEQ ID NO: 2650348 - DNA, 12 bp, Homo sapiens
gtttgtggcctc

SEQ ID NO: 2650349 - DNA, 14 bp, Homo sapiens
gtttgtggcctcag

SEQ ID NO: 2650350 - DNA, 19 bp, Homo sapiens
gtttgttggatcttcaatg

SEQ ID NO: 2650351 - DNA, 19 bp, Homo sapiens
gtttgtttctccccctggg

SEQ ID NO: 2650352 - DNA, 20 bp, Homo sapiens
gtttgtttctccccctgggc

SEQ ID NO: 2650353 - DNA, 18 bp, Homo sapiens
gtttgtttctgaaaggga

SEQ ID NO: 2650354 - DNA, 21 bp, Homo sapiens
gttttaaaataaaaattctga

SEQ ID NO: 2650355 - DNA, 12 bp, Homo sapiens
gttttaaaatta

SEQ ID NO: 2650356 - DNA, 22 bp, Homo sapiens
gttttaaatacgcactacatgt

SEQ ID NO: 2650357 - DNA, 18 bp, Homo sapiens
gttttaagttgtttgcat

SEQ ID NO: 2650358 - DNA, 20 bp, Homo sapiens
gttttaattccaatatgatg

SEQ ID NO: 2650359 - DNA, 23 bp, Homo sapiens
gttttaattccaatatgatgact

SEQ ID NO: 2650360 - DNA, 16 bp, Homo sapiens
gttttaattccatgaa

SEQ ID NO: 2650361 - DNA, 22 bp, Homo sapiens
gttttaattccatgaatcgctt

SEQ ID NO: 2650362 - DNA, 21 bp, Homo sapiens
gttttaatttaaacacctcct

SEQ ID NO: 2650363 - DNA, 23 bp, Homo sapiens
gttttacaataaaatcttgaaaa

SEQ ID NO: 2650364 - DNA, 15 bp, Homo sapiens
gttttactgcagctt

SEQ ID NO: 2650365 - DNA, 14 bp, Homo sapiens
gttttactgtgaaa

SEQ ID NO: 2650366 - DNA, 13 bp, Homo sapiens
gttttagaaaaca

SEQ ID NO: 2650367 - DNA, 22 bp, Homo sapiens
gttttagacaaatactcatgtg

SEQ ID NO: 2650368 - DNA, 23 bp, Homo sapiens
gttttagacaaatactcatgtgt

SEQ ID NO: 2650369 - DNA, 21 bp, Homo sapiens
gttttagttgcagaaacattt

SEQ ID NO: 2650370 - DNA, 18 bp, Homo sapiens
gttttatcacatgtatgt

SEQ ID NO: 2650371 - DNA, 14 bp, Homo sapiens
gttttatcatgaca

SEQ ID NO: 2650372 - DNA, 18 bp, Homo sapiens
gttttatgacttcattaa

SEQ ID NO: 2650373 - DNA, 12 bp, Homo sapiens
gttttcactctt

SEQ ID NO: 2650374 - DNA, 21 bp, Homo sapiens
gttttcagaacctcttcccca

SEQ ID NO: 2650375 - DNA, 17 bp, Homo sapiens
gttttcagtgtacatgg

SEQ ID NO: 2650376 - DNA, 22 bp, Homo sapiens
gttttcatggtgaaaatgtact

SEQ ID NO: 2650377 - DNA, 14 bp, Homo sapiens
gttttccaccctgg

SEQ ID NO: 2650378 - DNA, 16 bp, Homo sapiens
gttttccaccctggaa

SEQ ID NO: 2650379 - DNA, 18 bp, Homo sapiens
gttttccatgaaaacgtt

SEQ ID NO: 2650380 - DNA, 17 bp, Homo sapiens
gttttccattgtttgaa

SEQ ID NO: 2650381 - DNA, 17 bp, Homo sapiens
gttttcccctccctggg

SEQ ID NO: 2650382 - DNA, 17 bp, Homo sapiens
gttttcctttctcaccg

SEQ ID NO: 2650383 - DNA, 17 bp, Homo sapiens
gttttcgaagctcagcc

SEQ ID NO: 2650384 - DNA, 23 bp, Homo sapiens
gttttcgcacctaccatcaggga

SEQ ID NO: 2650385 - DNA, 16 bp, Homo sapiens
gttttctcctcccagg

SEQ ID NO: 2650386 - DNA, 18 bp, Homo sapiens
gttttctcctcccaggaa

SEQ ID NO: 2650387 - DNA, 12 bp, Homo sapiens
gttttctcttga

SEQ ID NO: 2650388 - DNA, 13 bp, Homo sapiens
gttttctgagccc

SEQ ID NO: 2650389 - DNA, 17 bp, Homo sapiens
gttttctggctggagcc

SEQ ID NO: 2650390 - DNA, 14 bp, Homo sapiens
gttttctttgaatg

SEQ ID NO: 2650391 - DNA, 15 bp, Homo sapiens
gttttgaaaagctat

SEQ ID NO: 2650392 - DNA, 13 bp, Homo sapiens
gttttgaaatgct

SEQ ID NO: 2650393 - DNA, 17 bp, Homo sapiens
gttttgaactaataaaa

SEQ ID NO: 2650394 - DNA, 18 bp, Homo sapiens
gttttgaatggtgttgta

SEQ ID NO: 2650395 - DNA, 17 bp, Homo sapiens
gttttgacatttttagt

SEQ ID NO: 2650396 - DNA, 16 bp, Homo sapiens
gttttgacggatgatt

SEQ ID NO: 2650397 - DNA, 23 bp, Homo sapiens
gttttgaggtttccttcagacag

SEQ ID NO: 2650398 - DNA, 20 bp, Homo sapiens
gttttgatttaatgttttca

SEQ ID NO: 2650399 - DNA, 20 bp, Homo sapiens
gttttgccatgttggccagg

SEQ ID NO: 2650400 - DNA, 15 bp, Homo sapiens
gttttgtattctctg

SEQ ID NO: 2650401 - DNA, 17 bp, Homo sapiens
gttttgtcaaactgtag

SEQ ID NO: 2650402 - DNA, 14 bp, Homo sapiens
gttttgtcttgaat

SEQ ID NO: 2650403 - DNA, 24 bp, Homo sapiens
gttttgtgactatatagagatgtt

SEQ ID NO: 2650404 - DNA, 19 bp, Homo sapiens
gttttgtggaggagctcag

SEQ ID NO: 2650405 - DNA, 15 bp, Homo sapiens
gtttttaaaagtttc

SEQ ID NO: 2650406 - DNA, 18 bp, Homo sapiens
gtttttaaaagtttcaat

SEQ ID NO: 2650407 - DNA, 15 bp, Homo sapiens
gtttttaactcaata

SEQ ID NO: 2650408 - DNA, 21 bp, Homo sapiens
gtttttatgaagaaaaaatac

SEQ ID NO: 2650409 - DNA, 19 bp, Homo sapiens
gtttttatggcttttgtgc

SEQ ID NO: 2650410 - DNA, 23 bp, Homo sapiens
gtttttatggcttttgtgcatta

SEQ ID NO: 2650411 - DNA, 13 bp, Homo sapiens
gtttttcaattaa

SEQ ID NO: 2650412 - DNA, 16 bp, Homo sapiens
gtttttcaattaaacg

SEQ ID NO: 2650413 - DNA, 17 bp, Homo sapiens
gtttttcaattaaacgg

SEQ ID NO: 2650414 - DNA, 12 bp, Homo sapiens
gtttttcagttt

SEQ ID NO: 2650415 - DNA, 15 bp, Homo sapiens
gtttttccactactg

SEQ ID NO: 2650416 - DNA, 19 bp, Homo sapiens
gtttttccttgtatttaaa

SEQ ID NO: 2650417 - DNA, 14 bp, Homo sapiens
gtttttcctttaaa

SEQ ID NO: 2650418 - DNA, 15 bp, Homo sapiens
gtttttcctttaaaa

SEQ ID NO: 2650419 - DNA, 22 bp, Homo sapiens
gtttttcttcaacatcaatgtt

SEQ ID NO: 2650420 - DNA, 14 bp, Homo sapiens
gtttttgtactgta

SEQ ID NO: 2650421 - DNA, 14 bp, Homo sapiens
gttttttcctgagc

SEQ ID NO: 2650422 - DNA, 19 bp, Homo sapiens
taaaaaaaaaaaagttata

SEQ ID NO: 2650423 - DNA, 22 bp, Homo sapiens
taaaaaaaaaggcatattgctt

SEQ ID NO: 2650424 - DNA, 16 bp, Homo sapiens
taaaaaaaagaaaaaa

SEQ ID NO: 2650425 - DNA, 15 bp, Homo sapiens
taaaaaaatttaagt

SEQ ID NO: 2650426 - DNA, 17 bp, Homo sapiens
taaaaaaatttaagtgc

SEQ ID NO: 2650427 - DNA, 15 bp, Homo sapiens
taaaaaatggaaaga

SEQ ID NO: 2650428 - DNA, 16 bp, Homo sapiens
taaaaacagcattgct

SEQ ID NO: 2650429 - DNA, 20 bp, Homo sapiens
taaaaagattgaagtatttt

SEQ ID NO: 2650430 - DNA, 17 bp, Homo sapiens
taaaaagtcttcactct

SEQ ID NO: 2650431 - DNA, 17 bp, Homo sapiens
taaaaagtgacacagca

SEQ ID NO: 2650432 - DNA, 15 bp, Homo sapiens
taaaaagtggaaaaa

SEQ ID NO: 2650433 - DNA, 15 bp, Homo sapiens
taaaaagttaaaaag

SEQ ID NO: 2650434 - DNA, 17 bp, Homo sapiens
taaaaagttaaaaagtt

SEQ ID NO: 2650435 - DNA, 19 bp, Homo sapiens
taaaaatatggaacttcta

SEQ ID NO: 2650436 - DNA, 15 bp, Homo sapiens
taaaaatatgtacaa

SEQ ID NO: 2650437 - DNA, 16 bp, Homo sapiens
taaaaatctcaaattt

SEQ ID NO: 2650438 - DNA, 18 bp, Homo sapiens
taaaaatggtttaaatgg

SEQ ID NO: 2650439 - DNA, 13 bp, Homo sapiens
taaaaatgtaaat

SEQ ID NO: 2650440 - DNA, 18 bp, Homo sapiens
taaaaatgtaaatattct

SEQ ID NO: 2650441 - DNA, 15 bp, Homo sapiens
taaaaattctgaatg

SEQ ID NO: 2650442 - DNA, 18 bp, Homo sapiens
taaaacaatattgtttct

SEQ ID NO: 2650443 - DNA, 15 bp, Homo sapiens
taaaacagacactgg

SEQ ID NO: 2650444 - DNA, 18 bp, Homo sapiens
taaaacattttcacacaa

SEQ ID NO: 2650445 - DNA, 13 bp, Homo sapiens
taaaaccacagca

SEQ ID NO: 2650446 - DNA, 21 bp, Homo sapiens
taaaaccccagccaactcatt

SEQ ID NO: 2650447 - DNA, 18 bp, Homo sapiens
taaaacctgagctagaag

SEQ ID NO: 2650448 - DNA, 16 bp, Homo sapiens
taaaacctgtcaatga

SEQ ID NO: 2650449 - DNA, 11 bp, Homo sapiens
taaaacctttc

SEQ ID NO: 2650450 - DNA, 18 bp, Homo sapiens
taaccccgggcgggtggc

SEQ ID NO: 2650451 - DNA, 17 bp, Homo sapiens
taacccttatcaccagc

SEQ ID NO: 2650452 - DNA, 20 bp, Homo sapiens
taaccgtcctcgagcaactg

SEQ ID NO: 2650453 - DNA, 22 bp, Homo sapiens
taacctatatgatttatagttt

SEQ ID NO: 2650454 - DNA, 22 bp, Homo sapiens
taacctattttgaaaaattcct

SEQ ID NO: 2650455 - DNA, 13 bp, Homo sapiens
taacctcagctct

SEQ ID NO: 2650456 - DNA, 18 bp, Homo sapiens
taacctcatcttcttcac

SEQ ID NO: 2650457 - DNA, 17 bp, Homo sapiens
taacctcttcagaggcc

SEQ ID NO: 2650458 - DNA, 12 bp, Homo sapiens
taacctggtgct

SEQ ID NO: 2650459 - DNA, 22 bp, Homo sapiens
taacctggtgctggatattttc

SEQ ID NO: 2650460 - DNA, 23 bp, Homo sapiens
taacgacttcagggcagggctct

SEQ ID NO: 2650461 - DNA, 13 bp, Homo sapiens
taacggctccagg

SEQ ID NO: 2650462 - DNA, 18 bp, Homo sapiens
taacggctccaggatttt

SEQ ID NO: 2650463 - DNA, 16 bp, Homo sapiens
taacgttgagcccctg

SEQ ID NO: 2650464 - DNA, 14 bp, Homo sapiens
taacgttgctgtgg

SEQ ID NO: 2650465 - DNA, 17 bp, Homo sapiens
taacgttgctgtgggaa

SEQ ID NO: 2650466 - DNA, 19 bp, Homo sapiens
taacgtttttcctttaaaa

SEQ ID NO: 2650467 - DNA, 23 bp, Homo sapiens
taactaatatgggcattgtagtt

SEQ ID NO: 2650468 - DNA, 19 bp, Homo sapiens
taactaatctattgggttc

SEQ ID NO: 2650469 - DNA, 15 bp, Homo sapiens
taactactgtgttcc

SEQ ID NO: 2650470 - DNA, 16 bp, Homo sapiens
taactactgtgttcct

SEQ ID NO: 2650471 - DNA, 18 bp, Homo sapiens
taactagaatttattcaa

SEQ ID NO: 2650472 - DNA, 21 bp, Homo sapiens
taactagagcagccctggagt

SEQ ID NO: 2650473 - DNA, 17 bp, Homo sapiens
taactagtgttgcttgg

SEQ ID NO: 2650474 - DNA, 16 bp, Homo sapiens
taactatgttgataaa

SEQ ID NO: 2650475 - DNA, 14 bp, Homo sapiens
taactcaatatttt

SEQ ID NO: 2650476 - DNA, 16 bp, Homo sapiens
taactcacctaactca

SEQ ID NO: 2650477 - DNA, 14 bp, Homo sapiens
taactcagatcact

SEQ ID NO: 2650478 - DNA, 23 bp, Homo sapiens
taactcagatcactactgcagtc

SEQ ID NO: 2650479 - DNA, 23 bp, Homo sapiens
taactcatactgtgctggagcca

SEQ ID NO: 2650480 - DNA, 11 bp, Homo sapiens
taactctgtct

SEQ ID NO: 2650481 - DNA, 14 bp, Homo sapiens
taactcttgtctat

SEQ ID NO: 2650482 - DNA, 18 bp, Homo sapiens
taactggagccccatcag

SEQ ID NO: 2650483 - DNA, 24 bp, Homo sapiens
taactggcagttttccattggttt

SEQ ID NO: 2650484 - DNA, 21 bp, Homo sapiens
taactgttatttataatcact

SEQ ID NO: 2650485 - DNA, 21 bp, Homo sapiens
taacttaaaaatgtaaatatt

SEQ ID NO: 2650486 - DNA, 23 bp, Homo sapiens
taacttaaaaatgtaaatattct

SEQ ID NO: 2650487 - DNA, 22 bp, Homo sapiens
taacttaaaagaacatgtatat

SEQ ID NO: 2650488 - DNA, 16 bp, Homo sapiens
taacttaatagtattt

SEQ ID NO: 2650489 - DNA, 17 bp, Homo sapiens
taacttatattgtaaga

SEQ ID NO: 2650490 - DNA, 21 bp, Homo sapiens
taacttatattgtaagaaata

SEQ ID NO: 2650491 - DNA, 21 bp, Homo sapiens
taacttccttggactcatttt

SEQ ID NO: 2650492 - DNA, 16 bp, Homo sapiens
taacttgtctttggac

SEQ ID NO: 2650493 - DNA, 12 bp, Homo sapiens
taactttaagtt

SEQ ID NO: 2650494 - DNA, 14 bp, Homo sapiens
taactttatgtgta

SEQ ID NO: 2650495 - DNA, 23 bp, Homo sapiens
taactttcattaaagcatttact

SEQ ID NO: 2650496 - DNA, 18 bp, Homo sapiens
taacttttataaacttta

SEQ ID NO: 2650497 - DNA, 21 bp, Homo sapiens
taacttttataaactttacct

SEQ ID NO: 2650498 - DNA, 13 bp, Homo sapiens
taacttttgtaag

SEQ ID NO: 2650499 - DNA, 18 bp, Homo sapiens
taacttttgtaagacaaa

SEQ ID NO: 2650500 - DNA, 16 bp, Homo sapiens
taagaaaacatcactg

SEQ ID NO: 2650501 - DNA, 21 bp, Homo sapiens
taagaaacaactctttgagaa

SEQ ID NO: 2650502 - DNA, 21 bp, Homo sapiens
taagaaacacactgaggcagg

SEQ ID NO: 2650503 - DNA, 18 bp, Homo sapiens
taagaaagtgaagcaaat

SEQ ID NO: 2650504 - DNA, 19 bp, Homo sapiens
taagaactgctttctttcg

SEQ ID NO: 2650505 - DNA, 15 bp, Homo sapiens
taagaagctgttgta

SEQ ID NO: 2650506 - DNA, 22 bp, Homo sapiens
taagaagctgttgtacatttat

SEQ ID NO: 2650507 - DNA, 20 bp, Homo sapiens
taagaagggatggattccaa

SEQ ID NO: 2650508 - DNA, 13 bp, Homo sapiens
taagaagtgaaaa

SEQ ID NO: 2650509 - DNA, 21 bp, Homo sapiens
taagaatgctggttttcctaa

SEQ ID NO: 2650510 - DNA, 16 bp, Homo sapiens
taagaatttagggaga

SEQ ID NO: 2650511 - DNA, 19 bp, Homo sapiens
taagacagtcccatcaaaa

SEQ ID NO: 2650512 - DNA, 17 bp, Homo sapiens
taagacataacgttttt

SEQ ID NO: 2650513 - DNA, 20 bp, Homo sapiens
taagacatactccttccatc

SEQ ID NO: 2650514 - DNA, 19 bp, Homo sapiens
taagaccataacagccaac

SEQ ID NO: 2650515 - DNA, 14 bp, Homo sapiens
taagacgacaagga

SEQ ID NO: 2650516 - DNA, 18 bp, Homo sapiens
taagactcattccctaga

SEQ ID NO: 2650517 - DNA, 16 bp, Homo sapiens
taagactgtaatgaat

SEQ ID NO: 2650518 - DNA, 15 bp, Homo sapiens
taagagagagagaca

SEQ ID NO: 2650519 - DNA, 19 bp, Homo sapiens
taagagcaccttcctcact

SEQ ID NO: 2650520 - DNA, 20 bp, Homo sapiens
taagagcaccttcctcactt

SEQ ID NO: 2650521 - DNA, 22 bp, Homo sapiens
taagagccatataagtttgaag

SEQ ID NO: 2650522 - DNA, 12 bp, Homo sapiens
taagaggcaggg

SEQ ID NO: 2650523 - DNA, 22 bp, Homo sapiens
taagaggcagggtctcactctg

SEQ ID NO: 2650524 - DNA, 18 bp, Homo sapiens
taagagggcacacactgt

SEQ ID NO: 2650525 - DNA, 21 bp, Homo sapiens
taagagtagaaactgcaggga

SEQ ID NO: 2650526 - DNA, 13 bp, Homo sapiens
taagagtgtagaa

SEQ ID NO: 2650527 - DNA, 16 bp, Homo sapiens
taagagtgtagaagca

SEQ ID NO: 2650528 - DNA, 18 bp, Homo sapiens
taagagtgtagaagcatt

SEQ ID NO: 2650529 - DNA, 15 bp, Homo sapiens
taagataataatata

SEQ ID NO: 2650530 - DNA, 22 bp, Homo sapiens
taagataataatatatgtttac

SEQ ID NO: 2650531 - DNA, 15 bp, Homo sapiens
taagatatttttcat

SEQ ID NO: 2650532 - DNA, 17 bp, Homo sapiens
taagatatttttcatga

SEQ ID NO: 2650533 - DNA, 17 bp, Homo sapiens
taagatgacattgctaa

SEQ ID NO: 2650534 - DNA, 17 bp, Homo sapiens
taagatgctaccttgtg

SEQ ID NO: 2650535 - DNA, 23 bp, Homo sapiens
taagatgctaccttgtgacccag

SEQ ID NO: 2650536 - DNA, 24 bp, Homo sapiens
taagatgctctatcttgctctgta

SEQ ID NO: 2650537 - DNA, 13 bp, Homo sapiens
taagatgctgggt

SEQ ID NO: 2650538 - DNA, 18 bp, Homo sapiens
taagatggattctcagat

SEQ ID NO: 2650539 - DNA, 20 bp, Homo sapiens
taagatggattctcagatat

SEQ ID NO: 2650540 - DNA, 14 bp, Homo sapiens
taagattcatattt

SEQ ID NO: 2650541 - DNA, 19 bp, Homo sapiens
taagcagcatttctgaagt

SEQ ID NO: 2650542 - DNA, 16 bp, Homo sapiens
taagcatcaaactctt

SEQ ID NO: 2650543 - DNA, 19 bp, Homo sapiens
taagcattaccactcaggc

SEQ ID NO: 2650544 - DNA, 12 bp, Homo sapiens
taagcattgttt

SEQ ID NO: 2650545 - DNA, 17 bp, Homo sapiens
taagcattgtttgctta

SEQ ID NO: 2650546 - DNA, 18 bp, Homo sapiens
taagcattgtttgcttat

SEQ ID NO: 2650547 - DNA, 13 bp, Homo sapiens
taagccagacatc

SEQ ID NO: 2650548 - DNA, 19 bp, Homo sapiens
taagccattctgactcata

SEQ ID NO: 2650549 - DNA, 20 bp, Homo sapiens
taagccctgtcgagacactt

SEQ ID NO: 2650550 - DNA, 15 bp, Homo sapiens
taagcctacctgctc

SEQ ID NO: 2650551 - DNA, 19 bp, Homo sapiens
taagcctccatttagttct

SEQ ID NO: 2650552 - DNA, 21 bp, Homo sapiens
taagcctccatttagttcttt

SEQ ID NO: 2650553 - DNA, 23 bp, Homo sapiens
taagcgaatgtgtacaaagtgta

SEQ ID NO: 2650554 - DNA, 21 bp, Homo sapiens
taagctattcagtaataactc

SEQ ID NO: 2650555 - DNA, 21 bp, Homo sapiens
taagctgtttattttatatta

SEQ ID NO: 2650556 - DNA, 17 bp, Homo sapiens
taagctttgccagctgc

SEQ ID NO: 2650557 - DNA, 20 bp, Homo sapiens
taaggaaactcttatctcag

SEQ ID NO: 2650558 - DNA, 16 bp, Homo sapiens
taaggaaagcaataaa

SEQ ID NO: 2650559 - DNA, 13 bp, Homo sapiens
taaggaagacaat

SEQ ID NO: 2650560 - DNA, 19 bp, Homo sapiens
taaggaatgtagctggttt

SEQ ID NO: 2650561 - DNA, 18 bp, Homo sapiens
taaggacatttcccaggg

SEQ ID NO: 2650562 - DNA, 17 bp, Homo sapiens
taaggatactttacatg

SEQ ID NO: 2650563 - DNA, 20 bp, Homo sapiens
taaggatgcttgtacataat

SEQ ID NO: 2650564 - DNA, 19 bp, Homo sapiens
taaggattttatgctttaa

SEQ ID NO: 2650565 - DNA, 22 bp, Homo sapiens
taaggattttatgctttaaaca

SEQ ID NO: 2650566 - DNA, 13 bp, Homo sapiens
taaggcatgaagg

SEQ ID NO: 2650567 - DNA, 15 bp, Homo sapiens
taaggcatgaaggat

SEQ ID NO: 2650568 - DNA, 20 bp, Homo sapiens
taaggcgtggagctgcctga

SEQ ID NO: 2650569 - DNA, 20 bp, Homo sapiens
taaggctgaggaaaggccag

SEQ ID NO: 2650570 - DNA, 20 bp, Homo sapiens
taagggacatgttttgataa

SEQ ID NO: 2650571 - DNA, 13 bp, Homo sapiens
taagggcagagtc

SEQ ID NO: 2650572 - DNA, 17 bp, Homo sapiens
taagggtatctggtgac

SEQ ID NO: 2650573 - DNA, 20 bp, Homo sapiens
taaggtttcgtttctgtata

SEQ ID NO: 2650574 - DNA, 15 bp, Homo sapiens
taagtaaaaccacag

SEQ ID NO: 2650575 - DNA, 23 bp, Homo sapiens
taagtaattatcgggaacagtgt

SEQ ID NO: 2650576 - DNA, 17 bp, Homo sapiens
taagtactatgtatcaa

SEQ ID NO: 2650577 - DNA, 19 bp, Homo sapiens
taagtactatgtatcaatg

SEQ ID NO: 2650578 - DNA, 19 bp, Homo sapiens
taagtattcttatttaatg

SEQ ID NO: 2650579 - DNA, 14 bp, Homo sapiens
taagtatttatata

SEQ ID NO: 2650580 - DNA, 15 bp, Homo sapiens
taagtcaacctgcct

SEQ ID NO: 2650581 - DNA, 15 bp, Homo sapiens
taagtcctttatgtg

SEQ ID NO: 2650582 - DNA, 16 bp, Homo sapiens
taagtgaaaaggtcat

SEQ ID NO: 2650583 - DNA, 13 bp, Homo sapiens
taagtgaaataag

SEQ ID NO: 2650584 - DNA, 14 bp, Homo sapiens
taagtgcacaacat

SEQ ID NO: 2650585 - DNA, 22 bp, Homo sapiens
taagtgcacaacattacaggga

SEQ ID NO: 2650586 - DNA, 18 bp, Homo sapiens
taagtgctgcatttaaaa

SEQ ID NO: 2650587 - DNA, 22 bp, Homo sapiens
taagtgctgcatttaaaagata

SEQ ID NO: 2650588 - DNA, 13 bp, Homo sapiens
taagtgctttgta

SEQ ID NO: 2650589 - DNA, 21 bp, Homo sapiens
taagttacacatttttcagat

SEQ ID NO: 2650590 - DNA, 14 bp, Homo sapiens
taagttacttcact

SEQ ID NO: 2650591 - DNA, 14 bp, Homo sapiens
taagttatagtata

SEQ ID NO: 2650592 - DNA, 12 bp, Homo sapiens
taagttattgca

SEQ ID NO: 2650593 - DNA, 20 bp, Homo sapiens
taagttattgcagtttatca

SEQ ID NO: 2650594 - DNA, 19 bp, Homo sapiens
taatttaaacaggcccagc

SEQ ID NO: 2650595 - DNA, 21 bp, Homo sapiens
taatttacaaaaatataaaat

SEQ ID NO: 2650596 - DNA, 22 bp, Homo sapiens
taatttacaaaaatataaaata

SEQ ID NO: 2650597 - DNA, 23 bp, Homo sapiens
taatttatcttgtctctgggctt

SEQ ID NO: 2650598 - DNA, 14 bp, Homo sapiens
taatttattattga

SEQ ID NO: 2650599 - DNA, 20 bp, Homo sapiens
taatttattgtttttccttg

SEQ ID NO: 2650600 - DNA, 12 bp, Homo sapiens
taatttatttat

SEQ ID NO: 2650601 - DNA, 19 bp, Homo sapiens
taatttatttattaagatg

SEQ ID NO: 2650602 - DNA, 18 bp, Homo sapiens
taatttctttgcctgttc

SEQ ID NO: 2650603 - DNA, 22 bp, Homo sapiens
taatttgaaaacataatctgca

SEQ ID NO: 2650604 - DNA, 22 bp, Homo sapiens
taatttgatagtattgtgcata

SEQ ID NO: 2650605 - DNA, 12 bp, Homo sapiens
taatttgatctt

SEQ ID NO: 2650606 - DNA, 14 bp, Homo sapiens
taattttaaacaaa

SEQ ID NO: 2650607 - DNA, 12 bp, Homo sapiens
taattttaatat

SEQ ID NO: 2650608 - DNA, 17 bp, Homo sapiens
taattttcctaataaag

SEQ ID NO: 2650609 - DNA, 23 bp, Homo sapiens
taattttcttcatgcaatgacat

SEQ ID NO: 2650610 - DNA, 18 bp, Homo sapiens
taattttgtattttccaa

SEQ ID NO: 2650611 - DNA, 16 bp, Homo sapiens
taatttttgctctaga

SEQ ID NO: 2650612 - DNA, 13 bp, Homo sapiens
taattttttacta

SEQ ID NO: 2650613 - DNA, 22 bp, Homo sapiens
taattttttttttccttttaaa

SEQ ID NO: 2650614 - DNA, 21 bp, Homo sapiens
tacaaaaaaaaaaaaaaatta

SEQ ID NO: 2650615 - DNA, 16 bp, Homo sapiens
tacaaaaacacagcaa

SEQ ID NO: 2650616 - DNA, 18 bp, Homo sapiens
tacaaaaacacagcaagg

SEQ ID NO: 2650617 - DNA, 20 bp, Homo sapiens
tacaaaaagcataaaaatta

SEQ ID NO: 2650618 - DNA, 15 bp, Homo sapiens
tacaaaagcatgtga

SEQ ID NO: 2650619 - DNA, 19 bp, Homo sapiens
tacaaaataaacaaataac

SEQ ID NO: 2650620 - DNA, 22 bp, Homo sapiens
tacaaacaatggaaactgaatg

SEQ ID NO: 2650621 - DNA, 14 bp, Homo sapiens
tacaaagaagacat

SEQ ID NO: 2650622 - DNA, 17 bp, Homo sapiens
tacaaagaagacatgtt

SEQ ID NO: 2650623 - DNA, 22 bp, Homo sapiens
tacaaagaagacatgttttaga

SEQ ID NO: 2650624 - DNA, 12 bp, Homo sapiens
tacaaatgtctt

SEQ ID NO: 2650625 - DNA, 21 bp, Homo sapiens
tacaaattgcttactttggaa

SEQ ID NO: 2650626 - DNA, 16 bp, Homo sapiens
tacaaattgcttgaaa

SEQ ID NO: 2650627 - DNA, 19 bp, Homo sapiens
tacaaattgcttgaaagaa

SEQ ID NO: 2650628 - DNA, 16 bp, Homo sapiens
tacaaatttgttattt

SEQ ID NO: 2650629 - DNA, 22 bp, Homo sapiens
tacaacaagagtttatttccaa

SEQ ID NO: 2650630 - DNA, 13 bp, Homo sapiens
tacaacagatttg

SEQ ID NO: 2650631 - DNA, 17 bp, Homo sapiens
tacaacagatttgtgaa

SEQ ID NO: 2650632 - DNA, 19 bp, Homo sapiens
tacaacagatttgtgaact

SEQ ID NO: 2650633 - DNA, 21 bp, Homo sapiens
tacaacagatttgtgaactca

SEQ ID NO: 2650634 - DNA, 14 bp, Homo sapiens
tacaacagtgctaa

SEQ ID NO: 2650635 - DNA, 20 bp, Homo sapiens
tacaactgagtccttaaaca

SEQ ID NO: 2650636 - DNA, 14 bp, Homo sapiens
tacaacttcagcag

SEQ ID NO: 2650637 - DNA, 16 bp, Homo sapiens
tacaagagcagcctgt

SEQ ID NO: 2650638 - DNA, 20 bp, Homo sapiens
tacaagagcagcctgtggca

SEQ ID NO: 2650639 - DNA, 13 bp, Homo sapiens
tacaagattagaa

SEQ ID NO: 2650640 - DNA, 21 bp, Homo sapiens
tacaagccattctaaggaaat

SEQ ID NO: 2650641 - DNA, 16 bp, Homo sapiens
tacaagcgtgagccac

SEQ ID NO: 2650642 - DNA, 14 bp, Homo sapiens
tacaaggcaacata

SEQ ID NO: 2650643 - DNA, 21 bp, Homo sapiens
tacaagtgtatatcagaaaag

SEQ ID NO: 2650644 - DNA, 15 bp, Homo sapiens
tacaataaataatct

SEQ ID NO: 2650645 - DNA, 17 bp, Homo sapiens
tacaatcattgctgaaa

SEQ ID NO: 2650646 - DNA, 23 bp, Homo sapiens
tacaatcattgctgaaaatggta

SEQ ID NO: 2650647 - DNA, 14 bp, Homo sapiens
tacaatgactttat

SEQ ID NO: 2650648 - DNA, 21 bp, Homo sapiens
tacaatgctgtgccctaaagt

SEQ ID NO: 2650649 - DNA, 14 bp, Homo sapiens
tacaatgtatttat

SEQ ID NO: 2650650 - DNA, 19 bp, Homo sapiens
tacaatgtatttatttaaa

SEQ ID NO: 2650651 - DNA, 20 bp, Homo sapiens
tacaatgtatttatttaaaa

SEQ ID NO: 2650652 - DNA, 23 bp, Homo sapiens
tacaattttttatcatgcatgtc

SEQ ID NO: 2650653 - DNA, 23 bp, Homo sapiens
tacacaaaacaaatgccacacat

SEQ ID NO: 2650654 - DNA, 20 bp, Homo sapiens
tacacacacacacacagcca

SEQ ID NO: 2650655 - DNA, 22 bp, Homo sapiens
tacacacacacacacagccaca

SEQ ID NO: 2650656 - DNA, 17 bp, Homo sapiens
tacacactgcatgtttg

SEQ ID NO: 2650657 - DNA, 22 bp, Homo sapiens
tacacattttattttattatgc

SEQ ID NO: 2650658 - DNA, 21 bp, Homo sapiens
tacacatttttcagatataaa

SEQ ID NO: 2650659 - DNA, 19 bp, Homo sapiens
tacaccagagataatatga

SEQ ID NO: 2650660 - DNA, 20 bp, Homo sapiens
tacaccagagataatatgag

SEQ ID NO: 2650661 - DNA, 19 bp, Homo sapiens
tacaccattatcttggaaa

SEQ ID NO: 2650662 - DNA, 13 bp, Homo sapiens
tacacgtgtcctg

SEQ ID NO: 2650663 - DNA, 15 bp, Homo sapiens
tacactccagcctga

SEQ ID NO: 2650664 - DNA, 17 bp, Homo sapiens
tacactccagcctgagc

SEQ ID NO: 2650665 - DNA, 20 bp, Homo sapiens
tacactgaagttaacagaga

SEQ ID NO: 2650666 - DNA, 17 bp, Homo sapiens
tacactgaatatttata

SEQ ID NO: 2650667 - DNA, 21 bp, Homo sapiens
tacactggaggagagaagaat

SEQ ID NO: 2650668 - DNA, 22 bp, Homo sapiens
tacactggaggagagaagaatg

SEQ ID NO: 2650669 - DNA, 22 bp, Homo sapiens
tacactgggagaggtgccagca

SEQ ID NO: 2650670 - DNA, 12 bp, Homo sapiens
tacactgtgaac

SEQ ID NO: 2650671 - DNA, 16 bp, Homo sapiens
tacactgtgctgagtc

SEQ ID NO: 2650672 - DNA, 18 bp, Homo sapiens
tacactgtttcaaacttt

SEQ ID NO: 2650673 - DNA, 19 bp, Homo sapiens
tacactgtttcaaacttta

SEQ ID NO: 2650674 - DNA, 20 bp, Homo sapiens
tacactgtttcaaactttac

SEQ ID NO: 2650675 - DNA, 21 bp, Homo sapiens
tacagaaagatggatgtgctt

SEQ ID NO: 2650676 - DNA, 20 bp, Homo sapiens
tacagaaagtggtgctcagt

SEQ ID NO: 2650677 - DNA, 17 bp, Homo sapiens
tacagaaattagccggg

SEQ ID NO: 2650678 - DNA, 18 bp, Homo sapiens
tacagaattctgctacct

SEQ ID NO: 2650679 - DNA, 13 bp, Homo sapiens
tacagacactaag

SEQ ID NO: 2650680 - DNA, 18 bp, Homo sapiens
tacagacactaagttata

SEQ ID NO: 2650681 - DNA, 20 bp, Homo sapiens
tacagaccgaactgttgtat

SEQ ID NO: 2650682 - DNA, 15 bp, Homo sapiens
tacagacttctccag

SEQ ID NO: 2650683 - DNA, 17 bp, Homo sapiens
tacagagacagaaagca

SEQ ID NO: 2650684 - DNA, 22 bp, Homo sapiens
tacagagaggagaaacacatct

SEQ ID NO: 2650685 - DNA, 15 bp, Homo sapiens
tacagagcttccctg

SEQ ID NO: 2650686 - DNA, 14 bp, Homo sapiens
tacagaggacagta

SEQ ID NO: 2650687 - DNA, 23 bp, Homo sapiens
tacagaggtctctgccggctctt

SEQ ID NO: 2650688 - DNA, 19 bp, Homo sapiens
tacagatagtcaaaccata

SEQ ID NO: 2650689 - DNA, 15 bp, Homo sapiens
tacagcactactctg

SEQ ID NO: 2650690 - DNA, 19 bp, Homo sapiens
tacagcgagaggcagagaa

SEQ ID NO: 2650691 - DNA, 21 bp, Homo sapiens
tacagctgggtggcactgcca

SEQ ID NO: 2650692 - DNA, 19 bp, Homo sapiens
tacaggaaaagctgctgac

SEQ ID NO: 2650693 - DNA, 21 bp, Homo sapiens
tacaggaagcaccccatgcca

SEQ ID NO: 2650694 - DNA, 18 bp, Homo sapiens
tacaggaaggtagaaata

SEQ ID NO: 2650695 - DNA, 20 bp, Homo sapiens
tacaggatttgaactcagat

SEQ ID NO: 2650696 - DNA, 23 bp, Homo sapiens
tacaggatttgaactcagatctg

SEQ ID NO: 2650697 - DNA, 15 bp, Homo sapiens
tacaggcatagagtt

SEQ ID NO: 2650698 - DNA, 20 bp, Homo sapiens
tacagggaatgcctgagtgc

SEQ ID NO: 2650699 - DNA, 16 bp, Homo sapiens
tacagggagctgggac

SEQ ID NO: 2650700 - DNA, 21 bp, Homo sapiens
tacaggtaaggtgagggaata

SEQ ID NO: 2650701 - DNA, 15 bp, Homo sapiens
tacaggttacaacag

SEQ ID NO: 2650702 - DNA, 18 bp, Homo sapiens
tacaggttacaacagatt

SEQ ID NO: 2650703 - DNA, 13 bp, Homo sapiens
tacagtaacttta

SEQ ID NO: 2650704 - DNA, 20 bp, Homo sapiens
tacagtaactttatgtgtaa

SEQ ID NO: 2650705 - DNA, 23 bp, Homo sapiens
tacagtaactttatgtgtaaata

SEQ ID NO: 2650706 - DNA, 22 bp, Homo sapiens
tacagtaggagcccagctctga

SEQ ID NO: 2650707 - DNA, 14 bp, Homo sapiens
tacagtctgtcatg

SEQ ID NO: 2650708 - DNA, 22 bp, Homo sapiens
tacagtcttccatttgcaaggg

SEQ ID NO: 2650709 - DNA, 20 bp, Homo sapiens
tacagtgaaaatgtaagctg

SEQ ID NO: 2650710 - DNA, 21 bp, Homo sapiens
tacagtgaaaatgtaagctgt

SEQ ID NO: 2650711 - DNA, 13 bp, Homo sapiens
tacagtgtacagt

SEQ ID NO: 2650712 - DNA, 13 bp, Homo sapiens
tacataaaggtgg

SEQ ID NO: 2650713 - DNA, 16 bp, Homo sapiens
tacataagataaatgt

SEQ ID NO: 2650714 - DNA, 17 bp, Homo sapiens
tacataagataaatgtg

SEQ ID NO: 2650715 - DNA, 15 bp, Homo sapiens
tacataatctgtaca

SEQ ID NO: 2650716 - DNA, 20 bp, Homo sapiens
tacataatctgtacaatgaa

SEQ ID NO: 2650717 - DNA, 24 bp, Homo sapiens
tacataatgcgtgcataccacttt

SEQ ID NO: 2650718 - DNA, 19 bp, Homo sapiens
tacataattttttattcaa

SEQ ID NO: 2650719 - DNA, 22 bp, Homo sapiens
tacataccctggccgccccctg

SEQ ID NO: 2650720 - DNA, 15 bp, Homo sapiens
tacatagcctatatt

SEQ ID NO: 2650721 - DNA, 20 bp, Homo sapiens
tacatagcctatatttacag

SEQ ID NO: 2650722 - DNA, 13 bp, Homo sapiens
tacatatgaaatt

SEQ ID NO: 2650723 - DNA, 16 bp, Homo sapiens
tacatatgagtgtgga

SEQ ID NO: 2650724 - DNA, 17 bp, Homo sapiens
tacatatgtaaaataaa

SEQ ID NO: 2650725 - DNA, 18 bp, Homo sapiens
tacatattaggaaaatat

SEQ ID NO: 2650726 - DNA, 15 bp, Homo sapiens
tacatattctttaaa

SEQ ID NO: 2650727 - DNA, 16 bp, Homo sapiens
tacatatttgtggaat

SEQ ID NO: 2650728 - DNA, 16 bp, Homo sapiens
tacatcccatgtaaca

SEQ ID NO: 2650729 - DNA, 22 bp, Homo sapiens
tacatcccatgtaacagaaagg

SEQ ID NO: 2650730 - DNA, 22 bp, Homo sapiens
tacatcctcatgcagccgtgat

SEQ ID NO: 2650731 - DNA, 15 bp, Homo sapiens
tacatctttcacatt

SEQ ID NO: 2650732 - DNA, 16 bp, Homo sapiens
tacatgacatttattt

SEQ ID NO: 2650733 - DNA, 22 bp, Homo sapiens
tacatgaggtactgagagtgaa

SEQ ID NO: 2650734 - DNA, 16 bp, Homo sapiens
tacatgcaatttatta

SEQ ID NO: 2650735 - DNA, 19 bp, Homo sapiens
tacatgcaatttattaaaa

SEQ ID NO: 2650736 - DNA, 22 bp, Homo sapiens
tacatgcaatttattaaaatga

SEQ ID NO: 2650737 - DNA, 20 bp, Homo sapiens
taggaggaccagagctactg

SEQ ID NO: 2650738 - DNA, 23 bp, Homo sapiens
taggagttcacttcatcttctca

SEQ ID NO: 2650739 - DNA, 23 bp, Homo sapiens
taggagttcgagaccagcctggc

SEQ ID NO: 2650740 - DNA, 21 bp, Homo sapiens
taggatttaacagtcatttaa

SEQ ID NO: 2650741 - DNA, 12 bp, Homo sapiens
taggcagagcct

SEQ ID NO: 2650742 - DNA, 17 bp, Homo sapiens
taggcaggacatgctga

SEQ ID NO: 2650743 - DNA, 22 bp, Homo sapiens
taggcaggacatgctgaagcca

SEQ ID NO: 2650744 - DNA, 14 bp, Homo sapiens
taggcaggacctgt

SEQ ID NO: 2650745 - DNA, 15 bp, Homo sapiens
taggcaggacctgtg

SEQ ID NO: 2650746 - DNA, 21 bp, Homo sapiens
taggcatgagggatcacaggg

SEQ ID NO: 2650747 - DNA, 16 bp, Homo sapiens
taggcatttgctgaat

SEQ ID NO: 2650748 - DNA, 20 bp, Homo sapiens
taggcatttgctgaatacag

SEQ ID NO: 2650749 - DNA, 14 bp, Homo sapiens
taggccatgaaaaa

SEQ ID NO: 2650750 - DNA, 14 bp, Homo sapiens
taggcctggccaga

SEQ ID NO: 2650751 - DNA, 15 bp, Homo sapiens
taggcctggccagat

SEQ ID NO: 2650752 - DNA, 20 bp, Homo sapiens
taggcctgggtgctggctgc

SEQ ID NO: 2650753 - DNA, 14 bp, Homo sapiens
taggcgagtgccag

SEQ ID NO: 2650754 - DNA, 16 bp, Homo sapiens
taggcgggaaggaggg

SEQ ID NO: 2650755 - DNA, 15 bp, Homo sapiens
taggctattcacaac

SEQ ID NO: 2650756 - DNA, 19 bp, Homo sapiens
taggctggagaagctcacc

SEQ ID NO: 2650757 - DNA, 19 bp, Homo sapiens
tagggaaaaaccagcgtgt

SEQ ID NO: 2650758 - DNA, 16 bp, Homo sapiens
tagggaaaacattcca

SEQ ID NO: 2650759 - DNA, 18 bp, Homo sapiens
tagggaaaacattccatc

SEQ ID NO: 2650760 - DNA, 14 bp, Homo sapiens
tagggaagggcctg

SEQ ID NO: 2650761 - DNA, 21 bp, Homo sapiens
tagggaatggcacagcccaaa

SEQ ID NO: 2650762 - DNA, 13 bp, Homo sapiens
tagggacttaaaa

SEQ ID NO: 2650763 - DNA, 14 bp, Homo sapiens
tagggacttaaaaa

SEQ ID NO: 2650764 - DNA, 22 bp, Homo sapiens
tagggaggaccttatctgtgcg

SEQ ID NO: 2650765 - DNA, 18 bp, Homo sapiens
tagggatgttctggccct

SEQ ID NO: 2650766 - DNA, 13 bp, Homo sapiens
tagggcagcttgc

SEQ ID NO: 2650767 - DNA, 19 bp, Homo sapiens
tagggcataatgatgatgg

SEQ ID NO: 2650768 - DNA, 18 bp, Homo sapiens
tagggcatttgagaaatg

SEQ ID NO: 2650769 - DNA, 16 bp, Homo sapiens
tagggccaagcccagc

SEQ ID NO: 2650770 - DNA, 23 bp, Homo sapiens
tagggccaagcccagcactgctt

SEQ ID NO: 2650771 - DNA, 17 bp, Homo sapiens
tagggttataataatgt

SEQ ID NO: 2650772 - DNA, 14 bp, Homo sapiens
taggtacacagctc

SEQ ID NO: 2650773 - DNA, 15 bp, Homo sapiens
taggtatgaataagt

SEQ ID NO: 2650774 - DNA, 14 bp, Homo sapiens
taggtcagtgaggc

SEQ ID NO: 2650775 - DNA, 11 bp, Homo sapiens
taggtgacaga

SEQ ID NO: 2650776 - DNA, 16 bp, Homo sapiens
taggtgacagagtgag

SEQ ID NO: 2650777 - DNA, 23 bp, Homo sapiens
taggtgacagagtgagactctgt

SEQ ID NO: 2650778 - DNA, 21 bp, Homo sapiens
taggtgatctcatttaatcct

SEQ ID NO: 2650779 - DNA, 18 bp, Homo sapiens
taggtgctacaaaaacac

SEQ ID NO: 2650780 - DNA, 23 bp, Homo sapiens
taggtgctacaaaaacacagcaa

SEQ ID NO: 2650781 - DNA, 16 bp, Homo sapiens
taggtggcaaggctgt

SEQ ID NO: 2650782 - DNA, 21 bp, Homo sapiens
taggtgtgactgaatttcttt

SEQ ID NO: 2650783 - DNA, 12 bp, Homo sapiens
taggttctaaaa

SEQ ID NO: 2650784 - DNA, 17 bp, Homo sapiens
taggtttaactcagatc

SEQ ID NO: 2650785 - DNA, 21 bp, Homo sapiens
taggtttaactcagatcacta

SEQ ID NO: 2650786 - DNA, 20 bp, Homo sapiens
taggtttttttccttctgaa

SEQ ID NO: 2650787 - DNA, 16 bp, Homo sapiens
tagtaaaaataaaatt

SEQ ID NO: 2650788 - DNA, 13 bp, Homo sapiens
tagtaaggctgtg

SEQ ID NO: 2650789 - DNA, 14 bp, Homo sapiens
tagtaagtgccttc

SEQ ID NO: 2650790 - DNA, 21 bp, Homo sapiens
tagtaatgctacgtgtgattt

SEQ ID NO: 2650791 - DNA, 14 bp, Homo sapiens
tagtaattctcagg

SEQ ID NO: 2650792 - DNA, 21 bp, Homo sapiens
tagtacataaaggtggtatgt

SEQ ID NO: 2650793 - DNA, 18 bp, Homo sapiens
tagtacctgaaaagtaac

SEQ ID NO: 2650794 - DNA, 14 bp, Homo sapiens
tagtactaactcct

SEQ ID NO: 2650795 - DNA, 19 bp, Homo sapiens
tagtactcctgcaaaattt

SEQ ID NO: 2650796 - DNA, 13 bp, Homo sapiens
tagtactgctctt

SEQ ID NO: 2650797 - DNA, 15 bp, Homo sapiens
tagtactgctcttgt

SEQ ID NO: 2650798 - DNA, 15 bp, Homo sapiens
tagtagagacagggt

SEQ ID NO: 2650799 - DNA, 18 bp, Homo sapiens
tagtagccctttctgtgt

SEQ ID NO: 2650800 - DNA, 19 bp, Homo sapiens
tagtagccctttctgtgtg

SEQ ID NO: 2650801 - DNA, 14 bp, Homo sapiens
tagtataaagaaaa

SEQ ID NO: 2650802 - DNA, 14 bp, Homo sapiens
tagtatcaaatatt

SEQ ID NO: 2650803 - DNA, 20 bp, Homo sapiens
tagtatcaaatattagatgt

SEQ ID NO: 2650804 - DNA, 21 bp, Homo sapiens
tagtatcaaatattagatgtg

SEQ ID NO: 2650805 - DNA, 13 bp, Homo sapiens
tagtatcctccag

SEQ ID NO: 2650806 - DNA, 14 bp, Homo sapiens
tagtatcctccagg

SEQ ID NO: 2650807 - DNA, 19 bp, Homo sapiens
tagtatcctccaggttttt

SEQ ID NO: 2650808 - DNA, 20 bp, Homo sapiens
tagtatcctccaggtttttc

SEQ ID NO: 2650809 - DNA, 21 bp, Homo sapiens
tagtatcctccaggtttttca

SEQ ID NO: 2650810 - DNA, 16 bp, Homo sapiens
tagtatggtggctggg

SEQ ID NO: 2650811 - DNA, 21 bp, Homo sapiens
tagtcacatggcctatgcaca

SEQ ID NO: 2650812 - DNA, 14 bp, Homo sapiens
tagtcactgagaca

SEQ ID NO: 2650813 - DNA, 22 bp, Homo sapiens
tagtccaatgtctttttaagct

SEQ ID NO: 2650814 - DNA, 23 bp, Homo sapiens
tagtctaaggatgctaaacctta

SEQ ID NO: 2650815 - DNA, 20 bp, Homo sapiens
tagtctactcttaagccatc

SEQ ID NO: 2650816 - DNA, 12 bp, Homo sapiens
tagtctcaggac

SEQ ID NO: 2650817 - DNA, 21 bp, Homo sapiens
tagtctcattacttttgaagt

SEQ ID NO: 2650818 - DNA, 17 bp, Homo sapiens
tagtctcctttgcactg

SEQ ID NO: 2650819 - DNA, 18 bp, Homo sapiens
tagtctcctttgcactga

SEQ ID NO: 2650820 - DNA, 19 bp, Homo sapiens
tagtctcctttgcactgag

SEQ ID NO: 2650821 - DNA, 23 bp, Homo sapiens
tagtctctctggggccacacaga

SEQ ID NO: 2650822 - DNA, 17 bp, Homo sapiens
tagtctctgtgctttga

SEQ ID NO: 2650823 - DNA, 12 bp, Homo sapiens
tagtcttctcat

SEQ ID NO: 2650824 - DNA, 14 bp, Homo sapiens
tagtcttctcatag

SEQ ID NO: 2650825 - DNA, 18 bp, Homo sapiens
tagtcttctcatagcatt

SEQ ID NO: 2650826 - DNA, 24 bp, Homo sapiens
tagtgaaaccccatctctactgaa

SEQ ID NO: 2650827 - DNA, 23 bp, Homo sapiens
tagtgaaatgaatatttaaataa

SEQ ID NO: 2650828 - DNA, 21 bp, Homo sapiens
tagtgaatcacgtaaagctag

SEQ ID NO: 2650829 - DNA, 13 bp, Homo sapiens
tagtgcagctgat

SEQ ID NO: 2650830 - DNA, 17 bp, Homo sapiens
tagtgcggacaagtttt

SEQ ID NO: 2650831 - DNA, 19 bp, Homo sapiens
tagtgcggacaagttttaa

SEQ ID NO: 2650832 - DNA, 19 bp, Homo sapiens
tagtgctcgctttctatgt

SEQ ID NO: 2650833 - DNA, 20 bp, Homo sapiens
tagtggcttcattagagcag

SEQ ID NO: 2650834 - DNA, 13 bp, Homo sapiens
tagtggtctttgt

SEQ ID NO: 2650835 - DNA, 21 bp, Homo sapiens
tagtggtctttgtaagagtgt

SEQ ID NO: 2650836 - DNA, 23 bp, Homo sapiens
tagtggtctttgtaagagtgtag

SEQ ID NO: 2650837 - DNA, 20 bp, Homo sapiens
tagtgtaggtcagcgtgctt

SEQ ID NO: 2650838 - DNA, 12 bp, Homo sapiens
tagtgtctatca

SEQ ID NO: 2650839 - DNA, 22 bp, Homo sapiens
tagtgtggaaattaagaagaaa

SEQ ID NO: 2650840 - DNA, 15 bp, Homo sapiens
tagtgtgttctgatt

SEQ ID NO: 2650841 - DNA, 19 bp, Homo sapiens
tagtgtgttctgattagaa

SEQ ID NO: 2650842 - DNA, 16 bp, Homo sapiens
tagtgttaatcaattt

SEQ ID NO: 2650843 - DNA, 16 bp, Homo sapiens
tagtgtttctgtgcat

SEQ ID NO: 2650844 - DNA, 15 bp, Homo sapiens
tagttaaatttctgg

SEQ ID NO: 2650845 - DNA, 14 bp, Homo sapiens
tagttacagctgtg

SEQ ID NO: 2650846 - DNA, 21 bp, Homo sapiens
tagttactgttgtgacctgaa

SEQ ID NO: 2650847 - DNA, 16 bp, Homo sapiens
tagttaggaaataaaa

SEQ ID NO: 2650848 - DNA, 21 bp, Homo sapiens
tagttaggaaataaaaccttt

SEQ ID NO: 2650849 - DNA, 15 bp, Homo sapiens
tagttagtagcatgt

SEQ ID NO: 2650850 - DNA, 15 bp, Homo sapiens
tagttatagtttcag

SEQ ID NO: 2650851 - DNA, 16 bp, Homo sapiens
tagttcctgctacaac

SEQ ID NO: 2650852 - DNA, 15 bp, Homo sapiens
tagttcgtagctttc

SEQ ID NO: 2650853 - DNA, 14 bp, Homo sapiens
tagttgaactgata

SEQ ID NO: 2650854 - DNA, 13 bp, Homo sapiens
tagttgagcccca

SEQ ID NO: 2650855 - DNA, 18 bp, Homo sapiens
tagttgcagactcagttt

SEQ ID NO: 2650856 - DNA, 23 bp, Homo sapiens
tagttgcagactcagtttgtcag

SEQ ID NO: 2650857 - DNA, 17 bp, Homo sapiens
tagtttctgttctgtgg

SEQ ID NO: 2650858 - DNA, 18 bp, Homo sapiens
tagtttctgttctgtgga

SEQ ID NO: 2650859 - DNA, 15 bp, Homo sapiens
tagtttgattaaatt

SEQ ID NO: 2650860 - DNA, 23 bp, Homo sapiens
tagtttgattaaattcttgcaaa

SEQ ID NO: 2650861 - DNA, 17 bp, Homo sapiens
tagtttgcattcctgat

SEQ ID NO: 2650862 - DNA, 14 bp, Homo sapiens
tagtttgtataact

SEQ ID NO: 2650863 - DNA, 17 bp, Homo sapiens
tagtttgtataacttct

SEQ ID NO: 2650864 - DNA, 18 bp, Homo sapiens
tagtttgtataacttctt

SEQ ID NO: 2650865 - DNA, 17 bp, Homo sapiens
tagttttatcacatgta

SEQ ID NO: 2650866 - DNA, 19 bp, Homo sapiens
tagttttatcacatgtatg

SEQ ID NO: 2650867 - DNA, 23 bp, Homo sapiens
tagttttcatacacagcctgggc

SEQ ID NO: 2650868 - DNA, 18 bp, Homo sapiens
tagtttttacctaccaca

SEQ ID NO: 2650869 - DNA, 21 bp, Homo sapiens
tataaaaagaaaagataaaga

SEQ ID NO: 2650870 - DNA, 13 bp, Homo sapiens
tataaaagtgatt

SEQ ID NO: 2650871 - DNA, 15 bp, Homo sapiens
tataaaattaagcaa

SEQ ID NO: 2650872 - DNA, 14 bp, Homo sapiens
tataaacatcacac

SEQ ID NO: 2650873 - DNA, 18 bp, Homo sapiens
tataaacatcacacacac

SEQ ID NO: 2650874 - DNA, 22 bp, Homo sapiens
tataaacatgcttgcattatat

SEQ ID NO: 2650875 - DNA, 14 bp, Homo sapiens
tataaactttacct

SEQ ID NO: 2650876 - DNA, 16 bp, Homo sapiens
tataaactttaccttt

SEQ ID NO: 2650877 - DNA, 18 bp, Homo sapiens
tataaactttaccttttt

SEQ ID NO: 2650878 - DNA, 15 bp, Homo sapiens
tataaactttagagt

SEQ ID NO: 2650879 - DNA, 21 bp, Homo sapiens
tataaactttagagtagcatg

SEQ ID NO: 2650880 - DNA, 19 bp, Homo sapiens
tataaagaagaacttgcat

SEQ ID NO: 2650881 - DNA, 15 bp, Homo sapiens
tattgtccattgtcc

SEQ ID NO: 2650882 - DNA, 21 bp, Homo sapiens
tattgtgatctatcaatagtc

SEQ ID NO: 2650883 - DNA, 19 bp, Homo sapiens
tattgttccaagacattgt

SEQ ID NO: 2650884 - DNA, 13 bp, Homo sapiens
tattgttcccagt

SEQ ID NO: 2650885 - DNA, 21 bp, Homo sapiens
tattgttcccagtgacacttc

SEQ ID NO: 2650886 - DNA, 15 bp, Homo sapiens
tattgtttaaaatca

SEQ ID NO: 2650887 - DNA, 20 bp, Homo sapiens
tattgtttaaaatcatttct

SEQ ID NO: 2650888 - DNA, 12 bp, Homo sapiens
tattgtttcaat

SEQ ID NO: 2650889 - DNA, 11 bp, Homo sapiens
tattgtttcta

SEQ ID NO: 2650890 - DNA, 22 bp, Homo sapiens
tattgttttcagtgtacatgga

SEQ ID NO: 2650891 - DNA, 22 bp, Homo sapiens
tattgtttttccttgtatttaa

SEQ ID NO: 2650892 - DNA, 13 bp, Homo sapiens
tatttaaaacttg

SEQ ID NO: 2650893 - DNA, 23 bp, Homo sapiens
tatttaaaagaaagcctcagaga

SEQ ID NO: 2650894 - DNA, 16 bp, Homo sapiens
tatttaaaagattcat

SEQ ID NO: 2650895 - DNA, 12 bp, Homo sapiens
tatttaaagaca

SEQ ID NO: 2650896 - DNA, 17 bp, Homo sapiens
tatttaagataattata

SEQ ID NO: 2650897 - DNA, 21 bp, Homo sapiens
tatttaagcctcatatttaaa

SEQ ID NO: 2650898 - DNA, 13 bp, Homo sapiens
tatttaataacat

SEQ ID NO: 2650899 - DNA, 15 bp, Homo sapiens
tatttaatgttatgt

SEQ ID NO: 2650900 - DNA, 22 bp, Homo sapiens
tatttacagtgaaaatgtaagc

SEQ ID NO: 2650901 - DNA, 14 bp, Homo sapiens
tatttacatatgaa

SEQ ID NO: 2650902 - DNA, 16 bp, Homo sapiens
tatttacatatgaaat

SEQ ID NO: 2650903 - DNA, 21 bp, Homo sapiens
tatttacatatgaaatttaat

SEQ ID NO: 2650904 - DNA, 23 bp, Homo sapiens
tatttactgagcttctctgtgaa

SEQ ID NO: 2650905 - DNA, 17 bp, Homo sapiens
tatttagattgttaaaa

SEQ ID NO: 2650906 - DNA, 19 bp, Homo sapiens
tatttagattgttaaaata

SEQ ID NO: 2650907 - DNA, 22 bp, Homo sapiens
tatttagattgttaaaataact

SEQ ID NO: 2650908 - DNA, 11 bp, Homo sapiens
tatttagcatg

SEQ ID NO: 2650909 - DNA, 18 bp, Homo sapiens
tatttagggaactgcttg

SEQ ID NO: 2650910 - DNA, 17 bp, Homo sapiens
tatttagttatagtttc

SEQ ID NO: 2650911 - DNA, 17 bp, Homo sapiens
tatttataaatatattt

SEQ ID NO: 2650912 - DNA, 21 bp, Homo sapiens
tatttataactcatcataaaa

SEQ ID NO: 2650913 - DNA, 14 bp, Homo sapiens
tatttataagcaga

SEQ ID NO: 2650914 - DNA, 20 bp, Homo sapiens
tatttatatattggtaacat

SEQ ID NO: 2650915 - DNA, 19 bp, Homo sapiens
tatttatatatttataact

SEQ ID NO: 2650916 - DNA, 14 bp, Homo sapiens
tatttatatttcac

SEQ ID NO: 2650917 - DNA, 21 bp, Homo sapiens
tatttatatttttattttatt

SEQ ID NO: 2650918 - DNA, 22 bp, Homo sapiens
tatttatctgtgtttttgaaat

SEQ ID NO: 2650919 - DNA, 19 bp, Homo sapiens
tatttattattttcacctg

SEQ ID NO: 2650920 - DNA, 16 bp, Homo sapiens
tatttatttaaaagat

SEQ ID NO: 2650921 - DNA, 13 bp, Homo sapiens
tatttatttaaat

SEQ ID NO: 2650922 - DNA, 14 bp, Homo sapiens
tatttatttatgga

SEQ ID NO: 2650923 - DNA, 17 bp, Homo sapiens
tatttattttcctcccc

SEQ ID NO: 2650924 - DNA, 14 bp, Homo sapiens
tatttcaagacatt

SEQ ID NO: 2650925 - DNA, 20 bp, Homo sapiens
tatttcactttagatgctga

SEQ ID NO: 2650926 - DNA, 17 bp, Homo sapiens
tatttcatgaaaattgt

SEQ ID NO: 2650927 - DNA, 21 bp, Homo sapiens
tatttccattccagaatatct

SEQ ID NO: 2650928 - DNA, 22 bp, Homo sapiens
tatttccccaggggaaaatgaa

SEQ ID NO: 2650929 - DNA, 18 bp, Homo sapiens
tatttccctctcattttg

SEQ ID NO: 2650930 - DNA, 19 bp, Homo sapiens
tatttcctcatgtgatcac

SEQ ID NO: 2650931 - DNA, 16 bp, Homo sapiens
tatttctatgagaaaa

SEQ ID NO: 2650932 - DNA, 18 bp, Homo sapiens
tatttctatttcctggaa

SEQ ID NO: 2650933 - DNA, 19 bp, Homo sapiens
tatttctcaacaaagcaca

SEQ ID NO: 2650934 - DNA, 16 bp, Homo sapiens
tatttctgagaaggtc

SEQ ID NO: 2650935 - DNA, 19 bp, Homo sapiens
tatttcttaaatctagtaa

SEQ ID NO: 2650936 - DNA, 16 bp, Homo sapiens
tatttgagactagttt

SEQ ID NO: 2650937 - DNA, 18 bp, Homo sapiens
tatttgcagttcacctgc

SEQ ID NO: 2650938 - DNA, 17 bp, Homo sapiens
tatttgccatgggcttc

SEQ ID NO: 2650939 - DNA, 15 bp, Homo sapiens
tatttgctttttgct

SEQ ID NO: 2650940 - DNA, 12 bp, Homo sapiens
tatttgtatctc

SEQ ID NO: 2650941 - DNA, 22 bp, Homo sapiens
tatttgtatctctgaagcatgt

SEQ ID NO: 2650942 - DNA, 12 bp, Homo sapiens
tatttgtggaat

SEQ ID NO: 2650943 - DNA, 20 bp, Homo sapiens
tatttgttaatggtttgaat

SEQ ID NO: 2650944 - DNA, 19 bp, Homo sapiens
tattttaaacaaaatagaa

SEQ ID NO: 2650945 - DNA, 23 bp, Homo sapiens
tattttacaattttttatcatgc

SEQ ID NO: 2650946 - DNA, 14 bp, Homo sapiens
tattttacttttat

SEQ ID NO: 2650947 - DNA, 21 bp, Homo sapiens
tattttattacatctttcaca

SEQ ID NO: 2650948 - DNA, 19 bp, Homo sapiens
tattttattccctttcaca

SEQ ID NO: 2650949 - DNA, 16 bp, Homo sapiens
tattttcaagaaactg

SEQ ID NO: 2650950 - DNA, 14 bp, Homo sapiens
tattttcaccattt

SEQ ID NO: 2650951 - DNA, 15 bp, Homo sapiens
tattttccaagtgtg

SEQ ID NO: 2650952 - DNA, 24 bp, Homo sapiens
tattttccaagtgtgcatattgta

SEQ ID NO: 2650953 - DNA, 12 bp, Homo sapiens
tattttcctccc

SEQ ID NO: 2650954 - DNA, 15 bp, Homo sapiens
tattttcctccccag

SEQ ID NO: 2650955 - DNA, 16 bp, Homo sapiens
tattttcctccccagc

SEQ ID NO: 2650956 - DNA, 20 bp, Homo sapiens
tattttctggtagatagaaa

SEQ ID NO: 2650957 - DNA, 23 bp, Homo sapiens
tattttgaatcaataatatattt

SEQ ID NO: 2650958 - DNA, 16 bp, Homo sapiens
tattttgattattgta

SEQ ID NO: 2650959 - DNA, 18 bp, Homo sapiens
tattttgattattgtatt

SEQ ID NO: 2650960 - DNA, 13 bp, Homo sapiens
tattttgctttgt

SEQ ID NO: 2650961 - DNA, 15 bp, Homo sapiens
tattttgctttgtga

SEQ ID NO: 2650962 - DNA, 14 bp, Homo sapiens
tattttggtacttt

SEQ ID NO: 2650963 - DNA, 21 bp, Homo sapiens
tattttggttcttagttctca

SEQ ID NO: 2650964 - DNA, 21 bp, Homo sapiens
tattttgtaaactcaaaatat

SEQ ID NO: 2650965 - DNA, 17 bp, Homo sapiens
tatttttaattaaataa

SEQ ID NO: 2650966 - DNA, 12 bp, Homo sapiens
tatttttactgc

SEQ ID NO: 2650967 - DNA, 21 bp, Homo sapiens
tatttttatatttagttatag

SEQ ID NO: 2650968 - DNA, 11 bp, Homo sapiens
tatttttcata

SEQ ID NO: 2650969 - DNA, 19 bp, Homo sapiens
tatttttcatattgtgcca

SEQ ID NO: 2650970 - DNA, 20 bp, Homo sapiens
tatttttcatgattttgaaa

SEQ ID NO: 2650971 - DNA, 14 bp, Homo sapiens
tatttttctcatga

SEQ ID NO: 2650972 - DNA, 22 bp, Homo sapiens
tatttttgaaaggcatgttcct

SEQ ID NO: 2650973 - DNA, 12 bp, Homo sapiens
tatttttgcatg

SEQ ID NO: 2650974 - DNA, 19 bp, Homo sapiens
tatttttggcagtctgaat

SEQ ID NO: 2650975 - DNA, 20 bp, Homo sapiens
tatttttgtttcttccaaag

SEQ ID NO: 2650976 - DNA, 15 bp, Homo sapiens
tatttttttactaat

SEQ ID NO: 2650977 - DNA, 14 bp, Homo sapiens
tatttttttctacc

SEQ ID NO: 2650978 - DNA, 15 bp, Homo sapiens
tatttttttctgatt

SEQ ID NO: 2650979 - DNA, 17 bp, Homo sapiens
tatttttttctgattgt

SEQ ID NO: 2650980 - DNA, 18 bp, Homo sapiens
tatttttttctgattgta

SEQ ID NO: 2650981 - DNA, 15 bp, Homo sapiens
tcaaaaaaagaaaaa

SEQ ID NO: 2650982 - DNA, 23 bp, Homo sapiens
tcaaaaagtctacgctctccttt

SEQ ID NO: 2650983 - DNA, 12 bp, Homo sapiens
tcaaaaagtgtt

SEQ ID NO: 2650984 - DNA, 14 bp, Homo sapiens
tcaaaaagtgttta

SEQ ID NO: 2650985 - DNA, 19 bp, Homo sapiens
tcaaaaagtgtttattttt

SEQ ID NO: 2650986 - DNA, 13 bp, Homo sapiens
tcaaaaatataac

SEQ ID NO: 2650987 - DNA, 14 bp, Homo sapiens
tcaaaaatataact

SEQ ID NO: 2650988 - DNA, 21 bp, Homo sapiens
tcaaaacacatctttcctgtc

SEQ ID NO: 2650989 - DNA, 15 bp, Homo sapiens
tcaaaactcaaatgc

SEQ ID NO: 2650990 - DNA, 14 bp, Homo sapiens
tcaaaagacaattc

SEQ ID NO: 2650991 - DNA, 18 bp, Homo sapiens
tcaaaagcaaatgagatc

SEQ ID NO: 2650992 - DNA, 16 bp, Homo sapiens
tcaaaagtattttcct

SEQ ID NO: 2650993 - DNA, 18 bp, Homo sapiens
tcaaaagtattttcctgt

SEQ ID NO: 2650994 - DNA, 14 bp, Homo sapiens
tcaaaagttgaaat

SEQ ID NO: 2650995 - DNA, 15 bp, Homo sapiens
tcaaaagttgaaatt

SEQ ID NO: 2650996 - DNA, 16 bp, Homo sapiens
tcaaaagttgaaatta

SEQ ID NO: 2650997 - DNA, 12 bp, Homo sapiens
tcaaaataaaaa

SEQ ID NO: 2650998 - DNA, 20 bp, Homo sapiens
tcaaaataaaaagtgacaca

SEQ ID NO: 2650999 - DNA, 21 bp, Homo sapiens
tcaaaataccatgccatttaa

SEQ ID NO: 2651000 - DNA, 23 bp, Homo sapiens
tcaaaataccatgccatttaaag

SEQ ID NO: 2651001 - DNA, 16 bp, Homo sapiens
tcaaaatatttgtaca

SEQ ID NO: 2651002 - DNA, 17 bp, Homo sapiens
tcaaaatatttgtacat

SEQ ID NO: 2651003 - DNA, 16 bp, Homo sapiens
tcaaaatttgaagaat

SEQ ID NO: 2651004 - DNA, 19 bp, Homo sapiens
tcaaacaaactctctgaac

SEQ ID NO: 2651005 - DNA, 15 bp, Homo sapiens
tcaaacaaagccaga

SEQ ID NO: 2651006 - DNA, 15 bp, Homo sapiens
tcaaacaacactggt

SEQ ID NO: 2651007 - DNA, 16 bp, Homo sapiens
tcaaacagaattttaa

SEQ ID NO: 2651008 - DNA, 15 bp, Homo sapiens
tcaaacagtaggttg

SEQ ID NO: 2651009 - DNA, 15 bp, Homo sapiens
tcaaaccataaactt

SEQ ID NO: 2651010 - DNA, 16 bp, Homo sapiens
tcaaaccataaacttc

SEQ ID NO: 2651011 - DNA, 17 bp, Homo sapiens
tcaaacctgtttaaata

SEQ ID NO: 2651012 - DNA, 15 bp, Homo sapiens
tcaaacgtgaaaatg

SEQ ID NO: 2651013 - DNA, 23 bp, Homo sapiens
tcaaactgaatgaaacccccaca

SEQ ID NO: 2651014 - DNA, 15 bp, Homo sapiens
tcaaactgaggaatt

SEQ ID NO: 2651015 - DNA, 14 bp, Homo sapiens
tcaaactgtagaaa

SEQ ID NO: 2651016 - DNA, 17 bp, Homo sapiens
tcaaactgtagaaatga

SEQ ID NO: 2651017 - DNA, 15 bp, Homo sapiens
tcaaactttactatg

SEQ ID NO: 2651018 - DNA, 16 bp, Homo sapiens
tcaaagaaatgctgat

SEQ ID NO: 2651019 - DNA, 19 bp, Homo sapiens
tcaaagaaatgctgatgga

SEQ ID NO: 2651020 - DNA, 22 bp, Homo sapiens
tcaaagaaggatggcacctaaa

SEQ ID NO: 2651021 - DNA, 17 bp, Homo sapiens
tcaaagacattctgaca

SEQ ID NO: 2651022 - DNA, 23 bp, Homo sapiens
tcaaagaggttttaaaaaaatcc

SEQ ID NO: 2651023 - DNA, 20 bp, Homo sapiens
tcaaagcaaggaaactatgt

SEQ ID NO: 2651024 - DNA, 19 bp, Homo sapiens
tcaaagcaatgcattttgg

SEQ ID NO: 2651025 - DNA, 21 bp, Homo sapiens
tcaaagcaccaaaataagaaa

SEQ ID NO: 2651026 - DNA, 17 bp, Homo sapiens
tcagccagccccatcag

SEQ ID NO: 2651027 - DNA, 19 bp, Homo sapiens
tcagccaggagctgggcag

SEQ ID NO: 2651028 - DNA, 16 bp, Homo sapiens
tcagccattcactgcc

SEQ ID NO: 2651029 - DNA, 13 bp, Homo sapiens
tcagcccaccccc

SEQ ID NO: 2651030 - DNA, 12 bp, Homo sapiens
tcagcccctctt

SEQ ID NO: 2651031 - DNA, 21 bp, Homo sapiens
tcagcccctcttgccccccac

SEQ ID NO: 2651032 - DNA, 13 bp, Homo sapiens
tcagccctgaggt

SEQ ID NO: 2651033 - DNA, 23 bp, Homo sapiens
tcagccctgaggtgaaagggagc

SEQ ID NO: 2651034 - DNA, 16 bp, Homo sapiens
tcagccgggccctgag

SEQ ID NO: 2651035 - DNA, 20 bp, Homo sapiens
tcagcctagccgacctcagc

SEQ ID NO: 2651036 - DNA, 23 bp, Homo sapiens
tcagcctagccgacctcagcctt

SEQ ID NO: 2651037 - DNA, 15 bp, Homo sapiens
tcagcctccagcctc

SEQ ID NO: 2651038 - DNA, 12 bp, Homo sapiens
tcagcctcccaa

SEQ ID NO: 2651039 - DNA, 22 bp, Homo sapiens
tcagcctcccaaagtgctggga

SEQ ID NO: 2651040 - DNA, 21 bp, Homo sapiens
tcagcctcccgaatagctggg

SEQ ID NO: 2651041 - DNA, 19 bp, Homo sapiens
tcagcctcctcatctgggg

SEQ ID NO: 2651042 - DNA, 21 bp, Homo sapiens
tcagcctcctgagtagctgga

SEQ ID NO: 2651043 - DNA, 15 bp, Homo sapiens
tcagcctgagtctcc

SEQ ID NO: 2651044 - DNA, 16 bp, Homo sapiens
tcagcctgctccagct

SEQ ID NO: 2651045 - DNA, 18 bp, Homo sapiens
tcagcctgctccagctgt

SEQ ID NO: 2651046 - DNA, 18 bp, Homo sapiens
tcagcctgtctcttccat

SEQ ID NO: 2651047 - DNA, 12 bp, Homo sapiens
tcagcctgtgct

SEQ ID NO: 2651048 - DNA, 21 bp, Homo sapiens
tcagccttccccctcccaggg

SEQ ID NO: 2651049 - DNA, 23 bp, Homo sapiens
tcagccttccccttgcccagggc

SEQ ID NO: 2651050 - DNA, 14 bp, Homo sapiens
tcagctactgattt

SEQ ID NO: 2651051 - DNA, 16 bp, Homo sapiens
tcagctcccatttcta

SEQ ID NO: 2651052 - DNA, 19 bp, Homo sapiens
tcagctcccatttctactc

SEQ ID NO: 2651053 - DNA, 20 bp, Homo sapiens
tcagctcccatttctactct

SEQ ID NO: 2651054 - DNA, 13 bp, Homo sapiens
tcagctccccaga

SEQ ID NO: 2651055 - DNA, 17 bp, Homo sapiens
tcagctccccagagtcc

SEQ ID NO: 2651056 - DNA, 21 bp, Homo sapiens
tcagctcccctcggagaagag

SEQ ID NO: 2651057 - DNA, 22 bp, Homo sapiens
tcagctcccctcggagaagagc

SEQ ID NO: 2651058 - DNA, 15 bp, Homo sapiens
tcagctccttcctgg

SEQ ID NO: 2651059 - DNA, 16 bp, Homo sapiens
tcagctccttcctgga

SEQ ID NO: 2651060 - DNA, 17 bp, Homo sapiens
tcagctctgggagagga

SEQ ID NO: 2651061 - DNA, 16 bp, Homo sapiens
tcagctgaacctgggt

SEQ ID NO: 2651062 - DNA, 21 bp, Homo sapiens
tcagctggcactgtctctgct

SEQ ID NO: 2651063 - DNA, 12 bp, Homo sapiens
tcagctgtactt

SEQ ID NO: 2651064 - DNA, 15 bp, Homo sapiens
tcagctgtttgtcat

SEQ ID NO: 2651065 - DNA, 18 bp, Homo sapiens
tcagcttcatttgtgtca

SEQ ID NO: 2651066 - DNA, 19 bp, Homo sapiens
tcagcttcctacccacacc

SEQ ID NO: 2651067 - DNA, 23 bp, Homo sapiens
tcagcttcctacccacacctctg

SEQ ID NO: 2651068 - DNA, 21 bp, Homo sapiens
tcagcttcgtttattttcaag

SEQ ID NO: 2651069 - DNA, 22 bp, Homo sapiens
tcagcttgtaaatagctcaggt

SEQ ID NO: 2651070 - DNA, 16 bp, Homo sapiens
tcagcttttgcttcat

SEQ ID NO: 2651071 - DNA, 20 bp, Homo sapiens
tcagctttttgtcttttctg

SEQ ID NO: 2651072 - DNA, 20 bp, Homo sapiens
tcaggaaatatatatgtgtg

SEQ ID NO: 2651073 - DNA, 21 bp, Homo sapiens
tcaggaaatatatatgtgtgt

SEQ ID NO: 2651074 - DNA, 23 bp, Homo sapiens
tcaggaaatcaaatatgcaaagc

SEQ ID NO: 2651075 - DNA, 16 bp, Homo sapiens
tcaggaagctcagggc

SEQ ID NO: 2651076 - DNA, 17 bp, Homo sapiens
tcaggaagctcagggcc

SEQ ID NO: 2651077 - DNA, 20 bp, Homo sapiens
tcaggaagctcagggcctgg

SEQ ID NO: 2651078 - DNA, 17 bp, Homo sapiens
tcaggaaggatgagcat

SEQ ID NO: 2651079 - DNA, 12 bp, Homo sapiens
tcaggacactaa

SEQ ID NO: 2651080 - DNA, 14 bp, Homo sapiens
tcaggaccaggcaa

SEQ ID NO: 2651081 - DNA, 14 bp, Homo sapiens
tcaggactcctctc

SEQ ID NO: 2651082 - DNA, 17 bp, Homo sapiens
tcaggagaggggcagaa

SEQ ID NO: 2651083 - DNA, 18 bp, Homo sapiens
tcaggagaggggcagaac

SEQ ID NO: 2651084 - DNA, 10 bp, Homo sapiens
tcaggagcag

SEQ ID NO: 2651085 - DNA, 17 bp, Homo sapiens
tcaggagttagaggcca

SEQ ID NO: 2651086 - DNA, 19 bp, Homo sapiens
tcaggagttagaggccagc

SEQ ID NO: 2651087 - DNA, 20 bp, Homo sapiens
tcaggatcaaaccccgacca

SEQ ID NO: 2651088 - DNA, 15 bp, Homo sapiens
tcaggatgaacccag

SEQ ID NO: 2651089 - DNA, 20 bp, Homo sapiens
tcaggatgatacactatgaa

SEQ ID NO: 2651090 - DNA, 17 bp, Homo sapiens
tcaggattctgttcctt

SEQ ID NO: 2651091 - DNA, 16 bp, Homo sapiens
tcaggcataggcctgg

SEQ ID NO: 2651092 - DNA, 17 bp, Homo sapiens
tcaggcatgaacatgta

SEQ ID NO: 2651093 - DNA, 18 bp, Homo sapiens
tcaggcatgaacatgtac

SEQ ID NO: 2651094 - DNA, 16 bp, Homo sapiens
tcaggcatgcctgtgt

SEQ ID NO: 2651095 - DNA, 17 bp, Homo sapiens
tcaggccacctgccccc

SEQ ID NO: 2651096 - DNA, 19 bp, Homo sapiens
tcaggccacctgccccctt

SEQ ID NO: 2651097 - DNA, 13 bp, Homo sapiens
tcaggccacttga

SEQ ID NO: 2651098 - DNA, 17 bp, Homo sapiens
tcaggccaggccctctg

SEQ ID NO: 2651099 - DNA, 19 bp, Homo sapiens
tcaggccaggccctctgcc

SEQ ID NO: 2651100 - DNA, 23 bp, Homo sapiens
tcaggccatcatcagtggagcca

SEQ ID NO: 2651101 - DNA, 17 bp, Homo sapiens
tcaggcctccctctctc

SEQ ID NO: 2651102 - DNA, 13 bp, Homo sapiens
tcaggcctgtgtg

SEQ ID NO: 2651103 - DNA, 21 bp, Homo sapiens
tcaggcgatccacctgtctca

SEQ ID NO: 2651104 - DNA, 23 bp, Homo sapiens
tcaggcgtagatcaccagaataa

SEQ ID NO: 2651105 - DNA, 14 bp, Homo sapiens
tcaggctctgccct

SEQ ID NO: 2651106 - DNA, 12 bp, Homo sapiens
tcaggctgctgg

SEQ ID NO: 2651107 - DNA, 14 bp, Homo sapiens
tcaggctgctggcg

SEQ ID NO: 2651108 - DNA, 19 bp, Homo sapiens
tcagggaaaagcagctctc

SEQ ID NO: 2651109 - DNA, 23 bp, Homo sapiens
tcagggaaaagcagctctcccct

SEQ ID NO: 2651110 - DNA, 16 bp, Homo sapiens
tcagggaaaggccagt

SEQ ID NO: 2651111 - DNA, 22 bp, Homo sapiens
tcagggaatttcaggaactaga

SEQ ID NO: 2651112 - DNA, 15 bp, Homo sapiens
tcagggaccaaggac

SEQ ID NO: 2651113 - DNA, 20 bp, Homo sapiens
tcagggaccaaggacccctc

SEQ ID NO: 2651114 - DNA, 16 bp, Homo sapiens
tcagggacccctgccc

SEQ ID NO: 2651115 - DNA, 20 bp, Homo sapiens
tcagggattttttttttaaa

SEQ ID NO: 2651116 - DNA, 17 bp, Homo sapiens
tcagggccatgcctgcc

SEQ ID NO: 2651117 - DNA, 14 bp, Homo sapiens
tcagggcccaagtc

SEQ ID NO: 2651118 - DNA, 15 bp, Homo sapiens
tcagggcccaagtcc

SEQ ID NO: 2651119 - DNA, 19 bp, Homo sapiens
tcagggcccaagtccctgt

SEQ ID NO: 2651120 - DNA, 14 bp, Homo sapiens
tcagggccccagca

SEQ ID NO: 2651121 - DNA, 23 bp, Homo sapiens
tcagggccccagcactaaagcag

SEQ ID NO: 2651122 - DNA, 14 bp, Homo sapiens
tcagggcctggctc

SEQ ID NO: 2651123 - DNA, 13 bp, Homo sapiens
tcagggctcctgc

SEQ ID NO: 2651124 - DNA, 14 bp, Homo sapiens
tcagggctcctgcc

SEQ ID NO: 2651125 - DNA, 15 bp, Homo sapiens
tcagggctcctgcct

SEQ ID NO: 2651126 - DNA, 16 bp, Homo sapiens
tcaggggactcagccc

SEQ ID NO: 2651127 - DNA, 15 bp, Homo sapiens
tcaggggccagagga

SEQ ID NO: 2651128 - DNA, 16 bp, Homo sapiens
tcaggggccagaggaa

SEQ ID NO: 2651129 - DNA, 14 bp, Homo sapiens
tcaggggctgtttg

SEQ ID NO: 2651130 - DNA, 20 bp, Homo sapiens
tcaggggggttgtgaggcct

SEQ ID NO: 2651131 - DNA, 19 bp, Homo sapiens
tcaggggtgtgcggccttt

SEQ ID NO: 2651132 - DNA, 18 bp, Homo sapiens
tcaggggttcgagaccag

SEQ ID NO: 2651133 - DNA, 22 bp, Homo sapiens
tcaggggttcgagaccagtctg

SEQ ID NO: 2651134 - DNA, 13 bp, Homo sapiens
tcagggtccctgg

SEQ ID NO: 2651135 - DNA, 12 bp, Homo sapiens
tcagggtctctg

SEQ ID NO: 2651136 - DNA, 16 bp, Homo sapiens
tcagggttggcccctg

SEQ ID NO: 2651137 - DNA, 17 bp, Homo sapiens
tcagggttggcccctgc

SEQ ID NO: 2651138 - DNA, 19 bp, Homo sapiens
tcagggttggcccctgccc

SEQ ID NO: 2651139 - DNA, 15 bp, Homo sapiens
tcaggtaacaggcag

SEQ ID NO: 2651140 - DNA, 15 bp, Homo sapiens
tcaggtattaagaaa

SEQ ID NO: 2651141 - DNA, 15 bp, Homo sapiens
tcaggtcagggtgag

SEQ ID NO: 2651142 - DNA, 12 bp, Homo sapiens
tcaggtccctgc

SEQ ID NO: 2651143 - DNA, 19 bp, Homo sapiens
tcaggtctcccacgtggga

SEQ ID NO: 2651144 - DNA, 16 bp, Homo sapiens
tcaggtgacatgtgaa

SEQ ID NO: 2651145 - DNA, 17 bp, Homo sapiens
tcaggtgacatgtgaaa

SEQ ID NO: 2651146 - DNA, 21 bp, Homo sapiens
tcaggtgacatgtgaaacctt

SEQ ID NO: 2651147 - DNA, 22 bp, Homo sapiens
tcaggtgaccaaaatccccttc

SEQ ID NO: 2651148 - DNA, 16 bp, Homo sapiens
tcaggtgatccaccca

SEQ ID NO: 2651149 - DNA, 23 bp, Homo sapiens
tcaggtgatccacccacctcagc

SEQ ID NO: 2651150 - DNA, 15 bp, Homo sapiens
tcaggtgctgccatc

SEQ ID NO: 2651151 - DNA, 19 bp, Homo sapiens
tcaggtggggcagcttgag

SEQ ID NO: 2651152 - DNA, 22 bp, Homo sapiens
tcaggtggggtcactctggcag

SEQ ID NO: 2651153 - DNA, 18 bp, Homo sapiens
tcaggtgtccctgcactt

SEQ ID NO: 2651154 - DNA, 16 bp, Homo sapiens
tcaggttctccttgat

SEQ ID NO: 2651155 - DNA, 13 bp, Homo sapiens
tcaggtttggggt

SEQ ID NO: 2651156 - DNA, 14 bp, Homo sapiens
tcaggttttgtaaa

SEQ ID NO: 2651157 - DNA, 17 bp, Homo sapiens
tcagtaagaaaaagaag

SEQ ID NO: 2651158 - DNA, 14 bp, Homo sapiens
tcagtaatttgagg

SEQ ID NO: 2651159 - DNA, 17 bp, Homo sapiens
tcagtaccctctcagct

SEQ ID NO: 2651160 - DNA, 15 bp, Homo sapiens
tcagtacctggagga

SEQ ID NO: 2651161 - DNA, 16 bp, Homo sapiens
tcagtataattctgta

SEQ ID NO: 2651162 - DNA, 20 bp, Homo sapiens
tcagtataattctgtactga

SEQ ID NO: 2651163 - DNA, 18 bp, Homo sapiens
tcagtatctgtatctctc

SEQ ID NO: 2651164 - DNA, 16 bp, Homo sapiens
tcagtatgtggaagtg

SEQ ID NO: 2651165 - DNA, 23 bp, Homo sapiens
tcagtattgaagcattttataaa

SEQ ID NO: 2651166 - DNA, 18 bp, Homo sapiens
tcagtattttccctgcta

SEQ ID NO: 2651167 - DNA, 20 bp, Homo sapiens
tcagtcccctcccatctggg

SEQ ID NO: 2651168 - DNA, 23 bp, Homo sapiens
tcagtcccctcccatctgggagt

SEQ ID NO: 2651169 - DNA, 19 bp, Homo sapiens
tcagtctcccttctcccat

SEQ ID NO: 2651170 - DNA, 23 bp, Homo sapiens
tcagtctcccttctcccatgagg

SEQ ID NO: 2651171 - DNA, 22 bp, Homo sapiens
tctctagaattttaagtgcttt

SEQ ID NO: 2651172 - DNA, 12 bp, Homo sapiens
tctctagccact

SEQ ID NO: 2651173 - DNA, 24 bp, Homo sapiens
tctctagctggtggtttcacggtg

SEQ ID NO: 2651174 - DNA, 19 bp, Homo sapiens
tctctagtgctgtgaaaaa

SEQ ID NO: 2651175 - DNA, 22 bp, Homo sapiens
tctctatagcaccagggctcac

SEQ ID NO: 2651176 - DNA, 14 bp, Homo sapiens
tctctatttaatat

SEQ ID NO: 2651177 - DNA, 17 bp, Homo sapiens
tctctatttaatattta

SEQ ID NO: 2651178 - DNA, 16 bp, Homo sapiens
tctctcaatatgctta

SEQ ID NO: 2651179 - DNA, 16 bp, Homo sapiens
tctctcagaagggagg

SEQ ID NO: 2651180 - DNA, 17 bp, Homo sapiens
tctctcagaagggaggc

SEQ ID NO: 2651181 - DNA, 14 bp, Homo sapiens
tctctcaggagcac

SEQ ID NO: 2651182 - DNA, 17 bp, Homo sapiens
tctctcaggagcacagg

SEQ ID NO: 2651183 - DNA, 13 bp, Homo sapiens
tctctccagcccc

SEQ ID NO: 2651184 - DNA, 15 bp, Homo sapiens
tctctccagcccctg

SEQ ID NO: 2651185 - DNA, 16 bp, Homo sapiens
tctctccagcccctgg

SEQ ID NO: 2651186 - DNA, 17 bp, Homo sapiens
tctctccagcccctgga

SEQ ID NO: 2651187 - DNA, 13 bp, Homo sapiens
tctctcccatgga

SEQ ID NO: 2651188 - DNA, 17 bp, Homo sapiens
tctctcccatggagccc

SEQ ID NO: 2651189 - DNA, 20 bp, Homo sapiens
tctctcccctcaaagtctgc

SEQ ID NO: 2651190 - DNA, 21 bp, Homo sapiens
tctctcccctcaaagtctgca

SEQ ID NO: 2651191 - DNA, 21 bp, Homo sapiens
tctctccctcccctgccattt

SEQ ID NO: 2651192 - DNA, 15 bp, Homo sapiens
tctctcggctcccca

SEQ ID NO: 2651193 - DNA, 20 bp, Homo sapiens
tctctcggctccccatgtgt

SEQ ID NO: 2651194 - DNA, 17 bp, Homo sapiens
tctctctcaatttttgg

SEQ ID NO: 2651195 - DNA, 22 bp, Homo sapiens
tctctctcctgtactttttcca

SEQ ID NO: 2651196 - DNA, 13 bp, Homo sapiens
tctctctggccct

SEQ ID NO: 2651197 - DNA, 21 bp, Homo sapiens
tctctctggccctctacccct

SEQ ID NO: 2651198 - DNA, 14 bp, Homo sapiens
tctctcttctgctc

SEQ ID NO: 2651199 - DNA, 22 bp, Homo sapiens
tctctgaagagtgggtttcaca

SEQ ID NO: 2651200 - DNA, 13 bp, Homo sapiens
tctctgaagcatg

SEQ ID NO: 2651201 - DNA, 14 bp, Homo sapiens
tctctgaagcatgt

SEQ ID NO: 2651202 - DNA, 21 bp, Homo sapiens
tctctgaagcatgtttcatgt

SEQ ID NO: 2651203 - DNA, 22 bp, Homo sapiens
tctctgaagcatgtttcatgtt

SEQ ID NO: 2651204 - DNA, 16 bp, Homo sapiens
tctctgaagtgaaact

SEQ ID NO: 2651205 - DNA, 12 bp, Homo sapiens
tctctgacctac

SEQ ID NO: 2651206 - DNA, 19 bp, Homo sapiens
tctctgattttcaaagctt

SEQ ID NO: 2651207 - DNA, 17 bp, Homo sapiens
tctctgccctccaagac

SEQ ID NO: 2651208 - DNA, 15 bp, Homo sapiens
tctctgccggctctt

SEQ ID NO: 2651209 - DNA, 21 bp, Homo sapiens
tctctgcctccctcaccctga

SEQ ID NO: 2651210 - DNA, 14 bp, Homo sapiens
tctctgctccacca

SEQ ID NO: 2651211 - DNA, 18 bp, Homo sapiens
tctctgctctgcgtgtca

SEQ ID NO: 2651212 - DNA, 18 bp, Homo sapiens
tctctggagccaagtcca

SEQ ID NO: 2651213 - DNA, 19 bp, Homo sapiens
tctctggcctcccacccga

SEQ ID NO: 2651214 - DNA, 21 bp, Homo sapiens
tctctgggcttggggcttcct

SEQ ID NO: 2651215 - DNA, 17 bp, Homo sapiens
tctctggtgagcgagga

SEQ ID NO: 2651216 - DNA, 19 bp, Homo sapiens
tctctgtagggaactctgg

SEQ ID NO: 2651217 - DNA, 12 bp, Homo sapiens
tctctgtctcat

SEQ ID NO: 2651218 - DNA, 16 bp, Homo sapiens
tctctgtctcatgtgt

SEQ ID NO: 2651219 - DNA, 16 bp, Homo sapiens
tctctgtgaacgattt

SEQ ID NO: 2651220 - DNA, 22 bp, Homo sapiens
tctctgtgaacgatttagaaag

SEQ ID NO: 2651221 - DNA, 15 bp, Homo sapiens
tctctgtgctgtgga

SEQ ID NO: 2651222 - DNA, 19 bp, Homo sapiens
tctctgtgcttcaattaat

SEQ ID NO: 2651223 - DNA, 10 bp, Homo sapiens
tctctgtgtt

SEQ ID NO: 2651224 - DNA, 21 bp, Homo sapiens
tctctgttccattgaatctgt

SEQ ID NO: 2651225 - DNA, 15 bp, Homo sapiens
tctcttatagaatat

SEQ ID NO: 2651226 - DNA, 13 bp, Homo sapiens
tctcttcaggttc

SEQ ID NO: 2651227 - DNA, 16 bp, Homo sapiens
tctcttcaggttctta

SEQ ID NO: 2651228 - DNA, 11 bp, Homo sapiens
tctcttcctac

SEQ ID NO: 2651229 - DNA, 20 bp, Homo sapiens
tctcttccttttatcagtag

SEQ ID NO: 2651230 - DNA, 14 bp, Homo sapiens
tctcttctgctcca

SEQ ID NO: 2651231 - DNA, 16 bp, Homo sapiens
tctcttctgctccacc

SEQ ID NO: 2651232 - DNA, 15 bp, Homo sapiens
tctcttgagcctggg

SEQ ID NO: 2651233 - DNA, 17 bp, Homo sapiens
tctcttgagcctgggag

SEQ ID NO: 2651234 - DNA, 22 bp, Homo sapiens
tctcttgagggagcttagccaa

SEQ ID NO: 2651235 - DNA, 13 bp, Homo sapiens
tctcttgcacccg

SEQ ID NO: 2651236 - DNA, 16 bp, Homo sapiens
tctcttggtcctgctg

SEQ ID NO: 2651237 - DNA, 17 bp, Homo sapiens
tctcttggtcctgctgc

SEQ ID NO: 2651238 - DNA, 16 bp, Homo sapiens
tctcttggtttccttc

SEQ ID NO: 2651239 - DNA, 17 bp, Homo sapiens
tctcttggtttccttcc

SEQ ID NO: 2651240 - DNA, 16 bp, Homo sapiens
tctcttttcaaaacat

SEQ ID NO: 2651241 - DNA, 13 bp, Homo sapiens
tctcttttcttta

SEQ ID NO: 2651242 - DNA, 17 bp, Homo sapiens
tctcttttgaaacaata

SEQ ID NO: 2651243 - DNA, 13 bp, Homo sapiens
tctctttttcagt

SEQ ID NO: 2651244 - DNA, 18 bp, Homo sapiens
tctctttttgctttcgaa

SEQ ID NO: 2651245 - DNA, 17 bp, Homo sapiens
tctgaaaacggccctct

SEQ ID NO: 2651246 - DNA, 14 bp, Homo sapiens
tctgaaaatgtatg

SEQ ID NO: 2651247 - DNA, 18 bp, Homo sapiens
tctgaaaattaacactgc

SEQ ID NO: 2651248 - DNA, 20 bp, Homo sapiens
tctgaaaccagtgttaggga

SEQ ID NO: 2651249 - DNA, 13 bp, Homo sapiens
tctgaaatgaaga

SEQ ID NO: 2651250 - DNA, 14 bp, Homo sapiens
tctgaaatgtgata

SEQ ID NO: 2651251 - DNA, 14 bp, Homo sapiens
tctgaactcaaact

SEQ ID NO: 2651252 - DNA, 22 bp, Homo sapiens
tctgaagagtgggtttcacaag

SEQ ID NO: 2651253 - DNA, 13 bp, Homo sapiens
tctgaagcatgtt

SEQ ID NO: 2651254 - DNA, 20 bp, Homo sapiens
tctgaagcatgtttcatgtt

SEQ ID NO: 2651255 - DNA, 21 bp, Homo sapiens
tctgaagcatgtttcatgttt

SEQ ID NO: 2651256 - DNA, 13 bp, Homo sapiens
tctgaagcctcac

SEQ ID NO: 2651257 - DNA, 16 bp, Homo sapiens
tctgaagcctctggga

SEQ ID NO: 2651258 - DNA, 20 bp, Homo sapiens
tctgaagctgacgaacttcc

SEQ ID NO: 2651259 - DNA, 21 bp, Homo sapiens
tctgaaggagccccattcctg

SEQ ID NO: 2651260 - DNA, 18 bp, Homo sapiens
tctgaaggctgggttctg

SEQ ID NO: 2651261 - DNA, 14 bp, Homo sapiens
tctgaagggaggtg

SEQ ID NO: 2651262 - DNA, 22 bp, Homo sapiens
tctgaagtcacatcacaggaca

SEQ ID NO: 2651263 - DNA, 22 bp, Homo sapiens
tctgaagtgaaactgcttgttt

SEQ ID NO: 2651264 - DNA, 13 bp, Homo sapiens
tctgaatggtcca

SEQ ID NO: 2651265 - DNA, 13 bp, Homo sapiens
tctgaatgttctg

SEQ ID NO: 2651266 - DNA, 19 bp, Homo sapiens
tctgaatgttctgacatta

SEQ ID NO: 2651267 - DNA, 18 bp, Homo sapiens
tctgaattagtccttgct

SEQ ID NO: 2651268 - DNA, 19 bp, Homo sapiens
tctgaattagtccttgctt

SEQ ID NO: 2651269 - DNA, 12 bp, Homo sapiens
tctgacacacag

SEQ ID NO: 2651270 - DNA, 14 bp, Homo sapiens
tctgacacacagct

SEQ ID NO: 2651271 - DNA, 15 bp, Homo sapiens
tctgacatctctgca

SEQ ID NO: 2651272 - DNA, 16 bp, Homo sapiens
tctgacatctctgcaa

SEQ ID NO: 2651273 - DNA, 15 bp, Homo sapiens
tctgacattaacagt

SEQ ID NO: 2651274 - DNA, 18 bp, Homo sapiens
tctgacattaacagtttt

SEQ ID NO: 2651275 - DNA, 19 bp, Homo sapiens
tctgacattaacagttttc

SEQ ID NO: 2651276 - DNA, 18 bp, Homo sapiens
tctgaccacacttcctgt

SEQ ID NO: 2651277 - DNA, 22 bp, Homo sapiens
tctgaccacacttcctgtccag

SEQ ID NO: 2651278 - DNA, 13 bp, Homo sapiens
tctgaccacgtgc

SEQ ID NO: 2651279 - DNA, 14 bp, Homo sapiens
tctgacccactgct

SEQ ID NO: 2651280 - DNA, 14 bp, Homo sapiens
tctgacccagtgag

SEQ ID NO: 2651281 - DNA, 17 bp, Homo sapiens
tctgacccatgctgccc

SEQ ID NO: 2651282 - DNA, 23 bp, Homo sapiens
tctgacccatgctgccctgtgag

SEQ ID NO: 2651283 - DNA, 14 bp, Homo sapiens
tctgacctccatga

SEQ ID NO: 2651284 - DNA, 18 bp, Homo sapiens
tctgacctgcactgggga

SEQ ID NO: 2651285 - DNA, 16 bp, Homo sapiens
tctgacctgcaggcca

SEQ ID NO: 2651286 - DNA, 17 bp, Homo sapiens
tctgacctgcaggccaa

SEQ ID NO: 2651287 - DNA, 21 bp, Homo sapiens
tctgacctgcaggccaagagc

SEQ ID NO: 2651288 - DNA, 14 bp, Homo sapiens
tctgactcagggct

SEQ ID NO: 2651289 - DNA, 20 bp, Homo sapiens
tctgactcagggctcctggg

SEQ ID NO: 2651290 - DNA, 19 bp, Homo sapiens
tctgagaaagactattcaa

SEQ ID NO: 2651291 - DNA, 20 bp, Homo sapiens
tctgagaaagactattcaaa

SEQ ID NO: 2651292 - DNA, 17 bp, Homo sapiens
tctgagcaagagctggc

SEQ ID NO: 2651293 - DNA, 19 bp, Homo sapiens
tctgagcccgggctgcctg

SEQ ID NO: 2651294 - DNA, 20 bp, Homo sapiens
tctgagctatttcatctatt

SEQ ID NO: 2651295 - DNA, 22 bp, Homo sapiens
tctgagctatttcatctatttt

SEQ ID NO: 2651296 - DNA, 17 bp, Homo sapiens
tctgagctgctctgaat

SEQ ID NO: 2651297 - DNA, 16 bp, Homo sapiens
tctgaggaatccagac

SEQ ID NO: 2651298 - DNA, 20 bp, Homo sapiens
tctgaggacactaaccacgc

SEQ ID NO: 2651299 - DNA, 11 bp, Homo sapiens
tctgaggctgt

SEQ ID NO: 2651300 - DNA, 19 bp, Homo sapiens
tctgaggcttccagagagt

SEQ ID NO: 2651301 - DNA, 13 bp, Homo sapiens
tctgagggaggag

SEQ ID NO: 2651302 - DNA, 21 bp, Homo sapiens
tctgagggaggaggccacctc

SEQ ID NO: 2651303 - DNA, 19 bp, Homo sapiens
tctgaggggcaactgagtc

SEQ ID NO: 2651304 - DNA, 23 bp, Homo sapiens
tctgagtatctcctcgcaagctg

SEQ ID NO: 2651305 - DNA, 22 bp, Homo sapiens
tctgagtttcattctcctgcct

SEQ ID NO: 2651306 - DNA, 15 bp, Homo sapiens
tctgataggccaagt

SEQ ID NO: 2651307 - DNA, 17 bp, Homo sapiens
tctgatattccatgaat

SEQ ID NO: 2651308 - DNA, 22 bp, Homo sapiens
tctgatattccatgaatgtatc

SEQ ID NO: 2651309 - DNA, 17 bp, Homo sapiens
tctgatcatccactgtg

SEQ ID NO: 2651310 - DNA, 22 bp, Homo sapiens
tctgatctgtgctttccagctc

SEQ ID NO: 2651311 - DNA, 23 bp, Homo sapiens
tctgatctgtgctttccagctca

SEQ ID NO: 2651312 - DNA, 13 bp, Homo sapiens
tctgatggcttct

SEQ ID NO: 2651313 - DNA, 18 bp, Homo sapiens
tctgattacacaaaacaa

SEQ ID NO: 2651314 - DNA, 13 bp, Homo sapiens
tctgattccactt

SEQ ID NO: 2651315 - DNA, 20 bp, Homo sapiens
tctgcaagaattgaagcagg

SEQ ID NO: 2651316 - DNA, 16 bp, Homo sapiens
tgaattttgttgctgt

SEQ ID NO: 2651317 - DNA, 18 bp, Homo sapiens
tgaattttgtttggactt

SEQ ID NO: 2651318 - DNA, 22 bp, Homo sapiens
tgaatttttaaaacccatttaa

SEQ ID NO: 2651319 - DNA, 15 bp, Homo sapiens
tgaatttttctctaa

SEQ ID NO: 2651320 - DNA, 22 bp, Homo sapiens
tgaatttttctctaactcagaa

SEQ ID NO: 2651321 - DNA, 14 bp, Homo sapiens
tgacaaaaattcaa

SEQ ID NO: 2651322 - DNA, 17 bp, Homo sapiens
tgacaaacctctaaccc

SEQ ID NO: 2651323 - DNA, 19 bp, Homo sapiens
tgacaaagactgagtacgt

SEQ ID NO: 2651324 - DNA, 21 bp, Homo sapiens
tgacaaagagtagacatttct

SEQ ID NO: 2651325 - DNA, 16 bp, Homo sapiens
tgacaaagcttggaag

SEQ ID NO: 2651326 - DNA, 14 bp, Homo sapiens
tgacaaagttactg

SEQ ID NO: 2651327 - DNA, 13 bp, Homo sapiens
tgacaacagaagc

SEQ ID NO: 2651328 - DNA, 16 bp, Homo sapiens
tgacaaccaccgctcc

SEQ ID NO: 2651329 - DNA, 19 bp, Homo sapiens
tgacaactttgccagcttt

SEQ ID NO: 2651330 - DNA, 15 bp, Homo sapiens
tgacaagccccaggc

SEQ ID NO: 2651331 - DNA, 18 bp, Homo sapiens
tgacaaggattgctactg

SEQ ID NO: 2651332 - DNA, 23 bp, Homo sapiens
tgacaaggattgctactgtccta

SEQ ID NO: 2651333 - DNA, 14 bp, Homo sapiens
tgacaaggccccag

SEQ ID NO: 2651334 - DNA, 14 bp, Homo sapiens
tgacaagtcatttt

SEQ ID NO: 2651335 - DNA, 15 bp, Homo sapiens
tgacaatcaactcta

SEQ ID NO: 2651336 - DNA, 22 bp, Homo sapiens
tgacaattttgtacaaatttgt

SEQ ID NO: 2651337 - DNA, 14 bp, Homo sapiens
tgacacacagctct

SEQ ID NO: 2651338 - DNA, 19 bp, Homo sapiens
tgacacacagctctgtcct

SEQ ID NO: 2651339 - DNA, 21 bp, Homo sapiens
tgacacatatgcaccttgtgt

SEQ ID NO: 2651340 - DNA, 13 bp, Homo sapiens
tgacaccagcctt

SEQ ID NO: 2651341 - DNA, 16 bp, Homo sapiens
tgacaccagcctttct

SEQ ID NO: 2651342 - DNA, 18 bp, Homo sapiens
tgacactagcccaatgaa

SEQ ID NO: 2651343 - DNA, 22 bp, Homo sapiens
tgacactagcccaatgaaatga

SEQ ID NO: 2651344 - DNA, 14 bp, Homo sapiens
tgacactcccttgg

SEQ ID NO: 2651345 - DNA, 20 bp, Homo sapiens
tgacacttcagagagctggt

SEQ ID NO: 2651346 - DNA, 23 bp, Homo sapiens
tgacacttcagagagctggtagt

SEQ ID NO: 2651347 - DNA, 14 bp, Homo sapiens
tgacacttccagtc

SEQ ID NO: 2651348 - DNA, 15 bp, Homo sapiens
tgacacttgtcccca

SEQ ID NO: 2651349 - DNA, 22 bp, Homo sapiens
tgacactttaattaccaacctg

SEQ ID NO: 2651350 - DNA, 13 bp, Homo sapiens
tgacagaaagcag

SEQ ID NO: 2651351 - DNA, 15 bp, Homo sapiens
tgacagaacactgtc

SEQ ID NO: 2651352 - DNA, 13 bp, Homo sapiens
tgacagacacagg

SEQ ID NO: 2651353 - DNA, 18 bp, Homo sapiens
tgacagacacaggcccgg

SEQ ID NO: 2651354 - DNA, 20 bp, Homo sapiens
tgacagacacaggcccggct

SEQ ID NO: 2651355 - DNA, 14 bp, Homo sapiens
tgacagactcctga

SEQ ID NO: 2651356 - DNA, 15 bp, Homo sapiens
tgacagactcctgag

SEQ ID NO: 2651357 - DNA, 22 bp, Homo sapiens
tgacagagcaagtgagaccctg

SEQ ID NO: 2651358 - DNA, 12 bp, Homo sapiens
tgacagagccag

SEQ ID NO: 2651359 - DNA, 23 bp, Homo sapiens
tgacagagccttctgaggacatt

SEQ ID NO: 2651360 - DNA, 13 bp, Homo sapiens
tgacagaggcagc

SEQ ID NO: 2651361 - DNA, 14 bp, Homo sapiens
tgacagaggcagcc

SEQ ID NO: 2651362 - DNA, 17 bp, Homo sapiens
tgacagaggcagcccca

SEQ ID NO: 2651363 - DNA, 14 bp, Homo sapiens
tgacagagtgagac

SEQ ID NO: 2651364 - DNA, 15 bp, Homo sapiens
tgacagagttcacta

SEQ ID NO: 2651365 - DNA, 18 bp, Homo sapiens
tgacagatcaagctgtga

SEQ ID NO: 2651366 - DNA, 22 bp, Homo sapiens
tgacagatgtcagccgagccgg

SEQ ID NO: 2651367 - DNA, 19 bp, Homo sapiens
tgacagatgttgaatgccc

SEQ ID NO: 2651368 - DNA, 14 bp, Homo sapiens
tgacagcaggtggg

SEQ ID NO: 2651369 - DNA, 19 bp, Homo sapiens
tgacagcctcccaccccca

SEQ ID NO: 2651370 - DNA, 20 bp, Homo sapiens
tgacaggcaatgctggctgt

SEQ ID NO: 2651371 - DNA, 19 bp, Homo sapiens
tgacaggcagcagagactt

SEQ ID NO: 2651372 - DNA, 13 bp, Homo sapiens
tgacagggaagct

SEQ ID NO: 2651373 - DNA, 16 bp, Homo sapiens
tgacagggaagctaca

SEQ ID NO: 2651374 - DNA, 20 bp, Homo sapiens
tgacagggaagctacaggtt

SEQ ID NO: 2651375 - DNA, 23 bp, Homo sapiens
tgacagggaagctacaggttaca

SEQ ID NO: 2651376 - DNA, 11 bp, Homo sapiens
tgacagggcac

SEQ ID NO: 2651377 - DNA, 17 bp, Homo sapiens
tgacaggtaaattaaga

SEQ ID NO: 2651378 - DNA, 23 bp, Homo sapiens
tgacagtcttgtgcttttcctat

SEQ ID NO: 2651379 - DNA, 19 bp, Homo sapiens
tgacagtgttgaaaatgtt

SEQ ID NO: 2651380 - DNA, 17 bp, Homo sapiens
tgacagttctgaagaat

SEQ ID NO: 2651381 - DNA, 15 bp, Homo sapiens
tgacatatttttgct

SEQ ID NO: 2651382 - DNA, 20 bp, Homo sapiens
tgacatcacttgtacaaaat

SEQ ID NO: 2651383 - DNA, 17 bp, Homo sapiens
tgacatcagtggcatgg

SEQ ID NO: 2651384 - DNA, 19 bp, Homo sapiens
tgacatctcaggggccaga

SEQ ID NO: 2651385 - DNA, 13 bp, Homo sapiens
tgacatctctgca

SEQ ID NO: 2651386 - DNA, 13 bp, Homo sapiens
tgacatctctttg

SEQ ID NO: 2651387 - DNA, 18 bp, Homo sapiens
tgacatgcactcagctct

SEQ ID NO: 2651388 - DNA, 17 bp, Homo sapiens
tgacatgtgaaaccttt

SEQ ID NO: 2651389 - DNA, 21 bp, Homo sapiens
tgacatgtgaaacctttttta

SEQ ID NO: 2651390 - DNA, 17 bp, Homo sapiens
tgacatgtggaaagtga

SEQ ID NO: 2651391 - DNA, 21 bp, Homo sapiens
tgacatgtggaaagtgaattt

SEQ ID NO: 2651392 - DNA, 19 bp, Homo sapiens
tgacatgttatatattttt

SEQ ID NO: 2651393 - DNA, 17 bp, Homo sapiens
tgacattaacagttttc

SEQ ID NO: 2651394 - DNA, 15 bp, Homo sapiens
tgacattgctttact

SEQ ID NO: 2651395 - DNA, 20 bp, Homo sapiens
tgacattgttggccaaagcc

SEQ ID NO: 2651396 - DNA, 21 bp, Homo sapiens
tgacatttatttttcatttag

SEQ ID NO: 2651397 - DNA, 21 bp, Homo sapiens
tgacatttggagtgttcccct

SEQ ID NO: 2651398 - DNA, 16 bp, Homo sapiens
tgaccaaaatcccctt

SEQ ID NO: 2651399 - DNA, 16 bp, Homo sapiens
tgaccaactagacatt

SEQ ID NO: 2651400 - DNA, 16 bp, Homo sapiens
tgaccaagcaggaagc

SEQ ID NO: 2651401 - DNA, 16 bp, Homo sapiens
tgaccaagttataaat

SEQ ID NO: 2651402 - DNA, 17 bp, Homo sapiens
tgaccaatattgtacag

SEQ ID NO: 2651403 - DNA, 18 bp, Homo sapiens
tgaccaatattgtacagt

SEQ ID NO: 2651404 - DNA, 18 bp, Homo sapiens
tgaccaatgatggtcacc

SEQ ID NO: 2651405 - DNA, 13 bp, Homo sapiens
tgaccaccctccc

SEQ ID NO: 2651406 - DNA, 15 bp, Homo sapiens
tgaccaccctcccct

SEQ ID NO: 2651407 - DNA, 16 bp, Homo sapiens
tgaccaccctcccctc

SEQ ID NO: 2651408 - DNA, 20 bp, Homo sapiens
tgaccactgcagaagacagt

SEQ ID NO: 2651409 - DNA, 20 bp, Homo sapiens
tgaccagcagatcccagctc

SEQ ID NO: 2651410 - DNA, 22 bp, Homo sapiens
tgaccagcctccatgctgcctc

SEQ ID NO: 2651411 - DNA, 16 bp, Homo sapiens
tgaccaggcatcctcc

SEQ ID NO: 2651412 - DNA, 21 bp, Homo sapiens
tgaccagtttaacctgatgca

SEQ ID NO: 2651413 - DNA, 22 bp, Homo sapiens
tgaccatccactctaccctccc

SEQ ID NO: 2651414 - DNA, 16 bp, Homo sapiens
tgaccattctccacct

SEQ ID NO: 2651415 - DNA, 18 bp, Homo sapiens
tgaccattctccacctgc

SEQ ID NO: 2651416 - DNA, 19 bp, Homo sapiens
tgaccattctccacctgcc

SEQ ID NO: 2651417 - DNA, 21 bp, Homo sapiens
tgaccattctccacctgccag

SEQ ID NO: 2651418 - DNA, 22 bp, Homo sapiens
tgaccattctccacctgccagg

SEQ ID NO: 2651419 - DNA, 17 bp, Homo sapiens
tgacccacaagaaatga

SEQ ID NO: 2651420 - DNA, 16 bp, Homo sapiens
tgacccacccctgtgc

SEQ ID NO: 2651421 - DNA, 17 bp, Homo sapiens
tgacccacccctgtgct

SEQ ID NO: 2651422 - DNA, 13 bp, Homo sapiens
tgacccaggccgc

SEQ ID NO: 2651423 - DNA, 15 bp, Homo sapiens
tgacccaggccgcag

SEQ ID NO: 2651424 - DNA, 22 bp, Homo sapiens
tgacccaggccgcagctcttgc

SEQ ID NO: 2651425 - DNA, 14 bp, Homo sapiens
tgacccaggctggg

SEQ ID NO: 2651426 - DNA, 17 bp, Homo sapiens
tgacccaggctgggcaa

SEQ ID NO: 2651427 - DNA, 13 bp, Homo sapiens
tgacccagtgaga

SEQ ID NO: 2651428 - DNA, 16 bp, Homo sapiens
tgacccatgctgccct

SEQ ID NO: 2651429 - DNA, 22 bp, Homo sapiens
tgaccccaaacaccttccagct

SEQ ID NO: 2651430 - DNA, 22 bp, Homo sapiens
tgacccccaaccaagtggctcc

SEQ ID NO: 2651431 - DNA, 13 bp, Homo sapiens
tgacccctgctca

SEQ ID NO: 2651432 - DNA, 14 bp, Homo sapiens
tgacccggaggcca

SEQ ID NO: 2651433 - DNA, 20 bp, Homo sapiens
tgacccggaggccacatgag

SEQ ID NO: 2651434 - DNA, 21 bp, Homo sapiens
tgacccggaggccacatgagt

SEQ ID NO: 2651435 - DNA, 13 bp, Homo sapiens
tgaccctcctgtt

SEQ ID NO: 2651436 - DNA, 16 bp, Homo sapiens
tgaccctcctgttgca

SEQ ID NO: 2651437 - DNA, 23 bp, Homo sapiens
tgaccctctgaatggtccagggt

SEQ ID NO: 2651438 - DNA, 15 bp, Homo sapiens
tgaccctgaagtgag

SEQ ID NO: 2651439 - DNA, 20 bp, Homo sapiens
tgaccgtgggcggggccttg

SEQ ID NO: 2651440 - DNA, 18 bp, Homo sapiens
tgacctactcgagggact

SEQ ID NO: 2651441 - DNA, 13 bp, Homo sapiens
tgacctactctca

SEQ ID NO: 2651442 - DNA, 17 bp, Homo sapiens
tgacctcaacctgtgat

SEQ ID NO: 2651443 - DNA, 18 bp, Homo sapiens
tgacctcaacctgtgatg

SEQ ID NO: 2651444 - DNA, 20 bp, Homo sapiens
tgacctcaggtgatccaccc

SEQ ID NO: 2651445 - DNA, 21 bp, Homo sapiens
tgacctcaggtgatccaccca

SEQ ID NO: 2651446 - DNA, 22 bp, Homo sapiens
tgacctcaggtgatccacccac

SEQ ID NO: 2651447 - DNA, 22 bp, Homo sapiens
tgacctcatgcatctccacctg

SEQ ID NO: 2651448 - DNA, 14 bp, Homo sapiens
tgacctcccagccc

SEQ ID NO: 2651449 - DNA, 15 bp, Homo sapiens
tgacctcccagccct

SEQ ID NO: 2651450 - DNA, 16 bp, Homo sapiens
tgacctcccagcccta

SEQ ID NO: 2651451 - DNA, 22 bp, Homo sapiens
tgacctcccagccctatggatg

SEQ ID NO: 2651452 - DNA, 14 bp, Homo sapiens
tgacctccctctaa

SEQ ID NO: 2651453 - DNA, 21 bp, Homo sapiens
tgacctctgcagcaataaagc

SEQ ID NO: 2651454 - DNA, 17 bp, Homo sapiens
tgacctctgttgtcctc

SEQ ID NO: 2651455 - DNA, 13 bp, Homo sapiens
tgacctgaagttc

SEQ ID NO: 2651456 - DNA, 14 bp, Homo sapiens
tgacctgaagttca

SEQ ID NO: 2651457 - DNA, 15 bp, Homo sapiens
tgacctgaggaagcg

SEQ ID NO: 2651458 - DNA, 17 bp, Homo sapiens
tgacctgaggcccttct

SEQ ID NO: 2651459 - DNA, 20 bp, Homo sapiens
tgacctgtcatgcccccctc

SEQ ID NO: 2651460 - DNA, 18 bp, Homo sapiens
tgattccctcctgctact

SEQ ID NO: 2651461 - DNA, 22 bp, Homo sapiens
tgattcgcccaaagccagacag

SEQ ID NO: 2651462 - DNA, 19 bp, Homo sapiens
tgattctaatgtcttcatt

SEQ ID NO: 2651463 - DNA, 12 bp, Homo sapiens
tgattctcaggg

SEQ ID NO: 2651464 - DNA, 21 bp, Homo sapiens
tgattctcagggtctctgctg

SEQ ID NO: 2651465 - DNA, 22 bp, Homo sapiens
tgattctcagggtctctgctgc

SEQ ID NO: 2651466 - DNA, 13 bp, Homo sapiens
tgattctcctgcc

SEQ ID NO: 2651467 - DNA, 15 bp, Homo sapiens
tgattctcctgcctc

SEQ ID NO: 2651468 - DNA, 12 bp, Homo sapiens
tgattctgcctt

SEQ ID NO: 2651469 - DNA, 15 bp, Homo sapiens
tgattcttgagttta

SEQ ID NO: 2651470 - DNA, 23 bp, Homo sapiens
tgattctttttaaagtgtttctg

SEQ ID NO: 2651471 - DNA, 13 bp, Homo sapiens
tgattgctaaatg

SEQ ID NO: 2651472 - DNA, 13 bp, Homo sapiens
tgattggaggggg

SEQ ID NO: 2651473 - DNA, 12 bp, Homo sapiens
tgattggctcac

SEQ ID NO: 2651474 - DNA, 15 bp, Homo sapiens
tgattgggacagagg

SEQ ID NO: 2651475 - DNA, 19 bp, Homo sapiens
tgattggtgcaacccttac

SEQ ID NO: 2651476 - DNA, 14 bp, Homo sapiens
tgattgtaaaatag

SEQ ID NO: 2651477 - DNA, 18 bp, Homo sapiens
tgattgtaacgttgctgt

SEQ ID NO: 2651478 - DNA, 21 bp, Homo sapiens
tgattgtaacgttgctgtggg

SEQ ID NO: 2651479 - DNA, 13 bp, Homo sapiens
tgatttaataaaa

SEQ ID NO: 2651480 - DNA, 19 bp, Homo sapiens
tgatttaataaaataattc

SEQ ID NO: 2651481 - DNA, 21 bp, Homo sapiens
tgatttaataaaataattcta

SEQ ID NO: 2651482 - DNA, 22 bp, Homo sapiens
tgatttaataaaataattctaa

SEQ ID NO: 2651483 - DNA, 23 bp, Homo sapiens
tgatttaataaaataattctaaa

SEQ ID NO: 2651484 - DNA, 18 bp, Homo sapiens
tgatttaatagtgttaat

SEQ ID NO: 2651485 - DNA, 22 bp, Homo sapiens
tgatttaatagtgttaatcaat

SEQ ID NO: 2651486 - DNA, 16 bp, Homo sapiens
tgatttcacaacagat

SEQ ID NO: 2651487 - DNA, 19 bp, Homo sapiens
tgatttcacaacagatcaa

SEQ ID NO: 2651488 - DNA, 21 bp, Homo sapiens
tgatttcagcacctacagtgt

SEQ ID NO: 2651489 - DNA, 13 bp, Homo sapiens
tgatttcattcaa

SEQ ID NO: 2651490 - DNA, 17 bp, Homo sapiens
tgatttcatttcaactg

SEQ ID NO: 2651491 - DNA, 18 bp, Homo sapiens
tgatttccgttaaaatac

SEQ ID NO: 2651492 - DNA, 17 bp, Homo sapiens
tgatttctagaaagcct

SEQ ID NO: 2651493 - DNA, 13 bp, Homo sapiens
tgatttctattca

SEQ ID NO: 2651494 - DNA, 20 bp, Homo sapiens
tgatttctattcaaggtggc

SEQ ID NO: 2651495 - DNA, 19 bp, Homo sapiens
tgatttcttctgttttctg

SEQ ID NO: 2651496 - DNA, 14 bp, Homo sapiens
tgatttgactgttt

SEQ ID NO: 2651497 - DNA, 20 bp, Homo sapiens
tgatttgactgtttttaccc

SEQ ID NO: 2651498 - DNA, 16 bp, Homo sapiens
tgattttaacaataac

SEQ ID NO: 2651499 - DNA, 18 bp, Homo sapiens
tgattttaacaataacta

SEQ ID NO: 2651500 - DNA, 22 bp, Homo sapiens
tgattttaacaataactactgt

SEQ ID NO: 2651501 - DNA, 15 bp, Homo sapiens
tgattttaactctgt

SEQ ID NO: 2651502 - DNA, 13 bp, Homo sapiens
tgattttcattgc

SEQ ID NO: 2651503 - DNA, 15 bp, Homo sapiens
tgattttcattgctg

SEQ ID NO: 2651504 - DNA, 13 bp, Homo sapiens
tgattttgcaaat

SEQ ID NO: 2651505 - DNA, 16 bp, Homo sapiens
tgattttgctgtagaa

SEQ ID NO: 2651506 - DNA, 18 bp, Homo sapiens
tgatttttttttcataca

SEQ ID NO: 2651507 - DNA, 16 bp, Homo sapiens
tgatttttttttttca

SEQ ID NO: 2651508 - DNA, 20 bp, Homo sapiens
tgcaaaagactaatttaaaa

SEQ ID NO: 2651509 - DNA, 19 bp, Homo sapiens
tgcaaaaggactctcagga

SEQ ID NO: 2651510 - DNA, 17 bp, Homo sapiens
tgcaaaatgagaccctc

SEQ ID NO: 2651511 - DNA, 22 bp, Homo sapiens
tgcaaacatggggttggctggg

SEQ ID NO: 2651512 - DNA, 12 bp, Homo sapiens
tgcaaactttat

SEQ ID NO: 2651513 - DNA, 12 bp, Homo sapiens
tgcaaagaaaat

SEQ ID NO: 2651514 - DNA, 18 bp, Homo sapiens
tgcaaagcactgacttct

SEQ ID NO: 2651515 - DNA, 22 bp, Homo sapiens
tgcaaagcactgacttctaagt

SEQ ID NO: 2651516 - DNA, 13 bp, Homo sapiens
tgcaaaggaaata

SEQ ID NO: 2651517 - DNA, 14 bp, Homo sapiens
tgcaaaggctggga

SEQ ID NO: 2651518 - DNA, 14 bp, Homo sapiens
tgcaaatcctatgt

SEQ ID NO: 2651519 - DNA, 17 bp, Homo sapiens
tgcaaatcctatgtgat

SEQ ID NO: 2651520 - DNA, 18 bp, Homo sapiens
tgcaaatcctatgtgatt

SEQ ID NO: 2651521 - DNA, 19 bp, Homo sapiens
tgcaaatcctatgtgattt

SEQ ID NO: 2651522 - DNA, 22 bp, Homo sapiens
tgcaaatgtcagatacaatgta

SEQ ID NO: 2651523 - DNA, 18 bp, Homo sapiens
tgcaaatgtcatcagaac

SEQ ID NO: 2651524 - DNA, 24 bp, Homo sapiens
tgcaacagcactggctctctccag

SEQ ID NO: 2651525 - DNA, 20 bp, Homo sapiens
tgcaacaggctgggcttcag

SEQ ID NO: 2651526 - DNA, 14 bp, Homo sapiens
tgcaacagtagcat

SEQ ID NO: 2651527 - DNA, 15 bp, Homo sapiens
tgcaacccttacccc

SEQ ID NO: 2651528 - DNA, 20 bp, Homo sapiens
tgcaacctccgcctcccggg

SEQ ID NO: 2651529 - DNA, 19 bp, Homo sapiens
tgcaacctcgctggactct

SEQ ID NO: 2651530 - DNA, 22 bp, Homo sapiens
tgcaacctcgctggactctcag

SEQ ID NO: 2651531 - DNA, 14 bp, Homo sapiens
tgcaacctgttgat

SEQ ID NO: 2651532 - DNA, 22 bp, Homo sapiens
tgcaacttcatgtcaacttctg

SEQ ID NO: 2651533 - DNA, 13 bp, Homo sapiens
tgcaacttctgcc

SEQ ID NO: 2651534 - DNA, 19 bp, Homo sapiens
tgcaactttaagcagctct

SEQ ID NO: 2651535 - DNA, 20 bp, Homo sapiens
tgcaactttaagcagctctt

SEQ ID NO: 2651536 - DNA, 17 bp, Homo sapiens
tgcaagagactctggcc

SEQ ID NO: 2651537 - DNA, 18 bp, Homo sapiens
tgcaagagactctggcct

SEQ ID NO: 2651538 - DNA, 19 bp, Homo sapiens
tgcaagagactctggcctc

SEQ ID NO: 2651539 - DNA, 18 bp, Homo sapiens
tgcaagattctgaaacat

SEQ ID NO: 2651540 - DNA, 16 bp, Homo sapiens
tgcaagcagggctctg

SEQ ID NO: 2651541 - DNA, 20 bp, Homo sapiens
tgcaaggaagccacagctgg

SEQ ID NO: 2651542 - DNA, 12 bp, Homo sapiens
tgcaaggaagga

SEQ ID NO: 2651543 - DNA, 19 bp, Homo sapiens
tgcaaggaaggaaagaaag

SEQ ID NO: 2651544 - DNA, 17 bp, Homo sapiens
tgcaaggaccaggactc

SEQ ID NO: 2651545 - DNA, 13 bp, Homo sapiens
tgcaaggcaaaga

SEQ ID NO: 2651546 - DNA, 20 bp, Homo sapiens
tgcaagggcagaacactaac

SEQ ID NO: 2651547 - DNA, 21 bp, Homo sapiens
tgcaagggcagaacactaacc

SEQ ID NO: 2651548 - DNA, 22 bp, Homo sapiens
tgcaagggcagaacactaacct

SEQ ID NO: 2651549 - DNA, 16 bp, Homo sapiens
tgcaagggctccccac

SEQ ID NO: 2651550 - DNA, 22 bp, Homo sapiens
tgcaagtatgtgagtgtgtcca

SEQ ID NO: 2651551 - DNA, 22 bp, Homo sapiens
tgcaagtatgttttagcatgtg

SEQ ID NO: 2651552 - DNA, 21 bp, Homo sapiens
tgcaagtggtagcaagaagtg

SEQ ID NO: 2651553 - DNA, 18 bp, Homo sapiens
tgcaagtgtctgtgtgca

SEQ ID NO: 2651554 - DNA, 21 bp, Homo sapiens
tgcaagtgtgtgcacatgtgt

SEQ ID NO: 2651555 - DNA, 20 bp, Homo sapiens
tgcaatagaacagagaaaga

SEQ ID NO: 2651556 - DNA, 23 bp, Homo sapiens
tgcaatatatctaaattgaataa

SEQ ID NO: 2651557 - DNA, 22 bp, Homo sapiens
tgcaatcgtaatgtacagatgg

SEQ ID NO: 2651558 - DNA, 21 bp, Homo sapiens
tgcaatgacacagtcttggct

SEQ ID NO: 2651559 - DNA, 16 bp, Homo sapiens
tgcaatgacatcttca

SEQ ID NO: 2651560 - DNA, 17 bp, Homo sapiens
tgcaatgacatcttcaa

SEQ ID NO: 2651561 - DNA, 15 bp, Homo sapiens
tgcaatggcagcctt

SEQ ID NO: 2651562 - DNA, 16 bp, Homo sapiens
tgcaatggcagccttg

SEQ ID NO: 2651563 - DNA, 17 bp, Homo sapiens
tgcaatggttaacatct

SEQ ID NO: 2651564 - DNA, 16 bp, Homo sapiens
tgcaatgtgctactga

SEQ ID NO: 2651565 - DNA, 22 bp, Homo sapiens
tgcaatttattaaaatgattgt

SEQ ID NO: 2651566 - DNA, 19 bp, Homo sapiens
tgcaatttgggagatatat

SEQ ID NO: 2651567 - DNA, 18 bp, Homo sapiens
tgcacaagctccaagctc

SEQ ID NO: 2651568 - DNA, 15 bp, Homo sapiens
tgcacaagctgcacc

SEQ ID NO: 2651569 - DNA, 18 bp, Homo sapiens
tgcacaagctgcaccctc

SEQ ID NO: 2651570 - DNA, 15 bp, Homo sapiens
tgcacaataaaaatg

SEQ ID NO: 2651571 - DNA, 20 bp, Homo sapiens
tgcacaataaaaatgtttaa

SEQ ID NO: 2651572 - DNA, 10 bp, Homo sapiens
tgcacacatt

SEQ ID NO: 2651573 - DNA, 15 bp, Homo sapiens
tgcacacatttttta

SEQ ID NO: 2651574 - DNA, 20 bp, Homo sapiens
tgcacacattttttaaatgc

SEQ ID NO: 2651575 - DNA, 18 bp, Homo sapiens
tgcacactcccctgcact

SEQ ID NO: 2651576 - DNA, 23 bp, Homo sapiens
tgcacacttgtgtgtgggctgtg

SEQ ID NO: 2651577 - DNA, 14 bp, Homo sapiens
tgcacactttgcca

SEQ ID NO: 2651578 - DNA, 12 bp, Homo sapiens
tgcacagagctc

SEQ ID NO: 2651579 - DNA, 18 bp, Homo sapiens
tgcacagagctctccagc

SEQ ID NO: 2651580 - DNA, 21 bp, Homo sapiens
tgcacagagctctccagctcc

SEQ ID NO: 2651581 - DNA, 17 bp, Homo sapiens
tgcacagagttgttaca

SEQ ID NO: 2651582 - DNA, 16 bp, Homo sapiens
tgcacagcggcccctg

SEQ ID NO: 2651583 - DNA, 14 bp, Homo sapiens
tgcacagggagacg

SEQ ID NO: 2651584 - DNA, 16 bp, Homo sapiens
tgcacagggagacgta

SEQ ID NO: 2651585 - DNA, 21 bp, Homo sapiens
tgcacatacgcaccacatctc

SEQ ID NO: 2651586 - DNA, 18 bp, Homo sapiens
tgcacatatggactctgc

SEQ ID NO: 2651587 - DNA, 19 bp, Homo sapiens
tgcacatatggactctgca

SEQ ID NO: 2651588 - DNA, 15 bp, Homo sapiens
tgcacatgtcttgta

SEQ ID NO: 2651589 - DNA, 19 bp, Homo sapiens
tgcacatgtcttgtacatg

SEQ ID NO: 2651590 - DNA, 22 bp, Homo sapiens
tgcacatgtcttgtacatgtgt

SEQ ID NO: 2651591 - DNA, 19 bp, Homo sapiens
tgcacatgtgtgcgtgtgc

SEQ ID NO: 2651592 - DNA, 15 bp, Homo sapiens
tgcaccactgcactc

SEQ ID NO: 2651593 - DNA, 17 bp, Homo sapiens
tgcacccacccaggagt

SEQ ID NO: 2651594 - DNA, 15 bp, Homo sapiens
tgcacccaggggtgg

SEQ ID NO: 2651595 - DNA, 16 bp, Homo sapiens
tgcaccccatgctgtt

SEQ ID NO: 2651596 - DNA, 18 bp, Homo sapiens
tgcaccctccaccctgtc

SEQ ID NO: 2651597 - DNA, 22 bp, Homo sapiens
tgcaccctggggcctggacctg

SEQ ID NO: 2651598 - DNA, 18 bp, Homo sapiens
tgcaccggctggcctggc

SEQ ID NO: 2651599 - DNA, 16 bp, Homo sapiens
tgcacctgccagcctg

SEQ ID NO: 2651600 - DNA, 20 bp, Homo sapiens
tgcacctgccagcctggctt

SEQ ID NO: 2651601 - DNA, 18 bp, Homo sapiens
tgcaccttaccaactttc

SEQ ID NO: 2651602 - DNA, 20 bp, Homo sapiens
tgcaccttaccaactttctg

SEQ ID NO: 2651603 - DNA, 21 bp, Homo sapiens
tgcaccttaccaactttctgt

SEQ ID NO: 2651604 - DNA, 21 bp, Homo sapiens
tgccccatcagtgctccctca

SEQ ID NO: 2651605 - DNA, 23 bp, Homo sapiens
tgccccatgcctgtccagcctgg

SEQ ID NO: 2651606 - DNA, 21 bp, Homo sapiens
tgcccccaccacggccactgg

SEQ ID NO: 2651607 - DNA, 15 bp, Homo sapiens
tgccccccaccccag

SEQ ID NO: 2651608 - DNA, 18 bp, Homo sapiens
tgccccccttgccagaca

SEQ ID NO: 2651609 - DNA, 15 bp, Homo sapiens
tgcccccggccccct

SEQ ID NO: 2651610 - DNA, 11 bp, Homo sapiens
tgccccctcct

SEQ ID NO: 2651611 - DNA, 12 bp, Homo sapiens
tgccccctcctc

SEQ ID NO: 2651612 - DNA, 14 bp, Homo sapiens
tgccccctgctggc

SEQ ID NO: 2651613 - DNA, 21 bp, Homo sapiens
tgccccctggtggacagtcct

SEQ ID NO: 2651614 - DNA, 17 bp, Homo sapiens
tgcccccttctcccaca

SEQ ID NO: 2651615 - DNA, 20 bp, Homo sapiens
tgcccccttctcccacactg

SEQ ID NO: 2651616 - DNA, 22 bp, Homo sapiens
tgcccccttctcccacactgct

SEQ ID NO: 2651617 - DNA, 23 bp, Homo sapiens
tgccccctttcagatgtcttctg

SEQ ID NO: 2651618 - DNA, 17 bp, Homo sapiens
tgccccgtcaccatctc

SEQ ID NO: 2651619 - DNA, 19 bp, Homo sapiens
tgccccgtcaccatctcag

SEQ ID NO: 2651620 - DNA, 17 bp, Homo sapiens
tgcccctcccccaaccc

SEQ ID NO: 2651621 - DNA, 20 bp, Homo sapiens
tgcccctctccaggcgccgg

SEQ ID NO: 2651622 - DNA, 14 bp, Homo sapiens
tgcccctgctgcct

SEQ ID NO: 2651623 - DNA, 17 bp, Homo sapiens
tgcccctgctgcctccc

SEQ ID NO: 2651624 - DNA, 21 bp, Homo sapiens
tgccccttcccatctcttcct

SEQ ID NO: 2651625 - DNA, 15 bp, Homo sapiens
tgcccggattctggg

SEQ ID NO: 2651626 - DNA, 16 bp, Homo sapiens
tgcccggattctggga

SEQ ID NO: 2651627 - DNA, 22 bp, Homo sapiens
tgcccggattctgggaggaagc

SEQ ID NO: 2651628 - DNA, 14 bp, Homo sapiens
tgcccggctgcgga

SEQ ID NO: 2651629 - DNA, 20 bp, Homo sapiens
tgcccgggcgcggccagccc

SEQ ID NO: 2651630 - DNA, 18 bp, Homo sapiens
tgcccgtctctctcccat

SEQ ID NO: 2651631 - DNA, 20 bp, Homo sapiens
tgcccgtctctctcccatgg

SEQ ID NO: 2651632 - DNA, 20 bp, Homo sapiens
tgccctaaagtgtatttttt

SEQ ID NO: 2651633 - DNA, 18 bp, Homo sapiens
tgccctacagaggtctct

SEQ ID NO: 2651634 - DNA, 17 bp, Homo sapiens
tgccctagagcacactg

SEQ ID NO: 2651635 - DNA, 23 bp, Homo sapiens
tgccctagagcacactgtagcat

SEQ ID NO: 2651636 - DNA, 14 bp, Homo sapiens
tgccctagctccac

SEQ ID NO: 2651637 - DNA, 16 bp, Homo sapiens
tgccctcaatcccagc

SEQ ID NO: 2651638 - DNA, 18 bp, Homo sapiens
tgccctcattttatgtca

SEQ ID NO: 2651639 - DNA, 20 bp, Homo sapiens
tgccctccaagaccttctcc

SEQ ID NO: 2651640 - DNA, 14 bp, Homo sapiens
tgccctccatcccg

SEQ ID NO: 2651641 - DNA, 15 bp, Homo sapiens
tgccctccccagagc

SEQ ID NO: 2651642 - DNA, 14 bp, Homo sapiens
tgccctcccctctc

SEQ ID NO: 2651643 - DNA, 21 bp, Homo sapiens
tgccctcccctctctgcaccg

SEQ ID NO: 2651644 - DNA, 13 bp, Homo sapiens
tgccctcgctgct

SEQ ID NO: 2651645 - DNA, 14 bp, Homo sapiens
tgccctcgctgctt

SEQ ID NO: 2651646 - DNA, 20 bp, Homo sapiens
tgccctcgtggccagcccgg

SEQ ID NO: 2651647 - DNA, 12 bp, Homo sapiens
tgccctcttcat

SEQ ID NO: 2651648 - DNA, 12 bp, Homo sapiens
tgccctgacctc

SEQ ID NO: 2651649 - DNA, 18 bp, Homo sapiens
tgccctgacctcccagcc

SEQ ID NO: 2651650 - DNA, 23 bp, Homo sapiens
tgccctgagtggatctccaagga

SEQ ID NO: 2651651 - DNA, 15 bp, Homo sapiens
tgccctgcccacctg

SEQ ID NO: 2651652 - DNA, 21 bp, Homo sapiens
tgccctgctgccgcctcccag

SEQ ID NO: 2651653 - DNA, 15 bp, Homo sapiens
tgccctgtgggcccc

SEQ ID NO: 2651654 - DNA, 18 bp, Homo sapiens
tgccctgtgggcccccaa

SEQ ID NO: 2651655 - DNA, 15 bp, Homo sapiens
tgcccttaaatcata

SEQ ID NO: 2651656 - DNA, 17 bp, Homo sapiens
tgcccttcacagtgttt

SEQ ID NO: 2651657 - DNA, 20 bp, Homo sapiens
tgcccttcaccccagtggcc

SEQ ID NO: 2651658 - DNA, 13 bp, Homo sapiens
tgcccttccctgt

SEQ ID NO: 2651659 - DNA, 18 bp, Homo sapiens
tgcccttccctgtccctc

SEQ ID NO: 2651660 - DNA, 18 bp, Homo sapiens
tgcccttgccctgacctc

SEQ ID NO: 2651661 - DNA, 22 bp, Homo sapiens
tgccgaatgtgcaggtttgtta

SEQ ID NO: 2651662 - DNA, 21 bp, Homo sapiens
tgccgaccagagccccacacg

SEQ ID NO: 2651663 - DNA, 22 bp, Homo sapiens
tgccgaccagagccccacacgg

SEQ ID NO: 2651664 - DNA, 16 bp, Homo sapiens
tgccgaccgaggctgg

SEQ ID NO: 2651665 - DNA, 22 bp, Homo sapiens
tgccgcaatggccatgtgggga

SEQ ID NO: 2651666 - DNA, 14 bp, Homo sapiens
tgccgccccaccca

SEQ ID NO: 2651667 - DNA, 10 bp, Homo sapiens
tgccgcctgc

SEQ ID NO: 2651668 - DNA, 15 bp, Homo sapiens
tgccggccctggggc

SEQ ID NO: 2651669 - DNA, 15 bp, Homo sapiens
tgccgtctacctgag

SEQ ID NO: 2651670 - DNA, 17 bp, Homo sapiens
tgccgtctacctgaggg

SEQ ID NO: 2651671 - DNA, 19 bp, Homo sapiens
tgcctcaagccccagagtg

SEQ ID NO: 2651672 - DNA, 19 bp, Homo sapiens
tgcctcaatgtgaccaggg

SEQ ID NO: 2651673 - DNA, 23 bp, Homo sapiens
tgcctcaatgtgaccaggggtga

SEQ ID NO: 2651674 - DNA, 18 bp, Homo sapiens
tgcctcagcctcccgagt

SEQ ID NO: 2651675 - DNA, 14 bp, Homo sapiens
tgcctcagcctccg

SEQ ID NO: 2651676 - DNA, 14 bp, Homo sapiens
tgcctcaggttcct

SEQ ID NO: 2651677 - DNA, 14 bp, Homo sapiens
tgcctccaccacca

SEQ ID NO: 2651678 - DNA, 12 bp, Homo sapiens
tgcctccaccct

SEQ ID NO: 2651679 - DNA, 14 bp, Homo sapiens
tgcctccaccctct

SEQ ID NO: 2651680 - DNA, 17 bp, Homo sapiens
tgcctccaccctctgag

SEQ ID NO: 2651681 - DNA, 17 bp, Homo sapiens
tgcctccaggtgtgcac

SEQ ID NO: 2651682 - DNA, 14 bp, Homo sapiens
tgcctcccatcacc

SEQ ID NO: 2651683 - DNA, 15 bp, Homo sapiens
tgcctccccaaccct

SEQ ID NO: 2651684 - DNA, 23 bp, Homo sapiens
tgcctccccaaccctgcccctgc

SEQ ID NO: 2651685 - DNA, 22 bp, Homo sapiens
tgcctccctcaccctgagcccc

SEQ ID NO: 2651686 - DNA, 19 bp, Homo sapiens
tgcctccgcctcagtaaga

SEQ ID NO: 2651687 - DNA, 22 bp, Homo sapiens
tgcctccgcgtgatcaaagcca

SEQ ID NO: 2651688 - DNA, 19 bp, Homo sapiens
tgcctcctcacccccagct

SEQ ID NO: 2651689 - DNA, 12 bp, Homo sapiens
tgcctcctcctt

SEQ ID NO: 2651690 - DNA, 14 bp, Homo sapiens
tgcctcctcttcaa

SEQ ID NO: 2651691 - DNA, 14 bp, Homo sapiens
tgcctcctgcctgc

SEQ ID NO: 2651692 - DNA, 16 bp, Homo sapiens
tgcctcctttgtgagg

SEQ ID NO: 2651693 - DNA, 19 bp, Homo sapiens
tgcctcgaactggctgcaa

SEQ ID NO: 2651694 - DNA, 20 bp, Homo sapiens
tgcctcgaactggctgcaaa

SEQ ID NO: 2651695 - DNA, 17 bp, Homo sapiens
tgcctctcctttgtata

SEQ ID NO: 2651696 - DNA, 20 bp, Homo sapiens
tgcctctcctttgtatatta

SEQ ID NO: 2651697 - DNA, 22 bp, Homo sapiens
tgcctctgacacacagctctgt

SEQ ID NO: 2651698 - DNA, 11 bp, Homo sapiens
tgcctctgcct

SEQ ID NO: 2651699 - DNA, 12 bp, Homo sapiens
tgcctctgcctc

SEQ ID NO: 2651700 - DNA, 18 bp, Homo sapiens
tgcctctgcctctgacac

SEQ ID NO: 2651701 - DNA, 13 bp, Homo sapiens
tgcctctgcctgt

SEQ ID NO: 2651702 - DNA, 18 bp, Homo sapiens
tgcctctgcctgtctccc

SEQ ID NO: 2651703 - DNA, 14 bp, Homo sapiens
tgcctctgggactg

SEQ ID NO: 2651704 - DNA, 13 bp, Homo sapiens
tgcctcttcctcc

SEQ ID NO: 2651705 - DNA, 21 bp, Homo sapiens
tgcctcttctctactctaggg

SEQ ID NO: 2651706 - DNA, 13 bp, Homo sapiens
tgcctcttctggg

SEQ ID NO: 2651707 - DNA, 21 bp, Homo sapiens
tgcctcttctgggagggcagc

SEQ ID NO: 2651708 - DNA, 16 bp, Homo sapiens
tgcctgaaccttccat

SEQ ID NO: 2651709 - DNA, 13 bp, Homo sapiens
tgcctgaagaaca

SEQ ID NO: 2651710 - DNA, 18 bp, Homo sapiens
tgcctgacatttggagtg

SEQ ID NO: 2651711 - DNA, 14 bp, Homo sapiens
tgcctgagggcccc

SEQ ID NO: 2651712 - DNA, 17 bp, Homo sapiens
tgcctgagggcccctct

SEQ ID NO: 2651713 - DNA, 23 bp, Homo sapiens
tgcctgagggcccctctgcccag

SEQ ID NO: 2651714 - DNA, 14 bp, Homo sapiens
tgcctgagggtgga

SEQ ID NO: 2651715 - DNA, 16 bp, Homo sapiens
tgcctgaggtctgtac

SEQ ID NO: 2651716 - DNA, 18 bp, Homo sapiens
tgcctgaggtctgtacgt

SEQ ID NO: 2651717 - DNA, 19 bp, Homo sapiens
tgcctgagtcacccatgaa

SEQ ID NO: 2651718 - DNA, 22 bp, Homo sapiens
tgcctgatatttccctcccctg

SEQ ID NO: 2651719 - DNA, 15 bp, Homo sapiens
tgcctgattgccaag

SEQ ID NO: 2651720 - DNA, 16 bp, Homo sapiens
tgcctgcccacccgtg

SEQ ID NO: 2651721 - DNA, 13 bp, Homo sapiens
tgcctgcccaggc

SEQ ID NO: 2651722 - DNA, 17 bp, Homo sapiens
tgcctgcccaggcccct

SEQ ID NO: 2651723 - DNA, 23 bp, Homo sapiens
tgcctgcccaggcccctgccacc

SEQ ID NO: 2651724 - DNA, 15 bp, Homo sapiens
tgcctgcctgtctgt

SEQ ID NO: 2651725 - DNA, 17 bp, Homo sapiens
tgcctggatggggctgc

SEQ ID NO: 2651726 - DNA, 15 bp, Homo sapiens
tgcctggcaggctgt

SEQ ID NO: 2651727 - DNA, 12 bp, Homo sapiens
tgcctggccagg

SEQ ID NO: 2651728 - DNA, 16 bp, Homo sapiens
tgcctggcctggcaca

SEQ ID NO: 2651729 - DNA, 22 bp, Homo sapiens
tgcctggcttcgcaaaatgttt

SEQ ID NO: 2651730 - DNA, 14 bp, Homo sapiens
tgcctgggaatgta

SEQ ID NO: 2651731 - DNA, 22 bp, Homo sapiens
tgcctgggagttttgtattcat

SEQ ID NO: 2651732 - DNA, 21 bp, Homo sapiens
tgcctgggatccctcatcctc

SEQ ID NO: 2651733 - DNA, 22 bp, Homo sapiens
tgcctgggctcccttgtgcgtg

SEQ ID NO: 2651734 - DNA, 20 bp, Homo sapiens
tgcctgtagttaggaaataa

SEQ ID NO: 2651735 - DNA, 21 bp, Homo sapiens
tgcctgtagttaggaaataaa

SEQ ID NO: 2651736 - DNA, 11 bp, Homo sapiens
tgcctgtctcc

SEQ ID NO: 2651737 - DNA, 18 bp, Homo sapiens
tgcctgtctgtctctcca

SEQ ID NO: 2651738 - DNA, 18 bp, Homo sapiens
tgcctgtctgttacactg

SEQ ID NO: 2651739 - DNA, 16 bp, Homo sapiens
tgcctgtgccacccac

SEQ ID NO: 2651740 - DNA, 19 bp, Homo sapiens
tgcctgtgccacccaccag

SEQ ID NO: 2651741 - DNA, 19 bp, Homo sapiens
tgcctgtggaatctggagt

SEQ ID NO: 2651742 - DNA, 17 bp, Homo sapiens
tgcctgttcagttacag

SEQ ID NO: 2651743 - DNA, 20 bp, Homo sapiens
tgcctgttcagttacagaaa

SEQ ID NO: 2651744 - DNA, 14 bp, Homo sapiens
tgcctgttcccatt

SEQ ID NO: 2651745 - DNA, 13 bp, Homo sapiens
tgccttaaagaaa

SEQ ID NO: 2651746 - DNA, 15 bp, Homo sapiens
tgccttagtctcagt

SEQ ID NO: 2651747 - DNA, 16 bp, Homo sapiens
tgccttagtctcagtt

SEQ ID NO: 2651748 - DNA, 13 bp, Homo sapiens
tgccttccataat

SEQ ID NO: 2651749 - DNA, 19 bp, Homo sapiens
tggactctgcacatgtctt

SEQ ID NO: 2651750 - DNA, 15 bp, Homo sapiens
tggactcttgctctt

SEQ ID NO: 2651751 - DNA, 15 bp, Homo sapiens
tggactgaagcctgc

SEQ ID NO: 2651752 - DNA, 18 bp, Homo sapiens
tggactgaagcctgcagg

SEQ ID NO: 2651753 - DNA, 19 bp, Homo sapiens
tggactgaagcctgcagga

SEQ ID NO: 2651754 - DNA, 16 bp, Homo sapiens
tggactggagtggagc

SEQ ID NO: 2651755 - DNA, 15 bp, Homo sapiens
tggactggcccctgg

SEQ ID NO: 2651756 - DNA, 13 bp, Homo sapiens
tggactgggaggt

SEQ ID NO: 2651757 - DNA, 21 bp, Homo sapiens
tggactgtcatagaaattaca

SEQ ID NO: 2651758 - DNA, 15 bp, Homo sapiens
tggactgtgatgcca

SEQ ID NO: 2651759 - DNA, 20 bp, Homo sapiens
tggacttcttttactcatga

SEQ ID NO: 2651760 - DNA, 17 bp, Homo sapiens
tggacttgagcttggca

SEQ ID NO: 2651761 - DNA, 19 bp, Homo sapiens
tggactttccaccccctcc

SEQ ID NO: 2651762 - DNA, 22 bp, Homo sapiens
tggagaaactgtagtctcagga

SEQ ID NO: 2651763 - DNA, 23 bp, Homo sapiens
tggagaaataaaaatacctcttt

SEQ ID NO: 2651764 - DNA, 11 bp, Homo sapiens
tggagaaatta

SEQ ID NO: 2651765 - DNA, 15 bp, Homo sapiens
tggagaactcctagg

SEQ ID NO: 2651766 - DNA, 17 bp, Homo sapiens
tggagaactcctagggt

SEQ ID NO: 2651767 - DNA, 13 bp, Homo sapiens
tggagaagccatt

SEQ ID NO: 2651768 - DNA, 22 bp, Homo sapiens
tggagaagcggctggcagccca

SEQ ID NO: 2651769 - DNA, 22 bp, Homo sapiens
tggagaagtcttagacttgaaa

SEQ ID NO: 2651770 - DNA, 21 bp, Homo sapiens
tggagacattcctgggcacag

SEQ ID NO: 2651771 - DNA, 18 bp, Homo sapiens
tggagaccatgcagagcg

SEQ ID NO: 2651772 - DNA, 22 bp, Homo sapiens
tggagactcctaggcaggacat

SEQ ID NO: 2651773 - DNA, 20 bp, Homo sapiens
tggagactgcttcccatcct

SEQ ID NO: 2651774 - DNA, 11 bp, Homo sapiens
tggagagaagt

SEQ ID NO: 2651775 - DNA, 18 bp, Homo sapiens
tggagagccagaacctgg

SEQ ID NO: 2651776 - DNA, 23 bp, Homo sapiens
tggagagctagaacctggagagc

SEQ ID NO: 2651777 - DNA, 18 bp, Homo sapiens
tggagagctggagcctgg

SEQ ID NO: 2651778 - DNA, 20 bp, Homo sapiens
tggagagctggagcctggtg

SEQ ID NO: 2651779 - DNA, 17 bp, Homo sapiens
tggagagtgcaacagta

SEQ ID NO: 2651780 - DNA, 21 bp, Homo sapiens
tggagagttcaatggctgctg

SEQ ID NO: 2651781 - DNA, 23 bp, Homo sapiens
tggagatgtcttcgtacagttct

SEQ ID NO: 2651782 - DNA, 19 bp, Homo sapiens
tggagatgttttagagtta

SEQ ID NO: 2651783 - DNA, 13 bp, Homo sapiens
tggagcagagggg

SEQ ID NO: 2651784 - DNA, 16 bp, Homo sapiens
tggagccaactgctgc

SEQ ID NO: 2651785 - DNA, 15 bp, Homo sapiens
tggagccaagtccag

SEQ ID NO: 2651786 - DNA, 13 bp, Homo sapiens
tggagccccagcc

SEQ ID NO: 2651787 - DNA, 14 bp, Homo sapiens
tggagccccagccc

SEQ ID NO: 2651788 - DNA, 15 bp, Homo sapiens
tggagccccagcccc

SEQ ID NO: 2651789 - DNA, 15 bp, Homo sapiens
tggagcccctgggtg

SEQ ID NO: 2651790 - DNA, 18 bp, Homo sapiens
tggagcccgcacccccac

SEQ ID NO: 2651791 - DNA, 19 bp, Homo sapiens
tggagcccgcacccccacc

SEQ ID NO: 2651792 - DNA, 13 bp, Homo sapiens
tggagcctggtgc

SEQ ID NO: 2651793 - DNA, 19 bp, Homo sapiens
tggagcctttgaataaaaa

SEQ ID NO: 2651794 - DNA, 18 bp, Homo sapiens
tggagctcagagagggca

SEQ ID NO: 2651795 - DNA, 13 bp, Homo sapiens
tggagctgagcct

SEQ ID NO: 2651796 - DNA, 15 bp, Homo sapiens
tggagctgagcctct

SEQ ID NO: 2651797 - DNA, 18 bp, Homo sapiens
tggagctggcgtctgtct

SEQ ID NO: 2651798 - DNA, 21 bp, Homo sapiens
tggagcttcatggcagaaggc

SEQ ID NO: 2651799 - DNA, 14 bp, Homo sapiens
tggaggaaagcaac

SEQ ID NO: 2651800 - DNA, 12 bp, Homo sapiens
tggaggaaggaa

SEQ ID NO: 2651801 - DNA, 18 bp, Homo sapiens
tggaggaaggattgtaaa

SEQ ID NO: 2651802 - DNA, 20 bp, Homo sapiens
tggaggaaggattgtaaaaa

SEQ ID NO: 2651803 - DNA, 15 bp, Homo sapiens
tggaggaatgctccc

SEQ ID NO: 2651804 - DNA, 16 bp, Homo sapiens
tggaggaatgctcccc

SEQ ID NO: 2651805 - DNA, 21 bp, Homo sapiens
tggaggagcaaaggctgagaa

SEQ ID NO: 2651806 - DNA, 20 bp, Homo sapiens
tggaggagctcaggacacta

SEQ ID NO: 2651807 - DNA, 22 bp, Homo sapiens
tggaggagctcaggacactaat

SEQ ID NO: 2651808 - DNA, 14 bp, Homo sapiens
tggaggccagccag

SEQ ID NO: 2651809 - DNA, 15 bp, Homo sapiens
tggaggccagccagt

SEQ ID NO: 2651810 - DNA, 22 bp, Homo sapiens
tggaggctgtcttctcaggctc

SEQ ID NO: 2651811 - DNA, 19 bp, Homo sapiens
tggagggaatgaacctgga

SEQ ID NO: 2651812 - DNA, 21 bp, Homo sapiens
tggagggctggaatctggaga

SEQ ID NO: 2651813 - DNA, 19 bp, Homo sapiens
tggaggggtggtcctgact

SEQ ID NO: 2651814 - DNA, 14 bp, Homo sapiens
tggaggtacactct

SEQ ID NO: 2651815 - DNA, 18 bp, Homo sapiens
tggaggtcacattcagga

SEQ ID NO: 2651816 - DNA, 15 bp, Homo sapiens
tggaggtggggttgg

SEQ ID NO: 2651817 - DNA, 17 bp, Homo sapiens
tggaggttaaggctgag

SEQ ID NO: 2651818 - DNA, 22 bp, Homo sapiens
tggaggttaaggctgaggaaag

SEQ ID NO: 2651819 - DNA, 14 bp, Homo sapiens
tggagtatatgtca

SEQ ID NO: 2651820 - DNA, 14 bp, Homo sapiens
tggagtcccctcac

SEQ ID NO: 2651821 - DNA, 15 bp, Homo sapiens
tggagtcccctcacc

SEQ ID NO: 2651822 - DNA, 14 bp, Homo sapiens
tggagtcggaaggg

SEQ ID NO: 2651823 - DNA, 17 bp, Homo sapiens
tggagtctccagtggtt

SEQ ID NO: 2651824 - DNA, 15 bp, Homo sapiens
tggagtgcagggagg

SEQ ID NO: 2651825 - DNA, 19 bp, Homo sapiens
tggagtgcagggaggagag

SEQ ID NO: 2651826 - DNA, 14 bp, Homo sapiens
tggagtgcagtgag

SEQ ID NO: 2651827 - DNA, 17 bp, Homo sapiens
tggagtgtggctgagga

SEQ ID NO: 2651828 - DNA, 17 bp, Homo sapiens
tggagttacattaatgt

SEQ ID NO: 2651829 - DNA, 16 bp, Homo sapiens
tggagttcctgaacct

SEQ ID NO: 2651830 - DNA, 14 bp, Homo sapiens
tggagttcttgtgc

SEQ ID NO: 2651831 - DNA, 21 bp, Homo sapiens
tggagtttttgtttggagagc

SEQ ID NO: 2651832 - DNA, 22 bp, Homo sapiens
tggatactgcccggggcagctg

SEQ ID NO: 2651833 - DNA, 16 bp, Homo sapiens
tggataggagcctgct

SEQ ID NO: 2651834 - DNA, 17 bp, Homo sapiens
tggatatagttttactt

SEQ ID NO: 2651835 - DNA, 23 bp, Homo sapiens
tggatattttcaaattgtatcta

SEQ ID NO: 2651836 - DNA, 15 bp, Homo sapiens
tggatcacagctgct

SEQ ID NO: 2651837 - DNA, 20 bp, Homo sapiens
tggatcacagctgctttctg

SEQ ID NO: 2651838 - DNA, 14 bp, Homo sapiens
tggatctccaagga

SEQ ID NO: 2651839 - DNA, 15 bp, Homo sapiens
tggatctccaaggac

SEQ ID NO: 2651840 - DNA, 19 bp, Homo sapiens
tggatctccccactctagg

SEQ ID NO: 2651841 - DNA, 18 bp, Homo sapiens
tggatctgtccaaggaaa

SEQ ID NO: 2651842 - DNA, 20 bp, Homo sapiens
tggatctgtccaaggaaact

SEQ ID NO: 2651843 - DNA, 18 bp, Homo sapiens
tggatgaaattttctaga

SEQ ID NO: 2651844 - DNA, 22 bp, Homo sapiens
tggatgaagattctcctgtgct

SEQ ID NO: 2651845 - DNA, 20 bp, Homo sapiens
tggatgaccagaacaaggtt

SEQ ID NO: 2651846 - DNA, 14 bp, Homo sapiens
tggatgatgtttcg

SEQ ID NO: 2651847 - DNA, 13 bp, Homo sapiens
tggatgcctgatt

SEQ ID NO: 2651848 - DNA, 14 bp, Homo sapiens
tggatgcctggtgg

SEQ ID NO: 2651849 - DNA, 20 bp, Homo sapiens
tggatgcctggtggcagctg

SEQ ID NO: 2651850 - DNA, 21 bp, Homo sapiens
tggatgcctggtggcagctgc

SEQ ID NO: 2651851 - DNA, 17 bp, Homo sapiens
tggatgtctgccaattt

SEQ ID NO: 2651852 - DNA, 14 bp, Homo sapiens
tggatgtcttcctt

SEQ ID NO: 2651853 - DNA, 15 bp, Homo sapiens
tggatgtcttccttg

SEQ ID NO: 2651854 - DNA, 20 bp, Homo sapiens
tggatgttttaattccatga

SEQ ID NO: 2651855 - DNA, 18 bp, Homo sapiens
tggattattcatttaaaa

SEQ ID NO: 2651856 - DNA, 20 bp, Homo sapiens
tggattattcatttaaaatg

SEQ ID NO: 2651857 - DNA, 16 bp, Homo sapiens
tggattatttaataac

SEQ ID NO: 2651858 - DNA, 18 bp, Homo sapiens
tggattatttaataacat

SEQ ID NO: 2651859 - DNA, 20 bp, Homo sapiens
tggattatttaataacatta

SEQ ID NO: 2651860 - DNA, 16 bp, Homo sapiens
tggattctcagatatt

SEQ ID NO: 2651861 - DNA, 19 bp, Homo sapiens
tggattctcagatatttat

SEQ ID NO: 2651862 - DNA, 13 bp, Homo sapiens
tggattgagggta

SEQ ID NO: 2651863 - DNA, 23 bp, Homo sapiens
tggattggagaagtaatcctagg

SEQ ID NO: 2651864 - DNA, 21 bp, Homo sapiens
tggattgtccccgacccttgc

SEQ ID NO: 2651865 - DNA, 24 bp, Homo sapiens
tggatttaacagaaatgtacagca

SEQ ID NO: 2651866 - DNA, 13 bp, Homo sapiens
tggatttgatgct

SEQ ID NO: 2651867 - DNA, 17 bp, Homo sapiens
tggatttgcctgtgcca

SEQ ID NO: 2651868 - DNA, 18 bp, Homo sapiens
tggatttgcctgtgccac

SEQ ID NO: 2651869 - DNA, 15 bp, Homo sapiens
tggatttgtttaaaa

SEQ ID NO: 2651870 - DNA, 16 bp, Homo sapiens
tggatttgtttaaaag

SEQ ID NO: 2651871 - DNA, 13 bp, Homo sapiens
tggcaacagaagc

SEQ ID NO: 2651872 - DNA, 14 bp, Homo sapiens
tggcaacagaagtg

SEQ ID NO: 2651873 - DNA, 13 bp, Homo sapiens
tggcaagagcccc

SEQ ID NO: 2651874 - DNA, 16 bp, Homo sapiens
tggcaagcccctgccc

SEQ ID NO: 2651875 - DNA, 19 bp, Homo sapiens
tggcaaggacacagatgaa

SEQ ID NO: 2651876 - DNA, 14 bp, Homo sapiens
tggcaaggctgtgc

SEQ ID NO: 2651877 - DNA, 17 bp, Homo sapiens
tggcaatagtgtgttct

SEQ ID NO: 2651878 - DNA, 14 bp, Homo sapiens
tggcaattctttga

SEQ ID NO: 2651879 - DNA, 14 bp, Homo sapiens
tggcaattttgtaa

SEQ ID NO: 2651880 - DNA, 23 bp, Homo sapiens
tggcacaatggctaattcccaga

SEQ ID NO: 2651881 - DNA, 16 bp, Homo sapiens
tggcacaggccccctt

SEQ ID NO: 2651882 - DNA, 22 bp, Homo sapiens
tggcacagttttctgagaaaga

SEQ ID NO: 2651883 - DNA, 23 bp, Homo sapiens
tggcacatcagcacgatttctgt

SEQ ID NO: 2651884 - DNA, 19 bp, Homo sapiens
tggcaccactgcactccag

SEQ ID NO: 2651885 - DNA, 20 bp, Homo sapiens
tggcaccagaggctgcagaa

SEQ ID NO: 2651886 - DNA, 16 bp, Homo sapiens
tggcaccagcagcctg

SEQ ID NO: 2651887 - DNA, 17 bp, Homo sapiens
tggcaccagcagcctgg

SEQ ID NO: 2651888 - DNA, 18 bp, Homo sapiens
tggcaccagcagcctgga

SEQ ID NO: 2651889 - DNA, 18 bp, Homo sapiens
tggcaccagcgaagggag

SEQ ID NO: 2651890 - DNA, 19 bp, Homo sapiens
tggcacccggcccctgctg

SEQ ID NO: 2651891 - DNA, 15 bp, Homo sapiens
tggcaccgccttctc

SEQ ID NO: 2651892 - DNA, 19 bp, Homo sapiens
tggcacggtggctcaggcc

SEQ ID NO: 2651893 - DNA, 15 bp, Homo sapiens
tggcactataatgta

SEQ ID NO: 2651894 - DNA, 22 bp, Homo sapiens
tgggtagctgtaaggcatgaag

SEQ ID NO: 2651895 - DNA, 18 bp, Homo sapiens
tgggtcacccctccagga

SEQ ID NO: 2651896 - DNA, 13 bp, Homo sapiens
tgggtccaaataa

SEQ ID NO: 2651897 - DNA, 20 bp, Homo sapiens
tgggtccaggggatgggagg

SEQ ID NO: 2651898 - DNA, 18 bp, Homo sapiens
tgggtccaggggcccctc

SEQ ID NO: 2651899 - DNA, 14 bp, Homo sapiens
tgggtctgtgtctc

SEQ ID NO: 2651900 - DNA, 15 bp, Homo sapiens
tgggtctgtgtgtgt

SEQ ID NO: 2651901 - DNA, 14 bp, Homo sapiens
tgggtgacagagca

SEQ ID NO: 2651902 - DNA, 17 bp, Homo sapiens
tgggtgacagagcaaga

SEQ ID NO: 2651903 - DNA, 13 bp, Homo sapiens
tgggtgctcccta

SEQ ID NO: 2651904 - DNA, 19 bp, Homo sapiens
tgggtggaaccaggaacct

SEQ ID NO: 2651905 - DNA, 16 bp, Homo sapiens
tgggtggacaggggcc

SEQ ID NO: 2651906 - DNA, 16 bp, Homo sapiens
tgggtggagaagccat

SEQ ID NO: 2651907 - DNA, 21 bp, Homo sapiens
tgggtggagaagccattgtct

SEQ ID NO: 2651908 - DNA, 23 bp, Homo sapiens
tgggtggagaagccattgtcttc

SEQ ID NO: 2651909 - DNA, 17 bp, Homo sapiens
tgggtggcaccagcagc

SEQ ID NO: 2651910 - DNA, 20 bp, Homo sapiens
tgggtggcaccagcagcctg

SEQ ID NO: 2651911 - DNA, 15 bp, Homo sapiens
tgggtggcctcggga

SEQ ID NO: 2651912 - DNA, 12 bp, Homo sapiens
tgggtgggagag

SEQ ID NO: 2651913 - DNA, 16 bp, Homo sapiens
tgggtgggtggtgggg

SEQ ID NO: 2651914 - DNA, 14 bp, Homo sapiens
tgggtggtggatct

SEQ ID NO: 2651915 - DNA, 20 bp, Homo sapiens
tgggtgtatttattttcctc

SEQ ID NO: 2651916 - DNA, 21 bp, Homo sapiens
tgggtgtcaagagggtctgag

SEQ ID NO: 2651917 - DNA, 18 bp, Homo sapiens
tgggtgtccaaaggaaga

SEQ ID NO: 2651918 - DNA, 18 bp, Homo sapiens
tgggtgtgtgtagccaag

SEQ ID NO: 2651919 - DNA, 16 bp, Homo sapiens
tgggttagggaaaaca

SEQ ID NO: 2651920 - DNA, 21 bp, Homo sapiens
tgggttagggaaaacattcca

SEQ ID NO: 2651921 - DNA, 20 bp, Homo sapiens
tgggttcagaaatgctgcct

SEQ ID NO: 2651922 - DNA, 21 bp, Homo sapiens
tgggttcagaaatgctgcctg

SEQ ID NO: 2651923 - DNA, 16 bp, Homo sapiens
tgggttcattattgga

SEQ ID NO: 2651924 - DNA, 18 bp, Homo sapiens
tgggttcattattggaat

SEQ ID NO: 2651925 - DNA, 15 bp, Homo sapiens
tgggttggtgcacag

SEQ ID NO: 2651926 - DNA, 20 bp, Homo sapiens
tgggttggtgcacagtgatt

SEQ ID NO: 2651927 - DNA, 16 bp, Homo sapiens
tgggttggtgcttcta

SEQ ID NO: 2651928 - DNA, 14 bp, Homo sapiens
tgggtttggacccc

SEQ ID NO: 2651929 - DNA, 20 bp, Homo sapiens
tgggtttggaccccagctgg

SEQ ID NO: 2651930 - DNA, 21 bp, Homo sapiens
tgggtttggaccccagctggg

SEQ ID NO: 2651931 - DNA, 21 bp, Homo sapiens
tggtaaactatttgtctttca

SEQ ID NO: 2651932 - DNA, 17 bp, Homo sapiens
tggtaaagactggcttt

SEQ ID NO: 2651933 - DNA, 20 bp, Homo sapiens
tggtaaatttccccaacagt

SEQ ID NO: 2651934 - DNA, 13 bp, Homo sapiens
tggtaactgttaa

SEQ ID NO: 2651935 - DNA, 15 bp, Homo sapiens
tggtaccagataaaa

SEQ ID NO: 2651936 - DNA, 14 bp, Homo sapiens
tggtacccagccat

SEQ ID NO: 2651937 - DNA, 22 bp, Homo sapiens
tggtacccagccatctgcccag

SEQ ID NO: 2651938 - DNA, 16 bp, Homo sapiens
tggtaccctcctggct

SEQ ID NO: 2651939 - DNA, 17 bp, Homo sapiens
tggtactctcctagaga

SEQ ID NO: 2651940 - DNA, 22 bp, Homo sapiens
tggtacttttatgatgtatatt

SEQ ID NO: 2651941 - DNA, 20 bp, Homo sapiens
tggtagaattggagagtaaa

SEQ ID NO: 2651942 - DNA, 17 bp, Homo sapiens
tggtagggacttaaaaa

SEQ ID NO: 2651943 - DNA, 19 bp, Homo sapiens
tggtagggggaaaatgtgt

SEQ ID NO: 2651944 - DNA, 22 bp, Homo sapiens
tggtagtaatcacagttggcct

SEQ ID NO: 2651945 - DNA, 14 bp, Homo sapiens
tggtatagaaatgc

SEQ ID NO: 2651946 - DNA, 22 bp, Homo sapiens
tggtatagaaatgctggttttt

SEQ ID NO: 2651947 - DNA, 22 bp, Homo sapiens
tggtatcctgtgacatgtaaca

SEQ ID NO: 2651948 - DNA, 22 bp, Homo sapiens
tggtatctagacccatcttctt

SEQ ID NO: 2651949 - DNA, 14 bp, Homo sapiens
tggtatctgttctt

SEQ ID NO: 2651950 - DNA, 14 bp, Homo sapiens
tggtatgagctgag

SEQ ID NO: 2651951 - DNA, 15 bp, Homo sapiens
tggtatgtgtgtgta

SEQ ID NO: 2651952 - DNA, 17 bp, Homo sapiens
tggtatgtgtgtgtatg

SEQ ID NO: 2651953 - DNA, 19 bp, Homo sapiens
tggtatgtgtgtgtatgct

SEQ ID NO: 2651954 - DNA, 18 bp, Homo sapiens
tggtattacactgtattt

SEQ ID NO: 2651955 - DNA, 20 bp, Homo sapiens
tggtattacactgtatttgt

SEQ ID NO: 2651956 - DNA, 16 bp, Homo sapiens
tggtattcctgcctcc

SEQ ID NO: 2651957 - DNA, 21 bp, Homo sapiens
tggtcaaacaaactctctgaa

SEQ ID NO: 2651958 - DNA, 16 bp, Homo sapiens
tggtcaacctcctgga

SEQ ID NO: 2651959 - DNA, 18 bp, Homo sapiens
tggtcaacctcctggaca

SEQ ID NO: 2651960 - DNA, 22 bp, Homo sapiens
tggtcaagattttgaatgcttc

SEQ ID NO: 2651961 - DNA, 15 bp, Homo sapiens
tggtcacagcctcct

SEQ ID NO: 2651962 - DNA, 23 bp, Homo sapiens
tggtcacaggactctgcctcctc

SEQ ID NO: 2651963 - DNA, 21 bp, Homo sapiens
tggtcaccaaatcagctgcta

SEQ ID NO: 2651964 - DNA, 13 bp, Homo sapiens
tggtcactgctgt

SEQ ID NO: 2651965 - DNA, 15 bp, Homo sapiens
tggtcagatttgaac

SEQ ID NO: 2651966 - DNA, 16 bp, Homo sapiens
tggtcagatttgaact

SEQ ID NO: 2651967 - DNA, 22 bp, Homo sapiens
tggtcagccctagggtggagag

SEQ ID NO: 2651968 - DNA, 19 bp, Homo sapiens
tggtcagctcccttctctg

SEQ ID NO: 2651969 - DNA, 21 bp, Homo sapiens
tggtcatagcccagatcagct

SEQ ID NO: 2651970 - DNA, 16 bp, Homo sapiens
tggtccaggagaaggc

SEQ ID NO: 2651971 - DNA, 14 bp, Homo sapiens
tggtccagggttga

SEQ ID NO: 2651972 - DNA, 15 bp, Homo sapiens
tggtccatagagagc

SEQ ID NO: 2651973 - DNA, 16 bp, Homo sapiens
tggtccatagagagca

SEQ ID NO: 2651974 - DNA, 20 bp, Homo sapiens
tggtccatggaatgcttgaa

SEQ ID NO: 2651975 - DNA, 14 bp, Homo sapiens
tggtcccaccccac

SEQ ID NO: 2651976 - DNA, 16 bp, Homo sapiens
tggtcccaccccacac

SEQ ID NO: 2651977 - DNA, 15 bp, Homo sapiens
tggtcccatccaggc

SEQ ID NO: 2651978 - DNA, 16 bp, Homo sapiens
tggtcccccttccatg

SEQ ID NO: 2651979 - DNA, 13 bp, Homo sapiens
tggtccctgggag

SEQ ID NO: 2651980 - DNA, 19 bp, Homo sapiens
tggtccctgggaggaaatt

SEQ ID NO: 2651981 - DNA, 19 bp, Homo sapiens
tggtccggacactcctaga

SEQ ID NO: 2651982 - DNA, 15 bp, Homo sapiens
tggtcctcttgcctc

SEQ ID NO: 2651983 - DNA, 20 bp, Homo sapiens
tggtcctgagggtccccacc

SEQ ID NO: 2651984 - DNA, 23 bp, Homo sapiens
tggtcctgctgcagttgccagtc

SEQ ID NO: 2651985 - DNA, 14 bp, Homo sapiens
tggtcctggggctc

SEQ ID NO: 2651986 - DNA, 13 bp, Homo sapiens
tggtcgcccagga

SEQ ID NO: 2651987 - DNA, 15 bp, Homo sapiens
tggtcgcccaggaga

SEQ ID NO: 2651988 - DNA, 18 bp, Homo sapiens
tggtctcaaactcctgac

SEQ ID NO: 2651989 - DNA, 16 bp, Homo sapiens
tggtctcaaactcttg

SEQ ID NO: 2651990 - DNA, 23 bp, Homo sapiens
tggtctcctcagcctcctcatct

SEQ ID NO: 2651991 - DNA, 22 bp, Homo sapiens
tggtctccttggaaatccgtct

SEQ ID NO: 2651992 - DNA, 19 bp, Homo sapiens
tggtctctaggctggggaa

SEQ ID NO: 2651993 - DNA, 14 bp, Homo sapiens
tggtctgaatgttc

SEQ ID NO: 2651994 - DNA, 15 bp, Homo sapiens
tggtctgaatgttct

SEQ ID NO: 2651995 - DNA, 16 bp, Homo sapiens
tggtctgacccactgc

SEQ ID NO: 2651996 - DNA, 17 bp, Homo sapiens
tggtcttgagatgtctt

SEQ ID NO: 2651997 - DNA, 14 bp, Homo sapiens
tggtctttaatgaa

SEQ ID NO: 2651998 - DNA, 15 bp, Homo sapiens
tggtctttctggaga

SEQ ID NO: 2651999 - DNA, 20 bp, Homo sapiens
tggtctttcttacaaggaag

SEQ ID NO: 2652000 - DNA, 15 bp, Homo sapiens
tggtctttgtaagag

SEQ ID NO: 2652001 - DNA, 23 bp, Homo sapiens
tggtctttgtaagagtgtagaag

SEQ ID NO: 2652002 - DNA, 17 bp, Homo sapiens
tggtgacctctgcctga

SEQ ID NO: 2652003 - DNA, 19 bp, Homo sapiens
tggtgactttcctctttgg

SEQ ID NO: 2652004 - DNA, 22 bp, Homo sapiens
tggtgagtcttggcggcagcag

SEQ ID NO: 2652005 - DNA, 18 bp, Homo sapiens
tggtgccacaaataaaat

SEQ ID NO: 2652006 - DNA, 13 bp, Homo sapiens
tggtgccagcctt

SEQ ID NO: 2652007 - DNA, 21 bp, Homo sapiens
tggtgccagccttcctctgca

SEQ ID NO: 2652008 - DNA, 12 bp, Homo sapiens
tggtgcctggcc

SEQ ID NO: 2652009 - DNA, 14 bp, Homo sapiens
tggtgcctggcctg

SEQ ID NO: 2652010 - DNA, 19 bp, Homo sapiens
tggtgcctggcctggcaca

SEQ ID NO: 2652011 - DNA, 22 bp, Homo sapiens
tggtgcctggcctggcacacat

SEQ ID NO: 2652012 - DNA, 23 bp, Homo sapiens
tggtgcctggcctggcacacatc

SEQ ID NO: 2652013 - DNA, 16 bp, Homo sapiens
tggtgcgatctgggtt

SEQ ID NO: 2652014 - DNA, 18 bp, Homo sapiens
tggtgctggatattttca

SEQ ID NO: 2652015 - DNA, 14 bp, Homo sapiens
tggtgctgggactg

SEQ ID NO: 2652016 - DNA, 15 bp, Homo sapiens
tggtgctgggactga

SEQ ID NO: 2652017 - DNA, 16 bp, Homo sapiens
tggtgctgggactgag

SEQ ID NO: 2652018 - DNA, 21 bp, Homo sapiens
tggtgctgggactgagccagt

SEQ ID NO: 2652019 - DNA, 17 bp, Homo sapiens
tggtgctgtggccaggg

SEQ ID NO: 2652020 - DNA, 17 bp, Homo sapiens
tggtggacagtcctggg

SEQ ID NO: 2652021 - DNA, 13 bp, Homo sapiens
tggtggagggcca

SEQ ID NO: 2652022 - DNA, 16 bp, Homo sapiens
tggtggcaagagcccc

SEQ ID NO: 2652023 - DNA, 19 bp, Homo sapiens
tggtggcactgagcccccc

SEQ ID NO: 2652024 - DNA, 12 bp, Homo sapiens
tggtggcagctg

SEQ ID NO: 2652025 - DNA, 13 bp, Homo sapiens
tggtggcagctgc

SEQ ID NO: 2652026 - DNA, 18 bp, Homo sapiens
tggtggcagtgggagctg

SEQ ID NO: 2652027 - DNA, 13 bp, Homo sapiens
tggtggctgggtt

SEQ ID NO: 2652028 - DNA, 22 bp, Homo sapiens
tggtggggaggggcgctggccc

SEQ ID NO: 2652029 - DNA, 16 bp, Homo sapiens
tggtgggggcctcggt

SEQ ID NO: 2652030 - DNA, 18 bp, Homo sapiens
tggtgggggtagagctga

SEQ ID NO: 2652031 - DNA, 18 bp, Homo sapiens
tggtgggtccatgggcag

SEQ ID NO: 2652032 - DNA, 18 bp, Homo sapiens
tggtggtttcagaaatgt

SEQ ID NO: 2652033 - DNA, 19 bp, Homo sapiens
tggtggttttctgttcttt

SEQ ID NO: 2652034 - DNA, 14 bp, Homo sapiens
tggtgtaataagac

SEQ ID NO: 2652035 - DNA, 15 bp, Homo sapiens
tggtgtaataagaca

SEQ ID NO: 2652036 - DNA, 12 bp, Homo sapiens
tggtgtgaaggt

SEQ ID NO: 2652037 - DNA, 16 bp, Homo sapiens
tggtgttgtatgcctt

SEQ ID NO: 2652038 - DNA, 18 bp, Homo sapiens
tggttaagtctgttttat

SEQ ID NO: 2652039 - DNA, 16 bp, Homo sapiens
tgtctgcccttcaccc

SEQ ID NO: 2652040 - DNA, 19 bp, Homo sapiens
tgtctgctttctccattgt

SEQ ID NO: 2652041 - DNA, 15 bp, Homo sapiens
tgtctggattcccag

SEQ ID NO: 2652042 - DNA, 15 bp, Homo sapiens
tgtctggccaggcct

SEQ ID NO: 2652043 - DNA, 22 bp, Homo sapiens
tgtctggttttaacaatttcct

SEQ ID NO: 2652044 - DNA, 19 bp, Homo sapiens
tgtctgtacacgtgtcctg

SEQ ID NO: 2652045 - DNA, 20 bp, Homo sapiens
tgtctgtacacgtgtcctgt

SEQ ID NO: 2652046 - DNA, 23 bp, Homo sapiens
tgtctgtagctcctcaactcacc

SEQ ID NO: 2652047 - DNA, 21 bp, Homo sapiens
tgtctgtcccggggtcctgtg

SEQ ID NO: 2652048 - DNA, 21 bp, Homo sapiens
tgtctgtgtgcaagtgtgtgc

SEQ ID NO: 2652049 - DNA, 11 bp, Homo sapiens
tgtctgttaca

SEQ ID NO: 2652050 - DNA, 12 bp, Homo sapiens
tgtctgttacac

SEQ ID NO: 2652051 - DNA, 23 bp, Homo sapiens
tgtctgttaccatgtcactgtgg

SEQ ID NO: 2652052 - DNA, 13 bp, Homo sapiens
tgtctgttctaca

SEQ ID NO: 2652053 - DNA, 12 bp, Homo sapiens
tgtcttaattaa

SEQ ID NO: 2652054 - DNA, 14 bp, Homo sapiens
tgtcttaattatta

SEQ ID NO: 2652055 - DNA, 13 bp, Homo sapiens
tgtcttatatata

SEQ ID NO: 2652056 - DNA, 17 bp, Homo sapiens
tgtcttcatttcattgt

SEQ ID NO: 2652057 - DNA, 12 bp, Homo sapiens
tgtcttccataa

SEQ ID NO: 2652058 - DNA, 13 bp, Homo sapiens
tgtcttccataat

SEQ ID NO: 2652059 - DNA, 17 bp, Homo sapiens
tgtcttccataatgtat

SEQ ID NO: 2652060 - DNA, 14 bp, Homo sapiens
tgtcttcccagggt

SEQ ID NO: 2652061 - DNA, 16 bp, Homo sapiens
tgtcttcccagggtag

SEQ ID NO: 2652062 - DNA, 21 bp, Homo sapiens
tgtcttcccagggtagcccgc

SEQ ID NO: 2652063 - DNA, 19 bp, Homo sapiens
tgtcttcggaaaccttggt

SEQ ID NO: 2652064 - DNA, 18 bp, Homo sapiens
tgtcttcgtacagttctt

SEQ ID NO: 2652065 - DNA, 21 bp, Homo sapiens
tgtcttctcaggctctgccct

SEQ ID NO: 2652066 - DNA, 14 bp, Homo sapiens
tgtcttctccccag

SEQ ID NO: 2652067 - DNA, 13 bp, Homo sapiens
tgtcttctgcctg

SEQ ID NO: 2652068 - DNA, 15 bp, Homo sapiens
tgtcttgtgtttctt

SEQ ID NO: 2652069 - DNA, 21 bp, Homo sapiens
tgtctttaggcagcagctttt

SEQ ID NO: 2652070 - DNA, 17 bp, Homo sapiens
tgtctttggaccctgag

SEQ ID NO: 2652071 - DNA, 16 bp, Homo sapiens
tgtcttttcttgcatg

SEQ ID NO: 2652072 - DNA, 23 bp, Homo sapiens
tgtctttttctggactgaagcct

SEQ ID NO: 2652073 - DNA, 16 bp, Homo sapiens
tgtcttttttcactac

SEQ ID NO: 2652074 - DNA, 21 bp, Homo sapiens
tgtgaaagtcagatgcccaga

SEQ ID NO: 2652075 - DNA, 20 bp, Homo sapiens
tgtgaactaaactttcacac

SEQ ID NO: 2652076 - DNA, 14 bp, Homo sapiens
tgtgaactcagcca

SEQ ID NO: 2652077 - DNA, 15 bp, Homo sapiens
tgtgaactcagccaa

SEQ ID NO: 2652078 - DNA, 16 bp, Homo sapiens
tgtgaactcagccaag

SEQ ID NO: 2652079 - DNA, 19 bp, Homo sapiens
tgtgaactcagccaagcac

SEQ ID NO: 2652080 - DNA, 15 bp, Homo sapiens
tgtgaagttagaatt

SEQ ID NO: 2652081 - DNA, 20 bp, Homo sapiens
tgtgaagttagaattccttc

SEQ ID NO: 2652082 - DNA, 23 bp, Homo sapiens
tgtgaatatttccatatggattt

SEQ ID NO: 2652083 - DNA, 20 bp, Homo sapiens
tgtgaattagctcacttggt

SEQ ID NO: 2652084 - DNA, 13 bp, Homo sapiens
tgtgaattcagat

SEQ ID NO: 2652085 - DNA, 18 bp, Homo sapiens
tgtgaattgcctgcagag

SEQ ID NO: 2652086 - DNA, 23 bp, Homo sapiens
tgtgaatttcttcactgttgaaa

SEQ ID NO: 2652087 - DNA, 14 bp, Homo sapiens
tgtgacatgtaaca

SEQ ID NO: 2652088 - DNA, 22 bp, Homo sapiens
tgtgacccagcactgcccaaag

SEQ ID NO: 2652089 - DNA, 16 bp, Homo sapiens
tgtgacctgaagttca

SEQ ID NO: 2652090 - DNA, 13 bp, Homo sapiens
tgtgacctgaggg

SEQ ID NO: 2652091 - DNA, 15 bp, Homo sapiens
tgtgaccttagtgtt

SEQ ID NO: 2652092 - DNA, 19 bp, Homo sapiens
tgtgaccttagtgtttctg

SEQ ID NO: 2652093 - DNA, 22 bp, Homo sapiens
tgtgactatatagagatgtttt

SEQ ID NO: 2652094 - DNA, 23 bp, Homo sapiens
tgtgacttgcatcgtggagacag

SEQ ID NO: 2652095 - DNA, 14 bp, Homo sapiens
tgtgagaatcaaaa

SEQ ID NO: 2652096 - DNA, 15 bp, Homo sapiens
tgtgagacccccaca

SEQ ID NO: 2652097 - DNA, 16 bp, Homo sapiens
tgtgagacccccacac

SEQ ID NO: 2652098 - DNA, 14 bp, Homo sapiens
tgtgagcaagaagt

SEQ ID NO: 2652099 - DNA, 14 bp, Homo sapiens
tgtgagcagtgagt

SEQ ID NO: 2652100 - DNA, 12 bp, Homo sapiens
tgtgagcccctg

SEQ ID NO: 2652101 - DNA, 14 bp, Homo sapiens
tgtgagcccctggt

SEQ ID NO: 2652102 - DNA, 12 bp, Homo sapiens
tgtgaggaagcc

SEQ ID NO: 2652103 - DNA, 18 bp, Homo sapiens
tgtgaggaagccgctggg

SEQ ID NO: 2652104 - DNA, 13 bp, Homo sapiens
tgtgaggagctgc

SEQ ID NO: 2652105 - DNA, 14 bp, Homo sapiens
tgtgaggagctgct

SEQ ID NO: 2652106 - DNA, 17 bp, Homo sapiens
tgtgaggagctgctggc

SEQ ID NO: 2652107 - DNA, 14 bp, Homo sapiens
tgtgaggccagggc

SEQ ID NO: 2652108 - DNA, 13 bp, Homo sapiens
tgtgaggcccctg

SEQ ID NO: 2652109 - DNA, 18 bp, Homo sapiens
tgtgaggcctggccaggc

SEQ ID NO: 2652110 - DNA, 18 bp, Homo sapiens
tgtgaggggctctctcat

SEQ ID NO: 2652111 - DNA, 19 bp, Homo sapiens
tgtgagtaagagctggtgt

SEQ ID NO: 2652112 - DNA, 17 bp, Homo sapiens
tgtgagtcaccaagccc

SEQ ID NO: 2652113 - DNA, 19 bp, Homo sapiens
tgtgagtcaccaagcccag

SEQ ID NO: 2652114 - DNA, 23 bp, Homo sapiens
tgtgagtgtgtccaagtgtgtgt

SEQ ID NO: 2652115 - DNA, 20 bp, Homo sapiens
tgtgatcaggctatgtatgg

SEQ ID NO: 2652116 - DNA, 23 bp, Homo sapiens
tgtgatcccaagtgccagtcttg

SEQ ID NO: 2652117 - DNA, 16 bp, Homo sapiens
tgtgatgaatactgta

SEQ ID NO: 2652118 - DNA, 14 bp, Homo sapiens
tgtgatgaggggag

SEQ ID NO: 2652119 - DNA, 15 bp, Homo sapiens
tgtgatgccacacag

SEQ ID NO: 2652120 - DNA, 20 bp, Homo sapiens
tgtgatggggccctgcctcc

SEQ ID NO: 2652121 - DNA, 21 bp, Homo sapiens
tgtgattctaatgtcttcatt

SEQ ID NO: 2652122 - DNA, 15 bp, Homo sapiens
tgtgattgggaataa

SEQ ID NO: 2652123 - DNA, 19 bp, Homo sapiens
tgtgatttaatagtgttaa

SEQ ID NO: 2652124 - DNA, 17 bp, Homo sapiens
tgtgatttagaactgta

SEQ ID NO: 2652125 - DNA, 18 bp, Homo sapiens
tgtgatttagaactgtat

SEQ ID NO: 2652126 - DNA, 23 bp, Homo sapiens
tgtgatttcctactaacctgttc

SEQ ID NO: 2652127 - DNA, 23 bp, Homo sapiens
tgtgatttgactgtttttaccca

SEQ ID NO: 2652128 - DNA, 14 bp, Homo sapiens
tgtgattttaactc

SEQ ID NO: 2652129 - DNA, 20 bp, Homo sapiens
tgtgattttaactctgtctt

SEQ ID NO: 2652130 - DNA, 17 bp, Homo sapiens
tgtgcaagtatgtgagt

SEQ ID NO: 2652131 - DNA, 15 bp, Homo sapiens
tgtgcaagtgtctgt

SEQ ID NO: 2652132 - DNA, 12 bp, Homo sapiens
tgtgcaagtgtg

SEQ ID NO: 2652133 - DNA, 21 bp, Homo sapiens
tgtgcaagtgtgtgcatgtgt

SEQ ID NO: 2652134 - DNA, 15 bp, Homo sapiens
tgtgcacaattctgt

SEQ ID NO: 2652135 - DNA, 20 bp, Homo sapiens
tgtgcacatctgtgtcttgt

SEQ ID NO: 2652136 - DNA, 18 bp, Homo sapiens
tgtgcacatgtgtgcgtg

SEQ ID NO: 2652137 - DNA, 21 bp, Homo sapiens
tgtgcaccttaccaactttct

SEQ ID NO: 2652138 - DNA, 19 bp, Homo sapiens
tgtgcacgtggcatgtggc

SEQ ID NO: 2652139 - DNA, 17 bp, Homo sapiens
tgtgcactgtcactttg

SEQ ID NO: 2652140 - DNA, 19 bp, Homo sapiens
tgtgcagactcaataaaat

SEQ ID NO: 2652141 - DNA, 17 bp, Homo sapiens
tgtgcagtcctgggatg

SEQ ID NO: 2652142 - DNA, 20 bp, Homo sapiens
tgtgcagtcctgggatgtgg

SEQ ID NO: 2652143 - DNA, 14 bp, Homo sapiens
tgtgcagtgtagcc

SEQ ID NO: 2652144 - DNA, 12 bp, Homo sapiens
tgtgcagtgttg

SEQ ID NO: 2652145 - DNA, 19 bp, Homo sapiens
tgtgcagttctagtttgca

SEQ ID NO: 2652146 - DNA, 13 bp, Homo sapiens
tgtgcatattgta

SEQ ID NO: 2652147 - DNA, 19 bp, Homo sapiens
tgtgcatattgtacacttt

SEQ ID NO: 2652148 - DNA, 15 bp, Homo sapiens
tgtgcatgggagcaa

SEQ ID NO: 2652149 - DNA, 20 bp, Homo sapiens
tgtgcatgtatgtcttggac

SEQ ID NO: 2652150 - DNA, 15 bp, Homo sapiens
tgtgcatgtgtgtgc

SEQ ID NO: 2652151 - DNA, 20 bp, Homo sapiens
tgtgcattatctagatactg

SEQ ID NO: 2652152 - DNA, 21 bp, Homo sapiens
tgtgcattatctagatactgt

SEQ ID NO: 2652153 - DNA, 16 bp, Homo sapiens
tgtgccaatatgtatt

SEQ ID NO: 2652154 - DNA, 18 bp, Homo sapiens
tgtgccaatatgtattgt

SEQ ID NO: 2652155 - DNA, 20 bp, Homo sapiens
tgtgccacccaccagggcga

SEQ ID NO: 2652156 - DNA, 18 bp, Homo sapiens
tgtgccatagagtttaac

SEQ ID NO: 2652157 - DNA, 18 bp, Homo sapiens
tgtgccatagtcacatgg

SEQ ID NO: 2652158 - DNA, 21 bp, Homo sapiens
tgtgcccacatcccaggcttc

SEQ ID NO: 2652159 - DNA, 14 bp, Homo sapiens
tgtgccccatgcct

SEQ ID NO: 2652160 - DNA, 19 bp, Homo sapiens
tgtgccccatgcctgtcca

SEQ ID NO: 2652161 - DNA, 14 bp, Homo sapiens
tgtgccctcttgat

SEQ ID NO: 2652162 - DNA, 13 bp, Homo sapiens
tgtgccctggtgg

SEQ ID NO: 2652163 - DNA, 15 bp, Homo sapiens
tgtgccgaatgtgca

SEQ ID NO: 2652164 - DNA, 15 bp, Homo sapiens
tgtgccgacagaagg

SEQ ID NO: 2652165 - DNA, 15 bp, Homo sapiens
tgtgcctctgcctgt

SEQ ID NO: 2652166 - DNA, 16 bp, Homo sapiens
tgtgcctctgggactg

SEQ ID NO: 2652167 - DNA, 17 bp, Homo sapiens
tgtgcctctgggactgg

SEQ ID NO: 2652168 - DNA, 15 bp, Homo sapiens
tgtgcctgaccctac

SEQ ID NO: 2652169 - DNA, 13 bp, Homo sapiens
tgtgcctgcagcc

SEQ ID NO: 2652170 - DNA, 16 bp, Homo sapiens
tgtgccttttatagct

SEQ ID NO: 2652171 - DNA, 18 bp, Homo sapiens
tgtgccttttatagctat

SEQ ID NO: 2652172 - DNA, 16 bp, Homo sapiens
tgtgccttttgccatc

SEQ ID NO: 2652173 - DNA, 19 bp, Homo sapiens
tgtgcgcctacaggagtga

SEQ ID NO: 2652174 - DNA, 14 bp, Homo sapiens
tgtgcgtgaaacac

SEQ ID NO: 2652175 - DNA, 15 bp, Homo sapiens
tgtgcgtgaaacaca

SEQ ID NO: 2652176 - DNA, 20 bp, Homo sapiens
tgtgcgtgtgtccatgtgtg

SEQ ID NO: 2652177 - DNA, 21 bp, Homo sapiens
tgtgcgtgtgtccatgtgtgt

SEQ ID NO: 2652178 - DNA, 14 bp, Homo sapiens
tgtgctactttgcc

SEQ ID NO: 2652179 - DNA, 20 bp, Homo sapiens
tgtgctccgtgcctccacca

SEQ ID NO: 2652180 - DNA, 23 bp, Homo sapiens
tgtgctccgtgcctccaccacca

SEQ ID NO: 2652181 - DNA, 16 bp, Homo sapiens
tgtgctctggacaggc

SEQ ID NO: 2652182 - DNA, 19 bp, Homo sapiens
tgtgctgaattctgcaatg

SEQ ID NO: 2652183 - DNA, 18 bp, Homo sapiens
tgtgctgagtctgaaggc

SEQ ID NO: 2652184 - DNA, 17 bp, Homo sapiens
ttataacttaaaatatt

SEQ ID NO: 2652185 - DNA, 16 bp, Homo sapiens
ttataagcagatttaa

SEQ ID NO: 2652186 - DNA, 21 bp, Homo sapiens
ttataataaaaggaaaagcaa

SEQ ID NO: 2652187 - DNA, 14 bp, Homo sapiens
ttataattgtatca

SEQ ID NO: 2652188 - DNA, 16 bp, Homo sapiens
ttataattttcctaat

SEQ ID NO: 2652189 - DNA, 21 bp, Homo sapiens
ttataatttttttattactga

SEQ ID NO: 2652190 - DNA, 15 bp, Homo sapiens
ttatacaatatcatc

SEQ ID NO: 2652191 - DNA, 22 bp, Homo sapiens
ttatacagaccgaactgttgta

SEQ ID NO: 2652192 - DNA, 18 bp, Homo sapiens
ttatacagctcagctttt

SEQ ID NO: 2652193 - DNA, 13 bp, Homo sapiens
ttatacataaaca

SEQ ID NO: 2652194 - DNA, 15 bp, Homo sapiens
ttatacgtgtagcta

SEQ ID NO: 2652195 - DNA, 17 bp, Homo sapiens
ttatacgtgtagctata

SEQ ID NO: 2652196 - DNA, 12 bp, Homo sapiens
ttatactaagaa

SEQ ID NO: 2652197 - DNA, 22 bp, Homo sapiens
ttatactgtacttaataaattc

SEQ ID NO: 2652198 - DNA, 14 bp, Homo sapiens
ttatagaaagttca

SEQ ID NO: 2652199 - DNA, 23 bp, Homo sapiens
ttatagaatatttattacctctg

SEQ ID NO: 2652200 - DNA, 19 bp, Homo sapiens
ttatagagggccaagactt

SEQ ID NO: 2652201 - DNA, 17 bp, Homo sapiens
ttatagcaaacttggaa

SEQ ID NO: 2652202 - DNA, 17 bp, Homo sapiens
ttatagctattactgtc

SEQ ID NO: 2652203 - DNA, 17 bp, Homo sapiens
ttataggtcactcctgg

SEQ ID NO: 2652204 - DNA, 12 bp, Homo sapiens
ttatagtttgta

SEQ ID NO: 2652205 - DNA, 13 bp, Homo sapiens
ttatataaatgct

SEQ ID NO: 2652206 - DNA, 14 bp, Homo sapiens
ttatatatgtattt

SEQ ID NO: 2652207 - DNA, 12 bp, Homo sapiens
ttatatatgtga

SEQ ID NO: 2652208 - DNA, 15 bp, Homo sapiens
ttatatatttataac

SEQ ID NO: 2652209 - DNA, 15 bp, Homo sapiens
ttatatcagcctgag

SEQ ID NO: 2652210 - DNA, 15 bp, Homo sapiens
ttatatgaagaaaat

SEQ ID NO: 2652211 - DNA, 20 bp, Homo sapiens
ttatatggatgattcagaaa

SEQ ID NO: 2652212 - DNA, 22 bp, Homo sapiens
ttatatggatgattcagaaatt

SEQ ID NO: 2652213 - DNA, 15 bp, Homo sapiens
ttatattaaaatatg

SEQ ID NO: 2652214 - DNA, 18 bp, Homo sapiens
ttatatttagttatagtt

SEQ ID NO: 2652215 - DNA, 22 bp, Homo sapiens
ttatatttagttatagtttcag

SEQ ID NO: 2652216 - DNA, 15 bp, Homo sapiens
ttatcaaaactttct

SEQ ID NO: 2652217 - DNA, 16 bp, Homo sapiens
ttatcaaaactttctt

SEQ ID NO: 2652218 - DNA, 13 bp, Homo sapiens
ttatcaaatcagt

SEQ ID NO: 2652219 - DNA, 14 bp, Homo sapiens
ttatcaagtgtctt

SEQ ID NO: 2652220 - DNA, 16 bp, Homo sapiens
ttatcacatgtatgtt

SEQ ID NO: 2652221 - DNA, 18 bp, Homo sapiens
ttatcacatgtatgtttt

SEQ ID NO: 2652222 - DNA, 17 bp, Homo sapiens
ttatcaccagctgcctc

SEQ ID NO: 2652223 - DNA, 21 bp, Homo sapiens
ttatcaccgtgggctccctga

SEQ ID NO: 2652224 - DNA, 21 bp, Homo sapiens
ttatcagtcataactaaataa

SEQ ID NO: 2652225 - DNA, 16 bp, Homo sapiens
ttatcatccacattgt

SEQ ID NO: 2652226 - DNA, 18 bp, Homo sapiens
ttatcatccacattgttt

SEQ ID NO: 2652227 - DNA, 15 bp, Homo sapiens
ttatcatgtgtaatc

SEQ ID NO: 2652228 - DNA, 21 bp, Homo sapiens
ttatcatgtgtaatcaataaa

SEQ ID NO: 2652229 - DNA, 18 bp, Homo sapiens
ttatcattcaagtgtaaa

SEQ ID NO: 2652230 - DNA, 21 bp, Homo sapiens
ttatcctctgatctccatggc

SEQ ID NO: 2652231 - DNA, 19 bp, Homo sapiens
ttatcgaaataacaatgtt

SEQ ID NO: 2652232 - DNA, 21 bp, Homo sapiens
ttatcgaaataacaatgttaa

SEQ ID NO: 2652233 - DNA, 22 bp, Homo sapiens
ttatcgaaataacaatgttaag

SEQ ID NO: 2652234 - DNA, 17 bp, Homo sapiens
ttatcgggaacagtgtt

SEQ ID NO: 2652235 - DNA, 18 bp, Homo sapiens
ttatcgggagcagtgtct

SEQ ID NO: 2652236 - DNA, 19 bp, Homo sapiens
ttatcgggagcagtgtctt

SEQ ID NO: 2652237 - DNA, 23 bp, Homo sapiens
ttatcgggagcagtgtcttccat

SEQ ID NO: 2652238 - DNA, 20 bp, Homo sapiens
ttatctaatacctctgtgtg

SEQ ID NO: 2652239 - DNA, 19 bp, Homo sapiens
ttatctcagtcatgcataa

SEQ ID NO: 2652240 - DNA, 20 bp, Homo sapiens
ttatctcagtcatgcataaa

SEQ ID NO: 2652241 - DNA, 14 bp, Homo sapiens
ttatctctctgtgc

SEQ ID NO: 2652242 - DNA, 20 bp, Homo sapiens
ttatctgggcatagatgcag

SEQ ID NO: 2652243 - DNA, 12 bp, Homo sapiens
ttatctgtgaat

SEQ ID NO: 2652244 - DNA, 19 bp, Homo sapiens
ttatcttgggactgggttt

SEQ ID NO: 2652245 - DNA, 12 bp, Homo sapiens
ttatctttatat

SEQ ID NO: 2652246 - DNA, 18 bp, Homo sapiens
ttatgaaaggtttacatt

SEQ ID NO: 2652247 - DNA, 18 bp, Homo sapiens
ttatgaagaaaaaataca

SEQ ID NO: 2652248 - DNA, 14 bp, Homo sapiens
ttatgacagttata

SEQ ID NO: 2652249 - DNA, 16 bp, Homo sapiens
ttatgacatcacttgt

SEQ ID NO: 2652250 - DNA, 18 bp, Homo sapiens
ttatgacatcacttgtac

SEQ ID NO: 2652251 - DNA, 21 bp, Homo sapiens
ttatgacatcacttgtacaaa

SEQ ID NO: 2652252 - DNA, 13 bp, Homo sapiens
ttatgagggccac

SEQ ID NO: 2652253 - DNA, 20 bp, Homo sapiens
ttatgatgtgggtcaaggaa

SEQ ID NO: 2652254 - DNA, 21 bp, Homo sapiens
ttatgatgtgggtcaaggaat

SEQ ID NO: 2652255 - DNA, 22 bp, Homo sapiens
ttatgcaaggaaggaaagaaag

SEQ ID NO: 2652256 - DNA, 17 bp, Homo sapiens
ttatgcccagcgtttga

SEQ ID NO: 2652257 - DNA, 22 bp, Homo sapiens
ttatggaagattttaaattcac

SEQ ID NO: 2652258 - DNA, 14 bp, Homo sapiens
ttatggcacatcag

SEQ ID NO: 2652259 - DNA, 18 bp, Homo sapiens
ttatggcctcagctgcct

SEQ ID NO: 2652260 - DNA, 18 bp, Homo sapiens
ttatggctataggtgcta

SEQ ID NO: 2652261 - DNA, 13 bp, Homo sapiens
ttatggtgtttct

SEQ ID NO: 2652262 - DNA, 20 bp, Homo sapiens
ttatgtaaaaggccaaacct

SEQ ID NO: 2652263 - DNA, 22 bp, Homo sapiens
ttatgtaaaaggccaaacctct

SEQ ID NO: 2652264 - DNA, 17 bp, Homo sapiens
ttatgtaataatgtgaa

SEQ ID NO: 2652265 - DNA, 16 bp, Homo sapiens
ttatgtagatgtgcat

SEQ ID NO: 2652266 - DNA, 21 bp, Homo sapiens
ttatgtatatttaaaagaaag

SEQ ID NO: 2652267 - DNA, 18 bp, Homo sapiens
ttatgtgccgtgttattg

SEQ ID NO: 2652268 - DNA, 15 bp, Homo sapiens
ttatgtgtaaataca

SEQ ID NO: 2652269 - DNA, 12 bp, Homo sapiens
ttatgtgtgtat

SEQ ID NO: 2652270 - DNA, 18 bp, Homo sapiens
ttatgtgtgtatatgtat

SEQ ID NO: 2652271 - DNA, 22 bp, Homo sapiens
ttatgtgtgtatatgtatgtgt

SEQ ID NO: 2652272 - DNA, 22 bp, Homo sapiens
ttatgttaagggaagaattcca

SEQ ID NO: 2652273 - DNA, 19 bp, Homo sapiens
ttatgtttatataaatgct

SEQ ID NO: 2652274 - DNA, 20 bp, Homo sapiens
ttatgtttgccactttgcaa

SEQ ID NO: 2652275 - DNA, 16 bp, Homo sapiens
ttattaaaatcttaaa

SEQ ID NO: 2652276 - DNA, 20 bp, Homo sapiens
ttattaaaatgattgtaaaa

SEQ ID NO: 2652277 - DNA, 21 bp, Homo sapiens
ttattaaaatgattgtaaaat

SEQ ID NO: 2652278 - DNA, 21 bp, Homo sapiens
ttattaaacagatttttacaa

SEQ ID NO: 2652279 - DNA, 22 bp, Homo sapiens
ttattaaacgtatgcatgtgaa

SEQ ID NO: 2652280 - DNA, 18 bp, Homo sapiens
ttattaatgcactttcta

SEQ ID NO: 2652281 - DNA, 22 bp, Homo sapiens
ttattaattgttttgcactttt

SEQ ID NO: 2652282 - DNA, 17 bp, Homo sapiens
ttattagagtgtctttc

SEQ ID NO: 2652283 - DNA, 22 bp, Homo sapiens
ttattagccaggtaatgtgaat

SEQ ID NO: 2652284 - DNA, 20 bp, Homo sapiens
ttattagtaagaaaacatca

SEQ ID NO: 2652285 - DNA, 14 bp, Homo sapiens
ttattagtttacat

SEQ ID NO: 2652286 - DNA, 18 bp, Homo sapiens
ttattataattgtatcag

SEQ ID NO: 2652287 - DNA, 15 bp, Homo sapiens
ttattattgaaattg

SEQ ID NO: 2652288 - DNA, 15 bp, Homo sapiens
ttattcagcttcatt

SEQ ID NO: 2652289 - DNA, 17 bp, Homo sapiens
ttattcctgataataat

SEQ ID NO: 2652290 - DNA, 20 bp, Homo sapiens
ttattcctgataataattga

SEQ ID NO: 2652291 - DNA, 22 bp, Homo sapiens
ttattgacaataatttcaggtt

SEQ ID NO: 2652292 - DNA, 16 bp, Homo sapiens
ttattgcagtttatca

SEQ ID NO: 2652293 - DNA, 18 bp, Homo sapiens
ttattgcagtttatcatt

SEQ ID NO: 2652294 - DNA, 15 bp, Homo sapiens
ttattgcccacgctg

SEQ ID NO: 2652295 - DNA, 14 bp, Homo sapiens
ttattgtacctctc

SEQ ID NO: 2652296 - DNA, 17 bp, Homo sapiens
ttattgtacctctctta

SEQ ID NO: 2652297 - DNA, 14 bp, Homo sapiens
ttattgtataaact

SEQ ID NO: 2652298 - DNA, 16 bp, Homo sapiens
ttatttaaaagattca

SEQ ID NO: 2652299 - DNA, 18 bp, Homo sapiens
ttatttaaaagattcatt

SEQ ID NO: 2652300 - DNA, 14 bp, Homo sapiens
ttatttaaatttta

SEQ ID NO: 2652301 - DNA, 12 bp, Homo sapiens
ttatttaataac

SEQ ID NO: 2652302 - DNA, 14 bp, Homo sapiens
ttatttaattaaaa

SEQ ID NO: 2652303 - DNA, 17 bp, Homo sapiens
ttatttagggaactgct

SEQ ID NO: 2652304 - DNA, 21 bp, Homo sapiens
ttatttagggaactgcttgac

SEQ ID NO: 2652305 - DNA, 14 bp, Homo sapiens
ttatttatcagtga

SEQ ID NO: 2652306 - DNA, 13 bp, Homo sapiens
ttatttattaaga

SEQ ID NO: 2652307 - DNA, 14 bp, Homo sapiens
ttatttattaagat

SEQ ID NO: 2652308 - DNA, 15 bp, Homo sapiens
ttatttattaagatg

SEQ ID NO: 2652309 - DNA, 17 bp, Homo sapiens
ttatttcagaaatgtac

SEQ ID NO: 2652310 - DNA, 17 bp, Homo sapiens
ttatttccaaataaaat

SEQ ID NO: 2652311 - DNA, 19 bp, Homo sapiens
ttatttctaggaagaattt

SEQ ID NO: 2652312 - DNA, 22 bp, Homo sapiens
ttatttctcagactttggaaaa

SEQ ID NO: 2652313 - DNA, 16 bp, Homo sapiens
ttatttctctgatttg

SEQ ID NO: 2652314 - DNA, 19 bp, Homo sapiens
ttatttcttaaacaaatgt

SEQ ID NO: 2652315 - DNA, 14 bp, Homo sapiens
ttatttgacaaaat

SEQ ID NO: 2652316 - DNA, 18 bp, Homo sapiens
ttatttgcagagacagga

SEQ ID NO: 2652317 - DNA, 13 bp, Homo sapiens
ttatttgtgtaat

SEQ ID NO: 2652318 - DNA, 22 bp, Homo sapiens
ttatttgtgttttaatttaaac

SEQ ID NO: 2652319 - DNA, 18 bp, Homo sapiens
ttatttgttattttcagt

SEQ ID NO: 2652320 - DNA, 14 bp, Homo sapiens
ttattttcctcccc

SEQ ID NO: 2652321 - DNA, 17 bp, Homo sapiens
ttattttctttgaaatt

SEQ ID NO: 2652322 - DNA, 18 bp, Homo sapiens
ttatttttagacagagtc

SEQ ID NO: 2652323 - DNA, 23 bp, Homo sapiens
ttatttttgtttcttccaaagca

SEQ ID NO: 2652324 - DNA, 18 bp, Homo sapiens
ttattttttaagtattta

SEQ ID NO: 2652325 - DNA, 14 bp, Homo sapiens
ttattttttaatta

SEQ ID NO: 2652326 - DNA, 13 bp, Homo sapiens
ttattttttattg

SEQ ID NO: 2652327 - DNA, 16 bp, Homo sapiens
ttattttttcagaccg

SEQ ID NO: 2652328 - DNA, 16 bp, Homo sapiens
ttctgtgcctgaatat

SEQ ID NO: 2652329 - DNA, 13 bp, Homo sapiens
ttctgtggaaagt

SEQ ID NO: 2652330 - DNA, 19 bp, Homo sapiens
ttctgtggaaagtgtaaag

SEQ ID NO: 2652331 - DNA, 22 bp, Homo sapiens
ttctgtggaaagtgtaaagcat

SEQ ID NO: 2652332 - DNA, 23 bp, Homo sapiens
ttctgtggttttcccctccctgg

SEQ ID NO: 2652333 - DNA, 20 bp, Homo sapiens
ttctgtgtgttttcataata

SEQ ID NO: 2652334 - DNA, 16 bp, Homo sapiens
ttctgttctgtggaaa

SEQ ID NO: 2652335 - DNA, 13 bp, Homo sapiens
ttctgtttagata

SEQ ID NO: 2652336 - DNA, 11 bp, Homo sapiens
ttctgtttctt

SEQ ID NO: 2652337 - DNA, 16 bp, Homo sapiens
ttctgtttggaggagc

SEQ ID NO: 2652338 - DNA, 13 bp, Homo sapiens
ttcttaaagagtt

SEQ ID NO: 2652339 - DNA, 21 bp, Homo sapiens
ttcttaaatgggctactttgt

SEQ ID NO: 2652340 - DNA, 23 bp, Homo sapiens
ttcttaagacgtgattttgctgt

SEQ ID NO: 2652341 - DNA, 22 bp, Homo sapiens
ttcttaagtatgttattttctg

SEQ ID NO: 2652342 - DNA, 14 bp, Homo sapiens
ttcttaattgcact

SEQ ID NO: 2652343 - DNA, 15 bp, Homo sapiens
ttcttacaaacatgt

SEQ ID NO: 2652344 - DNA, 12 bp, Homo sapiens
ttcttacaagga

SEQ ID NO: 2652345 - DNA, 19 bp, Homo sapiens
ttcttagttctcactgttc

SEQ ID NO: 2652346 - DNA, 13 bp, Homo sapiens
ttcttataaatat

SEQ ID NO: 2652347 - DNA, 17 bp, Homo sapiens
ttcttataaatatgaag

SEQ ID NO: 2652348 - DNA, 22 bp, Homo sapiens
ttcttataaatatgaagctcac

SEQ ID NO: 2652349 - DNA, 21 bp, Homo sapiens
ttcttatacatttgataaagt

SEQ ID NO: 2652350 - DNA, 16 bp, Homo sapiens
ttcttatatatgtgaa

SEQ ID NO: 2652351 - DNA, 17 bp, Homo sapiens
ttcttcaacatcaatgt

SEQ ID NO: 2652352 - DNA, 14 bp, Homo sapiens
ttcttcacccagct

SEQ ID NO: 2652353 - DNA, 13 bp, Homo sapiens
ttcttcagagact

SEQ ID NO: 2652354 - DNA, 23 bp, Homo sapiens
ttcttcagccacctctctttttc

SEQ ID NO: 2652355 - DNA, 14 bp, Homo sapiens
ttcttcatgcaatg

SEQ ID NO: 2652356 - DNA, 20 bp, Homo sapiens
ttcttcccttttacatactg

SEQ ID NO: 2652357 - DNA, 22 bp, Homo sapiens
ttcttcccttttacatactgct

SEQ ID NO: 2652358 - DNA, 15 bp, Homo sapiens
ttcttcgggaagaga

SEQ ID NO: 2652359 - DNA, 23 bp, Homo sapiens
ttcttctcaggcatgaacatgta

SEQ ID NO: 2652360 - DNA, 21 bp, Homo sapiens
ttcttctttttgcttcaaaaa

SEQ ID NO: 2652361 - DNA, 20 bp, Homo sapiens
ttcttggggccctacacctt

SEQ ID NO: 2652362 - DNA, 18 bp, Homo sapiens
ttcttggttcataaatga

SEQ ID NO: 2652363 - DNA, 16 bp, Homo sapiens
ttcttggttggctggc

SEQ ID NO: 2652364 - DNA, 21 bp, Homo sapiens
ttcttgtaatttaaacaggcc

SEQ ID NO: 2652365 - DNA, 13 bp, Homo sapiens
ttcttgtattaag

SEQ ID NO: 2652366 - DNA, 22 bp, Homo sapiens
ttcttgtgccatagtcacatgg

SEQ ID NO: 2652367 - DNA, 21 bp, Homo sapiens
ttctttaagaattacaggttg

SEQ ID NO: 2652368 - DNA, 20 bp, Homo sapiens
ttctttcaagtgaatctaaa

SEQ ID NO: 2652369 - DNA, 20 bp, Homo sapiens
ttctttccattatgattctt

SEQ ID NO: 2652370 - DNA, 22 bp, Homo sapiens
ttctttctagtggtctttgtaa

SEQ ID NO: 2652371 - DNA, 22 bp, Homo sapiens
ttctttctggctatgcatttga

SEQ ID NO: 2652372 - DNA, 15 bp, Homo sapiens
ttctttgaaattgtt

SEQ ID NO: 2652373 - DNA, 11 bp, Homo sapiens
ttctttgaatg

SEQ ID NO: 2652374 - DNA, 22 bp, Homo sapiens
ttctttgataatgttaaatttg

SEQ ID NO: 2652375 - DNA, 13 bp, Homo sapiens
ttctttgatgtta

SEQ ID NO: 2652376 - DNA, 20 bp, Homo sapiens
ttctttgatgttaacacatt

SEQ ID NO: 2652377 - DNA, 22 bp, Homo sapiens
ttctttgatgttaacacatttt

SEQ ID NO: 2652378 - DNA, 14 bp, Homo sapiens
ttctttgcctgttc

SEQ ID NO: 2652379 - DNA, 16 bp, Homo sapiens
ttctttgttacaggca

SEQ ID NO: 2652380 - DNA, 21 bp, Homo sapiens
ttcttttaaaggggcagaaaa

SEQ ID NO: 2652381 - DNA, 21 bp, Homo sapiens
ttcttttctggaatgtaatca

SEQ ID NO: 2652382 - DNA, 14 bp, Homo sapiens
ttcttttggcttcc

SEQ ID NO: 2652383 - DNA, 22 bp, Homo sapiens
ttcttttggtaaagactggctt

SEQ ID NO: 2652384 - DNA, 23 bp, Homo sapiens
ttctttttgctgttgtttctaaa

SEQ ID NO: 2652385 - DNA, 22 bp, Homo sapiens
ttgaaaaaatagagcctgaggg

SEQ ID NO: 2652386 - DNA, 21 bp, Homo sapiens
ttgaaaaatgtgcaaaacagc

SEQ ID NO: 2652387 - DNA, 13 bp, Homo sapiens
ttgaaaaattcct

SEQ ID NO: 2652388 - DNA, 20 bp, Homo sapiens
ttgaaaaattcctattgtga

SEQ ID NO: 2652389 - DNA, 23 bp, Homo sapiens
ttgaaaacactgttctctgccct

SEQ ID NO: 2652390 - DNA, 13 bp, Homo sapiens
ttgaaaacttttc

SEQ ID NO: 2652391 - DNA, 13 bp, Homo sapiens
ttgaaaagctatt

SEQ ID NO: 2652392 - DNA, 19 bp, Homo sapiens
ttgaaaccaccttttatta

SEQ ID NO: 2652393 - DNA, 17 bp, Homo sapiens
ttgaaagaaaggactct

SEQ ID NO: 2652394 - DNA, 13 bp, Homo sapiens
ttgaaagaccttc

SEQ ID NO: 2652395 - DNA, 14 bp, Homo sapiens
ttgaaagagatggc

SEQ ID NO: 2652396 - DNA, 16 bp, Homo sapiens
ttgaaagcatccatgt

SEQ ID NO: 2652397 - DNA, 22 bp, Homo sapiens
ttgaaagctgtggccagcttgt

SEQ ID NO: 2652398 - DNA, 19 bp, Homo sapiens
ttgaaaggcattctctgaa

SEQ ID NO: 2652399 - DNA, 20 bp, Homo sapiens
ttgaaaggcattctctgaag

SEQ ID NO: 2652400 - DNA, 13 bp, Homo sapiens
ttgaaatctttta

SEQ ID NO: 2652401 - DNA, 23 bp, Homo sapiens
ttgaaattatgtatgtttacata

SEQ ID NO: 2652402 - DNA, 12 bp, Homo sapiens
ttgaaattttaa

SEQ ID NO: 2652403 - DNA, 21 bp, Homo sapiens
ttgaaatttttattaaattat

SEQ ID NO: 2652404 - DNA, 20 bp, Homo sapiens
ttgaacaagttgtttcattg

SEQ ID NO: 2652405 - DNA, 19 bp, Homo sapiens
ttgaacactcatgctgaaa

SEQ ID NO: 2652406 - DNA, 13 bp, Homo sapiens
ttgaacactgggg

SEQ ID NO: 2652407 - DNA, 15 bp, Homo sapiens
ttgaactgatagtta

SEQ ID NO: 2652408 - DNA, 20 bp, Homo sapiens
ttgaactgatagttactgtt

SEQ ID NO: 2652409 - DNA, 22 bp, Homo sapiens
ttgaactgatagttactgttgt

SEQ ID NO: 2652410 - DNA, 18 bp, Homo sapiens
ttgaacttaaataaatgt

SEQ ID NO: 2652411 - DNA, 16 bp, Homo sapiens
ttgaacttttttccac

SEQ ID NO: 2652412 - DNA, 13 bp, Homo sapiens
ttgaagacactga

SEQ ID NO: 2652413 - DNA, 22 bp, Homo sapiens
ttgaagacactgaaatatacac

SEQ ID NO: 2652414 - DNA, 23 bp, Homo sapiens
ttgaagccaagtcagctttgcct

SEQ ID NO: 2652415 - DNA, 21 bp, Homo sapiens
ttgaagccactgaagctggga

SEQ ID NO: 2652416 - DNA, 15 bp, Homo sapiens
ttgaaggatctgttt

SEQ ID NO: 2652417 - DNA, 19 bp, Homo sapiens
ttgaagggtaaagaagttt

SEQ ID NO: 2652418 - DNA, 21 bp, Homo sapiens
ttgaataaagcctgcttttta

SEQ ID NO: 2652419 - DNA, 19 bp, Homo sapiens
ttgaataaagttgaagcta

SEQ ID NO: 2652420 - DNA, 12 bp, Homo sapiens
ttgaataaataa

SEQ ID NO: 2652421 - DNA, 12 bp, Homo sapiens
ttgaataatggt

SEQ ID NO: 2652422 - DNA, 16 bp, Homo sapiens
ttgaatatcccctccc

SEQ ID NO: 2652423 - DNA, 17 bp, Homo sapiens
ttgaatatcccctccca

SEQ ID NO: 2652424 - DNA, 14 bp, Homo sapiens
ttgaatcaataata

SEQ ID NO: 2652425 - DNA, 23 bp, Homo sapiens
ttgaatcatgtagtatcaaatat

SEQ ID NO: 2652426 - DNA, 17 bp, Homo sapiens
ttgaatccatgcttggg

SEQ ID NO: 2652427 - DNA, 19 bp, Homo sapiens
ttgaatccatgcttgggtg

SEQ ID NO: 2652428 - DNA, 17 bp, Homo sapiens
ttgaatctatttaagta

SEQ ID NO: 2652429 - DNA, 15 bp, Homo sapiens
ttgaatctttccaat

SEQ ID NO: 2652430 - DNA, 12 bp, Homo sapiens
ttgaatgaaaaa

SEQ ID NO: 2652431 - DNA, 15 bp, Homo sapiens
ttgaatgaaaaattt

SEQ ID NO: 2652432 - DNA, 22 bp, Homo sapiens
ttgaatgaaaaatttaagcatt

SEQ ID NO: 2652433 - DNA, 20 bp, Homo sapiens
ttgaatggtgttgtatgcct

SEQ ID NO: 2652434 - DNA, 16 bp, Homo sapiens
ttgaatgtcttttgaa

SEQ ID NO: 2652435 - DNA, 22 bp, Homo sapiens
ttgaattatcttggttgaaaat

SEQ ID NO: 2652436 - DNA, 18 bp, Homo sapiens
ttgaattgtaactgttct

SEQ ID NO: 2652437 - DNA, 14 bp, Homo sapiens
ttgaattttctgtg

SEQ ID NO: 2652438 - DNA, 13 bp, Homo sapiens
ttgacaaactctc

SEQ ID NO: 2652439 - DNA, 22 bp, Homo sapiens
ttgacaagtcattttaacttta

SEQ ID NO: 2652440 - DNA, 18 bp, Homo sapiens
ttgacaataatttcaggt

SEQ ID NO: 2652441 - DNA, 17 bp, Homo sapiens
ttgacacttaaaaatgg

SEQ ID NO: 2652442 - DNA, 17 bp, Homo sapiens
ttgacagatcaagctgt

SEQ ID NO: 2652443 - DNA, 19 bp, Homo sapiens
ttgacagatcaagctgtga

SEQ ID NO: 2652444 - DNA, 19 bp, Homo sapiens
ttgacaggattattggaaa

SEQ ID NO: 2652445 - DNA, 15 bp, Homo sapiens
ttgacagttctgaag

SEQ ID NO: 2652446 - DNA, 17 bp, Homo sapiens
ttgacagttctgaagaa

SEQ ID NO: 2652447 - DNA, 18 bp, Homo sapiens
ttgacagttctgaagaat

SEQ ID NO: 2652448 - DNA, 14 bp, Homo sapiens
ttgacatgtggaaa

SEQ ID NO: 2652449 - DNA, 22 bp, Homo sapiens
ttgacatgtggaaagtgaattt

SEQ ID NO: 2652450 - DNA, 18 bp, Homo sapiens
ttgaccaagcaggaagct

SEQ ID NO: 2652451 - DNA, 21 bp, Homo sapiens
ttgaccagcagatcccagctc

SEQ ID NO: 2652452 - DNA, 19 bp, Homo sapiens
ttgaccattctccacctgc

SEQ ID NO: 2652453 - DNA, 24 bp, Homo sapiens
ttgaccattctccacctgccaggg

SEQ ID NO: 2652454 - DNA, 21 bp, Homo sapiens
ttgacctcaggtgatccaccc

SEQ ID NO: 2652455 - DNA, 22 bp, Homo sapiens
ttgacctgcctcccttcatgca

SEQ ID NO: 2652456 - DNA, 23 bp, Homo sapiens
ttgacctgcctcccttcatgcat

SEQ ID NO: 2652457 - DNA, 15 bp, Homo sapiens
ttgacgccatcccag

SEQ ID NO: 2652458 - DNA, 18 bp, Homo sapiens
ttgacgccatcccagccc

SEQ ID NO: 2652459 - DNA, 15 bp, Homo sapiens
ttgacggatgattgg

SEQ ID NO: 2652460 - DNA, 19 bp, Homo sapiens
ttgactagggattcaggct

SEQ ID NO: 2652461 - DNA, 21 bp, Homo sapiens
ttgactagggattcaggctgc

SEQ ID NO: 2652462 - DNA, 23 bp, Homo sapiens
ttgactccttgtggtttatgtca

SEQ ID NO: 2652463 - DNA, 13 bp, Homo sapiens
ttgactctgggga

SEQ ID NO: 2652464 - DNA, 20 bp, Homo sapiens
ttgactgaagatgcagctca

SEQ ID NO: 2652465 - DNA, 16 bp, Homo sapiens
ttgacttattttctct

SEQ ID NO: 2652466 - DNA, 20 bp, Homo sapiens
ttgacttgacagaacactgt

SEQ ID NO: 2652467 - DNA, 13 bp, Homo sapiens
ttgactttcaggt

SEQ ID NO: 2652468 - DNA, 15 bp, Homo sapiens
ttgactttcaggtac

SEQ ID NO: 2652469 - DNA, 10 bp, Homo sapiens
ttgagaaacc

SEQ ID NO: 2652470 - DNA, 15 bp, Homo sapiens
ttgagaaatgaataa

SEQ ID NO: 2652471 - DNA, 18 bp, Homo sapiens
ttgttttaaaattaaagc

SEQ ID NO: 2652472 - DNA, 20 bp, Homo sapiens
ttgttttaaaattaaagcta

SEQ ID NO: 2652473 - DNA, 19 bp, Homo sapiens
ttgttttatcatgacatgt

SEQ ID NO: 2652474 - DNA, 16 bp, Homo sapiens
ttgttttcagtgtaca

SEQ ID NO: 2652475 - DNA, 14 bp, Homo sapiens
ttgttttcattatc

SEQ ID NO: 2652476 - DNA, 18 bp, Homo sapiens
ttgttttcttctgtatgt

SEQ ID NO: 2652477 - DNA, 22 bp, Homo sapiens
ttgtttttccttgtatttaaat

SEQ ID NO: 2652478 - DNA, 17 bp, Homo sapiens
tttaaaaaaatttaagt

SEQ ID NO: 2652479 - DNA, 15 bp, Homo sapiens
tttaaaaaccttgta

SEQ ID NO: 2652480 - DNA, 13 bp, Homo sapiens
tttaaaaatcata

SEQ ID NO: 2652481 - DNA, 22 bp, Homo sapiens
tttaaaaatctaccttctgtag

SEQ ID NO: 2652482 - DNA, 20 bp, Homo sapiens
tttaaaaggatttttatctt

SEQ ID NO: 2652483 - DNA, 16 bp, Homo sapiens
tttaaaattgtgatgt

SEQ ID NO: 2652484 - DNA, 14 bp, Homo sapiens
tttaaactgtgtac

SEQ ID NO: 2652485 - DNA, 22 bp, Homo sapiens
tttaaactgtgtacataactga

SEQ ID NO: 2652486 - DNA, 13 bp, Homo sapiens
tttaaagaatgct

SEQ ID NO: 2652487 - DNA, 24 bp, Homo sapiens
tttaaagcttattaaaactcattt

SEQ ID NO: 2652488 - DNA, 17 bp, Homo sapiens
tttaaaggaaaaaatgt

SEQ ID NO: 2652489 - DNA, 18 bp, Homo sapiens
tttaaagtgattaaacgt

SEQ ID NO: 2652490 - DNA, 21 bp, Homo sapiens
tttaaataaagtatcatgcat

SEQ ID NO: 2652491 - DNA, 23 bp, Homo sapiens
tttaaataaagtatcatgcattc

SEQ ID NO: 2652492 - DNA, 20 bp, Homo sapiens
tttaaatacgcactacatgt

SEQ ID NO: 2652493 - DNA, 15 bp, Homo sapiens
tttaacaaaagcaag

SEQ ID NO: 2652494 - DNA, 16 bp, Homo sapiens
tttaacaaaagcaaga

SEQ ID NO: 2652495 - DNA, 20 bp, Homo sapiens
tttaacaataactactgtgt

SEQ ID NO: 2652496 - DNA, 17 bp, Homo sapiens
tttaacacctgatgtgt

SEQ ID NO: 2652497 - DNA, 23 bp, Homo sapiens
tttaacagggtctctagtgctgt

SEQ ID NO: 2652498 - DNA, 15 bp, Homo sapiens
tttaactagaattta

SEQ ID NO: 2652499 - DNA, 15 bp, Homo sapiens
tttaactcagatcac

SEQ ID NO: 2652500 - DNA, 23 bp, Homo sapiens
tttaactcagatcactactgcag

SEQ ID NO: 2652501 - DNA, 18 bp, Homo sapiens
tttaactttaagtttcag

SEQ ID NO: 2652502 - DNA, 18 bp, Homo sapiens
tttaagaaaaaggatgca

SEQ ID NO: 2652503 - DNA, 15 bp, Homo sapiens
tttaagacacttttt

SEQ ID NO: 2652504 - DNA, 15 bp, Homo sapiens
tttaagataaattat

SEQ ID NO: 2652505 - DNA, 23 bp, Homo sapiens
tttaagataataatatatgttta

SEQ ID NO: 2652506 - DNA, 12 bp, Homo sapiens
tttaagattttt

SEQ ID NO: 2652507 - DNA, 16 bp, Homo sapiens
tttaagatttttctca

SEQ ID NO: 2652508 - DNA, 18 bp, Homo sapiens
tttaagatttttctcaaa

SEQ ID NO: 2652509 - DNA, 13 bp, Homo sapiens
tttaagcattgtt

SEQ ID NO: 2652510 - DNA, 18 bp, Homo sapiens
tttaagctgtttccatag

SEQ ID NO: 2652511 - DNA, 11 bp, Homo sapiens
tttaaggaaaa

SEQ ID NO: 2652512 - DNA, 12 bp, Homo sapiens
tttaaggaaaca

SEQ ID NO: 2652513 - DNA, 20 bp, Homo sapiens
tttaaggatgcttgtacata

SEQ ID NO: 2652514 - DNA, 22 bp, Homo sapiens
tttaaggatgcttgtacataat

SEQ ID NO: 2652515 - DNA, 17 bp, Homo sapiens
tttaagggtttgtggaa

SEQ ID NO: 2652516 - DNA, 16 bp, Homo sapiens
tttaaggtttttactg

SEQ ID NO: 2652517 - DNA, 18 bp, Homo sapiens
tttaagtatttaggtttt

SEQ ID NO: 2652518 - DNA, 18 bp, Homo sapiens
tttaagtgcgtgtgtaga

SEQ ID NO: 2652519 - DNA, 15 bp, Homo sapiens
tttaagtgctgcatt

SEQ ID NO: 2652520 - DNA, 18 bp, Homo sapiens
tttaagtgctttgtaatg

SEQ ID NO: 2652521 - DNA, 18 bp, Homo sapiens
tttaagttacacattttt

SEQ ID NO: 2652522 - DNA, 15 bp, Homo sapiens
tttaagttgtttgca

SEQ ID NO: 2652523 - DNA, 15 bp, Homo sapiens
tttaataacattacc

SEQ ID NO: 2652524 - DNA, 14 bp, Homo sapiens
tttaatacagcagt

SEQ ID NO: 2652525 - DNA, 13 bp, Homo sapiens
tttaatatttaaa

SEQ ID NO: 2652526 - DNA, 15 bp, Homo sapiens
tttaatatttaaaca

SEQ ID NO: 2652527 - DNA, 18 bp, Homo sapiens
tttaatatttaaacagca

SEQ ID NO: 2652528 - DNA, 13 bp, Homo sapiens
tttaatcttcagt

SEQ ID NO: 2652529 - DNA, 23 bp, Homo sapiens
tttaatgaaagactgtacaaagt

SEQ ID NO: 2652530 - DNA, 22 bp, Homo sapiens
tttaatggccggctggaaatgc

SEQ ID NO: 2652531 - DNA, 22 bp, Homo sapiens
tttaatgggggtagcagctgga

SEQ ID NO: 2652532 - DNA, 15 bp, Homo sapiens
tttaatgtgctgtgt

SEQ ID NO: 2652533 - DNA, 16 bp, Homo sapiens
tttaatgtgctgtgta

SEQ ID NO: 2652534 - DNA, 19 bp, Homo sapiens
tttaatgtgctgtgtaaag

SEQ ID NO: 2652535 - DNA, 20 bp, Homo sapiens
tttaatgtgctgtgtaaagt

SEQ ID NO: 2652536 - DNA, 14 bp, Homo sapiens
tttaattattattc

SEQ ID NO: 2652537 - DNA, 11 bp, Homo sapiens
tttaattctct

SEQ ID NO: 2652538 - DNA, 18 bp, Homo sapiens
tttaattgttgtttcttt

SEQ ID NO: 2652539 - DNA, 15 bp, Homo sapiens
tttaattttgtattt

SEQ ID NO: 2652540 - DNA, 19 bp, Homo sapiens
tttaatttttttgagacag

SEQ ID NO: 2652541 - DNA, 15 bp, Homo sapiens
tttacaagccccccc

SEQ ID NO: 2652542 - DNA, 21 bp, Homo sapiens
tttacaatcagccacattcta

SEQ ID NO: 2652543 - DNA, 19 bp, Homo sapiens
tttacaattttttatcatg

SEQ ID NO: 2652544 - DNA, 15 bp, Homo sapiens
tttacagcactactc

SEQ ID NO: 2652545 - DNA, 16 bp, Homo sapiens
tttacagcactactct

SEQ ID NO: 2652546 - DNA, 21 bp, Homo sapiens
tttacagcactactctgtgcc

SEQ ID NO: 2652547 - DNA, 13 bp, Homo sapiens
tttacagctgcct

SEQ ID NO: 2652548 - DNA, 16 bp, Homo sapiens
tttacagctgcctgca

SEQ ID NO: 2652549 - DNA, 18 bp, Homo sapiens
tttacctaccacagtgtc

SEQ ID NO: 2652550 - DNA, 19 bp, Homo sapiens
tttacctaccacagtgtct

SEQ ID NO: 2652551 - DNA, 21 bp, Homo sapiens
tttacctgtgcgttactaatt

SEQ ID NO: 2652552 - DNA, 16 bp, Homo sapiens
tttaccttttaattaa

SEQ ID NO: 2652553 - DNA, 19 bp, Homo sapiens
tttaccttttttatacata

SEQ ID NO: 2652554 - DNA, 17 bp, Homo sapiens
tttacggacaccccctc

SEQ ID NO: 2652555 - DNA, 22 bp, Homo sapiens
tttactaagccacaagaaattt

SEQ ID NO: 2652556 - DNA, 14 bp, Homo sapiens
tttactaatagaca

SEQ ID NO: 2652557 - DNA, 17 bp, Homo sapiens
tttactaatagacaatt

SEQ ID NO: 2652558 - DNA, 18 bp, Homo sapiens
tttactaatagacaattt

SEQ ID NO: 2652559 - DNA, 23 bp, Homo sapiens
tttactactgtggaaaaatattt

SEQ ID NO: 2652560 - DNA, 21 bp, Homo sapiens
tttactcaaccctctcaggtg

SEQ ID NO: 2652561 - DNA, 21 bp, Homo sapiens
tttactccagtggtgaagaaa

SEQ ID NO: 2652562 - DNA, 18 bp, Homo sapiens
tttactgagcttctctgt

SEQ ID NO: 2652563 - DNA, 16 bp, Homo sapiens
tttactgcagctttgt

SEQ ID NO: 2652564 - DNA, 14 bp, Homo sapiens
tttactgtttgtta

SEQ ID NO: 2652565 - DNA, 22 bp, Homo sapiens
tttacttcttatacatttgata

SEQ ID NO: 2652566 - DNA, 18 bp, Homo sapiens
tttacttgcattgaatat

SEQ ID NO: 2652567 - DNA, 18 bp, Homo sapiens
tttacttgccattactca

SEQ ID NO: 2652568 - DNA, 18 bp, Homo sapiens
tttacttttaaacagtga

SEQ ID NO: 2652569 - DNA, 15 bp, Homo sapiens
tttagaaagaatatt

SEQ ID NO: 2652570 - DNA, 19 bp, Homo sapiens
tttagaagaagtgtgtcac

SEQ ID NO: 2652571 - DNA, 19 bp, Homo sapiens
tttagacaaatactcatgt

SEQ ID NO: 2652572 - DNA, 23 bp, Homo sapiens
tttagacaaatactcatgtgtat

SEQ ID NO: 2652573 - DNA, 19 bp, Homo sapiens
tttagaccctattgctgct

SEQ ID NO: 2652574 - DNA, 15 bp, Homo sapiens
tttagactgtagcct

SEQ ID NO: 2652575 - DNA, 18 bp, Homo sapiens
tttagagaactgtggccg

SEQ ID NO: 2652576 - DNA, 21 bp, Homo sapiens
tttagagatgaattaaattta

SEQ ID NO: 2652577 - DNA, 11 bp, Homo sapiens
tttagatgctg

SEQ ID NO: 2652578 - DNA, 19 bp, Homo sapiens
tttagattgaaaacttttc

SEQ ID NO: 2652579 - DNA, 15 bp, Homo sapiens
tttagccaaaccctt

SEQ ID NO: 2652580 - DNA, 15 bp, Homo sapiens
tttagccaccatctt

SEQ ID NO: 2652581 - DNA, 15 bp, Homo sapiens
tttagcctagttcat

SEQ ID NO: 2652582 - DNA, 13 bp, Homo sapiens
tttaggagatttt

SEQ ID NO: 2652583 - DNA, 23 bp, Homo sapiens
tttagggactcaatttctcccca

SEQ ID NO: 2652584 - DNA, 19 bp, Homo sapiens
tttagggagagtcatattt

SEQ ID NO: 2652585 - DNA, 21 bp, Homo sapiens
tttagggagagtcatattttg

SEQ ID NO: 2652586 - DNA, 16 bp, Homo sapiens
tttagtaaggctgtgt

SEQ ID NO: 2652587 - DNA, 17 bp, Homo sapiens
tttagttaaatttctgg

SEQ ID NO: 2652588 - DNA, 15 bp, Homo sapiens
tttagttatagtttc

SEQ ID NO: 2652589 - DNA, 17 bp, Homo sapiens
tttagttctttggaaat

SEQ ID NO: 2652590 - DNA, 11 bp, Homo sapiens
tttagtttttg

SEQ ID NO: 2652591 - DNA, 14 bp, Homo sapiens
tttataaactttac

SEQ ID NO: 2652592 - DNA, 19 bp, Homo sapiens
tttataactcatcataaaa

SEQ ID NO: 2652593 - DNA, 12 bp, Homo sapiens
tttatacataaa

SEQ ID NO: 2652594 - DNA, 17 bp, Homo sapiens
tttatagtttgtacatg

SEQ ID NO: 2652595 - DNA, 14 bp, Homo sapiens
tttatataaatgct

SEQ ID NO: 2652596 - DNA, 13 bp, Homo sapiens
tttatatatacag

SEQ ID NO: 2652597 - DNA, 15 bp, Homo sapiens
tttatatatacagta

SEQ ID NO: 2652598 - DNA, 15 bp, Homo sapiens
tttatatatttataa

SEQ ID NO: 2652599 - DNA, 14 bp, Homo sapiens
tttatatttagtga

SEQ ID NO: 2652600 - DNA, 22 bp, Homo sapiens
tttatcaaacagaattttaaag

SEQ ID NO: 2652601 - DNA, 14 bp, Homo sapiens
tttatcaaatcagt

SEQ ID NO: 2652602 - DNA, 18 bp, Homo sapiens
tttatcaatcagtataat

SEQ ID NO: 2652603 - DNA, 15 bp, Homo sapiens
tttatcacacttctg

SEQ ID NO: 2652604 - DNA, 22 bp, Homo sapiens
tttatcacatgtatgttttggt

SEQ ID NO: 2652605 - DNA, 13 bp, Homo sapiens
tttatcagtgaca

SEQ ID NO: 2652606 - DNA, 18 bp, Homo sapiens
tttatcagtgacagagtt

SEQ ID NO: 2652607 - DNA, 14 bp, Homo sapiens
tttatcatgacatg

SEQ ID NO: 2652608 - DNA, 15 bp, Homo sapiens
tttatcatgacatgt

SEQ ID NO: 2652609 - DNA, 16 bp, Homo sapiens
tttatcatgcatgtcc

SEQ ID NO: 2652610 - DNA, 16 bp, Homo sapiens
tttatcgtcactgctt

SEQ ID NO: 2652611 - DNA, 12 bp, Homo sapiens
tttatctttata

SEQ ID NO: 2652612 - DNA, 12 bp, Homo sapiens
tttatgagccag

SEQ ID NO: 2652613 - DNA, 17 bp, Homo sapiens
tttatgcaaggaaggaa

SEQ ID NO: 2652614 - DNA, 13 bp, Homo sapiens
tttatggcctcag

SEQ ID NO: 2652615 - DNA, 20 bp, Homo sapiens
tttatggcttttgtgcatta

SEQ ID NO: 2652616 - DNA, 15 bp, Homo sapiens
ttttacttttaaatg

SEQ ID NO: 2652617 - DNA, 12 bp, Homo sapiens
ttttacttttat

SEQ ID NO: 2652618 - DNA, 18 bp, Homo sapiens
ttttagacaaatactcat

SEQ ID NO: 2652619 - DNA, 22 bp, Homo sapiens
ttttagacaaatactcatgtgt

SEQ ID NO: 2652620 - DNA, 23 bp, Homo sapiens
ttttagacaaatactcatgtgta

SEQ ID NO: 2652621 - DNA, 21 bp, Homo sapiens
ttttagaccctattgctgctt

SEQ ID NO: 2652622 - DNA, 19 bp, Homo sapiens
ttttagatcaaatacttta

SEQ ID NO: 2652623 - DNA, 20 bp, Homo sapiens
ttttagatgagattgtttta

SEQ ID NO: 2652624 - DNA, 22 bp, Homo sapiens
ttttagcatgtgtttggttctg

SEQ ID NO: 2652625 - DNA, 19 bp, Homo sapiens
ttttagcctagttcatcca

SEQ ID NO: 2652626 - DNA, 20 bp, Homo sapiens
ttttagctgatgaacttatt

SEQ ID NO: 2652627 - DNA, 22 bp, Homo sapiens
ttttagctggtggcaataaata

SEQ ID NO: 2652628 - DNA, 18 bp, Homo sapiens
ttttaggtctcttcccct

SEQ ID NO: 2652629 - DNA, 13 bp, Homo sapiens
ttttagttttagt

SEQ ID NO: 2652630 - DNA, 20 bp, Homo sapiens
ttttataaatcgcttttgat

SEQ ID NO: 2652631 - DNA, 12 bp, Homo sapiens
ttttatactgta

SEQ ID NO: 2652632 - DNA, 15 bp, Homo sapiens
ttttatactgtactt

SEQ ID NO: 2652633 - DNA, 11 bp, Homo sapiens
ttttatattta

SEQ ID NO: 2652634 - DNA, 13 bp, Homo sapiens
ttttatatttagt

SEQ ID NO: 2652635 - DNA, 23 bp, Homo sapiens
ttttatatttagttatagtttca

SEQ ID NO: 2652636 - DNA, 16 bp, Homo sapiens
ttttatcatgcatgtc

SEQ ID NO: 2652637 - DNA, 23 bp, Homo sapiens
ttttatctccccttcacatgcat

SEQ ID NO: 2652638 - DNA, 21 bp, Homo sapiens
ttttatggcttttgtgcatta

SEQ ID NO: 2652639 - DNA, 14 bp, Homo sapiens
ttttattaatgcac

SEQ ID NO: 2652640 - DNA, 19 bp, Homo sapiens
ttttattaatgcactttct

SEQ ID NO: 2652641 - DNA, 14 bp, Homo sapiens
ttttattcaagtta

SEQ ID NO: 2652642 - DNA, 13 bp, Homo sapiens
ttttattccacat

SEQ ID NO: 2652643 - DNA, 15 bp, Homo sapiens
ttttatttgcatgtg

SEQ ID NO: 2652644 - DNA, 18 bp, Homo sapiens
ttttatttttctaaaaaa

SEQ ID NO: 2652645 - DNA, 17 bp, Homo sapiens
ttttatttttttctacc

SEQ ID NO: 2652646 - DNA, 14 bp, Homo sapiens
ttttcaaaatggag

SEQ ID NO: 2652647 - DNA, 15 bp, Homo sapiens
ttttcaagaaactga

SEQ ID NO: 2652648 - DNA, 14 bp, Homo sapiens
ttttcaatatttat

SEQ ID NO: 2652649 - DNA, 14 bp, Homo sapiens
ttttcaattttgca

SEQ ID NO: 2652650 - DNA, 18 bp, Homo sapiens
ttttcacattcttataaa

SEQ ID NO: 2652651 - DNA, 22 bp, Homo sapiens
ttttcacattcttataaatatg

SEQ ID NO: 2652652 - DNA, 19 bp, Homo sapiens
ttttcaccagatttgctaa

SEQ ID NO: 2652653 - DNA, 13 bp, Homo sapiens
ttttcaccccacc

SEQ ID NO: 2652654 - DNA, 18 bp, Homo sapiens
ttttcactttgtgattat

SEQ ID NO: 2652655 - DNA, 15 bp, Homo sapiens
ttttcagaaatatgt

SEQ ID NO: 2652656 - DNA, 18 bp, Homo sapiens
ttttcagaacctcttccc

SEQ ID NO: 2652657 - DNA, 11 bp, Homo sapiens
ttttcagaccg

SEQ ID NO: 2652658 - DNA, 13 bp, Homo sapiens
ttttcagaccgaa

SEQ ID NO: 2652659 - DNA, 15 bp, Homo sapiens
ttttcagatataaaa

SEQ ID NO: 2652660 - DNA, 19 bp, Homo sapiens
ttttcagcaaactcttttc

SEQ ID NO: 2652661 - DNA, 23 bp, Homo sapiens
ttttcagtagggctacaaaacct

SEQ ID NO: 2652662 - DNA, 23 bp, Homo sapiens
ttttcagtcatataaaagctatg

SEQ ID NO: 2652663 - DNA, 12 bp, Homo sapiens
ttttcagttttc

SEQ ID NO: 2652664 - DNA, 18 bp, Homo sapiens
ttttcatacttttacctt

SEQ ID NO: 2652665 - DNA, 21 bp, Homo sapiens
ttttcatagattgagaagttt

SEQ ID NO: 2652666 - DNA, 14 bp, Homo sapiens
ttttcatattgtgc

SEQ ID NO: 2652667 - DNA, 14 bp, Homo sapiens
ttttcatctgggaa

SEQ ID NO: 2652668 - DNA, 15 bp, Homo sapiens
ttttcatttgcctat

SEQ ID NO: 2652669 - DNA, 16 bp, Homo sapiens
ttttcatttgcctatt

SEQ ID NO: 2652670 - DNA, 15 bp, Homo sapiens
ttttccaaaaaaata

SEQ ID NO: 2652671 - DNA, 20 bp, Homo sapiens
ttttccaaaagtggcctctt

SEQ ID NO: 2652672 - DNA, 13 bp, Homo sapiens
ttttccactttgt

SEQ ID NO: 2652673 - DNA, 14 bp, Homo sapiens
ttttccatgaaaac

SEQ ID NO: 2652674 - DNA, 19 bp, Homo sapiens
ttttccatgaaaatgcaac

SEQ ID NO: 2652675 - DNA, 20 bp, Homo sapiens
ttttccatgcgtgtttctga

SEQ ID NO: 2652676 - DNA, 19 bp, Homo sapiens
ttttcccccttttctgcat

SEQ ID NO: 2652677 - DNA, 13 bp, Homo sapiens
ttttcctatttgt

SEQ ID NO: 2652678 - DNA, 21 bp, Homo sapiens
ttttcctcccttgggttctga

SEQ ID NO: 2652679 - DNA, 19 bp, Homo sapiens
ttttcctccgggagagggg

SEQ ID NO: 2652680 - DNA, 21 bp, Homo sapiens
ttttcctttaaaaaaatttaa

SEQ ID NO: 2652681 - DNA, 23 bp, Homo sapiens
ttttcgaacattctttgcctggt

SEQ ID NO: 2652682 - DNA, 19 bp, Homo sapiens
ttttcgaagctcagcccac

SEQ ID NO: 2652683 - DNA, 21 bp, Homo sapiens
ttttctagcccgaatacaaac

SEQ ID NO: 2652684 - DNA, 23 bp, Homo sapiens
ttttctattgttactctggttct

SEQ ID NO: 2652685 - DNA, 19 bp, Homo sapiens
ttttctcaaagttttgaaa

SEQ ID NO: 2652686 - DNA, 10 bp, Homo sapiens
ttttctgagc

SEQ ID NO: 2652687 - DNA, 16 bp, Homo sapiens
ttttctgagcccgggc

SEQ ID NO: 2652688 - DNA, 14 bp, Homo sapiens
ttttctgattgtaa

SEQ ID NO: 2652689 - DNA, 16 bp, Homo sapiens
ttttctgcttttgaaa

SEQ ID NO: 2652690 - DNA, 21 bp, Homo sapiens
ttttctggaatacatgaaata

SEQ ID NO: 2652691 - DNA, 18 bp, Homo sapiens
ttttctggaatgtaatca

SEQ ID NO: 2652692 - DNA, 21 bp, Homo sapiens
ttttctggaggttgataactt

SEQ ID NO: 2652693 - DNA, 23 bp, Homo sapiens
ttttctggaggttgataactttg

SEQ ID NO: 2652694 - DNA, 17 bp, Homo sapiens
ttttctgtctctgcctc

SEQ ID NO: 2652695 - DNA, 12 bp, Homo sapiens
ttttctgttata

SEQ ID NO: 2652696 - DNA, 23 bp, Homo sapiens
ttttctgttgaagtttacaatca

SEQ ID NO: 2652697 - DNA, 14 bp, Homo sapiens
ttttcttaaataat

SEQ ID NO: 2652698 - DNA, 21 bp, Homo sapiens
ttttcttcaacatcaatgttc

SEQ ID NO: 2652699 - DNA, 15 bp, Homo sapiens
ttttcttcactgtcc

SEQ ID NO: 2652700 - DNA, 16 bp, Homo sapiens
ttttctttaaaagaat

SEQ ID NO: 2652701 - DNA, 19 bp, Homo sapiens
ttttctttgtgtagctttg

SEQ ID NO: 2652702 - DNA, 18 bp, Homo sapiens
ttttgaaaaattcctatt

SEQ ID NO: 2652703 - DNA, 23 bp, Homo sapiens
ttttgaaaagctattagccagga

SEQ ID NO: 2652704 - DNA, 17 bp, Homo sapiens
ttttgaaattaacctct

SEQ ID NO: 2652705 - DNA, 13 bp, Homo sapiens
ttttgaatgttat

SEQ ID NO: 2652706 - DNA, 16 bp, Homo sapiens
ttttgacactatatct

SEQ ID NO: 2652707 - DNA, 19 bp, Homo sapiens
ttttgacagtgttgaaaat

SEQ ID NO: 2652708 - DNA, 17 bp, Homo sapiens
ttttgacttaaagcaga

SEQ ID NO: 2652709 - DNA, 15 bp, Homo sapiens
ttttgaggagcccca

SEQ ID NO: 2652710 - DNA, 17 bp, Homo sapiens
ttttgatccaagctggt

SEQ ID NO: 2652711 - DNA, 20 bp, Homo sapiens
ttttgatgtttgtggcctca

SEQ ID NO: 2652712 - DNA, 18 bp, Homo sapiens
ttttgattattgtattta

SEQ ID NO: 2652713 - DNA, 20 bp, Homo sapiens
ttttgatttaatgttttcag

SEQ ID NO: 2652714 - DNA, 15 bp, Homo sapiens
ttttgatttatgcat

SEQ ID NO: 2652715 - DNA, 13 bp, Homo sapiens
ttttgcaaaattt

SEQ ID NO: 2652716 - DNA, 10 bp, Homo sapiens
ttttgcacag

SEQ ID NO: 2652717 - DNA, 17 bp, Homo sapiens
ttttgcaccccatgctg

SEQ ID NO: 2652718 - DNA, 21 bp, Homo sapiens
ttttgcaccccatgctgttga

SEQ ID NO: 2652719 - DNA, 16 bp, Homo sapiens
ttttgcacccctccca

SEQ ID NO: 2652720 - DNA, 12 bp, Homo sapiens
ttttgcactttt

SEQ ID NO: 2652721 - DNA, 14 bp, Homo sapiens
ttttgcagcagtga

SEQ ID NO: 2652722 - DNA, 21 bp, Homo sapiens
ttttgcagcccagacaaatgt

SEQ ID NO: 2652723 - DNA, 13 bp, Homo sapiens
ttttgcaggagca

SEQ ID NO: 2652724 - DNA, 18 bp, Homo sapiens
ttttgcatttaaaacaga

SEQ ID NO: 2652725 - DNA, 18 bp, Homo sapiens
ttttgcccttcacagtgt

SEQ ID NO: 2652726 - DNA, 15 bp, Homo sapiens
ttttgcctcttttct

SEQ ID NO: 2652727 - DNA, 17 bp, Homo sapiens
ttttgctattgtaaata

SEQ ID NO: 2652728 - DNA, 18 bp, Homo sapiens
ttttgctgtttcctttta

SEQ ID NO: 2652729 - DNA, 16 bp, Homo sapiens
ttttggccaaagtgtt

SEQ ID NO: 2652730 - DNA, 18 bp, Homo sapiens
ttttggggaagtgaggaa

SEQ ID NO: 2652731 - DNA, 19 bp, Homo sapiens
ttttggggttgtgttgtca

SEQ ID NO: 2652732 - DNA, 19 bp, Homo sapiens
ttttggtaaagactggctt

SEQ ID NO: 2652733 - DNA, 15 bp, Homo sapiens
ttttggttgaataaa

SEQ ID NO: 2652734 - DNA, 20 bp, Homo sapiens
ttttggttgtattctttgat

SEQ ID NO: 2652735 - DNA, 22 bp, Homo sapiens
ttttggttgtcaatattaaata

SEQ ID NO: 2652736 - DNA, 15 bp, Homo sapiens
ttttgtaaagatgcc

SEQ ID NO: 2652737 - DNA, 21 bp, Homo sapiens
ttttgtaaagatgccgggttt

SEQ ID NO: 2652738 - DNA, 13 bp, Homo sapiens
ttttgtaaagtgt

SEQ ID NO: 2652739 - DNA, 20 bp, Homo sapiens
ttttgtaagatgctgggttg

SEQ ID NO: 2652740 - DNA, 17 bp, Homo sapiens
ttttgtactgtaaagag

SEQ ID NO: 2652741 - DNA, 23 bp, Homo sapiens
ttttgtaggggtcaaagaaatgc

SEQ ID NO: 2652742 - DNA, 16 bp, Homo sapiens
ttttgtatagtaaagt

SEQ ID NO: 2652743 - DNA, 14 bp, Homo sapiens
ttttgtatctacat

SEQ ID NO: 2652744 - DNA, 18 bp, Homo sapiens
ttttgtatttttaatggg

SEQ ID NO: 2652745 - DNA, 19 bp, Homo sapiens
ttttgtgaatggattggat

SEQ ID NO: 2652746 - DNA, 16 bp, Homo sapiens
ttttgttacctttatg

SEQ ID NO: 2652747 - DNA, 12 bp, Homo sapiens
ttttgtttcata

SEQ ID NO: 2652748 - DNA, 16 bp, Homo sapiens
tttttaaataaaagca

SEQ ID NO: 2652749 - DNA, 20 bp, Homo sapiens
tttttaaattttatttcctg

SEQ ID NO: 2652750 - DNA, 12 bp, Homo sapiens
tttttaagaaaa

SEQ ID NO: 2652751 - DNA, 17 bp, Homo sapiens
tttttaagtgctgcatt

SEQ ID NO: 2652752 - DNA, 22 bp, Homo sapiens
tttttaagtgctgcatttaaaa

SEQ ID NO: 2652753 - DNA, 18 bp, Homo sapiens
tttttaagttacacattt

SEQ ID NO: 2652754 - DNA, 18 bp, Homo sapiens
tttttaataaaaaggcac

SEQ ID NO: 2652755 - DNA, 13 bp, Homo sapiens
tttttaatcatga

SEQ ID NO: 2652756 - DNA, 20 bp, Homo sapiens
tttttaattgttgtttcttt

SEQ ID NO: 2652757 - DNA, 21 bp, Homo sapiens
tttttaatttattattgaaat

SEQ ID NO: 2652758 - DNA, 16 bp, Homo sapiens
tttttaatttatttat

SEQ ID NO: 2652759 - DNA, 18 bp, Homo sapiens
tttttacaagttttaaat

SEQ ID NO: 2652760 - DNA, 19 bp, Homo sapiens
tttttacaagttttaaata

SEQ ID NO: 2652761 - DNA, 12 bp, Homo sapiens
aaaatcatgaga

SEQ ID NO: 2652762 - DNA, 17 bp, Homo sapiens
aaaatcatggaatggtt

SEQ ID NO: 2652763 - DNA, 18 bp, Homo sapiens
aaaatcatgtacatttct

SEQ ID NO: 2652764 - DNA, 13 bp, Homo sapiens
aaaatccttgctt

SEQ ID NO: 2652765 - DNA, 20 bp, Homo sapiens
aaaatccttgcttatgacat

SEQ ID NO: 2652766 - DNA, 15 bp, Homo sapiens
aaaatctaatattaa

SEQ ID NO: 2652767 - DNA, 15 bp, Homo sapiens
aaaatctcaaatttc

SEQ ID NO: 2652768 - DNA, 18 bp, Homo sapiens
aaaatctcaaatttctaa

SEQ ID NO: 2652769 - DNA, 13 bp, Homo sapiens
aaaatctgaaaat

SEQ ID NO: 2652770 - DNA, 22 bp, Homo sapiens
aaaatgaaagcatgtctcaata

SEQ ID NO: 2652771 - DNA, 15 bp, Homo sapiens
aaaatgaatcctaca

SEQ ID NO: 2652772 - DNA, 18 bp, Homo sapiens
aaaatgacagatgttgaa

SEQ ID NO: 2652773 - DNA, 21 bp, Homo sapiens
aaaatgagcctggcaagaatg

SEQ ID NO: 2652774 - DNA, 18 bp, Homo sapiens
aaaatgaggttcaactgt

SEQ ID NO: 2652775 - DNA, 20 bp, Homo sapiens
aaaatgcaaatcctatgtga

SEQ ID NO: 2652776 - DNA, 17 bp, Homo sapiens
aaaatgccaagacatga

SEQ ID NO: 2652777 - DNA, 12 bp, Homo sapiens
aaaatgcctttg

SEQ ID NO: 2652778 - DNA, 17 bp, Homo sapiens
aaaatgcctttgagaca

SEQ ID NO: 2652779 - DNA, 16 bp, Homo sapiens
aaaatgctgaacattg

SEQ ID NO: 2652780 - DNA, 20 bp, Homo sapiens
aaaatgctgaacattgcata

SEQ ID NO: 2652781 - DNA, 21 bp, Homo sapiens
aaaatgctgtattagtcacag

SEQ ID NO: 2652782 - DNA, 22 bp, Homo sapiens
aaaatgggacttcttttcacat

SEQ ID NO: 2652783 - DNA, 16 bp, Homo sapiens
aaaatggtttaaatgg

SEQ ID NO: 2652784 - DNA, 21 bp, Homo sapiens
aaaatgtaagctgtttatttt

SEQ ID NO: 2652785 - DNA, 10 bp, Homo sapiens
aaaatgtact

SEQ ID NO: 2652786 - DNA, 17 bp, Homo sapiens
aaaatgtatatgcactt

SEQ ID NO: 2652787 - DNA, 21 bp, Homo sapiens
aaaatgtctgtagctcctcaa

SEQ ID NO: 2652788 - DNA, 18 bp, Homo sapiens
aaaatgtctgttaactta

SEQ ID NO: 2652789 - DNA, 19 bp, Homo sapiens
aaaatgtgacccagatcct

SEQ ID NO: 2652790 - DNA, 16 bp, Homo sapiens
aaaatgttcagaaggt

SEQ ID NO: 2652791 - DNA, 15 bp, Homo sapiens
aaaatgttggattta

SEQ ID NO: 2652792 - DNA, 17 bp, Homo sapiens
aaaattaaatcaacctt

SEQ ID NO: 2652793 - DNA, 15 bp, Homo sapiens
aaaattagccaagtg

SEQ ID NO: 2652794 - DNA, 18 bp, Homo sapiens
aaaattagccgggcgtgg

SEQ ID NO: 2652795 - DNA, 19 bp, Homo sapiens
aaaattaggatttcatgat

SEQ ID NO: 2652796 - DNA, 22 bp, Homo sapiens
aaaattatagatgggaatgaag

SEQ ID NO: 2652797 - DNA, 19 bp, Homo sapiens
aaaattatttcagaaatgt

SEQ ID NO: 2652798 - DNA, 14 bp, Homo sapiens
aaaattatttgcat

SEQ ID NO: 2652799 - DNA, 18 bp, Homo sapiens
aaaattcaaaaagtgttt

SEQ ID NO: 2652800 - DNA, 21 bp, Homo sapiens
aaaattccatcccatcatctt

SEQ ID NO: 2652801 - DNA, 17 bp, Homo sapiens
aaaattcctattgtgat

SEQ ID NO: 2652802 - DNA, 22 bp, Homo sapiens
aaaattcctttgtgtttctatt

SEQ ID NO: 2652803 - DNA, 20 bp, Homo sapiens
aaaattctgtaggttctgtg

SEQ ID NO: 2652804 - DNA, 16 bp, Homo sapiens
aaaattgtgatgtgtc

SEQ ID NO: 2652805 - DNA, 22 bp, Homo sapiens
aaaatttaaagggtgtacttat

SEQ ID NO: 2652806 - DNA, 14 bp, Homo sapiens
aaaatttaagcatt

SEQ ID NO: 2652807 - DNA, 21 bp, Homo sapiens
aaaatttaagcattgtttgct

SEQ ID NO: 2652808 - DNA, 15 bp, Homo sapiens
aaaatttagtttttg

SEQ ID NO: 2652809 - DNA, 13 bp, Homo sapiens
aaaatttcacatt

SEQ ID NO: 2652810 - DNA, 20 bp, Homo sapiens
aaaatttcacattaatattt

SEQ ID NO: 2652811 - DNA, 17 bp, Homo sapiens
aaaatttccagtacctt

SEQ ID NO: 2652812 - DNA, 14 bp, Homo sapiens
aaaatttgttgcat

SEQ ID NO: 2652813 - DNA, 22 bp, Homo sapiens
aaaatttgttttgacggatgat

SEQ ID NO: 2652814 - DNA, 19 bp, Homo sapiens
aaacaaaaattaaaatcct

SEQ ID NO: 2652815 - DNA, 20 bp, Homo sapiens
aaacaaaatttgtttgaaat

SEQ ID NO: 2652816 - DNA, 12 bp, Homo sapiens
aaacaaagccag

SEQ ID NO: 2652817 - DNA, 13 bp, Homo sapiens
aaacaaagccaga

SEQ ID NO: 2652818 - DNA, 23 bp, Homo sapiens
aaacaaagcttagcaggagagga

SEQ ID NO: 2652819 - DNA, 15 bp, Homo sapiens
aaacaagtgctggca

SEQ ID NO: 2652820 - DNA, 15 bp, Homo sapiens
aaacaataaatgtgc

SEQ ID NO: 2652821 - DNA, 15 bp, Homo sapiens
aaacaatattgtttc

SEQ ID NO: 2652822 - DNA, 16 bp, Homo sapiens
aaacaatattgtttct

SEQ ID NO: 2652823 - DNA, 19 bp, Homo sapiens
aaacacaaacgggctcagc

SEQ ID NO: 2652824 - DNA, 13 bp, Homo sapiens
aaacacaaatgca

SEQ ID NO: 2652825 - DNA, 14 bp, Homo sapiens
aaacacaaatgcag

SEQ ID NO: 2652826 - DNA, 17 bp, Homo sapiens
aaacacaccaggctgtg

SEQ ID NO: 2652827 - DNA, 18 bp, Homo sapiens
aaacacaccaggctgtgg

SEQ ID NO: 2652828 - DNA, 21 bp, Homo sapiens
aaacacagacattctgccagg

SEQ ID NO: 2652829 - DNA, 14 bp, Homo sapiens
aaacacatcttccc

SEQ ID NO: 2652830 - DNA, 18 bp, Homo sapiens
aaacacctcctcatgtac

SEQ ID NO: 2652831 - DNA, 22 bp, Homo sapiens
aaacaccttccagctcctgtaa

SEQ ID NO: 2652832 - DNA, 13 bp, Homo sapiens
aaacaccttctct

SEQ ID NO: 2652833 - DNA, 20 bp, Homo sapiens
aaacactcggcatttcaaat

SEQ ID NO: 2652834 - DNA, 15 bp, Homo sapiens
aaacactgcaggcat

SEQ ID NO: 2652835 - DNA, 19 bp, Homo sapiens
aaacactggggctggcaca

SEQ ID NO: 2652836 - DNA, 16 bp, Homo sapiens
aaacactgttctctgc

SEQ ID NO: 2652837 - DNA, 15 bp, Homo sapiens
aaacagatataaatg

SEQ ID NO: 2652838 - DNA, 20 bp, Homo sapiens
aaacagatctcctggcaaag

SEQ ID NO: 2652839 - DNA, 19 bp, Homo sapiens
aaacagatttttacaaatg

SEQ ID NO: 2652840 - DNA, 21 bp, Homo sapiens
aaacagcattgctttctgaaa

SEQ ID NO: 2652841 - DNA, 21 bp, Homo sapiens
aaacagcgctgggtccacccc

SEQ ID NO: 2652842 - DNA, 17 bp, Homo sapiens
aaacagctaatgggaca

SEQ ID NO: 2652843 - DNA, 18 bp, Homo sapiens
aaacaggagacaggaagg

SEQ ID NO: 2652844 - DNA, 14 bp, Homo sapiens
aaacaggcccagca

SEQ ID NO: 2652845 - DNA, 17 bp, Homo sapiens
aaacagggcatctccag

SEQ ID NO: 2652846 - DNA, 15 bp, Homo sapiens
aaacagtctcaggaa

SEQ ID NO: 2652847 - DNA, 23 bp, Homo sapiens
aaacagttaactttcagaagaga

SEQ ID NO: 2652848 - DNA, 21 bp, Homo sapiens
aaacataattcttgtatatta

SEQ ID NO: 2652849 - DNA, 14 bp, Homo sapiens
aaacatcacacaca

SEQ ID NO: 2652850 - DNA, 20 bp, Homo sapiens
aaacatcagttactctgaag

SEQ ID NO: 2652851 - DNA, 18 bp, Homo sapiens
aaacatccttcaagaact

SEQ ID NO: 2652852 - DNA, 19 bp, Homo sapiens
aaacatgaccctaaatctt

SEQ ID NO: 2652853 - DNA, 22 bp, Homo sapiens
aaacatgctacacactgcatgt

SEQ ID NO: 2652854 - DNA, 15 bp, Homo sapiens
aaacattaagattga

SEQ ID NO: 2652855 - DNA, 12 bp, Homo sapiens
aaacattgaaga

SEQ ID NO: 2652856 - DNA, 17 bp, Homo sapiens
aaacattggttcttgta

SEQ ID NO: 2652857 - DNA, 18 bp, Homo sapiens
aaacattggttcttgtat

SEQ ID NO: 2652858 - DNA, 23 bp, Homo sapiens
aaacatttaacttgtttccaatg

SEQ ID NO: 2652859 - DNA, 12 bp, Homo sapiens
aaaccaagaaga

SEQ ID NO: 2652860 - DNA, 21 bp, Homo sapiens
aaaccacaaggctgttgcatg

SEQ ID NO: 2652861 - DNA, 12 bp, Homo sapiens
aaaccacagcag

SEQ ID NO: 2652862 - DNA, 15 bp, Homo sapiens
aaaccacagcagttg

SEQ ID NO: 2652863 - DNA, 12 bp, Homo sapiens
aaaccagaagca

SEQ ID NO: 2652864 - DNA, 19 bp, Homo sapiens
aaaccagtgttagggaagg

SEQ ID NO: 2652865 - DNA, 15 bp, Homo sapiens
aaaccatgcaaatgc

SEQ ID NO: 2652866 - DNA, 12 bp, Homo sapiens
aaacccagctct

SEQ ID NO: 2652867 - DNA, 16 bp, Homo sapiens
aaacccagctctggtc

SEQ ID NO: 2652868 - DNA, 13 bp, Homo sapiens
aaaccccatctct

SEQ ID NO: 2652869 - DNA, 16 bp, Homo sapiens
aaacccccacacacac

SEQ ID NO: 2652870 - DNA, 16 bp, Homo sapiens
aaacccgacagaggga

SEQ ID NO: 2652871 - DNA, 18 bp, Homo sapiens
aaacccgacagagggaag

SEQ ID NO: 2652872 - DNA, 16 bp, Homo sapiens
aaaccgccaaggctgg

SEQ ID NO: 2652873 - DNA, 22 bp, Homo sapiens
aaacctcacccgaggctgccca

SEQ ID NO: 2652874 - DNA, 19 bp, Homo sapiens
aaacctctaacccaggtct

SEQ ID NO: 2652875 - DNA, 11 bp, Homo sapiens
aaacctctcct

SEQ ID NO: 2652876 - DNA, 16 bp, Homo sapiens
aaacctctgttcagtg

SEQ ID NO: 2652877 - DNA, 21 bp, Homo sapiens
aaacctctgttcagtgtaaat

SEQ ID NO: 2652878 - DNA, 18 bp, Homo sapiens
aaacctgacccctgctca

SEQ ID NO: 2652879 - DNA, 16 bp, Homo sapiens
aaacctgccctgcctg

SEQ ID NO: 2652880 - DNA, 17 bp, Homo sapiens
aaacctgccctgcctga

SEQ ID NO: 2652881 - DNA, 18 bp, Homo sapiens
aaacctgtcaatgataca

SEQ ID NO: 2652882 - DNA, 21 bp, Homo sapiens
aaacctgtttaaatatttcaa

SEQ ID NO: 2652883 - DNA, 16 bp, Homo sapiens
aaacctttagggcagc

SEQ ID NO: 2652884 - DNA, 17 bp, Homo sapiens
aaacctttcaaatttca

SEQ ID NO: 2652885 - DNA, 19 bp, Homo sapiens
aaacgatttaattctcttg

SEQ ID NO: 2652886 - DNA, 21 bp, Homo sapiens
aaacgatttaattctcttgaa

SEQ ID NO: 2652887 - DNA, 23 bp, Homo sapiens
aaacggattagggcatttgagaa

SEQ ID NO: 2652888 - DNA, 21 bp, Homo sapiens
aaacggattattttttcagac

SEQ ID NO: 2652889 - DNA, 13 bp, Homo sapiens
aaacggccctctt

SEQ ID NO: 2652890 - DNA, 13 bp, Homo sapiens
aaactaaatctct

SEQ ID NO: 2652891 - DNA, 17 bp, Homo sapiens
aaactaaatctctaata

SEQ ID NO: 2652892 - DNA, 23 bp, Homo sapiens
aaactagctcgtgattggcatat

SEQ ID NO: 2652893 - DNA, 22 bp, Homo sapiens
aaactatttatctgtgtttttg

SEQ ID NO: 2652894 - DNA, 22 bp, Homo sapiens
aaactcaaaacttaacatattt

SEQ ID NO: 2652895 - DNA, 21 bp, Homo sapiens
aaactcaaaatatttgtacat

SEQ ID NO: 2652896 - DNA, 15 bp, Homo sapiens
aaactcaaacttttc

SEQ ID NO: 2652897 - DNA, 16 bp, Homo sapiens
aaactcacctgctggc

SEQ ID NO: 2652898 - DNA, 15 bp, Homo sapiens
aaactcactgctcaa

SEQ ID NO: 2652899 - DNA, 20 bp, Homo sapiens
aaactcactgctcaagaaga

SEQ ID NO: 2652900 - DNA, 13 bp, Homo sapiens
aaactcagggaca

SEQ ID NO: 2652901 - DNA, 20 bp, Homo sapiens
aaactcgaggactgtatttg

SEQ ID NO: 2652902 - DNA, 18 bp, Homo sapiens
aaactctcctctgctgct

SEQ ID NO: 2652903 - DNA, 13 bp, Homo sapiens
aaactctctgaac

SEQ ID NO: 2652904 - DNA, 22 bp, Homo sapiens
aaactctgggaaataagagaga

SEQ ID NO: 2652905 - DNA, 23 bp, Homo sapiens
aaactcttaaaacccaagtgcct

SEQ ID NO: 2652906 - DNA, 17 bp, Homo sapiens
aacaacttctttgtaat

SEQ ID NO: 2652907 - DNA, 17 bp, Homo sapiens
aacaagaccacgtttct

SEQ ID NO: 2652908 - DNA, 19 bp, Homo sapiens
aacaagaccacgtttctaa

SEQ ID NO: 2652909 - DNA, 19 bp, Homo sapiens
aacaagaccccgtctcaaa

SEQ ID NO: 2652910 - DNA, 17 bp, Homo sapiens
aacaagatctttcagga

SEQ ID NO: 2652911 - DNA, 19 bp, Homo sapiens
aacaagatctttcaggaaa

SEQ ID NO: 2652912 - DNA, 22 bp, Homo sapiens
aacaagatgctggatgtctgcc

SEQ ID NO: 2652913 - DNA, 19 bp, Homo sapiens
aacaagcaagctcccaagg

SEQ ID NO: 2652914 - DNA, 15 bp, Homo sapiens
aacaagtgctggcac

SEQ ID NO: 2652915 - DNA, 19 bp, Homo sapiens
aacaataaatgttggcttg

SEQ ID NO: 2652916 - DNA, 15 bp, Homo sapiens
aacaataactactgt

SEQ ID NO: 2652917 - DNA, 19 bp, Homo sapiens
aacaatactcataatgtga

SEQ ID NO: 2652918 - DNA, 18 bp, Homo sapiens
aacaatagtaattctcag

SEQ ID NO: 2652919 - DNA, 17 bp, Homo sapiens
aacaatcctagtgcttt

SEQ ID NO: 2652920 - DNA, 15 bp, Homo sapiens
aacaatgatatatgg

SEQ ID NO: 2652921 - DNA, 17 bp, Homo sapiens
aacaatggaaactgaat

SEQ ID NO: 2652922 - DNA, 11 bp, Homo sapiens
aacaatgttaa

SEQ ID NO: 2652923 - DNA, 18 bp, Homo sapiens
aacaatgttaaggaaact

SEQ ID NO: 2652924 - DNA, 22 bp, Homo sapiens
aacaatgttaaggaaactctta

SEQ ID NO: 2652925 - DNA, 13 bp, Homo sapiens
aacaatttatgaa

SEQ ID NO: 2652926 - DNA, 20 bp, Homo sapiens
aacaatttcctttatattta

SEQ ID NO: 2652927 - DNA, 13 bp, Homo sapiens
aacaattttaatg

SEQ ID NO: 2652928 - DNA, 23 bp, Homo sapiens
aacaattttaggaggaccagagc

SEQ ID NO: 2652929 - DNA, 13 bp, Homo sapiens
aacacaaatgcag

SEQ ID NO: 2652930 - DNA, 16 bp, Homo sapiens
aacacaagccacagaa

SEQ ID NO: 2652931 - DNA, 17 bp, Homo sapiens
aacacaagccacagaag

SEQ ID NO: 2652932 - DNA, 18 bp, Homo sapiens
aacacaagctggaagcac

SEQ ID NO: 2652933 - DNA, 12 bp, Homo sapiens
aacacacagaca

SEQ ID NO: 2652934 - DNA, 18 bp, Homo sapiens
aacacagcaagggtgatg

SEQ ID NO: 2652935 - DNA, 16 bp, Homo sapiens
aacacagcatgtgtat

SEQ ID NO: 2652936 - DNA, 19 bp, Homo sapiens
aacacagcgagactccgtc

SEQ ID NO: 2652937 - DNA, 19 bp, Homo sapiens
aacacagtgccttcaataa

SEQ ID NO: 2652938 - DNA, 20 bp, Homo sapiens
aacacagtgtttttgtaaag

SEQ ID NO: 2652939 - DNA, 12 bp, Homo sapiens
aacacatcagct

SEQ ID NO: 2652940 - DNA, 17 bp, Homo sapiens
aacacatctttcctgtc

SEQ ID NO: 2652941 - DNA, 20 bp, Homo sapiens
aacacatttgattctgtgtg

SEQ ID NO: 2652942 - DNA, 14 bp, Homo sapiens
aacacattttgtat

SEQ ID NO: 2652943 - DNA, 15 bp, Homo sapiens
aacacattttgtata

SEQ ID NO: 2652944 - DNA, 16 bp, Homo sapiens
aacacattttgtataa

SEQ ID NO: 2652945 - DNA, 16 bp, Homo sapiens
aacaccacagacacac

SEQ ID NO: 2652946 - DNA, 18 bp, Homo sapiens
aacaccacagacacacac

SEQ ID NO: 2652947 - DNA, 16 bp, Homo sapiens
aacacctcctcatgta

SEQ ID NO: 2652948 - DNA, 13 bp, Homo sapiens
aacaccttctctg

SEQ ID NO: 2652949 - DNA, 14 bp, Homo sapiens
aacactaaaaataa

SEQ ID NO: 2652950 - DNA, 15 bp, Homo sapiens
aacactaaaaataaa

SEQ ID NO: 2652951 - DNA, 21 bp, Homo sapiens
aacactatatggcagtgtctt

SEQ ID NO: 2652952 - DNA, 16 bp, Homo sapiens
aacactcatgctgaaa

SEQ ID NO: 2652953 - DNA, 17 bp, Homo sapiens
aacactcattgacctga

SEQ ID NO: 2652954 - DNA, 15 bp, Homo sapiens
aacactgagctgtca

SEQ ID NO: 2652955 - DNA, 17 bp, Homo sapiens
aacactgcttgtgtttt

SEQ ID NO: 2652956 - DNA, 22 bp, Homo sapiens
aacactggtgtgacctgagggc

SEQ ID NO: 2652957 - DNA, 16 bp, Homo sapiens
aacactgtgccctggt

SEQ ID NO: 2652958 - DNA, 18 bp, Homo sapiens
aacactgtgccctggtgg

SEQ ID NO: 2652959 - DNA, 17 bp, Homo sapiens
aacactgttctctgccc

SEQ ID NO: 2652960 - DNA, 20 bp, Homo sapiens
aacactgttctctgccctcc

SEQ ID NO: 2652961 - DNA, 21 bp, Homo sapiens
aacactgttctctgccctcca

SEQ ID NO: 2652962 - DNA, 11 bp, Homo sapiens
aacacttccat

SEQ ID NO: 2652963 - DNA, 10 bp, Homo sapiens
aacagaaatg

SEQ ID NO: 2652964 - DNA, 13 bp, Homo sapiens
aacagaaatgtac

SEQ ID NO: 2652965 - DNA, 20 bp, Homo sapiens
aacagaacatcattagaaca

SEQ ID NO: 2652966 - DNA, 14 bp, Homo sapiens
aacagaagcttcca

SEQ ID NO: 2652967 - DNA, 14 bp, Homo sapiens
aacagaatgtttta

SEQ ID NO: 2652968 - DNA, 19 bp, Homo sapiens
aacagacaccatcttttgt

SEQ ID NO: 2652969 - DNA, 18 bp, Homo sapiens
aacagaccccctctagaa

SEQ ID NO: 2652970 - DNA, 20 bp, Homo sapiens
aacagactggaagcacagct

SEQ ID NO: 2652971 - DNA, 19 bp, Homo sapiens
aacagataagcaagagaga

SEQ ID NO: 2652972 - DNA, 16 bp, Homo sapiens
aacagatcaatttgta

SEQ ID NO: 2652973 - DNA, 21 bp, Homo sapiens
aacagatgcaatgtgctactg

SEQ ID NO: 2652974 - DNA, 14 bp, Homo sapiens
aacagatgcttttc

SEQ ID NO: 2652975 - DNA, 18 bp, Homo sapiens
aacagattcacactgtct

SEQ ID NO: 2652976 - DNA, 18 bp, Homo sapiens
aacagatttgtgaactca

SEQ ID NO: 2652977 - DNA, 17 bp, Homo sapiens
aacagatttttacaaat

SEQ ID NO: 2652978 - DNA, 21 bp, Homo sapiens
aacagcactggctctctccag

SEQ ID NO: 2652979 - DNA, 11 bp, Homo sapiens
aacagcagtgt

SEQ ID NO: 2652980 - DNA, 16 bp, Homo sapiens
aacagcattgctttct

SEQ ID NO: 2652981 - DNA, 22 bp, Homo sapiens
aacagccgtcagccaaatgtaa

SEQ ID NO: 2652982 - DNA, 18 bp, Homo sapiens
aacagctatgggagcccc

SEQ ID NO: 2652983 - DNA, 18 bp, Homo sapiens
aacagctcaagtcttccc

SEQ ID NO: 2652984 - DNA, 18 bp, Homo sapiens
aacagctcagttctagtc

SEQ ID NO: 2652985 - DNA, 21 bp, Homo sapiens
aacagctgaggtctcttgagg

SEQ ID NO: 2652986 - DNA, 22 bp, Homo sapiens
aacaggaaaggctcgaaataca

SEQ ID NO: 2652987 - DNA, 17 bp, Homo sapiens
aacaggaggacaattca

SEQ ID NO: 2652988 - DNA, 20 bp, Homo sapiens
aacaggctcaatattcctga

SEQ ID NO: 2652989 - DNA, 21 bp, Homo sapiens
aacaggtggcaggaccaggac

SEQ ID NO: 2652990 - DNA, 20 bp, Homo sapiens
aacaggttattttagtttct

SEQ ID NO: 2652991 - DNA, 21 bp, Homo sapiens
aacaggttattttagtttctg

SEQ ID NO: 2652992 - DNA, 22 bp, Homo sapiens
aacagtagtgatagttgtaccg

SEQ ID NO: 2652993 - DNA, 17 bp, Homo sapiens
aacagtcaaaacagaga

SEQ ID NO: 2652994 - DNA, 17 bp, Homo sapiens
aacagtctcaggaaatc

SEQ ID NO: 2652995 - DNA, 12 bp, Homo sapiens
aacagtctgatc

SEQ ID NO: 2652996 - DNA, 21 bp, Homo sapiens
aacagtgagcctgaattttgt

SEQ ID NO: 2652997 - DNA, 22 bp, Homo sapiens
aacagtgcatattcctttctat

SEQ ID NO: 2652998 - DNA, 13 bp, Homo sapiens
aacagtgtgaagt

SEQ ID NO: 2652999 - DNA, 17 bp, Homo sapiens
aacagtgtgaagttaga

SEQ ID NO: 2653000 - DNA, 18 bp, Homo sapiens
aacagtgtttcccataat

SEQ ID NO: 2653001 - DNA, 21 bp, Homo sapiens
aacagtgtttcccataatttt

SEQ ID NO: 2653002 - DNA, 20 bp, Homo sapiens
aacagtgttttggaataaaa

SEQ ID NO: 2653003 - DNA, 13 bp, Homo sapiens
aacagttaacttt

SEQ ID NO: 2653004 - DNA, 18 bp, Homo sapiens
aacagttaactttcagaa

SEQ ID NO: 2653005 - DNA, 16 bp, Homo sapiens
aacagttcatgtttgc

SEQ ID NO: 2653006 - DNA, 15 bp, Homo sapiens
aacagttttccatga

SEQ ID NO: 2653007 - DNA, 17 bp, Homo sapiens
aacagttttccatgaaa

SEQ ID NO: 2653008 - DNA, 18 bp, Homo sapiens
aacataattcttgtatat

SEQ ID NO: 2653009 - DNA, 18 bp, Homo sapiens
aacatataatgttgttat

SEQ ID NO: 2653010 - DNA, 21 bp, Homo sapiens
aacatataatgttgttattta

SEQ ID NO: 2653011 - DNA, 19 bp, Homo sapiens
aacatcaatgttcattgta

SEQ ID NO: 2653012 - DNA, 18 bp, Homo sapiens
aacatcagttactctgaa

SEQ ID NO: 2653013 - DNA, 21 bp, Homo sapiens
aacatcatcaaggcactgcct

SEQ ID NO: 2653014 - DNA, 22 bp, Homo sapiens
aacatccaaggagaaacagaga

SEQ ID NO: 2653015 - DNA, 22 bp, Homo sapiens
aacatcctatcaacaacaaggt

SEQ ID NO: 2653016 - DNA, 22 bp, Homo sapiens
aacatctgtcctgtgaaagact

SEQ ID NO: 2653017 - DNA, 14 bp, Homo sapiens
aacatggacttgta

SEQ ID NO: 2653018 - DNA, 23 bp, Homo sapiens
aacatggacttgtatatttgtac

SEQ ID NO: 2653019 - DNA, 20 bp, Homo sapiens
aacatggttacaatcattgc

SEQ ID NO: 2653020 - DNA, 20 bp, Homo sapiens
aacattacagggaatgcctg

SEQ ID NO: 2653021 - DNA, 16 bp, Homo sapiens
aacattaccttactgt

SEQ ID NO: 2653022 - DNA, 19 bp, Homo sapiens
aacattaccttactgtgga

SEQ ID NO: 2653023 - DNA, 16 bp, Homo sapiens
aacattatttattcag

SEQ ID NO: 2653024 - DNA, 23 bp, Homo sapiens
aacattatttattcagcttcatt

SEQ ID NO: 2653025 - DNA, 14 bp, Homo sapiens
aacattccatcctt

SEQ ID NO: 2653026 - DNA, 16 bp, Homo sapiens
aacattctgatttgga

SEQ ID NO: 2653027 - DNA, 18 bp, Homo sapiens
aacattctgatttggaaa

SEQ ID NO: 2653028 - DNA, 23 bp, Homo sapiens
aacattgtgttcccatttcagct

SEQ ID NO: 2653029 - DNA, 15 bp, Homo sapiens
aacattttaaataaa

SEQ ID NO: 2653030 - DNA, 19 bp, Homo sapiens
aacattttaaataaaagaa

SEQ ID NO: 2653031 - DNA, 15 bp, Homo sapiens
aacattttacccaca

SEQ ID NO: 2653032 - DNA, 20 bp, Homo sapiens
aaccaaaaagaccagactaa

SEQ ID NO: 2653033 - DNA, 19 bp, Homo sapiens
aaccaaagagactggagca

SEQ ID NO: 2653034 - DNA, 14 bp, Homo sapiens
aaccaagaagggct

SEQ ID NO: 2653035 - DNA, 14 bp, Homo sapiens
aaccacagccctgt

SEQ ID NO: 2653036 - DNA, 15 bp, Homo sapiens
aaccacagccctgtc

SEQ ID NO: 2653037 - DNA, 16 bp, Homo sapiens
aaccacagccctgtca

SEQ ID NO: 2653038 - DNA, 13 bp, Homo sapiens
aaccacatcttgc

SEQ ID NO: 2653039 - DNA, 19 bp, Homo sapiens
aaccaccgctccccagccc

SEQ ID NO: 2653040 - DNA, 17 bp, Homo sapiens
aaccactgaatctggac

SEQ ID NO: 2653041 - DNA, 13 bp, Homo sapiens
aaccacttaaaaa

SEQ ID NO: 2653042 - DNA, 15 bp, Homo sapiens
aaccacttcagctga

SEQ ID NO: 2653043 - DNA, 17 bp, Homo sapiens
aaccagaagcaacagaa

SEQ ID NO: 2653044 - DNA, 21 bp, Homo sapiens
aaccagaagcaacagaaaaaa

SEQ ID NO: 2653045 - DNA, 21 bp, Homo sapiens
aaccagggagcccctttgatg

SEQ ID NO: 2653046 - DNA, 21 bp, Homo sapiens
aaccaggtttagacagtatga

SEQ ID NO: 2653047 - DNA, 19 bp, Homo sapiens
aaccagtgttgtggattta

SEQ ID NO: 2653048 - DNA, 14 bp, Homo sapiens
aaccagttatgtga

SEQ ID NO: 2653049 - DNA, 13 bp, Homo sapiens
aaccataaacttc

SEQ ID NO: 2653050 - DNA, 17 bp, Homo sapiens
aagcagcgtttctatga

SEQ ID NO: 2653051 - DNA, 20 bp, Homo sapiens
aagcagcgtttctatgacac

SEQ ID NO: 2653052 - DNA, 21 bp, Homo sapiens
aagcagcgtttctatgacaca

SEQ ID NO: 2653053 - DNA, 22 bp, Homo sapiens
aagcagcgtttctatgacacat

SEQ ID NO: 2653054 - DNA, 13 bp, Homo sapiens
aagcagctcaaag

SEQ ID NO: 2653055 - DNA, 16 bp, Homo sapiens
aagcagctcaaaggca

SEQ ID NO: 2653056 - DNA, 13 bp, Homo sapiens
aagcagctctccc

SEQ ID NO: 2653057 - DNA, 17 bp, Homo sapiens
aagcagctctcccctca

SEQ ID NO: 2653058 - DNA, 22 bp, Homo sapiens
aagcaggctacactgacactgg

SEQ ID NO: 2653059 - DNA, 17 bp, Homo sapiens
aagcagggtctgggcag

SEQ ID NO: 2653060 - DNA, 13 bp, Homo sapiens
aagcagtaactga

SEQ ID NO: 2653061 - DNA, 15 bp, Homo sapiens
aagcagtgcttctca

SEQ ID NO: 2653062 - DNA, 17 bp, Homo sapiens
aagcatattgttattat

SEQ ID NO: 2653063 - DNA, 16 bp, Homo sapiens
aagcatcacctcaggc

SEQ ID NO: 2653064 - DNA, 12 bp, Homo sapiens
aagcatccatgt

SEQ ID NO: 2653065 - DNA, 19 bp, Homo sapiens
aagcatgtggcatgttcat

SEQ ID NO: 2653066 - DNA, 18 bp, Homo sapiens
aagcattaacttctctgg

SEQ ID NO: 2653067 - DNA, 18 bp, Homo sapiens
aagcattaccactcaggc

SEQ ID NO: 2653068 - DNA, 18 bp, Homo sapiens
aagcattccttctttgat

SEQ ID NO: 2653069 - DNA, 20 bp, Homo sapiens
aagcattccttctttgataa

SEQ ID NO: 2653070 - DNA, 21 bp, Homo sapiens
aagcattccttctttgataat

SEQ ID NO: 2653071 - DNA, 19 bp, Homo sapiens
aagcattgtaaatgtgctt

SEQ ID NO: 2653072 - DNA, 14 bp, Homo sapiens
aagcattgtttgct

SEQ ID NO: 2653073 - DNA, 20 bp, Homo sapiens
aagcattgtttgcttattgt

SEQ ID NO: 2653074 - DNA, 19 bp, Homo sapiens
aagcatttaatgtagccat

SEQ ID NO: 2653075 - DNA, 16 bp, Homo sapiens
aagcatttactttgtg

SEQ ID NO: 2653076 - DNA, 21 bp, Homo sapiens
aagcattttataaatcgcttt

SEQ ID NO: 2653077 - DNA, 14 bp, Homo sapiens
aagccaaactctgc

SEQ ID NO: 2653078 - DNA, 15 bp, Homo sapiens
aagccaaactctgcc

SEQ ID NO: 2653079 - DNA, 16 bp, Homo sapiens
aagccaaagacttagt

SEQ ID NO: 2653080 - DNA, 18 bp, Homo sapiens
aagccaaagctaggcctg

SEQ ID NO: 2653081 - DNA, 22 bp, Homo sapiens
aagccaaagctaggcctggcca

SEQ ID NO: 2653082 - DNA, 17 bp, Homo sapiens
aagccaagcagccaagc

SEQ ID NO: 2653083 - DNA, 17 bp, Homo sapiens
aagccaataacacacag

SEQ ID NO: 2653084 - DNA, 15 bp, Homo sapiens
aagccaatcccctcc

SEQ ID NO: 2653085 - DNA, 16 bp, Homo sapiens
aagccaatcccctcct

SEQ ID NO: 2653086 - DNA, 19 bp, Homo sapiens
aagccaatcccctccttgg

SEQ ID NO: 2653087 - DNA, 20 bp, Homo sapiens
aagccaatcccctccttggg

SEQ ID NO: 2653088 - DNA, 11 bp, Homo sapiens
aagccacagaa

SEQ ID NO: 2653089 - DNA, 19 bp, Homo sapiens
aagccaccaacatactccc

SEQ ID NO: 2653090 - DNA, 17 bp, Homo sapiens
aagccagcgtcctcctc

SEQ ID NO: 2653091 - DNA, 12 bp, Homo sapiens
aagccagctttc

SEQ ID NO: 2653092 - DNA, 21 bp, Homo sapiens
aagccaggagcaaatgtttct

SEQ ID NO: 2653093 - DNA, 20 bp, Homo sapiens
aagccattctaaggaaatta

SEQ ID NO: 2653094 - DNA, 13 bp, Homo sapiens
aagccattgtctt

SEQ ID NO: 2653095 - DNA, 14 bp, Homo sapiens
aagccattgtcttc

SEQ ID NO: 2653096 - DNA, 18 bp, Homo sapiens
aagcccagaaaaggacag

SEQ ID NO: 2653097 - DNA, 22 bp, Homo sapiens
aagcccaggaaaggctccagga

SEQ ID NO: 2653098 - DNA, 19 bp, Homo sapiens
aagcccatgagtccttgaa

SEQ ID NO: 2653099 - DNA, 20 bp, Homo sapiens
aagcccatgagtccttgaaa

SEQ ID NO: 2653100 - DNA, 22 bp, Homo sapiens
aagcccatgagtccttgaaaat

SEQ ID NO: 2653101 - DNA, 12 bp, Homo sapiens
aagccccaggca

SEQ ID NO: 2653102 - DNA, 17 bp, Homo sapiens
aagcccctgcccatctg

SEQ ID NO: 2653103 - DNA, 21 bp, Homo sapiens
aagccccttgctctcccctgc

SEQ ID NO: 2653104 - DNA, 15 bp, Homo sapiens
aagcccgacttgctg

SEQ ID NO: 2653105 - DNA, 21 bp, Homo sapiens
aagccctcttccatcatgtcc

SEQ ID NO: 2653106 - DNA, 20 bp, Homo sapiens
aagccgctggggccagttgg

SEQ ID NO: 2653107 - DNA, 12 bp, Homo sapiens
aagccggcggcc

SEQ ID NO: 2653108 - DNA, 13 bp, Homo sapiens
aagccggcggccc

SEQ ID NO: 2653109 - DNA, 14 bp, Homo sapiens
aagccgtgccctgc

SEQ ID NO: 2653110 - DNA, 22 bp, Homo sapiens
aagcctagtgaaggcttctctc

SEQ ID NO: 2653111 - DNA, 20 bp, Homo sapiens
aagcctcatatttaaagaca

SEQ ID NO: 2653112 - DNA, 19 bp, Homo sapiens
aagcctccatttagttctt

SEQ ID NO: 2653113 - DNA, 11 bp, Homo sapiens
aagcctctgct

SEQ ID NO: 2653114 - DNA, 14 bp, Homo sapiens
aagcctctgctgcc

SEQ ID NO: 2653115 - DNA, 12 bp, Homo sapiens
aagcctctggct

SEQ ID NO: 2653116 - DNA, 12 bp, Homo sapiens
aagcctctggga

SEQ ID NO: 2653117 - DNA, 21 bp, Homo sapiens
aagcctggcctacatggttga

SEQ ID NO: 2653118 - DNA, 17 bp, Homo sapiens
aagcctgggattgacag

SEQ ID NO: 2653119 - DNA, 19 bp, Homo sapiens
aagcctgttttgttggaag

SEQ ID NO: 2653120 - DNA, 23 bp, Homo sapiens
aagccttatcaagtgtcttccat

SEQ ID NO: 2653121 - DNA, 15 bp, Homo sapiens
aagcctttccataag

SEQ ID NO: 2653122 - DNA, 20 bp, Homo sapiens
aagcgatgaatttggagact

SEQ ID NO: 2653123 - DNA, 17 bp, Homo sapiens
aagcgattcttctgctt

SEQ ID NO: 2653124 - DNA, 13 bp, Homo sapiens
aagctagaaatga

SEQ ID NO: 2653125 - DNA, 17 bp, Homo sapiens
aagctagaaggccacat

SEQ ID NO: 2653126 - DNA, 10 bp, Homo sapiens
aagctagaat

SEQ ID NO: 2653127 - DNA, 15 bp, Homo sapiens
aagctagctcccctc

SEQ ID NO: 2653128 - DNA, 18 bp, Homo sapiens
aagctagctcccctcctc

SEQ ID NO: 2653129 - DNA, 17 bp, Homo sapiens
aagctaggcctggccag

SEQ ID NO: 2653130 - DNA, 19 bp, Homo sapiens
aagctagtggcttcaaaat

SEQ ID NO: 2653131 - DNA, 17 bp, Homo sapiens
aagctatcctggctctt

SEQ ID NO: 2653132 - DNA, 21 bp, Homo sapiens
aagctatggtgagatgcagct

SEQ ID NO: 2653133 - DNA, 23 bp, Homo sapiens
aagctatggtgagatgcagctgg

SEQ ID NO: 2653134 - DNA, 16 bp, Homo sapiens
aagctattagccagga

SEQ ID NO: 2653135 - DNA, 18 bp, Homo sapiens
aagctcacctgttgctta

SEQ ID NO: 2653136 - DNA, 17 bp, Homo sapiens
aagctcagactggttga

SEQ ID NO: 2653137 - DNA, 15 bp, Homo sapiens
aagctcagccagccc

SEQ ID NO: 2653138 - DNA, 13 bp, Homo sapiens
aagctcagcccac

SEQ ID NO: 2653139 - DNA, 14 bp, Homo sapiens
aagctcagcccacc

SEQ ID NO: 2653140 - DNA, 15 bp, Homo sapiens
aagctcagcccaccc

SEQ ID NO: 2653141 - DNA, 18 bp, Homo sapiens
aagctcagggcctggctc

SEQ ID NO: 2653142 - DNA, 12 bp, Homo sapiens
aagctcatattt

SEQ ID NO: 2653143 - DNA, 20 bp, Homo sapiens
aagctcatattttgtatata

SEQ ID NO: 2653144 - DNA, 22 bp, Homo sapiens
aagctcatattttgtatatatc

SEQ ID NO: 2653145 - DNA, 14 bp, Homo sapiens
aagctccatctcca

SEQ ID NO: 2653146 - DNA, 20 bp, Homo sapiens
aagctccatctccactccag

SEQ ID NO: 2653147 - DNA, 16 bp, Homo sapiens
aagctcctagcagaga

SEQ ID NO: 2653148 - DNA, 22 bp, Homo sapiens
aagctcctgtcctcccatcccc

SEQ ID NO: 2653149 - DNA, 18 bp, Homo sapiens
aagctcgaaaacaattgt

SEQ ID NO: 2653150 - DNA, 15 bp, Homo sapiens
aagctctattaagat

SEQ ID NO: 2653151 - DNA, 24 bp, Homo sapiens
aagctctggctgaaccctgtgctg

SEQ ID NO: 2653152 - DNA, 20 bp, Homo sapiens
aagctctggtgacaccagcc

SEQ ID NO: 2653153 - DNA, 22 bp, Homo sapiens
aagctcttacactacattagaa

SEQ ID NO: 2653154 - DNA, 17 bp, Homo sapiens
aagctcttgaagacact

SEQ ID NO: 2653155 - DNA, 20 bp, Homo sapiens
aagctcttgaagacactgaa

SEQ ID NO: 2653156 - DNA, 21 bp, Homo sapiens
aagctgaagtgcatccaaagg

SEQ ID NO: 2653157 - DNA, 19 bp, Homo sapiens
aagctgacgaacttccatg

SEQ ID NO: 2653158 - DNA, 20 bp, Homo sapiens
aagctgacgaacttccatgg

SEQ ID NO: 2653159 - DNA, 22 bp, Homo sapiens
aagctgacgaacttccatggcc

SEQ ID NO: 2653160 - DNA, 14 bp, Homo sapiens
aagctgaggcggga

SEQ ID NO: 2653161 - DNA, 20 bp, Homo sapiens
aagctgcctggtatatccaa

SEQ ID NO: 2653162 - DNA, 14 bp, Homo sapiens
aagctgcctgtagt

SEQ ID NO: 2653163 - DNA, 22 bp, Homo sapiens
aagctgcctgtagttaggaaat

SEQ ID NO: 2653164 - DNA, 14 bp, Homo sapiens
aagctgctgacagt

SEQ ID NO: 2653165 - DNA, 16 bp, Homo sapiens
aagctgctgacagtgt

SEQ ID NO: 2653166 - DNA, 14 bp, Homo sapiens
aagctggaagcaca

SEQ ID NO: 2653167 - DNA, 22 bp, Homo sapiens
aagctgtagtagccctttctgt

SEQ ID NO: 2653168 - DNA, 23 bp, Homo sapiens
aagctgtagtagccctttctgtg

SEQ ID NO: 2653169 - DNA, 12 bp, Homo sapiens
aagctgttgtac

SEQ ID NO: 2653170 - DNA, 14 bp, Homo sapiens
aagctgttgtacat

SEQ ID NO: 2653171 - DNA, 15 bp, Homo sapiens
aagcttagcaggaga

SEQ ID NO: 2653172 - DNA, 20 bp, Homo sapiens
aagcttagcaggagaggaga

SEQ ID NO: 2653173 - DNA, 22 bp, Homo sapiens
aagcttagcaggagaggagagc

SEQ ID NO: 2653174 - DNA, 21 bp, Homo sapiens
aagcttccagtccaatctcat

SEQ ID NO: 2653175 - DNA, 21 bp, Homo sapiens
aagcttggcagccgagctcgt

SEQ ID NO: 2653176 - DNA, 13 bp, Homo sapiens
aagcttgtgtatc

SEQ ID NO: 2653177 - DNA, 22 bp, Homo sapiens
aagcttgtgtatccattatcat

SEQ ID NO: 2653178 - DNA, 19 bp, Homo sapiens
aagctttatacgtgtagct

SEQ ID NO: 2653179 - DNA, 17 bp, Homo sapiens
aaggaaaaaatgttgga

SEQ ID NO: 2653180 - DNA, 16 bp, Homo sapiens
aaggaaaccacagctg

SEQ ID NO: 2653181 - DNA, 12 bp, Homo sapiens
aaggaaactctt

SEQ ID NO: 2653182 - DNA, 20 bp, Homo sapiens
aaggaaactgggttcctgca

SEQ ID NO: 2653183 - DNA, 15 bp, Homo sapiens
aaggaaagagggagg

SEQ ID NO: 2653184 - DNA, 16 bp, Homo sapiens
aaggaaagcaataaat

SEQ ID NO: 2653185 - DNA, 20 bp, Homo sapiens
aaggaaagcaataaatgaat

SEQ ID NO: 2653186 - DNA, 14 bp, Homo sapiens
aaggaaatgattga

SEQ ID NO: 2653187 - DNA, 20 bp, Homo sapiens
aaggaactctggcttccagg

SEQ ID NO: 2653188 - DNA, 11 bp, Homo sapiens
aaggaaggaaa

SEQ ID NO: 2653189 - DNA, 17 bp, Homo sapiens
aaggaaggttttctcca

SEQ ID NO: 2653190 - DNA, 21 bp, Homo sapiens
aaggaatccactcccaggcag

SEQ ID NO: 2653191 - DNA, 15 bp, Homo sapiens
aaggaattctaggca

SEQ ID NO: 2653192 - DNA, 14 bp, Homo sapiens
aaggacaatttcaa

SEQ ID NO: 2653193 - DNA, 14 bp, Homo sapiens
aaggacacactaat

SEQ ID NO: 2653194 - DNA, 18 bp, Homo sapiens
aaggacacagatgaaaca

SEQ ID NO: 2653195 - DNA, 22 bp, Homo sapiens
aataaaacctttcaaatttcac

SEQ ID NO: 2653196 - DNA, 21 bp, Homo sapiens
aataaaagcagcatctgctaa

SEQ ID NO: 2653197 - DNA, 14 bp, Homo sapiens
aataaaaggaaaag

SEQ ID NO: 2653198 - DNA, 14 bp, Homo sapiens
aataaaatgtgatt

SEQ ID NO: 2653199 - DNA, 14 bp, Homo sapiens
aataaaattgcact

SEQ ID NO: 2653200 - DNA, 13 bp, Homo sapiens
aataaaatttgtt

SEQ ID NO: 2653201 - DNA, 14 bp, Homo sapiens
aataaaatttgttg

SEQ ID NO: 2653202 - DNA, 16 bp, Homo sapiens
aataaaatttgttgca

SEQ ID NO: 2653203 - DNA, 15 bp, Homo sapiens
aataaacgatttaat

SEQ ID NO: 2653204 - DNA, 20 bp, Homo sapiens
aataaacttttttttgagaa

SEQ ID NO: 2653205 - DNA, 11 bp, Homo sapiens
aataaagacag

SEQ ID NO: 2653206 - DNA, 14 bp, Homo sapiens
aataaagtaattat

SEQ ID NO: 2653207 - DNA, 11 bp, Homo sapiens
aataaagtatc

SEQ ID NO: 2653208 - DNA, 17 bp, Homo sapiens
aataaagtatcatgcat

SEQ ID NO: 2653209 - DNA, 16 bp, Homo sapiens
aataaatatgcctctc

SEQ ID NO: 2653210 - DNA, 20 bp, Homo sapiens
aataaatatgcctctccttt

SEQ ID NO: 2653211 - DNA, 16 bp, Homo sapiens
aataaatcataaaact

SEQ ID NO: 2653212 - DNA, 22 bp, Homo sapiens
aataaatctgttgccaagctgg

SEQ ID NO: 2653213 - DNA, 16 bp, Homo sapiens
aataaatgagctatgt

SEQ ID NO: 2653214 - DNA, 17 bp, Homo sapiens
aataaatgcaatatgta

SEQ ID NO: 2653215 - DNA, 16 bp, Homo sapiens
aataaattgctccttg

SEQ ID NO: 2653216 - DNA, 20 bp, Homo sapiens
aataaattgctccttgacat

SEQ ID NO: 2653217 - DNA, 20 bp, Homo sapiens
aataaattgtaattgtaaag

SEQ ID NO: 2653218 - DNA, 18 bp, Homo sapiens
aataaatttggttctaat

SEQ ID NO: 2653219 - DNA, 13 bp, Homo sapiens
aataacaatgtgc

SEQ ID NO: 2653220 - DNA, 14 bp, Homo sapiens
aataaccacttaaa

SEQ ID NO: 2653221 - DNA, 18 bp, Homo sapiens
aataactactgtgttcct

SEQ ID NO: 2653222 - DNA, 19 bp, Homo sapiens
aataactactgtgttcctg

SEQ ID NO: 2653223 - DNA, 21 bp, Homo sapiens
aataactccttcttgtagtag

SEQ ID NO: 2653224 - DNA, 12 bp, Homo sapiens
aataagaaaaga

SEQ ID NO: 2653225 - DNA, 22 bp, Homo sapiens
aataagaaacaactctttgaga

SEQ ID NO: 2653226 - DNA, 15 bp, Homo sapiens
aataagagaaagaaa

SEQ ID NO: 2653227 - DNA, 14 bp, Homo sapiens
aataagctaaagag

SEQ ID NO: 2653228 - DNA, 16 bp, Homo sapiens
aataaggtcaatgcca

SEQ ID NO: 2653229 - DNA, 14 bp, Homo sapiens
aataaggttgaaca

SEQ ID NO: 2653230 - DNA, 14 bp, Homo sapiens
aataagttattgca

SEQ ID NO: 2653231 - DNA, 18 bp, Homo sapiens
aataagttattgcagttt

SEQ ID NO: 2653232 - DNA, 13 bp, Homo sapiens
aataataaacttt

SEQ ID NO: 2653233 - DNA, 13 bp, Homo sapiens
aataataaagatc

SEQ ID NO: 2653234 - DNA, 11 bp, Homo sapiens
aataataatta

SEQ ID NO: 2653235 - DNA, 13 bp, Homo sapiens
aataatatatgtt

SEQ ID NO: 2653236 - DNA, 13 bp, Homo sapiens
aataatatgcatt

SEQ ID NO: 2653237 - DNA, 20 bp, Homo sapiens
aataatcacgctttcctgaa

SEQ ID NO: 2653238 - DNA, 21 bp, Homo sapiens
aataatcacgctttcctgaat

SEQ ID NO: 2653239 - DNA, 22 bp, Homo sapiens
aataatgaatggactcaaactg

SEQ ID NO: 2653240 - DNA, 19 bp, Homo sapiens
aataatgggcttagagcag

SEQ ID NO: 2653241 - DNA, 13 bp, Homo sapiens
aataatggtacca

SEQ ID NO: 2653242 - DNA, 21 bp, Homo sapiens
aataatggtcccatccaggca

SEQ ID NO: 2653243 - DNA, 15 bp, Homo sapiens
aataatgtgaatcat

SEQ ID NO: 2653244 - DNA, 19 bp, Homo sapiens
aataatgttaacatggaca

SEQ ID NO: 2653245 - DNA, 18 bp, Homo sapiens
aataattatccagagttt

SEQ ID NO: 2653246 - DNA, 20 bp, Homo sapiens
aataattatgagtttgctta

SEQ ID NO: 2653247 - DNA, 18 bp, Homo sapiens
aataattatttatttaat

SEQ ID NO: 2653248 - DNA, 16 bp, Homo sapiens
aataattttaaacaaa

SEQ ID NO: 2653249 - DNA, 13 bp, Homo sapiens
aatacaaacaatg

SEQ ID NO: 2653250 - DNA, 17 bp, Homo sapiens
aatacaaacatatttgt

SEQ ID NO: 2653251 - DNA, 20 bp, Homo sapiens
aatacaaacatatttgttaa

SEQ ID NO: 2653252 - DNA, 22 bp, Homo sapiens
aatacaacatgtagctgagttt

SEQ ID NO: 2653253 - DNA, 17 bp, Homo sapiens
aatacacaagtaaacat

SEQ ID NO: 2653254 - DNA, 14 bp, Homo sapiens
aatacacactcaaa

SEQ ID NO: 2653255 - DNA, 20 bp, Homo sapiens
aatacaccactacattctgt

SEQ ID NO: 2653256 - DNA, 15 bp, Homo sapiens
aatacagacactaag

SEQ ID NO: 2653257 - DNA, 18 bp, Homo sapiens
aatacagcaacaatttat

SEQ ID NO: 2653258 - DNA, 19 bp, Homo sapiens
aatacagccaaagataatc

SEQ ID NO: 2653259 - DNA, 16 bp, Homo sapiens
aatacagggcatgcat

SEQ ID NO: 2653260 - DNA, 21 bp, Homo sapiens
aatacagtcttccatttgcaa

SEQ ID NO: 2653261 - DNA, 12 bp, Homo sapiens
aatacagtgtta

SEQ ID NO: 2653262 - DNA, 12 bp, Homo sapiens
aatacattttat

SEQ ID NO: 2653263 - DNA, 20 bp, Homo sapiens
aataccaaaattatttcaga

SEQ ID NO: 2653264 - DNA, 16 bp, Homo sapiens
aataccaagtatttat

SEQ ID NO: 2653265 - DNA, 17 bp, Homo sapiens
aataccagccagtaaat

SEQ ID NO: 2653266 - DNA, 18 bp, Homo sapiens
aataccatgccatttaaa

SEQ ID NO: 2653267 - DNA, 20 bp, Homo sapiens
aataccattttttaaggaaa

SEQ ID NO: 2653268 - DNA, 18 bp, Homo sapiens
aatacctgtccccctgac

SEQ ID NO: 2653269 - DNA, 21 bp, Homo sapiens
aatacctgtccccctgacaac

SEQ ID NO: 2653270 - DNA, 21 bp, Homo sapiens
aatactatatttatactgtat

SEQ ID NO: 2653271 - DNA, 21 bp, Homo sapiens
aatactatttttactgccact

SEQ ID NO: 2653272 - DNA, 19 bp, Homo sapiens
aatactcataatgtgaagt

SEQ ID NO: 2653273 - DNA, 13 bp, Homo sapiens
aatactcatgtgt

SEQ ID NO: 2653274 - DNA, 23 bp, Homo sapiens
aatactcttaggaagagaaacca

SEQ ID NO: 2653275 - DNA, 22 bp, Homo sapiens
aatactgccagatgctgatgtt

SEQ ID NO: 2653276 - DNA, 22 bp, Homo sapiens
aatactgtacaatgactttatt

SEQ ID NO: 2653277 - DNA, 17 bp, Homo sapiens
aatacttgtcaatattt

SEQ ID NO: 2653278 - DNA, 16 bp, Homo sapiens
aatactttaaaggaaa

SEQ ID NO: 2653279 - DNA, 20 bp, Homo sapiens
aatagaaaactgaaaatcta

SEQ ID NO: 2653280 - DNA, 15 bp, Homo sapiens
aatagaagaacatcc

SEQ ID NO: 2653281 - DNA, 17 bp, Homo sapiens
aatagaatataattatc

SEQ ID NO: 2653282 - DNA, 20 bp, Homo sapiens
aatagaatataattatcgga

SEQ ID NO: 2653283 - DNA, 23 bp, Homo sapiens
aatagacaatttattatggcaca

SEQ ID NO: 2653284 - DNA, 15 bp, Homo sapiens
aatagacagtatatt

SEQ ID NO: 2653285 - DNA, 16 bp, Homo sapiens
aatagagcctgaggga

SEQ ID NO: 2653286 - DNA, 16 bp, Homo sapiens
aatagagtatatgcac

SEQ ID NO: 2653287 - DNA, 17 bp, Homo sapiens
aatagagtatatgcact

SEQ ID NO: 2653288 - DNA, 20 bp, Homo sapiens
aatagataagagtagaaact

SEQ ID NO: 2653289 - DNA, 21 bp, Homo sapiens
aatagatatccacttgagaca

SEQ ID NO: 2653290 - DNA, 22 bp, Homo sapiens
aatagccaacacccatctgttt

SEQ ID NO: 2653291 - DNA, 20 bp, Homo sapiens
aatagccacttaccttcaat

SEQ ID NO: 2653292 - DNA, 20 bp, Homo sapiens
aatagcctgcctcttctcta

SEQ ID NO: 2653293 - DNA, 17 bp, Homo sapiens
aatagctatatccatgt

SEQ ID NO: 2653294 - DNA, 22 bp, Homo sapiens
aatagctatatccatgtactgt

SEQ ID NO: 2653295 - DNA, 15 bp, Homo sapiens
aataggagaggatga

SEQ ID NO: 2653296 - DNA, 13 bp, Homo sapiens
aataggcaaaggg

SEQ ID NO: 2653297 - DNA, 18 bp, Homo sapiens
aatagtatttatgaaatg

SEQ ID NO: 2653298 - DNA, 15 bp, Homo sapiens
aatagtctgtgtgaa

SEQ ID NO: 2653299 - DNA, 20 bp, Homo sapiens
aatagtgcttaaaaatcatt

SEQ ID NO: 2653300 - DNA, 22 bp, Homo sapiens
aatagtggtgtgatttggggat

SEQ ID NO: 2653301 - DNA, 20 bp, Homo sapiens
aatagtgtggaaattaagaa

SEQ ID NO: 2653302 - DNA, 22 bp, Homo sapiens
aatagtgtgttctgattagaaa

SEQ ID NO: 2653303 - DNA, 17 bp, Homo sapiens
aatagtgttaatcaatt

SEQ ID NO: 2653304 - DNA, 22 bp, Homo sapiens
aatagtgttaatcaatttaaac

SEQ ID NO: 2653305 - DNA, 14 bp, Homo sapiens
aatagttgagcccc

SEQ ID NO: 2653306 - DNA, 14 bp, Homo sapiens
aatataaaaggcaa

SEQ ID NO: 2653307 - DNA, 22 bp, Homo sapiens
aatataaaaggcaaatgtgtac

SEQ ID NO: 2653308 - DNA, 11 bp, Homo sapiens
aatataattat

SEQ ID NO: 2653309 - DNA, 15 bp, Homo sapiens
aatataattctgtaa

SEQ ID NO: 2653310 - DNA, 18 bp, Homo sapiens
aatataattttttagaga

SEQ ID NO: 2653311 - DNA, 13 bp, Homo sapiens
aatatacacacag

SEQ ID NO: 2653312 - DNA, 13 bp, Homo sapiens
aatatactgtaaa

SEQ ID NO: 2653313 - DNA, 21 bp, Homo sapiens
aatatactgtaaagaaagaga

SEQ ID NO: 2653314 - DNA, 22 bp, Homo sapiens
aatatagaaacacgaactttag

SEQ ID NO: 2653315 - DNA, 16 bp, Homo sapiens
aatataggaacttaaa

SEQ ID NO: 2653316 - DNA, 20 bp, Homo sapiens
aatataggaacttaaataat

SEQ ID NO: 2653317 - DNA, 21 bp, Homo sapiens
aatataggaacttaaataatg

SEQ ID NO: 2653318 - DNA, 17 bp, Homo sapiens
aatatatctaaattgaa

SEQ ID NO: 2653319 - DNA, 12 bp, Homo sapiens
aatatatgttta

SEQ ID NO: 2653320 - DNA, 13 bp, Homo sapiens
aatatatgtttac

SEQ ID NO: 2653321 - DNA, 20 bp, Homo sapiens
aatatatgtttaccttttaa

SEQ ID NO: 2653322 - DNA, 20 bp, Homo sapiens
aatatatttaagataattat

SEQ ID NO: 2653323 - DNA, 13 bp, Homo sapiens
aatatatttgtgt

SEQ ID NO: 2653324 - DNA, 14 bp, Homo sapiens
aatatatttgtgta

SEQ ID NO: 2653325 - DNA, 24 bp, Homo sapiens
aatatatttgtgtatttaacaggg

SEQ ID NO: 2653326 - DNA, 15 bp, Homo sapiens
aatatatttttatat

SEQ ID NO: 2653327 - DNA, 20 bp, Homo sapiens
aatatatttttatatttagt

SEQ ID NO: 2653328 - DNA, 20 bp, Homo sapiens
aatatcagcaagtctcttta

SEQ ID NO: 2653329 - DNA, 19 bp, Homo sapiens
aatatcagtagaaactcta

SEQ ID NO: 2653330 - DNA, 16 bp, Homo sapiens
aatatctgaaaatgta

SEQ ID NO: 2653331 - DNA, 18 bp, Homo sapiens
aatatctgaaaatgtatg

SEQ ID NO: 2653332 - DNA, 13 bp, Homo sapiens
aatatctgaaatg

SEQ ID NO: 2653333 - DNA, 13 bp, Homo sapiens
aatatctgtattt

SEQ ID NO: 2653334 - DNA, 14 bp, Homo sapiens
aatatctgtattta

SEQ ID NO: 2653335 - DNA, 20 bp, Homo sapiens
aatatctgtatttaattttg

SEQ ID NO: 2653336 - DNA, 21 bp, Homo sapiens
aatatctgtatttaattttga

SEQ ID NO: 2653337 - DNA, 18 bp, Homo sapiens
aatatgaagctcacctgt

SEQ ID NO: 2653338 - DNA, 19 bp, Homo sapiens
aatatgacggaagaacata

SEQ ID NO: 2653339 - DNA, 17 bp, Homo sapiens
aatatgatattgcatat

SEQ ID NO: 2653340 - DNA, 15 bp, Homo sapiens
aattgtataacaggt

SEQ ID NO: 2653341 - DNA, 19 bp, Homo sapiens
aattgtataacaggttatt

SEQ ID NO: 2653342 - DNA, 17 bp, Homo sapiens
aattgtatcagaggcct

SEQ ID NO: 2653343 - DNA, 19 bp, Homo sapiens
aattgtatcgtatagctgt

SEQ ID NO: 2653344 - DNA, 13 bp, Homo sapiens
aattgtatctagt

SEQ ID NO: 2653345 - DNA, 12 bp, Homo sapiens
aattgtatgtta

SEQ ID NO: 2653346 - DNA, 16 bp, Homo sapiens
aattgtattttagtaa

SEQ ID NO: 2653347 - DNA, 17 bp, Homo sapiens
aattgtccgtgttcata

SEQ ID NO: 2653348 - DNA, 12 bp, Homo sapiens
aattgtgaaaaa

SEQ ID NO: 2653349 - DNA, 15 bp, Homo sapiens
aattgtgatgtgtcc

SEQ ID NO: 2653350 - DNA, 18 bp, Homo sapiens
aattgttgacagttctga

SEQ ID NO: 2653351 - DNA, 12 bp, Homo sapiens
aattgttgtttc

SEQ ID NO: 2653352 - DNA, 21 bp, Homo sapiens
aattgttgtttctttctagtg

SEQ ID NO: 2653353 - DNA, 13 bp, Homo sapiens
aattgttgtttgt

SEQ ID NO: 2653354 - DNA, 14 bp, Homo sapiens
aattgttgtttgta

SEQ ID NO: 2653355 - DNA, 20 bp, Homo sapiens
aattgtttaagtgttgtaaa

SEQ ID NO: 2653356 - DNA, 20 bp, Homo sapiens
aattgttttgcactttttta

SEQ ID NO: 2653357 - DNA, 14 bp, Homo sapiens
aatttaaaaaataa

SEQ ID NO: 2653358 - DNA, 13 bp, Homo sapiens
aatttaaaagtct

SEQ ID NO: 2653359 - DNA, 9 bp, Homo sapiens
aatttaaac

SEQ ID NO: 2653360 - DNA, 18 bp, Homo sapiens
aatttaaacaggcccagc

SEQ ID NO: 2653361 - DNA, 17 bp, Homo sapiens
aatttaaacccatttta

SEQ ID NO: 2653362 - DNA, 22 bp, Homo sapiens
aatttaaagggtgtacttatat

SEQ ID NO: 2653363 - DNA, 14 bp, Homo sapiens
aatttaagtgcgtg

SEQ ID NO: 2653364 - DNA, 20 bp, Homo sapiens
aatttaagtgcgtgtgtaga

SEQ ID NO: 2653365 - DNA, 21 bp, Homo sapiens
aatttaattaggggttgctaa

SEQ ID NO: 2653366 - DNA, 19 bp, Homo sapiens
aatttaattcatgtttctt

SEQ ID NO: 2653367 - DNA, 23 bp, Homo sapiens
aatttaattcatgtttcttaaat

SEQ ID NO: 2653368 - DNA, 21 bp, Homo sapiens
aatttacaaaaatataaaata

SEQ ID NO: 2653369 - DNA, 17 bp, Homo sapiens
aatttacagagacagaa

SEQ ID NO: 2653370 - DNA, 19 bp, Homo sapiens
aatttacatactctgctta

SEQ ID NO: 2653371 - DNA, 15 bp, Homo sapiens
aatttagttattgat

SEQ ID NO: 2653372 - DNA, 17 bp, Homo sapiens
aatttattagttaatat

SEQ ID NO: 2653373 - DNA, 16 bp, Homo sapiens
aatttattattgaaat

SEQ ID NO: 2653374 - DNA, 16 bp, Homo sapiens
aatttattattgttct

SEQ ID NO: 2653375 - DNA, 16 bp, Homo sapiens
aatttattgcttgata

SEQ ID NO: 2653376 - DNA, 22 bp, Homo sapiens
aatttatttattaagatggatt

SEQ ID NO: 2653377 - DNA, 15 bp, Homo sapiens
aatttatttttgcat

SEQ ID NO: 2653378 - DNA, 22 bp, Homo sapiens
aatttcaggttttgtaaagatg

SEQ ID NO: 2653379 - DNA, 22 bp, Homo sapiens
aatttcatacctatcatcttaa

SEQ ID NO: 2653380 - DNA, 17 bp, Homo sapiens
aatttccagtacctttg

SEQ ID NO: 2653381 - DNA, 20 bp, Homo sapiens
aatttccagtacctttgtca

SEQ ID NO: 2653382 - DNA, 22 bp, Homo sapiens
aatttccccaacagtgtgaagt

SEQ ID NO: 2653383 - DNA, 18 bp, Homo sapiens
aatttcctggtgtgaagg

SEQ ID NO: 2653384 - DNA, 21 bp, Homo sapiens
aatttcctgttggatttgttt

SEQ ID NO: 2653385 - DNA, 16 bp, Homo sapiens
aatttctaccatttca

SEQ ID NO: 2653386 - DNA, 16 bp, Homo sapiens
aatttctactttgaag

SEQ ID NO: 2653387 - DNA, 20 bp, Homo sapiens
aatttcttggtaagaagccg

SEQ ID NO: 2653388 - DNA, 22 bp, Homo sapiens
aatttctttatgtaatctatgt

SEQ ID NO: 2653389 - DNA, 19 bp, Homo sapiens
aatttgaaaataattgttc

SEQ ID NO: 2653390 - DNA, 12 bp, Homo sapiens
aatttgaatgaa

SEQ ID NO: 2653391 - DNA, 13 bp, Homo sapiens
aatttgaatgaaa

SEQ ID NO: 2653392 - DNA, 14 bp, Homo sapiens
aatttgaatgaaaa

SEQ ID NO: 2653393 - DNA, 18 bp, Homo sapiens
aatttgagagaaatatga

SEQ ID NO: 2653394 - DNA, 13 bp, Homo sapiens
aatttgaggacaa

SEQ ID NO: 2653395 - DNA, 13 bp, Homo sapiens
aatttgagtgctc

SEQ ID NO: 2653396 - DNA, 20 bp, Homo sapiens
aatttgatacatatgtgaat

SEQ ID NO: 2653397 - DNA, 21 bp, Homo sapiens
aatttgatagtattgtgcata

SEQ ID NO: 2653398 - DNA, 17 bp, Homo sapiens
aatttgattattaacat

SEQ ID NO: 2653399 - DNA, 15 bp, Homo sapiens
aatttgccctcccat

SEQ ID NO: 2653400 - DNA, 16 bp, Homo sapiens
aatttggttctaatag

SEQ ID NO: 2653401 - DNA, 23 bp, Homo sapiens
aatttgtaaaaacagcattgctt

SEQ ID NO: 2653402 - DNA, 14 bp, Homo sapiens
aatttgtaagtttc

SEQ ID NO: 2653403 - DNA, 16 bp, Homo sapiens
aatttgtaagtttcag

SEQ ID NO: 2653404 - DNA, 15 bp, Homo sapiens
aatttgtaattgctt

SEQ ID NO: 2653405 - DNA, 20 bp, Homo sapiens
aatttgtacatatgtaaaat

SEQ ID NO: 2653406 - DNA, 14 bp, Homo sapiens
aatttgtgatacaa

SEQ ID NO: 2653407 - DNA, 20 bp, Homo sapiens
aatttgtgatacaatgctgt

SEQ ID NO: 2653408 - DNA, 17 bp, Homo sapiens
aatttgtttgaaatctt

SEQ ID NO: 2653409 - DNA, 18 bp, Homo sapiens
aattttaaataaaagtga

SEQ ID NO: 2653410 - DNA, 22 bp, Homo sapiens
aattttaagtgctttgtaatgg

SEQ ID NO: 2653411 - DNA, 13 bp, Homo sapiens
aattttaatttat

SEQ ID NO: 2653412 - DNA, 19 bp, Homo sapiens
aattttatagctcagttta

SEQ ID NO: 2653413 - DNA, 16 bp, Homo sapiens
aattttatctcttatt

SEQ ID NO: 2653414 - DNA, 12 bp, Homo sapiens
aattttatgaat

SEQ ID NO: 2653415 - DNA, 19 bp, Homo sapiens
aattttatgagggccacgg

SEQ ID NO: 2653416 - DNA, 12 bp, Homo sapiens
aattttattcct

SEQ ID NO: 2653417 - DNA, 19 bp, Homo sapiens
aattttcaagtaattgtga

SEQ ID NO: 2653418 - DNA, 18 bp, Homo sapiens
aattttctcccaggaagc

SEQ ID NO: 2653419 - DNA, 21 bp, Homo sapiens
aattttctgtgttctgaagtc

SEQ ID NO: 2653420 - DNA, 13 bp, Homo sapiens
aattttcttcatg

SEQ ID NO: 2653421 - DNA, 14 bp, Homo sapiens
aattttcttcatgc

SEQ ID NO: 2653422 - DNA, 16 bp, Homo sapiens
aattttgacactatat

SEQ ID NO: 2653423 - DNA, 14 bp, Homo sapiens
aattttgatgtttt

SEQ ID NO: 2653424 - DNA, 19 bp, Homo sapiens
aattttggttgtattcttt

SEQ ID NO: 2653425 - DNA, 20 bp, Homo sapiens
aattttggttgtattctttg

SEQ ID NO: 2653426 - DNA, 14 bp, Homo sapiens
aattttgtattttc

SEQ ID NO: 2653427 - DNA, 13 bp, Homo sapiens
aattttgttgctg

SEQ ID NO: 2653428 - DNA, 22 bp, Homo sapiens
aatttttaaagtatatatttat

SEQ ID NO: 2653429 - DNA, 20 bp, Homo sapiens
aatttttaaatgtaaaacat

SEQ ID NO: 2653430 - DNA, 17 bp, Homo sapiens
aatttttattaaattat

SEQ ID NO: 2653431 - DNA, 18 bp, Homo sapiens
aatttttattaaattatg

SEQ ID NO: 2653432 - DNA, 18 bp, Homo sapiens
aatttttggttgaataaa

SEQ ID NO: 2653433 - DNA, 20 bp, Homo sapiens
aattttttatcatgcatgtc

SEQ ID NO: 2653434 - DNA, 20 bp, Homo sapiens
aatttttttaattttgtatt

SEQ ID NO: 2653435 - DNA, 22 bp, Homo sapiens
aatttttttatcgtcactgctt

SEQ ID NO: 2653436 - DNA, 19 bp, Homo sapiens
aatttttttcaatatttat

SEQ ID NO: 2653437 - DNA, 21 bp, Homo sapiens
aatttttttcatcttctctgg

SEQ ID NO: 2653438 - DNA, 19 bp, Homo sapiens
aatttttttttcctagccc

SEQ ID NO: 2653439 - DNA, 20 bp, Homo sapiens
aattttttttttttaacttt

SEQ ID NO: 2653440 - DNA, 17 bp, Homo sapiens
acaaaaaaaaagtttta

SEQ ID NO: 2653441 - DNA, 19 bp, Homo sapiens
acaaaaaaaaagttttatt

SEQ ID NO: 2653442 - DNA, 14 bp, Homo sapiens
acaaaaacacagca

SEQ ID NO: 2653443 - DNA, 13 bp, Homo sapiens
acaaaaacatggc

SEQ ID NO: 2653444 - DNA, 14 bp, Homo sapiens
acaaaaattaaaat

SEQ ID NO: 2653445 - DNA, 12 bp, Homo sapiens
acaaaacaaatg

SEQ ID NO: 2653446 - DNA, 22 bp, Homo sapiens
acaaaagcatgtgagactggtt

SEQ ID NO: 2653447 - DNA, 22 bp, Homo sapiens
acaaaataaccaatcctggaca

SEQ ID NO: 2653448 - DNA, 15 bp, Homo sapiens
acaaaatagaagctg

SEQ ID NO: 2653449 - DNA, 20 bp, Homo sapiens
acaaaatttagtttttgttc

SEQ ID NO: 2653450 - DNA, 18 bp, Homo sapiens
acaaacaatggaaactga

SEQ ID NO: 2653451 - DNA, 14 bp, Homo sapiens
acaaacatcactct

SEQ ID NO: 2653452 - DNA, 14 bp, Homo sapiens
acaaacatgaccct

SEQ ID NO: 2653453 - DNA, 19 bp, Homo sapiens
acaaacatgtggttaatgc

SEQ ID NO: 2653454 - DNA, 21 bp, Homo sapiens
acaaaccgagtgcaatgaatg

SEQ ID NO: 2653455 - DNA, 15 bp, Homo sapiens
acaaacgggctcagc

SEQ ID NO: 2653456 - DNA, 18 bp, Homo sapiens
acaaacgtatgtaaatgt

SEQ ID NO: 2653457 - DNA, 21 bp, Homo sapiens
acaaacgtatgtaaatgtata

SEQ ID NO: 2653458 - DNA, 22 bp, Homo sapiens
acaaactatttcttatatatgt

SEQ ID NO: 2653459 - DNA, 18 bp, Homo sapiens
acaaagaagacaacatta

SEQ ID NO: 2653460 - DNA, 19 bp, Homo sapiens
acaaagaagacatgtttta

SEQ ID NO: 2653461 - DNA, 18 bp, Homo sapiens
acaaagacaaattctgtt

SEQ ID NO: 2653462 - DNA, 19 bp, Homo sapiens
acaaagacaaattctgttt

SEQ ID NO: 2653463 - DNA, 13 bp, Homo sapiens
acaaagactgagt

SEQ ID NO: 2653464 - DNA, 14 bp, Homo sapiens
acaaagcacagtgt

SEQ ID NO: 2653465 - DNA, 16 bp, Homo sapiens
acaaagcacagtgtta

SEQ ID NO: 2653466 - DNA, 16 bp, Homo sapiens
acaaagcacagtttga

SEQ ID NO: 2653467 - DNA, 11 bp, Homo sapiens
acaaagccaga

SEQ ID NO: 2653468 - DNA, 16 bp, Homo sapiens
acaaagccagaagctg

SEQ ID NO: 2653469 - DNA, 18 bp, Homo sapiens
acaaagcccttccatgtc

SEQ ID NO: 2653470 - DNA, 16 bp, Homo sapiens
acaaagcttagcagga

SEQ ID NO: 2653471 - DNA, 19 bp, Homo sapiens
acaaagcttagcaggagag

SEQ ID NO: 2653472 - DNA, 20 bp, Homo sapiens
acaaagcttctatcccagga

SEQ ID NO: 2653473 - DNA, 23 bp, Homo sapiens
acaaagcttggaagagcctgcag

SEQ ID NO: 2653474 - DNA, 15 bp, Homo sapiens
acaaagggttttaat

SEQ ID NO: 2653475 - DNA, 16 bp, Homo sapiens
acaaataacaatgtgc

SEQ ID NO: 2653476 - DNA, 17 bp, Homo sapiens
acaaatactcatgtgta

SEQ ID NO: 2653477 - DNA, 18 bp, Homo sapiens
acaaatactcatgtgtat

SEQ ID NO: 2653478 - DNA, 18 bp, Homo sapiens
acaaatatttattttctt

SEQ ID NO: 2653479 - DNA, 21 bp, Homo sapiens
acaaatctcaagcaaacagct

SEQ ID NO: 2653480 - DNA, 16 bp, Homo sapiens
acaaattctgtttctt

SEQ ID NO: 2653481 - DNA, 19 bp, Homo sapiens
acaaatttacagagacaga

SEQ ID NO: 2653482 - DNA, 13 bp, Homo sapiens
acaacaagagttt

SEQ ID NO: 2653483 - DNA, 19 bp, Homo sapiens
acaacagaagcttcagaag

SEQ ID NO: 2653484 - DNA, 14 bp, Homo sapiens
acaacagatttgtg

SEQ ID NO: 2653485 - DNA, 17 bp, Homo sapiens
acaggaagatcttaaat

SEQ ID NO: 2653486 - DNA, 15 bp, Homo sapiens
acaggaagcacccca

SEQ ID NO: 2653487 - DNA, 17 bp, Homo sapiens
acaggacagtgcttcag

SEQ ID NO: 2653488 - DNA, 23 bp, Homo sapiens
acaggaccagggatttccatgat

SEQ ID NO: 2653489 - DNA, 17 bp, Homo sapiens
acaggacccccttcccc

SEQ ID NO: 2653490 - DNA, 16 bp, Homo sapiens
acaggactctgcctcc

SEQ ID NO: 2653491 - DNA, 20 bp, Homo sapiens
acaggaggacaattcatgaa

SEQ ID NO: 2653492 - DNA, 19 bp, Homo sapiens
acaggataaagatatcaat

SEQ ID NO: 2653493 - DNA, 21 bp, Homo sapiens
acaggatcctattctcaccag

SEQ ID NO: 2653494 - DNA, 19 bp, Homo sapiens
acaggatgggggctggcct

SEQ ID NO: 2653495 - DNA, 14 bp, Homo sapiens
acaggattattgga

SEQ ID NO: 2653496 - DNA, 20 bp, Homo sapiens
acaggcaagcacctcctgcc

SEQ ID NO: 2653497 - DNA, 23 bp, Homo sapiens
acaggcaagcacctcctgcctcg

SEQ ID NO: 2653498 - DNA, 14 bp, Homo sapiens
acaggcaatgctgg

SEQ ID NO: 2653499 - DNA, 16 bp, Homo sapiens
acaggcaatgctggct

SEQ ID NO: 2653500 - DNA, 23 bp, Homo sapiens
acaggcaatgctggctgttggct

SEQ ID NO: 2653501 - DNA, 12 bp, Homo sapiens
acaggcacaaaa

SEQ ID NO: 2653502 - DNA, 14 bp, Homo sapiens
acaggcacccacca

SEQ ID NO: 2653503 - DNA, 17 bp, Homo sapiens
acaggcaccgagaatgt

SEQ ID NO: 2653504 - DNA, 22 bp, Homo sapiens
acaggcagcctggacatagaga

SEQ ID NO: 2653505 - DNA, 13 bp, Homo sapiens
acaggcaggtcca

SEQ ID NO: 2653506 - DNA, 15 bp, Homo sapiens
acaggcatgttctct

SEQ ID NO: 2653507 - DNA, 22 bp, Homo sapiens
acaggcatgttctctgaggaca

SEQ ID NO: 2653508 - DNA, 22 bp, Homo sapiens
acaggcccagcattgctggttc

SEQ ID NO: 2653509 - DNA, 23 bp, Homo sapiens
acaggcccagcattgctggttct

SEQ ID NO: 2653510 - DNA, 21 bp, Homo sapiens
acaggcccccttgagtggggt

SEQ ID NO: 2653511 - DNA, 17 bp, Homo sapiens
acaggcccggctccagg

SEQ ID NO: 2653512 - DNA, 21 bp, Homo sapiens
acaggcccggctccaggctcc

SEQ ID NO: 2653513 - DNA, 17 bp, Homo sapiens
acaggctgggcttcagt

SEQ ID NO: 2653514 - DNA, 21 bp, Homo sapiens
acaggctgggcttcagtggca

SEQ ID NO: 2653515 - DNA, 23 bp, Homo sapiens
acagggaaccctgcttgcacttt

SEQ ID NO: 2653516 - DNA, 13 bp, Homo sapiens
acagggaagctac

SEQ ID NO: 2653517 - DNA, 12 bp, Homo sapiens
acagggagggga

SEQ ID NO: 2653518 - DNA, 23 bp, Homo sapiens
acagggatgagcatggagctggc

SEQ ID NO: 2653519 - DNA, 17 bp, Homo sapiens
acagggcagctgggccc

SEQ ID NO: 2653520 - DNA, 18 bp, Homo sapiens
acagggcagctgggccca

SEQ ID NO: 2653521 - DNA, 21 bp, Homo sapiens
acagggcatctccaggaaggc

SEQ ID NO: 2653522 - DNA, 21 bp, Homo sapiens
acagggctgataagctaacac

SEQ ID NO: 2653523 - DNA, 20 bp, Homo sapiens
acagggctggcccagccctg

SEQ ID NO: 2653524 - DNA, 22 bp, Homo sapiens
acagggctggcccagccctgct

SEQ ID NO: 2653525 - DNA, 23 bp, Homo sapiens
acagggtctctagtgctgtgaaa

SEQ ID NO: 2653526 - DNA, 22 bp, Homo sapiens
acaggtcaatacagtacaggca

SEQ ID NO: 2653527 - DNA, 18 bp, Homo sapiens
acaggtggacacacaagg

SEQ ID NO: 2653528 - DNA, 22 bp, Homo sapiens
acaggtgggcttcccagtggct

SEQ ID NO: 2653529 - DNA, 22 bp, Homo sapiens
acaggtgtgagtcaccaagccc

SEQ ID NO: 2653530 - DNA, 14 bp, Homo sapiens
acaggtgtttatac

SEQ ID NO: 2653531 - DNA, 18 bp, Homo sapiens
acaggttacaacagattt

SEQ ID NO: 2653532 - DNA, 22 bp, Homo sapiens
acaggttacaacagatttgtga

SEQ ID NO: 2653533 - DNA, 21 bp, Homo sapiens
acaggttattttagtttctgt

SEQ ID NO: 2653534 - DNA, 10 bp, Homo sapiens
acagtaactt

SEQ ID NO: 2653535 - DNA, 13 bp, Homo sapiens
acagtacaggcag

SEQ ID NO: 2653536 - DNA, 16 bp, Homo sapiens
acagtacaggcagcac

SEQ ID NO: 2653537 - DNA, 14 bp, Homo sapiens
acagtaggagccca

SEQ ID NO: 2653538 - DNA, 17 bp, Homo sapiens
acagtattacttctgct

SEQ ID NO: 2653539 - DNA, 14 bp, Homo sapiens
acagtccagcctgg

SEQ ID NO: 2653540 - DNA, 15 bp, Homo sapiens
acagtccagcctgga

SEQ ID NO: 2653541 - DNA, 16 bp, Homo sapiens
acagtccagcctggag

SEQ ID NO: 2653542 - DNA, 18 bp, Homo sapiens
acagtccagcctggagat

SEQ ID NO: 2653543 - DNA, 12 bp, Homo sapiens
acagtccctgcc

SEQ ID NO: 2653544 - DNA, 13 bp, Homo sapiens
acagtcctcccat

SEQ ID NO: 2653545 - DNA, 17 bp, Homo sapiens
acagtcctcccatctca

SEQ ID NO: 2653546 - DNA, 23 bp, Homo sapiens
acagtcctgggagaacctcaggc

SEQ ID NO: 2653547 - DNA, 18 bp, Homo sapiens
acagtccttaccagcaga

SEQ ID NO: 2653548 - DNA, 14 bp, Homo sapiens
acagtctcaggaaa

SEQ ID NO: 2653549 - DNA, 16 bp, Homo sapiens
acagtctcaggaaatc

SEQ ID NO: 2653550 - DNA, 22 bp, Homo sapiens
acagtctgatcgtgacgctgaa

SEQ ID NO: 2653551 - DNA, 13 bp, Homo sapiens
acagtctgtcatg

SEQ ID NO: 2653552 - DNA, 19 bp, Homo sapiens
acagtcttccatttgcaag

SEQ ID NO: 2653553 - DNA, 14 bp, Homo sapiens
acagtcttgtatta

SEQ ID NO: 2653554 - DNA, 15 bp, Homo sapiens
acagtcttgtattaa

SEQ ID NO: 2653555 - DNA, 21 bp, Homo sapiens
acagtgaaaatgtaagctgtt

SEQ ID NO: 2653556 - DNA, 14 bp, Homo sapiens
acagtgatctccat

SEQ ID NO: 2653557 - DNA, 22 bp, Homo sapiens
acagtgatctccatatgttaca

SEQ ID NO: 2653558 - DNA, 24 bp, Homo sapiens
acagtgatgctgtgctatgaattt

SEQ ID NO: 2653559 - DNA, 21 bp, Homo sapiens
acagtgcctgggaatgtatta

SEQ ID NO: 2653560 - DNA, 17 bp, Homo sapiens
acagtgccttcaataaa

SEQ ID NO: 2653561 - DNA, 20 bp, Homo sapiens
acagtgccttcaataaatgg

SEQ ID NO: 2653562 - DNA, 21 bp, Homo sapiens
acagtgcttcagcctgaggct

SEQ ID NO: 2653563 - DNA, 20 bp, Homo sapiens
acagtgcttgccacagagcg

SEQ ID NO: 2653564 - DNA, 21 bp, Homo sapiens
acagtggctcacgcctgtaat

SEQ ID NO: 2653565 - DNA, 14 bp, Homo sapiens
acagtgggagccag

SEQ ID NO: 2653566 - DNA, 15 bp, Homo sapiens
acagtgggagccagg

SEQ ID NO: 2653567 - DNA, 13 bp, Homo sapiens
acagtggtggcag

SEQ ID NO: 2653568 - DNA, 12 bp, Homo sapiens
acagtgtacagt

SEQ ID NO: 2653569 - DNA, 13 bp, Homo sapiens
acagtgtacagtc

SEQ ID NO: 2653570 - DNA, 15 bp, Homo sapiens
acagtgtacagtctt

SEQ ID NO: 2653571 - DNA, 18 bp, Homo sapiens
acagtgtacagtcttgta

SEQ ID NO: 2653572 - DNA, 23 bp, Homo sapiens
acagtgtctgtatcggagacagt

SEQ ID NO: 2653573 - DNA, 18 bp, Homo sapiens
acagtgtgaagttagaat

SEQ ID NO: 2653574 - DNA, 19 bp, Homo sapiens
acagtgtgaagttagaatt

SEQ ID NO: 2653575 - DNA, 22 bp, Homo sapiens
acagtgtgaagttagaattcct

SEQ ID NO: 2653576 - DNA, 21 bp, Homo sapiens
acagtgttgaaaatgttcaga

SEQ ID NO: 2653577 - DNA, 9 bp, Homo sapiens
acagtgttt

SEQ ID NO: 2653578 - DNA, 15 bp, Homo sapiens
acagtgtttcccata

SEQ ID NO: 2653579 - DNA, 18 bp, Homo sapiens
acagtgtttcccataatt

SEQ ID NO: 2653580 - DNA, 19 bp, Homo sapiens
acagtgtttcgacagctga

SEQ ID NO: 2653581 - DNA, 14 bp, Homo sapiens
acagttaactttca

SEQ ID NO: 2653582 - DNA, 16 bp, Homo sapiens
acagttaactttcaga

SEQ ID NO: 2653583 - DNA, 13 bp, Homo sapiens
acagttactcaga

SEQ ID NO: 2653584 - DNA, 20 bp, Homo sapiens
acagttcaagaaagcttcaa

SEQ ID NO: 2653585 - DNA, 21 bp, Homo sapiens
acagttcagtggcagggctca

SEQ ID NO: 2653586 - DNA, 15 bp, Homo sapiens
acagttcatatgtac

SEQ ID NO: 2653587 - DNA, 15 bp, Homo sapiens
acagttgaaaaacag

SEQ ID NO: 2653588 - DNA, 22 bp, Homo sapiens
acagttgctgtcataagaatga

SEQ ID NO: 2653589 - DNA, 16 bp, Homo sapiens
acagttggccttcaga

SEQ ID NO: 2653590 - DNA, 15 bp, Homo sapiens
acagttgttggcctc

SEQ ID NO: 2653591 - DNA, 18 bp, Homo sapiens
acagtttcttagcttttt

SEQ ID NO: 2653592 - DNA, 20 bp, Homo sapiens
acagtttcttagctttttaa

SEQ ID NO: 2653593 - DNA, 15 bp, Homo sapiens
acagtttgaacaaaa

SEQ ID NO: 2653594 - DNA, 20 bp, Homo sapiens
acagtttgttagtatgaggc

SEQ ID NO: 2653595 - DNA, 14 bp, Homo sapiens
acagttttccatga

SEQ ID NO: 2653596 - DNA, 16 bp, Homo sapiens
acagttttccatgaaa

SEQ ID NO: 2653597 - DNA, 19 bp, Homo sapiens
acagttttccatgaaaacg

SEQ ID NO: 2653598 - DNA, 21 bp, Homo sapiens
acagttttccatgaaaacgtt

SEQ ID NO: 2653599 - DNA, 14 bp, Homo sapiens
acagttttccttct

SEQ ID NO: 2653600 - DNA, 19 bp, Homo sapiens
acagttttggttgctttaa

SEQ ID NO: 2653601 - DNA, 15 bp, Homo sapiens
acataacgtttttcc

SEQ ID NO: 2653602 - DNA, 16 bp, Homo sapiens
acataagataaatgtg

SEQ ID NO: 2653603 - DNA, 22 bp, Homo sapiens
acataagcggcgtaagtttaaa

SEQ ID NO: 2653604 - DNA, 21 bp, Homo sapiens
acataatgcgtgcataccact

SEQ ID NO: 2653605 - DNA, 18 bp, Homo sapiens
acataattttttattcaa

SEQ ID NO: 2653606 - DNA, 16 bp, Homo sapiens
acatacaattattttt

SEQ ID NO: 2653607 - DNA, 16 bp, Homo sapiens
acatacacacatatgt

SEQ ID NO: 2653608 - DNA, 21 bp, Homo sapiens
acatactaaccagcagaaatg

SEQ ID NO: 2653609 - DNA, 22 bp, Homo sapiens
acatactaaccagcagaaatgc

SEQ ID NO: 2653610 - DNA, 12 bp, Homo sapiens
acatactgctgt

SEQ ID NO: 2653611 - DNA, 22 bp, Homo sapiens
acatactttcatcctgactctg

SEQ ID NO: 2653612 - DNA, 14 bp, Homo sapiens
acatagaattaaca

SEQ ID NO: 2653613 - DNA, 20 bp, Homo sapiens
acatagagagggagaagaag

SEQ ID NO: 2653614 - DNA, 15 bp, Homo sapiens
acatagatgtccctt

SEQ ID NO: 2653615 - DNA, 20 bp, Homo sapiens
acatagcctatatttacagt

SEQ ID NO: 2653616 - DNA, 19 bp, Homo sapiens
acatagcgaatacaaaatt

SEQ ID NO: 2653617 - DNA, 21 bp, Homo sapiens
acatagcttacaagccagctg

SEQ ID NO: 2653618 - DNA, 15 bp, Homo sapiens
acatatgaaatttaa

SEQ ID NO: 2653619 - DNA, 13 bp, Homo sapiens
acatatgtgaata

SEQ ID NO: 2653620 - DNA, 16 bp, Homo sapiens
acatattgatttccgt

SEQ ID NO: 2653621 - DNA, 18 bp, Homo sapiens
acatattgatttccgtta

SEQ ID NO: 2653622 - DNA, 18 bp, Homo sapiens
acatatttccaagaagtt

SEQ ID NO: 2653623 - DNA, 15 bp, Homo sapiens
acatatttgtggaat

SEQ ID NO: 2653624 - DNA, 18 bp, Homo sapiens
acatcaacatcttggtca

SEQ ID NO: 2653625 - DNA, 13 bp, Homo sapiens
acatcaatgttca

SEQ ID NO: 2653626 - DNA, 18 bp, Homo sapiens
acatcaatgttcattgta

SEQ ID NO: 2653627 - DNA, 22 bp, Homo sapiens
acatcacccttaccatgtgcct

SEQ ID NO: 2653628 - DNA, 23 bp, Homo sapiens
acatcaccgacgcgtctcctgtt

SEQ ID NO: 2653629 - DNA, 24 bp, Homo sapiens
acccgaggctgcccactatggtca

SEQ ID NO: 2653630 - DNA, 12 bp, Homo sapiens
acccgatgctgc

SEQ ID NO: 2653631 - DNA, 13 bp, Homo sapiens
acccgatgctgct

SEQ ID NO: 2653632 - DNA, 18 bp, Homo sapiens
acccgcctctcccgtcag

SEQ ID NO: 2653633 - DNA, 16 bp, Homo sapiens
acccgctttcttgctg

SEQ ID NO: 2653634 - DNA, 22 bp, Homo sapiens
acccggagctaacactggcccc

SEQ ID NO: 2653635 - DNA, 23 bp, Homo sapiens
acccggagctaacactggcccct

SEQ ID NO: 2653636 - DNA, 12 bp, Homo sapiens
acccggaggcca

SEQ ID NO: 2653637 - DNA, 22 bp, Homo sapiens
acccggcaggctagaacctggc

SEQ ID NO: 2653638 - DNA, 20 bp, Homo sapiens
acccggcccctgctggttca

SEQ ID NO: 2653639 - DNA, 19 bp, Homo sapiens
acccgggaagggggctggg

SEQ ID NO: 2653640 - DNA, 15 bp, Homo sapiens
acccgggaggcagag

SEQ ID NO: 2653641 - DNA, 18 bp, Homo sapiens
acccgttctgctggcctg

SEQ ID NO: 2653642 - DNA, 22 bp, Homo sapiens
acccgttctgctggcctggatc

SEQ ID NO: 2653643 - DNA, 19 bp, Homo sapiens
accctaaaaagcagagctt

SEQ ID NO: 2653644 - DNA, 21 bp, Homo sapiens
accctagttctacctcaggca

SEQ ID NO: 2653645 - DNA, 17 bp, Homo sapiens
accctatatgtagtata

SEQ ID NO: 2653646 - DNA, 17 bp, Homo sapiens
accctcagcaccccttc

SEQ ID NO: 2653647 - DNA, 15 bp, Homo sapiens
accctcaggacaatg

SEQ ID NO: 2653648 - DNA, 20 bp, Homo sapiens
accctcaggcataggcctgg

SEQ ID NO: 2653649 - DNA, 13 bp, Homo sapiens
accctcatgctgt

SEQ ID NO: 2653650 - DNA, 14 bp, Homo sapiens
accctcatgttctt

SEQ ID NO: 2653651 - DNA, 16 bp, Homo sapiens
accctcccatggcacc

SEQ ID NO: 2653652 - DNA, 17 bp, Homo sapiens
accctcccatggcacct

SEQ ID NO: 2653653 - DNA, 14 bp, Homo sapiens
accctcccctctct

SEQ ID NO: 2653654 - DNA, 19 bp, Homo sapiens
accctcccctctcttgcac

SEQ ID NO: 2653655 - DNA, 20 bp, Homo sapiens
accctccctcagcccctctt

SEQ ID NO: 2653656 - DNA, 23 bp, Homo sapiens
accctccctccgatccttcctcc

SEQ ID NO: 2653657 - DNA, 12 bp, Homo sapiens
accctccctgga

SEQ ID NO: 2653658 - DNA, 14 bp, Homo sapiens
accctccctggagt

SEQ ID NO: 2653659 - DNA, 15 bp, Homo sapiens
accctccgccttcac

SEQ ID NO: 2653660 - DNA, 22 bp, Homo sapiens
accctccgccttcactccggtg

SEQ ID NO: 2653661 - DNA, 23 bp, Homo sapiens
accctcctgtcttcccagggtag

SEQ ID NO: 2653662 - DNA, 16 bp, Homo sapiens
accctcgggcccacct

SEQ ID NO: 2653663 - DNA, 17 bp, Homo sapiens
accctcgggcccacctg

SEQ ID NO: 2653664 - DNA, 18 bp, Homo sapiens
accctcgggcccacctgg

SEQ ID NO: 2653665 - DNA, 19 bp, Homo sapiens
accctctgaatggtccagg

SEQ ID NO: 2653666 - DNA, 21 bp, Homo sapiens
accctctgaatggtccagggt

SEQ ID NO: 2653667 - DNA, 11 bp, Homo sapiens
accctgagccc

SEQ ID NO: 2653668 - DNA, 17 bp, Homo sapiens
accctgagccccttcct

SEQ ID NO: 2653669 - DNA, 17 bp, Homo sapiens
accctgagctgaggcag

SEQ ID NO: 2653670 - DNA, 16 bp, Homo sapiens
accctgaggcccagag

SEQ ID NO: 2653671 - DNA, 17 bp, Homo sapiens
accctgaggcccagagg

SEQ ID NO: 2653672 - DNA, 18 bp, Homo sapiens
accctgcccctgccccgt

SEQ ID NO: 2653673 - DNA, 14 bp, Homo sapiens
accctgccctgtgg

SEQ ID NO: 2653674 - DNA, 15 bp, Homo sapiens
accctgccctgtggg

SEQ ID NO: 2653675 - DNA, 18 bp, Homo sapiens
accctgcgaaggggccct

SEQ ID NO: 2653676 - DNA, 13 bp, Homo sapiens
accctggagccca

SEQ ID NO: 2653677 - DNA, 16 bp, Homo sapiens
accctggatcagtcct

SEQ ID NO: 2653678 - DNA, 20 bp, Homo sapiens
accctgggctctgggagcag

SEQ ID NO: 2653679 - DNA, 17 bp, Homo sapiens
accctggggcctggacc

SEQ ID NO: 2653680 - DNA, 20 bp, Homo sapiens
accctgtactgttctgtgtc

SEQ ID NO: 2653681 - DNA, 19 bp, Homo sapiens
accctgtcccccagctctg

SEQ ID NO: 2653682 - DNA, 20 bp, Homo sapiens
accctgtcccccagctctgg

SEQ ID NO: 2653683 - DNA, 21 bp, Homo sapiens
accctgtcccccagctctggt

SEQ ID NO: 2653684 - DNA, 14 bp, Homo sapiens
accctgtctctact

SEQ ID NO: 2653685 - DNA, 20 bp, Homo sapiens
accctgtgatggggccctgc

SEQ ID NO: 2653686 - DNA, 22 bp, Homo sapiens
accctgtgatggggccctgcct

SEQ ID NO: 2653687 - DNA, 15 bp, Homo sapiens
accctgtgctggtgt

SEQ ID NO: 2653688 - DNA, 19 bp, Homo sapiens
accctgtgctggtgtcctg

SEQ ID NO: 2653689 - DNA, 23 bp, Homo sapiens
accctgtgctggtgtcctgacca

SEQ ID NO: 2653690 - DNA, 22 bp, Homo sapiens
acccttaccatgtgcctgatcc

SEQ ID NO: 2653691 - DNA, 18 bp, Homo sapiens
acccttaccccttagcct

SEQ ID NO: 2653692 - DNA, 19 bp, Homo sapiens
acccttaccccttagcctc

SEQ ID NO: 2653693 - DNA, 19 bp, Homo sapiens
acccttcccttgagccctc

SEQ ID NO: 2653694 - DNA, 15 bp, Homo sapiens
acccttctttcctct

SEQ ID NO: 2653695 - DNA, 11 bp, Homo sapiens
acccttggcct

SEQ ID NO: 2653696 - DNA, 16 bp, Homo sapiens
acccttgtggtcccac

SEQ ID NO: 2653697 - DNA, 23 bp, Homo sapiens
acccttgtggtcccaccccacac

SEQ ID NO: 2653698 - DNA, 20 bp, Homo sapiens
accctttgaattggacaata

SEQ ID NO: 2653699 - DNA, 12 bp, Homo sapiens
acccttttccag

SEQ ID NO: 2653700 - DNA, 12 bp, Homo sapiens
accgaaacagcg

SEQ ID NO: 2653701 - DNA, 23 bp, Homo sapiens
accgagcctctgtcactgcaggc

SEQ ID NO: 2653702 - DNA, 16 bp, Homo sapiens
accgaggcgcgggggc

SEQ ID NO: 2653703 - DNA, 17 bp, Homo sapiens
accgaggcgcgggggcc

SEQ ID NO: 2653704 - DNA, 17 bp, Homo sapiens
accgaggctggagctgg

SEQ ID NO: 2653705 - DNA, 18 bp, Homo sapiens
accgaggctggagctggc

SEQ ID NO: 2653706 - DNA, 14 bp, Homo sapiens
accgagtgaaccta

SEQ ID NO: 2653707 - DNA, 13 bp, Homo sapiens
accgatgctccag

SEQ ID NO: 2653708 - DNA, 15 bp, Homo sapiens
accgatgctccagcc

SEQ ID NO: 2653709 - DNA, 23 bp, Homo sapiens
accgatgctccagccaacccctg

SEQ ID NO: 2653710 - DNA, 20 bp, Homo sapiens
accgcagaagcctccccagc

SEQ ID NO: 2653711 - DNA, 17 bp, Homo sapiens
accgcagacaggaccag

SEQ ID NO: 2653712 - DNA, 12 bp, Homo sapiens
accgcaggaagc

SEQ ID NO: 2653713 - DNA, 13 bp, Homo sapiens
accgcaggaagct

SEQ ID NO: 2653714 - DNA, 19 bp, Homo sapiens
accgcaggaagctgctccg

SEQ ID NO: 2653715 - DNA, 21 bp, Homo sapiens
accgcagtcgtcgcacagtct

SEQ ID NO: 2653716 - DNA, 22 bp, Homo sapiens
accgcagtcgtcgcacagtctc

SEQ ID NO: 2653717 - DNA, 23 bp, Homo sapiens
accgcagtcgtcgcacagtctct

SEQ ID NO: 2653718 - DNA, 17 bp, Homo sapiens
accgccagatggggcct

SEQ ID NO: 2653719 - DNA, 17 bp, Homo sapiens
accgctccccagcccag

SEQ ID NO: 2653720 - DNA, 18 bp, Homo sapiens
accgctccccagcccagg

SEQ ID NO: 2653721 - DNA, 19 bp, Homo sapiens
accgctccccagcccaggg

SEQ ID NO: 2653722 - DNA, 20 bp, Homo sapiens
accgctccccagcccagggt

SEQ ID NO: 2653723 - DNA, 23 bp, Homo sapiens
accggagctttcaaagaaggaat

SEQ ID NO: 2653724 - DNA, 13 bp, Homo sapiens
accggatcctggg

SEQ ID NO: 2653725 - DNA, 14 bp, Homo sapiens
accggatcctgggt

SEQ ID NO: 2653726 - DNA, 15 bp, Homo sapiens
accggctggcctggc

SEQ ID NO: 2653727 - DNA, 21 bp, Homo sapiens
accgggctgggagctctgcag

SEQ ID NO: 2653728 - DNA, 16 bp, Homo sapiens
accgtccgccctgctc

SEQ ID NO: 2653729 - DNA, 17 bp, Homo sapiens
accgtggaccttcctgc

SEQ ID NO: 2653730 - DNA, 15 bp, Homo sapiens
accgtgggcggggcc

SEQ ID NO: 2653731 - DNA, 19 bp, Homo sapiens
accgtgggcggggccttgc

SEQ ID NO: 2653732 - DNA, 20 bp, Homo sapiens
accgtgggcggggccttgcg

SEQ ID NO: 2653733 - DNA, 13 bp, Homo sapiens
accgtttcttccc

SEQ ID NO: 2653734 - DNA, 19 bp, Homo sapiens
acctaaaatttgccctccc

SEQ ID NO: 2653735 - DNA, 18 bp, Homo sapiens
acctacagtgtacagtct

SEQ ID NO: 2653736 - DNA, 13 bp, Homo sapiens
acctacatgtatt

SEQ ID NO: 2653737 - DNA, 16 bp, Homo sapiens
acctacctcaggttgc

SEQ ID NO: 2653738 - DNA, 14 bp, Homo sapiens
acctagaagggcta

SEQ ID NO: 2653739 - DNA, 16 bp, Homo sapiens
acctagcgtcagtatt

SEQ ID NO: 2653740 - DNA, 20 bp, Homo sapiens
acctagggatgttctggccc

SEQ ID NO: 2653741 - DNA, 15 bp, Homo sapiens
acctagtagtcattt

SEQ ID NO: 2653742 - DNA, 13 bp, Homo sapiens
acctagtctaagg

SEQ ID NO: 2653743 - DNA, 18 bp, Homo sapiens
acctataaagtaaagcta

SEQ ID NO: 2653744 - DNA, 22 bp, Homo sapiens
acctatataataaagctactga

SEQ ID NO: 2653745 - DNA, 22 bp, Homo sapiens
acctatggtataatggttgact

SEQ ID NO: 2653746 - DNA, 23 bp, Homo sapiens
acctcaaacttccagtcaggtag

SEQ ID NO: 2653747 - DNA, 22 bp, Homo sapiens
acctcaacccccatttctattt

SEQ ID NO: 2653748 - DNA, 22 bp, Homo sapiens
acctcaactgcctactccaaaa

SEQ ID NO: 2653749 - DNA, 19 bp, Homo sapiens
acctcacccgaggctgccc

SEQ ID NO: 2653750 - DNA, 16 bp, Homo sapiens
acctcacgcacctccc

SEQ ID NO: 2653751 - DNA, 22 bp, Homo sapiens
acctcagacttaccaggaagca

SEQ ID NO: 2653752 - DNA, 15 bp, Homo sapiens
acctcagcctagacc

SEQ ID NO: 2653753 - DNA, 12 bp, Homo sapiens
acctcagcctcc

SEQ ID NO: 2653754 - DNA, 11 bp, Homo sapiens
acctcagcctg

SEQ ID NO: 2653755 - DNA, 16 bp, Homo sapiens
acctcagcctgtgctg

SEQ ID NO: 2653756 - DNA, 20 bp, Homo sapiens
acctcagccttccccttgcc

SEQ ID NO: 2653757 - DNA, 14 bp, Homo sapiens
acctcagctctggg

SEQ ID NO: 2653758 - DNA, 17 bp, Homo sapiens
acctcagctctgggaga

SEQ ID NO: 2653759 - DNA, 13 bp, Homo sapiens
acctcaggccagg

SEQ ID NO: 2653760 - DNA, 20 bp, Homo sapiens
acctcaggtgatccacccac

SEQ ID NO: 2653761 - DNA, 16 bp, Homo sapiens
acctcagttcccttgg

SEQ ID NO: 2653762 - DNA, 22 bp, Homo sapiens
acctcagttcccttggcctcag

SEQ ID NO: 2653763 - DNA, 23 bp, Homo sapiens
acctcagttcccttggcctcaga

SEQ ID NO: 2653764 - DNA, 21 bp, Homo sapiens
acctcatgcatctccacctgc

SEQ ID NO: 2653765 - DNA, 21 bp, Homo sapiens
acctccagaaacggccattca

SEQ ID NO: 2653766 - DNA, 13 bp, Homo sapiens
acctcccagccct

SEQ ID NO: 2653767 - DNA, 22 bp, Homo sapiens
acctcccagccctatggatgtg

SEQ ID NO: 2653768 - DNA, 22 bp, Homo sapiens
acctcccctccttgcctcctgt

SEQ ID NO: 2653769 - DNA, 10 bp, Homo sapiens
acctccctcc

SEQ ID NO: 2653770 - DNA, 15 bp, Homo sapiens
acctccctgaaccat

SEQ ID NO: 2653771 - DNA, 17 bp, Homo sapiens
acctccctgacccgtct

SEQ ID NO: 2653772 - DNA, 16 bp, Homo sapiens
acctccgcctcccggg

SEQ ID NO: 2653773 - DNA, 14 bp, Homo sapiens
actgtataaatagg

SEQ ID NO: 2653774 - DNA, 20 bp, Homo sapiens
actgtataaataggagagga

SEQ ID NO: 2653775 - DNA, 21 bp, Homo sapiens
actgtataaataggagaggat

SEQ ID NO: 2653776 - DNA, 23 bp, Homo sapiens
actgtataaataggagaggatga

SEQ ID NO: 2653777 - DNA, 13 bp, Homo sapiens
actgtatataaag

SEQ ID NO: 2653778 - DNA, 20 bp, Homo sapiens
actgtatcatgacaaagact

SEQ ID NO: 2653779 - DNA, 13 bp, Homo sapiens
actgtattaagag

SEQ ID NO: 2653780 - DNA, 21 bp, Homo sapiens
actgtattaagagtgaaaatt

SEQ ID NO: 2653781 - DNA, 17 bp, Homo sapiens
actgtatttgtgactaa

SEQ ID NO: 2653782 - DNA, 22 bp, Homo sapiens
actgtatttgtgactaattgta

SEQ ID NO: 2653783 - DNA, 15 bp, Homo sapiens
actgtcaaaataatt

SEQ ID NO: 2653784 - DNA, 17 bp, Homo sapiens
actgtcaccctccacct

SEQ ID NO: 2653785 - DNA, 23 bp, Homo sapiens
actgtcagctcccctcggagaag

SEQ ID NO: 2653786 - DNA, 14 bp, Homo sapiens
actgtccctcaaat

SEQ ID NO: 2653787 - DNA, 17 bp, Homo sapiens
actgtcctacccaccct

SEQ ID NO: 2653788 - DNA, 18 bp, Homo sapiens
actgtcctacccaccctc

SEQ ID NO: 2653789 - DNA, 23 bp, Homo sapiens
actgtcctacccaccctcctttc

SEQ ID NO: 2653790 - DNA, 23 bp, Homo sapiens
actgtcctgggcgccctggaagc

SEQ ID NO: 2653791 - DNA, 12 bp, Homo sapiens
actgtctcactg

SEQ ID NO: 2653792 - DNA, 21 bp, Homo sapiens
actgtctcgatgcaatgaaca

SEQ ID NO: 2653793 - DNA, 15 bp, Homo sapiens
actgtctctcctgat

SEQ ID NO: 2653794 - DNA, 16 bp, Homo sapiens
actgtgaagagaacca

SEQ ID NO: 2653795 - DNA, 14 bp, Homo sapiens
actgtgacaggcag

SEQ ID NO: 2653796 - DNA, 20 bp, Homo sapiens
actgtgatgccacacagagt

SEQ ID NO: 2653797 - DNA, 19 bp, Homo sapiens
actgtgcacatctgtgtct

SEQ ID NO: 2653798 - DNA, 21 bp, Homo sapiens
actgtgcagagtctagaagtt

SEQ ID NO: 2653799 - DNA, 18 bp, Homo sapiens
actgtgccatgtgccagg

SEQ ID NO: 2653800 - DNA, 12 bp, Homo sapiens
actgtgctaata

SEQ ID NO: 2653801 - DNA, 18 bp, Homo sapiens
actgtgctggagccacta

SEQ ID NO: 2653802 - DNA, 15 bp, Homo sapiens
actgtggaaaaatat

SEQ ID NO: 2653803 - DNA, 16 bp, Homo sapiens
actgtggaggaaggat

SEQ ID NO: 2653804 - DNA, 18 bp, Homo sapiens
actgtggaggaaggattg

SEQ ID NO: 2653805 - DNA, 15 bp, Homo sapiens
actgtggcacacgcc

SEQ ID NO: 2653806 - DNA, 12 bp, Homo sapiens
actgtgtataga

SEQ ID NO: 2653807 - DNA, 10 bp, Homo sapiens
actgtgtgtg

SEQ ID NO: 2653808 - DNA, 14 bp, Homo sapiens
actgtgttcattag

SEQ ID NO: 2653809 - DNA, 21 bp, Homo sapiens
actgttaatagttcaggtaac

SEQ ID NO: 2653810 - DNA, 20 bp, Homo sapiens
actgttagaaaatggacact

SEQ ID NO: 2653811 - DNA, 19 bp, Homo sapiens
actgttatgaaataaagaa

SEQ ID NO: 2653812 - DNA, 23 bp, Homo sapiens
actgttatgaaataaagaaattg

SEQ ID NO: 2653813 - DNA, 17 bp, Homo sapiens
actgttatttataatca

SEQ ID NO: 2653814 - DNA, 21 bp, Homo sapiens
actgttatttataatcacttt

SEQ ID NO: 2653815 - DNA, 15 bp, Homo sapiens
actgttccccctgtg

SEQ ID NO: 2653816 - DNA, 18 bp, Homo sapiens
actgttccctctgctcct

SEQ ID NO: 2653817 - DNA, 22 bp, Homo sapiens
actgttccctctgctcctggag

SEQ ID NO: 2653818 - DNA, 14 bp, Homo sapiens
actgttctctgccc

SEQ ID NO: 2653819 - DNA, 15 bp, Homo sapiens
actgttctctgccct

SEQ ID NO: 2653820 - DNA, 18 bp, Homo sapiens
actgttctctgccctcca

SEQ ID NO: 2653821 - DNA, 18 bp, Homo sapiens
actgttctcttcttgaac

SEQ ID NO: 2653822 - DNA, 15 bp, Homo sapiens
actgttctgtgtctt

SEQ ID NO: 2653823 - DNA, 23 bp, Homo sapiens
actgttgaaaattattttaaaca

SEQ ID NO: 2653824 - DNA, 17 bp, Homo sapiens
actgttgcccaggctgg

SEQ ID NO: 2653825 - DNA, 21 bp, Homo sapiens
actgttgctcaaatctattca

SEQ ID NO: 2653826 - DNA, 13 bp, Homo sapiens
actgttgtataaa

SEQ ID NO: 2653827 - DNA, 15 bp, Homo sapiens
actgttgtataaatt

SEQ ID NO: 2653828 - DNA, 13 bp, Homo sapiens
actgtttcaaact

SEQ ID NO: 2653829 - DNA, 19 bp, Homo sapiens
actgtttcaaactttacta

SEQ ID NO: 2653830 - DNA, 13 bp, Homo sapiens
actgtttctctgc

SEQ ID NO: 2653831 - DNA, 18 bp, Homo sapiens
actgtttgaggtttttaa

SEQ ID NO: 2653832 - DNA, 14 bp, Homo sapiens
actgtttttaccca

SEQ ID NO: 2653833 - DNA, 15 bp, Homo sapiens
actgtttttacccat

SEQ ID NO: 2653834 - DNA, 17 bp, Homo sapiens
acttaaaaaaatgacag

SEQ ID NO: 2653835 - DNA, 14 bp, Homo sapiens
acttaaaaaatgtc

SEQ ID NO: 2653836 - DNA, 13 bp, Homo sapiens
acttaaaaatggt

SEQ ID NO: 2653837 - DNA, 22 bp, Homo sapiens
acttaaaaatggtttaaatggt

SEQ ID NO: 2653838 - DNA, 14 bp, Homo sapiens
acttaaaaatgtaa

SEQ ID NO: 2653839 - DNA, 17 bp, Homo sapiens
acttaaaaatgtaaata

SEQ ID NO: 2653840 - DNA, 20 bp, Homo sapiens
acttaaaatattcctgcatt

SEQ ID NO: 2653841 - DNA, 13 bp, Homo sapiens
acttaaaatattt

SEQ ID NO: 2653842 - DNA, 15 bp, Homo sapiens
acttaaagatttatc

SEQ ID NO: 2653843 - DNA, 16 bp, Homo sapiens
acttaaataatgtgaa

SEQ ID NO: 2653844 - DNA, 18 bp, Homo sapiens
acttaaataatgtgaaac

SEQ ID NO: 2653845 - DNA, 20 bp, Homo sapiens
acttaaataatgtgaaactg

SEQ ID NO: 2653846 - DNA, 19 bp, Homo sapiens
acttaacggctccaggatt

SEQ ID NO: 2653847 - DNA, 17 bp, Homo sapiens
acttaataatgtgtaca

SEQ ID NO: 2653848 - DNA, 15 bp, Homo sapiens
acttaatctaaatgg

SEQ ID NO: 2653849 - DNA, 17 bp, Homo sapiens
acttaatctaaatggaa

SEQ ID NO: 2653850 - DNA, 19 bp, Homo sapiens
acttaatctaaatggaacc

SEQ ID NO: 2653851 - DNA, 13 bp, Homo sapiens
acttaatgaatga

SEQ ID NO: 2653852 - DNA, 14 bp, Homo sapiens
acttaattgctaca
